United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 225

SEQ ID NO: 9316923 - DNA, 22 bp, Homo sapiens
ctgtggagtttgtggcgctgac

SEQ ID NO: 9316924 - DNA, 22 bp, Homo sapiens
ctggttcccagcaggagtgtag

SEQ ID NO: 9316925 - DNA, 22 bp, Homo sapiens
ctggttccaggatggatctttc

SEQ ID NO: 9316926 - DNA, 22 bp, Homo sapiens
ctggttccagaattgcctgtgg

SEQ ID NO: 9316927 - DNA, 22 bp, Homo sapiens
ctgtccccacccaaatctcatc

SEQ ID NO: 9316928 - DNA, 21 bp, Homo sapiens
ctgtccccagtgagcaccccc

SEQ ID NO: 9316929 - DNA, 22 bp, Homo sapiens
ctgtccccattgtttgagggtt

SEQ ID NO: 9316930 - DNA, 18 bp, Homo sapiens
ctgtcccatcctcaggtt

SEQ ID NO: 9316931 - DNA, 22 bp, Homo sapiens
ctgtcccctgtgctttcacttg

SEQ ID NO: 9316932 - DNA, 22 bp, Homo sapiens
ctgtccccgcgagtccagagct

SEQ ID NO: 9316933 - DNA, 22 bp, Homo sapiens
ctgtcccctgtgctttcacttg

SEQ ID NO: 9316934 - DNA, 20 bp, Homo sapiens
ctgtccccgaggtcaccagg

SEQ ID NO: 9316935 - DNA, 22 bp, Homo sapiens
ctgtgaggcggaaaggactctc

SEQ ID NO: 9316936 - DNA, 22 bp, Homo sapiens
ctgtgaggcctttggccagata

SEQ ID NO: 9316937 - DNA, 22 bp, Homo sapiens
ctgtgagggcagggaccagagg

SEQ ID NO: 9316938 - DNA, 22 bp, Homo sapiens
ctgtgacccagttcctggcacc

SEQ ID NO: 9316939 - DNA, 22 bp, Homo sapiens
ctgtgagatttttaaataactt

SEQ ID NO: 9316940 - DNA, 22 bp, Homo sapiens
ctgtccctctcacacctcacca

SEQ ID NO: 9316941 - DNA, 21 bp, Homo sapiens
ctgtccctctttgcttccctc

SEQ ID NO: 9316942 - DNA, 22 bp, Homo sapiens
ctgtccctcagttctgggcaaa

SEQ ID NO: 9316943 - DNA, 22 bp, Homo sapiens
gaggccagaagtctgagatcag

SEQ ID NO: 9316944 - DNA, 22 bp, Homo sapiens
gaggcctggaccagccacagag

SEQ ID NO: 9316945 - DNA, 22 bp, Homo sapiens
gaggcctggaattccagcctgg

SEQ ID NO: 9316946 - DNA, 22 bp, Homo sapiens
gaggccagaatgagtctctggg

SEQ ID NO: 9316947 - DNA, 22 bp, Homo sapiens
gaggatggtatgaggcaagcaa

SEQ ID NO: 9316948 - DNA, 22 bp, Homo sapiens
gaggatggtatgaggcaagcaa

SEQ ID NO: 9316949 - DNA, 22 bp, Homo sapiens
gaggatggtgagcaggacccag

SEQ ID NO: 9316950 - DNA, 22 bp, Homo sapiens
gaggatggaggtgtgagctatg

SEQ ID NO: 9316951 - DNA, 22 bp, Homo sapiens
gaggcatgcagagctggagcag

SEQ ID NO: 9316952 - DNA, 22 bp, Homo sapiens
gaggcatggcctgaggctagga

SEQ ID NO: 9316953 - DNA, 22 bp, Homo sapiens
gaggcatggcctgaggctagga

SEQ ID NO: 9316954 - DNA, 22 bp, Homo sapiens
gaggccacggaagggagctgtg

SEQ ID NO: 9316955 - DNA, 21 bp, Homo sapiens
gaggccactaataggggcaga

SEQ ID NO: 9316956 - DNA, 18 bp, Homo sapiens
gaggatggaaggagatgc

SEQ ID NO: 9316957 - DNA, 18 bp, Homo sapiens
gaggatggaaggagatgc

SEQ ID NO: 9316958 - DNA, 18 bp, Homo sapiens
gaggatggaaggagatgc

SEQ ID NO: 9316959 - DNA, 22 bp, Homo sapiens
gaggagtggagttgctgggttg

SEQ ID NO: 9316960 - DNA, 22 bp, Homo sapiens
gaggagtgccagccgtggagtc

SEQ ID NO: 9316961 - DNA, 22 bp, Homo sapiens
gaggagagagggactgtctgca

SEQ ID NO: 9316962 - DNA, 22 bp, Homo sapiens
gaggaggtggagtcatgcagag

SEQ ID NO: 9316963 - DNA, 22 bp, Homo sapiens
gaggacgggcttcatggggcct

SEQ ID NO: 9316964 - DNA, 17 bp, Homo sapiens
gaggacagggaagtagg

SEQ ID NO: 9316965 - DNA, 22 bp, Homo sapiens
gaggactgaaacttacaggaaa

SEQ ID NO: 9316966 - DNA, 22 bp, Homo sapiens
gaggagagaacattcctccata

SEQ ID NO: 9316967 - DNA, 22 bp, Homo sapiens
gagctgggatttgaacctggga

SEQ ID NO: 9316968 - DNA, 22 bp, Homo sapiens
gagctcccaggccccagcaagg

SEQ ID NO: 9316969 - DNA, 22 bp, Homo sapiens
gaggacaggagactcactgttt

SEQ ID NO: 9316970 - DNA, 22 bp, Homo sapiens
gagctcagcctgaggcctggct

SEQ ID NO: 9316971 - DNA, 22 bp, Homo sapiens
gagctcaggagcatcagaagaa

SEQ ID NO: 9316972 - DNA, 22 bp, Homo sapiens
gagctcagcccaaagagcagtg

SEQ ID NO: 9316973 - DNA, 22 bp, Homo sapiens
gagctcagattctggtgtcaga

SEQ ID NO: 9316974 - DNA, 22 bp, Homo sapiens
gagctcagattctggtgtcaga

SEQ ID NO: 9316975 - DNA, 22 bp, Homo sapiens
gagctcatccccatggtccgtc

SEQ ID NO: 9316976 - DNA, 22 bp, Homo sapiens
gagctcagtgtagtcatggctt

SEQ ID NO: 9316977 - DNA, 22 bp, Homo sapiens
gagctcagggcattgagcaaga

SEQ ID NO: 9316978 - DNA, 22 bp, Homo sapiens
gagctcagggcattgagcaaga

SEQ ID NO: 9316979 - DNA, 22 bp, Homo sapiens
gagctcattcattcattgcctg

SEQ ID NO: 9316980 - DNA, 22 bp, Homo sapiens
gagctcattgtggatggatggg

SEQ ID NO: 9316981 - DNA, 22 bp, Homo sapiens
gagcaggcattctagtggctga

SEQ ID NO: 9316982 - DNA, 22 bp, Homo sapiens
gagcaggcaactctgcagtgcc

SEQ ID NO: 9316983 - DNA, 22 bp, Homo sapiens
gagcaggacgtgggaatgggaa

SEQ ID NO: 9316984 - DNA, 22 bp, Homo sapiens
gagcaggatgggagctggggcc

SEQ ID NO: 9316985 - DNA, 22 bp, Homo sapiens
gagcaggcaaagatgaaaggag

SEQ ID NO: 9316986 - DNA, 22 bp, Homo sapiens
gagcaggccagcaatggaaggg

SEQ ID NO: 9316987 - DNA, 22 bp, Homo sapiens
gagcaggcctggggtgaggcct

SEQ ID NO: 9316988 - DNA, 22 bp, Homo sapiens
gagctcagactcgggcctgggg

SEQ ID NO: 9316989 - DNA, 22 bp, Homo sapiens
gagctcagaggattctggggag

SEQ ID NO: 9316990 - DNA, 22 bp, Homo sapiens
gaggcctgtagtcatggatgta

SEQ ID NO: 9316991 - DNA, 19 bp, Homo sapiens
gaggcgaggcgtgcaggag

SEQ ID NO: 9316992 - DNA, 22 bp, Homo sapiens
gaggcgagaagctggagatggt

SEQ ID NO: 9316993 - DNA, 22 bp, Homo sapiens
gaggcctggtgctgtgtccaca

SEQ ID NO: 9316994 - DNA, 22 bp, Homo sapiens
gaggcctggtctatgagatgtt

SEQ ID NO: 9316995 - DNA, 22 bp, Homo sapiens
gaggcctggtctatgagatgtt

SEQ ID NO: 9316996 - DNA, 22 bp, Homo sapiens
gaggcctggtttgcatgagaat

SEQ ID NO: 9316997 - DNA, 22 bp, Homo sapiens
gaggcctggtttccagcatcct

SEQ ID NO: 9316998 - DNA, 22 bp, Homo sapiens
gaggctagagcaggggctcaat

SEQ ID NO: 9316999 - DNA, 22 bp, Homo sapiens
gaggctagatgtttgctgggag

SEQ ID NO: 9317000 - DNA, 22 bp, Homo sapiens
gaggctagatgtttgctgggag

SEQ ID NO: 9317001 - DNA, 22 bp, Homo sapiens
gaggcggcggccgagcctggct

SEQ ID NO: 9317002 - DNA, 22 bp, Homo sapiens
gaggctggggtctgcctttctg

SEQ ID NO: 9317003 - DNA, 22 bp, Homo sapiens
gaggctggtaggaaaggaaaca

SEQ ID NO: 9317004 - DNA, 22 bp, Homo sapiens
gaggctggggtctgcctttctg

SEQ ID NO: 9317005 - DNA, 22 bp, Homo sapiens
gaggctggttcccttgatcttt

SEQ ID NO: 9317006 - DNA, 22 bp, Homo sapiens
gaggctggttcccttgatcttt

SEQ ID NO: 9317007 - DNA, 22 bp, Homo sapiens
gaggctggttcccttgatcttt

SEQ ID NO: 9317008 - DNA, 22 bp, Homo sapiens
gaggctggttctgaagtactgt

SEQ ID NO: 9317009 - DNA, 22 bp, Homo sapiens
gaggctggttctgaagtactgt

SEQ ID NO: 9317010 - DNA, 22 bp, Homo sapiens
gaggctggtcagccctaagatc

SEQ ID NO: 9317011 - DNA, 22 bp, Homo sapiens
gaggctggtaggaaaggaaaca

SEQ ID NO: 9317012 - DNA, 22 bp, Homo sapiens
gaggctggtcagccctaagatc

SEQ ID NO: 9317013 - DNA, 22 bp, Homo sapiens
gaggctggtggttagttccatt

SEQ ID NO: 9317014 - DNA, 22 bp, Homo sapiens
gaggctggtggttagttccatt

SEQ ID NO: 9317015 - DNA, 22 bp, Homo sapiens
gagggccagatcccaggaggaa

SEQ ID NO: 9317016 - DNA, 22 bp, Homo sapiens
gagggctgataaatgcgcatgg

SEQ ID NO: 9317017 - DNA, 22 bp, Homo sapiens
gagggctgaagtgttttatgag

SEQ ID NO: 9317018 - DNA, 22 bp, Homo sapiens
gagggaatagttggaactgagt

SEQ ID NO: 9317019 - DNA, 21 bp, Homo sapiens
gaggctgtctgctgctggcct

SEQ ID NO: 9317020 - DNA, 22 bp, Homo sapiens
gaggctgtctgttagcctggga

SEQ ID NO: 9317021 - DNA, 22 bp, Homo sapiens
gaggctgtaagtgtggagccta

SEQ ID NO: 9317022 - DNA, 22 bp, Homo sapiens
gaggctgtctgttagcctggga

SEQ ID NO: 9317023 - DNA, 22 bp, Homo sapiens
gaggctggtttgccttttggca

SEQ ID NO: 9317024 - DNA, 22 bp, Homo sapiens
gaggctggtttgccttttggca

SEQ ID NO: 9317025 - DNA, 22 bp, Homo sapiens
gaggctgtaagtgtggagccta

SEQ ID NO: 9317026 - DNA, 22 bp, Homo sapiens
gagggaagattccccatatggg

SEQ ID NO: 9317027 - DNA, 22 bp, Homo sapiens
gagggaagagggtttgaattca

SEQ ID NO: 9317028 - DNA, 22 bp, Homo sapiens
gagggaagaggcctgacatttt

SEQ ID NO: 9317029 - DNA, 19 bp, Homo sapiens
gaggtgtctttcctgagta

SEQ ID NO: 9317030 - DNA, 22 bp, Homo sapiens
gaggtgagtggatcacgaggtc

SEQ ID NO: 9317031 - DNA, 22 bp, Homo sapiens
gaggtgagtggatcacgaggtc

SEQ ID NO: 9317032 - DNA, 22 bp, Homo sapiens
gaggtggctggctcagagccag

SEQ ID NO: 9317033 - DNA, 22 bp, Homo sapiens
gaggtggctgcttgctgggaaa

SEQ ID NO: 9317034 - DNA, 22 bp, Homo sapiens
gaggtggctggctcagagccag

SEQ ID NO: 9317035 - DNA, 22 bp, Homo sapiens
gaggtggctgggagtagggaat

SEQ ID NO: 9317036 - DNA, 22 bp, Homo sapiens
gaggtggctgtcagcttcactt

SEQ ID NO: 9317037 - DNA, 18 bp, Homo sapiens
gaggtggctgggccatct

SEQ ID NO: 9317038 - DNA, 22 bp, Homo sapiens
gaggtggctccaggagcaatgc

SEQ ID NO: 9317039 - DNA, 22 bp, Homo sapiens
gaggtggctccttcagggaata

SEQ ID NO: 9317040 - DNA, 22 bp, Homo sapiens
gaggtggctccttcagggaata

SEQ ID NO: 9317041 - DNA, 22 bp, Homo sapiens
gagggtgctgtgccaagatgac

SEQ ID NO: 9317042 - DNA, 22 bp, Homo sapiens
gagggtgcagctgggccccacg

SEQ ID NO: 9317043 - DNA, 22 bp, Homo sapiens
gagggctgataacaggaataca

SEQ ID NO: 9317044 - DNA, 22 bp, Homo sapiens
gagggctgatgcttacttattt

SEQ ID NO: 9317045 - DNA, 22 bp, Homo sapiens
gagggtggcctttagagcccat

SEQ ID NO: 9317046 - DNA, 22 bp, Homo sapiens
gagggtggcctttagagcccat

SEQ ID NO: 9317047 - DNA, 22 bp, Homo sapiens
gagggtggctcctccctgggcc

SEQ ID NO: 9317048 - DNA, 22 bp, Homo sapiens
gagggtggtggcttaaggtgct

SEQ ID NO: 9317049 - DNA, 22 bp, Homo sapiens
gaggtctgccttcaggagagtt

SEQ ID NO: 9317050 - DNA, 22 bp, Homo sapiens
gagggtggggaatagactgcta

SEQ ID NO: 9317051 - DNA, 22 bp, Homo sapiens
gagggtggggaatagactgcta

SEQ ID NO: 9317052 - DNA, 22 bp, Homo sapiens
gagggtgggctttgttcctcca

SEQ ID NO: 9317053 - DNA, 22 bp, Homo sapiens
gagagctgtccggctgagcagc

SEQ ID NO: 9317054 - DNA, 22 bp, Homo sapiens
gagagctgtcagcgtagcaccg

SEQ ID NO: 9317055 - DNA, 22 bp, Homo sapiens
gagagctgtcagcgtagcaccg

SEQ ID NO: 9317056 - DNA, 22 bp, Homo sapiens
gagaggagacttatccagattg

SEQ ID NO: 9317057 - DNA, 22 bp, Homo sapiens
gagaggagaagcctgcgcttca

SEQ ID NO: 9317058 - DNA, 18 bp, Homo sapiens
gagaggagccagaatttt

SEQ ID NO: 9317059 - DNA, 22 bp, Homo sapiens
gagaggaggtggctatgacagc

SEQ ID NO: 9317060 - DNA, 22 bp, Homo sapiens
gagaggagtaggctgatggtgc

SEQ ID NO: 9317061 - DNA, 22 bp, Homo sapiens
gagaggagtagacactttggtt

SEQ ID NO: 9317062 - DNA, 22 bp, Homo sapiens
gagaggagtaggctgatggtgc

SEQ ID NO: 9317063 - DNA, 22 bp, Homo sapiens
gagagccctacaaggcgttttg

SEQ ID NO: 9317064 - DNA, 22 bp, Homo sapiens
gagagcaggaggcagcgggacg

SEQ ID NO: 9317065 - DNA, 22 bp, Homo sapiens
gagagcaggaggcagcgggacg

SEQ ID NO: 9317066 - DNA, 22 bp, Homo sapiens
gagagcaggctctcgggggcca

SEQ ID NO: 9317067 - DNA, 22 bp, Homo sapiens
gagagcaggctctcgggggcca

SEQ ID NO: 9317068 - DNA, 22 bp, Homo sapiens
gagagagaaccccgtgcccttc

SEQ ID NO: 9317069 - DNA, 22 bp, Homo sapiens
gagaactttctgtgtttttatc

SEQ ID NO: 9317070 - DNA, 21 bp, Homo sapiens
gagaactgaaccagagcagct

SEQ ID NO: 9317071 - DNA, 19 bp, Homo sapiens
gactccaactttaagcatg

SEQ ID NO: 9317072 - DNA, 19 bp, Homo sapiens
gactccaactttaagcatg

SEQ ID NO: 9317073 - DNA, 22 bp, Homo sapiens
gagaagcaatcgtgacatctcc

SEQ ID NO: 9317074 - DNA, 22 bp, Homo sapiens
gagcaaagcttttagggccttt

SEQ ID NO: 9317075 - DNA, 22 bp, Homo sapiens
gagcaaaggtgcagtttgaaat

SEQ ID NO: 9317076 - DNA, 22 bp, Homo sapiens
gagcacacactttgaaattagg

SEQ ID NO: 9317077 - DNA, 22 bp, Homo sapiens
gagcacacagtgtgcctgtgta

SEQ ID NO: 9317078 - DNA, 22 bp, Homo sapiens
gagcaaggatgggtctatagta

SEQ ID NO: 9317079 - DNA, 20 bp, Homo sapiens
gagcacagtaatgactgcta

SEQ ID NO: 9317080 - DNA, 23 bp, Homo sapiens
gagcagagcgggcgggggtcctg

SEQ ID NO: 9317081 - DNA, 19 bp, Homo sapiens
gagcagcttcctatctggt

SEQ ID NO: 9317082 - DNA, 22 bp, Homo sapiens
gacatcatatcaggaggcatgt

SEQ ID NO: 9317083 - DNA, 17 bp, Homo sapiens
gacatcagtacttacag

SEQ ID NO: 9317084 - DNA, 22 bp, Homo sapiens
gacagcaggtaattagttaaca

SEQ ID NO: 9317085 - DNA, 22 bp, Homo sapiens
gacctgcccactctgaggacat

SEQ ID NO: 9317086 - DNA, 22 bp, Homo sapiens
gaccttccatgccttcttccaa

SEQ ID NO: 9317087 - DNA, 22 bp, Homo sapiens
gaccttccttctttgctccggg

SEQ ID NO: 9317088 - DNA, 22 bp, Homo sapiens
gacctggcctgcacagccctta

SEQ ID NO: 9317089 - DNA, 22 bp, Homo sapiens
gactagtcatttgcattccgtc

SEQ ID NO: 9317090 - DNA, 22 bp, Homo sapiens
gactactcaaactttctctata

SEQ ID NO: 9317091 - DNA, 22 bp, Homo sapiens
gaccttcttgctgtgtcctaac

SEQ ID NO: 9317092 - DNA, 22 bp, Homo sapiens
gacagcagggaaagtccagacc

SEQ ID NO: 9317093 - DNA, 22 bp, Homo sapiens
gacaaatgaatgatgaacacca

SEQ ID NO: 9317094 - DNA, 23 bp, Homo sapiens
gacaaagcacttgaaatgtgtac

SEQ ID NO: 9317095 - DNA, 22 bp, Homo sapiens
gacaaaactgagatcacactgt

SEQ ID NO: 9317096 - DNA, 22 bp, Homo sapiens
gacaaaacacattagtttaaaa

SEQ ID NO: 9317097 - DNA, 22 bp, Homo sapiens
gaatttatctacgttaagtatg

SEQ ID NO: 9317098 - DNA, 22 bp, Homo sapiens
gaagaattgcccatttctgtct

SEQ ID NO: 9317099 - DNA, 22 bp, Homo sapiens
gaagaattgaggatgtttacct

SEQ ID NO: 9317100 - DNA, 22 bp, Homo sapiens
gaattacataataaaatgagag

SEQ ID NO: 9317101 - DNA, 22 bp, Homo sapiens
gaatttaaggaccaagcatttt

SEQ ID NO: 9317102 - DNA, 22 bp, Homo sapiens
gaattacaaagtgagacaagct

SEQ ID NO: 9317103 - DNA, 22 bp, Homo sapiens
gaattacagccagaagaatgaa

SEQ ID NO: 9317104 - DNA, 22 bp, Homo sapiens
gaattacagagttgttaagtca

SEQ ID NO: 9317105 - DNA, 22 bp, Homo sapiens
tcctgcctcttgccttcttcac

SEQ ID NO: 9317106 - DNA, 22 bp, Homo sapiens
tcctgcctcttttcttattcca

SEQ ID NO: 9317107 - DNA, 22 bp, Homo sapiens
tcctgcctgcaatcccagcact

SEQ ID NO: 9317108 - DNA, 22 bp, Homo sapiens
tcctgcctgagcgtggaggagg

SEQ ID NO: 9317109 - DNA, 22 bp, Homo sapiens
tcctgcctagcaggtgacctat

SEQ ID NO: 9317110 - DNA, 22 bp, Homo sapiens
tcctgcctaccttgcggaggtg

SEQ ID NO: 9317111 - DNA, 22 bp, Homo sapiens
tcctgcctcacagttgaagttt

SEQ ID NO: 9317112 - DNA, 22 bp, Homo sapiens
tcctgcctctccatgctaacta

SEQ ID NO: 9317113 - DNA, 22 bp, Homo sapiens
tcctgcctcaggctctggagta

SEQ ID NO: 9317114 - DNA, 22 bp, Homo sapiens
tcctgcagccttgggctggagc

SEQ ID NO: 9317115 - DNA, 22 bp, Homo sapiens
tcctgcagctctgagaagcatc

SEQ ID NO: 9317116 - DNA, 22 bp, Homo sapiens
tcctgcagctctgagaagcatc

SEQ ID NO: 9317117 - DNA, 22 bp, Homo sapiens
tcctgcagccactgcaggcaga

SEQ ID NO: 9317118 - DNA, 22 bp, Homo sapiens
tcctgcagctgaagctcatgtg

SEQ ID NO: 9317119 - DNA, 22 bp, Homo sapiens
tcctgcagctgaagctcatgtg

SEQ ID NO: 9317120 - DNA, 21 bp, Homo sapiens
tcctgcaggaggcctgagagg

SEQ ID NO: 9317121 - DNA, 21 bp, Homo sapiens
tcctgcaggaggcctgagagg

SEQ ID NO: 9317122 - DNA, 22 bp, Homo sapiens
tcctgcaggcctgttcccagta

SEQ ID NO: 9317123 - DNA, 22 bp, Homo sapiens
tcctgcaggccagaggggtgag

SEQ ID NO: 9317124 - DNA, 21 bp, Homo sapiens
tcctgcagggcagcagagtgg

SEQ ID NO: 9317125 - DNA, 19 bp, Homo sapiens
tcctgcaggtggcttgcag

SEQ ID NO: 9317126 - DNA, 21 bp, Homo sapiens
tcctgcagggcagcagagtgg

SEQ ID NO: 9317127 - DNA, 22 bp, Homo sapiens
tcctgcaggccagaggggtgag

SEQ ID NO: 9317128 - DNA, 22 bp, Homo sapiens
tcctgcaggcttgagtcctcag

SEQ ID NO: 9317129 - DNA, 22 bp, Homo sapiens
tcctgcccagagctctccactc

SEQ ID NO: 9317130 - DNA, 22 bp, Homo sapiens
tcctgcagccattagaggtcaa

SEQ ID NO: 9317131 - DNA, 22 bp, Homo sapiens
tcctgcagccaagggtcatcga

SEQ ID NO: 9317132 - DNA, 22 bp, Homo sapiens
tcctgcagagccgccctcaggt

SEQ ID NO: 9317133 - DNA, 22 bp, Homo sapiens
tcctgcagagacagaggcctca

SEQ ID NO: 9317134 - DNA, 23 bp, Homo sapiens
tcctgcagataagctggttgaca

SEQ ID NO: 9317135 - DNA, 21 bp, Homo sapiens
tcctgcagaatgccttcctac

SEQ ID NO: 9317136 - DNA, 22 bp, Homo sapiens
tcctgcagacctcagtcaggtc

SEQ ID NO: 9317137 - DNA, 22 bp, Homo sapiens
tcctgagctacagtagtatgat

SEQ ID NO: 9317138 - DNA, 22 bp, Homo sapiens
tcctgagctcccatgaacaggc

SEQ ID NO: 9317139 - DNA, 22 bp, Homo sapiens
tcctgagctgacacttggggag

SEQ ID NO: 9317140 - DNA, 22 bp, Homo sapiens
tcctgaggaaagttcatgaatg

SEQ ID NO: 9317141 - DNA, 22 bp, Homo sapiens
tcctgagctttacagtaaggac

SEQ ID NO: 9317142 - DNA, 22 bp, Homo sapiens
tcctgaggactaacaggaagga

SEQ ID NO: 9317143 - DNA, 22 bp, Homo sapiens
tcctgaggactaacaggaagga

SEQ ID NO: 9317144 - DNA, 22 bp, Homo sapiens
tcctgaggaccctgtcaggggc

SEQ ID NO: 9317145 - DNA, 22 bp, Homo sapiens
tcctgaggaccctgtcaggggc

SEQ ID NO: 9317146 - DNA, 22 bp, Homo sapiens
tcctgaggaatgtgaagagaac

SEQ ID NO: 9317147 - DNA, 22 bp, Homo sapiens
tcctgaggctaaagtgcagtgg

SEQ ID NO: 9317148 - DNA, 22 bp, Homo sapiens
tcctgaggagaagagtgctagg

SEQ ID NO: 9317149 - DNA, 22 bp, Homo sapiens
tcctgaggcacaatcctagaat

SEQ ID NO: 9317150 - DNA, 22 bp, Homo sapiens
tcctgaggcacaatcctagaat

SEQ ID NO: 9317151 - DNA, 22 bp, Homo sapiens
tcctgaggatggttgaagtgca

SEQ ID NO: 9317152 - DNA, 22 bp, Homo sapiens
tcctgaggccctgttagggtct

SEQ ID NO: 9317153 - DNA, 22 bp, Homo sapiens
tcctgaggcctctgtgatgtga

SEQ ID NO: 9317154 - DNA, 22 bp, Homo sapiens
tcctgagccctggggtcagtgt

SEQ ID NO: 9317155 - DNA, 22 bp, Homo sapiens
tcctgagcacctatgccatggc

SEQ ID NO: 9317156 - DNA, 22 bp, Homo sapiens
tcctgagcaacacagctaagtg

SEQ ID NO: 9317157 - DNA, 22 bp, Homo sapiens
tcctgagcacagagacaaggaa

SEQ ID NO: 9317158 - DNA, 20 bp, Homo sapiens
tcctgagatttaaggggttc

SEQ ID NO: 9317159 - DNA, 22 bp, Homo sapiens
tcctgagagtcaagaatgcagg

SEQ ID NO: 9317160 - DNA, 22 bp, Homo sapiens
tcctgagataggagttgaaggc

SEQ ID NO: 9317161 - DNA, 22 bp, Homo sapiens
tcctcagtaaggatcgtcagct

SEQ ID NO: 9317162 - DNA, 22 bp, Homo sapiens
tcctgagacatctctgctggtc

SEQ ID NO: 9317163 - DNA, 20 bp, Homo sapiens
tcctgagacctgggaaggtt

SEQ ID NO: 9317164 - DNA, 22 bp, Homo sapiens
tcccagcctggaccctgccagt

SEQ ID NO: 9317165 - DNA, 22 bp, Homo sapiens
tcccagcctggaccctgccagt

SEQ ID NO: 9317166 - DNA, 22 bp, Homo sapiens
tcccagccggtgcctgggtccc

SEQ ID NO: 9317167 - DNA, 22 bp, Homo sapiens
tcccagcattaatgcctgtcag

SEQ ID NO: 9317168 - DNA, 22 bp, Homo sapiens
tccattctatgcttacatttat

SEQ ID NO: 9317169 - DNA, 22 bp, Homo sapiens
tccatgggaagattttgagtgg

SEQ ID NO: 9317170 - DNA, 22 bp, Homo sapiens
tccatggggcccaggatgagag

SEQ ID NO: 9317171 - DNA, 23 bp, Homo sapiens
tccaggctgggacttcaactggc

SEQ ID NO: 9317172 - DNA, 22 bp, Homo sapiens
tccaggctttttcatgctgtct

SEQ ID NO: 9317173 - DNA, 23 bp, Homo sapiens
tccaggctgggacttcaactggc

SEQ ID NO: 9317174 - DNA, 22 bp, Homo sapiens
tccagggaagagcagaggctac

SEQ ID NO: 9317175 - DNA, 22 bp, Homo sapiens
tccagggaaggtgtgaggctgg

SEQ ID NO: 9317176 - DNA, 22 bp, Homo sapiens
tccagggctgacttgggagagg

SEQ ID NO: 9317177 - DNA, 22 bp, Homo sapiens
tccagggctgacttgggagagg

SEQ ID NO: 9317178 - DNA, 22 bp, Homo sapiens
tccagggctgggttggctcagc

SEQ ID NO: 9317179 - DNA, 22 bp, Homo sapiens
tccagggctgggttggctcagc

SEQ ID NO: 9317180 - DNA, 22 bp, Homo sapiens
tccagggctgggttggctcagc

SEQ ID NO: 9317181 - DNA, 22 bp, Homo sapiens
tccagggctgttactttacata

SEQ ID NO: 9317182 - DNA, 22 bp, Homo sapiens
tccaggtgagtgcaggtgcaga

SEQ ID NO: 9317183 - DNA, 22 bp, Homo sapiens
tccaggtgacagagacaggata

SEQ ID NO: 9317184 - DNA, 22 bp, Homo sapiens
tccaggtctgtgagctaaatgg

SEQ ID NO: 9317185 - DNA, 21 bp, Homo sapiens
tccagggctttgattctctca

SEQ ID NO: 9317186 - DNA, 22 bp, Homo sapiens
tccaggtcttcctattccaggt

SEQ ID NO: 9317187 - DNA, 22 bp, Homo sapiens
tccagggcttgacagggtgcct

SEQ ID NO: 9317188 - DNA, 18 bp, Homo sapiens
tccagggcttcctcctct

SEQ ID NO: 9317189 - DNA, 22 bp, Homo sapiens
tccagggcttgacagggtgcct

SEQ ID NO: 9317190 - DNA, 22 bp, Homo sapiens
tccagggcttgacagggtgcct

SEQ ID NO: 9317191 - DNA, 18 bp, Homo sapiens
tccagggcttcctcctct

SEQ ID NO: 9317192 - DNA, 22 bp, Homo sapiens
tccagggcttggctgggacggt

SEQ ID NO: 9317193 - DNA, 19 bp, Homo sapiens
tccagggctttatggcttt

SEQ ID NO: 9317194 - DNA, 19 bp, Homo sapiens
tccagggctttatggcttt

SEQ ID NO: 9317195 - DNA, 21 bp, Homo sapiens
tccagggctttgattctctca

SEQ ID NO: 9317196 - DNA, 22 bp, Homo sapiens
tccaggctaattttgcattgtt

SEQ ID NO: 9317197 - DNA, 22 bp, Homo sapiens
tccaggcctttgcacatgttgt

SEQ ID NO: 9317198 - DNA, 20 bp, Homo sapiens
tccaggccttgttctcagat

SEQ ID NO: 9317199 - DNA, 22 bp, Homo sapiens
tccaggcctggctccattcagt

SEQ ID NO: 9317200 - DNA, 22 bp, Homo sapiens
tccaggccttgacaggtcagtt

SEQ ID NO: 9317201 - DNA, 22 bp, Homo sapiens
tccaggcctctagccctctctt

SEQ ID NO: 9317202 - DNA, 22 bp, Homo sapiens
tccaggcctctagcccctatct

SEQ ID NO: 9317203 - DNA, 18 bp, Homo sapiens
tccaggcctgaagtgtcc

SEQ ID NO: 9317204 - DNA, 18 bp, Homo sapiens
tccaggcctgaagtgtcc

SEQ ID NO: 9317205 - DNA, 22 bp, Homo sapiens
tccaggcctgcctggtgtttgc

SEQ ID NO: 9317206 - DNA, 22 bp, Homo sapiens
tccaggcctgcaatgacaaagc

SEQ ID NO: 9317207 - DNA, 22 bp, Homo sapiens
tccaggcctgactataaatgta

SEQ ID NO: 9317208 - DNA, 22 bp, Homo sapiens
tccaggctggctcttcaaaatt

SEQ ID NO: 9317209 - DNA, 22 bp, Homo sapiens
tccaggctggagtgcagtggcg

SEQ ID NO: 9317210 - DNA, 22 bp, Homo sapiens
tccaggctggagtgcagtggca

SEQ ID NO: 9317211 - DNA, 22 bp, Homo sapiens
tccaggctggacatgaggcggg

SEQ ID NO: 9317212 - DNA, 21 bp, Homo sapiens
tccaggctggaaggggcgttg

SEQ ID NO: 9317213 - DNA, 22 bp, Homo sapiens
tccaggctagagtgcagtggcc

SEQ ID NO: 9317214 - DNA, 22 bp, Homo sapiens
tccaggctacttggattcctgg

SEQ ID NO: 9317215 - DNA, 22 bp, Homo sapiens
tccaggctagaagtcacaggcc

SEQ ID NO: 9317216 - DNA, 22 bp, Homo sapiens
tccaggctagaagtcacaggcc

SEQ ID NO: 9317217 - DNA, 22 bp, Homo sapiens
tccctggacaacagacttcact

SEQ ID NO: 9317218 - DNA, 23 bp, Homo sapiens
tccctggaggcaggtccagggcc

SEQ ID NO: 9317219 - DNA, 20 bp, Homo sapiens
tccctggaggtggtggcatc

SEQ ID NO: 9317220 - DNA, 22 bp, Homo sapiens
tccctgggaccggcagctcaca

SEQ ID NO: 9317221 - DNA, 22 bp, Homo sapiens
tccctgggaccggcagctcaca

SEQ ID NO: 9317222 - DNA, 22 bp, Homo sapiens
tcctagcctggtgagaaactgt

SEQ ID NO: 9317223 - DNA, 22 bp, Homo sapiens
tcctaggaagtggaggcacctg

SEQ ID NO: 9317224 - DNA, 22 bp, Homo sapiens
tcctaggcagttggtgctccat

SEQ ID NO: 9317225 - DNA, 22 bp, Homo sapiens
tcctaggcctggcctggtggat

SEQ ID NO: 9317226 - DNA, 22 bp, Homo sapiens
tcctagggtaatcagcatacat

SEQ ID NO: 9317227 - DNA, 22 bp, Homo sapiens
tcctagggtaatcagcatacat

SEQ ID NO: 9317228 - DNA, 22 bp, Homo sapiens
tccctgggagatgatgatgagg

SEQ ID NO: 9317229 - DNA, 22 bp, Homo sapiens
tcctcaggtcaaagcaggagaa

SEQ ID NO: 9317230 - DNA, 19 bp, Homo sapiens
tcctcaggggctcacagac

SEQ ID NO: 9317231 - DNA, 22 bp, Homo sapiens
tcctcagggcggcctccgtctt

SEQ ID NO: 9317232 - DNA, 21 bp, Homo sapiens
tcctcagggccccagagcact

SEQ ID NO: 9317233 - DNA, 22 bp, Homo sapiens
tcctcagggaagatgagcctca

SEQ ID NO: 9317234 - DNA, 22 bp, Homo sapiens
tcctcagcaaacacttcactct

SEQ ID NO: 9317235 - DNA, 22 bp, Homo sapiens
tcctcagagatgggcatctaag

SEQ ID NO: 9317236 - DNA, 22 bp, Homo sapiens
tcctcagagcagccctccgcat

SEQ ID NO: 9317237 - DNA, 22 bp, Homo sapiens
tcctcagagcatagcgctgtct

SEQ ID NO: 9317238 - DNA, 22 bp, Homo sapiens
tcctcagatataaatgagggtg

SEQ ID NO: 9317239 - DNA, 22 bp, Homo sapiens
tcctcagatacctggcagatca

SEQ ID NO: 9317240 - DNA, 22 bp, Homo sapiens
tcctcacaagcatcctgtctca

SEQ ID NO: 9317241 - DNA, 22 bp, Homo sapiens
tcctagttctctgccagtcgct

SEQ ID NO: 9317242 - DNA, 22 bp, Homo sapiens
tcctcacagtcaacactttgag

SEQ ID NO: 9317243 - DNA, 20 bp, Homo sapiens
tcctcagaagacatttgggg

SEQ ID NO: 9317244 - DNA, 22 bp, Homo sapiens
tcctcagaaacccctgtgaggt

SEQ ID NO: 9317245 - DNA, 22 bp, Homo sapiens
tcctcagaatcacctggcagct

SEQ ID NO: 9317246 - DNA, 22 bp, Homo sapiens
tcctcagaatggatggcagggg

SEQ ID NO: 9317247 - DNA, 19 bp, Homo sapiens
tccctcagtctgccaggcc

SEQ ID NO: 9317248 - DNA, 22 bp, Homo sapiens
tccctcagtccctggacaggca

SEQ ID NO: 9317249 - DNA, 22 bp, Homo sapiens
tccctcagcttgtctccatgca

SEQ ID NO: 9317250 - DNA, 20 bp, Homo sapiens
tccctccctccagctctggg

SEQ ID NO: 9317251 - DNA, 22 bp, Homo sapiens
tccctctcttgggcgtggctca

SEQ ID NO: 9317252 - DNA, 22 bp, Homo sapiens
tccctgccctgccttcatggtt

SEQ ID NO: 9317253 - DNA, 22 bp, Homo sapiens
tccctgccctgccttcatggtt

SEQ ID NO: 9317254 - DNA, 22 bp, Homo sapiens
tccctgcctcctggcagtgcca

SEQ ID NO: 9317255 - DNA, 22 bp, Homo sapiens
tccctgagactctggagtgtaa

SEQ ID NO: 9317256 - DNA, 22 bp, Homo sapiens
tcccaggctggggccaggtgac

SEQ ID NO: 9317257 - DNA, 22 bp, Homo sapiens
tcccaggctggggccaggtgac

SEQ ID NO: 9317258 - DNA, 20 bp, Homo sapiens
tcccaggctgggctccagct

SEQ ID NO: 9317259 - DNA, 23 bp, Homo sapiens
tcccagggaaggtgagcgaggct

SEQ ID NO: 9317260 - DNA, 23 bp, Homo sapiens
tcccagggaaggtgagcgaggct

SEQ ID NO: 9317261 - DNA, 20 bp, Homo sapiens
tcccaggctccaccctagac

SEQ ID NO: 9317262 - DNA, 22 bp, Homo sapiens
tcccaggctaggcctctgcgtt

SEQ ID NO: 9317263 - DNA, 20 bp, Homo sapiens
tcccaggctccaccctagac

SEQ ID NO: 9317264 - DNA, 22 bp, Homo sapiens
tccctcagatgagctcctagca

SEQ ID NO: 9317265 - DNA, 21 bp, Homo sapiens
tccctcagacagggtgcctat

SEQ ID NO: 9317266 - DNA, 21 bp, Homo sapiens
tccctcagacagggtgcctat

SEQ ID NO: 9317267 - DNA, 22 bp, Homo sapiens
tccctcagagaccgtggtgcag

SEQ ID NO: 9317268 - DNA, 22 bp, Homo sapiens
tccctcagagggcaagcgcaga

SEQ ID NO: 9317269 - DNA, 22 bp, Homo sapiens
tccctcagcaggaatgtggcag

SEQ ID NO: 9317270 - DNA, 22 bp, Homo sapiens
tcccagggactggatgatgcag

SEQ ID NO: 9317271 - DNA, 22 bp, Homo sapiens
tcccctggtgccacgatctgct

SEQ ID NO: 9317272 - DNA, 22 bp, Homo sapiens
tcagatttagggtgattacctt

SEQ ID NO: 9317273 - DNA, 22 bp, Homo sapiens
tcagatttatgtggctaggctc

SEQ ID NO: 9317274 - DNA, 22 bp, Homo sapiens
tcagattttccagcctttctct

SEQ ID NO: 9317275 - DNA, 22 bp, Homo sapiens
tcagatttgtcctactaggcac

SEQ ID NO: 9317276 - DNA, 22 bp, Homo sapiens
tcagcaggctgtcagcaggggc

SEQ ID NO: 9317277 - DNA, 22 bp, Homo sapiens
tcagcaggctgtcagcaggggc

SEQ ID NO: 9317278 - DNA, 22 bp, Homo sapiens
tcagcaggctctggttgaccat

SEQ ID NO: 9317279 - DNA, 22 bp, Homo sapiens
tcagcaggcagtgggtcacaat

SEQ ID NO: 9317280 - DNA, 22 bp, Homo sapiens
tcagcaggcccatcctccaggc

SEQ ID NO: 9317281 - DNA, 22 bp, Homo sapiens
tcagcaggcggttccttgtggg

SEQ ID NO: 9317282 - DNA, 22 bp, Homo sapiens
tcagcaaatacttattgagcgc

SEQ ID NO: 9317283 - DNA, 22 bp, Homo sapiens
tcagcaggcaggaggcatgcca

SEQ ID NO: 9317284 - DNA, 22 bp, Homo sapiens
tcagcaaacattgattggactt

SEQ ID NO: 9317285 - DNA, 21 bp, Homo sapiens
tcagcaaaataagcaaatgga

SEQ ID NO: 9317286 - DNA, 22 bp, Homo sapiens
tcagatttttgagatgtctgtt

SEQ ID NO: 9317287 - DNA, 20 bp, Homo sapiens
tcagatttttctaactttga

SEQ ID NO: 9317288 - DNA, 22 bp, Homo sapiens
tcagcagggctgtggtgtggct

SEQ ID NO: 9317289 - DNA, 22 bp, Homo sapiens
tcagcagggctgggagctgtga

SEQ ID NO: 9317290 - DNA, 17 bp, Homo sapiens
tcagcaggggccaagct

SEQ ID NO: 9317291 - DNA, 22 bp, Homo sapiens
tcagcaggggccgttgggtgga

SEQ ID NO: 9317292 - DNA, 22 bp, Homo sapiens
tcagcagggagaggagaatgca

SEQ ID NO: 9317293 - DNA, 22 bp, Homo sapiens
tcagcagggaggctctgtgccc

SEQ ID NO: 9317294 - DNA, 22 bp, Homo sapiens
tcagcagggccatgctctctct

SEQ ID NO: 9317295 - DNA, 22 bp, Homo sapiens
tcagcagggcatactgagccta

SEQ ID NO: 9317296 - DNA, 22 bp, Homo sapiens
tcagcagggcctccttgtgcag

SEQ ID NO: 9317297 - DNA, 22 bp, Homo sapiens
tcagctggaagatggtgcagaa

SEQ ID NO: 9317298 - DNA, 22 bp, Homo sapiens
tcagctggcaggttctgggaag

SEQ ID NO: 9317299 - DNA, 22 bp, Homo sapiens
tcagctggcagttcagaggctg

SEQ ID NO: 9317300 - DNA, 22 bp, Homo sapiens
tcagctgggaagttctcgcttg

SEQ ID NO: 9317301 - DNA, 22 bp, Homo sapiens
tcagctggtgccactcagtcaa

SEQ ID NO: 9317302 - DNA, 22 bp, Homo sapiens
tcagctggtgtttcttctcctt

SEQ ID NO: 9317303 - DNA, 22 bp, Homo sapiens
tcagctggtgagtggatagaca

SEQ ID NO: 9317304 - DNA, 18 bp, Homo sapiens
tcagctgggtttctgggt

SEQ ID NO: 9317305 - DNA, 18 bp, Homo sapiens
tcagctggggctgcagcc

SEQ ID NO: 9317306 - DNA, 22 bp, Homo sapiens
tcaggacacttggcacaaggtc

SEQ ID NO: 9317307 - DNA, 22 bp, Homo sapiens
tcaggacagaaggctgccaggg

SEQ ID NO: 9317308 - DNA, 22 bp, Homo sapiens
tcaggacagccagggtgcagac

SEQ ID NO: 9317309 - DNA, 22 bp, Homo sapiens
tcaggacaggttcgggtgggta

SEQ ID NO: 9317310 - DNA, 22 bp, Homo sapiens
tcaggacagagatcagaacttc

SEQ ID NO: 9317311 - DNA, 22 bp, Homo sapiens
tcaggagaacttccttctaccc

SEQ ID NO: 9317312 - DNA, 22 bp, Homo sapiens
tcaggacatttgtcagcaggag

SEQ ID NO: 9317313 - DNA, 17 bp, Homo sapiens
tcagcatacacagagaa

SEQ ID NO: 9317314 - DNA, 22 bp, Homo sapiens
tcagaaacagaaactaagaacc

SEQ ID NO: 9317315 - DNA, 22 bp, Homo sapiens
tcagaacagaagctggctataa

SEQ ID NO: 9317316 - DNA, 22 bp, Homo sapiens
tcagaacaattcctttataaca

SEQ ID NO: 9317317 - DNA, 22 bp, Homo sapiens
tcacattttatatctctggttt

SEQ ID NO: 9317318 - DNA, 22 bp, Homo sapiens
tcacattttatctattttaagt

SEQ ID NO: 9317319 - DNA, 22 bp, Homo sapiens
tcacatttgtgttttattagag

SEQ ID NO: 9317320 - DNA, 22 bp, Homo sapiens
tcacatttggagaaagcctgcc

SEQ ID NO: 9317321 - DNA, 22 bp, Homo sapiens
tcacatttgttcttgaatctaa

SEQ ID NO: 9317322 - DNA, 22 bp, Homo sapiens
tcacatttgttcctctgcactt

SEQ ID NO: 9317323 - DNA, 22 bp, Homo sapiens
tcactgcaacctccacctcccg

SEQ ID NO: 9317324 - DNA, 22 bp, Homo sapiens
tcactgcaacctccacctcctg

SEQ ID NO: 9317325 - DNA, 22 bp, Homo sapiens
tcactgcgcttcagcctgggtg

SEQ ID NO: 9317326 - DNA, 22 bp, Homo sapiens
tcactgctatattggatactga

SEQ ID NO: 9317327 - DNA, 22 bp, Homo sapiens
tcacagtgaggagttacagttt

SEQ ID NO: 9317328 - DNA, 22 bp, Homo sapiens
tcacataaattatacaatttca

SEQ ID NO: 9317329 - DNA, 22 bp, Homo sapiens
tcacagttttagctgttaaata

SEQ ID NO: 9317330 - DNA, 22 bp, Homo sapiens
tcacatttctgattataccaaa

SEQ ID NO: 9317331 - DNA, 22 bp, Homo sapiens
tcacatttctttatgtagtctt

SEQ ID NO: 9317332 - DNA, 22 bp, Homo sapiens
tcacatttctgattataccaaa

SEQ ID NO: 9317333 - DNA, 21 bp, Homo sapiens
tcacatttctcatgggtaaat

SEQ ID NO: 9317334 - DNA, 21 bp, Homo sapiens
tcacatttctcatgggtaaat

SEQ ID NO: 9317335 - DNA, 22 bp, Homo sapiens
tcacatttcgcatcagtccgat

SEQ ID NO: 9317336 - DNA, 22 bp, Homo sapiens
tcacatttcacatgggaggagg

SEQ ID NO: 9317337 - DNA, 23 bp, Homo sapiens
tcacatttaacccctcagacctc

SEQ ID NO: 9317338 - DNA, 22 bp, Homo sapiens
tcacatttaaacaggaggatta

SEQ ID NO: 9317339 - DNA, 22 bp, Homo sapiens
tcaacacaacagagaaatgctg

SEQ ID NO: 9317340 - DNA, 22 bp, Homo sapiens
tcagggcatactcttcaaggtc

SEQ ID NO: 9317341 - DNA, 22 bp, Homo sapiens
tcagggctccggaagtggcctc

SEQ ID NO: 9317342 - DNA, 22 bp, Homo sapiens
tcagggctgactgctactctcc

SEQ ID NO: 9317343 - DNA, 22 bp, Homo sapiens
tcagggctcagcatctggcatt

SEQ ID NO: 9317344 - DNA, 22 bp, Homo sapiens
tcagggctcagtgggataggtc

SEQ ID NO: 9317345 - DNA, 22 bp, Homo sapiens
tcagggctcaccagcctctgcc

SEQ ID NO: 9317346 - DNA, 22 bp, Homo sapiens
tcagggcatctcttaagtggtg

SEQ ID NO: 9317347 - DNA, 23 bp, Homo sapiens
tcagggctcacacgttttctggc

SEQ ID NO: 9317348 - DNA, 22 bp, Homo sapiens
tcagggctgcagaagaggcagg

SEQ ID NO: 9317349 - DNA, 22 bp, Homo sapiens
tcagggctgcagaagaggcagg

SEQ ID NO: 9317350 - DNA, 22 bp, Homo sapiens
tcagtaaaagggtgctttactc

SEQ ID NO: 9317351 - DNA, 22 bp, Homo sapiens
tcagtaaaacctgcttttagtg

SEQ ID NO: 9317352 - DNA, 21 bp, Homo sapiens
tcagtaaaaaaactacctaga

SEQ ID NO: 9317353 - DNA, 22 bp, Homo sapiens
tcagggctgcatacaggagata

SEQ ID NO: 9317354 - DNA, 22 bp, Homo sapiens
tcagggctgcatacaggagata

SEQ ID NO: 9317355 - DNA, 22 bp, Homo sapiens
tcagtaaatgcctttctgtgaa

SEQ ID NO: 9317356 - DNA, 22 bp, Homo sapiens
tcagtaaatgagcaaaaatttc

SEQ ID NO: 9317357 - DNA, 22 bp, Homo sapiens
tcagtaaatgaatgaatatatg

SEQ ID NO: 9317358 - DNA, 22 bp, Homo sapiens
tcagtaaatggttgctgttatt

SEQ ID NO: 9317359 - DNA, 23 bp, Homo sapiens
tcagtaaatggtaaagtctcttc

SEQ ID NO: 9317360 - DNA, 22 bp, Homo sapiens
tcagtaaatgcttgcaggccga

SEQ ID NO: 9317361 - DNA, 21 bp, Homo sapiens
tcagtaaacctaaagattgta

SEQ ID NO: 9317362 - DNA, 22 bp, Homo sapiens
tcagtaaacaggtttaagtcct

SEQ ID NO: 9317363 - DNA, 22 bp, Homo sapiens
tcagtaaaattacagatctaca

SEQ ID NO: 9317364 - DNA, 22 bp, Homo sapiens
tcagtaaaataaaacatgggac

SEQ ID NO: 9317365 - DNA, 22 bp, Homo sapiens
tcagtaaaggctaggttatgct

SEQ ID NO: 9317366 - DNA, 22 bp, Homo sapiens
tcagtaaaggggaggtgatggg

SEQ ID NO: 9317367 - DNA, 22 bp, Homo sapiens
tcagtaaagtctctagagggta

SEQ ID NO: 9317368 - DNA, 22 bp, Homo sapiens
tcagtaaagttctttcttgctg

SEQ ID NO: 9317369 - DNA, 22 bp, Homo sapiens
tcagtaaatctctaattggcat

SEQ ID NO: 9317370 - DNA, 22 bp, Homo sapiens
tcagtaaataactcagatgctc

SEQ ID NO: 9317371 - DNA, 19 bp, Homo sapiens
tcagggcagtccggtcccc

SEQ ID NO: 9317372 - DNA, 21 bp, Homo sapiens
tcagggcagtgggaggttcct

SEQ ID NO: 9317373 - DNA, 22 bp, Homo sapiens
tcagggcaggttaacttgggtg

SEQ ID NO: 9317374 - DNA, 22 bp, Homo sapiens
tcagggcaggttaacttgggtg

SEQ ID NO: 9317375 - DNA, 22 bp, Homo sapiens
tcagggcaggcgagcagctgct

SEQ ID NO: 9317376 - DNA, 22 bp, Homo sapiens
tcagggcaggcgagcagctgct

SEQ ID NO: 9317377 - DNA, 22 bp, Homo sapiens
tcagggcaggacagtgtaggcc

SEQ ID NO: 9317378 - DNA, 22 bp, Homo sapiens
tcaggctttgctctgttgattt

SEQ ID NO: 9317379 - DNA, 22 bp, Homo sapiens
tcaggcttgaggtctgtatgtg

SEQ ID NO: 9317380 - DNA, 22 bp, Homo sapiens
tcaggcttgggaggcccagggc

SEQ ID NO: 9317381 - DNA, 22 bp, Homo sapiens
tcaggcttataggtagtggtta

SEQ ID NO: 9317382 - DNA, 22 bp, Homo sapiens
tcaggcttattacgttattgtc

SEQ ID NO: 9317383 - DNA, 22 bp, Homo sapiens
tcagtgtttaccgtatgttgtt

SEQ ID NO: 9317384 - DNA, 22 bp, Homo sapiens
tcagttaatatgggtaaagcat

SEQ ID NO: 9317385 - DNA, 22 bp, Homo sapiens
tcatctgttatttatgcctgag

SEQ ID NO: 9317386 - DNA, 22 bp, Homo sapiens
tcatctgtgaataatgaactgg

SEQ ID NO: 9317387 - DNA, 22 bp, Homo sapiens
tcatctgtgcaggactcagaag

SEQ ID NO: 9317388 - DNA, 23 bp, Homo sapiens
tcatctgtaagtatctgtggagt

SEQ ID NO: 9317389 - DNA, 22 bp, Homo sapiens
tcatctttaccccttgcttcaa

SEQ ID NO: 9317390 - DNA, 22 bp, Homo sapiens
tcatctttcctcaaaagatcca

SEQ ID NO: 9317391 - DNA, 22 bp, Homo sapiens
tcatctttgtatccctaacaca

SEQ ID NO: 9317392 - DNA, 22 bp, Homo sapiens
tcatgaaaaattttccatgtca

SEQ ID NO: 9317393 - DNA, 22 bp, Homo sapiens
tcatttgtaccattttttaaga

SEQ ID NO: 9317394 - DNA, 21 bp, Homo sapiens
tcatttgtgatctgatttcca

SEQ ID NO: 9317395 - DNA, 22 bp, Homo sapiens
tcatttttttccggtaggaata

SEQ ID NO: 9317396 - DNA, 22 bp, Homo sapiens
tccaaaggcaaaactgtggtgt

SEQ ID NO: 9317397 - DNA, 22 bp, Homo sapiens
tccaaaggaagaggctgtcagt

SEQ ID NO: 9317398 - DNA, 22 bp, Homo sapiens
tccaaaggccctgagttcactt

SEQ ID NO: 9317399 - DNA, 22 bp, Homo sapiens
tccaaagcatctgagtgtgcat

SEQ ID NO: 9317400 - DNA, 18 bp, Homo sapiens
tccaaagccagagaagtt

SEQ ID NO: 9317401 - DNA, 22 bp, Homo sapiens
tccaaacaccctccatgctgca

SEQ ID NO: 9317402 - DNA, 22 bp, Homo sapiens
tccaaggcatagacacagtgcc

SEQ ID NO: 9317403 - DNA, 22 bp, Homo sapiens
tccaagaagctcagcaaacatc

SEQ ID NO: 9317404 - DNA, 22 bp, Homo sapiens
tccaagctactgaaggtttggg

SEQ ID NO: 9317405 - DNA, 22 bp, Homo sapiens
tccaactttctcctccggcttg

SEQ ID NO: 9317406 - DNA, 22 bp, Homo sapiens
tccaagaacccaagcgaatgcc

SEQ ID NO: 9317407 - DNA, 22 bp, Homo sapiens
tccaagaagagcctttctcctc

SEQ ID NO: 9317408 - DNA, 22 bp, Homo sapiens
tccaaggccgcaggctgggcct

SEQ ID NO: 9317409 - DNA, 22 bp, Homo sapiens
tcatttatagaagtgggcagta

SEQ ID NO: 9317410 - DNA, 22 bp, Homo sapiens
tcatttaattggttttgctcgt

SEQ ID NO: 9317411 - DNA, 22 bp, Homo sapiens
tcatttaatagcttttgtcttt

SEQ ID NO: 9317412 - DNA, 19 bp, Homo sapiens
tcatgcagtggggggtgtg

SEQ ID NO: 9317413 - DNA, 22 bp, Homo sapiens
tcatttctgttgtgcatcactg

SEQ ID NO: 9317414 - DNA, 22 bp, Homo sapiens
tcatttggccttctttgcattg

SEQ ID NO: 9317415 - DNA, 22 bp, Homo sapiens
tcatttggaagcctgagagtgt

SEQ ID NO: 9317416 - DNA, 22 bp, Homo sapiens
tcatttgggtcagttttccata

SEQ ID NO: 9317417 - DNA, 21 bp, Homo sapiens
tcatttcagggccttggcttc

SEQ ID NO: 9317418 - DNA, 22 bp, Homo sapiens
tcaaactggcagacttctactt

SEQ ID NO: 9317419 - DNA, 22 bp, Homo sapiens
tattttgtcttctgctcatcac

SEQ ID NO: 9317420 - DNA, 22 bp, Homo sapiens
tcaaagggtaatgtaatagtct

SEQ ID NO: 9317421 - DNA, 22 bp, Homo sapiens
tcaaagggtccttaacatgaga

SEQ ID NO: 9317422 - DNA, 22 bp, Homo sapiens
tcaaagggtagcccagggaaga

SEQ ID NO: 9317423 - DNA, 22 bp, Homo sapiens
tcaaataatgccattcatcatc

SEQ ID NO: 9317424 - DNA, 22 bp, Homo sapiens
tcaaatattggctatttcacat

SEQ ID NO: 9317425 - DNA, 22 bp, Homo sapiens
tattgtgacttttactgagtaa

SEQ ID NO: 9317426 - DNA, 22 bp, Homo sapiens
tattgtgagtataactgcattt

SEQ ID NO: 9317427 - DNA, 22 bp, Homo sapiens
tattgtgagttcagactaaaaa

SEQ ID NO: 9317428 - DNA, 22 bp, Homo sapiens
tattgtgcccctcccaggaaca

SEQ ID NO: 9317429 - DNA, 22 bp, Homo sapiens
tatttaaaatagtgctccagca

SEQ ID NO: 9317430 - DNA, 22 bp, Homo sapiens
tatttaataaaactatggcatg

SEQ ID NO: 9317431 - DNA, 22 bp, Homo sapiens
tatttaaaataagccccagtgg

SEQ ID NO: 9317432 - DNA, 22 bp, Homo sapiens
tattgtatcttctgtttagaag

SEQ ID NO: 9317433 - DNA, 23 bp, Homo sapiens
tattacaattggtcttattaaga

SEQ ID NO: 9317434 - DNA, 21 bp, Homo sapiens
tatttgctgccatctttgagg

SEQ ID NO: 9317435 - DNA, 21 bp, Homo sapiens
tatttgctgccatctttgagg

SEQ ID NO: 9317436 - DNA, 22 bp, Homo sapiens
tatttgctttggtcctccaagc

SEQ ID NO: 9317437 - DNA, 22 bp, Homo sapiens
tatttgatagagataaatgata

SEQ ID NO: 9317438 - DNA, 22 bp, Homo sapiens
tatttgatgaaggtaaagtctt

SEQ ID NO: 9317439 - DNA, 23 bp, Homo sapiens
tatttgctactggtaattctgga

SEQ ID NO: 9317440 - DNA, 22 bp, Homo sapiens
tataaagaaatgatttccagaa

SEQ ID NO: 9317441 - DNA, 18 bp, Homo sapiens
tataaacacacttaggtt

SEQ ID NO: 9317442 - DNA, 22 bp, Homo sapiens
tagttttttcaacaaatggtgc

SEQ ID NO: 9317443 - DNA, 22 bp, Homo sapiens
tataaagctgactcatgaaact

SEQ ID NO: 9317444 - DNA, 22 bp, Homo sapiens
tataaagctgactcatgaaact

SEQ ID NO: 9317445 - DNA, 22 bp, Homo sapiens
tataaagaaggcacagcaagac

SEQ ID NO: 9317446 - DNA, 22 bp, Homo sapiens
tataaagaagtgtaaacaggaa

SEQ ID NO: 9317447 - DNA, 22 bp, Homo sapiens
tataaagagtctatctggtggc

SEQ ID NO: 9317448 - DNA, 22 bp, Homo sapiens
tataaagaatccagaagagaca

SEQ ID NO: 9317449 - DNA, 22 bp, Homo sapiens
tataaagagtctcaaagaagtt

SEQ ID NO: 9317450 - DNA, 22 bp, Homo sapiens
tatcagcatctcctcaaagata

SEQ ID NO: 9317451 - DNA, 22 bp, Homo sapiens
tatgaaaaggtggccaatgtag

SEQ ID NO: 9317452 - DNA, 22 bp, Homo sapiens
tatgaaaatttagctgaagcat

SEQ ID NO: 9317453 - DNA, 22 bp, Homo sapiens
tatgaaagaatctcagagcaca

SEQ ID NO: 9317454 - DNA, 22 bp, Homo sapiens
tatgaatataccacaatttagg

SEQ ID NO: 9317455 - DNA, 22 bp, Homo sapiens
tatgaagtgatgttgaattttg

SEQ ID NO: 9317456 - DNA, 22 bp, Homo sapiens
tatgacaaggtggagtatgagt

SEQ ID NO: 9317457 - DNA, 22 bp, Homo sapiens
tatgaaatttctagttctgctt

SEQ ID NO: 9317458 - DNA, 22 bp, Homo sapiens
tatgaaatttaaacacagatca

SEQ ID NO: 9317459 - DNA, 22 bp, Homo sapiens
tatgaaatgatggggaaaatag

SEQ ID NO: 9317460 - DNA, 22 bp, Homo sapiens
tatgaaatggtagtaggaaggg

SEQ ID NO: 9317461 - DNA, 22 bp, Homo sapiens
tatgaaattgccatttttatgg

SEQ ID NO: 9317462 - DNA, 22 bp, Homo sapiens
tatggttatgtaatcagttgtt

SEQ ID NO: 9317463 - DNA, 22 bp, Homo sapiens
tatgtacatatacacgtgtgtg

SEQ ID NO: 9317464 - DNA, 17 bp, Homo sapiens
tatgcttttcttctcca

SEQ ID NO: 9317465 - DNA, 22 bp, Homo sapiens
tatgctttgaaaatgtgctgaa

SEQ ID NO: 9317466 - DNA, 22 bp, Homo sapiens
tatgctttcattcatatgtgag

SEQ ID NO: 9317467 - DNA, 22 bp, Homo sapiens
tatgtcactcggctcggcccac

SEQ ID NO: 9317468 - DNA, 22 bp, Homo sapiens
tattaataagtgactactagct

SEQ ID NO: 9317469 - DNA, 22 bp, Homo sapiens
tatgtattctcagatttactaa

SEQ ID NO: 9317470 - DNA, 22 bp, Homo sapiens
tatgtattctcagatttactaa

SEQ ID NO: 9317471 - DNA, 22 bp, Homo sapiens
tatgtatatggtagaagtatgt

SEQ ID NO: 9317472 - DNA, 17 bp, Homo sapiens
tatgtagtacttataaa

SEQ ID NO: 9317473 - DNA, 22 bp, Homo sapiens
tatgtatagagtcttttaaatt

SEQ ID NO: 9317474 - DNA, 22 bp, Homo sapiens
taggccaggacagagcttccag

SEQ ID NO: 9317475 - DNA, 22 bp, Homo sapiens
taggccagattgttatccatgg

SEQ ID NO: 9317476 - DNA, 22 bp, Homo sapiens
taggcaggctgaatgtagattt

SEQ ID NO: 9317477 - DNA, 22 bp, Homo sapiens
taggcagattccatattttggc

SEQ ID NO: 9317478 - DNA, 22 bp, Homo sapiens
taggcagatgttaacaggaaaa

SEQ ID NO: 9317479 - DNA, 21 bp, Homo sapiens
taggcagaggagcaggtatct

SEQ ID NO: 9317480 - DNA, 22 bp, Homo sapiens
taggcagaggtatggtaaggac

SEQ ID NO: 9317481 - DNA, 22 bp, Homo sapiens
taggcagagtttaatggttaag

SEQ ID NO: 9317482 - DNA, 23 bp, Homo sapiens
taggcaggactcagatatgacag

SEQ ID NO: 9317483 - DNA, 22 bp, Homo sapiens
taggcagagaggccataagaat

SEQ ID NO: 9317484 - DNA, 20 bp, Homo sapiens
taggcagagctgtgcagcct

SEQ ID NO: 9317485 - DNA, 22 bp, Homo sapiens
taggcagaattcattgtgctgc

SEQ ID NO: 9317486 - DNA, 22 bp, Homo sapiens
taggcagaattgtgggctctaa

SEQ ID NO: 9317487 - DNA, 22 bp, Homo sapiens
taggcagaattgttgaatgaag

SEQ ID NO: 9317488 - DNA, 22 bp, Homo sapiens
tagctgttacccataaaagcca

SEQ ID NO: 9317489 - DNA, 22 bp, Homo sapiens
tagctgttaatatacaaatggt

SEQ ID NO: 9317490 - DNA, 16 bp, Homo sapiens
tagggctgggaaggag

SEQ ID NO: 9317491 - DNA, 22 bp, Homo sapiens
tagggctggcgtgctcagggaa

SEQ ID NO: 9317492 - DNA, 22 bp, Homo sapiens
tagggctgggtacactcttgcc

SEQ ID NO: 9317493 - DNA, 22 bp, Homo sapiens
tagggctgtggtcagtcctcta

SEQ ID NO: 9317494 - DNA, 22 bp, Homo sapiens
tagggctgtgtctccaggacca

SEQ ID NO: 9317495 - DNA, 22 bp, Homo sapiens
tagggctgttagtaattctcag

SEQ ID NO: 9317496 - DNA, 22 bp, Homo sapiens
tagggctgtttaaaagtgaggt

SEQ ID NO: 9317497 - DNA, 19 bp, Homo sapiens
tagggctggccgggcggtg

SEQ ID NO: 9317498 - DNA, 22 bp, Homo sapiens
tagggctgctgcagatgacagg

SEQ ID NO: 9317499 - DNA, 22 bp, Homo sapiens
tagggctgctttgtattctgct

SEQ ID NO: 9317500 - DNA, 22 bp, Homo sapiens
tagggctgaggcaacaagggag

SEQ ID NO: 9317501 - DNA, 22 bp, Homo sapiens
tagggctgcagaacaatggcct

SEQ ID NO: 9317502 - DNA, 22 bp, Homo sapiens
tagggctgcctatggctagata

SEQ ID NO: 9317503 - DNA, 22 bp, Homo sapiens
tagggctgccatttgcttttct

SEQ ID NO: 9317504 - DNA, 22 bp, Homo sapiens
tagggcagagtccaggatgggc

SEQ ID NO: 9317505 - DNA, 18 bp, Homo sapiens
taggccagtatacttttc

SEQ ID NO: 9317506 - DNA, 22 bp, Homo sapiens
taggccatgcagcaaagaggct

SEQ ID NO: 9317507 - DNA, 22 bp, Homo sapiens
taggccattgatttttataagt

SEQ ID NO: 9317508 - DNA, 22 bp, Homo sapiens
taggccattcttggagcttact

SEQ ID NO: 9317509 - DNA, 22 bp, Homo sapiens
tagggcagccacccaggctgct

SEQ ID NO: 9317510 - DNA, 22 bp, Homo sapiens
tagggcagattcggtggagttt

SEQ ID NO: 9317511 - DNA, 23 bp, Homo sapiens
tagggcagctgggagggacatgc

SEQ ID NO: 9317512 - DNA, 22 bp, Homo sapiens
tagggcagctgcatcaggcact

SEQ ID NO: 9317513 - DNA, 22 bp, Homo sapiens
tagggctttgctcatcctaggt

SEQ ID NO: 9317514 - DNA, 22 bp, Homo sapiens
tagggctttgctcatcctaggt

SEQ ID NO: 9317515 - DNA, 22 bp, Homo sapiens
tagggctttgcgatggctattc

SEQ ID NO: 9317516 - DNA, 22 bp, Homo sapiens
taggggaggggatcatgtgctg

SEQ ID NO: 9317517 - DNA, 22 bp, Homo sapiens
tagttacagagaaatgatttga

SEQ ID NO: 9317518 - DNA, 22 bp, Homo sapiens
tagtttaatggtcaactaatga

SEQ ID NO: 9317519 - DNA, 22 bp, Homo sapiens
tagttctgtgtagctcaagagt

SEQ ID NO: 9317520 - DNA, 22 bp, Homo sapiens
tagttctggacacacgttccca

SEQ ID NO: 9317521 - DNA, 22 bp, Homo sapiens
tagttatatccagtctttaaaa

SEQ ID NO: 9317522 - DNA, 22 bp, Homo sapiens
tagttacataaagtggactgtt

SEQ ID NO: 9317523 - DNA, 22 bp, Homo sapiens
tagttttatgaattggtataat

SEQ ID NO: 9317524 - DNA, 22 bp, Homo sapiens
tagtttttaagtgtacaatttc

SEQ ID NO: 9317525 - DNA, 22 bp, Homo sapiens
tagtttatgattttttggaagg

SEQ ID NO: 9317526 - DNA, 22 bp, Homo sapiens
tagtttatagttagcgagcacg

SEQ ID NO: 9317527 - DNA, 22 bp, Homo sapiens
tagtttatgctgctgcagtgag

SEQ ID NO: 9317528 - DNA, 22 bp, Homo sapiens
tagtttcatctccaccctgccc

SEQ ID NO: 9317529 - DNA, 22 bp, Homo sapiens
tagacttttcaaaatctagacc

SEQ ID NO: 9317530 - DNA, 22 bp, Homo sapiens
tagatatgatgagtcacttgag

SEQ ID NO: 9317531 - DNA, 22 bp, Homo sapiens
tagaagcacaggttaaaggcat

SEQ ID NO: 9317532 - DNA, 22 bp, Homo sapiens
tagacctgcagacctgggcccc

SEQ ID NO: 9317533 - DNA, 22 bp, Homo sapiens
tagacctgaaatatggacctgg

SEQ ID NO: 9317534 - DNA, 22 bp, Homo sapiens
tagactggtgaattagggggaa

SEQ ID NO: 9317535 - DNA, 22 bp, Homo sapiens
tacttacataaaaactgaatgt

SEQ ID NO: 9317536 - DNA, 22 bp, Homo sapiens
tacttacattagcaaacaaggt

SEQ ID NO: 9317537 - DNA, 22 bp, Homo sapiens
tagaaatgggttacatttagag

SEQ ID NO: 9317538 - DNA, 22 bp, Homo sapiens
tagaaatggggaagtagttagg

SEQ ID NO: 9317539 - DNA, 22 bp, Homo sapiens
tagctgagagctcacttgagga

SEQ ID NO: 9317540 - DNA, 22 bp, Homo sapiens
tagcagggtccaatgtgaggca

SEQ ID NO: 9317541 - DNA, 19 bp, Homo sapiens
tagcagctgccaaaggaga

SEQ ID NO: 9317542 - DNA, 22 bp, Homo sapiens
tagcaaagaggagacctaggca

SEQ ID NO: 9317543 - DNA, 18 bp, Homo sapiens
tagcaaagatgtggattg

SEQ ID NO: 9317544 - DNA, 22 bp, Homo sapiens
tagcaaagaagatattattgca

SEQ ID NO: 9317545 - DNA, 22 bp, Homo sapiens
tagcaaagagaaaaattatgct

SEQ ID NO: 9317546 - DNA, 22 bp, Homo sapiens
tagcaaagaccaaagctagttg

SEQ ID NO: 9317547 - DNA, 22 bp, Homo sapiens
tagcaaagcccttgctgtgtaa

SEQ ID NO: 9317548 - DNA, 22 bp, Homo sapiens
tagcaaagcccttcaggccctg

SEQ ID NO: 9317549 - DNA, 21 bp, Homo sapiens
tagcaaagccagatgtatatt

SEQ ID NO: 9317550 - DNA, 22 bp, Homo sapiens
tagcaaagcccacgtgccaagc

SEQ ID NO: 9317551 - DNA, 22 bp, Homo sapiens
tagcaaagcgaaagagatttat

SEQ ID NO: 9317552 - DNA, 22 bp, Homo sapiens
tagcaaagaacctgatacccca

SEQ ID NO: 9317553 - DNA, 22 bp, Homo sapiens
tagatcttgttacagatttcct

SEQ ID NO: 9317554 - DNA, 23 bp, Homo sapiens
tagcaaagttgtttgggaaattt

SEQ ID NO: 9317555 - DNA, 22 bp, Homo sapiens
tagcaaagttttgtggtgatta

SEQ ID NO: 9317556 - DNA, 22 bp, Homo sapiens
tagcaaaggtagagttttgaga

SEQ ID NO: 9317557 - DNA, 22 bp, Homo sapiens
tagcaaagggaaagaagggcct

SEQ ID NO: 9317558 - DNA, 22 bp, Homo sapiens
tagcaaaggccttggacacgct

SEQ ID NO: 9317559 - DNA, 22 bp, Homo sapiens
tagcaaagctccgtagttattt

SEQ ID NO: 9317560 - DNA, 22 bp, Homo sapiens
tagcaaaggatgactatgtacc

SEQ ID NO: 9317561 - DNA, 22 bp, Homo sapiens
tagcaaatacatgatgtaattt

SEQ ID NO: 9317562 - DNA, 22 bp, Homo sapiens
tagcaaatgcctggttaattag

SEQ ID NO: 9317563 - DNA, 21 bp, Homo sapiens
tagcaaatggagagtaagaga

SEQ ID NO: 9317564 - DNA, 22 bp, Homo sapiens
tagcaaatgtgttatgctatgc

SEQ ID NO: 9317565 - DNA, 22 bp, Homo sapiens
gtttgttttaagataggatgga

SEQ ID NO: 9317566 - DNA, 22 bp, Homo sapiens
gtttgtgcgggacatgatccgg

SEQ ID NO: 9317567 - DNA, 22 bp, Homo sapiens
gtttgaaagaccaattagattt

SEQ ID NO: 9317568 - DNA, 20 bp, Homo sapiens
gtttgaaatgattggttggt

SEQ ID NO: 9317569 - DNA, 22 bp, Homo sapiens
gtttcttaggtaaattctttga

SEQ ID NO: 9317570 - DNA, 22 bp, Homo sapiens
gtttcttttaaaatatgtagac

SEQ ID NO: 9317571 - DNA, 22 bp, Homo sapiens
gtttcacatgaaacttggggaa

SEQ ID NO: 9317572 - DNA, 22 bp, Homo sapiens
gtttcacaggttggagccagca

SEQ ID NO: 9317573 - DNA, 22 bp, Homo sapiens
gtttatattcaacggagtatct

SEQ ID NO: 9317574 - DNA, 22 bp, Homo sapiens
gtttattagagttttctgtctg

SEQ ID NO: 9317575 - DNA, 22 bp, Homo sapiens
gtttattaactgtcaagtgatt

SEQ ID NO: 9317576 - DNA, 22 bp, Homo sapiens
gtttattatacaacaaaagcta

SEQ ID NO: 9317577 - DNA, 22 bp, Homo sapiens
gtttattatacaacaaaagcta

SEQ ID NO: 9317578 - DNA, 23 bp, Homo sapiens
gttgaagtggtcggggaggcaga

SEQ ID NO: 9317579 - DNA, 22 bp, Homo sapiens
gttctttaacctagtctcattt

SEQ ID NO: 9317580 - DNA, 22 bp, Homo sapiens
gttatataagacaaatcagagt

SEQ ID NO: 9317581 - DNA, 22 bp, Homo sapiens
gttatatatagtatttctctga

SEQ ID NO: 9317582 - DNA, 22 bp, Homo sapiens
gttataaatgactgcaaaagtt

SEQ ID NO: 9317583 - DNA, 22 bp, Homo sapiens
gttatacttatgtgcaaaaata

SEQ ID NO: 9317584 - DNA, 22 bp, Homo sapiens
gttatacgcctgtcaggaagct

SEQ ID NO: 9317585 - DNA, 22 bp, Homo sapiens
gttatgaagtcattcacaaata

SEQ ID NO: 9317586 - DNA, 22 bp, Homo sapiens
gttatgattgaaattccagttt

SEQ ID NO: 9317587 - DNA, 22 bp, Homo sapiens
gttatgatggccctttcctggt

SEQ ID NO: 9317588 - DNA, 22 bp, Homo sapiens
gttatgctgagttgcatgaggt

SEQ ID NO: 9317589 - DNA, 22 bp, Homo sapiens
gttatgctgcctggtgagtcat

SEQ ID NO: 9317590 - DNA, 22 bp, Homo sapiens
gttatgatggcaccactgcact

SEQ ID NO: 9317591 - DNA, 22 bp, Homo sapiens
gttctgctgtgtctcagcaggt

SEQ ID NO: 9317592 - DNA, 22 bp, Homo sapiens
gttctgcttaaattattgatcc

SEQ ID NO: 9317593 - DNA, 22 bp, Homo sapiens
gttctgcttccttgcttgcgca

SEQ ID NO: 9317594 - DNA, 22 bp, Homo sapiens
gttctgctgtaatatctctgct

SEQ ID NO: 9317595 - DNA, 22 bp, Homo sapiens
gtgctggctgccaggaggctgc

SEQ ID NO: 9317596 - DNA, 22 bp, Homo sapiens
gtgctggctgccaggaggctgc

SEQ ID NO: 9317597 - DNA, 22 bp, Homo sapiens
gtgctggctggacatggagcac

SEQ ID NO: 9317598 - DNA, 17 bp, Homo sapiens
gtgctggcctggggctc

SEQ ID NO: 9317599 - DNA, 22 bp, Homo sapiens
gtgctggcctcagagggtcatg

SEQ ID NO: 9317600 - DNA, 21 bp, Homo sapiens
gtgctgggacacagccaggct

SEQ ID NO: 9317601 - DNA, 22 bp, Homo sapiens
gtgttcaaaatgtaggtagatt

SEQ ID NO: 9317602 - DNA, 22 bp, Homo sapiens
gtgtttcctctagaagccatgg

SEQ ID NO: 9317603 - DNA, 22 bp, Homo sapiens
gtgtttattttcatagttggcc

SEQ ID NO: 9317604 - DNA, 22 bp, Homo sapiens
gtgtttatttagagtaggccat

SEQ ID NO: 9317605 - DNA, 22 bp, Homo sapiens
gtgtttatgtttgtgtagggga

SEQ ID NO: 9317606 - DNA, 22 bp, Homo sapiens
gtgtttatgagtgaccttgtct

SEQ ID NO: 9317607 - DNA, 22 bp, Homo sapiens
gtgtttatgtttgtgtagggga

SEQ ID NO: 9317608 - DNA, 22 bp, Homo sapiens
gtgtttataggagtgaatgctg

SEQ ID NO: 9317609 - DNA, 22 bp, Homo sapiens
gtgtttatacagcaaagagcat

SEQ ID NO: 9317610 - DNA, 22 bp, Homo sapiens
gtgtttatacagcaaagagcat

SEQ ID NO: 9317611 - DNA, 22 bp, Homo sapiens
gttataaatacctaataggatt

SEQ ID NO: 9317612 - DNA, 22 bp, Homo sapiens
gttaacaaatgtaaagcaatta

SEQ ID NO: 9317613 - DNA, 22 bp, Homo sapiens
taaagcaaggcaaattgttggt

SEQ ID NO: 9317614 - DNA, 22 bp, Homo sapiens
taaagcaaggcaaattgttggt

SEQ ID NO: 9317615 - DNA, 22 bp, Homo sapiens
taaagcaatgaaagttttgcag

SEQ ID NO: 9317616 - DNA, 22 bp, Homo sapiens
taaagcaatttgagcaagttct

SEQ ID NO: 9317617 - DNA, 22 bp, Homo sapiens
taaagcaatttgagcaagttct

SEQ ID NO: 9317618 - DNA, 22 bp, Homo sapiens
taaagcaattactcagtggctt

SEQ ID NO: 9317619 - DNA, 22 bp, Homo sapiens
taaagcaaggaatagagtagtc

SEQ ID NO: 9317620 - DNA, 23 bp, Homo sapiens
taaagcaaagtcaagtgcactcc

SEQ ID NO: 9317621 - DNA, 22 bp, Homo sapiens
taaagcaagacacacccatagc

SEQ ID NO: 9317622 - DNA, 22 bp, Homo sapiens
taaagacatggtgtaggtgaac

SEQ ID NO: 9317623 - DNA, 22 bp, Homo sapiens
taaagcaaaaatgaactgccat

SEQ ID NO: 9317624 - DNA, 22 bp, Homo sapiens
taaatgcagtacaaattgttct

SEQ ID NO: 9317625 - DNA, 22 bp, Homo sapiens
taaatgcagcagtttctgttct

SEQ ID NO: 9317626 - DNA, 20 bp, Homo sapiens
taaatgcatgaatgtaaggc

SEQ ID NO: 9317627 - DNA, 22 bp, Homo sapiens
taaatgcaagggaaaggcaaga

SEQ ID NO: 9317628 - DNA, 20 bp, Homo sapiens
taaagcagccgtggagggta

SEQ ID NO: 9317629 - DNA, 22 bp, Homo sapiens
taaagcacatatcttacaataa

SEQ ID NO: 9317630 - DNA, 22 bp, Homo sapiens
taaagcaccatttgtttatcca

SEQ ID NO: 9317631 - DNA, 22 bp, Homo sapiens
taaagacatgcaaagtctaatt

SEQ ID NO: 9317632 - DNA, 20 bp, Homo sapiens
taaagacataagctactatc

SEQ ID NO: 9317633 - DNA, 22 bp, Homo sapiens
taaagacataggatcagggaga

SEQ ID NO: 9317634 - DNA, 22 bp, Homo sapiens
taaagacactggttttaatcat

SEQ ID NO: 9317635 - DNA, 22 bp, Homo sapiens
taaagacagatggaccagccat

SEQ ID NO: 9317636 - DNA, 23 bp, Homo sapiens
taaagacagccttcaggattctg

SEQ ID NO: 9317637 - DNA, 22 bp, Homo sapiens
taaatgctatcgcataaaacct

SEQ ID NO: 9317638 - DNA, 18 bp, Homo sapiens
taaatgcatgttaataac

SEQ ID NO: 9317639 - DNA, 22 bp, Homo sapiens
taacagctctgtgtggctgtaa

SEQ ID NO: 9317640 - DNA, 22 bp, Homo sapiens
taacatgagagctaagacatta

SEQ ID NO: 9317641 - DNA, 22 bp, Homo sapiens
tacagaattagattattagaga

SEQ ID NO: 9317642 - DNA, 20 bp, Homo sapiens
tacagaatgcaataaaatgg

SEQ ID NO: 9317643 - DNA, 22 bp, Homo sapiens
tacacataggtctgaataaaaa

SEQ ID NO: 9317644 - DNA, 22 bp, Homo sapiens
tacacataggagggtaataaaa

SEQ ID NO: 9317645 - DNA, 22 bp, Homo sapiens
tacagaatctatgcttcacagt

SEQ ID NO: 9317646 - DNA, 22 bp, Homo sapiens
tacacagaacctggtgtacagt

SEQ ID NO: 9317647 - DNA, 22 bp, Homo sapiens
tacacagaaattgtgtagggat

SEQ ID NO: 9317648 - DNA, 22 bp, Homo sapiens
tacacataaaatgctcatggta

SEQ ID NO: 9317649 - DNA, 22 bp, Homo sapiens
tacacatacattgcttacaagg

SEQ ID NO: 9317650 - DNA, 22 bp, Homo sapiens
tacacatacaccaatgtggtca

SEQ ID NO: 9317651 - DNA, 21 bp, Homo sapiens
taatttattcagcacagtgtt

SEQ ID NO: 9317652 - DNA, 22 bp, Homo sapiens
taatttatggtatgtgtgtaat

SEQ ID NO: 9317653 - DNA, 22 bp, Homo sapiens
taatttatgatgcaaagaaaag

SEQ ID NO: 9317654 - DNA, 22 bp, Homo sapiens
taatttatttcaactgccaagg

SEQ ID NO: 9317655 - DNA, 22 bp, Homo sapiens
tacaacataacgggcattcagt

SEQ ID NO: 9317656 - DNA, 22 bp, Homo sapiens
tacaacattgtgttgcttcata

SEQ ID NO: 9317657 - DNA, 21 bp, Homo sapiens
tacaagatagaggtaatatat

SEQ ID NO: 9317658 - DNA, 22 bp, Homo sapiens
taaggaggtgcccactctcagg

SEQ ID NO: 9317659 - DNA, 22 bp, Homo sapiens
taaggaaagtgccatgatttct

SEQ ID NO: 9317660 - DNA, 22 bp, Homo sapiens
taaggaaacaacttgtattttt

SEQ ID NO: 9317661 - DNA, 22 bp, Homo sapiens
taaggaaaatggacatcaaaca

SEQ ID NO: 9317662 - DNA, 22 bp, Homo sapiens
taaggaaagtacatgttttgac

SEQ ID NO: 9317663 - DNA, 22 bp, Homo sapiens
taagcattcaatgcttagcact

SEQ ID NO: 9317664 - DNA, 22 bp, Homo sapiens
taagcctgcatgaaccatgaga

SEQ ID NO: 9317665 - DNA, 22 bp, Homo sapiens
taagcctgcatgaaccatgaga

SEQ ID NO: 9317666 - DNA, 22 bp, Homo sapiens
taagcttcaaagaacatattgg

SEQ ID NO: 9317667 - DNA, 22 bp, Homo sapiens
taatcctgtcttgaccatcagg

SEQ ID NO: 9317668 - DNA, 22 bp, Homo sapiens
taattattctagtcacatagca

SEQ ID NO: 9317669 - DNA, 22 bp, Homo sapiens
taattgctatttaatgtggtga

SEQ ID NO: 9317670 - DNA, 22 bp, Homo sapiens
taattgctattggaatgctttg

SEQ ID NO: 9317671 - DNA, 22 bp, Homo sapiens
taattgctcgagaaataacctc

SEQ ID NO: 9317672 - DNA, 22 bp, Homo sapiens
taattgctccaaggagaactaa

SEQ ID NO: 9317673 - DNA, 22 bp, Homo sapiens
taattgctcttggccgtgccag

SEQ ID NO: 9317674 - DNA, 22 bp, Homo sapiens
taattgctgaactactatccct

SEQ ID NO: 9317675 - DNA, 23 bp, Homo sapiens
taattgcttgagttagtaataca

SEQ ID NO: 9317676 - DNA, 22 bp, Homo sapiens
taattgctgtatagattgtcat

SEQ ID NO: 9317677 - DNA, 22 bp, Homo sapiens
taattgctaatcctgccttcta

SEQ ID NO: 9317678 - DNA, 22 bp, Homo sapiens
taattgctaaatgaaggagaag

SEQ ID NO: 9317679 - DNA, 22 bp, Homo sapiens
taatttatatggaattgttgct

SEQ ID NO: 9317680 - DNA, 22 bp, Homo sapiens
taatttacttgcaaataacaat

SEQ ID NO: 9317681 - DNA, 22 bp, Homo sapiens
taatttatagaatttcttggat

SEQ ID NO: 9317682 - DNA, 22 bp, Homo sapiens
tactgtgtgcccagccgagctg

SEQ ID NO: 9317683 - DNA, 22 bp, Homo sapiens
tactctgcaagttgaaggtggc

SEQ ID NO: 9317684 - DNA, 22 bp, Homo sapiens
tactctgccccagccaataatg

SEQ ID NO: 9317685 - DNA, 22 bp, Homo sapiens
tactgttatatatagcagcagt

SEQ ID NO: 9317686 - DNA, 22 bp, Homo sapiens
tactgttttctttacaccatgt

SEQ ID NO: 9317687 - DNA, 22 bp, Homo sapiens
tacttacactgaagcaaagata

SEQ ID NO: 9317688 - DNA, 22 bp, Homo sapiens
tacttacagaaggaagcaattg

SEQ ID NO: 9317689 - DNA, 22 bp, Homo sapiens
tactataaagtcttaatgagtc

SEQ ID NO: 9317690 - DNA, 22 bp, Homo sapiens
tactagtcttctgctattccct

SEQ ID NO: 9317691 - DNA, 22 bp, Homo sapiens
tacagagagtacagcatccaca

SEQ ID NO: 9317692 - DNA, 22 bp, Homo sapiens
tacagagatgtgaaaagctcta

SEQ ID NO: 9317693 - DNA, 22 bp, Homo sapiens
tacagaggaggggattttaata

SEQ ID NO: 9317694 - DNA, 22 bp, Homo sapiens
tacagtatggaaaatgtatagt

SEQ ID NO: 9317695 - DNA, 22 bp, Homo sapiens
tacagaggaggtggttgggagt

SEQ ID NO: 9317696 - DNA, 22 bp, Homo sapiens
tacagaggcacatgcaattttc

SEQ ID NO: 9317697 - DNA, 22 bp, Homo sapiens
tacagaggggacatggaagaca

SEQ ID NO: 9317698 - DNA, 22 bp, Homo sapiens
tacagaggggacatggaagaca

SEQ ID NO: 9317699 - DNA, 20 bp, Homo sapiens
tacagtgtatgtatttaggc

SEQ ID NO: 9317700 - DNA, 22 bp, Homo sapiens
tacagtgtctgcaactgcacac

SEQ ID NO: 9317701 - DNA, 22 bp, Homo sapiens
tacagtgtccctttttcagaca

SEQ ID NO: 9317702 - DNA, 22 bp, Homo sapiens
tacagtgtatgtatttgtaggt

SEQ ID NO: 9317703 - DNA, 19 bp, Homo sapiens
taccaaattgcattatggc

SEQ ID NO: 9317704 - DNA, 22 bp, Homo sapiens
taccaaatgtaatcattctaat

SEQ ID NO: 9317705 - DNA, 22 bp, Homo sapiens
tacagtgtgaataagcaggcat

SEQ ID NO: 9317706 - DNA, 22 bp, Homo sapiens
tacagtgtgacatttctacaaa

SEQ ID NO: 9317707 - DNA, 22 bp, Homo sapiens
tacagtgtctggatatcaaagg

SEQ ID NO: 9317708 - DNA, 22 bp, Homo sapiens
tacagtgtttcccccaggatag

SEQ ID NO: 9317709 - DNA, 23 bp, Homo sapiens
gcttgtctagtgaattcatatct

SEQ ID NO: 9317710 - DNA, 22 bp, Homo sapiens
gcttgtctctcagccccagtca

SEQ ID NO: 9317711 - DNA, 22 bp, Homo sapiens
gctttaatgcaatttcacctca

SEQ ID NO: 9317712 - DNA, 22 bp, Homo sapiens
gctttaatgcaatttcacctca

SEQ ID NO: 9317713 - DNA, 22 bp, Homo sapiens
gctttacaacaaattgaatatg

SEQ ID NO: 9317714 - DNA, 22 bp, Homo sapiens
gctttacataaacatttattat

SEQ ID NO: 9317715 - DNA, 22 bp, Homo sapiens
gctttacacagatgaatatttc

SEQ ID NO: 9317716 - DNA, 22 bp, Homo sapiens
gctttaatgaagtcacgcaaag

SEQ ID NO: 9317717 - DNA, 22 bp, Homo sapiens
gctttaagtctcagtttgttag

SEQ ID NO: 9317718 - DNA, 20 bp, Homo sapiens
gctttaagccaaaatgtgaa

SEQ ID NO: 9317719 - DNA, 21 bp, Homo sapiens
gctgttgcccgccgcctcttc

SEQ ID NO: 9317720 - DNA, 22 bp, Homo sapiens
gctgtgtgttcaataatgtgat

SEQ ID NO: 9317721 - DNA, 22 bp, Homo sapiens
gctgtgtgctgggcatggcact

SEQ ID NO: 9317722 - DNA, 22 bp, Homo sapiens
gctgtgtggctgtgccgtcacg

SEQ ID NO: 9317723 - DNA, 17 bp, Homo sapiens
gctgtttctccagaagt

SEQ ID NO: 9317724 - DNA, 22 bp, Homo sapiens
gctgtttctaagctggttccta

SEQ ID NO: 9317725 - DNA, 22 bp, Homo sapiens
gctgtttccccttcacagtggc

SEQ ID NO: 9317726 - DNA, 22 bp, Homo sapiens
gctgtttctgagtagctaggct

SEQ ID NO: 9317727 - DNA, 22 bp, Homo sapiens
gctgtttcttgaggctactcct

SEQ ID NO: 9317728 - DNA, 22 bp, Homo sapiens
gcttaaagttgtaaattagaga

SEQ ID NO: 9317729 - DNA, 18 bp, Homo sapiens
gctttttagtgcatcttc

SEQ ID NO: 9317730 - DNA, 22 bp, Homo sapiens
gcttttttgggatgcctgcctt

SEQ ID NO: 9317731 - DNA, 22 bp, Homo sapiens
gctttatgcaaacctggtactt

SEQ ID NO: 9317732 - DNA, 22 bp, Homo sapiens
gctttatgcaaacctggtactt

SEQ ID NO: 9317733 - DNA, 22 bp, Homo sapiens
gctttatgctacgatttctagt

SEQ ID NO: 9317734 - DNA, 22 bp, Homo sapiens
gctttatccgcttgacccttac

SEQ ID NO: 9317735 - DNA, 22 bp, Homo sapiens
gctttatccgcttgacccttac

SEQ ID NO: 9317736 - DNA, 19 bp, Homo sapiens
gctggccacgccccagttg

SEQ ID NO: 9317737 - DNA, 22 bp, Homo sapiens
gctggccacattgtgccgtcct

SEQ ID NO: 9317738 - DNA, 22 bp, Homo sapiens
gctggccagccctcttcctcca

SEQ ID NO: 9317739 - DNA, 22 bp, Homo sapiens
gctggccaaagtgtacctggag

SEQ ID NO: 9317740 - DNA, 22 bp, Homo sapiens
gctggccacagatccccaggga

SEQ ID NO: 9317741 - DNA, 23 bp, Homo sapiens
gctgtacaggaaccagtttggag

SEQ ID NO: 9317742 - DNA, 22 bp, Homo sapiens
gctgtacagtttactaggtggg

SEQ ID NO: 9317743 - DNA, 22 bp, Homo sapiens
gctgtacatcacaatttgctgt

SEQ ID NO: 9317744 - DNA, 22 bp, Homo sapiens
gctgtacattctgtgggtttgg

SEQ ID NO: 9317745 - DNA, 22 bp, Homo sapiens
gctgtcacaagcatctggggca

SEQ ID NO: 9317746 - DNA, 22 bp, Homo sapiens
gctgtcacatttggagcactgg

SEQ ID NO: 9317747 - DNA, 22 bp, Homo sapiens
gctgtcacatcaaggcactaaa

SEQ ID NO: 9317748 - DNA, 22 bp, Homo sapiens
gctgtcacacatgggatctcag

SEQ ID NO: 9317749 - DNA, 22 bp, Homo sapiens
gctgtcactctccggccttccc

SEQ ID NO: 9317750 - DNA, 22 bp, Homo sapiens
gctgtcactcaccaggcctgca

SEQ ID NO: 9317751 - DNA, 22 bp, Homo sapiens
gctgtcaccaaagcaggcactg

SEQ ID NO: 9317752 - DNA, 22 bp, Homo sapiens
gctgtcagcgcccaaggagctc

SEQ ID NO: 9317753 - DNA, 22 bp, Homo sapiens
gctgtcagtgaggtgagacatg

SEQ ID NO: 9317754 - DNA, 19 bp, Homo sapiens
gctgtattaaagatacatg

SEQ ID NO: 9317755 - DNA, 22 bp, Homo sapiens
gctgtatttaacaactggctca

SEQ ID NO: 9317756 - DNA, 18 bp, Homo sapiens
gctgtgtgcacctgataa

SEQ ID NO: 9317757 - DNA, 22 bp, Homo sapiens
gctgtgtgccaggggaaggctg

SEQ ID NO: 9317758 - DNA, 22 bp, Homo sapiens
gctgtgtgctaggatatgtttt

SEQ ID NO: 9317759 - DNA, 22 bp, Homo sapiens
gctgtgtgacctgggcaagtct

SEQ ID NO: 9317760 - DNA, 22 bp, Homo sapiens
gctgtgtgactgagagcctggc

SEQ ID NO: 9317761 - DNA, 22 bp, Homo sapiens
gctgtccaggagtgcagagatt

SEQ ID NO: 9317762 - DNA, 17 bp, Homo sapiens
ggagccaggagcccacc

SEQ ID NO: 9317763 - DNA, 23 bp, Homo sapiens
ggagcctggcatatgagacgcat

SEQ ID NO: 9317764 - DNA, 22 bp, Homo sapiens
ggagcctggagtttctgatggg

SEQ ID NO: 9317765 - DNA, 22 bp, Homo sapiens
ggagccagtttagacctcagtt

SEQ ID NO: 9317766 - DNA, 22 bp, Homo sapiens
ggagctggctacagagaactcc

SEQ ID NO: 9317767 - DNA, 22 bp, Homo sapiens
ggagctgcatttagggagcctt

SEQ ID NO: 9317768 - DNA, 21 bp, Homo sapiens
ggagctgcaggagccgaaggc

SEQ ID NO: 9317769 - DNA, 22 bp, Homo sapiens
ggagcctggtatagtgttgcat

SEQ ID NO: 9317770 - DNA, 22 bp, Homo sapiens
ggagcctggcctggctctgtgt

SEQ ID NO: 9317771 - DNA, 22 bp, Homo sapiens
ggagctgggaccctgtcatctg

SEQ ID NO: 9317772 - DNA, 22 bp, Homo sapiens
ggagctgttgcgcatgcgctcg

SEQ ID NO: 9317773 - DNA, 22 bp, Homo sapiens
ggagctgttgattgtttgagga

SEQ ID NO: 9317774 - DNA, 22 bp, Homo sapiens
ggagctgttatggcataagcat

SEQ ID NO: 9317775 - DNA, 22 bp, Homo sapiens
ggaggaggggtgactgaatgct

SEQ ID NO: 9317776 - DNA, 21 bp, Homo sapiens
ggagctggggagctggcccca

SEQ ID NO: 9317777 - DNA, 22 bp, Homo sapiens
ggagctggtcagccttgagcat

SEQ ID NO: 9317778 - DNA, 22 bp, Homo sapiens
ggagctgtgggacgctgtccca

SEQ ID NO: 9317779 - DNA, 22 bp, Homo sapiens
ggagctgttaaatgcagaattt

SEQ ID NO: 9317780 - DNA, 22 bp, Homo sapiens
ggagctgtgcagtgactacaga

SEQ ID NO: 9317781 - DNA, 22 bp, Homo sapiens
ggaaggcagtgaaggggctgat

SEQ ID NO: 9317782 - DNA, 22 bp, Homo sapiens
ggacagagggttgacagagtat

SEQ ID NO: 9317783 - DNA, 22 bp, Homo sapiens
ggacaggagtgaggcgggttcc

SEQ ID NO: 9317784 - DNA, 22 bp, Homo sapiens
ggaaaaatgacacatatctcaa

SEQ ID NO: 9317785 - DNA, 22 bp, Homo sapiens
ggaaggagcatttgccagttta

SEQ ID NO: 9317786 - DNA, 19 bp, Homo sapiens
ggaaggagagaaatgcatg

SEQ ID NO: 9317787 - DNA, 22 bp, Homo sapiens
ggaaggaattccaagactaaag

SEQ ID NO: 9317788 - DNA, 19 bp, Homo sapiens
ggaaggcagaggggctgtg

SEQ ID NO: 9317789 - DNA, 22 bp, Homo sapiens
ggacagggctcttggcactcct

SEQ ID NO: 9317790 - DNA, 22 bp, Homo sapiens
ggagaaaggcatagcagaacct

SEQ ID NO: 9317791 - DNA, 22 bp, Homo sapiens
ggactgggaatcagggagatgc

SEQ ID NO: 9317792 - DNA, 19 bp, Homo sapiens
ggactgttgccaggcctct

SEQ ID NO: 9317793 - DNA, 22 bp, Homo sapiens
gctgagggggaaggaaagctga

SEQ ID NO: 9317794 - DNA, 22 bp, Homo sapiens
gctgaggtttcaggagtggcag

SEQ ID NO: 9317795 - DNA, 22 bp, Homo sapiens
gctgagtggagcagtcagcgct

SEQ ID NO: 9317796 - DNA, 22 bp, Homo sapiens
gctgagtgattgatattttagt

SEQ ID NO: 9317797 - DNA, 17 bp, Homo sapiens
gctgagtgcagggagtc

SEQ ID NO: 9317798 - DNA, 22 bp, Homo sapiens
gctgcagggctctcacaggggg

SEQ ID NO: 9317799 - DNA, 22 bp, Homo sapiens
gctgcctcctgaaagcgctctg

SEQ ID NO: 9317800 - DNA, 22 bp, Homo sapiens
gctgcctcccagagccctgcag

SEQ ID NO: 9317801 - DNA, 22 bp, Homo sapiens
gctgcctccactggctcccagt

SEQ ID NO: 9317802 - DNA, 22 bp, Homo sapiens
gctggaggtggtgagaaaaggt

SEQ ID NO: 9317803 - DNA, 22 bp, Homo sapiens
gctggcaggtccaagatagagc

SEQ ID NO: 9317804 - DNA, 22 bp, Homo sapiens
gctggcagtcccatcagctggg

SEQ ID NO: 9317805 - DNA, 22 bp, Homo sapiens
gctggcagtttcctcaccgagg

SEQ ID NO: 9317806 - DNA, 22 bp, Homo sapiens
gctggaggggtaataggatggg

SEQ ID NO: 9317807 - DNA, 23 bp, Homo sapiens
gctgcctctgttggtcttcagtt

SEQ ID NO: 9317808 - DNA, 22 bp, Homo sapiens
gctgctggaacaaatcacccca

SEQ ID NO: 9317809 - DNA, 22 bp, Homo sapiens
gctctctgccatatgaggatac

SEQ ID NO: 9317810 - DNA, 22 bp, Homo sapiens
gctctctgggtggtgggcaaca

SEQ ID NO: 9317811 - DNA, 22 bp, Homo sapiens
gctctctgggtgtgtctagata

SEQ ID NO: 9317812 - DNA, 22 bp, Homo sapiens
gctctctggttccagtcaggaa

SEQ ID NO: 9317813 - DNA, 22 bp, Homo sapiens
gctctctgttattaagatcttt

SEQ ID NO: 9317814 - DNA, 22 bp, Homo sapiens
gctctgggtagccactgcctgg

SEQ ID NO: 9317815 - DNA, 22 bp, Homo sapiens
gctctgtcaacagctagctgtg

SEQ ID NO: 9317816 - DNA, 22 bp, Homo sapiens
gctctgtccagcgtgcacagaa

SEQ ID NO: 9317817 - DNA, 22 bp, Homo sapiens
gctccccttggtcctcctggga

SEQ ID NO: 9317818 - DNA, 22 bp, Homo sapiens
gctccctcccaccagcctgcag

SEQ ID NO: 9317819 - DNA, 22 bp, Homo sapiens
gctccccattgatctgcaggct

SEQ ID NO: 9317820 - DNA, 20 bp, Homo sapiens
gctccccttctctgggcctc

SEQ ID NO: 9317821 - DNA, 22 bp, Homo sapiens
gctcccagctggagcctcaaca

SEQ ID NO: 9317822 - DNA, 20 bp, Homo sapiens
gctcccagcctgcagtcccc

SEQ ID NO: 9317823 - DNA, 22 bp, Homo sapiens
gctcccaggaagagaagggcca

SEQ ID NO: 9317824 - DNA, 22 bp, Homo sapiens
gctcccaggaagagaagggcca

SEQ ID NO: 9317825 - DNA, 22 bp, Homo sapiens
gctcccagcattgcttcccagg

SEQ ID NO: 9317826 - DNA, 22 bp, Homo sapiens
gctcccagcattgctgctgaat

SEQ ID NO: 9317827 - DNA, 22 bp, Homo sapiens
gctcccagcattgctgctgaat

SEQ ID NO: 9317828 - DNA, 22 bp, Homo sapiens
gctctctcgtgaacaggtggtt

SEQ ID NO: 9317829 - DNA, 22 bp, Homo sapiens
gctctctccctaggcaagtgag

SEQ ID NO: 9317830 - DNA, 22 bp, Homo sapiens
gctctctccctaggcaagtgag

SEQ ID NO: 9317831 - DNA, 22 bp, Homo sapiens
gctctctccctaggcaagtgag

SEQ ID NO: 9317832 - DNA, 22 bp, Homo sapiens
gctctctcttggggattcagca

SEQ ID NO: 9317833 - DNA, 22 bp, Homo sapiens
gctctctcgtgaacaggtggtt

SEQ ID NO: 9317834 - DNA, 22 bp, Homo sapiens
gctctctcttggggattcagca

SEQ ID NO: 9317835 - DNA, 21 bp, Homo sapiens
gctctctgcatggtggctcag

SEQ ID NO: 9317836 - DNA, 22 bp, Homo sapiens
gctctctgcaagtcagcagcct

SEQ ID NO: 9317837 - DNA, 22 bp, Homo sapiens
gctctctgaggtgctggcagag

SEQ ID NO: 9317838 - DNA, 22 bp, Homo sapiens
gctctccaggtctcatgcactg

SEQ ID NO: 9317839 - DNA, 22 bp, Homo sapiens
gctccctctgctcaggcacttg

SEQ ID NO: 9317840 - DNA, 22 bp, Homo sapiens
gctctccaggggctcccaggat

SEQ ID NO: 9317841 - DNA, 21 bp, Homo sapiens
gctctccagggccagcccagg

SEQ ID NO: 9317842 - DNA, 22 bp, Homo sapiens
gctcagtgtgttcaagggctca

SEQ ID NO: 9317843 - DNA, 22 bp, Homo sapiens
gctcccagactgaccagaggtg

SEQ ID NO: 9317844 - DNA, 23 bp, Homo sapiens
gctcatcaggcttagagtcaagg

SEQ ID NO: 9317845 - DNA, 22 bp, Homo sapiens
gctcccagcaattgaggcagcc

SEQ ID NO: 9317846 - DNA, 22 bp, Homo sapiens
gctcagggcctggctgcggact

SEQ ID NO: 9317847 - DNA, 22 bp, Homo sapiens
gctcagggccatggaccagcag

SEQ ID NO: 9317848 - DNA, 22 bp, Homo sapiens
gctcagggagagagggcagccg

SEQ ID NO: 9317849 - DNA, 20 bp, Homo sapiens
gcctggcacccggggctggc

SEQ ID NO: 9317850 - DNA, 22 bp, Homo sapiens
gcctggagtggtcctgctgccc

SEQ ID NO: 9317851 - DNA, 22 bp, Homo sapiens
gcctggcactcactgaagaggc

SEQ ID NO: 9317852 - DNA, 22 bp, Homo sapiens
gcctggcactcaatcatctgct

SEQ ID NO: 9317853 - DNA, 22 bp, Homo sapiens
gcctggcactgggctcctggcc

SEQ ID NO: 9317854 - DNA, 22 bp, Homo sapiens
gctaggcttcaaaatctccctg

SEQ ID NO: 9317855 - DNA, 22 bp, Homo sapiens
gctaggagtaaggagaccttca

SEQ ID NO: 9317856 - DNA, 22 bp, Homo sapiens
gctaggagtgggatggaagtcg

SEQ ID NO: 9317857 - DNA, 22 bp, Homo sapiens
gctagccaagatgggtcacaaa

SEQ ID NO: 9317858 - DNA, 22 bp, Homo sapiens
gctagcctgcagtggctatggt

SEQ ID NO: 9317859 - DNA, 22 bp, Homo sapiens
gctagagaccagaggccttgaa

SEQ ID NO: 9317860 - DNA, 22 bp, Homo sapiens
gcaggtgaatgatggactagga

SEQ ID NO: 9317861 - DNA, 19 bp, Homo sapiens
gcaggtgagccgtggctcc

SEQ ID NO: 9317862 - DNA, 22 bp, Homo sapiens
gcaggtgagggtgtctgaatag

SEQ ID NO: 9317863 - DNA, 22 bp, Homo sapiens
gcaggtgatgtgatgtgagcat

SEQ ID NO: 9317864 - DNA, 22 bp, Homo sapiens
gcaggtgatgtgatgtgagcat

SEQ ID NO: 9317865 - DNA, 22 bp, Homo sapiens
gcaggtgaaagtgagtagtgag

SEQ ID NO: 9317866 - DNA, 22 bp, Homo sapiens
gcaggtgaatgatggactagga

SEQ ID NO: 9317867 - DNA, 22 bp, Homo sapiens
gcaggtctggcatagagcctgc

SEQ ID NO: 9317868 - DNA, 22 bp, Homo sapiens
gcaggtccagtcaccagagaga

SEQ ID NO: 9317869 - DNA, 22 bp, Homo sapiens
gcaggtcccagaaagttaattc

SEQ ID NO: 9317870 - DNA, 20 bp, Homo sapiens
gcaggtccctggcatgcaga

SEQ ID NO: 9317871 - DNA, 19 bp, Homo sapiens
gcaggtcattaggctaggt

SEQ ID NO: 9317872 - DNA, 22 bp, Homo sapiens
gcagggcatgggccctgtctgc

SEQ ID NO: 9317873 - DNA, 22 bp, Homo sapiens
gcagggcatgggccctgtctgc

SEQ ID NO: 9317874 - DNA, 22 bp, Homo sapiens
gcagggccagggctcaggctgt

SEQ ID NO: 9317875 - DNA, 22 bp, Homo sapiens
gcagggcagggcaagaactggg

SEQ ID NO: 9317876 - DNA, 22 bp, Homo sapiens
gcagggccaggtacaagaagca

SEQ ID NO: 9317877 - DNA, 22 bp, Homo sapiens
gcagggccaggtacaagaagca

SEQ ID NO: 9317878 - DNA, 22 bp, Homo sapiens
gcagggcagcttagtccctgtc

SEQ ID NO: 9317879 - DNA, 22 bp, Homo sapiens
gcagggcagcttagtccctgtc

SEQ ID NO: 9317880 - DNA, 22 bp, Homo sapiens
gcagggcagctgaagctaggtg

SEQ ID NO: 9317881 - DNA, 22 bp, Homo sapiens
gcagggcagctgaagctaggtg

SEQ ID NO: 9317882 - DNA, 22 bp, Homo sapiens
gcagggcagctcactgtggttc

SEQ ID NO: 9317883 - DNA, 22 bp, Homo sapiens
gcagggcagccacaggccccct

SEQ ID NO: 9317884 - DNA, 22 bp, Homo sapiens
gcaggccctcctctagcaaggc

SEQ ID NO: 9317885 - DNA, 22 bp, Homo sapiens
gcaggccaggctaggggctgtc

SEQ ID NO: 9317886 - DNA, 22 bp, Homo sapiens
gcaggccacagtggagtctctg

SEQ ID NO: 9317887 - DNA, 22 bp, Homo sapiens
gcaggccagctgtgcagatggg

SEQ ID NO: 9317888 - DNA, 22 bp, Homo sapiens
gcaggcatggtcgctgccaggt

SEQ ID NO: 9317889 - DNA, 22 bp, Homo sapiens
gcaggcatggtcgctgccaggt

SEQ ID NO: 9317890 - DNA, 22 bp, Homo sapiens
gcaggcagttgcagttttctag

SEQ ID NO: 9317891 - DNA, 22 bp, Homo sapiens
gcagcccaagcctgagcatcct

SEQ ID NO: 9317892 - DNA, 22 bp, Homo sapiens
gcagctgggacactgaggccag

SEQ ID NO: 9317893 - DNA, 22 bp, Homo sapiens
gcagctggggaggtcgtgggga

SEQ ID NO: 9317894 - DNA, 22 bp, Homo sapiens
gcagctggggccacacttaggc

SEQ ID NO: 9317895 - DNA, 22 bp, Homo sapiens
gcagctgggtctgtgtgggctg

SEQ ID NO: 9317896 - DNA, 21 bp, Homo sapiens
gcagctggtctcagagcttgc

SEQ ID NO: 9317897 - DNA, 22 bp, Homo sapiens
gcagctggtctggcctagagta

SEQ ID NO: 9317898 - DNA, 22 bp, Homo sapiens
gcagctggttaatgggagaatt

SEQ ID NO: 9317899 - DNA, 23 bp, Homo sapiens
gcagctggttagaagggaaggag

SEQ ID NO: 9317900 - DNA, 22 bp, Homo sapiens
gcagccaggaaagctggaccct

SEQ ID NO: 9317901 - DNA, 22 bp, Homo sapiens
gcagcactgatcctaaacttag

SEQ ID NO: 9317902 - DNA, 22 bp, Homo sapiens
gcagcagatgtgggcccagagc

SEQ ID NO: 9317903 - DNA, 22 bp, Homo sapiens
gcacagagtgggtgagatgtgg

SEQ ID NO: 9317904 - DNA, 22 bp, Homo sapiens
gcacagagtcactagctaagca

SEQ ID NO: 9317905 - DNA, 22 bp, Homo sapiens
gcacagagaggctgtgagcgcc

SEQ ID NO: 9317906 - DNA, 22 bp, Homo sapiens
gcacagactttgattgcagtca

SEQ ID NO: 9317907 - DNA, 22 bp, Homo sapiens
gcacagagacagtcctgagatc

SEQ ID NO: 9317908 - DNA, 22 bp, Homo sapiens
gcacagacaccattaaatattt

SEQ ID NO: 9317909 - DNA, 22 bp, Homo sapiens
gcacagactgtatcttaatcat

SEQ ID NO: 9317910 - DNA, 22 bp, Homo sapiens
gcacagacagaatccctactcc

SEQ ID NO: 9317911 - DNA, 22 bp, Homo sapiens
gcacagacccaccatctatagt

SEQ ID NO: 9317912 - DNA, 22 bp, Homo sapiens
gcacagactcaccttaatttga

SEQ ID NO: 9317913 - DNA, 22 bp, Homo sapiens
gcacagacatatccatatttac

SEQ ID NO: 9317914 - DNA, 22 bp, Homo sapiens
gcaatagactgtttttattgtt

SEQ ID NO: 9317915 - DNA, 22 bp, Homo sapiens
gcaatagagcagctaatggaaa

SEQ ID NO: 9317916 - DNA, 18 bp, Homo sapiens
gagtagcattgaggaaac

SEQ ID NO: 9317917 - DNA, 22 bp, Homo sapiens
gagtagcagccacagaggaccc

SEQ ID NO: 9317918 - DNA, 22 bp, Homo sapiens
gagtagcattctagagtatgct

SEQ ID NO: 9317919 - DNA, 22 bp, Homo sapiens
gagtagcagtagtccaagccag

SEQ ID NO: 9317920 - DNA, 22 bp, Homo sapiens
gcaaggagcctggaggtgagtg

SEQ ID NO: 9317921 - DNA, 22 bp, Homo sapiens
gcaaggaggctggtggaggaag

SEQ ID NO: 9317922 - DNA, 22 bp, Homo sapiens
gcaaggagactgtagggccaag

SEQ ID NO: 9317923 - DNA, 17 bp, Homo sapiens
gcaaggaagttctttgc

SEQ ID NO: 9317924 - DNA, 22 bp, Homo sapiens
gcaaggaagcagagttgctatc

SEQ ID NO: 9317925 - DNA, 20 bp, Homo sapiens
gcaaggcacagtgaggaggg

SEQ ID NO: 9317926 - DNA, 22 bp, Homo sapiens
gcaaggcagcgcggagtagcta

SEQ ID NO: 9317927 - DNA, 22 bp, Homo sapiens
gcaataaataacatggaagaca

SEQ ID NO: 9317928 - DNA, 22 bp, Homo sapiens
gcaataaagtagcagctcatca

SEQ ID NO: 9317929 - DNA, 22 bp, Homo sapiens
gcaataaagattttactgtcag

SEQ ID NO: 9317930 - DNA, 22 bp, Homo sapiens
gcaataaacatgtttgatgcgc

SEQ ID NO: 9317931 - DNA, 22 bp, Homo sapiens
gcaataaactctctcaagccac

SEQ ID NO: 9317932 - DNA, 22 bp, Homo sapiens
gcaataaaatgtaatgattggg

SEQ ID NO: 9317933 - DNA, 22 bp, Homo sapiens
gcaccactacactccagcctgg

SEQ ID NO: 9317934 - DNA, 22 bp, Homo sapiens
gcacatttgccactgagctcct

SEQ ID NO: 9317935 - DNA, 22 bp, Homo sapiens
gcacatttgagacatccaggca

SEQ ID NO: 9317936 - DNA, 22 bp, Homo sapiens
gcagagtgagccgaggctgctc

SEQ ID NO: 9317937 - DNA, 22 bp, Homo sapiens
gcagatgttgttgctgggagtt

SEQ ID NO: 9317938 - DNA, 22 bp, Homo sapiens
gcagcaaagctcttcatgtgat

SEQ ID NO: 9317939 - DNA, 22 bp, Homo sapiens
gcagaggtgagtttctcagctg

SEQ ID NO: 9317940 - DNA, 22 bp, Homo sapiens
gcagaggtgctcagtggcagaa

SEQ ID NO: 9317941 - DNA, 22 bp, Homo sapiens
gcagaggtggatgcaattgggg

SEQ ID NO: 9317942 - DNA, 22 bp, Homo sapiens
gcagaggtgctcagtggcagaa

SEQ ID NO: 9317943 - DNA, 22 bp, Homo sapiens
gcagaggtgtagccccctccat

SEQ ID NO: 9317944 - DNA, 22 bp, Homo sapiens
gcagaggtggcatctgggctct

SEQ ID NO: 9317945 - DNA, 22 bp, Homo sapiens
gcagaggtgtgggaggggccac

SEQ ID NO: 9317946 - DNA, 22 bp, Homo sapiens
gcagaggtgtcaccttccagga

SEQ ID NO: 9317947 - DNA, 22 bp, Homo sapiens
gcagaggttggattggtgactt

SEQ ID NO: 9317948 - DNA, 23 bp, Homo sapiens
gcagaggtttttcagtatggttt

SEQ ID NO: 9317949 - DNA, 23 bp, Homo sapiens
gcagaggttatgttttttaggct

SEQ ID NO: 9317950 - DNA, 23 bp, Homo sapiens
gcagagtcaagtagtcatgagtg

SEQ ID NO: 9317951 - DNA, 22 bp, Homo sapiens
gcagagtcaggtccaaggactg

SEQ ID NO: 9317952 - DNA, 18 bp, Homo sapiens
gcctccaccatggagggt

SEQ ID NO: 9317953 - DNA, 22 bp, Homo sapiens
gccctggaatctctccatggga

SEQ ID NO: 9317954 - DNA, 22 bp, Homo sapiens
gccctgctctggtctctgcccg

SEQ ID NO: 9317955 - DNA, 22 bp, Homo sapiens
gccctgctcctccgtcccacga

SEQ ID NO: 9317956 - DNA, 22 bp, Homo sapiens
gccctgctcctccgtcccacga

SEQ ID NO: 9317957 - DNA, 23 bp, Homo sapiens
gccctgctgggacctcctgctac

SEQ ID NO: 9317958 - DNA, 22 bp, Homo sapiens
gccctgctctgttggtcacctg

SEQ ID NO: 9317959 - DNA, 22 bp, Homo sapiens
gccctgctcttttgcccaccca

SEQ ID NO: 9317960 - DNA, 22 bp, Homo sapiens
gccctgctgtcttcagagtata

SEQ ID NO: 9317961 - DNA, 23 bp, Homo sapiens
gccctgctgggacctcctgctac

SEQ ID NO: 9317962 - DNA, 22 bp, Homo sapiens
gccctgctgtttagagagctac

SEQ ID NO: 9317963 - DNA, 22 bp, Homo sapiens
gccccaggggaggtgccctgca

SEQ ID NO: 9317964 - DNA, 20 bp, Homo sapiens
gcccaaggtccagaaggggg

SEQ ID NO: 9317965 - DNA, 22 bp, Homo sapiens
gccccaggtggtaaacctaaga

SEQ ID NO: 9317966 - DNA, 22 bp, Homo sapiens
gcccctccatccatcaccgggg

SEQ ID NO: 9317967 - DNA, 22 bp, Homo sapiens
gcccctcccagtcaggagcact

SEQ ID NO: 9317968 - DNA, 22 bp, Homo sapiens
gcccctgcctttgaacctggag

SEQ ID NO: 9317969 - DNA, 22 bp, Homo sapiens
gcccctccgggcgcgtcatagc

SEQ ID NO: 9317970 - DNA, 22 bp, Homo sapiens
gccccttcttctggagattcaa

SEQ ID NO: 9317971 - DNA, 22 bp, Homo sapiens
gcccgcagagatctttaacaaa

SEQ ID NO: 9317972 - DNA, 22 bp, Homo sapiens
gccctgagtggtacctgtgggt

SEQ ID NO: 9317973 - DNA, 22 bp, Homo sapiens
gccctgagtgcctgtgtaagaa

SEQ ID NO: 9317974 - DNA, 22 bp, Homo sapiens
gcctgcagcctcaagggctgag

SEQ ID NO: 9317975 - DNA, 22 bp, Homo sapiens
gcctgcagcccctctgcagtag

SEQ ID NO: 9317976 - DNA, 22 bp, Homo sapiens
gcctgcagaggtgctgctagct

SEQ ID NO: 9317977 - DNA, 22 bp, Homo sapiens
gcctgcagaggtgctgctagct

SEQ ID NO: 9317978 - DNA, 22 bp, Homo sapiens
gcctgcagacgtgttttcctca

SEQ ID NO: 9317979 - DNA, 19 bp, Homo sapiens
gcctgcagaaaaggcaggg

SEQ ID NO: 9317980 - DNA, 22 bp, Homo sapiens
gcctgatcaggtcctcggcata

SEQ ID NO: 9317981 - DNA, 22 bp, Homo sapiens
gcctgaggaatgctcctgactt

SEQ ID NO: 9317982 - DNA, 22 bp, Homo sapiens
gcctgagggctcctagcaggct

SEQ ID NO: 9317983 - DNA, 22 bp, Homo sapiens
gcctccctgttcttccacaata

SEQ ID NO: 9317984 - DNA, 22 bp, Homo sapiens
gcctccctgtttcctgctccaa

SEQ ID NO: 9317985 - DNA, 18 bp, Homo sapiens
gcctccctggctacactt

SEQ ID NO: 9317986 - DNA, 22 bp, Homo sapiens
gcctccctgagtcacccaagca

SEQ ID NO: 9317987 - DNA, 22 bp, Homo sapiens
gcctccacccctggggagtgga

SEQ ID NO: 9317988 - DNA, 22 bp, Homo sapiens
gcctggagtgcagtggcgtgat

SEQ ID NO: 9317989 - DNA, 22 bp, Homo sapiens
gcctggagacctgctcctctac

SEQ ID NO: 9317990 - DNA, 22 bp, Homo sapiens
gcctggagagcactgtgcgctt

SEQ ID NO: 9317991 - DNA, 22 bp, Homo sapiens
gcctgcagttctgtgctaggca

SEQ ID NO: 9317992 - DNA, 22 bp, Homo sapiens
gcctgcagggtgatgggctgcc

SEQ ID NO: 9317993 - DNA, 22 bp, Homo sapiens
gcctggagaagatggaactagc

SEQ ID NO: 9317994 - DNA, 23 bp, Homo sapiens
gcctggagaaaagctgcagttca

SEQ ID NO: 9317995 - DNA, 22 bp, Homo sapiens
gccagctgagcaaattccagct

SEQ ID NO: 9317996 - DNA, 22 bp, Homo sapiens
gccagctgggccttagggctgg

SEQ ID NO: 9317997 - DNA, 22 bp, Homo sapiens
gccagctgaggccgtgcaggct

SEQ ID NO: 9317998 - DNA, 22 bp, Homo sapiens
gccaggaaaaaccggccctgct

SEQ ID NO: 9317999 - DNA, 22 bp, Homo sapiens
gccaggaagtcagccaagccca

SEQ ID NO: 9318000 - DNA, 22 bp, Homo sapiens
gccaggaagtgcagccctgcca

SEQ ID NO: 9318001 - DNA, 22 bp, Homo sapiens
gcccaagccgccttccagagac

SEQ ID NO: 9318002 - DNA, 22 bp, Homo sapiens
gcccaaggtatatcagagacag

SEQ ID NO: 9318003 - DNA, 22 bp, Homo sapiens
gcccaaggtcacacacaggaag

SEQ ID NO: 9318004 - DNA, 22 bp, Homo sapiens
gccaggctaagaaaggtgtgat

SEQ ID NO: 9318005 - DNA, 22 bp, Homo sapiens
gccaggctaagaaaggtgtgat

SEQ ID NO: 9318006 - DNA, 22 bp, Homo sapiens
gccaggctaagaaaggtgtgat

SEQ ID NO: 9318007 - DNA, 23 bp, Homo sapiens
gccaggctccggtctgtggccac

SEQ ID NO: 9318008 - DNA, 22 bp, Homo sapiens
gccaggctccccggatccctgg

SEQ ID NO: 9318009 - DNA, 22 bp, Homo sapiens
gccaggctcagtagcgattcct

SEQ ID NO: 9318010 - DNA, 19 bp, Homo sapiens
gccaggctccatagccggc

SEQ ID NO: 9318011 - DNA, 22 bp, Homo sapiens
gccaggctccaggccctcctga

SEQ ID NO: 9318012 - DNA, 22 bp, Homo sapiens
gccaggctccaggccctcctga

SEQ ID NO: 9318013 - DNA, 22 bp, Homo sapiens
gcatttatttctttactgcatc

SEQ ID NO: 9318014 - DNA, 22 bp, Homo sapiens
gcatttatttctttactgcatc

SEQ ID NO: 9318015 - DNA, 22 bp, Homo sapiens
gccaccctggaccaccctgggc

SEQ ID NO: 9318016 - DNA, 22 bp, Homo sapiens
gccaccctgcaaatgcccagga

SEQ ID NO: 9318017 - DNA, 18 bp, Homo sapiens
gccaccctcctcgtctcc

SEQ ID NO: 9318018 - DNA, 22 bp, Homo sapiens
gcatttaaatttgaacttcaga

SEQ ID NO: 9318019 - DNA, 22 bp, Homo sapiens
gcatttaaatttgaacttcaga

SEQ ID NO: 9318020 - DNA, 22 bp, Homo sapiens
gccacctgtttcagatgtggtt

SEQ ID NO: 9318021 - DNA, 22 bp, Homo sapiens
gccaccctggacgcactgttcg

SEQ ID NO: 9318022 - DNA, 22 bp, Homo sapiens
gcagtttagtagatgacattat

SEQ ID NO: 9318023 - DNA, 22 bp, Homo sapiens
gcattaatgtaagacccactcc

SEQ ID NO: 9318024 - DNA, 22 bp, Homo sapiens
gcattgaatcctatcaggcaaa

SEQ ID NO: 9318025 - DNA, 22 bp, Homo sapiens
gcattgaatcctatcaggcaaa

SEQ ID NO: 9318026 - DNA, 22 bp, Homo sapiens
gcattgaagatcttagactagg

SEQ ID NO: 9318027 - DNA, 22 bp, Homo sapiens
gcagttaaaaataaaccttcat

SEQ ID NO: 9318028 - DNA, 22 bp, Homo sapiens
gcagttcctacagtggaaagcg

SEQ ID NO: 9318029 - DNA, 22 bp, Homo sapiens
gggccgtagaccacgtccgggc

SEQ ID NO: 9318030 - DNA, 19 bp, Homo sapiens
gggcctcacccacacctcc

SEQ ID NO: 9318031 - DNA, 22 bp, Homo sapiens
gggccctgccccgtggctctga

SEQ ID NO: 9318032 - DNA, 22 bp, Homo sapiens
gggcaggtggcaaagccagagg

SEQ ID NO: 9318033 - DNA, 22 bp, Homo sapiens
gggcaggtggagggcccagcca

SEQ ID NO: 9318034 - DNA, 22 bp, Homo sapiens
gggcaggtggcagggtctctgg

SEQ ID NO: 9318035 - DNA, 22 bp, Homo sapiens
gggcaggtggcctcttgtacta

SEQ ID NO: 9318036 - DNA, 22 bp, Homo sapiens
gggcaggtgtgcagagctgttg

SEQ ID NO: 9318037 - DNA, 22 bp, Homo sapiens
gggcaggtgtgcagagctgttg

SEQ ID NO: 9318038 - DNA, 22 bp, Homo sapiens
gggcaggtgttgtcaatctaat

SEQ ID NO: 9318039 - DNA, 22 bp, Homo sapiens
gggcaggtgtttccaaggtgag

SEQ ID NO: 9318040 - DNA, 22 bp, Homo sapiens
gggctctgaatcccaggtctgc

SEQ ID NO: 9318041 - DNA, 22 bp, Homo sapiens
gggctccaactacatcagcctt

SEQ ID NO: 9318042 - DNA, 22 bp, Homo sapiens
gggctccaaaatctatgtcttc

SEQ ID NO: 9318043 - DNA, 22 bp, Homo sapiens
gggctccaaaatcctgtagcct

SEQ ID NO: 9318044 - DNA, 22 bp, Homo sapiens
gggctccaaagtaagctttagt

SEQ ID NO: 9318045 - DNA, 22 bp, Homo sapiens
gggctccaaccccagtgaactc

SEQ ID NO: 9318046 - DNA, 22 bp, Homo sapiens
gggctccaacggtgagcatgga

SEQ ID NO: 9318047 - DNA, 22 bp, Homo sapiens
gggctcagctgggcgtgctggt

SEQ ID NO: 9318048 - DNA, 22 bp, Homo sapiens
gggctcagctgggcgtgctggt

SEQ ID NO: 9318049 - DNA, 21 bp, Homo sapiens
gggctcagcgctcggctcctc

SEQ ID NO: 9318050 - DNA, 22 bp, Homo sapiens
gggctcagacatccctcctgga

SEQ ID NO: 9318051 - DNA, 22 bp, Homo sapiens
gggctcagaggagtggcctggg

SEQ ID NO: 9318052 - DNA, 22 bp, Homo sapiens
gggctcagagcatttgggttgg

SEQ ID NO: 9318053 - DNA, 22 bp, Homo sapiens
gggctcagaggagtggcctggg

SEQ ID NO: 9318054 - DNA, 23 bp, Homo sapiens
gggctcagatttcattctgtgcc

SEQ ID NO: 9318055 - DNA, 22 bp, Homo sapiens
gggctcagccccattgaaccag

SEQ ID NO: 9318056 - DNA, 22 bp, Homo sapiens
gggaggttgaggctgcagtgag

SEQ ID NO: 9318057 - DNA, 22 bp, Homo sapiens
gggagctgaatggcaatggaga

SEQ ID NO: 9318058 - DNA, 22 bp, Homo sapiens
gggagtcagtgaaggagtcaga

SEQ ID NO: 9318059 - DNA, 22 bp, Homo sapiens
gggagctgaactgctgaagttg

SEQ ID NO: 9318060 - DNA, 22 bp, Homo sapiens
gggagctgaagtaggggtaaat

SEQ ID NO: 9318061 - DNA, 22 bp, Homo sapiens
gggagctgaaggagccggcggg

SEQ ID NO: 9318062 - DNA, 22 bp, Homo sapiens
gggagtgtgcacacatggtata

SEQ ID NO: 9318063 - DNA, 19 bp, Homo sapiens
gggatcagcccagggctct

SEQ ID NO: 9318064 - DNA, 22 bp, Homo sapiens
gggatcagaaacatagccctga

SEQ ID NO: 9318065 - DNA, 22 bp, Homo sapiens
gggagtgggtttggcctaggcc

SEQ ID NO: 9318066 - DNA, 22 bp, Homo sapiens
gggagtgggtttggcctaggcc

SEQ ID NO: 9318067 - DNA, 20 bp, Homo sapiens
gggagtggtggtagcctgtg

SEQ ID NO: 9318068 - DNA, 22 bp, Homo sapiens
gggagtggattatgtggaccca

SEQ ID NO: 9318069 - DNA, 22 bp, Homo sapiens
gggagtgggtttggcctaggcc

SEQ ID NO: 9318070 - DNA, 22 bp, Homo sapiens
gggagtgggtttggcctaggcc

SEQ ID NO: 9318071 - DNA, 17 bp, Homo sapiens
gggcagggactcctggg

SEQ ID NO: 9318072 - DNA, 17 bp, Homo sapiens
gggcagggactcctggg

SEQ ID NO: 9318073 - DNA, 15 bp, Homo sapiens
gggcaggtctggggc

SEQ ID NO: 9318074 - DNA, 22 bp, Homo sapiens
gggcaggtctgggtcagcctga

SEQ ID NO: 9318075 - DNA, 21 bp, Homo sapiens
gggcaggtctctgatgtcaac

SEQ ID NO: 9318076 - DNA, 22 bp, Homo sapiens
gggcaggtgattttggctccat

SEQ ID NO: 9318077 - DNA, 22 bp, Homo sapiens
gggcaggtgacctcttgtcctg

SEQ ID NO: 9318078 - DNA, 22 bp, Homo sapiens
gggcaggtgcccagggccagag

SEQ ID NO: 9318079 - DNA, 22 bp, Homo sapiens
gggcaggtgccagctccctgtc

SEQ ID NO: 9318080 - DNA, 20 bp, Homo sapiens
gggatcaggaaaggaggcta

SEQ ID NO: 9318081 - DNA, 22 bp, Homo sapiens
gggcactggtgctgccatcttg

SEQ ID NO: 9318082 - DNA, 22 bp, Homo sapiens
gggatcagttaaggagagtttt

SEQ ID NO: 9318083 - DNA, 20 bp, Homo sapiens
gggatcaggaaaggaggcta

SEQ ID NO: 9318084 - DNA, 20 bp, Homo sapiens
gggcagagccagccagtccc

SEQ ID NO: 9318085 - DNA, 22 bp, Homo sapiens
gggcagaggctctggcccatcc

SEQ ID NO: 9318086 - DNA, 22 bp, Homo sapiens
gggcagagagctggaactcctt

SEQ ID NO: 9318087 - DNA, 20 bp, Homo sapiens
gggcagagccagccagtccc

SEQ ID NO: 9318088 - DNA, 22 bp, Homo sapiens
ggctgtggccagcggggctgag

SEQ ID NO: 9318089 - DNA, 22 bp, Homo sapiens
ggctgtggcattaggtgaggcc

SEQ ID NO: 9318090 - DNA, 22 bp, Homo sapiens
ggctgtgggatgcataggagct

SEQ ID NO: 9318091 - DNA, 22 bp, Homo sapiens
gggaagagggagctggaatgat

SEQ ID NO: 9318092 - DNA, 22 bp, Homo sapiens
ggctgtggtcattaggaggttg

SEQ ID NO: 9318093 - DNA, 22 bp, Homo sapiens
ggctgtggcattaggtgaggcc

SEQ ID NO: 9318094 - DNA, 22 bp, Homo sapiens
ggctgtgctgagggggaagccc

SEQ ID NO: 9318095 - DNA, 22 bp, Homo sapiens
ggctgtgctttgcccaaagggc

SEQ ID NO: 9318096 - DNA, 22 bp, Homo sapiens
ggctggccagggccctcgctgg

SEQ ID NO: 9318097 - DNA, 18 bp, Homo sapiens
ggctgtgcgtggaggctg

SEQ ID NO: 9318098 - DNA, 22 bp, Homo sapiens
gggagccatgctggtcttcttt

SEQ ID NO: 9318099 - DNA, 19 bp, Homo sapiens
gggagccagaccctttgct

SEQ ID NO: 9318100 - DNA, 22 bp, Homo sapiens
gggagatggctcagaggccgcg

SEQ ID NO: 9318101 - DNA, 23 bp, Homo sapiens
gggagatgggaaatgaaggctct

SEQ ID NO: 9318102 - DNA, 22 bp, Homo sapiens
gggaaggcatacctgagggaga

SEQ ID NO: 9318103 - DNA, 22 bp, Homo sapiens
gggaagcatctgagggtccact

SEQ ID NO: 9318104 - DNA, 22 bp, Homo sapiens
gggaagagtgtcggttgaagtg

SEQ ID NO: 9318105 - DNA, 22 bp, Homo sapiens
ggctgcctggacctcctctttc

SEQ ID NO: 9318106 - DNA, 22 bp, Homo sapiens
ggctgcctgctcctcctgcacg

SEQ ID NO: 9318107 - DNA, 22 bp, Homo sapiens
ggctgcctgaggctgaggcccg

SEQ ID NO: 9318108 - DNA, 22 bp, Homo sapiens
ggctgcctctggaagctggaga

SEQ ID NO: 9318109 - DNA, 22 bp, Homo sapiens
ggctggcagtgtgagagaggga

SEQ ID NO: 9318110 - DNA, 22 bp, Homo sapiens
ggctggcagtgtgagagaggga

SEQ ID NO: 9318111 - DNA, 22 bp, Homo sapiens
ggctggcagttaatacctgaag

SEQ ID NO: 9318112 - DNA, 22 bp, Homo sapiens
ggctggcaggcacagtatgcaa

SEQ ID NO: 9318113 - DNA, 22 bp, Homo sapiens
ggctggcagaagtgtgctggct

SEQ ID NO: 9318114 - DNA, 22 bp, Homo sapiens
ggctggcagaagtgtgctggct

SEQ ID NO: 9318115 - DNA, 22 bp, Homo sapiens
ggctggcagaggggagtctgtg

SEQ ID NO: 9318116 - DNA, 22 bp, Homo sapiens
ggctgcagttgtgtgaaggccg

SEQ ID NO: 9318117 - DNA, 22 bp, Homo sapiens
ggctgccaccctcggacttccg

SEQ ID NO: 9318118 - DNA, 22 bp, Homo sapiens
ggctgcctcctgctgggctgga

SEQ ID NO: 9318119 - DNA, 20 bp, Homo sapiens
ggctgcctccttcctttcct

SEQ ID NO: 9318120 - DNA, 22 bp, Homo sapiens
ggctgcaggcttccctccagca

SEQ ID NO: 9318121 - DNA, 21 bp, Homo sapiens
ggctgcagggagccctggggt

SEQ ID NO: 9318122 - DNA, 22 bp, Homo sapiens
ggctgcaggcagggtatccact

SEQ ID NO: 9318123 - DNA, 22 bp, Homo sapiens
ggctctgcgcggtaaagtgact

SEQ ID NO: 9318124 - DNA, 17 bp, Homo sapiens
ggctgcagtccaggagg

SEQ ID NO: 9318125 - DNA, 17 bp, Homo sapiens
ggctgcagtccaggagg

SEQ ID NO: 9318126 - DNA, 22 bp, Homo sapiens
ggctgcagggcagctggtgtgg

SEQ ID NO: 9318127 - DNA, 22 bp, Homo sapiens
ggctgcaggttggttggcagct

SEQ ID NO: 9318128 - DNA, 22 bp, Homo sapiens
ggccagctcttgtccacggagg

SEQ ID NO: 9318129 - DNA, 22 bp, Homo sapiens
ggccagcagtcacagggtcaga

SEQ ID NO: 9318130 - DNA, 22 bp, Homo sapiens
ggccagctgctcagtgtctctg

SEQ ID NO: 9318131 - DNA, 20 bp, Homo sapiens
ggccagctgatgcacgatgc

SEQ ID NO: 9318132 - DNA, 22 bp, Homo sapiens
ggccagctggatgtgggtgacg

SEQ ID NO: 9318133 - DNA, 22 bp, Homo sapiens
ggccacatgtggctgctcgtat

SEQ ID NO: 9318134 - DNA, 22 bp, Homo sapiens
ggccacagcagatgcttcagat

SEQ ID NO: 9318135 - DNA, 22 bp, Homo sapiens
ggcagtgggtggatctcaggga

SEQ ID NO: 9318136 - DNA, 22 bp, Homo sapiens
ggcagtggctgtagtctcttgg

SEQ ID NO: 9318137 - DNA, 22 bp, Homo sapiens
ggcagtggcatgtgggtagtgg

SEQ ID NO: 9318138 - DNA, 22 bp, Homo sapiens
ggcctctctccttggcttgcag

SEQ ID NO: 9318139 - DNA, 21 bp, Homo sapiens
ggcctcccggaccgcagcgcc

SEQ ID NO: 9318140 - DNA, 22 bp, Homo sapiens
ggcctctctggcatggctgccc

SEQ ID NO: 9318141 - DNA, 22 bp, Homo sapiens
ggcctctcttgggacagctgtc

SEQ ID NO: 9318142 - DNA, 22 bp, Homo sapiens
ggcctctgcaggcctcgacaag

SEQ ID NO: 9318143 - DNA, 22 bp, Homo sapiens
ggctaggctcacctggagagtt

SEQ ID NO: 9318144 - DNA, 22 bp, Homo sapiens
ggctagggacacagctctgctc

SEQ ID NO: 9318145 - DNA, 22 bp, Homo sapiens
ggctaggctcacctggagagtt

SEQ ID NO: 9318146 - DNA, 22 bp, Homo sapiens
ggctagggaaatcctgatccaa

SEQ ID NO: 9318147 - DNA, 22 bp, Homo sapiens
ggctcactgcaacttccgcctc

SEQ ID NO: 9318148 - DNA, 22 bp, Homo sapiens
ggctcacgcaattatcccggcc

SEQ ID NO: 9318149 - DNA, 22 bp, Homo sapiens
ggctctgcccagatgaagagga

SEQ ID NO: 9318150 - DNA, 22 bp, Homo sapiens
ggctctgcccgcggctgcccac

SEQ ID NO: 9318151 - DNA, 22 bp, Homo sapiens
ggctctgcctctgaccctctgg

SEQ ID NO: 9318152 - DNA, 22 bp, Homo sapiens
ggctcagcacagggctggcatc

SEQ ID NO: 9318153 - DNA, 22 bp, Homo sapiens
ggctcagagttaggacccatgt

SEQ ID NO: 9318154 - DNA, 22 bp, Homo sapiens
ggctctgaacatggggaggagt

SEQ ID NO: 9318155 - DNA, 22 bp, Homo sapiens
ggcagtgagctggagggaagga

SEQ ID NO: 9318156 - DNA, 22 bp, Homo sapiens
ggcagtgagctggagggaagga

SEQ ID NO: 9318157 - DNA, 22 bp, Homo sapiens
ggcagtgactgttcagacgtcc

SEQ ID NO: 9318158 - DNA, 22 bp, Homo sapiens
ggcagtgagtcccggagaggcc

SEQ ID NO: 9318159 - DNA, 22 bp, Homo sapiens
ggcagtgagtcccggagaggcc

SEQ ID NO: 9318160 - DNA, 22 bp, Homo sapiens
ggcagtgagtcccggagaggcc

SEQ ID NO: 9318161 - DNA, 22 bp, Homo sapiens
ggcagtgccactaagctctgct

SEQ ID NO: 9318162 - DNA, 18 bp, Homo sapiens
ggcagtgcagtctcaggg

SEQ ID NO: 9318163 - DNA, 22 bp, Homo sapiens
ggcagtgcaaggctggcacagt

SEQ ID NO: 9318164 - DNA, 22 bp, Homo sapiens
ggcagtggaggaccctgtgtct

SEQ ID NO: 9318165 - DNA, 20 bp, Homo sapiens
ggcagggcatcaacagctct

SEQ ID NO: 9318166 - DNA, 20 bp, Homo sapiens
ggcagggcatcaacagctct

SEQ ID NO: 9318167 - DNA, 22 bp, Homo sapiens
ggcaggggtcctggtgttgact

SEQ ID NO: 9318168 - DNA, 22 bp, Homo sapiens
ggcaggggtcctggtgttgact

SEQ ID NO: 9318169 - DNA, 22 bp, Homo sapiens
ggcagggcttgtctctgtgatg

SEQ ID NO: 9318170 - DNA, 18 bp, Homo sapiens
ggcagggaaaagataggg

SEQ ID NO: 9318171 - DNA, 22 bp, Homo sapiens
ggcagggaaacagctgatccca

SEQ ID NO: 9318172 - DNA, 22 bp, Homo sapiens
ggcagggaaacagctgatccca

SEQ ID NO: 9318173 - DNA, 22 bp, Homo sapiens
ggcagggaagctggcatcacgg

SEQ ID NO: 9318174 - DNA, 22 bp, Homo sapiens
ggcagccttgagggaggcctgg

SEQ ID NO: 9318175 - DNA, 22 bp, Homo sapiens
ggcaggctgttcacctgctttt

SEQ ID NO: 9318176 - DNA, 22 bp, Homo sapiens
ggcaggcttggtggcaccggtt

SEQ ID NO: 9318177 - DNA, 22 bp, Homo sapiens
ggcaggcttgatatggggggac

SEQ ID NO: 9318178 - DNA, 22 bp, Homo sapiens
ggcaggctttgagaaagagcat

SEQ ID NO: 9318179 - DNA, 22 bp, Homo sapiens
ggcaggctttcagcatcaagtc

SEQ ID NO: 9318180 - DNA, 20 bp, Homo sapiens
ggcaggctttatatggaggg

SEQ ID NO: 9318181 - DNA, 23 bp, Homo sapiens
ggcagcctctgactctgctttgc

SEQ ID NO: 9318182 - DNA, 22 bp, Homo sapiens
ggcagcctcaggttttctttga

SEQ ID NO: 9318183 - DNA, 19 bp, Homo sapiens
ggcagcctgcacgggctgc

SEQ ID NO: 9318184 - DNA, 17 bp, Homo sapiens
ggcagcctcaggcgttt

SEQ ID NO: 9318185 - DNA, 22 bp, Homo sapiens
ggcagccctgtggagaggccca

SEQ ID NO: 9318186 - DNA, 21 bp, Homo sapiens
ggcagcccgccctctcctggc

SEQ ID NO: 9318187 - DNA, 22 bp, Homo sapiens
ggcagccatgtgggcagcgagt

SEQ ID NO: 9318188 - DNA, 22 bp, Homo sapiens
ggcagccccagaaacagttcag

SEQ ID NO: 9318189 - DNA, 22 bp, Homo sapiens
ggcagccatgtcccagggcttc

SEQ ID NO: 9318190 - DNA, 22 bp, Homo sapiens
ggcaccatcagctgtgcagggg

SEQ ID NO: 9318191 - DNA, 22 bp, Homo sapiens
ggcaccagggaaggaaggctgg

SEQ ID NO: 9318192 - DNA, 22 bp, Homo sapiens
ggcaccagggcaagggtctttc

SEQ ID NO: 9318193 - DNA, 22 bp, Homo sapiens
ggaggcagaacttcccgtcagt

SEQ ID NO: 9318194 - DNA, 19 bp, Homo sapiens
ggcacctttctgctgtgtc

SEQ ID NO: 9318195 - DNA, 22 bp, Homo sapiens
ggcaccttggctagtgatcaac

SEQ ID NO: 9318196 - DNA, 22 bp, Homo sapiens
ggaggaggggtttacattggaa

SEQ ID NO: 9318197 - DNA, 22 bp, Homo sapiens
ggaggatgagctacgaggagct

SEQ ID NO: 9318198 - DNA, 22 bp, Homo sapiens
ggaggagtcagttgggctgctt

SEQ ID NO: 9318199 - DNA, 22 bp, Homo sapiens
ggaggaggtgggttaagttgta

SEQ ID NO: 9318200 - DNA, 22 bp, Homo sapiens
ggaggcaacacagggtgtgttt

SEQ ID NO: 9318201 - DNA, 22 bp, Homo sapiens
ggcagatggggtgacaagagag

SEQ ID NO: 9318202 - DNA, 22 bp, Homo sapiens
ggcagatggagaagcagcaggt

SEQ ID NO: 9318203 - DNA, 22 bp, Homo sapiens
ggcagatgttatatgatctgag

SEQ ID NO: 9318204 - DNA, 22 bp, Homo sapiens
ggcagaggtgacagtgtctttt

SEQ ID NO: 9318205 - DNA, 22 bp, Homo sapiens
ggcagatggaatgagctgtcta

SEQ ID NO: 9318206 - DNA, 22 bp, Homo sapiens
ggcagcactgcagcttgttggg

SEQ ID NO: 9318207 - DNA, 22 bp, Homo sapiens
ggcagcagaactggccctgtat

SEQ ID NO: 9318208 - DNA, 18 bp, Homo sapiens
ggcagcaagaagggaggg

SEQ ID NO: 9318209 - DNA, 22 bp, Homo sapiens
ggcagatgttgcagtgagcaga

SEQ ID NO: 9318210 - DNA, 22 bp, Homo sapiens
ggtgagccgaaaagggtcataa

SEQ ID NO: 9318211 - DNA, 22 bp, Homo sapiens
ggtgaggaaagatggtgacagt

SEQ ID NO: 9318212 - DNA, 22 bp, Homo sapiens
ggtgaggaattggggactgacc

SEQ ID NO: 9318213 - DNA, 22 bp, Homo sapiens
ggtgagaggcagtgctgtggaa

SEQ ID NO: 9318214 - DNA, 22 bp, Homo sapiens
ggtgagaggcctgagagctgga

SEQ ID NO: 9318215 - DNA, 18 bp, Homo sapiens
ggtgagggagctggaagc

SEQ ID NO: 9318216 - DNA, 22 bp, Homo sapiens
ggtgctctgacaccctccttgg

SEQ ID NO: 9318217 - DNA, 22 bp, Homo sapiens
ggtgctgtggcagctcctcctc

SEQ ID NO: 9318218 - DNA, 22 bp, Homo sapiens
ggtgagggagtggaacgaggtg

SEQ ID NO: 9318219 - DNA, 22 bp, Homo sapiens
ggtgctcaaggtgacaggacat

SEQ ID NO: 9318220 - DNA, 22 bp, Homo sapiens
ggtccccgtggaggctggagcg

SEQ ID NO: 9318221 - DNA, 23 bp, Homo sapiens
ggtcccagtggagaggcctcacc

SEQ ID NO: 9318222 - DNA, 22 bp, Homo sapiens
ggtcccaggttgacagggagac

SEQ ID NO: 9318223 - DNA, 22 bp, Homo sapiens
ggtcccagttgcccaggtcagg

SEQ ID NO: 9318224 - DNA, 22 bp, Homo sapiens
ggtcccagttgcccaggtcagg

SEQ ID NO: 9318225 - DNA, 22 bp, Homo sapiens
gggttggcatcagggttctgtg

SEQ ID NO: 9318226 - DNA, 22 bp, Homo sapiens
gggttggcagcaccagaggagg

SEQ ID NO: 9318227 - DNA, 22 bp, Homo sapiens
gggttgaggcggatgtcggcgg

SEQ ID NO: 9318228 - DNA, 22 bp, Homo sapiens
gggttgaggcggatgtcggcgg

SEQ ID NO: 9318229 - DNA, 22 bp, Homo sapiens
gggttgaggcggatgtcggcgg

SEQ ID NO: 9318230 - DNA, 22 bp, Homo sapiens
ggtcccagctgctcaagaggct

SEQ ID NO: 9318231 - DNA, 22 bp, Homo sapiens
gggttggggcccagcagtctgc

SEQ ID NO: 9318232 - DNA, 22 bp, Homo sapiens
ggtcccagaattggttagcaca

SEQ ID NO: 9318233 - DNA, 22 bp, Homo sapiens
ggttggtgctgcatttgcctca

SEQ ID NO: 9318234 - DNA, 22 bp, Homo sapiens
ggttggtgcccaggccatactg

SEQ ID NO: 9318235 - DNA, 22 bp, Homo sapiens
ggttggggcgagctggaggccc

SEQ ID NO: 9318236 - DNA, 22 bp, Homo sapiens
gtaattacattagggtaaataa

SEQ ID NO: 9318237 - DNA, 22 bp, Homo sapiens
gtaattacatgagtactgtaag

SEQ ID NO: 9318238 - DNA, 22 bp, Homo sapiens
ggttagtagcacagatgctgaa

SEQ ID NO: 9318239 - DNA, 22 bp, Homo sapiens
ggttagtagtttgctctattag

SEQ ID NO: 9318240 - DNA, 22 bp, Homo sapiens
ggttcacaggtcctgggagcag

SEQ ID NO: 9318241 - DNA, 22 bp, Homo sapiens
ggtggtctgtttattgaaggtt

SEQ ID NO: 9318242 - DNA, 22 bp, Homo sapiens
ggtggggcccaggcatctgatg

SEQ ID NO: 9318243 - DNA, 22 bp, Homo sapiens
ggtgggtgcagggggcttctta

SEQ ID NO: 9318244 - DNA, 22 bp, Homo sapiens
ggtgggtggaaacagcatgtac

SEQ ID NO: 9318245 - DNA, 22 bp, Homo sapiens
ggtggggcctgctccagcggcc

SEQ ID NO: 9318246 - DNA, 22 bp, Homo sapiens
ggtggggccctggcactggtat

SEQ ID NO: 9318247 - DNA, 19 bp, Homo sapiens
ggtggcagaacgtgggtcc

SEQ ID NO: 9318248 - DNA, 22 bp, Homo sapiens
ggtggcagagacataggacata

SEQ ID NO: 9318249 - DNA, 22 bp, Homo sapiens
ggtggcagagacataggacata

SEQ ID NO: 9318250 - DNA, 16 bp, Homo sapiens
gggctgggggattctg

SEQ ID NO: 9318251 - DNA, 22 bp, Homo sapiens
gggctggtgaggctgccctgca

SEQ ID NO: 9318252 - DNA, 22 bp, Homo sapiens
gggcttctattctggcacaaga

SEQ ID NO: 9318253 - DNA, 22 bp, Homo sapiens
gggcttctgggcaccactccct

SEQ ID NO: 9318254 - DNA, 23 bp, Homo sapiens
gggcttcattttaattcagctgc

SEQ ID NO: 9318255 - DNA, 22 bp, Homo sapiens
gggcttcattcaggcagaattt

SEQ ID NO: 9318256 - DNA, 22 bp, Homo sapiens
gggcttcagttctgaccatctt

SEQ ID NO: 9318257 - DNA, 22 bp, Homo sapiens
gggcttcagggtacttcctcct

SEQ ID NO: 9318258 - DNA, 22 bp, Homo sapiens
gggcttcattcaggcagaattt

SEQ ID NO: 9318259 - DNA, 22 bp, Homo sapiens
gggcttcattcaggcagaattt

SEQ ID NO: 9318260 - DNA, 22 bp, Homo sapiens
gggcttcagttctgaccatctt

SEQ ID NO: 9318261 - DNA, 23 bp, Homo sapiens
gggcttcattttaattcagctgc

SEQ ID NO: 9318262 - DNA, 23 bp, Homo sapiens
gggcttcattttaattcagctgc

SEQ ID NO: 9318263 - DNA, 23 bp, Homo sapiens
gggcttcattttaattcagctgc

SEQ ID NO: 9318264 - DNA, 22 bp, Homo sapiens
gggcttcaaaattggcactctt

SEQ ID NO: 9318265 - DNA, 22 bp, Homo sapiens
gggcttcaatagcagaggcgtg

SEQ ID NO: 9318266 - DNA, 22 bp, Homo sapiens
gggcttcaatagcagaggcgtg

SEQ ID NO: 9318267 - DNA, 22 bp, Homo sapiens
gggcttcaaaattggcactctt

SEQ ID NO: 9318268 - DNA, 22 bp, Homo sapiens
gggcttcaaaattggcactctt

SEQ ID NO: 9318269 - DNA, 22 bp, Homo sapiens
gggcttcaatagcagaggcgtg

SEQ ID NO: 9318270 - DNA, 22 bp, Homo sapiens
gggcttcagatccagggacctc

SEQ ID NO: 9318271 - DNA, 22 bp, Homo sapiens
gggcttcagatccagggacctc

SEQ ID NO: 9318272 - DNA, 22 bp, Homo sapiens
gggcttcaggagggtcagccca

SEQ ID NO: 9318273 - DNA, 22 bp, Homo sapiens
gggcttcagctggggatggagc

SEQ ID NO: 9318274 - DNA, 22 bp, Homo sapiens
gggcttcaggagggtcagccca

SEQ ID NO: 9318275 - DNA, 22 bp, Homo sapiens
gggcttcaggagggtcagccca

SEQ ID NO: 9318276 - DNA, 22 bp, Homo sapiens
gggcttcagctggggatggagc

SEQ ID NO: 9318277 - DNA, 22 bp, Homo sapiens
gggcttcagggtacttcctcct

SEQ ID NO: 9318278 - DNA, 22 bp, Homo sapiens
gggcttcagtaccaaagtttga

SEQ ID NO: 9318279 - DNA, 22 bp, Homo sapiens
gggcttcagggtacttcctcct

SEQ ID NO: 9318280 - DNA, 22 bp, Homo sapiens
gggcttcaggagggtcagccca

SEQ ID NO: 9318281 - DNA, 22 bp, Homo sapiens
ggggcagggaggttatcgccga

SEQ ID NO: 9318282 - DNA, 22 bp, Homo sapiens
ggggatctaggatatttcatga

SEQ ID NO: 9318283 - DNA, 22 bp, Homo sapiens
ggggagtgacgcagggccatag

SEQ ID NO: 9318284 - DNA, 22 bp, Homo sapiens
ggggagtgttttcatgggcttg

SEQ ID NO: 9318285 - DNA, 22 bp, Homo sapiens
ggggaggcaagatgaagtgagg

SEQ ID NO: 9318286 - DNA, 22 bp, Homo sapiens
ggggaggcaagatgaagtgagg

SEQ ID NO: 9318287 - DNA, 22 bp, Homo sapiens
ggggtggagatggtggcccttt

SEQ ID NO: 9318288 - DNA, 18 bp, Homo sapiens
ggggtgcccagactgtct

SEQ ID NO: 9318289 - DNA, 18 bp, Homo sapiens
ggggtgcccagactgtct

SEQ ID NO: 9318290 - DNA, 22 bp, Homo sapiens
ggggtggccctaccctctggaa

SEQ ID NO: 9318291 - DNA, 19 bp, Homo sapiens
ggggtggctggggctccag

SEQ ID NO: 9318292 - DNA, 22 bp, Homo sapiens
ggggccagtaggagtgatgtac

SEQ ID NO: 9318293 - DNA, 21 bp, Homo sapiens
gggtgctgtggtcatgcagga

SEQ ID NO: 9318294 - DNA, 21 bp, Homo sapiens
gggtgctgtggtcatgcagga

SEQ ID NO: 9318295 - DNA, 22 bp, Homo sapiens
gggtgcagcagagctcctctgt

SEQ ID NO: 9318296 - DNA, 22 bp, Homo sapiens
gggtgaggcccatttgaggcca

SEQ ID NO: 9318297 - DNA, 21 bp, Homo sapiens
gggtggtctgctgaagaggga

SEQ ID NO: 9318298 - DNA, 22 bp, Homo sapiens
gggtggtctggcaggctggaaa

SEQ ID NO: 9318299 - DNA, 22 bp, Homo sapiens
gggtggtcatctgaaggtctgg

SEQ ID NO: 9318300 - DNA, 19 bp, Homo sapiens
gggtggtccaactttcagg

SEQ ID NO: 9318301 - DNA, 21 bp, Homo sapiens
gggtggtctagctcaggaact

SEQ ID NO: 9318302 - DNA, 16 bp, Homo sapiens
gggtggtcttggagac

SEQ ID NO: 9318303 - DNA, 22 bp, Homo sapiens
gggtggtggcggaggctccagg

SEQ ID NO: 9318304 - DNA, 22 bp, Homo sapiens
gggtggaattgttggcatcgga

SEQ ID NO: 9318305 - DNA, 21 bp, Homo sapiens
gggtggggttccagccttttc

SEQ ID NO: 9318306 - DNA, 22 bp, Homo sapiens
gtccagcccctgactcccaggc

SEQ ID NO: 9318307 - DNA, 22 bp, Homo sapiens
gtccagccaggctgcagcaccc

SEQ ID NO: 9318308 - DNA, 22 bp, Homo sapiens
gtccagccctctgcctccaggt

SEQ ID NO: 9318309 - DNA, 22 bp, Homo sapiens
gtcagaggaggctgagtaggaa

SEQ ID NO: 9318310 - DNA, 21 bp, Homo sapiens
gtcagagatgcccaactgcct

SEQ ID NO: 9318311 - DNA, 22 bp, Homo sapiens
gtcagagaactggattttccaa

SEQ ID NO: 9318312 - DNA, 22 bp, Homo sapiens
gtcagagacaaacttcctctct

SEQ ID NO: 9318313 - DNA, 22 bp, Homo sapiens
gtcagagagggcacgtgcacac

SEQ ID NO: 9318314 - DNA, 22 bp, Homo sapiens
gtcagagatggcatgaaagatt

SEQ ID NO: 9318315 - DNA, 22 bp, Homo sapiens
gtccagagaagggaggggactc

SEQ ID NO: 9318316 - DNA, 22 bp, Homo sapiens
gtccaggctgacccctagagga

SEQ ID NO: 9318317 - DNA, 22 bp, Homo sapiens
gtccaggcctgcctctgaggag

SEQ ID NO: 9318318 - DNA, 22 bp, Homo sapiens
gtccaggctgcccagggtcctg

SEQ ID NO: 9318319 - DNA, 22 bp, Homo sapiens
gtccaggctgcccagggtcctg

SEQ ID NO: 9318320 - DNA, 22 bp, Homo sapiens
gtccaggccatggtggacacag

SEQ ID NO: 9318321 - DNA, 22 bp, Homo sapiens
gtccaggccccagggattcttg

SEQ ID NO: 9318322 - DNA, 22 bp, Homo sapiens
gtccaggctcaaaaggttgtta

SEQ ID NO: 9318323 - DNA, 22 bp, Homo sapiens
gtccaggctcaaaaggttgtta

SEQ ID NO: 9318324 - DNA, 22 bp, Homo sapiens
gtccaggcctgcctctgaggag

SEQ ID NO: 9318325 - DNA, 22 bp, Homo sapiens
gtccaggctaagtcccttctgc

SEQ ID NO: 9318326 - DNA, 22 bp, Homo sapiens
gtccaggaatcaaaagatggaa

SEQ ID NO: 9318327 - DNA, 22 bp, Homo sapiens
gtccaggaagcaataaatagaa

SEQ ID NO: 9318328 - DNA, 20 bp, Homo sapiens
gtccaggacccagcaggagg

SEQ ID NO: 9318329 - DNA, 19 bp, Homo sapiens
gtccaggcattgggttggt

SEQ ID NO: 9318330 - DNA, 19 bp, Homo sapiens
gtccaggcattgggttggt

SEQ ID NO: 9318331 - DNA, 22 bp, Homo sapiens
gtccaggcacctcccttgtgct

SEQ ID NO: 9318332 - DNA, 22 bp, Homo sapiens
gtccaggcacctcccttgtgct

SEQ ID NO: 9318333 - DNA, 22 bp, Homo sapiens
gtccaggagtttccaattaagc

SEQ ID NO: 9318334 - DNA, 20 bp, Homo sapiens
gtcggctctacccagactgt

SEQ ID NO: 9318335 - DNA, 22 bp, Homo sapiens
gtcgtcctgggccgagccccgg

SEQ ID NO: 9318336 - DNA, 22 bp, Homo sapiens
gtcgttctctgccagggcgttg

SEQ ID NO: 9318337 - DNA, 22 bp, Homo sapiens
gtcctgggaactggacagctaa

SEQ ID NO: 9318338 - DNA, 22 bp, Homo sapiens
gtcctggcacctcactggctac

SEQ ID NO: 9318339 - DNA, 22 bp, Homo sapiens
gtcctggcccactggcaggctg

SEQ ID NO: 9318340 - DNA, 22 bp, Homo sapiens
gtagtgggtggaaatgactaca

SEQ ID NO: 9318341 - DNA, 22 bp, Homo sapiens
gtataaaggcacaggttttctg

SEQ ID NO: 9318342 - DNA, 22 bp, Homo sapiens
gtataaagtataagcttgtttt

SEQ ID NO: 9318343 - DNA, 22 bp, Homo sapiens
gtacaaattttgacatctagga

SEQ ID NO: 9318344 - DNA, 22 bp, Homo sapiens
gtacaaattgatacagatttga

SEQ ID NO: 9318345 - DNA, 22 bp, Homo sapiens
gtacaaattgatacaggttttc

SEQ ID NO: 9318346 - DNA, 22 bp, Homo sapiens
gtacaaatacattctgaaggta

SEQ ID NO: 9318347 - DNA, 22 bp, Homo sapiens
gtacaaaagttattgcggtttt

SEQ ID NO: 9318348 - DNA, 22 bp, Homo sapiens
gtacaaatgagagttctgtttt

SEQ ID NO: 9318349 - DNA, 22 bp, Homo sapiens
gtacaaatgaaaatagaccact

SEQ ID NO: 9318350 - DNA, 22 bp, Homo sapiens
gtacaaatgtacacttgtataa

SEQ ID NO: 9318351 - DNA, 22 bp, Homo sapiens
gtacaaatgcaggtttgttaca

SEQ ID NO: 9318352 - DNA, 22 bp, Homo sapiens
gtacaaattaggaagctttgtg

SEQ ID NO: 9318353 - DNA, 22 bp, Homo sapiens
gtaggtcagacataagaggaca

SEQ ID NO: 9318354 - DNA, 22 bp, Homo sapiens
gtagtcacaaaccattcatatg

SEQ ID NO: 9318355 - DNA, 22 bp, Homo sapiens
gtagtagcagtaacaaggtata

SEQ ID NO: 9318356 - DNA, 18 bp, Homo sapiens
gtagtagctatgggctca

SEQ ID NO: 9318357 - DNA, 22 bp, Homo sapiens
gtagtagctgtagatatcagga

SEQ ID NO: 9318358 - DNA, 22 bp, Homo sapiens
gtagtagctgtgaaagtctgct

SEQ ID NO: 9318359 - DNA, 22 bp, Homo sapiens
gtacaataactagtcttatagt

SEQ ID NO: 9318360 - DNA, 22 bp, Homo sapiens
gtacaatagcagttttcccttt

SEQ ID NO: 9318361 - DNA, 19 bp, Homo sapiens
gtacaatgtgttgttggta

SEQ ID NO: 9318362 - DNA, 22 bp, Homo sapiens
gtacaatagtccctgtttggat

SEQ ID NO: 9318363 - DNA, 22 bp, Homo sapiens
gtctagggctcctcagtgacaa

SEQ ID NO: 9318364 - DNA, 22 bp, Homo sapiens
gtctccagccattctctgatca

SEQ ID NO: 9318365 - DNA, 22 bp, Homo sapiens
gtctccagggctgctggcgcct

SEQ ID NO: 9318366 - DNA, 22 bp, Homo sapiens
gtctttatctttgaaattagtc

SEQ ID NO: 9318367 - DNA, 22 bp, Homo sapiens
gtgaggagctgacactggggtg

SEQ ID NO: 9318368 - DNA, 22 bp, Homo sapiens
gtgaggagggctggtcccaggc

SEQ ID NO: 9318369 - DNA, 22 bp, Homo sapiens
gtgaggagggctggtcccaggc

SEQ ID NO: 9318370 - DNA, 22 bp, Homo sapiens
gtgaggagggctggtcccaggc

SEQ ID NO: 9318371 - DNA, 22 bp, Homo sapiens
gtgaggactggtaaggactgca

SEQ ID NO: 9318372 - DNA, 22 bp, Homo sapiens
gtgaggactagtgggtttgtgc

SEQ ID NO: 9318373 - DNA, 22 bp, Homo sapiens
gtgaggaagtctgagagccaca

SEQ ID NO: 9318374 - DNA, 22 bp, Homo sapiens
gtgaaaaatgatttgttaactg

SEQ ID NO: 9318375 - DNA, 22 bp, Homo sapiens
gtctttatttgagattgtcatt

SEQ ID NO: 9318376 - DNA, 22 bp, Homo sapiens
gtctttctatgatgaactgttg

SEQ ID NO: 9318377 - DNA, 22 bp, Homo sapiens
gtgccagggagtggaggagctt

SEQ ID NO: 9318378 - DNA, 22 bp, Homo sapiens
gtgctgagtgcagagtgcagag

SEQ ID NO: 9318379 - DNA, 22 bp, Homo sapiens
gtgctgagaacaaaagtggaca

SEQ ID NO: 9318380 - DNA, 20 bp, Homo sapiens
gtgctgagtgaaatgagatt

SEQ ID NO: 9318381 - DNA, 22 bp, Homo sapiens
gtgctgaatccactcttaggaa

SEQ ID NO: 9318382 - DNA, 22 bp, Homo sapiens
gtgctgaattgtgctctttaca

SEQ ID NO: 9318383 - DNA, 22 bp, Homo sapiens
gtgcccaggcccaaggcaccac

SEQ ID NO: 9318384 - DNA, 22 bp, Homo sapiens
gtgctgaagtgaaattcatcaa

SEQ ID NO: 9318385 - DNA, 22 bp, Homo sapiens
gtgaggatgcagatgagggcct

SEQ ID NO: 9318386 - DNA, 22 bp, Homo sapiens
gtgaggatcaaatgaaatagca

SEQ ID NO: 9318387 - DNA, 22 bp, Homo sapiens
gtgaggatacttaagagaacac

SEQ ID NO: 9318388 - DNA, 19 bp, Homo sapiens
gtgaggatactgctcagag

SEQ ID NO: 9318389 - DNA, 22 bp, Homo sapiens
gtgcaggagtaggagagggctt

SEQ ID NO: 9318390 - DNA, 22 bp, Homo sapiens
gtgcagggagcccagaaggtcc

SEQ ID NO: 9318391 - DNA, 22 bp, Homo sapiens
gtgcaggctctcgttcttgaca

SEQ ID NO: 9318392 - DNA, 22 bp, Homo sapiens
gtgcaggctagatccttcctac

SEQ ID NO: 9318393 - DNA, 22 bp, Homo sapiens
gtgcaggcaaaagggccaggcc

SEQ ID NO: 9318394 - DNA, 22 bp, Homo sapiens
gtgcagggtagcgacggcagga

SEQ ID NO: 9318395 - DNA, 17 bp, Homo sapiens
gtgcagggatgaaggat

SEQ ID NO: 9318396 - DNA, 22 bp, Homo sapiens
gtgcagggcagccgaatgggct

SEQ ID NO: 9318397 - DNA, 22 bp, Homo sapiens
gtgcagggcagccgaatgggct

SEQ ID NO: 9318398 - DNA, 22 bp, Homo sapiens
gtgcagggcagccgaatgggct

SEQ ID NO: 9318399 - DNA, 22 bp, Homo sapiens
tttttacacttagcattgagcg

SEQ ID NO: 9318400 - DNA, 22 bp, Homo sapiens
ttttgtttgtgtccactgcagt

SEQ ID NO: 9318401 - DNA, 22 bp, Homo sapiens
tttttcatctgattgataactc

SEQ ID NO: 9318402 - DNA, 22 bp, Homo sapiens
tttttatatgaaggatagtgcg

SEQ ID NO: 9318403 - DNA, 22 bp, Homo sapiens
tttttatactttgctcaagatt

SEQ ID NO: 9318404 - DNA, 22 bp, Homo sapiens
tttgacaagagcaaatgttctt

SEQ ID NO: 9318405 - DNA, 22 bp, Homo sapiens
tttgacaattaggtagaaaaag

SEQ ID NO: 9318406 - DNA, 20 bp, Homo sapiens
tttgacaccttgggagagac

SEQ ID NO: 9318407 - DNA, 22 bp, Homo sapiens
tttgaatgcaggacatacagaa

SEQ ID NO: 9318408 - DNA, 22 bp, Homo sapiens
tttgaatggactgagaatcttg

SEQ ID NO: 9318409 - DNA, 22 bp, Homo sapiens
tttgaattattccttgagttga

SEQ ID NO: 9318410 - DNA, 20 bp, Homo sapiens
tttgaatgtaaagcatgtca

SEQ ID NO: 9318411 - DNA, 22 bp, Homo sapiens
tttgacaaataggggaataagg

SEQ ID NO: 9318412 - DNA, 22 bp, Homo sapiens
tttgacaaaattatgctaatat

SEQ ID NO: 9318413 - DNA, 22 bp, Homo sapiens
tttgaagcagatggttaagctt

SEQ ID NO: 9318414 - DNA, 22 bp, Homo sapiens
tttgaatatgtgcttgttaaat

SEQ ID NO: 9318415 - DNA, 22 bp, Homo sapiens
tttgaatgaaattgacatttgg

SEQ ID NO: 9318416 - DNA, 22 bp, Homo sapiens
tttgaaaggaagttaatacttt

SEQ ID NO: 9318417 - DNA, 22 bp, Homo sapiens
tttcttttgaatagtgtgtggt

SEQ ID NO: 9318418 - DNA, 22 bp, Homo sapiens
tttctttgttgttatcacatca

SEQ ID NO: 9318419 - DNA, 22 bp, Homo sapiens
tttctttgttgttatcacatca

SEQ ID NO: 9318420 - DNA, 22 bp, Homo sapiens
tttctttgagtctcagtttgct

SEQ ID NO: 9318421 - DNA, 22 bp, Homo sapiens
tttcctcagaagtgtctactat

SEQ ID NO: 9318422 - DNA, 22 bp, Homo sapiens
tttcctcatttatctgctggga

SEQ ID NO: 9318423 - DNA, 22 bp, Homo sapiens
tttcctctccggggcctccagg

SEQ ID NO: 9318424 - DNA, 22 bp, Homo sapiens
tttcctctgactgctcccctgc

SEQ ID NO: 9318425 - DNA, 22 bp, Homo sapiens
tttcccttctttcctgagtaat

SEQ ID NO: 9318426 - DNA, 22 bp, Homo sapiens
tttccctctgtgccagcttctc

SEQ ID NO: 9318427 - DNA, 17 bp, Homo sapiens
tttccctccttccactc

SEQ ID NO: 9318428 - DNA, 22 bp, Homo sapiens
tttcccttgttccttcctctga

SEQ ID NO: 9318429 - DNA, 22 bp, Homo sapiens
tttccctttgcactctacaatt

SEQ ID NO: 9318430 - DNA, 22 bp, Homo sapiens
tttccctttagcctgagaatcc

SEQ ID NO: 9318431 - DNA, 22 bp, Homo sapiens
tttgctttgtttaaaagtggta

SEQ ID NO: 9318432 - DNA, 22 bp, Homo sapiens
tttgctttgggaggttgtctgg

SEQ ID NO: 9318433 - DNA, 22 bp, Homo sapiens
tttgcttttgtgctctagtggt

SEQ ID NO: 9318434 - DNA, 22 bp, Homo sapiens
tttgcttttgtgctctagtggt

SEQ ID NO: 9318435 - DNA, 22 bp, Homo sapiens
tttgcttttgtgctctagtggt

SEQ ID NO: 9318436 - DNA, 22 bp, Homo sapiens
tttggtgtctgaaaataacagt

SEQ ID NO: 9318437 - DNA, 22 bp, Homo sapiens
tttggtgtctggctgtatggac

SEQ ID NO: 9318438 - DNA, 22 bp, Homo sapiens
tttggttggaaggatggatagc

SEQ ID NO: 9318439 - DNA, 22 bp, Homo sapiens
tttgtaaaagcccaagctgtag

SEQ ID NO: 9318440 - DNA, 22 bp, Homo sapiens
tttggtttgcctgagtaccctc

SEQ ID NO: 9318441 - DNA, 22 bp, Homo sapiens
tttggtttgaatgagcataaga

SEQ ID NO: 9318442 - DNA, 22 bp, Homo sapiens
tttggtttagggtcatttaaca

SEQ ID NO: 9318443 - DNA, 22 bp, Homo sapiens
tttggtattgcacactgtcttc

SEQ ID NO: 9318444 - DNA, 22 bp, Homo sapiens
tttggtaagtacccacctgggt

SEQ ID NO: 9318445 - DNA, 22 bp, Homo sapiens
tttgatttactataagcagcac

SEQ ID NO: 9318446 - DNA, 21 bp, Homo sapiens
tttgattcttcctctccccag

SEQ ID NO: 9318447 - DNA, 22 bp, Homo sapiens
tttgattctcaattgccctctg

SEQ ID NO: 9318448 - DNA, 22 bp, Homo sapiens
tttgattcaaaaaccactccac

SEQ ID NO: 9318449 - DNA, 22 bp, Homo sapiens
tttgattcctggggcagggctg

SEQ ID NO: 9318450 - DNA, 22 bp, Homo sapiens
tttgattctcaattgccctctg

SEQ ID NO: 9318451 - DNA, 22 bp, Homo sapiens
tttgatgaaagctactatttac

SEQ ID NO: 9318452 - DNA, 22 bp, Homo sapiens
tttgatgaacctatataatttg

SEQ ID NO: 9318453 - DNA, 19 bp, Homo sapiens
tttgatgagaatttaagca

SEQ ID NO: 9318454 - DNA, 22 bp, Homo sapiens
tttgctttgggaggttgtctgg

SEQ ID NO: 9318455 - DNA, 22 bp, Homo sapiens
tttgctttgactgtcagcaagt

SEQ ID NO: 9318456 - DNA, 22 bp, Homo sapiens
tttgctttctgttgaacagagt

SEQ ID NO: 9318457 - DNA, 22 bp, Homo sapiens
tttgctttcttgattcagatta

SEQ ID NO: 9318458 - DNA, 22 bp, Homo sapiens
tttgctttcttgattcagatta

SEQ ID NO: 9318459 - DNA, 22 bp, Homo sapiens
tttgctttcttgattcagatta

SEQ ID NO: 9318460 - DNA, 22 bp, Homo sapiens
tttgctttcccttgtagaaagt

SEQ ID NO: 9318461 - DNA, 22 bp, Homo sapiens
tttgcttgttcaagatttctgt

SEQ ID NO: 9318462 - DNA, 18 bp, Homo sapiens
tttgctttccttcttcag

SEQ ID NO: 9318463 - DNA, 18 bp, Homo sapiens
tttgctttccttcttcag

SEQ ID NO: 9318464 - DNA, 22 bp, Homo sapiens
ttttatgtaataaactgtacac

SEQ ID NO: 9318465 - DNA, 20 bp, Homo sapiens
ttttatgtcaccttcctgtc

SEQ ID NO: 9318466 - DNA, 22 bp, Homo sapiens
ttttaatgtgctctgcaatgat

SEQ ID NO: 9318467 - DNA, 22 bp, Homo sapiens
ttttaatgggcgactattatgg

SEQ ID NO: 9318468 - DNA, 22 bp, Homo sapiens
tttgtgtttaatacaaggacct

SEQ ID NO: 9318469 - DNA, 22 bp, Homo sapiens
tttgtgttgttttaagccacta

SEQ ID NO: 9318470 - DNA, 22 bp, Homo sapiens
tttgtgtttatgaagttattct

SEQ ID NO: 9318471 - DNA, 22 bp, Homo sapiens
tttgtgtttgtacaatgcacta

SEQ ID NO: 9318472 - DNA, 22 bp, Homo sapiens
tttgttaaaatgcagattctgt

SEQ ID NO: 9318473 - DNA, 22 bp, Homo sapiens
tttgtgttttagctggtgaggc

SEQ ID NO: 9318474 - DNA, 22 bp, Homo sapiens
tttgtaaaggcctgaatttcag

SEQ ID NO: 9318475 - DNA, 22 bp, Homo sapiens
tttgtaaagtctgttctgagtt

SEQ ID NO: 9318476 - DNA, 22 bp, Homo sapiens
tttgtaaatagcagtactcatg

SEQ ID NO: 9318477 - DNA, 22 bp, Homo sapiens
tttgtaaatagcagtactcatg

SEQ ID NO: 9318478 - DNA, 22 bp, Homo sapiens
tttgtaaaaggaggaagcatgg

SEQ ID NO: 9318479 - DNA, 22 bp, Homo sapiens
tttgtaaaattagggaattcaa

SEQ ID NO: 9318480 - DNA, 22 bp, Homo sapiens
tttgtgtcgtcactgtcttctc

SEQ ID NO: 9318481 - DNA, 22 bp, Homo sapiens
ttttattgcaataaagtgtgta

SEQ ID NO: 9318482 - DNA, 21 bp, Homo sapiens
ttttattgatgaatggccact

SEQ ID NO: 9318483 - DNA, 22 bp, Homo sapiens
ttttattagtggctagatgggg

SEQ ID NO: 9318484 - DNA, 22 bp, Homo sapiens
ttttattagtggctagatgggg

SEQ ID NO: 9318485 - DNA, 22 bp, Homo sapiens
ttttattggagtgataccaagc

SEQ ID NO: 9318486 - DNA, 22 bp, Homo sapiens
ttttattggagtgataccaagc

SEQ ID NO: 9318487 - DNA, 22 bp, Homo sapiens
ttttcatttacattagggaaga

SEQ ID NO: 9318488 - DNA, 22 bp, Homo sapiens
ttttctcttccctctggacctg

SEQ ID NO: 9318489 - DNA, 22 bp, Homo sapiens
ttttctcaagatccaatgcact

SEQ ID NO: 9318490 - DNA, 22 bp, Homo sapiens
ttttctgaagtttaagacattt

SEQ ID NO: 9318491 - DNA, 22 bp, Homo sapiens
ttttcttatggtgaagcacaaa

SEQ ID NO: 9318492 - DNA, 22 bp, Homo sapiens
ttttctgacctatctacattta

SEQ ID NO: 9318493 - DNA, 22 bp, Homo sapiens
ttttctgactctattgaggtat

SEQ ID NO: 9318494 - DNA, 22 bp, Homo sapiens
ttttctgagctcagtgacttac

SEQ ID NO: 9318495 - DNA, 22 bp, Homo sapiens
ttcctgcacagcccttcctgag

SEQ ID NO: 9318496 - DNA, 23 bp, Homo sapiens
ttcctgagtgctggagagagtgc

SEQ ID NO: 9318497 - DNA, 22 bp, Homo sapiens
ttcctgagggccccagaggagg

SEQ ID NO: 9318498 - DNA, 22 bp, Homo sapiens
ttcctgaattgagctttagaaa

SEQ ID NO: 9318499 - DNA, 21 bp, Homo sapiens
ttcctggggacttccgtggga

SEQ ID NO: 9318500 - DNA, 22 bp, Homo sapiens
ttcctggggcgactgtatctga

SEQ ID NO: 9318501 - DNA, 22 bp, Homo sapiens
ttcctgccctgcctgtgccact

SEQ ID NO: 9318502 - DNA, 22 bp, Homo sapiens
ttccttcttccaaacccatcat

SEQ ID NO: 9318503 - DNA, 22 bp, Homo sapiens
ttccttcttcctttagtaacca

SEQ ID NO: 9318504 - DNA, 22 bp, Homo sapiens
ttccttcttgtaatgatctgcc

SEQ ID NO: 9318505 - DNA, 18 bp, Homo sapiens
ttccttctgatgtatatg

SEQ ID NO: 9318506 - DNA, 22 bp, Homo sapiens
ttccttctttgtggtagaaagt

SEQ ID NO: 9318507 - DNA, 22 bp, Homo sapiens
ttcctgggttccctctcattct

SEQ ID NO: 9318508 - DNA, 22 bp, Homo sapiens
ttcctgggttgtgcattgtaca

SEQ ID NO: 9318509 - DNA, 22 bp, Homo sapiens
ttcctgggtttacgtattgggt

SEQ ID NO: 9318510 - DNA, 22 bp, Homo sapiens
ttcctggggtgaagatattttt

SEQ ID NO: 9318511 - DNA, 19 bp, Homo sapiens
ttcctggggttccattgtg

SEQ ID NO: 9318512 - DNA, 22 bp, Homo sapiens
ttcctgggtggtcctggtagag

SEQ ID NO: 9318513 - DNA, 22 bp, Homo sapiens
ttcctggggcttagcaatggag

SEQ ID NO: 9318514 - DNA, 22 bp, Homo sapiens
ttcctggggcttagcaatggag

SEQ ID NO: 9318515 - DNA, 22 bp, Homo sapiens
ttcctgggggcagcagtcttga

SEQ ID NO: 9318516 - DNA, 22 bp, Homo sapiens
ttcctggggctccagctaccag

SEQ ID NO: 9318517 - DNA, 22 bp, Homo sapiens
ttcctggggggatagatttcac

SEQ ID NO: 9318518 - DNA, 22 bp, Homo sapiens
ttcctggggtactggagaaaat

SEQ ID NO: 9318519 - DNA, 22 bp, Homo sapiens
ttctctaatacattttgacaaa

SEQ ID NO: 9318520 - DNA, 22 bp, Homo sapiens
ttctctaagccttagtttcttc

SEQ ID NO: 9318521 - DNA, 22 bp, Homo sapiens
ttctctcccatgaagcttctat

SEQ ID NO: 9318522 - DNA, 22 bp, Homo sapiens
ttctctcctacccagtatccat

SEQ ID NO: 9318523 - DNA, 22 bp, Homo sapiens
ttctctcctcctagaggctttt

SEQ ID NO: 9318524 - DNA, 22 bp, Homo sapiens
ttctctctgagagcatctggaa

SEQ ID NO: 9318525 - DNA, 22 bp, Homo sapiens
ttctctcccatgaagcttctat

SEQ ID NO: 9318526 - DNA, 21 bp, Homo sapiens
ttctctccatatgcccagccc

SEQ ID NO: 9318527 - DNA, 22 bp, Homo sapiens
ttctctcattcaaattaaagtg

SEQ ID NO: 9318528 - DNA, 22 bp, Homo sapiens
ttctctccagactgcagtgggt

SEQ ID NO: 9318529 - DNA, 22 bp, Homo sapiens
ttctctgcagcttaggcccagt

SEQ ID NO: 9318530 - DNA, 22 bp, Homo sapiens
ttctctgcattgtaaagagcca

SEQ ID NO: 9318531 - DNA, 22 bp, Homo sapiens
ttctctgcagctcctggctggg

SEQ ID NO: 9318532 - DNA, 22 bp, Homo sapiens
ttctctgcctcacaggtctaag

SEQ ID NO: 9318533 - DNA, 22 bp, Homo sapiens
ttctctgctctcacatacagaa

SEQ ID NO: 9318534 - DNA, 22 bp, Homo sapiens
ttctctcctcctagaggctttt

SEQ ID NO: 9318535 - DNA, 22 bp, Homo sapiens
ttctctctgtggtcccattttg

SEQ ID NO: 9318536 - DNA, 22 bp, Homo sapiens
ttctctcttactgccatgctgt

SEQ ID NO: 9318537 - DNA, 22 bp, Homo sapiens
ttctctcttactgccatgctgt

SEQ ID NO: 9318538 - DNA, 22 bp, Homo sapiens
ttctctcttactgccatgctgt

SEQ ID NO: 9318539 - DNA, 22 bp, Homo sapiens
ttctctcttccagttcccactt

SEQ ID NO: 9318540 - DNA, 22 bp, Homo sapiens
ttctctcttccagttcccactt

SEQ ID NO: 9318541 - DNA, 22 bp, Homo sapiens
ttctcaggactcctgcctgctt

SEQ ID NO: 9318542 - DNA, 22 bp, Homo sapiens
ttctcaggctgtggagccgtct

SEQ ID NO: 9318543 - DNA, 22 bp, Homo sapiens
ttctcagggcatctcatgaccc

SEQ ID NO: 9318544 - DNA, 22 bp, Homo sapiens
ttctcctctgttggccttccct

SEQ ID NO: 9318545 - DNA, 23 bp, Homo sapiens
ttctcctgaggaagcagggactg

SEQ ID NO: 9318546 - DNA, 22 bp, Homo sapiens
ttctcctgagttcccaggtcta

SEQ ID NO: 9318547 - DNA, 22 bp, Homo sapiens
ttctccaaggatacagtcctgt

SEQ ID NO: 9318548 - DNA, 22 bp, Homo sapiens
ttctcagggtttgtgcaggctt

SEQ ID NO: 9318549 - DNA, 22 bp, Homo sapiens
ttctcagggttggcctcaaatc

SEQ ID NO: 9318550 - DNA, 22 bp, Homo sapiens
ttctgtctgtaaacttctcaat

SEQ ID NO: 9318551 - DNA, 22 bp, Homo sapiens
ttctgtctggaaaaggacatag

SEQ ID NO: 9318552 - DNA, 22 bp, Homo sapiens
ttctgtctggaaaaggacatag

SEQ ID NO: 9318553 - DNA, 22 bp, Homo sapiens
ttctgtacccaacatttttact

SEQ ID NO: 9318554 - DNA, 22 bp, Homo sapiens
ttctgtacaagttgtggctgct

SEQ ID NO: 9318555 - DNA, 22 bp, Homo sapiens
ttctgttacaagtgaaaaaatg

SEQ ID NO: 9318556 - DNA, 22 bp, Homo sapiens
ttcttatagaagcaaccattgt

SEQ ID NO: 9318557 - DNA, 22 bp, Homo sapiens
ttcttttgggaattacgtatgc

SEQ ID NO: 9318558 - DNA, 22 bp, Homo sapiens
ttcttttggactcaaagagaac

SEQ ID NO: 9318559 - DNA, 22 bp, Homo sapiens
ttcttttgcaagactattgatt

SEQ ID NO: 9318560 - DNA, 22 bp, Homo sapiens
ttcttcaaaacaacactggcct

SEQ ID NO: 9318561 - DNA, 22 bp, Homo sapiens
ttcttattcttgaaatgtggga

SEQ ID NO: 9318562 - DNA, 22 bp, Homo sapiens
ttcttcaacaaggacactgtta

SEQ ID NO: 9318563 - DNA, 20 bp, Homo sapiens
ttctttgttccttacatttg

SEQ ID NO: 9318564 - DNA, 22 bp, Homo sapiens
ttctttgtttgataagtatgct

SEQ ID NO: 9318565 - DNA, 22 bp, Homo sapiens
ttctttgttgtactttcctaca

SEQ ID NO: 9318566 - DNA, 22 bp, Homo sapiens
ttctttgtagcaaaacgtgtat

SEQ ID NO: 9318567 - DNA, 22 bp, Homo sapiens
ttctttgtgcatccaattttct

SEQ ID NO: 9318568 - DNA, 22 bp, Homo sapiens
ttcttttaaaagagagcagaaa

SEQ ID NO: 9318569 - DNA, 22 bp, Homo sapiens
ttcttttaatgttctgaagttt

SEQ ID NO: 9318570 - DNA, 22 bp, Homo sapiens
ttcataatcaccaaaaactgga

SEQ ID NO: 9318571 - DNA, 22 bp, Homo sapiens
ttcatttattcagcaggtattt

SEQ ID NO: 9318572 - DNA, 22 bp, Homo sapiens
ttcatttgcactggattactgg

SEQ ID NO: 9318573 - DNA, 22 bp, Homo sapiens
ttcatttaatttgtgtattaac

SEQ ID NO: 9318574 - DNA, 23 bp, Homo sapiens
ttccaggcagagcagggattaga

SEQ ID NO: 9318575 - DNA, 22 bp, Homo sapiens
ttccaggcagaacaatcatgct

SEQ ID NO: 9318576 - DNA, 22 bp, Homo sapiens
ttccaggcacatcccaactcca

SEQ ID NO: 9318577 - DNA, 22 bp, Homo sapiens
ttcattttctttcacgctgctg

SEQ ID NO: 9318578 - DNA, 22 bp, Homo sapiens
ttcatttgttgacagagacatg

SEQ ID NO: 9318579 - DNA, 20 bp, Homo sapiens
ttcatttgggaaaatctgcg

SEQ ID NO: 9318580 - DNA, 22 bp, Homo sapiens
ttcatttggcctctgcttaaaa

SEQ ID NO: 9318581 - DNA, 22 bp, Homo sapiens
ttcatttgtctgctatagatcc

SEQ ID NO: 9318582 - DNA, 22 bp, Homo sapiens
ttcatttgtggtgaatgaagtg

SEQ ID NO: 9318583 - DNA, 22 bp, Homo sapiens
ttcatttgtggttatttacaat

SEQ ID NO: 9318584 - DNA, 22 bp, Homo sapiens
ttcatttgtccaaatactatgt

SEQ ID NO: 9318585 - DNA, 22 bp, Homo sapiens
ttccaggctgatgggccacagg

SEQ ID NO: 9318586 - DNA, 22 bp, Homo sapiens
ttccaggctgcacagttgggac

SEQ ID NO: 9318587 - DNA, 22 bp, Homo sapiens
ttccaggctgcagttttctagt

SEQ ID NO: 9318588 - DNA, 22 bp, Homo sapiens
ttccaggctgcagttgtagtta

SEQ ID NO: 9318589 - DNA, 22 bp, Homo sapiens
ttccaggcttctctggggcgtc

SEQ ID NO: 9318590 - DNA, 22 bp, Homo sapiens
ttccaggcatgtcagacatagg

SEQ ID NO: 9318591 - DNA, 22 bp, Homo sapiens
ttccaggcattacagggtttgc

SEQ ID NO: 9318592 - DNA, 22 bp, Homo sapiens
ttccaggcattaaagtttctcc

SEQ ID NO: 9318593 - DNA, 22 bp, Homo sapiens
ttccaggctatccggtgaaggg

SEQ ID NO: 9318594 - DNA, 22 bp, Homo sapiens
ttccaggctattccctttggag

SEQ ID NO: 9318595 - DNA, 22 bp, Homo sapiens
ttccaggcgcacgtcggcctta

SEQ ID NO: 9318596 - DNA, 22 bp, Homo sapiens
ttccaggccagaatggtcacat

SEQ ID NO: 9318597 - DNA, 22 bp, Homo sapiens
ttccaggctcccttggaggtgt

SEQ ID NO: 9318598 - DNA, 22 bp, Homo sapiens
ttccaggctcctgcagtttcta

SEQ ID NO: 9318599 - DNA, 22 bp, Homo sapiens
ttccaggctcttccaggctgtc

SEQ ID NO: 9318600 - DNA, 20 bp, Homo sapiens
ttcagagatagggtctttaa

SEQ ID NO: 9318601 - DNA, 22 bp, Homo sapiens
ttcagagatggaaggcagaatg

SEQ ID NO: 9318602 - DNA, 22 bp, Homo sapiens
ttcagagatgacacctggtgtt

SEQ ID NO: 9318603 - DNA, 22 bp, Homo sapiens
ttcagagagtttgtgagtcctt

SEQ ID NO: 9318604 - DNA, 22 bp, Homo sapiens
ttcagagagtccagtatgcagt

SEQ ID NO: 9318605 - DNA, 22 bp, Homo sapiens
ttcagagaagtgcacaaaatca

SEQ ID NO: 9318606 - DNA, 22 bp, Homo sapiens
ttcagagacagcaaccaggaca

SEQ ID NO: 9318607 - DNA, 22 bp, Homo sapiens
ttcagagaattggataattcgt

SEQ ID NO: 9318608 - DNA, 22 bp, Homo sapiens
ttcagagagaaaccagtgggaa

SEQ ID NO: 9318609 - DNA, 22 bp, Homo sapiens
ttcagagacatgttctagatca

SEQ ID NO: 9318610 - DNA, 22 bp, Homo sapiens
ttcagagagtacagttgctggc

SEQ ID NO: 9318611 - DNA, 22 bp, Homo sapiens
ttcagagagaccaagtggcgtg

SEQ ID NO: 9318612 - DNA, 22 bp, Homo sapiens
ttcacagggcagcagctgagcc

SEQ ID NO: 9318613 - DNA, 22 bp, Homo sapiens
ttcacaggcttggaggtggggg

SEQ ID NO: 9318614 - DNA, 22 bp, Homo sapiens
ttcacagggcagatcatttctg

SEQ ID NO: 9318615 - DNA, 22 bp, Homo sapiens
ttcacaggtgactggggataac

SEQ ID NO: 9318616 - DNA, 22 bp, Homo sapiens
ttcacaggatagctattgcacg

SEQ ID NO: 9318617 - DNA, 22 bp, Homo sapiens
ttcacaggaatgtaggggtctt

SEQ ID NO: 9318618 - DNA, 22 bp, Homo sapiens
ttcacaggtgagcattaggccg

SEQ ID NO: 9318619 - DNA, 22 bp, Homo sapiens
ttcacagggccactggcaggag

SEQ ID NO: 9318620 - DNA, 22 bp, Homo sapiens
ttcagagaaactgaggtttaga

SEQ ID NO: 9318621 - DNA, 22 bp, Homo sapiens
ttcagagaagcaaaggcagatt

SEQ ID NO: 9318622 - DNA, 22 bp, Homo sapiens
ttcagagaaaggaaagccggat

SEQ ID NO: 9318623 - DNA, 22 bp, Homo sapiens
ttcagagaaagcagatttactc

SEQ ID NO: 9318624 - DNA, 22 bp, Homo sapiens
ttcagagaacttcatggaagag

SEQ ID NO: 9318625 - DNA, 18 bp, Homo sapiens
ttcagcagcagacacact

SEQ ID NO: 9318626 - DNA, 22 bp, Homo sapiens
ttcagcactttgttttgctcat

SEQ ID NO: 9318627 - DNA, 22 bp, Homo sapiens
ttcagcacctggaatagcacct

SEQ ID NO: 9318628 - DNA, 22 bp, Homo sapiens
ttcagcactgactgagtggtta

SEQ ID NO: 9318629 - DNA, 22 bp, Homo sapiens
ttcagcactgttatggatttgc

SEQ ID NO: 9318630 - DNA, 22 bp, Homo sapiens
ttcagcactggacagcgagtct

SEQ ID NO: 9318631 - DNA, 22 bp, Homo sapiens
ttcagcaccacttccagagaag

SEQ ID NO: 9318632 - DNA, 22 bp, Homo sapiens
ttcagcacagttcaagatggta

SEQ ID NO: 9318633 - DNA, 22 bp, Homo sapiens
ttcagcaccctctgaggcatcc

SEQ ID NO: 9318634 - DNA, 22 bp, Homo sapiens
ttcagcacaagactagacaggt

SEQ ID NO: 9318635 - DNA, 22 bp, Homo sapiens
ttcagagccacttcaagtctaa

SEQ ID NO: 9318636 - DNA, 22 bp, Homo sapiens
ttcagagctggtgtctacagct

SEQ ID NO: 9318637 - DNA, 22 bp, Homo sapiens
ttcaaagattttcccaaagctc

SEQ ID NO: 9318638 - DNA, 21 bp, Homo sapiens
ttcaaagacttgatgctgacc

SEQ ID NO: 9318639 - DNA, 18 bp, Homo sapiens
ttcacaggaaatgtcttt

SEQ ID NO: 9318640 - DNA, 22 bp, Homo sapiens
ttatatctttttacatctctcc

SEQ ID NO: 9318641 - DNA, 22 bp, Homo sapiens
ttatatctttttacatctctcc

SEQ ID NO: 9318642 - DNA, 22 bp, Homo sapiens
ttatatccaaaggcaaggagga

SEQ ID NO: 9318643 - DNA, 22 bp, Homo sapiens
ttatatatcttgatttgttcca

SEQ ID NO: 9318644 - DNA, 22 bp, Homo sapiens
ttatatatatgtagaggtcacg

SEQ ID NO: 9318645 - DNA, 22 bp, Homo sapiens
ttattagctgggcttcagggtg

SEQ ID NO: 9318646 - DNA, 22 bp, Homo sapiens
ttattatagattatgcaagatt

SEQ ID NO: 9318647 - DNA, 22 bp, Homo sapiens
ttattgggtcccaacaagttgc

SEQ ID NO: 9318648 - DNA, 22 bp, Homo sapiens
ttattgtaggcctattgtagaa

SEQ ID NO: 9318649 - DNA, 22 bp, Homo sapiens
ttattgctctattatggcctaa

SEQ ID NO: 9318650 - DNA, 22 bp, Homo sapiens
ttattgctatggtgagagggat

SEQ ID NO: 9318651 - DNA, 22 bp, Homo sapiens
ttattgcttttgtgcaggtgag

SEQ ID NO: 9318652 - DNA, 22 bp, Homo sapiens
ttattgctggcaccttcaattc

SEQ ID NO: 9318653 - DNA, 23 bp, Homo sapiens
ttattgctttccctgccttcctg

SEQ ID NO: 9318654 - DNA, 23 bp, Homo sapiens
ttattgctttccctgccttcctg

SEQ ID NO: 9318655 - DNA, 22 bp, Homo sapiens
ttattgtgaggaataagtgaga

SEQ ID NO: 9318656 - DNA, 22 bp, Homo sapiens
ttattgtggactactgttctgg

SEQ ID NO: 9318657 - DNA, 22 bp, Homo sapiens
ttagccattttattcagcaggt

SEQ ID NO: 9318658 - DNA, 22 bp, Homo sapiens
ttagccttagaagcttagcaaa

SEQ ID NO: 9318659 - DNA, 22 bp, Homo sapiens
ttagccatttgaggtcttcatt

SEQ ID NO: 9318660 - DNA, 22 bp, Homo sapiens
ttagctagttattatcaaatga

SEQ ID NO: 9318661 - DNA, 22 bp, Homo sapiens
ttagcttaattaaataatcagt

SEQ ID NO: 9318662 - DNA, 22 bp, Homo sapiens
ttagctttagagccattactgg

SEQ ID NO: 9318663 - DNA, 22 bp, Homo sapiens
ttagctttatatatttggatcg

SEQ ID NO: 9318664 - DNA, 22 bp, Homo sapiens
ttagctttagagccattactgg

SEQ ID NO: 9318665 - DNA, 22 bp, Homo sapiens
ttagctttcagcctttctcacc

SEQ ID NO: 9318666 - DNA, 22 bp, Homo sapiens
ttagctttcagcctttctcacc

SEQ ID NO: 9318667 - DNA, 22 bp, Homo sapiens
ttagctgactgtgtgatttggc

SEQ ID NO: 9318668 - DNA, 22 bp, Homo sapiens
ttagcttaattaaataatcagt

SEQ ID NO: 9318669 - DNA, 22 bp, Homo sapiens
tcctgctggaaacttcctcttg

SEQ ID NO: 9318670 - DNA, 22 bp, Homo sapiens
tcctgctggactctgagtacaa

SEQ ID NO: 9318671 - DNA, 21 bp, Homo sapiens
tcctgctgctcctgtcgtgtt

SEQ ID NO: 9318672 - DNA, 18 bp, Homo sapiens
tcctgcctgtgccccagg

SEQ ID NO: 9318673 - DNA, 22 bp, Homo sapiens
tcctgcctgtttacctgtactt

SEQ ID NO: 9318674 - DNA, 19 bp, Homo sapiens
tcctgcctggggccgcctg

SEQ ID NO: 9318675 - DNA, 18 bp, Homo sapiens
tcctgcctgcgggctccc

SEQ ID NO: 9318676 - DNA, 20 bp, Homo sapiens
tcctgctgaccttcacaagc

SEQ ID NO: 9318677 - DNA, 22 bp, Homo sapiens
tcctgctgctacctggcccacg

SEQ ID NO: 9318678 - DNA, 22 bp, Homo sapiens
tcctgctgagcatgttctgccc

SEQ ID NO: 9318679 - DNA, 22 bp, Homo sapiens
tcctgctgagcgtctgtcattt

SEQ ID NO: 9318680 - DNA, 20 bp, Homo sapiens
tcctgctgccacctcttctt

SEQ ID NO: 9318681 - DNA, 22 bp, Homo sapiens
ttagctttgaattccatggagg

SEQ ID NO: 9318682 - DNA, 22 bp, Homo sapiens
ttagctttcttggagaattaca

SEQ ID NO: 9318683 - DNA, 22 bp, Homo sapiens
ttagctttctttggcagacgtg

SEQ ID NO: 9318684 - DNA, 21 bp, Homo sapiens
ttagctttctagaatctttgt

SEQ ID NO: 9318685 - DNA, 22 bp, Homo sapiens
ttagctttcatgaacctggtcg

SEQ ID NO: 9318686 - DNA, 21 bp, Homo sapiens
ttagctttctagaatctttgt

SEQ ID NO: 9318687 - DNA, 22 bp, Homo sapiens
ttagctttcctactaataaata

SEQ ID NO: 9318688 - DNA, 20 bp, Homo sapiens
ttagctttggcaatagtgac

SEQ ID NO: 9318689 - DNA, 20 bp, Homo sapiens
ttagctttggcaatagtgac

SEQ ID NO: 9318690 - DNA, 22 bp, Homo sapiens
ttagctttggattgcatttagt

SEQ ID NO: 9318691 - DNA, 22 bp, Homo sapiens
ttagcttttaagtgtgctacat

SEQ ID NO: 9318692 - DNA, 22 bp, Homo sapiens
ttagcttttaagtgtgctacat

SEQ ID NO: 9318693 - DNA, 22 bp, Homo sapiens
ttagcttttgagaatgatttct

SEQ ID NO: 9318694 - DNA, 22 bp, Homo sapiens
ttagcttttcacttgcattatc

SEQ ID NO: 9318695 - DNA, 22 bp, Homo sapiens
ttagcttttctctatgttggct

SEQ ID NO: 9318696 - DNA, 22 bp, Homo sapiens
ttagcttttcacttgcattatc

SEQ ID NO: 9318697 - DNA, 22 bp, Homo sapiens
ttagcttttttgcagatgtcct

SEQ ID NO: 9318698 - DNA, 22 bp, Homo sapiens
ttaggaaaatcatgagagatga

SEQ ID NO: 9318699 - DNA, 22 bp, Homo sapiens
ttatacatgtgttttgagatga

SEQ ID NO: 9318700 - DNA, 22 bp, Homo sapiens
ttatagtatgtgcatatgtgtg

SEQ ID NO: 9318701 - DNA, 22 bp, Homo sapiens
ttatagtatgtgcatatgtgtg

SEQ ID NO: 9318702 - DNA, 22 bp, Homo sapiens
ttataggcttagttctgtgtgt

SEQ ID NO: 9318703 - DNA, 22 bp, Homo sapiens
ttatactaaaacgcattgaatt

SEQ ID NO: 9318704 - DNA, 22 bp, Homo sapiens
ttatactttatactacatcatt

SEQ ID NO: 9318705 - DNA, 22 bp, Homo sapiens
ttatagaatccagttgttgtat

SEQ ID NO: 9318706 - DNA, 21 bp, Homo sapiens
tttcagacctatctttgaagg

SEQ ID NO: 9318707 - DNA, 22 bp, Homo sapiens
tttcagactgctgtgtgaaact

SEQ ID NO: 9318708 - DNA, 22 bp, Homo sapiens
tttcacagctagtgagcttcta

SEQ ID NO: 9318709 - DNA, 22 bp, Homo sapiens
tttcacagcatataggtgtact

SEQ ID NO: 9318710 - DNA, 22 bp, Homo sapiens
tttcacatttgttttaagaagt

SEQ ID NO: 9318711 - DNA, 22 bp, Homo sapiens
tttcattcagcaccctgaggtg

SEQ ID NO: 9318712 - DNA, 22 bp, Homo sapiens
tttcattatacagcttcataaa

SEQ ID NO: 9318713 - DNA, 22 bp, Homo sapiens
tttcatgatccatttacaaaat

SEQ ID NO: 9318714 - DNA, 22 bp, Homo sapiens
tttcatgatccatttacaaaat

SEQ ID NO: 9318715 - DNA, 22 bp, Homo sapiens
tttcatgagtggaagaagtgta

SEQ ID NO: 9318716 - DNA, 22 bp, Homo sapiens
tttcatgaggtctttcagcaag

SEQ ID NO: 9318717 - DNA, 22 bp, Homo sapiens
tttcatgaggtctttcagcaag

SEQ ID NO: 9318718 - DNA, 22 bp, Homo sapiens
tttcatgaggggcaaaatctca

SEQ ID NO: 9318719 - DNA, 22 bp, Homo sapiens
tttcatgaggctgcataaggag

SEQ ID NO: 9318720 - DNA, 22 bp, Homo sapiens
tttcatcttgattctatatggc

SEQ ID NO: 9318721 - DNA, 22 bp, Homo sapiens
tttattgacccaaagcgagagt

SEQ ID NO: 9318722 - DNA, 22 bp, Homo sapiens
tttattgcactgtctcaatacc

SEQ ID NO: 9318723 - DNA, 23 bp, Homo sapiens
tttcaacaatgcttagagaaaac

SEQ ID NO: 9318724 - DNA, 22 bp, Homo sapiens
tttattctaacttgctgctcta

SEQ ID NO: 9318725 - DNA, 22 bp, Homo sapiens
tttattctaacttgctgctcta

SEQ ID NO: 9318726 - DNA, 22 bp, Homo sapiens
tttattctataggcattaagca

SEQ ID NO: 9318727 - DNA, 21 bp, Homo sapiens
tttattctcagatacagggag

SEQ ID NO: 9318728 - DNA, 22 bp, Homo sapiens
tttattctagctcagaatagtt

SEQ ID NO: 9318729 - DNA, 22 bp, Homo sapiens
tttattctagctcagaatagtt

SEQ ID NO: 9318730 - DNA, 22 bp, Homo sapiens
tttattcttgagagtgagaaga

SEQ ID NO: 9318731 - DNA, 22 bp, Homo sapiens
tttattctgtgctacatgaaga

SEQ ID NO: 9318732 - DNA, 21 bp, Homo sapiens
tttattctcagatacagggag

SEQ ID NO: 9318733 - DNA, 23 bp, Homo sapiens
tttattctcagatacataggtct

SEQ ID NO: 9318734 - DNA, 22 bp, Homo sapiens
tttattctctagttggtcagat

SEQ ID NO: 9318735 - DNA, 22 bp, Homo sapiens
tttcacagatcctacagcttgt

SEQ ID NO: 9318736 - DNA, 22 bp, Homo sapiens
tttcacagatataagatttcac

SEQ ID NO: 9318737 - DNA, 23 bp, Homo sapiens
tttcacagaaggattgtagggcc

SEQ ID NO: 9318738 - DNA, 23 bp, Homo sapiens
tttcacagaaggattgtagggcc

SEQ ID NO: 9318739 - DNA, 22 bp, Homo sapiens
tttcacagaaagaagctagttt

SEQ ID NO: 9318740 - DNA, 22 bp, Homo sapiens
tttcacaatgcaatcctacttc

SEQ ID NO: 9318741 - DNA, 20 bp, Homo sapiens
tttcacaatgaacatgtctc

SEQ ID NO: 9318742 - DNA, 22 bp, Homo sapiens
tttcaagaacagcagcattcca

SEQ ID NO: 9318743 - DNA, 22 bp, Homo sapiens
tttcaagcagcgtgaaaaacga

SEQ ID NO: 9318744 - DNA, 22 bp, Homo sapiens
tttaatgatagctgtttcacat

SEQ ID NO: 9318745 - DNA, 22 bp, Homo sapiens
tttaatgatagtcttacgaaaa

SEQ ID NO: 9318746 - DNA, 22 bp, Homo sapiens
tttaaggatgatgtgatatata

SEQ ID NO: 9318747 - DNA, 22 bp, Homo sapiens
tttaaggcagtgaaactattct

SEQ ID NO: 9318748 - DNA, 22 bp, Homo sapiens
tttaatcttcaaaatagtctta

SEQ ID NO: 9318749 - DNA, 22 bp, Homo sapiens
tttaatctcccactctcagcct

SEQ ID NO: 9318750 - DNA, 22 bp, Homo sapiens
tttaaggaaaaaatgtacttag

SEQ ID NO: 9318751 - DNA, 22 bp, Homo sapiens
tttaaagtggtccatttcagaa

SEQ ID NO: 9318752 - DNA, 22 bp, Homo sapiens
tttaaactgttgattttatgaa

SEQ ID NO: 9318753 - DNA, 22 bp, Homo sapiens
tttaaacatcttgttgccttaa

SEQ ID NO: 9318754 - DNA, 22 bp, Homo sapiens
ttgtgtgtagactcagccattg

SEQ ID NO: 9318755 - DNA, 17 bp, Homo sapiens
ttgtgtgtagttctgat

SEQ ID NO: 9318756 - DNA, 22 bp, Homo sapiens
ttgtgtgtactggttatgggca

SEQ ID NO: 9318757 - DNA, 20 bp, Homo sapiens
tttacattttgaaacagtga

SEQ ID NO: 9318758 - DNA, 22 bp, Homo sapiens
tttacagtgagagcttagtgag

SEQ ID NO: 9318759 - DNA, 22 bp, Homo sapiens
tttaccaaatgagactattgtt

SEQ ID NO: 9318760 - DNA, 22 bp, Homo sapiens
tttaccaagctttaattacata

SEQ ID NO: 9318761 - DNA, 22 bp, Homo sapiens
tttagcaaggagaaataatcct

SEQ ID NO: 9318762 - DNA, 17 bp, Homo sapiens
tttagaggataagcccc

SEQ ID NO: 9318763 - DNA, 22 bp, Homo sapiens
tttagaggtctgtttcacatca

SEQ ID NO: 9318764 - DNA, 22 bp, Homo sapiens
tttagaggctgcctatcacaac

SEQ ID NO: 9318765 - DNA, 22 bp, Homo sapiens
tttagagcccatgtgagtgtga

SEQ ID NO: 9318766 - DNA, 22 bp, Homo sapiens
tttagcaatatcataaggaaga

SEQ ID NO: 9318767 - DNA, 22 bp, Homo sapiens
tttagcatatcctataaaacta

SEQ ID NO: 9318768 - DNA, 22 bp, Homo sapiens
tttatctgagctgatagatagt

SEQ ID NO: 9318769 - DNA, 22 bp, Homo sapiens
tttatctcttttgaccaagatt

SEQ ID NO: 9318770 - DNA, 22 bp, Homo sapiens
ttggcagtaaaagaaaatgctt

SEQ ID NO: 9318771 - DNA, 17 bp, Homo sapiens
ttgggagagaaaggtat

SEQ ID NO: 9318772 - DNA, 22 bp, Homo sapiens
ttgggagatattgttctttaca

SEQ ID NO: 9318773 - DNA, 22 bp, Homo sapiens
ttgggagacaaaggctctgtct

SEQ ID NO: 9318774 - DNA, 22 bp, Homo sapiens
ttgggagatagggtaatttagc

SEQ ID NO: 9318775 - DNA, 22 bp, Homo sapiens
ttgggagatggggagataatat

SEQ ID NO: 9318776 - DNA, 22 bp, Homo sapiens
ttgggagattcattgagccaag

SEQ ID NO: 9318777 - DNA, 17 bp, Homo sapiens
ttgggagagaaaggtat

SEQ ID NO: 9318778 - DNA, 22 bp, Homo sapiens
ttgggagaaggctgggacttta

SEQ ID NO: 9318779 - DNA, 22 bp, Homo sapiens
ttggcataccttagtggtggag

SEQ ID NO: 9318780 - DNA, 22 bp, Homo sapiens
ttggcatcagtgtaggacctgt

SEQ ID NO: 9318781 - DNA, 22 bp, Homo sapiens
ttggccagtggaaagaggagga

SEQ ID NO: 9318782 - DNA, 22 bp, Homo sapiens
ttggccatctaagcccagccac

SEQ ID NO: 9318783 - DNA, 22 bp, Homo sapiens
ttgtcacatgtagttcattctc

SEQ ID NO: 9318784 - DNA, 22 bp, Homo sapiens
ttgtacaagtattatgtgaaca

SEQ ID NO: 9318785 - DNA, 22 bp, Homo sapiens
ttgtacaagtattatgtgaaca

SEQ ID NO: 9318786 - DNA, 21 bp, Homo sapiens
ttgtaccttagagcacaccct

SEQ ID NO: 9318787 - DNA, 22 bp, Homo sapiens
ttgtacctttgcagccccaggt

SEQ ID NO: 9318788 - DNA, 22 bp, Homo sapiens
ttgtacctaaaggtaaatgggc

SEQ ID NO: 9318789 - DNA, 23 bp, Homo sapiens
ttgtacctaattactagttccag

SEQ ID NO: 9318790 - DNA, 22 bp, Homo sapiens
ttgtacctcttacctctatagc

SEQ ID NO: 9318791 - DNA, 22 bp, Homo sapiens
ttgtaaacatctgttgcttaga

SEQ ID NO: 9318792 - DNA, 22 bp, Homo sapiens
ttgtaaatgaccttttctaatt

SEQ ID NO: 9318793 - DNA, 22 bp, Homo sapiens
ttgtaaaggctgttattgactt

SEQ ID NO: 9318794 - DNA, 22 bp, Homo sapiens
ttgtaacttgtgattataatct

SEQ ID NO: 9318795 - DNA, 22 bp, Homo sapiens
ttgtaacacttttctattaata

SEQ ID NO: 9318796 - DNA, 22 bp, Homo sapiens
ttgtaacagctgcttaatagag

SEQ ID NO: 9318797 - DNA, 22 bp, Homo sapiens
ttgctgacctttgctctccgtt

SEQ ID NO: 9318798 - DNA, 22 bp, Homo sapiens
ttgctgaattgaatcctttggt

SEQ ID NO: 9318799 - DNA, 22 bp, Homo sapiens
ttgcttatagagagtttcatac

SEQ ID NO: 9318800 - DNA, 21 bp, Homo sapiens
ttgcttatggcactgctttgc

SEQ ID NO: 9318801 - DNA, 22 bp, Homo sapiens
ttgctgtttaatgatgtcttat

SEQ ID NO: 9318802 - DNA, 22 bp, Homo sapiens
ttgctgttttacatctggtggg

SEQ ID NO: 9318803 - DNA, 22 bp, Homo sapiens
ttgctgtttctctgtgtctggt

SEQ ID NO: 9318804 - DNA, 22 bp, Homo sapiens
ttgctgaaaacagtgggtattg

SEQ ID NO: 9318805 - DNA, 22 bp, Homo sapiens
ttgctgaaaagctggcctttgt

SEQ ID NO: 9318806 - DNA, 22 bp, Homo sapiens
ttgctgaaaacaggtcatcagg

SEQ ID NO: 9318807 - DNA, 22 bp, Homo sapiens
ttgctcttgaaaattgatgctg

SEQ ID NO: 9318808 - DNA, 22 bp, Homo sapiens
ttgctgaaccctgccctctaat

SEQ ID NO: 9318809 - DNA, 22 bp, Homo sapiens
ttgctgaaatctatgacatcct

SEQ ID NO: 9318810 - DNA, 22 bp, Homo sapiens
ttgctgaaagtggcaagaagta

SEQ ID NO: 9318811 - DNA, 22 bp, Homo sapiens
ttgctgaaaggtagctgtgtgg

SEQ ID NO: 9318812 - DNA, 22 bp, Homo sapiens
ttgctgaagtattgtgaatcct

SEQ ID NO: 9318813 - DNA, 22 bp, Homo sapiens
ttgctgaaggcctcttggggtt

SEQ ID NO: 9318814 - DNA, 22 bp, Homo sapiens
ttgctgaagtatgaaaaagaca

SEQ ID NO: 9318815 - DNA, 22 bp, Homo sapiens
ttgctgaagaaaaaatatgtta

SEQ ID NO: 9318816 - DNA, 22 bp, Homo sapiens
ttgctgaagctgccaaaccagt

SEQ ID NO: 9318817 - DNA, 19 bp, Homo sapiens
ttgctgaaggaagcctctg

SEQ ID NO: 9318818 - DNA, 22 bp, Homo sapiens
ttgctgaagttaatgcttgcaa

SEQ ID NO: 9318819 - DNA, 22 bp, Homo sapiens
ttgctgaagtgaaggtatgttt

SEQ ID NO: 9318820 - DNA, 22 bp, Homo sapiens
ttgctgaatgcaagttggatag

SEQ ID NO: 9318821 - DNA, 22 bp, Homo sapiens
ttgctgaagttgctcagctcca

SEQ ID NO: 9318822 - DNA, 22 bp, Homo sapiens
ttgcatttatagactgccattt

SEQ ID NO: 9318823 - DNA, 22 bp, Homo sapiens
ttgcattagtgtcataaggtgg

SEQ ID NO: 9318824 - DNA, 22 bp, Homo sapiens
ttgctttccgtcatgtgctaat

SEQ ID NO: 9318825 - DNA, 22 bp, Homo sapiens
ttgctttccgtcatgtgctaat

SEQ ID NO: 9318826 - DNA, 22 bp, Homo sapiens
ttgctttccgtcatgtgctaat

SEQ ID NO: 9318827 - DNA, 22 bp, Homo sapiens
ttgctttattgggtttactgcc

SEQ ID NO: 9318828 - DNA, 22 bp, Homo sapiens
ttgctttatttggcatgccact

SEQ ID NO: 9318829 - DNA, 22 bp, Homo sapiens
ttgcttcactgagttatgcctg

SEQ ID NO: 9318830 - DNA, 22 bp, Homo sapiens
ttgcttcactacttctaggctc

SEQ ID NO: 9318831 - DNA, 22 bp, Homo sapiens
ttgcttcagaagttctgcttgt

SEQ ID NO: 9318832 - DNA, 22 bp, Homo sapiens
ttgcttcagagggagacacttt

SEQ ID NO: 9318833 - DNA, 22 bp, Homo sapiens
ttggaaacgtcaccttttcctt

SEQ ID NO: 9318834 - DNA, 22 bp, Homo sapiens
ttgcagattaaaacactgagct

SEQ ID NO: 9318835 - DNA, 22 bp, Homo sapiens
ttgcagacattccagagctttt

SEQ ID NO: 9318836 - DNA, 22 bp, Homo sapiens
ttgcagacagtgagagtgaaag

SEQ ID NO: 9318837 - DNA, 22 bp, Homo sapiens
ttgcagacttacttcgagaaat

SEQ ID NO: 9318838 - DNA, 22 bp, Homo sapiens
ttgcaattgctatggagagcgt

SEQ ID NO: 9318839 - DNA, 22 bp, Homo sapiens
ttgcaattagttacaaaagtgg

SEQ ID NO: 9318840 - DNA, 22 bp, Homo sapiens
ttgacaaagatatattcatgct

SEQ ID NO: 9318841 - DNA, 22 bp, Homo sapiens
ttgacaaaacaacacagatttc

SEQ ID NO: 9318842 - DNA, 22 bp, Homo sapiens
ttgacaaatacccattagacca

SEQ ID NO: 9318843 - DNA, 22 bp, Homo sapiens
ttgacaaagtttagtaataatc

SEQ ID NO: 9318844 - DNA, 22 bp, Homo sapiens
aataagttgcctgttgaatcat

SEQ ID NO: 9318845 - DNA, 19 bp, Homo sapiens
aataagcttgggtaaaact

SEQ ID NO: 9318846 - DNA, 22 bp, Homo sapiens
aataagctggagctatattgag

SEQ ID NO: 9318847 - DNA, 19 bp, Homo sapiens
aataagcttgggtaaaact

SEQ ID NO: 9318848 - DNA, 22 bp, Homo sapiens
aataagctgctaggaacttagt

SEQ ID NO: 9318849 - DNA, 22 bp, Homo sapiens
actggctgagtttatgttcaca

SEQ ID NO: 9318850 - DNA, 22 bp, Homo sapiens
actggctgagttgcttcagcaa

SEQ ID NO: 9318851 - DNA, 20 bp, Homo sapiens
aataaaagaagccttcaccc

SEQ ID NO: 9318852 - DNA, 22 bp, Homo sapiens
aatagaacaataattgtaaact

SEQ ID NO: 9318853 - DNA, 22 bp, Homo sapiens
actgtaatatggttcttttgat

SEQ ID NO: 9318854 - DNA, 22 bp, Homo sapiens
actgtacaaatattgcaaaata

SEQ ID NO: 9318855 - DNA, 22 bp, Homo sapiens
actgtacaactgctgagcagaa

SEQ ID NO: 9318856 - DNA, 22 bp, Homo sapiens
actgtacacacttctctgtctt

SEQ ID NO: 9318857 - DNA, 22 bp, Homo sapiens
actgtacaacctctgcccctgt

SEQ ID NO: 9318858 - DNA, 22 bp, Homo sapiens
actgtacatatggattctaaga

SEQ ID NO: 9318859 - DNA, 22 bp, Homo sapiens
actgtacacgtgtcatttacag

SEQ ID NO: 9318860 - DNA, 22 bp, Homo sapiens
actgtacacattcgtcaagact

SEQ ID NO: 9318861 - DNA, 22 bp, Homo sapiens
actgtacacagtggtgtactgt

SEQ ID NO: 9318862 - DNA, 22 bp, Homo sapiens
aagtgtttcaataatttggacc

SEQ ID NO: 9318863 - DNA, 22 bp, Homo sapiens
aagtgtgtttccgtgattgagg

SEQ ID NO: 9318864 - DNA, 22 bp, Homo sapiens
aagtgtttaaattatttgcagg

SEQ ID NO: 9318865 - DNA, 22 bp, Homo sapiens
acctgcctcagtgcagctggat

SEQ ID NO: 9318866 - DNA, 22 bp, Homo sapiens
acctgcctctaagcagcaggtg

SEQ ID NO: 9318867 - DNA, 22 bp, Homo sapiens
acctgcctcagtgcagctggat

SEQ ID NO: 9318868 - DNA, 22 bp, Homo sapiens
aagtgtctgatggagcgaaatg

SEQ ID NO: 9318869 - DNA, 22 bp, Homo sapiens
aagtgtctttatatttgagaaa

SEQ ID NO: 9318870 - DNA, 22 bp, Homo sapiens
aagtgtgtattgtttatgctgc

SEQ ID NO: 9318871 - DNA, 22 bp, Homo sapiens
aagttcctcttctctgcaggga

SEQ ID NO: 9318872 - DNA, 22 bp, Homo sapiens
actgcactccagcctgggtgac

SEQ ID NO: 9318873 - DNA, 22 bp, Homo sapiens
actgcagcctttgggctcataa

SEQ ID NO: 9318874 - DNA, 22 bp, Homo sapiens
agaagccactggaggttgagat

SEQ ID NO: 9318875 - DNA, 22 bp, Homo sapiens
aatgaagtgtttagaagtttta

SEQ ID NO: 9318876 - DNA, 17 bp, Homo sapiens
agaactgtagtagctcc

SEQ ID NO: 9318877 - DNA, 22 bp, Homo sapiens
agaacacactgggggaaacaag

SEQ ID NO: 9318878 - DNA, 22 bp, Homo sapiens
agaacgtctttactcttacgaa

SEQ ID NO: 9318879 - DNA, 22 bp, Homo sapiens
agaactgtgccaaaaattttgt

SEQ ID NO: 9318880 - DNA, 22 bp, Homo sapiens
agaagaaagattgaaggttcct

SEQ ID NO: 9318881 - DNA, 22 bp, Homo sapiens
aatgcacaaaggtgtctattgc

SEQ ID NO: 9318882 - DNA, 22 bp, Homo sapiens
aatgcatccctgccaatgcttt

SEQ ID NO: 9318883 - DNA, 22 bp, Homo sapiens
agaaggaaaacctgtcttatgt

SEQ ID NO: 9318884 - DNA, 22 bp, Homo sapiens
agaaggaaggataactgcatta

SEQ ID NO: 9318885 - DNA, 22 bp, Homo sapiens
agaaggaagccaggagggtgca

SEQ ID NO: 9318886 - DNA, 22 bp, Homo sapiens
agaaactgacaggaaatgaatt

SEQ ID NO: 9318887 - DNA, 22 bp, Homo sapiens
aatcctggctgcgttggccagc

SEQ ID NO: 9318888 - DNA, 22 bp, Homo sapiens
actttgtttccatatttgtagc

SEQ ID NO: 9318889 - DNA, 22 bp, Homo sapiens
actttgttgttccttgtctaaa

SEQ ID NO: 9318890 - DNA, 22 bp, Homo sapiens
acttttaaatgagtttcagttg

SEQ ID NO: 9318891 - DNA, 22 bp, Homo sapiens
actttgatctaagtttctttga

SEQ ID NO: 9318892 - DNA, 22 bp, Homo sapiens
actttgttgaagaatatgttag

SEQ ID NO: 9318893 - DNA, 22 bp, Homo sapiens
actttgttctaatagtatctct

SEQ ID NO: 9318894 - DNA, 22 bp, Homo sapiens
actttgttctaatagtatctct

SEQ ID NO: 9318895 - DNA, 22 bp, Homo sapiens
actttgttgatgaaatagtttt

SEQ ID NO: 9318896 - DNA, 22 bp, Homo sapiens
aatagctgattagcctacaata

SEQ ID NO: 9318897 - DNA, 20 bp, Homo sapiens
aatagctgagggcaagagta

SEQ ID NO: 9318898 - DNA, 21 bp, Homo sapiens
aatagctgaggtcacccagcc

SEQ ID NO: 9318899 - DNA, 22 bp, Homo sapiens
aatagcttagtcctgattctgt

SEQ ID NO: 9318900 - DNA, 22 bp, Homo sapiens
aatagctgggacctgaattagc

SEQ ID NO: 9318901 - DNA, 22 bp, Homo sapiens
aatagcttttactcctccgagg

SEQ ID NO: 9318902 - DNA, 22 bp, Homo sapiens
aatagctttctcatgacttcac

SEQ ID NO: 9318903 - DNA, 22 bp, Homo sapiens
aatagcttggacccattgcttt

SEQ ID NO: 9318904 - DNA, 22 bp, Homo sapiens
acatgaaatgcagcctgtaacc

SEQ ID NO: 9318905 - DNA, 22 bp, Homo sapiens
acatgaacattatatcagcaag

SEQ ID NO: 9318906 - DNA, 20 bp, Homo sapiens
acatcctggtgactagaact

SEQ ID NO: 9318907 - DNA, 22 bp, Homo sapiens
aaggcaccataggcaaatccag

SEQ ID NO: 9318908 - DNA, 18 bp, Homo sapiens
aaggcacaggagaacatt

SEQ ID NO: 9318909 - DNA, 22 bp, Homo sapiens
aaggcaaatgtgttcttttagt

SEQ ID NO: 9318910 - DNA, 22 bp, Homo sapiens
aaggcaagttttagttttctgg

SEQ ID NO: 9318911 - DNA, 22 bp, Homo sapiens
aaggaagaagggaagttactta

SEQ ID NO: 9318912 - DNA, 22 bp, Homo sapiens
aagcttcatctgatgccgaact

SEQ ID NO: 9318913 - DNA, 22 bp, Homo sapiens
aagcttcatttcaactcagggg

SEQ ID NO: 9318914 - DNA, 22 bp, Homo sapiens
aagcttacagttccacgtagca

SEQ ID NO: 9318915 - DNA, 22 bp, Homo sapiens
aagcttcacattgaacttgggt

SEQ ID NO: 9318916 - DNA, 22 bp, Homo sapiens
aagcttcaatgagataattgtt

SEQ ID NO: 9318917 - DNA, 22 bp, Homo sapiens
aagcttcagtgtgagcatgtaa

SEQ ID NO: 9318918 - DNA, 22 bp, Homo sapiens
aagcttcatatatgtgtgagtc

SEQ ID NO: 9318919 - DNA, 22 bp, Homo sapiens
aagcttcagttctggggcaatg

SEQ ID NO: 9318920 - DNA, 22 bp, Homo sapiens
aagcttcagtggactgtagtgt

SEQ ID NO: 9318921 - DNA, 22 bp, Homo sapiens
aagcttcaggcccacccatgtc

SEQ ID NO: 9318922 - DNA, 20 bp, Homo sapiens
aagcttcacttcatttgatc

SEQ ID NO: 9318923 - DNA, 22 bp, Homo sapiens
aagctgtgtcctagaggtgtaa

SEQ ID NO: 9318924 - DNA, 22 bp, Homo sapiens
aaggacacaaaacagcagcagt

SEQ ID NO: 9318925 - DNA, 22 bp, Homo sapiens
aaggacaagtagtatttgcatc

SEQ ID NO: 9318926 - DNA, 22 bp, Homo sapiens
aaggacacggggctggctctgg

SEQ ID NO: 9318927 - DNA, 18 bp, Homo sapiens
aaggacacagtccctgct

SEQ ID NO: 9318928 - DNA, 22 bp, Homo sapiens
aaggacaggagaaaacgggatc

SEQ ID NO: 9318929 - DNA, 22 bp, Homo sapiens
aaggacaggcacagtggtggag

SEQ ID NO: 9318930 - DNA, 22 bp, Homo sapiens
aaggaggccctctccttctgga

SEQ ID NO: 9318931 - DNA, 22 bp, Homo sapiens
aaggatgcagggacccaaggct

SEQ ID NO: 9318932 - DNA, 22 bp, Homo sapiens
aaggattagtaggtacagttca

SEQ ID NO: 9318933 - DNA, 16 bp, Homo sapiens
aaggaatgtcattctg

SEQ ID NO: 9318934 - DNA, 17 bp, Homo sapiens
aaggaatgtcagaagtt

SEQ ID NO: 9318935 - DNA, 21 bp, Homo sapiens
aaggaatgaatggatggatga

SEQ ID NO: 9318936 - DNA, 22 bp, Homo sapiens
aaggaatgctctaggagggcag

SEQ ID NO: 9318937 - DNA, 19 bp, Homo sapiens
aaggaatggctttaagtag

SEQ ID NO: 9318938 - DNA, 20 bp, Homo sapiens
aaggaatatttgtatctggg

SEQ ID NO: 9318939 - DNA, 22 bp, Homo sapiens
aaggaagcagcaatgcatgatt

SEQ ID NO: 9318940 - DNA, 22 bp, Homo sapiens
acctctggacactgcatccttc

SEQ ID NO: 9318941 - DNA, 22 bp, Homo sapiens
acctctctgggcctgcttcctg

SEQ ID NO: 9318942 - DNA, 22 bp, Homo sapiens
acctctcagggccttggtttcc

SEQ ID NO: 9318943 - DNA, 22 bp, Homo sapiens
acctctcaggtcttcctcatat

SEQ ID NO: 9318944 - DNA, 22 bp, Homo sapiens
acctctcaggtcttcctcatat

SEQ ID NO: 9318945 - DNA, 22 bp, Homo sapiens
acccagggctcaagcgtaggca

SEQ ID NO: 9318946 - DNA, 22 bp, Homo sapiens
aagtccttggagaatagaaagg

SEQ ID NO: 9318947 - DNA, 22 bp, Homo sapiens
aagtcctgttcctcatacttcc

SEQ ID NO: 9318948 - DNA, 22 bp, Homo sapiens
acctgcctatcagctgcctgct

SEQ ID NO: 9318949 - DNA, 22 bp, Homo sapiens
acctgcctagttggttctgccc

SEQ ID NO: 9318950 - DNA, 22 bp, Homo sapiens
acctgcctagttggttctgccc

SEQ ID NO: 9318951 - DNA, 22 bp, Homo sapiens
acctgcctatggagccacatgg

SEQ ID NO: 9318952 - DNA, 22 bp, Homo sapiens
acctgcctatcagctgcctgct

SEQ ID NO: 9318953 - DNA, 20 bp, Homo sapiens
aagtcctgacctagtctaaa

SEQ ID NO: 9318954 - DNA, 22 bp, Homo sapiens
aagtcctgggcatttgaacagg

SEQ ID NO: 9318955 - DNA, 22 bp, Homo sapiens
aagtcctgggtgagaactgtcc

SEQ ID NO: 9318956 - DNA, 22 bp, Homo sapiens
aagtcctgtgctagagacacct

SEQ ID NO: 9318957 - DNA, 18 bp, Homo sapiens
aagtagatcatgagccac

SEQ ID NO: 9318958 - DNA, 22 bp, Homo sapiens
aagtagacagtcatctactttg

SEQ ID NO: 9318959 - DNA, 22 bp, Homo sapiens
aagtagacttttgcatcaagga

SEQ ID NO: 9318960 - DNA, 22 bp, Homo sapiens
aagtagcaatctcattagttgg

SEQ ID NO: 9318961 - DNA, 22 bp, Homo sapiens
aagtagcaaggaagattatgat

SEQ ID NO: 9318962 - DNA, 22 bp, Homo sapiens
aagtagcatcaaggaggatcca

SEQ ID NO: 9318963 - DNA, 22 bp, Homo sapiens
aagtagcattccatggtataga

SEQ ID NO: 9318964 - DNA, 22 bp, Homo sapiens
aagtagcagggattacaggtgt

SEQ ID NO: 9318965 - DNA, 22 bp, Homo sapiens
aagtagcaatctcattagttgg

SEQ ID NO: 9318966 - DNA, 22 bp, Homo sapiens
aagtagcattttcaaaatgtat

SEQ ID NO: 9318967 - DNA, 22 bp, Homo sapiens
aagtatacttaaaagagttgat

SEQ ID NO: 9318968 - DNA, 22 bp, Homo sapiens
aagtatattttttgaagcatat

SEQ ID NO: 9318969 - DNA, 22 bp, Homo sapiens
aagtccagtgctttagattcca

SEQ ID NO: 9318970 - DNA, 22 bp, Homo sapiens
aagggcagaatagagaagatgg

SEQ ID NO: 9318971 - DNA, 22 bp, Homo sapiens
aagggaggtaaagctatttaaa

SEQ ID NO: 9318972 - DNA, 22 bp, Homo sapiens
aagggaggtaaagctatttaaa

SEQ ID NO: 9318973 - DNA, 20 bp, Homo sapiens
aagggcagagggaacagact

SEQ ID NO: 9318974 - DNA, 22 bp, Homo sapiens
acatttcagtaagtgttaattt

SEQ ID NO: 9318975 - DNA, 22 bp, Homo sapiens
acatttcagtgagctattgaag

SEQ ID NO: 9318976 - DNA, 22 bp, Homo sapiens
aagggctgatctcactttcttt

SEQ ID NO: 9318977 - DNA, 22 bp, Homo sapiens
aagggctggagaggaaaggttg

SEQ ID NO: 9318978 - DNA, 22 bp, Homo sapiens
aagggctggagaggaaaggttg

SEQ ID NO: 9318979 - DNA, 22 bp, Homo sapiens
aagggctggagactgggtcttc

SEQ ID NO: 9318980 - DNA, 22 bp, Homo sapiens
aagggctggatctctctgagca

SEQ ID NO: 9318981 - DNA, 22 bp, Homo sapiens
aagggctggatctctctgagca

SEQ ID NO: 9318982 - DNA, 22 bp, Homo sapiens
aagggctggccacattctgggt

SEQ ID NO: 9318983 - DNA, 22 bp, Homo sapiens
aagggctggccctgggaagagt

SEQ ID NO: 9318984 - DNA, 18 bp, Homo sapiens
aagggctggcctttggag

SEQ ID NO: 9318985 - DNA, 22 bp, Homo sapiens
acccaggatgataatgttcaca

SEQ ID NO: 9318986 - DNA, 22 bp, Homo sapiens
aagggtgggccctggcagccat

SEQ ID NO: 9318987 - DNA, 22 bp, Homo sapiens
aaggggaaaaagtgttaggagt

SEQ ID NO: 9318988 - DNA, 19 bp, Homo sapiens
aagggctgggcacctcact

SEQ ID NO: 9318989 - DNA, 22 bp, Homo sapiens
accagaggaagggaatctcaag

SEQ ID NO: 9318990 - DNA, 22 bp, Homo sapiens
agcaggcttggtccccagcctc

SEQ ID NO: 9318991 - DNA, 22 bp, Homo sapiens
agcaggcttggtccccagcctc

SEQ ID NO: 9318992 - DNA, 22 bp, Homo sapiens
agcaggcttgttatgtctgaga

SEQ ID NO: 9318993 - DNA, 22 bp, Homo sapiens
agcaggctttcaagagtcttct

SEQ ID NO: 9318994 - DNA, 22 bp, Homo sapiens
agcaggctttccacagaaggag

SEQ ID NO: 9318995 - DNA, 21 bp, Homo sapiens
agcaggctttggagtggggct

SEQ ID NO: 9318996 - DNA, 19 bp, Homo sapiens
agcagggacatggaacttt

SEQ ID NO: 9318997 - DNA, 22 bp, Homo sapiens
acacagtattgtgactataact

SEQ ID NO: 9318998 - DNA, 20 bp, Homo sapiens
acacaagcacttctggtatt

SEQ ID NO: 9318999 - DNA, 19 bp, Homo sapiens
acacaatgacacatatata

SEQ ID NO: 9319000 - DNA, 22 bp, Homo sapiens
acacaatggcgtgtgccacaga

SEQ ID NO: 9319001 - DNA, 22 bp, Homo sapiens
acacaatgtcatcataatgtca

SEQ ID NO: 9319002 - DNA, 22 bp, Homo sapiens
acacacaactcattgtgtaata

SEQ ID NO: 9319003 - DNA, 22 bp, Homo sapiens
acacacaattagttttatgctt

SEQ ID NO: 9319004 - DNA, 22 bp, Homo sapiens
acacacaattagttttatgctt

SEQ ID NO: 9319005 - DNA, 22 bp, Homo sapiens
acacacaactcattgtgtaata

SEQ ID NO: 9319006 - DNA, 22 bp, Homo sapiens
acacacaaatctattagtgaat

SEQ ID NO: 9319007 - DNA, 22 bp, Homo sapiens
acaccatgatgagtgatgtagc

SEQ ID NO: 9319008 - DNA, 22 bp, Homo sapiens
acaccatggttcccaaactgtg

SEQ ID NO: 9319009 - DNA, 21 bp, Homo sapiens
agcaggtgtaaaggaggaaat

SEQ ID NO: 9319010 - DNA, 22 bp, Homo sapiens
agcaggtgagcacagccaggct

SEQ ID NO: 9319011 - DNA, 22 bp, Homo sapiens
agcatttaattacagtttaatt

SEQ ID NO: 9319012 - DNA, 22 bp, Homo sapiens
agccaaggacacggagcctcct

SEQ ID NO: 9319013 - DNA, 22 bp, Homo sapiens
agccaaggagtgcaggtggctt

SEQ ID NO: 9319014 - DNA, 22 bp, Homo sapiens
agccaaggactcagtggtaggc

SEQ ID NO: 9319015 - DNA, 22 bp, Homo sapiens
agccaatctcctgttgatgcca

SEQ ID NO: 9319016 - DNA, 22 bp, Homo sapiens
agccaaggtatcatgagaggca

SEQ ID NO: 9319017 - DNA, 22 bp, Homo sapiens
agccaagggtcagctgcacaga

SEQ ID NO: 9319018 - DNA, 22 bp, Homo sapiens
agccaaggcagctagagctctg

SEQ ID NO: 9319019 - DNA, 22 bp, Homo sapiens
agccaaggcagctagagctctg

SEQ ID NO: 9319020 - DNA, 22 bp, Homo sapiens
agccagctggagaccactgttt

SEQ ID NO: 9319021 - DNA, 22 bp, Homo sapiens
agccagaggtcatgagcacagg

SEQ ID NO: 9319022 - DNA, 22 bp, Homo sapiens
agccaggaagaaggtcacacca

SEQ ID NO: 9319023 - DNA, 22 bp, Homo sapiens
agccaggaagagaggcctcacc

SEQ ID NO: 9319024 - DNA, 22 bp, Homo sapiens
agccagctgtgggctcaggcgg

SEQ ID NO: 9319025 - DNA, 22 bp, Homo sapiens
agccagctgtcctccctttcct

SEQ ID NO: 9319026 - DNA, 22 bp, Homo sapiens
acacttaagcatgaagtataaa

SEQ ID NO: 9319027 - DNA, 22 bp, Homo sapiens
agcggctggaccagcgttcaag

SEQ ID NO: 9319028 - DNA, 22 bp, Homo sapiens
agcggctgctccgcaggctggc

SEQ ID NO: 9319029 - DNA, 22 bp, Homo sapiens
acagaggtcatggagagttctc

SEQ ID NO: 9319030 - DNA, 22 bp, Homo sapiens
acagataatacattgtgctaca

SEQ ID NO: 9319031 - DNA, 22 bp, Homo sapiens
agcgtgaattagttggtacaca

SEQ ID NO: 9319032 - DNA, 22 bp, Homo sapiens
acagagggtctgggcacaggac

SEQ ID NO: 9319033 - DNA, 19 bp, Homo sapiens
acagagggcaactgagaaa

SEQ ID NO: 9319034 - DNA, 22 bp, Homo sapiens
acagaggtcacctttgtatctt

SEQ ID NO: 9319035 - DNA, 22 bp, Homo sapiens
acagaggtaggacatgagatat

SEQ ID NO: 9319036 - DNA, 22 bp, Homo sapiens
acagaagtgtgtgtgtaggaat

SEQ ID NO: 9319037 - DNA, 22 bp, Homo sapiens
acagaactttctgatcctgagc

SEQ ID NO: 9319038 - DNA, 23 bp, Homo sapiens
acagaagccaggagccgctgggc

SEQ ID NO: 9319039 - DNA, 17 bp, Homo sapiens
acagaggcaggagtgga

SEQ ID NO: 9319040 - DNA, 22 bp, Homo sapiens
acagcagcaatagcagtgacat

SEQ ID NO: 9319041 - DNA, 22 bp, Homo sapiens
acagcagcaatagcagtgacat

SEQ ID NO: 9319042 - DNA, 22 bp, Homo sapiens
acagcagcataaactgactaag

SEQ ID NO: 9319043 - DNA, 22 bp, Homo sapiens
acagcagcactattgacatttt

SEQ ID NO: 9319044 - DNA, 22 bp, Homo sapiens
acagcagccagccactgtgagc

SEQ ID NO: 9319045 - DNA, 22 bp, Homo sapiens
agctgaggttgaagagtgaacg

SEQ ID NO: 9319046 - DNA, 21 bp, Homo sapiens
agctgaggtaaggcaagagag

SEQ ID NO: 9319047 - DNA, 21 bp, Homo sapiens
agctgaggtaaggcaagagag

SEQ ID NO: 9319048 - DNA, 21 bp, Homo sapiens
agctgaggtaaggcaagagag

SEQ ID NO: 9319049 - DNA, 23 bp, Homo sapiens
agctgaggtgcagatccaaagaa

SEQ ID NO: 9319050 - DNA, 22 bp, Homo sapiens
agctgagggcaggatggggtga

SEQ ID NO: 9319051 - DNA, 22 bp, Homo sapiens
agctgagggttcggtgtccaca

SEQ ID NO: 9319052 - DNA, 21 bp, Homo sapiens
agctgaggtaaggcaagagag

SEQ ID NO: 9319053 - DNA, 22 bp, Homo sapiens
agctgagattatgctcttctca

SEQ ID NO: 9319054 - DNA, 22 bp, Homo sapiens
agctgagattgtttccatttct

SEQ ID NO: 9319055 - DNA, 22 bp, Homo sapiens
acagcaggttttaactttgaag

SEQ ID NO: 9319056 - DNA, 21 bp, Homo sapiens
acagcagggctggcatgacag

SEQ ID NO: 9319057 - DNA, 22 bp, Homo sapiens
acagcaggttattgttatggca

SEQ ID NO: 9319058 - DNA, 18 bp, Homo sapiens
acagcaggtttcattctt

SEQ ID NO: 9319059 - DNA, 17 bp, Homo sapiens
acagcaggcccggaggg

SEQ ID NO: 9319060 - DNA, 22 bp, Homo sapiens
acagcaggcccatactggaagg

SEQ ID NO: 9319061 - DNA, 17 bp, Homo sapiens
acagcagggaagtgttg

SEQ ID NO: 9319062 - DNA, 19 bp, Homo sapiens
acagcagggatttttggag

SEQ ID NO: 9319063 - DNA, 22 bp, Homo sapiens
acagcagggaatatgggaattg

SEQ ID NO: 9319064 - DNA, 22 bp, Homo sapiens
aatttctccaagaatgcttaga

SEQ ID NO: 9319065 - DNA, 22 bp, Homo sapiens
aatttgatgagtttgtaagtct

SEQ ID NO: 9319066 - DNA, 22 bp, Homo sapiens
aatttgcatgatgagaacaata

SEQ ID NO: 9319067 - DNA, 22 bp, Homo sapiens
aatttgcatgatgagaacaata

SEQ ID NO: 9319068 - DNA, 22 bp, Homo sapiens
aatttggacttgggtgctagag

SEQ ID NO: 9319069 - DNA, 22 bp, Homo sapiens
aatttggagagaaacaagtagg

SEQ ID NO: 9319070 - DNA, 22 bp, Homo sapiens
aatttggaggtatttagctgtc

SEQ ID NO: 9319071 - DNA, 20 bp, Homo sapiens
agagtgggtgtcacaggctg

SEQ ID NO: 9319072 - DNA, 22 bp, Homo sapiens
agatgctgaattattgtgcttt

SEQ ID NO: 9319073 - DNA, 22 bp, Homo sapiens
agatgcagagtttgctgtggac

SEQ ID NO: 9319074 - DNA, 22 bp, Homo sapiens
acaaagtgttttctgaaggcct

SEQ ID NO: 9319075 - DNA, 22 bp, Homo sapiens
acaaatagagattcaaataaag

SEQ ID NO: 9319076 - DNA, 22 bp, Homo sapiens
agatctttagtgaagctaaatc

SEQ ID NO: 9319077 - DNA, 20 bp, Homo sapiens
agatctttgggttgtcatat

SEQ ID NO: 9319078 - DNA, 22 bp, Homo sapiens
agatctttaaaagttattatta

SEQ ID NO: 9319079 - DNA, 22 bp, Homo sapiens
acaaataggtagatttgcaaca

SEQ ID NO: 9319080 - DNA, 22 bp, Homo sapiens
agcacagggacaatgccaggtg

SEQ ID NO: 9319081 - DNA, 22 bp, Homo sapiens
agcacaggaccaaggaagctgt

SEQ ID NO: 9319082 - DNA, 22 bp, Homo sapiens
agcacagggcccagcctaggcc

SEQ ID NO: 9319083 - DNA, 22 bp, Homo sapiens
acacaaattgtaggataattgc

SEQ ID NO: 9319084 - DNA, 21 bp, Homo sapiens
acacaacaggcagtcattttc

SEQ ID NO: 9319085 - DNA, 22 bp, Homo sapiens
agcacacatcacttctgctcat

SEQ ID NO: 9319086 - DNA, 22 bp, Homo sapiens
agcacacagtcttccttcctcc

SEQ ID NO: 9319087 - DNA, 22 bp, Homo sapiens
agcacaggaacatggagatggg

SEQ ID NO: 9319088 - DNA, 22 bp, Homo sapiens
agcacagaatgaggtggaagtg

SEQ ID NO: 9319089 - DNA, 22 bp, Homo sapiens
agcacaaatataaaaatgtctg

SEQ ID NO: 9319090 - DNA, 23 bp, Homo sapiens
agcacaaagtgttttccttgtag

SEQ ID NO: 9319091 - DNA, 22 bp, Homo sapiens
agcacaaaagcagccacagatg

SEQ ID NO: 9319092 - DNA, 22 bp, Homo sapiens
agcacacagtattagccattgt

SEQ ID NO: 9319093 - DNA, 22 bp, Homo sapiens
agcacacaggccacctccactt

SEQ ID NO: 9319094 - DNA, 22 bp, Homo sapiens
agcacacaggacttgattcatg

SEQ ID NO: 9319095 - DNA, 21 bp, Homo sapiens
agcaaaggcaggagaggtttc

SEQ ID NO: 9319096 - DNA, 22 bp, Homo sapiens
agcaaataaagacaattatgtc

SEQ ID NO: 9319097 - DNA, 22 bp, Homo sapiens
acaacatttaaggaggcactga

SEQ ID NO: 9319098 - DNA, 22 bp, Homo sapiens
acaatagaaataattaagcaca

SEQ ID NO: 9319099 - DNA, 19 bp, Homo sapiens
acaatagaaaagtcttttg

SEQ ID NO: 9319100 - DNA, 22 bp, Homo sapiens
agcaaatacatttttagcataa

SEQ ID NO: 9319101 - DNA, 18 bp, Homo sapiens
agcaaatattaagtgcat

SEQ ID NO: 9319102 - DNA, 22 bp, Homo sapiens
aattcatgagtagaatctatat

SEQ ID NO: 9319103 - DNA, 22 bp, Homo sapiens
aattcattgccagaatctatga

SEQ ID NO: 9319104 - DNA, 22 bp, Homo sapiens
agagctgcaatttcatgtggtg

SEQ ID NO: 9319105 - DNA, 21 bp, Homo sapiens
aattacagatggaattacaga

SEQ ID NO: 9319106 - DNA, 21 bp, Homo sapiens
aattacagatggaattacaga

SEQ ID NO: 9319107 - DNA, 23 bp, Homo sapiens
aattacaaccaagaactggaagg

SEQ ID NO: 9319108 - DNA, 22 bp, Homo sapiens
agagcacagcagatctctgatg

SEQ ID NO: 9319109 - DNA, 22 bp, Homo sapiens
agaggattttaaaagcatatgt

SEQ ID NO: 9319110 - DNA, 22 bp, Homo sapiens
agaggattcactgcagaagaca

SEQ ID NO: 9319111 - DNA, 22 bp, Homo sapiens
agaggattcttagaattctgag

SEQ ID NO: 9319112 - DNA, 22 bp, Homo sapiens
aatttcacagctggtctatggg

SEQ ID NO: 9319113 - DNA, 22 bp, Homo sapiens
agaggaggtggtgatgctttaa

SEQ ID NO: 9319114 - DNA, 22 bp, Homo sapiens
agaggaatttctggaaggaggc

SEQ ID NO: 9319115 - DNA, 22 bp, Homo sapiens
agaggaatggagactaaacgct

SEQ ID NO: 9319116 - DNA, 22 bp, Homo sapiens
agaggaatctgtctagacacaa

SEQ ID NO: 9319117 - DNA, 22 bp, Homo sapiens
agaggaatatgggtgcactaga

SEQ ID NO: 9319118 - DNA, 22 bp, Homo sapiens
agaggaataaatttctgtagtg

SEQ ID NO: 9319119 - DNA, 22 bp, Homo sapiens
agaggaagtaatcaggacctgc

SEQ ID NO: 9319120 - DNA, 22 bp, Homo sapiens
agagctgggtggtggtgactca

SEQ ID NO: 9319121 - DNA, 22 bp, Homo sapiens
agacatttatgtttctctagga

SEQ ID NO: 9319122 - DNA, 22 bp, Homo sapiens
agacatttatgtttctctagga

SEQ ID NO: 9319123 - DNA, 22 bp, Homo sapiens
aatgctaaaatggcactaaagt

SEQ ID NO: 9319124 - DNA, 23 bp, Homo sapiens
agagcaaggaaatgaggtgtgat

SEQ ID NO: 9319125 - DNA, 23 bp, Homo sapiens
agagcaaggaaatgaggtgtgat

SEQ ID NO: 9319126 - DNA, 22 bp, Homo sapiens
acaatgtagttgtcatgagaca

SEQ ID NO: 9319127 - DNA, 22 bp, Homo sapiens
acaatgtgacctgacagtgtta

SEQ ID NO: 9319128 - DNA, 22 bp, Homo sapiens
acaatatttgggggcagtttgt

SEQ ID NO: 9319129 - DNA, 20 bp, Homo sapiens
acaatatgtagatgaatagc

SEQ ID NO: 9319130 - DNA, 22 bp, Homo sapiens
acaaattgttgggactcagccc

SEQ ID NO: 9319131 - DNA, 22 bp, Homo sapiens
acaaggcttcacacagtatgaa

SEQ ID NO: 9319132 - DNA, 22 bp, Homo sapiens
acaaggcttcacacagtatgaa

SEQ ID NO: 9319133 - DNA, 22 bp, Homo sapiens
acaatagtaaggtatattgtca

SEQ ID NO: 9319134 - DNA, 22 bp, Homo sapiens
acaatagtgcctggcatagagt

SEQ ID NO: 9319135 - DNA, 20 bp, Homo sapiens
acaatagatttgagcaaagt

SEQ ID NO: 9319136 - DNA, 22 bp, Homo sapiens
acaatagacccatgacacatac

SEQ ID NO: 9319137 - DNA, 21 bp, Homo sapiens
acaatagacataagcagagca

SEQ ID NO: 9319138 - DNA, 22 bp, Homo sapiens
acaatagatactgggcacatat

SEQ ID NO: 9319139 - DNA, 22 bp, Homo sapiens
acaatagagttctcataggaca

SEQ ID NO: 9319140 - DNA, 22 bp, Homo sapiens
acacagccgtgaatctgcttct

SEQ ID NO: 9319141 - DNA, 22 bp, Homo sapiens
aagataatattcattaactaga

SEQ ID NO: 9319142 - DNA, 20 bp, Homo sapiens
acacagactcagcttggatg

SEQ ID NO: 9319143 - DNA, 17 bp, Homo sapiens
acacagacaggcagaca

SEQ ID NO: 9319144 - DNA, 22 bp, Homo sapiens
acaatgttctctgagttgtgtg

SEQ ID NO: 9319145 - DNA, 22 bp, Homo sapiens
acaaagctagagaagagaattg

SEQ ID NO: 9319146 - DNA, 22 bp, Homo sapiens
acaaatgaacatataagcttga

SEQ ID NO: 9319147 - DNA, 22 bp, Homo sapiens
acaaattgggtatgagctaaga

SEQ ID NO: 9319148 - DNA, 20 bp, Homo sapiens
acaaattggcagaatgacaa

SEQ ID NO: 9319149 - DNA, 22 bp, Homo sapiens
acaaatgaacctgaaatctcag

SEQ ID NO: 9319150 - DNA, 22 bp, Homo sapiens
aagaatatctgttttatttagg

SEQ ID NO: 9319151 - DNA, 22 bp, Homo sapiens
acaaaaccagaaaatctctacc

SEQ ID NO: 9319152 - DNA, 22 bp, Homo sapiens
aagaacatttatgatggcattt

SEQ ID NO: 9319153 - DNA, 19 bp, Homo sapiens
aagaagcaataagctgtga

SEQ ID NO: 9319154 - DNA, 19 bp, Homo sapiens
aagaagcaataagctgtga

SEQ ID NO: 9319155 - DNA, 21 bp, Homo sapiens
aagaagcaatttattggaagg

SEQ ID NO: 9319156 - DNA, 22 bp, Homo sapiens
aagcagtgactctcagaggcag

SEQ ID NO: 9319157 - DNA, 22 bp, Homo sapiens
aagcagtgatgcatacagctgt

SEQ ID NO: 9319158 - DNA, 22 bp, Homo sapiens
acagcaggaagctggagggaaa

SEQ ID NO: 9319159 - DNA, 19 bp, Homo sapiens
acagcaggtgtggggataa

SEQ ID NO: 9319160 - DNA, 22 bp, Homo sapiens
acagcaggtagctttgtgcctc

SEQ ID NO: 9319161 - DNA, 22 bp, Homo sapiens
acagcagggtcacattccctct

SEQ ID NO: 9319162 - DNA, 22 bp, Homo sapiens
acagcaggggtggaataaacgt

SEQ ID NO: 9319163 - DNA, 22 bp, Homo sapiens
acagcagggggagctgttggac

SEQ ID NO: 9319164 - DNA, 22 bp, Homo sapiens
aagcagggtgtcttgacccatg

SEQ ID NO: 9319165 - DNA, 21 bp, Homo sapiens
aagcaggacatatgatgccct

SEQ ID NO: 9319166 - DNA, 22 bp, Homo sapiens
aagcaggcttggtgtggccgct

SEQ ID NO: 9319167 - DNA, 22 bp, Homo sapiens
acagcaggttacagtggcacag

SEQ ID NO: 9319168 - DNA, 22 bp, Homo sapiens
aagccaggttccatggaggagc

SEQ ID NO: 9319169 - DNA, 22 bp, Homo sapiens
acagacctgggcacagaaagga

SEQ ID NO: 9319170 - DNA, 22 bp, Homo sapiens
acacatataccactgtaaatga

SEQ ID NO: 9319171 - DNA, 20 bp, Homo sapiens
acacatatagcagcataaac

SEQ ID NO: 9319172 - DNA, 22 bp, Homo sapiens
acacataagcctaatcatctcc

SEQ ID NO: 9319173 - DNA, 22 bp, Homo sapiens
acacttgaggtttttaggtgcg

SEQ ID NO: 9319174 - DNA, 21 bp, Homo sapiens
acacttcagtttttaaaggga

SEQ ID NO: 9319175 - DNA, 22 bp, Homo sapiens
aacagtttatgataaattctta

SEQ ID NO: 9319176 - DNA, 22 bp, Homo sapiens
aacagtttatgataaattctta

SEQ ID NO: 9319177 - DNA, 22 bp, Homo sapiens
aacagtttatgagatatgctat

SEQ ID NO: 9319178 - DNA, 22 bp, Homo sapiens
aagttacagtctgcttgctgac

SEQ ID NO: 9319179 - DNA, 22 bp, Homo sapiens
aataatgataatggttatagct

SEQ ID NO: 9319180 - DNA, 22 bp, Homo sapiens
aataatgtacatacatatttcg

SEQ ID NO: 9319181 - DNA, 22 bp, Homo sapiens
aataatgtaggatgataaatga

SEQ ID NO: 9319182 - DNA, 22 bp, Homo sapiens
aataatgtctatggttccaaaa

SEQ ID NO: 9319183 - DNA, 21 bp, Homo sapiens
aatacagtgaagaatttcttt

SEQ ID NO: 9319184 - DNA, 19 bp, Homo sapiens
aatacagtgttatagaatt

SEQ ID NO: 9319185 - DNA, 22 bp, Homo sapiens
aatatttatatttctcttccct

SEQ ID NO: 9319186 - DNA, 22 bp, Homo sapiens
aatatttatatttctcttccct

SEQ ID NO: 9319187 - DNA, 22 bp, Homo sapiens
aatatttatatttctcttccct

SEQ ID NO: 9319188 - DNA, 22 bp, Homo sapiens
aatatttatgacaggaagtagc

SEQ ID NO: 9319189 - DNA, 22 bp, Homo sapiens
aatatttatgacaggaagtagc

SEQ ID NO: 9319190 - DNA, 22 bp, Homo sapiens
aatatttatgacaggaagtagc

SEQ ID NO: 9319191 - DNA, 22 bp, Homo sapiens
aatatttctgcagaatggtttt

SEQ ID NO: 9319192 - DNA, 22 bp, Homo sapiens
aatgaaatgaagatatgatcag

SEQ ID NO: 9319193 - DNA, 18 bp, Homo sapiens
aatgaaatgtacaccttt

SEQ ID NO: 9319194 - DNA, 22 bp, Homo sapiens
aatgaaatgtagcttatccata

SEQ ID NO: 9319195 - DNA, 22 bp, Homo sapiens
aatgcacatgttgtaataaata

SEQ ID NO: 9319196 - DNA, 22 bp, Homo sapiens
aatgaaatctgctgggtaaaga

SEQ ID NO: 9319197 - DNA, 22 bp, Homo sapiens
aatgaaatagttggctgtagag

SEQ ID NO: 9319198 - DNA, 21 bp, Homo sapiens
aatctgcttccctgtgacttg

SEQ ID NO: 9319199 - DNA, 22 bp, Homo sapiens
aatctgcacccactgaaaatgc

SEQ ID NO: 9319200 - DNA, 22 bp, Homo sapiens
aatctcttcccagtaaaaatgg

SEQ ID NO: 9319201 - DNA, 22 bp, Homo sapiens
aatgcagtgagccattaaatgg

SEQ ID NO: 9319202 - DNA, 22 bp, Homo sapiens
aacttggctttgccatttatcg

SEQ ID NO: 9319203 - DNA, 22 bp, Homo sapiens
aagggcaggcagagatcatata

SEQ ID NO: 9319204 - DNA, 22 bp, Homo sapiens
aagggcaggagaagacggatat

SEQ ID NO: 9319205 - DNA, 22 bp, Homo sapiens
aaggccatctacttacggaatt

SEQ ID NO: 9319206 - DNA, 22 bp, Homo sapiens
aaggcccttcggcttcctcagc

SEQ ID NO: 9319207 - DNA, 22 bp, Homo sapiens
aaggccctggatggttttgaga

SEQ ID NO: 9319208 - DNA, 22 bp, Homo sapiens
aaggccctggccccagcttctt

SEQ ID NO: 9319209 - DNA, 22 bp, Homo sapiens
aaggccctcatgcgtcagagcc

SEQ ID NO: 9319210 - DNA, 22 bp, Homo sapiens
aaggccctagaatctatattgc

SEQ ID NO: 9319211 - DNA, 22 bp, Homo sapiens
aaggccctaatagagcacatat

SEQ ID NO: 9319212 - DNA, 22 bp, Homo sapiens
aaggataaaaaccacttctaat

SEQ ID NO: 9319213 - DNA, 22 bp, Homo sapiens
aaggagtctgggccattcagag

SEQ ID NO: 9319214 - DNA, 22 bp, Homo sapiens
aaatggaagctatttatgattc

SEQ ID NO: 9319215 - DNA, 22 bp, Homo sapiens
aaatggaactgttgtgcatttg

SEQ ID NO: 9319216 - DNA, 22 bp, Homo sapiens
aaatggcaatcagcagaagcta

SEQ ID NO: 9319217 - DNA, 22 bp, Homo sapiens
aaatggcaatttagtttattta

SEQ ID NO: 9319218 - DNA, 20 bp, Homo sapiens
aaatggcacatgggaagtcc

SEQ ID NO: 9319219 - DNA, 21 bp, Homo sapiens
aaggtctgtaaagtgacagga

SEQ ID NO: 9319220 - DNA, 22 bp, Homo sapiens
aagggcaggtgggcatttctgg

SEQ ID NO: 9319221 - DNA, 22 bp, Homo sapiens
aagggcagggagtttgtgtcta

SEQ ID NO: 9319222 - DNA, 22 bp, Homo sapiens
aagggctgccagggggtgccag

SEQ ID NO: 9319223 - DNA, 22 bp, Homo sapiens
aagggctgcatttgatgtgtca

SEQ ID NO: 9319224 - DNA, 22 bp, Homo sapiens
aagggctgcaatccaaaacact

SEQ ID NO: 9319225 - DNA, 22 bp, Homo sapiens
aagggctgcatttgatgtgtca

SEQ ID NO: 9319226 - DNA, 22 bp, Homo sapiens
aagggctgctgtagaagcagag

SEQ ID NO: 9319227 - DNA, 22 bp, Homo sapiens
aagggctgctgtagaagcagag

SEQ ID NO: 9319228 - DNA, 22 bp, Homo sapiens
aaggttaaataggtattttcca

SEQ ID NO: 9319229 - DNA, 22 bp, Homo sapiens
aagtccagtgaaatagaatgca

SEQ ID NO: 9319230 - DNA, 22 bp, Homo sapiens
aagtctgagagaaactctctca

SEQ ID NO: 9319231 - DNA, 22 bp, Homo sapiens
aagtctttttgaatctataact

SEQ ID NO: 9319232 - DNA, 22 bp, Homo sapiens
aagtgaaacatgtatctcttta

SEQ ID NO: 9319233 - DNA, 22 bp, Homo sapiens
aagtcttagcaactatcgcttt

SEQ ID NO: 9319234 - DNA, 22 bp, Homo sapiens
aagtcttacataatagtttgga

SEQ ID NO: 9319235 - DNA, 22 bp, Homo sapiens
aagtcttaggcattttatttct

SEQ ID NO: 9319236 - DNA, 22 bp, Homo sapiens
aacagtgttttgctctttgccc

SEQ ID NO: 9319237 - DNA, 22 bp, Homo sapiens
aacagtgtttttcttcagcact

SEQ ID NO: 9319238 - DNA, 22 bp, Homo sapiens
aacagtgtctgtggttaaaggt

SEQ ID NO: 9319239 - DNA, 22 bp, Homo sapiens
aacagtgtcaggattacagata

SEQ ID NO: 9319240 - DNA, 22 bp, Homo sapiens
aacagtgtgttttgttattaag

SEQ ID NO: 9319241 - DNA, 22 bp, Homo sapiens
aacagtgttctagggtgtggct

SEQ ID NO: 9319242 - DNA, 22 bp, Homo sapiens
aacagtgtgtacacatcatagg

SEQ ID NO: 9319243 - DNA, 22 bp, Homo sapiens
aacagtaacgagatgtcctaac

SEQ ID NO: 9319244 - DNA, 22 bp, Homo sapiens
aacagtaagagatgttttatct

SEQ ID NO: 9319245 - DNA, 22 bp, Homo sapiens
aacagtaaagacagaatttatc

SEQ ID NO: 9319246 - DNA, 22 bp, Homo sapiens
aagtgcttagaagttgcattag

SEQ ID NO: 9319247 - DNA, 22 bp, Homo sapiens
aaaattgtgaaggtttctgaaa

SEQ ID NO: 9319248 - DNA, 22 bp, Homo sapiens
aaaattgtaggaactgaatcaa

SEQ ID NO: 9319249 - DNA, 22 bp, Homo sapiens
aaaatttccaccatctttgtgt

SEQ ID NO: 9319250 - DNA, 22 bp, Homo sapiens
aaaggagaaaacatacaggact

SEQ ID NO: 9319251 - DNA, 22 bp, Homo sapiens
aaagtcattggaatattaatga

SEQ ID NO: 9319252 - DNA, 19 bp, Homo sapiens
aaagttttattctcatttg

SEQ ID NO: 9319253 - DNA, 22 bp, Homo sapiens
aaagtcatacatggtgcttact

SEQ ID NO: 9319254 - DNA, 22 bp, Homo sapiens
aaaggagataaagggcccttca

SEQ ID NO: 9319255 - DNA, 22 bp, Homo sapiens
aaatccagtgttcaaagtttga

SEQ ID NO: 9319256 - DNA, 22 bp, Homo sapiens
aaatgacaataaaagtccatgc

SEQ ID NO: 9319257 - DNA, 22 bp, Homo sapiens
aaatgacagagtaagctgttta

SEQ ID NO: 9319258 - DNA, 21 bp, Homo sapiens
aaatgaatgtggtagtgcaag

SEQ ID NO: 9319259 - DNA, 22 bp, Homo sapiens
aaatccagtgggtcctcatgag

SEQ ID NO: 9319260 - DNA, 22 bp, Homo sapiens
aaacttcagtgaatgacttatg

SEQ ID NO: 9319261 - DNA, 23 bp, Homo sapiens
aaatgtcttctagctcttgagaa

SEQ ID NO: 9319262 - DNA, 22 bp, Homo sapiens
aaagacacatatgcttaaccca

SEQ ID NO: 9319263 - DNA, 22 bp, Homo sapiens
aaagacacatgtctcttagatt

SEQ ID NO: 9319264 - DNA, 22 bp, Homo sapiens
aaagacagacggaaacctgagg

SEQ ID NO: 9319265 - DNA, 22 bp, Homo sapiens
aaagacagatggcaaggatgat

SEQ ID NO: 9319266 - DNA, 22 bp, Homo sapiens
aaagacagtggattcaaaatcc

SEQ ID NO: 9319267 - DNA, 22 bp, Homo sapiens
aaagacacacagtgcttcagtt

SEQ ID NO: 9319268 - DNA, 22 bp, Homo sapiens
aaagacacacagccagcaagtg

SEQ ID NO: 9319269 - DNA, 22 bp, Homo sapiens
aaaagcatctcaaaggagcttc

SEQ ID NO: 9319270 - DNA, 20 bp, Homo sapiens
aaaagcagccagagatggta

SEQ ID NO: 9319271 - DNA, 22 bp, Homo sapiens
aaaagcaggtactcagcttggg

SEQ ID NO: 9319272 - DNA, 22 bp, Homo sapiens
aaaagcaagttgcctaggttga

SEQ ID NO: 9319273 - DNA, 22 bp, Homo sapiens
aaaagcagagactctggagcta

SEQ ID NO: 9319274 - DNA, 22 bp, Homo sapiens
aaaagcactacaatttcgcttc

SEQ ID NO: 9319275 - DNA, 22 bp, Homo sapiens
aaaagcagaccacgctttgtgg

SEQ ID NO: 9319276 - DNA, 22 bp, Homo sapiens
aaaacaggtgtcagcaaactat

SEQ ID NO: 9319277 - DNA, 22 bp, Homo sapiens
aaaacacaagaagcagggtaca

SEQ ID NO: 9319278 - DNA, 22 bp, Homo sapiens
aaaagcaagaggctggattaaa

SEQ ID NO: 9319279 - DNA, 22 bp, Homo sapiens
aaaaatctatgactgcttctcc

SEQ ID NO: 9319280 - DNA, 22 bp, Homo sapiens
aaaagcaagttgcctaggttga

SEQ ID NO: 9319281 - DNA, 22 bp, Homo sapiens
aaaagcaaggcagtctgtctga

SEQ ID NO: 9319282 - DNA, 20 bp, Homo sapiens
aaaaattgatatcgcttcct

SEQ ID NO: 9319283 - DNA, 22 bp, Homo sapiens
aaaaattgctgagaacggaatt

SEQ ID NO: 9319284 - DNA, 22 bp, Homo sapiens
aaaaccaagttttccttagtct

SEQ ID NO: 9319285 - DNA, 22 bp, Homo sapiens
aaaacattgaattgcacactat

SEQ ID NO: 9319286 - DNA, 22 bp, Homo sapiens
aaaacattctgtgaactctcaa

SEQ ID NO: 9319287 - DNA, 22 bp, Homo sapiens
aaaacattctgtgaactctcaa

SEQ ID NO: 9319288 - DNA, 22 bp, Homo sapiens
aaaacattttactgccatctca

SEQ ID NO: 9319289 - DNA, 22 bp, Homo sapiens
aaaacattgaattgcacactat

SEQ ID NO: 9319290 - DNA, 22 bp, Homo sapiens
aaaagttgcaaaattgctcttc

SEQ ID NO: 9319291 - DNA, 22 bp, Homo sapiens
aaaagttacctctgtaatataa

SEQ ID NO: 9319292 - DNA, 22 bp, Homo sapiens
aaaagttaactgtgttcatgca

SEQ ID NO: 9319293 - DNA, 22 bp, Homo sapiens
aaaatgcatgagaatgtgctcg

SEQ ID NO: 9319294 - DNA, 18 bp, Homo sapiens
aaaatgcaggcgacatgg

SEQ ID NO: 9319295 - DNA, 22 bp, Homo sapiens
aaaatggctgtggtctggcaag

SEQ ID NO: 9319296 - DNA, 22 bp, Homo sapiens
aaaatggctgtggtctggcaag

SEQ ID NO: 9319297 - DNA, 22 bp, Homo sapiens
aaaatgcaaacctacctacata

SEQ ID NO: 9319298 - DNA, 22 bp, Homo sapiens
aaagcaatggatgagaatctgt

SEQ ID NO: 9319299 - DNA, 21 bp, Homo sapiens
aaaatgtagacttttccctga

SEQ ID NO: 9319300 - DNA, 22 bp, Homo sapiens
aaagcagctgctctggccttga

SEQ ID NO: 9319301 - DNA, 22 bp, Homo sapiens
aaagcagctgtttgactttcca

SEQ ID NO: 9319302 - DNA, 22 bp, Homo sapiens
aaagcaggcagcaggctggatt

SEQ ID NO: 9319303 - DNA, 22 bp, Homo sapiens
aaagcagctgatctcagagcct

SEQ ID NO: 9319304 - DNA, 22 bp, Homo sapiens
aaagcagggatgaggctagagg

SEQ ID NO: 9319305 - DNA, 22 bp, Homo sapiens
aaagcagggatgaggctagagg

SEQ ID NO: 9319306 - DNA, 22 bp, Homo sapiens
aaagcagggtccaaggagatgt

SEQ ID NO: 9319307 - DNA, 19 bp, Homo sapiens
aaattggcatgctgacctc

SEQ ID NO: 9319308 - DNA, 22 bp, Homo sapiens
aaattgcttgagattagtctcc

SEQ ID NO: 9319309 - DNA, 22 bp, Homo sapiens
aaagcaggttgcaattacagtg

SEQ ID NO: 9319310 - DNA, 22 bp, Homo sapiens
aaagcaggttatgaccatggcc

SEQ ID NO: 9319311 - DNA, 20 bp, Homo sapiens
aaagcagtatgcaagtagag

SEQ ID NO: 9319312 - DNA, 22 bp, Homo sapiens
aaagcagtctcagacttaagca

SEQ ID NO: 9319313 - DNA, 22 bp, Homo sapiens
aaattccattaggaaacttcca

SEQ ID NO: 9319314 - DNA, 22 bp, Homo sapiens
aaattgctgaccaagtatattc

SEQ ID NO: 9319315 - DNA, 22 bp, Homo sapiens
aaattgctgttgggtgactctt

SEQ ID NO: 9319316 - DNA, 22 bp, Homo sapiens
aaattgctgtgaggtggtagta

SEQ ID NO: 9319317 - DNA, 22 bp, Homo sapiens
aaattgcttataaagatgaatg

SEQ ID NO: 9319318 - DNA, 22 bp, Homo sapiens
aaattgctggatcctactccca

SEQ ID NO: 9319319 - DNA, 22 bp, Homo sapiens
aaattgctggcagcctttattc

SEQ ID NO: 9319320 - DNA, 22 bp, Homo sapiens
aaattgctgggtcccacccaag

SEQ ID NO: 9319321 - DNA, 22 bp, Homo sapiens
aaattgctgacacttgaccatt

SEQ ID NO: 9319322 - DNA, 22 bp, Homo sapiens
aaattgctctttaaaagtactg

SEQ ID NO: 9319323 - DNA, 22 bp, Homo sapiens
aaattgctatatgtgaatgtga

SEQ ID NO: 9319324 - DNA, 22 bp, Homo sapiens
aaattgctagttgcttttttca

SEQ ID NO: 9319325 - DNA, 22 bp, Homo sapiens
aaaggcagagtgctcagctggc

SEQ ID NO: 9319326 - DNA, 22 bp, Homo sapiens
aaaggaatattcaaaacagtca

SEQ ID NO: 9319327 - DNA, 22 bp, Homo sapiens
aaagcatattaggactgaatta

SEQ ID NO: 9319328 - DNA, 22 bp, Homo sapiens
aaagccaaatgaaagatggttc

SEQ ID NO: 9319329 - DNA, 22 bp, Homo sapiens
aaagtctttattttgtatcttt

SEQ ID NO: 9319330 - DNA, 22 bp, Homo sapiens
aaagggaatgtgtaggacatgt

SEQ ID NO: 9319331 - DNA, 22 bp, Homo sapiens
aaagggaagttgcacatgttcc

SEQ ID NO: 9319332 - DNA, 22 bp, Homo sapiens
aaagggaactctaattatcttc

SEQ ID NO: 9319333 - DNA, 22 bp, Homo sapiens
aaaggctggggactgaggaagg

SEQ ID NO: 9319334 - DNA, 22 bp, Homo sapiens
aaaggctggaaactgaagataa

SEQ ID NO: 9319335 - DNA, 22 bp, Homo sapiens
aaaggctggattcagagaggtg

SEQ ID NO: 9319336 - DNA, 22 bp, Homo sapiens
aaaggctccttctcccatgacc

SEQ ID NO: 9319337 - DNA, 22 bp, Homo sapiens
aaatacataaaggttgtaccag

SEQ ID NO: 9319338 - DNA, 22 bp, Homo sapiens
aagaagtggttggaagaagcat

SEQ ID NO: 9319339 - DNA, 22 bp, Homo sapiens
aagaagtggtccttttctttct

SEQ ID NO: 9319340 - DNA, 22 bp, Homo sapiens
aaagttctttttctataaatcc

SEQ ID NO: 9319341 - DNA, 22 bp, Homo sapiens
aaagttgcacaactttgtatac

SEQ ID NO: 9319342 - DNA, 22 bp, Homo sapiens
aaagttgcacaactttgtatac

SEQ ID NO: 9319343 - DNA, 22 bp, Homo sapiens
aaagttgctggctttggttcat

SEQ ID NO: 9319344 - DNA, 22 bp, Homo sapiens
aagaagcagagctgtgggtgtt

SEQ ID NO: 9319345 - DNA, 22 bp, Homo sapiens
aagaagcagctgccaggccagt

SEQ ID NO: 9319346 - DNA, 22 bp, Homo sapiens
aagaagcattctttcattggtt

SEQ ID NO: 9319347 - DNA, 22 bp, Homo sapiens
aagaagcagctgccaggccagt

SEQ ID NO: 9319348 - DNA, 22 bp, Homo sapiens
aagaagcaggtcacagacaggg

SEQ ID NO: 9319349 - DNA, 22 bp, Homo sapiens
aagaagcatgagaagattttat

SEQ ID NO: 9319350 - DNA, 22 bp, Homo sapiens
aagaagcatggctgtagattcc

SEQ ID NO: 9319351 - DNA, 22 bp, Homo sapiens
aaatattattgcttaaggggag

SEQ ID NO: 9319352 - DNA, 22 bp, Homo sapiens
aaatatgagatgttctctttcg

SEQ ID NO: 9319353 - DNA, 22 bp, Homo sapiens
aaatatagtaaatgcatagttc

SEQ ID NO: 9319354 - DNA, 22 bp, Homo sapiens
aaatataccagttgcctgcatc

SEQ ID NO: 9319355 - DNA, 22 bp, Homo sapiens
aaatgcttcacctcattaaact

SEQ ID NO: 9319356 - DNA, 22 bp, Homo sapiens
aaatgcttgctcttgattattt

SEQ ID NO: 9319357 - DNA, 22 bp, Homo sapiens
aaatgcttgtatatttcttggt

SEQ ID NO: 9319358 - DNA, 22 bp, Homo sapiens
aaatgctttggtgctggtacag

SEQ ID NO: 9319359 - DNA, 21 bp, Homo sapiens
aaatgctttgtatatatctgt

SEQ ID NO: 9319360 - DNA, 22 bp, Homo sapiens
aaatgcttattagtgtcacaaa

SEQ ID NO: 9319361 - DNA, 18 bp, Homo sapiens
aaatgctgctcaaattcc

SEQ ID NO: 9319362 - DNA, 22 bp, Homo sapiens
aaatgcaattcaggaagacaag

SEQ ID NO: 9319363 - DNA, 22 bp, Homo sapiens
aaatgcaagttcatattttgtt

SEQ ID NO: 9319364 - DNA, 22 bp, Homo sapiens
aaatgcaaggccatgtgaagga

SEQ ID NO: 9319365 - DNA, 22 bp, Homo sapiens
aaatgcaaggcacattcctttt

SEQ ID NO: 9319366 - DNA, 22 bp, Homo sapiens
aaatgccaaggagagactgtta

SEQ ID NO: 9319367 - DNA, 22 bp, Homo sapiens
aaatgcatttttaattagaccc

SEQ ID NO: 9319368 - DNA, 22 bp, Homo sapiens
aaatgatggtactcatgtttag

SEQ ID NO: 9319369 - DNA, 22 bp, Homo sapiens
aaatgcaacgggctttccttat

SEQ ID NO: 9319370 - DNA, 22 bp, Homo sapiens
aaatattggtaggatgcttgtt

SEQ ID NO: 9319371 - DNA, 22 bp, Homo sapiens
aaatatttgtctgaggcggttg

SEQ ID NO: 9319372 - DNA, 22 bp, Homo sapiens
aaatgaaatgagtgcctggagg

SEQ ID NO: 9319373 - DNA, 20 bp, Homo sapiens
cacaggctatatgagagcca

SEQ ID NO: 9319374 - DNA, 19 bp, Homo sapiens
agcaggctaggctgcctct

SEQ ID NO: 9319375 - DNA, 22 bp, Homo sapiens
agcaggctaggaacctcactgc

SEQ ID NO: 9319376 - DNA, 19 bp, Homo sapiens
agcaggctaggctgcctct

SEQ ID NO: 9319377 - DNA, 22 bp, Homo sapiens
agcaggctaggaacctcactgc

SEQ ID NO: 9319378 - DNA, 22 bp, Homo sapiens
agcaggctactcctgtgttcgt

SEQ ID NO: 9319379 - DNA, 18 bp, Homo sapiens
cacaggctcccagtgagg

SEQ ID NO: 9319380 - DNA, 20 bp, Homo sapiens
cacaggctatatgagagcca

SEQ ID NO: 9319381 - DNA, 22 bp, Homo sapiens
cacaggctccggccttgcagcc

SEQ ID NO: 9319382 - DNA, 22 bp, Homo sapiens
agcaggctaatcttgctgaaca

SEQ ID NO: 9319383 - DNA, 22 bp, Homo sapiens
agcaggctaaataataatacat

SEQ ID NO: 9319384 - DNA, 22 bp, Homo sapiens
agcaggctaagggacctgttta

SEQ ID NO: 9319385 - DNA, 20 bp, Homo sapiens
agcaggccttggggagagga

SEQ ID NO: 9319386 - DNA, 22 bp, Homo sapiens
cacaggctcttctcacttgatt

SEQ ID NO: 9319387 - DNA, 22 bp, Homo sapiens
cacaggctctccagggcctgga

SEQ ID NO: 9319388 - DNA, 20 bp, Homo sapiens
cacaggctatatgagagcca

SEQ ID NO: 9319389 - DNA, 22 bp, Homo sapiens
cacatgggtgtgcctggaggaa

SEQ ID NO: 9319390 - DNA, 22 bp, Homo sapiens
agcaggtggatttagacgggag

SEQ ID NO: 9319391 - DNA, 22 bp, Homo sapiens
agcaggtggccacgaggaggag

SEQ ID NO: 9319392 - DNA, 22 bp, Homo sapiens
agcaggtgggatcaagctggca

SEQ ID NO: 9319393 - DNA, 22 bp, Homo sapiens
cactgaaatcgaaaaatgtagg

SEQ ID NO: 9319394 - DNA, 22 bp, Homo sapiens
cactaggcgccgggtggctgtg

SEQ ID NO: 9319395 - DNA, 22 bp, Homo sapiens
cactaggcatctgtgagggtag

SEQ ID NO: 9319396 - DNA, 22 bp, Homo sapiens
cacgggctgtttccatgcaaaa

SEQ ID NO: 9319397 - DNA, 22 bp, Homo sapiens
cacgggagacgtgatcttggac

SEQ ID NO: 9319398 - DNA, 22 bp, Homo sapiens
cactaaaactacattggaaaca

SEQ ID NO: 9319399 - DNA, 22 bp, Homo sapiens
cacattgaaccatatattagtg

SEQ ID NO: 9319400 - DNA, 22 bp, Homo sapiens
cactgcacttcagcctgggtga

SEQ ID NO: 9319401 - DNA, 22 bp, Homo sapiens
agcattaggtgtgtttcagagg

SEQ ID NO: 9319402 - DNA, 22 bp, Homo sapiens
agcatttatgactaatgtaaaa

SEQ ID NO: 9319403 - DNA, 22 bp, Homo sapiens
agcatttagtctttattgcagc

SEQ ID NO: 9319404 - DNA, 22 bp, Homo sapiens
agcatttaggagaatttgagaa

SEQ ID NO: 9319405 - DNA, 22 bp, Homo sapiens
agcatttagttagtaaatgttt

SEQ ID NO: 9319406 - DNA, 22 bp, Homo sapiens
cactgcactccatcctgggaaa

SEQ ID NO: 9319407 - DNA, 22 bp, Homo sapiens
cactgcactccagcccgggcaa

SEQ ID NO: 9319408 - DNA, 22 bp, Homo sapiens
cactgcaacctccacctcctgg

SEQ ID NO: 9319409 - DNA, 22 bp, Homo sapiens
cactgaactggtcttaggaggt

SEQ ID NO: 9319410 - DNA, 22 bp, Homo sapiens
cactgggcgccagctgctgagc

SEQ ID NO: 9319411 - DNA, 22 bp, Homo sapiens
cactgggcaattctgagcctaa

SEQ ID NO: 9319412 - DNA, 22 bp, Homo sapiens
caagggctgctatcagctactg

SEQ ID NO: 9319413 - DNA, 22 bp, Homo sapiens
caagggctcacggtctgctggg

SEQ ID NO: 9319414 - DNA, 22 bp, Homo sapiens
caagggctctaagtcacaagat

SEQ ID NO: 9319415 - DNA, 22 bp, Homo sapiens
caagggctcttttgaggaatgt

SEQ ID NO: 9319416 - DNA, 22 bp, Homo sapiens
caagggctgaacacaggtttca

SEQ ID NO: 9319417 - DNA, 20 bp, Homo sapiens
caaggggagtagtatgggcc

SEQ ID NO: 9319418 - DNA, 22 bp, Homo sapiens
caagtccaggtgggcaaataaa

SEQ ID NO: 9319419 - DNA, 22 bp, Homo sapiens
caagtccaagatcaagaagcca

SEQ ID NO: 9319420 - DNA, 22 bp, Homo sapiens
caagggaattgtgtgtgagagg

SEQ ID NO: 9319421 - DNA, 22 bp, Homo sapiens
caagtctgacctctgggtgaag

SEQ ID NO: 9319422 - DNA, 22 bp, Homo sapiens
caattatatttagaatgataca

SEQ ID NO: 9319423 - DNA, 22 bp, Homo sapiens
caattagacatttattggccag

SEQ ID NO: 9319424 - DNA, 22 bp, Homo sapiens
caattagaggaggaagctcata

SEQ ID NO: 9319425 - DNA, 22 bp, Homo sapiens
caattacatttattgagcattc

SEQ ID NO: 9319426 - DNA, 21 bp, Homo sapiens
caattacagatggctcagggg

SEQ ID NO: 9319427 - DNA, 22 bp, Homo sapiens
agcagagaagacacaggcttca

SEQ ID NO: 9319428 - DNA, 22 bp, Homo sapiens
caagctggagttcctcagagtg

SEQ ID NO: 9319429 - DNA, 22 bp, Homo sapiens
caaggaaaacagatgatcaaca

SEQ ID NO: 9319430 - DNA, 22 bp, Homo sapiens
caaggaaaacagatgatcaaca

SEQ ID NO: 9319431 - DNA, 22 bp, Homo sapiens
caaggaaaagaagtatttcaga

SEQ ID NO: 9319432 - DNA, 22 bp, Homo sapiens
caaggaaacatgaaatgcattg

SEQ ID NO: 9319433 - DNA, 22 bp, Homo sapiens
caaggaaacatgaaatgcattg

SEQ ID NO: 9319434 - DNA, 22 bp, Homo sapiens
caaggaaaaagcgagctcgggg

SEQ ID NO: 9319435 - DNA, 22 bp, Homo sapiens
caatttctgggcctcacacaag

SEQ ID NO: 9319436 - DNA, 22 bp, Homo sapiens
caatttctggaactaattctga

SEQ ID NO: 9319437 - DNA, 22 bp, Homo sapiens
caatttggttacttccttagaa

SEQ ID NO: 9319438 - DNA, 22 bp, Homo sapiens
caatttcttgttaattctcagg

SEQ ID NO: 9319439 - DNA, 22 bp, Homo sapiens
caatttctctttatatctcaca

SEQ ID NO: 9319440 - DNA, 22 bp, Homo sapiens
cacacagaaccgctcgccactt

SEQ ID NO: 9319441 - DNA, 22 bp, Homo sapiens
caatttttaaactatgaagttg

SEQ ID NO: 9319442 - DNA, 22 bp, Homo sapiens
cacactttgtgctaatctattt

SEQ ID NO: 9319443 - DNA, 22 bp, Homo sapiens
cacacttgtgaccgatataatg

SEQ ID NO: 9319444 - DNA, 22 bp, Homo sapiens
cacactttgttgaagttttcat

SEQ ID NO: 9319445 - DNA, 22 bp, Homo sapiens
cacaggaaaaatgggtccttta

SEQ ID NO: 9319446 - DNA, 22 bp, Homo sapiens
cacaggaaaataaaagatctaa

SEQ ID NO: 9319447 - DNA, 20 bp, Homo sapiens
cacaggaaagctactcagtt

SEQ ID NO: 9319448 - DNA, 22 bp, Homo sapiens
cacaggaaatattaggagggat

SEQ ID NO: 9319449 - DNA, 22 bp, Homo sapiens
cacagctgccatggctgcactt

SEQ ID NO: 9319450 - DNA, 22 bp, Homo sapiens
agcgcttgccgcactccaagca

SEQ ID NO: 9319451 - DNA, 22 bp, Homo sapiens
cagcccacgtcagggccactca

SEQ ID NO: 9319452 - DNA, 22 bp, Homo sapiens
cagcccagtaccaagcagttgg

SEQ ID NO: 9319453 - DNA, 22 bp, Homo sapiens
cagcctctaagcacagcctctc

SEQ ID NO: 9319454 - DNA, 22 bp, Homo sapiens
cagccctggtgaggttggctat

SEQ ID NO: 9319455 - DNA, 22 bp, Homo sapiens
cagcatggggcttggagtcagc

SEQ ID NO: 9319456 - DNA, 22 bp, Homo sapiens
cagcatggggcttggagtcagc

SEQ ID NO: 9319457 - DNA, 22 bp, Homo sapiens
cagcatgggttccgggggcctg

SEQ ID NO: 9319458 - DNA, 22 bp, Homo sapiens
agcgagggaggtctgaggacag

SEQ ID NO: 9319459 - DNA, 22 bp, Homo sapiens
cagcatggagacaaagtgggca

SEQ ID NO: 9319460 - DNA, 22 bp, Homo sapiens
cagcatggacaggggtggcgtt

SEQ ID NO: 9319461 - DNA, 22 bp, Homo sapiens
cagcactggggggattcggagc

SEQ ID NO: 9319462 - DNA, 22 bp, Homo sapiens
agctgagctcaggctgatgtaa

SEQ ID NO: 9319463 - DNA, 22 bp, Homo sapiens
agctgagctgcagatgactgta

SEQ ID NO: 9319464 - DNA, 22 bp, Homo sapiens
agctgagccagcagcaacagga

SEQ ID NO: 9319465 - DNA, 22 bp, Homo sapiens
agctgaggacgtgaagggcggc

SEQ ID NO: 9319466 - DNA, 22 bp, Homo sapiens
agctgaggaggaatgatgggta

SEQ ID NO: 9319467 - DNA, 22 bp, Homo sapiens
cagctggcagccctggccctgc

SEQ ID NO: 9319468 - DNA, 22 bp, Homo sapiens
cagctggatgggagaccatgtt

SEQ ID NO: 9319469 - DNA, 22 bp, Homo sapiens
cagctggcaagtggagcagggt

SEQ ID NO: 9319470 - DNA, 22 bp, Homo sapiens
cagctggactgggatgtagcga

SEQ ID NO: 9319471 - DNA, 22 bp, Homo sapiens
cagctgctttcagcaggaggga

SEQ ID NO: 9319472 - DNA, 20 bp, Homo sapiens
agctgaggcacctgaggtta

SEQ ID NO: 9319473 - DNA, 20 bp, Homo sapiens
agctgaggcacctgaggtta

SEQ ID NO: 9319474 - DNA, 22 bp, Homo sapiens
cagctgccagcttctctccatc

SEQ ID NO: 9319475 - DNA, 22 bp, Homo sapiens
cagccttgatggatgaggaagt

SEQ ID NO: 9319476 - DNA, 22 bp, Homo sapiens
cagcctttatggaaaggcctgg

SEQ ID NO: 9319477 - DNA, 22 bp, Homo sapiens
cagcctttatctcctgggctca

SEQ ID NO: 9319478 - DNA, 22 bp, Homo sapiens
cagcctttccaattgctgctgc

SEQ ID NO: 9319479 - DNA, 22 bp, Homo sapiens
cagcctttctgtttcctaaggt

SEQ ID NO: 9319480 - DNA, 22 bp, Homo sapiens
cagcctttctgtttcctaaggt

SEQ ID NO: 9319481 - DNA, 22 bp, Homo sapiens
cagcctctgacaccacagtcgt

SEQ ID NO: 9319482 - DNA, 22 bp, Homo sapiens
cagcctctgtggctgccacacc

SEQ ID NO: 9319483 - DNA, 22 bp, Homo sapiens
agccaagcactcaactcctgga

SEQ ID NO: 9319484 - DNA, 22 bp, Homo sapiens
agccaggccttttctcaaggtt

SEQ ID NO: 9319485 - DNA, 22 bp, Homo sapiens
agccagggacgctgcaggctac

SEQ ID NO: 9319486 - DNA, 22 bp, Homo sapiens
agccagggacgctgcaggctac

SEQ ID NO: 9319487 - DNA, 22 bp, Homo sapiens
agccagggaagaggcctacctc

SEQ ID NO: 9319488 - DNA, 22 bp, Homo sapiens
agccaggctcaaggcctgctcc

SEQ ID NO: 9319489 - DNA, 22 bp, Homo sapiens
cagagcaggggtttcccaggtt

SEQ ID NO: 9319490 - DNA, 22 bp, Homo sapiens
agccaggggagtcagctgctgg

SEQ ID NO: 9319491 - DNA, 22 bp, Homo sapiens
agccagggacgctgcaggctac

SEQ ID NO: 9319492 - DNA, 23 bp, Homo sapiens
agccagggcactggtggagattg

SEQ ID NO: 9319493 - DNA, 22 bp, Homo sapiens
agccagggatggcagtgcccag

SEQ ID NO: 9319494 - DNA, 20 bp, Homo sapiens
cagagccagggttttgtttt

SEQ ID NO: 9319495 - DNA, 22 bp, Homo sapiens
cagagccaggtctaggagtctc

SEQ ID NO: 9319496 - DNA, 22 bp, Homo sapiens
cagagcagtaaatctggggcac

SEQ ID NO: 9319497 - DNA, 22 bp, Homo sapiens
cagagcagtaaatctggggcac

SEQ ID NO: 9319498 - DNA, 18 bp, Homo sapiens
cagagcagtatgaatgtt

SEQ ID NO: 9319499 - DNA, 22 bp, Homo sapiens
cagagctgttgcggggcttggc

SEQ ID NO: 9319500 - DNA, 22 bp, Homo sapiens
cagagtggcagtcccaggccca

SEQ ID NO: 9319501 - DNA, 22 bp, Homo sapiens
agccctcctggggccacgctgg

SEQ ID NO: 9319502 - DNA, 22 bp, Homo sapiens
agccctcctttgttcatgctgc

SEQ ID NO: 9319503 - DNA, 21 bp, Homo sapiens
agcccttaggacataagagag

SEQ ID NO: 9319504 - DNA, 22 bp, Homo sapiens
cagaggagaattgcgggatcat

SEQ ID NO: 9319505 - DNA, 22 bp, Homo sapiens
agcccttcaagagctctgtcct

SEQ ID NO: 9319506 - DNA, 22 bp, Homo sapiens
agcctagggggtcctgggccac

SEQ ID NO: 9319507 - DNA, 22 bp, Homo sapiens
agccggctggtgccctcgggga

SEQ ID NO: 9319508 - DNA, 18 bp, Homo sapiens
cagatccaggcagctatt

SEQ ID NO: 9319509 - DNA, 22 bp, Homo sapiens
cagatccacccttgtagtgaca

SEQ ID NO: 9319510 - DNA, 22 bp, Homo sapiens
cagatgaactgtgactgaaaat

SEQ ID NO: 9319511 - DNA, 22 bp, Homo sapiens
agcctgcttggcagccctccca

SEQ ID NO: 9319512 - DNA, 22 bp, Homo sapiens
agcctgcttcctcagggaacaa

SEQ ID NO: 9319513 - DNA, 22 bp, Homo sapiens
agcctgcttgagagtcctggct

SEQ ID NO: 9319514 - DNA, 19 bp, Homo sapiens
agcctggagggctggtcac

SEQ ID NO: 9319515 - DNA, 22 bp, Homo sapiens
cagcactgctgctgtacacaca

SEQ ID NO: 9319516 - DNA, 22 bp, Homo sapiens
attcctttggactcctccttgc

SEQ ID NO: 9319517 - DNA, 22 bp, Homo sapiens
attcccactagctctttataga

SEQ ID NO: 9319518 - DNA, 22 bp, Homo sapiens
attcccacctgaaaaaggtagg

SEQ ID NO: 9319519 - DNA, 22 bp, Homo sapiens
attcgcgggcctggagggtggg

SEQ ID NO: 9319520 - DNA, 19 bp, Homo sapiens
attcttctcttcctgctgt

SEQ ID NO: 9319521 - DNA, 22 bp, Homo sapiens
attctacaacccaataataatt

SEQ ID NO: 9319522 - DNA, 20 bp, Homo sapiens
attctacaagaataagcatg

SEQ ID NO: 9319523 - DNA, 22 bp, Homo sapiens
attctctcatttatctgtccta

SEQ ID NO: 9319524 - DNA, 22 bp, Homo sapiens
attctctcttctgctgcccgtg

SEQ ID NO: 9319525 - DNA, 22 bp, Homo sapiens
attctctctagaagctgagatg

SEQ ID NO: 9319526 - DNA, 22 bp, Homo sapiens
attctctctctatgaaaactga

SEQ ID NO: 9319527 - DNA, 22 bp, Homo sapiens
agaggccctgggctggtgtgct

SEQ ID NO: 9319528 - DNA, 22 bp, Homo sapiens
agaggccggccgagcccatggg

SEQ ID NO: 9319529 - DNA, 22 bp, Homo sapiens
agaggccctggctagagcagct

SEQ ID NO: 9319530 - DNA, 22 bp, Homo sapiens
attatttctcactcacataata

SEQ ID NO: 9319531 - DNA, 22 bp, Homo sapiens
attatttgacttgagaacaggt

SEQ ID NO: 9319532 - DNA, 22 bp, Homo sapiens
agagctttgtttgattgtcaga

SEQ ID NO: 9319533 - DNA, 22 bp, Homo sapiens
agagctttgggacatttgctag

SEQ ID NO: 9319534 - DNA, 22 bp, Homo sapiens
attaataaaataccactttgtt

SEQ ID NO: 9319535 - DNA, 22 bp, Homo sapiens
agaggaaacataggtttttaaa

SEQ ID NO: 9319536 - DNA, 22 bp, Homo sapiens
agagcttttgggaattcaggta

SEQ ID NO: 9319537 - DNA, 22 bp, Homo sapiens
agagctttttgacatctctcta

SEQ ID NO: 9319538 - DNA, 21 bp, Homo sapiens
agaggaagaagagtgtattat

SEQ ID NO: 9319539 - DNA, 22 bp, Homo sapiens
agaggccctctctgctcagtct

SEQ ID NO: 9319540 - DNA, 22 bp, Homo sapiens
agataaattcctaagatttcag

SEQ ID NO: 9319541 - DNA, 22 bp, Homo sapiens
agataattatttacttcaaagt

SEQ ID NO: 9319542 - DNA, 22 bp, Homo sapiens
attgtattataattaggccaaa

SEQ ID NO: 9319543 - DNA, 22 bp, Homo sapiens
attgtatttccagcttgaatgt

SEQ ID NO: 9319544 - DNA, 22 bp, Homo sapiens
attgaaaaattcacaattctgg

SEQ ID NO: 9319545 - DNA, 22 bp, Homo sapiens
attgaaaaattcacaattctgg

SEQ ID NO: 9319546 - DNA, 22 bp, Homo sapiens
attgaaaaatgactattgctta

SEQ ID NO: 9319547 - DNA, 22 bp, Homo sapiens
attgaaaaatgactattgctta

SEQ ID NO: 9319548 - DNA, 22 bp, Homo sapiens
attgaaaatgacatttgtgccc

SEQ ID NO: 9319549 - DNA, 22 bp, Homo sapiens
attgaaaatataattctaggag

SEQ ID NO: 9319550 - DNA, 22 bp, Homo sapiens
attgaaatccctacctcagagg

SEQ ID NO: 9319551 - DNA, 22 bp, Homo sapiens
attgtataagtctatttacaat

SEQ ID NO: 9319552 - DNA, 22 bp, Homo sapiens
attgtataacagcatgtatttt

SEQ ID NO: 9319553 - DNA, 22 bp, Homo sapiens
attgagagtgtatagctgatct

SEQ ID NO: 9319554 - DNA, 22 bp, Homo sapiens
atttacagccttgaaaacagca

SEQ ID NO: 9319555 - DNA, 22 bp, Homo sapiens
atttctcttcctcctagggttg

SEQ ID NO: 9319556 - DNA, 22 bp, Homo sapiens
atttacaggtagaattttaagt

SEQ ID NO: 9319557 - DNA, 22 bp, Homo sapiens
atttctcttagcaagacattac

SEQ ID NO: 9319558 - DNA, 22 bp, Homo sapiens
agatgaggggtagaaaggactt

SEQ ID NO: 9319559 - DNA, 21 bp, Homo sapiens
agatgaggatactgaggccta

SEQ ID NO: 9319560 - DNA, 22 bp, Homo sapiens
agatttatgtggtcacactcag

SEQ ID NO: 9319561 - DNA, 21 bp, Homo sapiens
attttctgtgatagctgtctc

SEQ ID NO: 9319562 - DNA, 22 bp, Homo sapiens
attttctgtaactatttctata

SEQ ID NO: 9319563 - DNA, 22 bp, Homo sapiens
agattgtcattgacgatgagca

SEQ ID NO: 9319564 - DNA, 22 bp, Homo sapiens
agattgctaatgaagttcttga

SEQ ID NO: 9319565 - DNA, 22 bp, Homo sapiens
caaacatttgttggaacccctg

SEQ ID NO: 9319566 - DNA, 23 bp, Homo sapiens
agcaataagaagggatacatgtg

SEQ ID NO: 9319567 - DNA, 22 bp, Homo sapiens
agcaataagggatcctctataa

SEQ ID NO: 9319568 - DNA, 22 bp, Homo sapiens
agcaataatttaggcctttcct

SEQ ID NO: 9319569 - DNA, 22 bp, Homo sapiens
agcaatcaccacctctatattt

SEQ ID NO: 9319570 - DNA, 22 bp, Homo sapiens
caaagttttagtaaacatatat

SEQ ID NO: 9319571 - DNA, 22 bp, Homo sapiens
caaagtttggctctcatgacat

SEQ ID NO: 9319572 - DNA, 22 bp, Homo sapiens
caaagtttaaagtagatttcag

SEQ ID NO: 9319573 - DNA, 22 bp, Homo sapiens
agcaatgactggctatatgatt

SEQ ID NO: 9319574 - DNA, 22 bp, Homo sapiens
attttgtgggttctgctgatgt

SEQ ID NO: 9319575 - DNA, 22 bp, Homo sapiens
agcaataaccactctaatttat

SEQ ID NO: 9319576 - DNA, 22 bp, Homo sapiens
agcaataacagaaaactttcct

SEQ ID NO: 9319577 - DNA, 22 bp, Homo sapiens
agcaataaatgtaaaggttaag

SEQ ID NO: 9319578 - DNA, 22 bp, Homo sapiens
agcaagtagtaccaagtagctc

SEQ ID NO: 9319579 - DNA, 23 bp, Homo sapiens
attttttgtctttgtaactagat

SEQ ID NO: 9319580 - DNA, 22 bp, Homo sapiens
atgaggcaaggatcaggtaagg

SEQ ID NO: 9319581 - DNA, 22 bp, Homo sapiens
atgacttaatcatacttgcatt

SEQ ID NO: 9319582 - DNA, 22 bp, Homo sapiens
atgacttattacaagtcatatt

SEQ ID NO: 9319583 - DNA, 22 bp, Homo sapiens
atgaggagaccaaggcctgatg

SEQ ID NO: 9319584 - DNA, 22 bp, Homo sapiens
atgaggaggccagtaagagcct

SEQ ID NO: 9319585 - DNA, 22 bp, Homo sapiens
atgaggaggccagtaagagcct

SEQ ID NO: 9319586 - DNA, 22 bp, Homo sapiens
atgatatatgtgttgagcttgc

SEQ ID NO: 9319587 - DNA, 22 bp, Homo sapiens
atgattgaaaatgacattgcca

SEQ ID NO: 9319588 - DNA, 22 bp, Homo sapiens
atgattgaccatctgctgggct

SEQ ID NO: 9319589 - DNA, 22 bp, Homo sapiens
atgcaaatgtttaagttactat

SEQ ID NO: 9319590 - DNA, 22 bp, Homo sapiens
atgcaaatgtcaccacttctaa

SEQ ID NO: 9319591 - DNA, 22 bp, Homo sapiens
atgcaaatgctagagaatgttg

SEQ ID NO: 9319592 - DNA, 22 bp, Homo sapiens
atctgggcctgttccctcacct

SEQ ID NO: 9319593 - DNA, 22 bp, Homo sapiens
atgactgctctgggctcccatg

SEQ ID NO: 9319594 - DNA, 22 bp, Homo sapiens
atgactgattacccaagcctct

SEQ ID NO: 9319595 - DNA, 22 bp, Homo sapiens
atcttacacgataactgttagt

SEQ ID NO: 9319596 - DNA, 22 bp, Homo sapiens
atcttaatcgagtccatgaaaa

SEQ ID NO: 9319597 - DNA, 22 bp, Homo sapiens
atcttacattccctcaccattt

SEQ ID NO: 9319598 - DNA, 22 bp, Homo sapiens
atgctgagaaacctgtctggca

SEQ ID NO: 9319599 - DNA, 22 bp, Homo sapiens
atgctgagactggagcagctgg

SEQ ID NO: 9319600 - DNA, 22 bp, Homo sapiens
atgctgaagagttcatgattat

SEQ ID NO: 9319601 - DNA, 22 bp, Homo sapiens
atgctgaatgaaagaaattagt

SEQ ID NO: 9319602 - DNA, 22 bp, Homo sapiens
atgctgaactgagatgtaactt

SEQ ID NO: 9319603 - DNA, 22 bp, Homo sapiens
atgctgaaaattggatttgaat

SEQ ID NO: 9319604 - DNA, 22 bp, Homo sapiens
atgcttccctttgctccacatg

SEQ ID NO: 9319605 - DNA, 22 bp, Homo sapiens
atgcttccctcacatatcctgg

SEQ ID NO: 9319606 - DNA, 22 bp, Homo sapiens
atgcttcctaaccatggccgtg

SEQ ID NO: 9319607 - DNA, 20 bp, Homo sapiens
atgcttccagggtgtgtctg

SEQ ID NO: 9319608 - DNA, 22 bp, Homo sapiens
atgcttccagattggtaggggt

SEQ ID NO: 9319609 - DNA, 22 bp, Homo sapiens
atgcttcccctctcatttcagc

SEQ ID NO: 9319610 - DNA, 22 bp, Homo sapiens
atgcttccatgaacgttcttgt

SEQ ID NO: 9319611 - DNA, 22 bp, Homo sapiens
atgcttccaacagttctgtgaa

SEQ ID NO: 9319612 - DNA, 22 bp, Homo sapiens
atgcttccaatattctcccttt

SEQ ID NO: 9319613 - DNA, 22 bp, Homo sapiens
atgcttccaaggctaagacaag

SEQ ID NO: 9319614 - DNA, 23 bp, Homo sapiens
atgcttccacagagcttgcagcc

SEQ ID NO: 9319615 - DNA, 22 bp, Homo sapiens
atgcttccactgttctgctctc

SEQ ID NO: 9319616 - DNA, 22 bp, Homo sapiens
atgcttcctctacggcctctga

SEQ ID NO: 9319617 - DNA, 22 bp, Homo sapiens
atgcttccttaccagaagatga

SEQ ID NO: 9319618 - DNA, 22 bp, Homo sapiens
atgcttcctcccttccactcaa

SEQ ID NO: 9319619 - DNA, 22 bp, Homo sapiens
atgcttcctttttcccttaagg

SEQ ID NO: 9319620 - DNA, 22 bp, Homo sapiens
atgcaaattctttgcttcttct

SEQ ID NO: 9319621 - DNA, 22 bp, Homo sapiens
atgcaacaaatgctacgaatcg

SEQ ID NO: 9319622 - DNA, 22 bp, Homo sapiens
atgtgcagaggcttccttgact

SEQ ID NO: 9319623 - DNA, 22 bp, Homo sapiens
atgtgcagcttttctagagaag

SEQ ID NO: 9319624 - DNA, 22 bp, Homo sapiens
atgtgcaggatccaggctccta

SEQ ID NO: 9319625 - DNA, 22 bp, Homo sapiens
atgtgcaaatccaatgtgaatg

SEQ ID NO: 9319626 - DNA, 22 bp, Homo sapiens
atgtcttgatattttactgttt

SEQ ID NO: 9319627 - DNA, 22 bp, Homo sapiens
agagccagcaagtgaatagtga

SEQ ID NO: 9319628 - DNA, 22 bp, Homo sapiens
agagccagcatttgggccctgc

SEQ ID NO: 9319629 - DNA, 22 bp, Homo sapiens
agagccaggactgtgtctcact

SEQ ID NO: 9319630 - DNA, 22 bp, Homo sapiens
agagccaggactgtgtctcact

SEQ ID NO: 9319631 - DNA, 22 bp, Homo sapiens
agagccaggaagtggcgtgggg

SEQ ID NO: 9319632 - DNA, 22 bp, Homo sapiens
agagctccgtgcctggctgcca

SEQ ID NO: 9319633 - DNA, 22 bp, Homo sapiens
agagctcctcacttcgggttca

SEQ ID NO: 9319634 - DNA, 22 bp, Homo sapiens
attaagctggtccagacaagtt

SEQ ID NO: 9319635 - DNA, 22 bp, Homo sapiens
agagctcagtgtgttatggtta

SEQ ID NO: 9319636 - DNA, 22 bp, Homo sapiens
agagcctgttttgtgggagatg

SEQ ID NO: 9319637 - DNA, 22 bp, Homo sapiens
agagctaagaaacagaattgct

SEQ ID NO: 9319638 - DNA, 22 bp, Homo sapiens
agagctaagaaacagaattgct

SEQ ID NO: 9319639 - DNA, 22 bp, Homo sapiens
agagctaggaatgaccactctc

SEQ ID NO: 9319640 - DNA, 22 bp, Homo sapiens
atgttcaacagtttgcacacat

SEQ ID NO: 9319641 - DNA, 22 bp, Homo sapiens
atgttcaaactttttacacacc

SEQ ID NO: 9319642 - DNA, 22 bp, Homo sapiens
atgttcctcattcttgcaaccc

SEQ ID NO: 9319643 - DNA, 22 bp, Homo sapiens
atgggccttgacacatggagtg

SEQ ID NO: 9319644 - DNA, 22 bp, Homo sapiens
atgtacatactgcattttcaaa

SEQ ID NO: 9319645 - DNA, 22 bp, Homo sapiens
atgtacatagcatcatctagga

SEQ ID NO: 9319646 - DNA, 22 bp, Homo sapiens
agagatggcgtctcagagcctg

SEQ ID NO: 9319647 - DNA, 22 bp, Homo sapiens
atgtatatgaagctagtatttt

SEQ ID NO: 9319648 - DNA, 22 bp, Homo sapiens
atgtatatgaagctagtatttt

SEQ ID NO: 9319649 - DNA, 23 bp, Homo sapiens
atggacagggtttcagggtcaca

SEQ ID NO: 9319650 - DNA, 22 bp, Homo sapiens
atgggcagtgtattggaaggaa

SEQ ID NO: 9319651 - DNA, 22 bp, Homo sapiens
atgggcagtgtattggaaggaa

SEQ ID NO: 9319652 - DNA, 22 bp, Homo sapiens
atggacagctcttatgtgggca

SEQ ID NO: 9319653 - DNA, 22 bp, Homo sapiens
aggctgctggcaggcgtggacg

SEQ ID NO: 9319654 - DNA, 22 bp, Homo sapiens
aggctgctgccttggagagtgt

SEQ ID NO: 9319655 - DNA, 22 bp, Homo sapiens
aggctgctgccttggagagtgt

SEQ ID NO: 9319656 - DNA, 22 bp, Homo sapiens
acatttctcaggtaagtcattt

SEQ ID NO: 9319657 - DNA, 18 bp, Homo sapiens
acatttctccttctgacc

SEQ ID NO: 9319658 - DNA, 22 bp, Homo sapiens
aggctggcatacatttgttctt

SEQ ID NO: 9319659 - DNA, 23 bp, Homo sapiens
aggctggcttcaggagcctctcc

SEQ ID NO: 9319660 - DNA, 22 bp, Homo sapiens
aggctggccagtgctgcagtgg

SEQ ID NO: 9319661 - DNA, 22 bp, Homo sapiens
aggctggcttggctctcctgtg

SEQ ID NO: 9319662 - DNA, 22 bp, Homo sapiens
aggctggcttggctctcctgtg

SEQ ID NO: 9319663 - DNA, 22 bp, Homo sapiens
aggctggcttcccaagcgtcct

SEQ ID NO: 9319664 - DNA, 23 bp, Homo sapiens
aggctggcttcaggagcctctcc

SEQ ID NO: 9319665 - DNA, 23 bp, Homo sapiens
aggctggcttcaggagcctctcc

SEQ ID NO: 9319666 - DNA, 22 bp, Homo sapiens
aggctgtgatgagcctcatgga

SEQ ID NO: 9319667 - DNA, 22 bp, Homo sapiens
accactgcccatggtgaaaact

SEQ ID NO: 9319668 - DNA, 21 bp, Homo sapiens
accactgcctccaaggttcag

SEQ ID NO: 9319669 - DNA, 22 bp, Homo sapiens
accagaaaggaataatagaatt

SEQ ID NO: 9319670 - DNA, 22 bp, Homo sapiens
aggctgggaaacctgaagttgt

SEQ ID NO: 9319671 - DNA, 22 bp, Homo sapiens
aggctggctttggtagcatggt

SEQ ID NO: 9319672 - DNA, 22 bp, Homo sapiens
aggctggctttggtagcatggt

SEQ ID NO: 9319673 - DNA, 22 bp, Homo sapiens
aggctgggaaatgtattccagc

SEQ ID NO: 9319674 - DNA, 22 bp, Homo sapiens
aggctgggaaatgtagtcttcc

SEQ ID NO: 9319675 - DNA, 22 bp, Homo sapiens
aggctgtgagttttgtctcaga

SEQ ID NO: 9319676 - DNA, 19 bp, Homo sapiens
aggctgtgaggggaaggaa

SEQ ID NO: 9319677 - DNA, 19 bp, Homo sapiens
aggctgtgagggaggactc

SEQ ID NO: 9319678 - DNA, 22 bp, Homo sapiens
aggctgtgagaagtccttcagt

SEQ ID NO: 9319679 - DNA, 22 bp, Homo sapiens
acatgtattgacattatattct

SEQ ID NO: 9319680 - DNA, 22 bp, Homo sapiens
aggctatttccactcttctcat

SEQ ID NO: 9319681 - DNA, 22 bp, Homo sapiens
aggctcaggaggagctgccgga

SEQ ID NO: 9319682 - DNA, 22 bp, Homo sapiens
aggctcagggacggggcccctt

SEQ ID NO: 9319683 - DNA, 22 bp, Homo sapiens
aggctcaggcaggaatggcgga

SEQ ID NO: 9319684 - DNA, 20 bp, Homo sapiens
aggctcagctgagctcttgg

SEQ ID NO: 9319685 - DNA, 22 bp, Homo sapiens
aggctcagctggtggtgatcgc

SEQ ID NO: 9319686 - DNA, 20 bp, Homo sapiens
aggctcagctgagctcttgg

SEQ ID NO: 9319687 - DNA, 22 bp, Homo sapiens
aggctctataccgctgggagtt

SEQ ID NO: 9319688 - DNA, 22 bp, Homo sapiens
aggctctcagatcagccacatt

SEQ ID NO: 9319689 - DNA, 22 bp, Homo sapiens
aggctctctagaaactgtgcct

SEQ ID NO: 9319690 - DNA, 22 bp, Homo sapiens
aggctctctctgcccctgggac

SEQ ID NO: 9319691 - DNA, 20 bp, Homo sapiens
aggctcagggtgtttaggaa

SEQ ID NO: 9319692 - DNA, 22 bp, Homo sapiens
aggctcagggactccctccctc

SEQ ID NO: 9319693 - DNA, 22 bp, Homo sapiens
aggctcaggtctcaggtctggc

SEQ ID NO: 9319694 - DNA, 22 bp, Homo sapiens
acattaaaatggagaattttga

SEQ ID NO: 9319695 - DNA, 22 bp, Homo sapiens
aggctctaaggagggctgtcta

SEQ ID NO: 9319696 - DNA, 22 bp, Homo sapiens
aggctccagtctcctctggcag

SEQ ID NO: 9319697 - DNA, 22 bp, Homo sapiens
acattaaatttcatagtgatta

SEQ ID NO: 9319698 - DNA, 22 bp, Homo sapiens
agggccagcactcctggcagga

SEQ ID NO: 9319699 - DNA, 22 bp, Homo sapiens
agggccagcagcttggccaacc

SEQ ID NO: 9319700 - DNA, 21 bp, Homo sapiens
agggccagatcaccaaggagc

SEQ ID NO: 9319701 - DNA, 22 bp, Homo sapiens
agggctcaatggtgggcatgta

SEQ ID NO: 9319702 - DNA, 22 bp, Homo sapiens
agggctcaccactgtgcactcc

SEQ ID NO: 9319703 - DNA, 22 bp, Homo sapiens
agggccagttcagaggacatgg

SEQ ID NO: 9319704 - DNA, 22 bp, Homo sapiens
agggccagttcagaggacatgg

SEQ ID NO: 9319705 - DNA, 22 bp, Homo sapiens
agggccagttcagaggacatgg

SEQ ID NO: 9319706 - DNA, 22 bp, Homo sapiens
agggcacaagactctgagcccc

SEQ ID NO: 9319707 - DNA, 22 bp, Homo sapiens
agggctgaagggaggtgctcat

SEQ ID NO: 9319708 - DNA, 22 bp, Homo sapiens
agggctcagtaaacggtggatt

SEQ ID NO: 9319709 - DNA, 22 bp, Homo sapiens
agggctgacagtaaaagtatga

SEQ ID NO: 9319710 - DNA, 22 bp, Homo sapiens
agggctcactgggaggctataa

SEQ ID NO: 9319711 - DNA, 22 bp, Homo sapiens
agggctcagaacaatgagtgta

SEQ ID NO: 9319712 - DNA, 22 bp, Homo sapiens
agggctcagagcaaaagggcac

SEQ ID NO: 9319713 - DNA, 22 bp, Homo sapiens
agggctcagaaatgtctacggg

SEQ ID NO: 9319714 - DNA, 22 bp, Homo sapiens
agggctcagccagcctgtgtgc

SEQ ID NO: 9319715 - DNA, 22 bp, Homo sapiens
agggctcagccagcctgtgtgc

SEQ ID NO: 9319716 - DNA, 22 bp, Homo sapiens
agggctttcggcactctgaggg

SEQ ID NO: 9319717 - DNA, 22 bp, Homo sapiens
agggctttgagaatagtggaac

SEQ ID NO: 9319718 - DNA, 22 bp, Homo sapiens
aggggcagttccaagttttgtg

SEQ ID NO: 9319719 - DNA, 22 bp, Homo sapiens
aggggcaggtgctgcacttaga

SEQ ID NO: 9319720 - DNA, 22 bp, Homo sapiens
aggggcctcagcctcctggtca

SEQ ID NO: 9319721 - DNA, 20 bp, Homo sapiens
aggggcctggaacaggcctt

SEQ ID NO: 9319722 - DNA, 22 bp, Homo sapiens
aggggtggcctgccttactccc

SEQ ID NO: 9319723 - DNA, 22 bp, Homo sapiens
aggggtggagagtgttgccagt

SEQ ID NO: 9319724 - DNA, 22 bp, Homo sapiens
aggggtggagagtgttgccagt

SEQ ID NO: 9319725 - DNA, 22 bp, Homo sapiens
aggggtgatttgggacaggaca

SEQ ID NO: 9319726 - DNA, 23 bp, Homo sapiens
aggggtggtcagtacccgcagtg

SEQ ID NO: 9319727 - DNA, 22 bp, Homo sapiens
aggcagaagccagccagggtcc

SEQ ID NO: 9319728 - DNA, 22 bp, Homo sapiens
aggcagaagccagccagggtcc

SEQ ID NO: 9319729 - DNA, 22 bp, Homo sapiens
aggcagaaccagctgggacttt

SEQ ID NO: 9319730 - DNA, 22 bp, Homo sapiens
aggcagatatttcagttcacat

SEQ ID NO: 9319731 - DNA, 22 bp, Homo sapiens
aggcagatcagtacagggttaa

SEQ ID NO: 9319732 - DNA, 22 bp, Homo sapiens
aggcagatcacttgaggccagg

SEQ ID NO: 9319733 - DNA, 22 bp, Homo sapiens
aggcagagaaaaaccagatatg

SEQ ID NO: 9319734 - DNA, 22 bp, Homo sapiens
aggcagatgtgtcttctaaaat

SEQ ID NO: 9319735 - DNA, 22 bp, Homo sapiens
aggcagatgggcgtctataaat

SEQ ID NO: 9319736 - DNA, 22 bp, Homo sapiens
aggcagattacttgaggccagg

SEQ ID NO: 9319737 - DNA, 22 bp, Homo sapiens
aggcagattttctttactcagt

SEQ ID NO: 9319738 - DNA, 18 bp, Homo sapiens
aggcaggtgctggaagtc

SEQ ID NO: 9319739 - DNA, 22 bp, Homo sapiens
aggcaggggagctggaagggta

SEQ ID NO: 9319740 - DNA, 18 bp, Homo sapiens
aggcaggtgctggaagtc

SEQ ID NO: 9319741 - DNA, 22 bp, Homo sapiens
aggcaggtgcttatgacttgct

SEQ ID NO: 9319742 - DNA, 22 bp, Homo sapiens
aggcaggtgggagtgattcctt

SEQ ID NO: 9319743 - DNA, 22 bp, Homo sapiens
aggcaggtgttaaccctctgag

SEQ ID NO: 9319744 - DNA, 22 bp, Homo sapiens
aggcaggtgggtcacttgagtc

SEQ ID NO: 9319745 - DNA, 22 bp, Homo sapiens
aggcaggtgttgggagacacca

SEQ ID NO: 9319746 - DNA, 22 bp, Homo sapiens
aggcaggtgttacctctggttt

SEQ ID NO: 9319747 - DNA, 22 bp, Homo sapiens
aggcaggttacaaaaactttat

SEQ ID NO: 9319748 - DNA, 22 bp, Homo sapiens
aggcaggttggggaaaagcact

SEQ ID NO: 9319749 - DNA, 22 bp, Homo sapiens
acatctgaaagggattgcagaa

SEQ ID NO: 9319750 - DNA, 22 bp, Homo sapiens
acatctcttataaactctctga

SEQ ID NO: 9319751 - DNA, 22 bp, Homo sapiens
acatatatgtaaagtactttgt

SEQ ID NO: 9319752 - DNA, 22 bp, Homo sapiens
acatctttatactagtccttga

SEQ ID NO: 9319753 - DNA, 20 bp, Homo sapiens
aggcagtgtagagatgagta

SEQ ID NO: 9319754 - DNA, 20 bp, Homo sapiens
aggcagtgtagagatgagta

SEQ ID NO: 9319755 - DNA, 22 bp, Homo sapiens
aggcagtgtattgctagcggct

SEQ ID NO: 9319756 - DNA, 22 bp, Homo sapiens
aggcagtgtgtagctggaagag

SEQ ID NO: 9319757 - DNA, 19 bp, Homo sapiens
aggaggccatgccactaga

SEQ ID NO: 9319758 - DNA, 19 bp, Homo sapiens
aggaggccatgccactaga

SEQ ID NO: 9319759 - DNA, 22 bp, Homo sapiens
aggaggccaggccctcaagcct

SEQ ID NO: 9319760 - DNA, 22 bp, Homo sapiens
aggaggccaggccctcaagcct

SEQ ID NO: 9319761 - DNA, 22 bp, Homo sapiens
acagtgagcccactccaggaga

SEQ ID NO: 9319762 - DNA, 22 bp, Homo sapiens
aggaggcaggaagtctatggga

SEQ ID NO: 9319763 - DNA, 22 bp, Homo sapiens
aggactgttttttcttctaggg

SEQ ID NO: 9319764 - DNA, 22 bp, Homo sapiens
acagtgttctcttcctgtatag

SEQ ID NO: 9319765 - DNA, 22 bp, Homo sapiens
acagtgttctcttcctgtatag

SEQ ID NO: 9319766 - DNA, 22 bp, Homo sapiens
acagtgttcacttaacaatgga

SEQ ID NO: 9319767 - DNA, 22 bp, Homo sapiens
acagtgttcctttgttgtgact

SEQ ID NO: 9319768 - DNA, 22 bp, Homo sapiens
acagtgttcactaaggttagct

SEQ ID NO: 9319769 - DNA, 20 bp, Homo sapiens
acagtgttaggtttttcctt

SEQ ID NO: 9319770 - DNA, 22 bp, Homo sapiens
acagtgttcaaaccactaggct

SEQ ID NO: 9319771 - DNA, 22 bp, Homo sapiens
acagtgttatttctgagtaatg

SEQ ID NO: 9319772 - DNA, 20 bp, Homo sapiens
acagtgttagttatcatctc

SEQ ID NO: 9319773 - DNA, 22 bp, Homo sapiens
acagtgttacttgatagtgtat

SEQ ID NO: 9319774 - DNA, 22 bp, Homo sapiens
aggcacctgaggtggccagcct

SEQ ID NO: 9319775 - DNA, 22 bp, Homo sapiens
aggcacctggatcttggaattc

SEQ ID NO: 9319776 - DNA, 22 bp, Homo sapiens
aggcacctggccagttgtcttg

SEQ ID NO: 9319777 - DNA, 19 bp, Homo sapiens
aggcaccttgatggcttcc

SEQ ID NO: 9319778 - DNA, 22 bp, Homo sapiens
aggcaccaggttgtggtttgtc

SEQ ID NO: 9319779 - DNA, 22 bp, Homo sapiens
acagggccaggtgagaggtgct

SEQ ID NO: 9319780 - DNA, 22 bp, Homo sapiens
acagggcctcagccagggcaga

SEQ ID NO: 9319781 - DNA, 22 bp, Homo sapiens
acagggctatattcctcagagc

SEQ ID NO: 9319782 - DNA, 22 bp, Homo sapiens
acagggctatattcctcagagc

SEQ ID NO: 9319783 - DNA, 23 bp, Homo sapiens
acagggctagctgacagtggtat

SEQ ID NO: 9319784 - DNA, 22 bp, Homo sapiens
aggactggccctgaggggaggc

SEQ ID NO: 9319785 - DNA, 22 bp, Homo sapiens
aggactggccctgaggggaggc

SEQ ID NO: 9319786 - DNA, 22 bp, Homo sapiens
aggactggcagtgtgaggggtc

SEQ ID NO: 9319787 - DNA, 22 bp, Homo sapiens
aggactggcagtgtgaggggtc

SEQ ID NO: 9319788 - DNA, 22 bp, Homo sapiens
aggactggcagtgtgaggggtc

SEQ ID NO: 9319789 - DNA, 22 bp, Homo sapiens
aggactgggtgcagagggcatc

SEQ ID NO: 9319790 - DNA, 22 bp, Homo sapiens
aggactgggtgcagagggcatc

SEQ ID NO: 9319791 - DNA, 22 bp, Homo sapiens
aggactgggtgcagagggcatc

SEQ ID NO: 9319792 - DNA, 22 bp, Homo sapiens
aggactggcggtcggtggggat

SEQ ID NO: 9319793 - DNA, 22 bp, Homo sapiens
aggactggtgccagacaaggta

SEQ ID NO: 9319794 - DNA, 22 bp, Homo sapiens
acaggctctcagccagttggca

SEQ ID NO: 9319795 - DNA, 22 bp, Homo sapiens
acaggctctctattgagtgcag

SEQ ID NO: 9319796 - DNA, 22 bp, Homo sapiens
acaggctctctattgagtgcag

SEQ ID NO: 9319797 - DNA, 22 bp, Homo sapiens
acagggcatgtgcaagagacat

SEQ ID NO: 9319798 - DNA, 23 bp, Homo sapiens
acagggcattgctggcctcgagg

SEQ ID NO: 9319799 - DNA, 17 bp, Homo sapiens
aggaaagtctgctgtcc

SEQ ID NO: 9319800 - DNA, 22 bp, Homo sapiens
aggaaagtgaatgttattttgc

SEQ ID NO: 9319801 - DNA, 22 bp, Homo sapiens
aggaaataagggcacttcagat

SEQ ID NO: 9319802 - DNA, 22 bp, Homo sapiens
acaggcctggtgctgctgacag

SEQ ID NO: 9319803 - DNA, 22 bp, Homo sapiens
acaggccttaggagagatgggg

SEQ ID NO: 9319804 - DNA, 22 bp, Homo sapiens
acaggcctgtgtgcacacgagg

SEQ ID NO: 9319805 - DNA, 22 bp, Homo sapiens
acaggccttggtcctgacctaa

SEQ ID NO: 9319806 - DNA, 22 bp, Homo sapiens
acaggccttggcaggcatgtga

SEQ ID NO: 9319807 - DNA, 22 bp, Homo sapiens
acaggccttggcaggcatgtga

SEQ ID NO: 9319808 - DNA, 22 bp, Homo sapiens
acaggacatggcttctgtgacg

SEQ ID NO: 9319809 - DNA, 22 bp, Homo sapiens
acaggacatgtaccaggtggtc

SEQ ID NO: 9319810 - DNA, 22 bp, Homo sapiens
acaggacatgtaccaggtggtc

SEQ ID NO: 9319811 - DNA, 22 bp, Homo sapiens
acaggacaggctgggctagact

SEQ ID NO: 9319812 - DNA, 22 bp, Homo sapiens
acaggacaggctgggctagact

SEQ ID NO: 9319813 - DNA, 22 bp, Homo sapiens
acaggatcgccctgttgcccag

SEQ ID NO: 9319814 - DNA, 22 bp, Homo sapiens
acaggacaatttataatgggca

SEQ ID NO: 9319815 - DNA, 22 bp, Homo sapiens
acaggacaaaaatctggatggc

SEQ ID NO: 9319816 - DNA, 23 bp, Homo sapiens
acaggaatttgtgcaccatgaag

SEQ ID NO: 9319817 - DNA, 22 bp, Homo sapiens
acagcttctcctcgatgtcatg

SEQ ID NO: 9319818 - DNA, 22 bp, Homo sapiens
acagcttctctgaaattcatgt

SEQ ID NO: 9319819 - DNA, 22 bp, Homo sapiens
acagcttctatttctctgtact

SEQ ID NO: 9319820 - DNA, 22 bp, Homo sapiens
acagcttcgaggatctcatccc

SEQ ID NO: 9319821 - DNA, 22 bp, Homo sapiens
acagcagttaacgatcagactc

SEQ ID NO: 9319822 - DNA, 22 bp, Homo sapiens
acagcatttaaagaaaatgaac

SEQ ID NO: 9319823 - DNA, 22 bp, Homo sapiens
agtgctttgaatgttctgggca

SEQ ID NO: 9319824 - DNA, 22 bp, Homo sapiens
agtgctttatgttgttgtgcaa

SEQ ID NO: 9319825 - DNA, 22 bp, Homo sapiens
agtgctttcagtgtgctctttt

SEQ ID NO: 9319826 - DNA, 22 bp, Homo sapiens
agtgctttcttgctccatcagt

SEQ ID NO: 9319827 - DNA, 22 bp, Homo sapiens
agtgctttccttcttgtgacat

SEQ ID NO: 9319828 - DNA, 22 bp, Homo sapiens
agtgggagataacttaacagct

SEQ ID NO: 9319829 - DNA, 20 bp, Homo sapiens
agtgggagagggcagactgc

SEQ ID NO: 9319830 - DNA, 22 bp, Homo sapiens
agtggctggaattgcaggtgcg

SEQ ID NO: 9319831 - DNA, 22 bp, Homo sapiens
agtgggagccagcagcttgggg

SEQ ID NO: 9319832 - DNA, 22 bp, Homo sapiens
agtgggagccagcagcttgggg

SEQ ID NO: 9319833 - DNA, 22 bp, Homo sapiens
agtgggaggaagtggtgatatt

SEQ ID NO: 9319834 - DNA, 20 bp, Homo sapiens
agtgcaagaaagcacagctg

SEQ ID NO: 9319835 - DNA, 22 bp, Homo sapiens
agtgattttgtagctatgagat

SEQ ID NO: 9319836 - DNA, 22 bp, Homo sapiens
agtgattttatcaatttactca

SEQ ID NO: 9319837 - DNA, 22 bp, Homo sapiens
agtgagatatgtctcactgtcc

SEQ ID NO: 9319838 - DNA, 22 bp, Homo sapiens
agtgaatgtccccgcgggtcag

SEQ ID NO: 9319839 - DNA, 22 bp, Homo sapiens
agtgaggataccaatgtgtaga

SEQ ID NO: 9319840 - DNA, 17 bp, Homo sapiens
agtgaggagattggaag

SEQ ID NO: 9319841 - DNA, 22 bp, Homo sapiens
agtgaggaaatccattatcaag

SEQ ID NO: 9319842 - DNA, 20 bp, Homo sapiens
agtgaggcagttcagtgggc

SEQ ID NO: 9319843 - DNA, 22 bp, Homo sapiens
agttacacaattattgcatgga

SEQ ID NO: 9319844 - DNA, 22 bp, Homo sapiens
agtggggcggacaggaccagga

SEQ ID NO: 9319845 - DNA, 21 bp, Homo sapiens
agtgtctctggaagcacgtgt

SEQ ID NO: 9319846 - DNA, 22 bp, Homo sapiens
agtgtgggttttatggagccct

SEQ ID NO: 9319847 - DNA, 22 bp, Homo sapiens
agtgtgggtgagggaggccctc

SEQ ID NO: 9319848 - DNA, 22 bp, Homo sapiens
agtgtcttagtccatttgggct

SEQ ID NO: 9319849 - DNA, 22 bp, Homo sapiens
aggtgaggataggtggccaagg

SEQ ID NO: 9319850 - DNA, 22 bp, Homo sapiens
aggtgagaaaacgagggttgca

SEQ ID NO: 9319851 - DNA, 19 bp, Homo sapiens
aggtgcaggtcacagggga

SEQ ID NO: 9319852 - DNA, 22 bp, Homo sapiens
aggtgcaggagctgtgcaggga

SEQ ID NO: 9319853 - DNA, 22 bp, Homo sapiens
aggtgcagtgaaggaaaaggaa

SEQ ID NO: 9319854 - DNA, 22 bp, Homo sapiens
aggtgcagtgtttaaaagtagc

SEQ ID NO: 9319855 - DNA, 23 bp, Homo sapiens
aggtgccaactgagagctgagag

SEQ ID NO: 9319856 - DNA, 21 bp, Homo sapiens
aggtgccaaggagaagcaggc

SEQ ID NO: 9319857 - DNA, 21 bp, Homo sapiens
aggtgccaaggagaagcaggc

SEQ ID NO: 9319858 - DNA, 22 bp, Homo sapiens
agggtccatgtttccagttaat

SEQ ID NO: 9319859 - DNA, 22 bp, Homo sapiens
agggtccatcaaggactgcaca

SEQ ID NO: 9319860 - DNA, 19 bp, Homo sapiens
agggtccagggagcggctc

SEQ ID NO: 9319861 - DNA, 18 bp, Homo sapiens
agggtcagtgtcactggc

SEQ ID NO: 9319862 - DNA, 22 bp, Homo sapiens
agggtcagtgatgagggagccc

SEQ ID NO: 9319863 - DNA, 22 bp, Homo sapiens
agggtccacttggacattgatc

SEQ ID NO: 9319864 - DNA, 23 bp, Homo sapiens
aggtggtcttgtggatgctgcaa

SEQ ID NO: 9319865 - DNA, 22 bp, Homo sapiens
aggtggtcttggcccacccagg

SEQ ID NO: 9319866 - DNA, 22 bp, Homo sapiens
aggtggtcttgtggatgccgca

SEQ ID NO: 9319867 - DNA, 22 bp, Homo sapiens
aggttccatcacctgcagtgga

SEQ ID NO: 9319868 - DNA, 22 bp, Homo sapiens
aggttccaggtctgggttatgt

SEQ ID NO: 9319869 - DNA, 21 bp, Homo sapiens
aggttccagcagccagagaat

SEQ ID NO: 9319870 - DNA, 22 bp, Homo sapiens
aggttctggcattgctcagtaa

SEQ ID NO: 9319871 - DNA, 22 bp, Homo sapiens
actcagagcctcgagggactgc

SEQ ID NO: 9319872 - DNA, 22 bp, Homo sapiens
aggtggagaagagatgggcagt

SEQ ID NO: 9319873 - DNA, 22 bp, Homo sapiens
aggtggagaagagatgggcagt

SEQ ID NO: 9319874 - DNA, 21 bp, Homo sapiens
aggtggtctgcagcagctgaa

SEQ ID NO: 9319875 - DNA, 22 bp, Homo sapiens
aggtggtcttaaactgctctgg

SEQ ID NO: 9319876 - DNA, 22 bp, Homo sapiens
aggtggtctagcatcacggtga

SEQ ID NO: 9319877 - DNA, 19 bp, Homo sapiens
aggtggtctaggctggaga

SEQ ID NO: 9319878 - DNA, 22 bp, Homo sapiens
aggtggtcactaactgccaaga

SEQ ID NO: 9319879 - DNA, 22 bp, Homo sapiens
aggtgggttccgcggcggcccg

SEQ ID NO: 9319880 - DNA, 15 bp, Homo sapiens
aggtggtcagtagca

SEQ ID NO: 9319881 - DNA, 22 bp, Homo sapiens
aggtggtccctataatgtggga

SEQ ID NO: 9319882 - DNA, 22 bp, Homo sapiens
aggtggtcgaatgaaataattt

SEQ ID NO: 9319883 - DNA, 22 bp, Homo sapiens
aggtggtccagagtaggaagtg

SEQ ID NO: 9319884 - DNA, 22 bp, Homo sapiens
aggtggagacccagagaaggcg

SEQ ID NO: 9319885 - DNA, 22 bp, Homo sapiens
agtcaggggttggacggggcca

SEQ ID NO: 9319886 - DNA, 22 bp, Homo sapiens
agtcagggttgtaggctcaccc

SEQ ID NO: 9319887 - DNA, 22 bp, Homo sapiens
agtaacagtaacatcttcctag

SEQ ID NO: 9319888 - DNA, 22 bp, Homo sapiens
agtaaccctctgattttaaagt

SEQ ID NO: 9319889 - DNA, 22 bp, Homo sapiens
agtaacatgctaatttgattat

SEQ ID NO: 9319890 - DNA, 22 bp, Homo sapiens
agtaagcaccgggatggtcaag

SEQ ID NO: 9319891 - DNA, 22 bp, Homo sapiens
actcagagttttacccagagac

SEQ ID NO: 9319892 - DNA, 22 bp, Homo sapiens
actcagagtttgcgttccatac

SEQ ID NO: 9319893 - DNA, 22 bp, Homo sapiens
actcagagttcctgtgcatagt

SEQ ID NO: 9319894 - DNA, 22 bp, Homo sapiens
actcagagtgcatctcctattt

SEQ ID NO: 9319895 - DNA, 22 bp, Homo sapiens
actcagagtctgtttggtacct

SEQ ID NO: 9319896 - DNA, 22 bp, Homo sapiens
actcagagtcaatgttaatggc

SEQ ID NO: 9319897 - DNA, 22 bp, Homo sapiens
actcagagtagaaaataggttc

SEQ ID NO: 9319898 - DNA, 22 bp, Homo sapiens
actcagaggggactggtgtggt

SEQ ID NO: 9319899 - DNA, 22 bp, Homo sapiens
actcagagtctgagataaatct

SEQ ID NO: 9319900 - DNA, 22 bp, Homo sapiens
actcagaggctggaaatcaaag

SEQ ID NO: 9319901 - DNA, 22 bp, Homo sapiens
actcagaggcagctgctcaccc

SEQ ID NO: 9319902 - DNA, 22 bp, Homo sapiens
actcagaggaaagttgagattg

SEQ ID NO: 9319903 - DNA, 22 bp, Homo sapiens
actcagaggaccaaaaggaaag

SEQ ID NO: 9319904 - DNA, 22 bp, Homo sapiens
actcagaggaaaccctcctagg

SEQ ID NO: 9319905 - DNA, 22 bp, Homo sapiens
actcagagcttggctccttgct

SEQ ID NO: 9319906 - DNA, 22 bp, Homo sapiens
actctgggctgttaggagctgt

SEQ ID NO: 9319907 - DNA, 22 bp, Homo sapiens
actctggggcgctactccaact

SEQ ID NO: 9319908 - DNA, 22 bp, Homo sapiens
agtcctggttctgattctgaca

SEQ ID NO: 9319909 - DNA, 22 bp, Homo sapiens
agtccaggaaaataagctaggt

SEQ ID NO: 9319910 - DNA, 22 bp, Homo sapiens
actctgggagaggacaaacaaa

SEQ ID NO: 9319911 - DNA, 22 bp, Homo sapiens
agtccaggcctccctctcctgc

SEQ ID NO: 9319912 - DNA, 21 bp, Homo sapiens
agtccaggcctgcccacttcc

SEQ ID NO: 9319913 - DNA, 20 bp, Homo sapiens
actttacagagaagactgac

SEQ ID NO: 9319914 - DNA, 22 bp, Homo sapiens
atagcatttacttttcagaaat

SEQ ID NO: 9319915 - DNA, 22 bp, Homo sapiens
atagcattatttacaattagta

SEQ ID NO: 9319916 - DNA, 22 bp, Homo sapiens
atagcatggccaggaagctggg

SEQ ID NO: 9319917 - DNA, 22 bp, Homo sapiens
atagaagcttttaaataacagg

SEQ ID NO: 9319918 - DNA, 22 bp, Homo sapiens
atagaagctgataaactacttc

SEQ ID NO: 9319919 - DNA, 22 bp, Homo sapiens
atactgttggcagcagaccaga

SEQ ID NO: 9319920 - DNA, 22 bp, Homo sapiens
atacacttccaaatattgatta

SEQ ID NO: 9319921 - DNA, 22 bp, Homo sapiens
atagttatgctctagacaagaa

SEQ ID NO: 9319922 - DNA, 17 bp, Homo sapiens
agaaaagagaccagcag

SEQ ID NO: 9319923 - DNA, 22 bp, Homo sapiens
agaaaagaggctttctaagcat

SEQ ID NO: 9319924 - DNA, 23 bp, Homo sapiens
agaaaagcttggacacatggcct

SEQ ID NO: 9319925 - DNA, 22 bp, Homo sapiens
atagctttgagggctccttagg

SEQ ID NO: 9319926 - DNA, 22 bp, Homo sapiens
ataggaaagaaaattatgtagg

SEQ ID NO: 9319927 - DNA, 22 bp, Homo sapiens
atacacactgctatcctttttt

SEQ ID NO: 9319928 - DNA, 22 bp, Homo sapiens
atacacacatatgtgagttttg

SEQ ID NO: 9319929 - DNA, 22 bp, Homo sapiens
atacacacgtgcacgtgggaaa

SEQ ID NO: 9319930 - DNA, 22 bp, Homo sapiens
atacacacaatcaggttttgta

SEQ ID NO: 9319931 - DNA, 22 bp, Homo sapiens
atacacaattgtgtttttatga

SEQ ID NO: 9319932 - DNA, 22 bp, Homo sapiens
atacaatgggtgcaaagatgtg

SEQ ID NO: 9319933 - DNA, 22 bp, Homo sapiens
atacaatgaagtatagatgaaa

SEQ ID NO: 9319934 - DNA, 22 bp, Homo sapiens
atacaatctagtctgtcagcaa

SEQ ID NO: 9319935 - DNA, 22 bp, Homo sapiens
ataagcttgatgtaactaacca

SEQ ID NO: 9319936 - DNA, 22 bp, Homo sapiens
ataagcttttaaagctactttg

SEQ ID NO: 9319937 - DNA, 22 bp, Homo sapiens
ataagcttttgattcacttcag

SEQ ID NO: 9319938 - DNA, 22 bp, Homo sapiens
ataagctttgctggagagacct

SEQ ID NO: 9319939 - DNA, 22 bp, Homo sapiens
ataagcttcctgttagaaaccg

SEQ ID NO: 9319940 - DNA, 22 bp, Homo sapiens
ataagctctggacagccacatt

SEQ ID NO: 9319941 - DNA, 22 bp, Homo sapiens
ataagctgaatagtcaacacaa

SEQ ID NO: 9319942 - DNA, 22 bp, Homo sapiens
ataagctgtactctataaatgt

SEQ ID NO: 9319943 - DNA, 22 bp, Homo sapiens
ataaggaaaattggagaaattg

SEQ ID NO: 9319944 - DNA, 22 bp, Homo sapiens
agttcagcttcccaggtcactg

SEQ ID NO: 9319945 - DNA, 22 bp, Homo sapiens
agttgaataattagacatatct

SEQ ID NO: 9319946 - DNA, 22 bp, Homo sapiens
agttctttgtgagtaatacaga

SEQ ID NO: 9319947 - DNA, 22 bp, Homo sapiens
ataaattgtgcttttgacatct

SEQ ID NO: 9319948 - DNA, 22 bp, Homo sapiens
ataaattttcttgctgtactta

SEQ ID NO: 9319949 - DNA, 22 bp, Homo sapiens
agaaagtttgtttttatccata

SEQ ID NO: 9319950 - DNA, 22 bp, Homo sapiens
agaaatgcagtcattgtatagt

SEQ ID NO: 9319951 - DNA, 22 bp, Homo sapiens
atcaagttctgtcacatttgtc

SEQ ID NO: 9319952 - DNA, 22 bp, Homo sapiens
atcaagttttcttagttgactg

SEQ ID NO: 9319953 - DNA, 22 bp, Homo sapiens
atcaagcagtgaaaaatgctag

SEQ ID NO: 9319954 - DNA, 22 bp, Homo sapiens
agaaagacaaaatgcagtggct

SEQ ID NO: 9319955 - DNA, 22 bp, Homo sapiens
atattaatgggatttagtcagg

SEQ ID NO: 9319956 - DNA, 22 bp, Homo sapiens
atattaatgggatttagtcagg

SEQ ID NO: 9319957 - DNA, 22 bp, Homo sapiens
atattaatgggatttagtcagg

SEQ ID NO: 9319958 - DNA, 22 bp, Homo sapiens
agaaaagggcaggagggataca

SEQ ID NO: 9319959 - DNA, 22 bp, Homo sapiens
atatagaatacacagggaaagt

SEQ ID NO: 9319960 - DNA, 20 bp, Homo sapiens
atatagagtcaaaatggctt

SEQ ID NO: 9319961 - DNA, 22 bp, Homo sapiens
atatagtaagcagtctgtaaat

SEQ ID NO: 9319962 - DNA, 19 bp, Homo sapiens
atatagcattattcaattt

SEQ ID NO: 9319963 - DNA, 22 bp, Homo sapiens
atatagattccatggttccttt

SEQ ID NO: 9319964 - DNA, 22 bp, Homo sapiens
atatagatcaaatgatgctaat

SEQ ID NO: 9319965 - DNA, 22 bp, Homo sapiens
agaaacttcagctattcttttg

SEQ ID NO: 9319966 - DNA, 22 bp, Homo sapiens
agaaacttcagctattcttttg

SEQ ID NO: 9319967 - DNA, 22 bp, Homo sapiens
agaaactgtgttactagaatgt

SEQ ID NO: 9319968 - DNA, 17 bp, Homo sapiens
agaaactgaggctcagt

SEQ ID NO: 9319969 - DNA, 22 bp, Homo sapiens
agaaactgcagctcagagaagt

SEQ ID NO: 9319970 - DNA, 22 bp, Homo sapiens
atatagtttaagaaagtacagt

SEQ ID NO: 9319971 - DNA, 22 bp, Homo sapiens
atcctggcgccacacggctcta

SEQ ID NO: 9319972 - DNA, 23 bp, Homo sapiens
atcctgctgatggccctccagga

SEQ ID NO: 9319973 - DNA, 23 bp, Homo sapiens
atcctgctgatggccctccagga

SEQ ID NO: 9319974 - DNA, 22 bp, Homo sapiens
atcctgaagcatgaatgtcaaa

SEQ ID NO: 9319975 - DNA, 22 bp, Homo sapiens
atcctgggaatgggagggtcat

SEQ ID NO: 9319976 - DNA, 22 bp, Homo sapiens
atcctgggaagtggcctcctcc

SEQ ID NO: 9319977 - DNA, 22 bp, Homo sapiens
atcctgggaagctgacattgaa

SEQ ID NO: 9319978 - DNA, 22 bp, Homo sapiens
agaagccatggtatgcaactac

SEQ ID NO: 9319979 - DNA, 22 bp, Homo sapiens
agaagccattgaagcagacctc

SEQ ID NO: 9319980 - DNA, 21 bp, Homo sapiens
agaagccatttgttaggactt

SEQ ID NO: 9319981 - DNA, 19 bp, Homo sapiens
agaagcccagatcccagcc

SEQ ID NO: 9319982 - DNA, 20 bp, Homo sapiens
atctgcttgcctgtcctcgg

SEQ ID NO: 9319983 - DNA, 22 bp, Homo sapiens
agaagctgcgtttatttaaatc

SEQ ID NO: 9319984 - DNA, 22 bp, Homo sapiens
atctgcttttgagaatttactt

SEQ ID NO: 9319985 - DNA, 22 bp, Homo sapiens
atctgcttgttgcatgtctgtt

SEQ ID NO: 9319986 - DNA, 22 bp, Homo sapiens
agaagcacctgtcagctacatg

SEQ ID NO: 9319987 - DNA, 19 bp, Homo sapiens
agaagcaccagtcattcct

SEQ ID NO: 9319988 - DNA, 22 bp, Homo sapiens
agaagcacggttttgtctagca

SEQ ID NO: 9319989 - DNA, 22 bp, Homo sapiens
agaagcactacgataggtggtc

SEQ ID NO: 9319990 - DNA, 22 bp, Homo sapiens
agaagcactagagggtatggaa

SEQ ID NO: 9319991 - DNA, 22 bp, Homo sapiens
cacagagctggaaaggctgggc

SEQ ID NO: 9319992 - DNA, 22 bp, Homo sapiens
cacagaggaatgcatcagcaga

SEQ ID NO: 9319993 - DNA, 22 bp, Homo sapiens
cacagaggatgcccaagcgatc

SEQ ID NO: 9319994 - DNA, 22 bp, Homo sapiens
ggactgggccaggggttggact

SEQ ID NO: 9319995 - DNA, 22 bp, Homo sapiens
ggactgggccaggggttggact

SEQ ID NO: 9319996 - DNA, 17 bp, Homo sapiens
ggactgggcggggcagg

SEQ ID NO: 9319997 - DNA, 17 bp, Homo sapiens
ggactgggcggggcagg

SEQ ID NO: 9319998 - DNA, 22 bp, Homo sapiens
ggactgggattctggatctgct

SEQ ID NO: 9319999 - DNA, 22 bp, Homo sapiens
ggactgggagaatggaggcaag

SEQ ID NO: 9320000 - DNA, 22 bp, Homo sapiens
ggactgggagaatggaggcaag

SEQ ID NO: 9320001 - DNA, 15 bp, Homo sapiens
cacacagacagcttg

SEQ ID NO: 9320002 - DNA, 22 bp, Homo sapiens
cacacagacagctctctgaaga

SEQ ID NO: 9320003 - DNA, 22 bp, Homo sapiens
cacacagatggtaagggaggga

SEQ ID NO: 9320004 - DNA, 22 bp, Homo sapiens
ggaaggggagctggaaagggta

SEQ ID NO: 9320005 - DNA, 20 bp, Homo sapiens
ggaaggggcaaagtgtgtga

SEQ ID NO: 9320006 - DNA, 22 bp, Homo sapiens
ggaaggggagctaaatctactg

SEQ ID NO: 9320007 - DNA, 21 bp, Homo sapiens
ggaagggctctgaggacggct

SEQ ID NO: 9320008 - DNA, 22 bp, Homo sapiens
cacagaagtttcatagtctcga

SEQ ID NO: 9320009 - DNA, 22 bp, Homo sapiens
cacagaagaatcatgctgtgtt

SEQ ID NO: 9320010 - DNA, 22 bp, Homo sapiens
cacagaactggttaatagcaga

SEQ ID NO: 9320011 - DNA, 22 bp, Homo sapiens
cacagaactggttaatagcaga

SEQ ID NO: 9320012 - DNA, 22 bp, Homo sapiens
ggaaggggccttgagcaaactg

SEQ ID NO: 9320013 - DNA, 22 bp, Homo sapiens
ggaaggggccttgagcaaactg

SEQ ID NO: 9320014 - DNA, 20 bp, Homo sapiens
ggaaggggcaaagtgtgtga

SEQ ID NO: 9320015 - DNA, 22 bp, Homo sapiens
ggagctggagagtacagagttt

SEQ ID NO: 9320016 - DNA, 22 bp, Homo sapiens
ggagctggcagcgcaacccaga

SEQ ID NO: 9320017 - DNA, 22 bp, Homo sapiens
ggagctggagagctagcctagg

SEQ ID NO: 9320018 - DNA, 21 bp, Homo sapiens
ggagcctctggcagggggcca

SEQ ID NO: 9320019 - DNA, 22 bp, Homo sapiens
ggagcctgacagtgcccagcat

SEQ ID NO: 9320020 - DNA, 22 bp, Homo sapiens
ggagcctgcgggagctcccatt

SEQ ID NO: 9320021 - DNA, 22 bp, Homo sapiens
ggagccctgctgacatgggtgt

SEQ ID NO: 9320022 - DNA, 22 bp, Homo sapiens
ggagccgcacgtgctgggcccg

SEQ ID NO: 9320023 - DNA, 22 bp, Homo sapiens
ggaggcaggaaagacaggttca

SEQ ID NO: 9320024 - DNA, 22 bp, Homo sapiens
cacaggctgggaagcctaggcc

SEQ ID NO: 9320025 - DNA, 22 bp, Homo sapiens
cacaggcttccagtccccagct

SEQ ID NO: 9320026 - DNA, 22 bp, Homo sapiens
cacaggcttccagtccccagct

SEQ ID NO: 9320027 - DNA, 22 bp, Homo sapiens
cacaggctgggaagcctaggcc

SEQ ID NO: 9320028 - DNA, 22 bp, Homo sapiens
cacaggcttgtcagcatgaggc

SEQ ID NO: 9320029 - DNA, 22 bp, Homo sapiens
cacaggcttgtcagcatgaggc

SEQ ID NO: 9320030 - DNA, 22 bp, Homo sapiens
cacaggcttttctgacataggc

SEQ ID NO: 9320031 - DNA, 22 bp, Homo sapiens
cacaggaatcgtcacttagcgc

SEQ ID NO: 9320032 - DNA, 18 bp, Homo sapiens
cacaggaaggggaatatc

SEQ ID NO: 9320033 - DNA, 22 bp, Homo sapiens
caaggcagcttaatagaatttg

SEQ ID NO: 9320034 - DNA, 22 bp, Homo sapiens
caaggcaggaagcctgtcttat

SEQ ID NO: 9320035 - DNA, 22 bp, Homo sapiens
caaggccactccagagactggt

SEQ ID NO: 9320036 - DNA, 22 bp, Homo sapiens
caaggccagagccagcgataag

SEQ ID NO: 9320037 - DNA, 22 bp, Homo sapiens
caaggcctatgcacacctagga

SEQ ID NO: 9320038 - DNA, 22 bp, Homo sapiens
caaggcctaatcatactgctaa

SEQ ID NO: 9320039 - DNA, 22 bp, Homo sapiens
caaggccatgagcagcgagtgt

SEQ ID NO: 9320040 - DNA, 22 bp, Homo sapiens
gctggctgtatcacctggccag

SEQ ID NO: 9320041 - DNA, 21 bp, Homo sapiens
gctggctgtcccagggaagca

SEQ ID NO: 9320042 - DNA, 21 bp, Homo sapiens
gctggctgtcccagggaagca

SEQ ID NO: 9320043 - DNA, 22 bp, Homo sapiens
gctggctgtatcacctggccag

SEQ ID NO: 9320044 - DNA, 22 bp, Homo sapiens
gctggctggtccagcaggggct

SEQ ID NO: 9320045 - DNA, 22 bp, Homo sapiens
gctggctgggtccctgagaggc

SEQ ID NO: 9320046 - DNA, 22 bp, Homo sapiens
gctggctgggtccctgagaggc

SEQ ID NO: 9320047 - DNA, 22 bp, Homo sapiens
gctggctgggacagattccatt

SEQ ID NO: 9320048 - DNA, 20 bp, Homo sapiens
caaggcctggatctagttgc

SEQ ID NO: 9320049 - DNA, 22 bp, Homo sapiens
gctggctggctgtgcaaaggca

SEQ ID NO: 9320050 - DNA, 22 bp, Homo sapiens
caagcaggatgaagcccaggga

SEQ ID NO: 9320051 - DNA, 22 bp, Homo sapiens
caaatgtggtttctcagcattc

SEQ ID NO: 9320052 - DNA, 21 bp, Homo sapiens
caagccagaccaatagcagcc

SEQ ID NO: 9320053 - DNA, 22 bp, Homo sapiens
caagcagggtttatgcatggag

SEQ ID NO: 9320054 - DNA, 22 bp, Homo sapiens
caagccagtcagctcagtagat

SEQ ID NO: 9320055 - DNA, 22 bp, Homo sapiens
caagtagaacagagctaccttg

SEQ ID NO: 9320056 - DNA, 22 bp, Homo sapiens
caagtagagattacagtgtgca

SEQ ID NO: 9320057 - DNA, 22 bp, Homo sapiens
caagtagaaggatgtgattgta

SEQ ID NO: 9320058 - DNA, 22 bp, Homo sapiens
caagtagagttcacttgtcttt

SEQ ID NO: 9320059 - DNA, 22 bp, Homo sapiens
caagtatgagaaagctattacc

SEQ ID NO: 9320060 - DNA, 22 bp, Homo sapiens
caagtatatttgaacatgtaaa

SEQ ID NO: 9320061 - DNA, 22 bp, Homo sapiens
caaggtgatacttacattagtg

SEQ ID NO: 9320062 - DNA, 22 bp, Homo sapiens
caaggtagttctggtcattgac

SEQ ID NO: 9320063 - DNA, 22 bp, Homo sapiens
gctgttcccatgtggggctcag

SEQ ID NO: 9320064 - DNA, 22 bp, Homo sapiens
gctgttcagatgcgattcagga

SEQ ID NO: 9320065 - DNA, 22 bp, Homo sapiens
gctgttcagggcactcatgggc

SEQ ID NO: 9320066 - DNA, 22 bp, Homo sapiens
gctgttcatagaaatggtctca

SEQ ID NO: 9320067 - DNA, 22 bp, Homo sapiens
gctgttcatagaaatggtctca

SEQ ID NO: 9320068 - DNA, 22 bp, Homo sapiens
gctgttataatattctgtttgt

SEQ ID NO: 9320069 - DNA, 20 bp, Homo sapiens
gctgttagttgggggctccc

SEQ ID NO: 9320070 - DNA, 22 bp, Homo sapiens
gctgttagtcagtggatgcccc

SEQ ID NO: 9320071 - DNA, 20 bp, Homo sapiens
gctgttagttgggggctccc

SEQ ID NO: 9320072 - DNA, 22 bp, Homo sapiens
gctgttagagaattagagtggg

SEQ ID NO: 9320073 - DNA, 22 bp, Homo sapiens
gctgttagtcaaatcagttgag

SEQ ID NO: 9320074 - DNA, 22 bp, Homo sapiens
gctgttagtcagtggatgcccc

SEQ ID NO: 9320075 - DNA, 22 bp, Homo sapiens
gctgttaggtgccctgaccttg

SEQ ID NO: 9320076 - DNA, 16 bp, Homo sapiens
gctgttagtagataga

SEQ ID NO: 9320077 - DNA, 23 bp, Homo sapiens
gctgttagatttaataagcattt

SEQ ID NO: 9320078 - DNA, 22 bp, Homo sapiens
gctgttcctgcttagaggtcgg

SEQ ID NO: 9320079 - DNA, 20 bp, Homo sapiens
gctgttgccagtacagatgg

SEQ ID NO: 9320080 - DNA, 22 bp, Homo sapiens
gctgttgcaatcaaggccatgg

SEQ ID NO: 9320081 - DNA, 22 bp, Homo sapiens
gctttctgtggtgatgtaaagg

SEQ ID NO: 9320082 - DNA, 22 bp, Homo sapiens
gctttcttagtgtgttaattgg

SEQ ID NO: 9320083 - DNA, 22 bp, Homo sapiens
caagttttgattttgcagtaaa

SEQ ID NO: 9320084 - DNA, 22 bp, Homo sapiens
gctttcttttcaagaatgtatt

SEQ ID NO: 9320085 - DNA, 22 bp, Homo sapiens
gctttcttggttctgcaggggc

SEQ ID NO: 9320086 - DNA, 22 bp, Homo sapiens
gctttcttgctgcatggtggct

SEQ ID NO: 9320087 - DNA, 22 bp, Homo sapiens
gctttcttatttagaagatttg

SEQ ID NO: 9320088 - DNA, 22 bp, Homo sapiens
gctttgatgaatctgtgcttgg

SEQ ID NO: 9320089 - DNA, 22 bp, Homo sapiens
gctttgatgaatctgtgcttgg

SEQ ID NO: 9320090 - DNA, 21 bp, Homo sapiens
gctttgatgctgccttgctcc

SEQ ID NO: 9320091 - DNA, 22 bp, Homo sapiens
gctttgattcttggcttatcag

SEQ ID NO: 9320092 - DNA, 22 bp, Homo sapiens
gctttgattcttggcttatcag

SEQ ID NO: 9320093 - DNA, 22 bp, Homo sapiens
gctttgcaggaaaccagtgcat

SEQ ID NO: 9320094 - DNA, 22 bp, Homo sapiens
cagaaagcagagctgagccttt

SEQ ID NO: 9320095 - DNA, 22 bp, Homo sapiens
cagaaagccgacttacaatgga

SEQ ID NO: 9320096 - DNA, 22 bp, Homo sapiens
ggctgcctactttcccagagtt

SEQ ID NO: 9320097 - DNA, 22 bp, Homo sapiens
ggctgcctagacttggaatttc

SEQ ID NO: 9320098 - DNA, 22 bp, Homo sapiens
cactttgggtttatgtcaatca

SEQ ID NO: 9320099 - DNA, 22 bp, Homo sapiens
ggcttaaaactttgaaagtgtt

SEQ ID NO: 9320100 - DNA, 22 bp, Homo sapiens
ggcttaaatcacagtgactttt

SEQ ID NO: 9320101 - DNA, 22 bp, Homo sapiens
ggcttaagaaatgtctagtttt

SEQ ID NO: 9320102 - DNA, 22 bp, Homo sapiens
ggcttaagatatttctgattcc

SEQ ID NO: 9320103 - DNA, 22 bp, Homo sapiens
ggcttaagatggtagctttgag

SEQ ID NO: 9320104 - DNA, 21 bp, Homo sapiens
ggctggtgtttagctgtgata

SEQ ID NO: 9320105 - DNA, 22 bp, Homo sapiens
ggcctgtgtctgtgcctgtcct

SEQ ID NO: 9320106 - DNA, 22 bp, Homo sapiens
ggcctgtgtcctccttgccctg

SEQ ID NO: 9320107 - DNA, 22 bp, Homo sapiens
ggcctgtggctttggcgtctaa

SEQ ID NO: 9320108 - DNA, 22 bp, Homo sapiens
ggcctgtggtttctagtaggtt

SEQ ID NO: 9320109 - DNA, 22 bp, Homo sapiens
ggctcaggctggagtgcagtgg

SEQ ID NO: 9320110 - DNA, 22 bp, Homo sapiens
ggctcagggaatgaggaagaat

SEQ ID NO: 9320111 - DNA, 22 bp, Homo sapiens
ggctcaggggccaggcctgtcc

SEQ ID NO: 9320112 - DNA, 22 bp, Homo sapiens
ggctcaggctggagtgcagtgg

SEQ ID NO: 9320113 - DNA, 22 bp, Homo sapiens
ggctcacacatgactgggctct

SEQ ID NO: 9320114 - DNA, 22 bp, Homo sapiens
ggctcacaaaatgttgcttaat

SEQ ID NO: 9320115 - DNA, 22 bp, Homo sapiens
ggcctgggctccgggagttact

SEQ ID NO: 9320116 - DNA, 22 bp, Homo sapiens
ggcctgtccagcctgcctggct

SEQ ID NO: 9320117 - DNA, 22 bp, Homo sapiens
ggcctgtctcacccccgggtgc

SEQ ID NO: 9320118 - DNA, 22 bp, Homo sapiens
ggcctctctccctggcttgcag

SEQ ID NO: 9320119 - DNA, 22 bp, Homo sapiens
ggctcaggttaccagtccctcc

SEQ ID NO: 9320120 - DNA, 22 bp, Homo sapiens
ggctccagggtctctccttgtg

SEQ ID NO: 9320121 - DNA, 22 bp, Homo sapiens
ggctccaggtacgtatgggagg

SEQ ID NO: 9320122 - DNA, 22 bp, Homo sapiens
ggctccaggtacgtatgggagg

SEQ ID NO: 9320123 - DNA, 22 bp, Homo sapiens
ggctccagggtacccctggatg

SEQ ID NO: 9320124 - DNA, 22 bp, Homo sapiens
ggctccaggtttaagggtatgt

SEQ ID NO: 9320125 - DNA, 22 bp, Homo sapiens
ggctccaggtttaagggtatgt

SEQ ID NO: 9320126 - DNA, 18 bp, Homo sapiens
ggctccagtcttcagtgg

SEQ ID NO: 9320127 - DNA, 22 bp, Homo sapiens
ggctccaggtgcatgccaggct

SEQ ID NO: 9320128 - DNA, 22 bp, Homo sapiens
ggctccaggtgcatgccaggct

SEQ ID NO: 9320129 - DNA, 22 bp, Homo sapiens
ggctctggtcagtgaggggcct

SEQ ID NO: 9320130 - DNA, 22 bp, Homo sapiens
ggctctggtgagggtaggagat

SEQ ID NO: 9320131 - DNA, 22 bp, Homo sapiens
ggctctggtgccctggctccca

SEQ ID NO: 9320132 - DNA, 22 bp, Homo sapiens
ggcagggcagcgctgattaggg

SEQ ID NO: 9320133 - DNA, 22 bp, Homo sapiens
ggcagggagtggagactcccta

SEQ ID NO: 9320134 - DNA, 22 bp, Homo sapiens
ggcagggagtggagactcccta

SEQ ID NO: 9320135 - DNA, 22 bp, Homo sapiens
ggcagggcaggaaagtcaggaa

SEQ ID NO: 9320136 - DNA, 22 bp, Homo sapiens
ggcagggcaggaaagtcaggaa

SEQ ID NO: 9320137 - DNA, 22 bp, Homo sapiens
ggcaggtgcccagagagcacga

SEQ ID NO: 9320138 - DNA, 22 bp, Homo sapiens
ggcaggtgcacctgagccatct

SEQ ID NO: 9320139 - DNA, 22 bp, Homo sapiens
ggcaggtgatctagagtcaata

SEQ ID NO: 9320140 - DNA, 22 bp, Homo sapiens
ggcattgatgggagatggtgga

SEQ ID NO: 9320141 - DNA, 22 bp, Homo sapiens
ggccaccttcctgtggtctctg

SEQ ID NO: 9320142 - DNA, 22 bp, Homo sapiens
ggcccttcctcttgtgctggca

SEQ ID NO: 9320143 - DNA, 22 bp, Homo sapiens
ggccgccctttccacggtttct

SEQ ID NO: 9320144 - DNA, 22 bp, Homo sapiens
ggccactgctctccagcctggg

SEQ ID NO: 9320145 - DNA, 22 bp, Homo sapiens
ggccactgcctccgccatggct

SEQ ID NO: 9320146 - DNA, 23 bp, Homo sapiens
ggccactgaattttctgcatctt

SEQ ID NO: 9320147 - DNA, 22 bp, Homo sapiens
ggccactgacctacatctgggg

SEQ ID NO: 9320148 - DNA, 22 bp, Homo sapiens
ggccggcctttgcgagcattct

SEQ ID NO: 9320149 - DNA, 22 bp, Homo sapiens
cacgatggagtcctatggggca

SEQ ID NO: 9320150 - DNA, 22 bp, Homo sapiens
ggcaggcatggccactccctag

SEQ ID NO: 9320151 - DNA, 22 bp, Homo sapiens
ggcaggcatggggtctgccatt

SEQ ID NO: 9320152 - DNA, 22 bp, Homo sapiens
cacatttatgggctgggaggca

SEQ ID NO: 9320153 - DNA, 22 bp, Homo sapiens
cacatagaaaacttagcaggga

SEQ ID NO: 9320154 - DNA, 22 bp, Homo sapiens
cacatttatctgttctttctag

SEQ ID NO: 9320155 - DNA, 22 bp, Homo sapiens
cacatttaggttcctatagcca

SEQ ID NO: 9320156 - DNA, 22 bp, Homo sapiens
cacatttaggaggtggggaagc

SEQ ID NO: 9320157 - DNA, 22 bp, Homo sapiens
cacatttagaggttagcatggt

SEQ ID NO: 9320158 - DNA, 22 bp, Homo sapiens
cacatttagaggttagcatggt

SEQ ID NO: 9320159 - DNA, 22 bp, Homo sapiens
cacatacaatggtgttatttgg

SEQ ID NO: 9320160 - DNA, 22 bp, Homo sapiens
cacatacaatggtgttatttgg

SEQ ID NO: 9320161 - DNA, 22 bp, Homo sapiens
cacatacatacgtatgtataca

SEQ ID NO: 9320162 - DNA, 22 bp, Homo sapiens
cacagttttatcttatactgat

SEQ ID NO: 9320163 - DNA, 22 bp, Homo sapiens
cacagttttgtcttggtttcca

SEQ ID NO: 9320164 - DNA, 22 bp, Homo sapiens
cacatacaagccatggggggat

SEQ ID NO: 9320165 - DNA, 22 bp, Homo sapiens
cacataattgaacgtgatgagt

SEQ ID NO: 9320166 - DNA, 22 bp, Homo sapiens
cacataatcaccaagtcctttc

SEQ ID NO: 9320167 - DNA, 22 bp, Homo sapiens
cacataatacatgttccactta

SEQ ID NO: 9320168 - DNA, 22 bp, Homo sapiens
cacataataaatgttcctgatg

SEQ ID NO: 9320169 - DNA, 21 bp, Homo sapiens
ggaggtcccttctggtttcag

SEQ ID NO: 9320170 - DNA, 22 bp, Homo sapiens
cacaggcttttttggctgatgt

SEQ ID NO: 9320171 - DNA, 22 bp, Homo sapiens
ggaggtggaggttgcaatgagc

SEQ ID NO: 9320172 - DNA, 22 bp, Homo sapiens
ggaggtggaggttgcaatgagc

SEQ ID NO: 9320173 - DNA, 22 bp, Homo sapiens
ggaggtggagctggaagttcca

SEQ ID NO: 9320174 - DNA, 22 bp, Homo sapiens
cacagtgtgggcatggtgcctg

SEQ ID NO: 9320175 - DNA, 22 bp, Homo sapiens
ggaggtggaggttgcaatgagc

SEQ ID NO: 9320176 - DNA, 22 bp, Homo sapiens
ggtgacgaatccatagcatcga

SEQ ID NO: 9320177 - DNA, 22 bp, Homo sapiens
cagcaaaggtagaagcacagga

SEQ ID NO: 9320178 - DNA, 22 bp, Homo sapiens
cagcaaagtaagctgacatgta

SEQ ID NO: 9320179 - DNA, 22 bp, Homo sapiens
ggtctgagtggtgctgactcag

SEQ ID NO: 9320180 - DNA, 22 bp, Homo sapiens
ggtctgaggctccaaggaggtg

SEQ ID NO: 9320181 - DNA, 22 bp, Homo sapiens
ggtctgaggtttgggattcact

SEQ ID NO: 9320182 - DNA, 22 bp, Homo sapiens
ggtgacctcacctggtcccacc

SEQ ID NO: 9320183 - DNA, 22 bp, Homo sapiens
ggtgctggacacgtggcactcc

SEQ ID NO: 9320184 - DNA, 22 bp, Homo sapiens
ggtgctgggaacgaggaattca

SEQ ID NO: 9320185 - DNA, 22 bp, Homo sapiens
cagcacaattttcaggagtcca

SEQ ID NO: 9320186 - DNA, 22 bp, Homo sapiens
ggtgctgacttcacagtcttac

SEQ ID NO: 9320187 - DNA, 22 bp, Homo sapiens
ggtgctgacttcacagtcttac

SEQ ID NO: 9320188 - DNA, 22 bp, Homo sapiens
ggtgctgactgaggatggcttg

SEQ ID NO: 9320189 - DNA, 22 bp, Homo sapiens
ggtgctgacattcagagtctgg

SEQ ID NO: 9320190 - DNA, 22 bp, Homo sapiens
ggtgctgagtgagctagaggct

SEQ ID NO: 9320191 - DNA, 22 bp, Homo sapiens
cagcacagtagagtagttgtaa

SEQ ID NO: 9320192 - DNA, 22 bp, Homo sapiens
cagcacagtgcagatgctgact

SEQ ID NO: 9320193 - DNA, 22 bp, Homo sapiens
cagcacagtttcccccatgagc

SEQ ID NO: 9320194 - DNA, 22 bp, Homo sapiens
cagcacatcttctgatcttttg

SEQ ID NO: 9320195 - DNA, 22 bp, Homo sapiens
cagcacatctccaagaatttct

SEQ ID NO: 9320196 - DNA, 19 bp, Homo sapiens
cagaggcaccaggtataga

SEQ ID NO: 9320197 - DNA, 22 bp, Homo sapiens
cagaggcacagtgcgggccact

SEQ ID NO: 9320198 - DNA, 22 bp, Homo sapiens
cagaggcacagtgcgggccact

SEQ ID NO: 9320199 - DNA, 22 bp, Homo sapiens
cagaggcacagtgcgggccact

SEQ ID NO: 9320200 - DNA, 22 bp, Homo sapiens
ggggagcaggctgggctgtctg

SEQ ID NO: 9320201 - DNA, 22 bp, Homo sapiens
ggggagcaatagttgaggtgtg

SEQ ID NO: 9320202 - DNA, 22 bp, Homo sapiens
cagaggggtgtagagatcactg

SEQ ID NO: 9320203 - DNA, 22 bp, Homo sapiens
cagagggtcaccaggaagtgca

SEQ ID NO: 9320204 - DNA, 23 bp, Homo sapiens
cagagggttccatggagcatggt

SEQ ID NO: 9320205 - DNA, 22 bp, Homo sapiens
cagagggtggaggccaggctct

SEQ ID NO: 9320206 - DNA, 23 bp, Homo sapiens
cagagggttccatggagcatggt

SEQ ID NO: 9320207 - DNA, 22 bp, Homo sapiens
cagagggtgtgaaggggatgaa

SEQ ID NO: 9320208 - DNA, 22 bp, Homo sapiens
cagagggtgtgaaggggatgaa

SEQ ID NO: 9320209 - DNA, 22 bp, Homo sapiens
cagaggggataacaggtgtaga

SEQ ID NO: 9320210 - DNA, 22 bp, Homo sapiens
cagaggggataacaggtgtaga

SEQ ID NO: 9320211 - DNA, 21 bp, Homo sapiens
cagaggggctagcctggctgc

SEQ ID NO: 9320212 - DNA, 22 bp, Homo sapiens
cagaggctttgccctggaaacc

SEQ ID NO: 9320213 - DNA, 22 bp, Homo sapiens
cagagggaaaaggggagtaata

SEQ ID NO: 9320214 - DNA, 22 bp, Homo sapiens
cagagggttgtcaggcgccttg

SEQ ID NO: 9320215 - DNA, 22 bp, Homo sapiens
cagagggttgatgtgaggctta

SEQ ID NO: 9320216 - DNA, 21 bp, Homo sapiens
cagagggtttctcaggtgttt

SEQ ID NO: 9320217 - DNA, 21 bp, Homo sapiens
cagagggtttctcaggtgttt

SEQ ID NO: 9320218 - DNA, 22 bp, Homo sapiens
cagaggtacagccattgaagat

SEQ ID NO: 9320219 - DNA, 22 bp, Homo sapiens
ggtccagaagctggtagggtag

SEQ ID NO: 9320220 - DNA, 22 bp, Homo sapiens
ggtctgagagccactgaatccc

SEQ ID NO: 9320221 - DNA, 19 bp, Homo sapiens
cagagtccttgaccagtcc

SEQ ID NO: 9320222 - DNA, 22 bp, Homo sapiens
cagagtcctggacacagagaca

SEQ ID NO: 9320223 - DNA, 22 bp, Homo sapiens
gggcaggtatttatcttctatt

SEQ ID NO: 9320224 - DNA, 22 bp, Homo sapiens
gggcaggtaggtgaaataatga

SEQ ID NO: 9320225 - DNA, 22 bp, Homo sapiens
cagagacagggcagggagtgtg

SEQ ID NO: 9320226 - DNA, 22 bp, Homo sapiens
gggcagtgtcgaggtctggtcc

SEQ ID NO: 9320227 - DNA, 22 bp, Homo sapiens
cagagacagcctgggagggaca

SEQ ID NO: 9320228 - DNA, 22 bp, Homo sapiens
gggcagcattctgtgggcaggt

SEQ ID NO: 9320229 - DNA, 22 bp, Homo sapiens
gggcagcatcaggaggggcttt

SEQ ID NO: 9320230 - DNA, 22 bp, Homo sapiens
cagactggccacatctgcactg

SEQ ID NO: 9320231 - DNA, 22 bp, Homo sapiens
cagactgggctggtggaaagct

SEQ ID NO: 9320232 - DNA, 22 bp, Homo sapiens
gggcagcagagccctgccgagt

SEQ ID NO: 9320233 - DNA, 22 bp, Homo sapiens
gggcagagactcagaaacagaa

SEQ ID NO: 9320234 - DNA, 22 bp, Homo sapiens
cagacgggctcatggcagtccc

SEQ ID NO: 9320235 - DNA, 22 bp, Homo sapiens
cagacgggtggtctgcgaggcc

SEQ ID NO: 9320236 - DNA, 22 bp, Homo sapiens
cagacctgggtccctggcctgt

SEQ ID NO: 9320237 - DNA, 22 bp, Homo sapiens
cagacctgaggagcactgagcc

SEQ ID NO: 9320238 - DNA, 22 bp, Homo sapiens
ggcttcagaggggaggtagtgc

SEQ ID NO: 9320239 - DNA, 22 bp, Homo sapiens
ggcttcactcataattaggttc

SEQ ID NO: 9320240 - DNA, 22 bp, Homo sapiens
ggcttcactgactggttctagg

SEQ ID NO: 9320241 - DNA, 22 bp, Homo sapiens
ggcttcagaagactggacaggt

SEQ ID NO: 9320242 - DNA, 22 bp, Homo sapiens
ggcttcagaggagaagagggtg

SEQ ID NO: 9320243 - DNA, 22 bp, Homo sapiens
ggcttcaaaacctatctttgat

SEQ ID NO: 9320244 - DNA, 22 bp, Homo sapiens
ggcttcaaatggagcaaccaga

SEQ ID NO: 9320245 - DNA, 22 bp, Homo sapiens
ggcttagcaactcctgaggctc

SEQ ID NO: 9320246 - DNA, 22 bp, Homo sapiens
ggcttcacatagcaatgtgagc

SEQ ID NO: 9320247 - DNA, 22 bp, Homo sapiens
ggcttcaatgtattcacattca

SEQ ID NO: 9320248 - DNA, 22 bp, Homo sapiens
ggcttcaatgtattcacattca

SEQ ID NO: 9320249 - DNA, 22 bp, Homo sapiens
ggcttcacagccccattagtgc

SEQ ID NO: 9320250 - DNA, 22 bp, Homo sapiens
ggcttcaagtcgtatatttggg

SEQ ID NO: 9320251 - DNA, 17 bp, Homo sapiens
ggcttacaggtgccagc

SEQ ID NO: 9320252 - DNA, 20 bp, Homo sapiens
ggcttaaggaattcttttct

SEQ ID NO: 9320253 - DNA, 17 bp, Homo sapiens
ggcttacaggtgccagc

SEQ ID NO: 9320254 - DNA, 22 bp, Homo sapiens
ggcttaagtcctgaatttatgc

SEQ ID NO: 9320255 - DNA, 22 bp, Homo sapiens
ggcttagcaactcctgaggctc

SEQ ID NO: 9320256 - DNA, 22 bp, Homo sapiens
ggcttagcaactcctgaggctc

SEQ ID NO: 9320257 - DNA, 22 bp, Homo sapiens
gggcagtgtctgcaaatgaaca

SEQ ID NO: 9320258 - DNA, 22 bp, Homo sapiens
gggccacattgaagggtgggta

SEQ ID NO: 9320259 - DNA, 21 bp, Homo sapiens
gggccactctagagaaagaaa

SEQ ID NO: 9320260 - DNA, 22 bp, Homo sapiens
gggctcttttctgagcttcact

SEQ ID NO: 9320261 - DNA, 20 bp, Homo sapiens
gggctcttaggtagcagggg

SEQ ID NO: 9320262 - DNA, 19 bp, Homo sapiens
cagagcctcagagctagaa

SEQ ID NO: 9320263 - DNA, 22 bp, Homo sapiens
cagagcctcagaatcctgtgga

SEQ ID NO: 9320264 - DNA, 22 bp, Homo sapiens
cagagcctcatcatccactcca

SEQ ID NO: 9320265 - DNA, 22 bp, Homo sapiens
cagagcctctgccctgggcact

SEQ ID NO: 9320266 - DNA, 22 bp, Homo sapiens
cagagcctccctcctctgccat

SEQ ID NO: 9320267 - DNA, 22 bp, Homo sapiens
cagagcctctcagaggtcagac

SEQ ID NO: 9320268 - DNA, 22 bp, Homo sapiens
cagagcctgcctctggctgtgg

SEQ ID NO: 9320269 - DNA, 22 bp, Homo sapiens
cagagctgggatcccatgggcg

SEQ ID NO: 9320270 - DNA, 23 bp, Homo sapiens
cagagctggcttcatgggtgtgc

SEQ ID NO: 9320271 - DNA, 22 bp, Homo sapiens
gggctgaggggtatctcatggg

SEQ ID NO: 9320272 - DNA, 22 bp, Homo sapiens
gggctgaggggtatctcatggg

SEQ ID NO: 9320273 - DNA, 22 bp, Homo sapiens
cagagctgggtttgggaaacct

SEQ ID NO: 9320274 - DNA, 22 bp, Homo sapiens
gggctgagtcatctggggcctc

SEQ ID NO: 9320275 - DNA, 22 bp, Homo sapiens
gggctgagtctgctgcctgtca

SEQ ID NO: 9320276 - DNA, 22 bp, Homo sapiens
gggctgagtgacctcaggccaa

SEQ ID NO: 9320277 - DNA, 22 bp, Homo sapiens
cagaggcaaaagaggtggaggt

SEQ ID NO: 9320278 - DNA, 20 bp, Homo sapiens
cagaggcaaggagacttgga

SEQ ID NO: 9320279 - DNA, 20 bp, Homo sapiens
cagaggcaaggagacttgga

SEQ ID NO: 9320280 - DNA, 22 bp, Homo sapiens
gggctgagtgacctcaggccaa

SEQ ID NO: 9320281 - DNA, 22 bp, Homo sapiens
cagaggcaaaagaggtggaggt

SEQ ID NO: 9320282 - DNA, 22 bp, Homo sapiens
cagaggattatggagatggtct

SEQ ID NO: 9320283 - DNA, 22 bp, Homo sapiens
cagaggattatttcagaatcta

SEQ ID NO: 9320284 - DNA, 22 bp, Homo sapiens
gtctgcttttctgaattgcctg

SEQ ID NO: 9320285 - DNA, 22 bp, Homo sapiens
gtctgctttctgggaactcttt

SEQ ID NO: 9320286 - DNA, 22 bp, Homo sapiens
gtctgctttgtctttcatgata

SEQ ID NO: 9320287 - DNA, 22 bp, Homo sapiens
gtctgcttttgttttactggta

SEQ ID NO: 9320288 - DNA, 22 bp, Homo sapiens
gtctgcttttctgccctttcat

SEQ ID NO: 9320289 - DNA, 22 bp, Homo sapiens
gtctcttgtggatgttgggaag

SEQ ID NO: 9320290 - DNA, 22 bp, Homo sapiens
gtcccaggctccatggcagcca

SEQ ID NO: 9320291 - DNA, 22 bp, Homo sapiens
gtcccaggcttatgtggagctt

SEQ ID NO: 9320292 - DNA, 22 bp, Homo sapiens
gtccctgggaaaggagagggca

SEQ ID NO: 9320293 - DNA, 22 bp, Homo sapiens
cagccaggcctggtgaccaaag

SEQ ID NO: 9320294 - DNA, 22 bp, Homo sapiens
cagccaggcccccgagtcgttg

SEQ ID NO: 9320295 - DNA, 22 bp, Homo sapiens
cagccagggagggcaaatgaga

SEQ ID NO: 9320296 - DNA, 22 bp, Homo sapiens
cagcccaggctcagatgttggg

SEQ ID NO: 9320297 - DNA, 22 bp, Homo sapiens
cagccaggtatgggcgtgcggg

SEQ ID NO: 9320298 - DNA, 22 bp, Homo sapiens
cagccaggtatgggcgtgcggg

SEQ ID NO: 9320299 - DNA, 22 bp, Homo sapiens
cagccagggtcaggcagcttct

SEQ ID NO: 9320300 - DNA, 22 bp, Homo sapiens
cagccagggtcaggcagcttct

SEQ ID NO: 9320301 - DNA, 22 bp, Homo sapiens
cagcccctcacagagctgtcct

SEQ ID NO: 9320302 - DNA, 22 bp, Homo sapiens
cagcccctcacagagctgtcct

SEQ ID NO: 9320303 - DNA, 22 bp, Homo sapiens
cagccccttcctggcatctgga

SEQ ID NO: 9320304 - DNA, 22 bp, Homo sapiens
gtctgttacctccaagaccatt

SEQ ID NO: 9320305 - DNA, 22 bp, Homo sapiens
gtcatctgtgcttttggtagga

SEQ ID NO: 9320306 - DNA, 22 bp, Homo sapiens
gtcatctgtttacttttctgct

SEQ ID NO: 9320307 - DNA, 22 bp, Homo sapiens
gtcatattggctccacttcctc

SEQ ID NO: 9320308 - DNA, 22 bp, Homo sapiens
gtcatattgaagaagactggca

SEQ ID NO: 9320309 - DNA, 22 bp, Homo sapiens
gtcatattataaatgttctgtt

SEQ ID NO: 9320310 - DNA, 20 bp, Homo sapiens
cagcaggctatggggcaccc

SEQ ID NO: 9320311 - DNA, 22 bp, Homo sapiens
gtcccaggcagagtcaggaggg

SEQ ID NO: 9320312 - DNA, 22 bp, Homo sapiens
gtcccaggagttgctgggcctt

SEQ ID NO: 9320313 - DNA, 22 bp, Homo sapiens
gtcccaggcaggccactggcag

SEQ ID NO: 9320314 - DNA, 22 bp, Homo sapiens
gtcccagaggctttggccacag

SEQ ID NO: 9320315 - DNA, 22 bp, Homo sapiens
cagcaggctctgagtggctgcc

SEQ ID NO: 9320316 - DNA, 22 bp, Homo sapiens
cagcaggctctgagtggctgcc

SEQ ID NO: 9320317 - DNA, 22 bp, Homo sapiens
gtccagccagctggtccttgcc

SEQ ID NO: 9320318 - DNA, 22 bp, Homo sapiens
gtccagccactcaccttccagc

SEQ ID NO: 9320319 - DNA, 22 bp, Homo sapiens
cagcaggctgtggaaatcctgg

SEQ ID NO: 9320320 - DNA, 22 bp, Homo sapiens
cagcactaatcctgcaatttct

SEQ ID NO: 9320321 - DNA, 22 bp, Homo sapiens
cagcagctagaggaagggcaga

SEQ ID NO: 9320322 - DNA, 22 bp, Homo sapiens
gtcagcctgcactcagggagcg

SEQ ID NO: 9320323 - DNA, 20 bp, Homo sapiens
cagcaggaaaagtgcctcag

SEQ ID NO: 9320324 - DNA, 22 bp, Homo sapiens
gtgccccagacacgcatgtggg

SEQ ID NO: 9320325 - DNA, 22 bp, Homo sapiens
gtgctgttgcctggctgcacgg

SEQ ID NO: 9320326 - DNA, 22 bp, Homo sapiens
gtgctgttctggctgccaccac

SEQ ID NO: 9320327 - DNA, 22 bp, Homo sapiens
cagcctgctagggcaatgcctt

SEQ ID NO: 9320328 - DNA, 22 bp, Homo sapiens
cagcctgctctcagatgttgag

SEQ ID NO: 9320329 - DNA, 22 bp, Homo sapiens
cagcctggcctgggactgctga

SEQ ID NO: 9320330 - DNA, 22 bp, Homo sapiens
cagctaggaagtccttggcgaa

SEQ ID NO: 9320331 - DNA, 22 bp, Homo sapiens
cagctagtacaatgggagagca

SEQ ID NO: 9320332 - DNA, 22 bp, Homo sapiens
cagctacaaatacttttgtatg

SEQ ID NO: 9320333 - DNA, 22 bp, Homo sapiens
cagcctgccgtcagccaggtag

SEQ ID NO: 9320334 - DNA, 22 bp, Homo sapiens
cagcctgcctcagtttccctct

SEQ ID NO: 9320335 - DNA, 22 bp, Homo sapiens
cagcctgcagggctgcctgttg

SEQ ID NO: 9320336 - DNA, 16 bp, Homo sapiens
cagcctgcagtggtca

SEQ ID NO: 9320337 - DNA, 22 bp, Homo sapiens
cagccctggaacagctgactca

SEQ ID NO: 9320338 - DNA, 20 bp, Homo sapiens
cagcctccactcactcagct

SEQ ID NO: 9320339 - DNA, 23 bp, Homo sapiens
cagccctggagatgtgggaggca

SEQ ID NO: 9320340 - DNA, 22 bp, Homo sapiens
cagccctgcttccccgctagtt

SEQ ID NO: 9320341 - DNA, 22 bp, Homo sapiens
cagccctgctggttttgggcaa

SEQ ID NO: 9320342 - DNA, 22 bp, Homo sapiens
cagccctgctgacactgtctga

SEQ ID NO: 9320343 - DNA, 22 bp, Homo sapiens
cagccctgctcttagtgtctcc

SEQ ID NO: 9320344 - DNA, 22 bp, Homo sapiens
cagccctgccatggagcctcct

SEQ ID NO: 9320345 - DNA, 22 bp, Homo sapiens
cagccctgcagctggatctcac

SEQ ID NO: 9320346 - DNA, 22 bp, Homo sapiens
cagccctgcagccatggcctgt

SEQ ID NO: 9320347 - DNA, 22 bp, Homo sapiens
caaaagcagttctatctgagtt

SEQ ID NO: 9320348 - DNA, 22 bp, Homo sapiens
atttttgccctgcagtacataa

SEQ ID NO: 9320349 - DNA, 22 bp, Homo sapiens
attttagagaaacaaacgtagg

SEQ ID NO: 9320350 - DNA, 22 bp, Homo sapiens
caaaattgatgaatgtatgatt

SEQ ID NO: 9320351 - DNA, 22 bp, Homo sapiens
caaacaatttgcatttccttag

SEQ ID NO: 9320352 - DNA, 22 bp, Homo sapiens
caaaattgattgtggtgatggt

SEQ ID NO: 9320353 - DNA, 22 bp, Homo sapiens
caaaattgttgatgctgctttg

SEQ ID NO: 9320354 - DNA, 23 bp, Homo sapiens
caaaatgctatgtgcccaatgca

SEQ ID NO: 9320355 - DNA, 22 bp, Homo sapiens
caaaatgcatctgagaccaggc

SEQ ID NO: 9320356 - DNA, 22 bp, Homo sapiens
caaaataccacgacttgtttta

SEQ ID NO: 9320357 - DNA, 22 bp, Homo sapiens
caaagcagcctgcagtgtggac

SEQ ID NO: 9320358 - DNA, 22 bp, Homo sapiens
caaagcagagccagagcttgtc

SEQ ID NO: 9320359 - DNA, 22 bp, Homo sapiens
caaacattcaagtacaagtctt

SEQ ID NO: 9320360 - DNA, 22 bp, Homo sapiens
caaagcagtgatccttaaagga

SEQ ID NO: 9320361 - DNA, 18 bp, Homo sapiens
caaagcaggtgacagtgt

SEQ ID NO: 9320362 - DNA, 22 bp, Homo sapiens
caaatggagaattagcagtttg

SEQ ID NO: 9320363 - DNA, 22 bp, Homo sapiens
caaatgcatagaaagatgaaac

SEQ ID NO: 9320364 - DNA, 22 bp, Homo sapiens
caaatgcatagtttataagaag

SEQ ID NO: 9320365 - DNA, 22 bp, Homo sapiens
gctcttggccaagtggaagggt

SEQ ID NO: 9320366 - DNA, 21 bp, Homo sapiens
gctcttggaaggggctcagct

SEQ ID NO: 9320367 - DNA, 22 bp, Homo sapiens
caaatagactctagaatttatt

SEQ ID NO: 9320368 - DNA, 22 bp, Homo sapiens
gctcttgtcagagaggccagct

SEQ ID NO: 9320369 - DNA, 22 bp, Homo sapiens
gctgacccctacaggttgtgtt

SEQ ID NO: 9320370 - DNA, 22 bp, Homo sapiens
gctgacagcaaggggctgccct

SEQ ID NO: 9320371 - DNA, 21 bp, Homo sapiens
caaagctcattctttggtcat

SEQ ID NO: 9320372 - DNA, 22 bp, Homo sapiens
caaaggaggtaatgggtgtgag

SEQ ID NO: 9320373 - DNA, 22 bp, Homo sapiens
caaaggaggtgataggccctct

SEQ ID NO: 9320374 - DNA, 22 bp, Homo sapiens
caaaggaggtgataggccctct

SEQ ID NO: 9320375 - DNA, 22 bp, Homo sapiens
caaataattactatcctcactt

SEQ ID NO: 9320376 - DNA, 22 bp, Homo sapiens
gcctggcacattgcagtggatt

SEQ ID NO: 9320377 - DNA, 22 bp, Homo sapiens
gcctggcaatggcctcaggaag

SEQ ID NO: 9320378 - DNA, 22 bp, Homo sapiens
gcctggcacaggaattaggagg

SEQ ID NO: 9320379 - DNA, 22 bp, Homo sapiens
gcctggcaaggccctgttgact

SEQ ID NO: 9320380 - DNA, 22 bp, Homo sapiens
gcctgaagtttcatgcctctat

SEQ ID NO: 9320381 - DNA, 22 bp, Homo sapiens
gcccccagacctcagtgggctg

SEQ ID NO: 9320382 - DNA, 22 bp, Homo sapiens
atttgctagtggaattttcctg

SEQ ID NO: 9320383 - DNA, 22 bp, Homo sapiens
gcctaggagacaagcgtgaaag

SEQ ID NO: 9320384 - DNA, 22 bp, Homo sapiens
gcctatggattggagaaggagc

SEQ ID NO: 9320385 - DNA, 22 bp, Homo sapiens
gcctgaagaacagctgtgagga

SEQ ID NO: 9320386 - DNA, 22 bp, Homo sapiens
atttcatgttaactgaacagaa

SEQ ID NO: 9320387 - DNA, 22 bp, Homo sapiens
atttccaggagaaaggatttta

SEQ ID NO: 9320388 - DNA, 22 bp, Homo sapiens
atttccagtgcactgaatagaa

SEQ ID NO: 9320389 - DNA, 22 bp, Homo sapiens
atttccagtgactctcacaggt

SEQ ID NO: 9320390 - DNA, 22 bp, Homo sapiens
atttccagtatgcaaatgcctc

SEQ ID NO: 9320391 - DNA, 22 bp, Homo sapiens
atttccagtcctaatgatctgg

SEQ ID NO: 9320392 - DNA, 22 bp, Homo sapiens
atttccagtacccagaacagag

SEQ ID NO: 9320393 - DNA, 22 bp, Homo sapiens
atttccaggctgttttgtgaat

SEQ ID NO: 9320394 - DNA, 22 bp, Homo sapiens
atttccagtactattttctgct

SEQ ID NO: 9320395 - DNA, 22 bp, Homo sapiens
atttccaggtaacctgttgagt

SEQ ID NO: 9320396 - DNA, 22 bp, Homo sapiens
atttccaggagttgaggtctga

SEQ ID NO: 9320397 - DNA, 19 bp, Homo sapiens
gccaggcctggacctgcag

SEQ ID NO: 9320398 - DNA, 22 bp, Homo sapiens
gccaggctgctggctgctgtcc

SEQ ID NO: 9320399 - DNA, 22 bp, Homo sapiens
gccaggctgctggctgctgtcc

SEQ ID NO: 9320400 - DNA, 22 bp, Homo sapiens
gccaggctggaaagaacagaca

SEQ ID NO: 9320401 - DNA, 22 bp, Homo sapiens
gccaggctggtcttgaactcct

SEQ ID NO: 9320402 - DNA, 22 bp, Homo sapiens
gccaggctggggggagatgtct

SEQ ID NO: 9320403 - DNA, 22 bp, Homo sapiens
gccaggctggccagcaccttct

SEQ ID NO: 9320404 - DNA, 23 bp, Homo sapiens
gcccaccctcagcgtcctcacgg

SEQ ID NO: 9320405 - DNA, 22 bp, Homo sapiens
atttctgatacccggtcaccct

SEQ ID NO: 9320406 - DNA, 22 bp, Homo sapiens
atttctgctactgcaccctagt

SEQ ID NO: 9320407 - DNA, 22 bp, Homo sapiens
atttctgccatagccaggggat

SEQ ID NO: 9320408 - DNA, 22 bp, Homo sapiens
atttctgatagtaaaggtcttt

SEQ ID NO: 9320409 - DNA, 22 bp, Homo sapiens
atttctgataaacgtaagctgc

SEQ ID NO: 9320410 - DNA, 22 bp, Homo sapiens
gccccaggttgcctgtcccagg

SEQ ID NO: 9320411 - DNA, 22 bp, Homo sapiens
gcactagtgttcttcagtaata

SEQ ID NO: 9320412 - DNA, 22 bp, Homo sapiens
gcactagttctactgccagcaa

SEQ ID NO: 9320413 - DNA, 22 bp, Homo sapiens
gcactagtcaagtgaacaattt

SEQ ID NO: 9320414 - DNA, 22 bp, Homo sapiens
gcactagtctaggtgctaagat

SEQ ID NO: 9320415 - DNA, 22 bp, Homo sapiens
gcacggcaagacggggcctcct

SEQ ID NO: 9320416 - DNA, 21 bp, Homo sapiens
attcagaaagggaataaactc

SEQ ID NO: 9320417 - DNA, 22 bp, Homo sapiens
attcagaaagggttgcctggtt

SEQ ID NO: 9320418 - DNA, 22 bp, Homo sapiens
attcagaaagatatgcctggtt

SEQ ID NO: 9320419 - DNA, 22 bp, Homo sapiens
attcatatcatagagttattga

SEQ ID NO: 9320420 - DNA, 22 bp, Homo sapiens
attcagtttcatggcacagcta

SEQ ID NO: 9320421 - DNA, 22 bp, Homo sapiens
gatttcactggctttaagcaca

SEQ ID NO: 9320422 - DNA, 22 bp, Homo sapiens
gatttcacgggaggtggctgga

SEQ ID NO: 9320423 - DNA, 22 bp, Homo sapiens
attactttcagatgtgctgtaa

SEQ ID NO: 9320424 - DNA, 22 bp, Homo sapiens
attactgttggcaaagtcttat

SEQ ID NO: 9320425 - DNA, 17 bp, Homo sapiens
gatttcctgaagttctt

SEQ ID NO: 9320426 - DNA, 22 bp, Homo sapiens
attagctttatttgaaatagga

SEQ ID NO: 9320427 - DNA, 22 bp, Homo sapiens
attagctttatttgaaatagga

SEQ ID NO: 9320428 - DNA, 22 bp, Homo sapiens
attagctttaaagactttgatt

SEQ ID NO: 9320429 - DNA, 22 bp, Homo sapiens
attagctttaaagactttgatt

SEQ ID NO: 9320430 - DNA, 22 bp, Homo sapiens
attagctttaaaccacagcagt

SEQ ID NO: 9320431 - DNA, 22 bp, Homo sapiens
attagctttggattcagaagat

SEQ ID NO: 9320432 - DNA, 22 bp, Homo sapiens
attagctttggattcagaagat

SEQ ID NO: 9320433 - DNA, 22 bp, Homo sapiens
attagctttggtggaaaggagt

SEQ ID NO: 9320434 - DNA, 22 bp, Homo sapiens
attagcttattgtaaggtgaaa

SEQ ID NO: 9320435 - DNA, 21 bp, Homo sapiens
attagcttcaaaagcttgtct

SEQ ID NO: 9320436 - DNA, 22 bp, Homo sapiens
attagcttcaaagccatcaacc

SEQ ID NO: 9320437 - DNA, 22 bp, Homo sapiens
attagcttatcccatttctgaa

SEQ ID NO: 9320438 - DNA, 22 bp, Homo sapiens
attagcttatcccatttctgaa

SEQ ID NO: 9320439 - DNA, 22 bp, Homo sapiens
attagcttctgtgcatggactt

SEQ ID NO: 9320440 - DNA, 20 bp, Homo sapiens
attagcttggagacagtggc

SEQ ID NO: 9320441 - DNA, 22 bp, Homo sapiens
attagcttggtatgccataaag

SEQ ID NO: 9320442 - DNA, 22 bp, Homo sapiens
attagcttcctatagtaagggg

SEQ ID NO: 9320443 - DNA, 22 bp, Homo sapiens
attagcttctgaagcccttgaa

SEQ ID NO: 9320444 - DNA, 22 bp, Homo sapiens
attagcttagtgtttccgtaat

SEQ ID NO: 9320445 - DNA, 22 bp, Homo sapiens
attagcttagtgtttccgtaat

SEQ ID NO: 9320446 - DNA, 22 bp, Homo sapiens
attagcttaggcatgaagagaa

SEQ ID NO: 9320447 - DNA, 22 bp, Homo sapiens
attagcttatcacacaagctgc

SEQ ID NO: 9320448 - DNA, 22 bp, Homo sapiens
attagtagagggagaagcttgg

SEQ ID NO: 9320449 - DNA, 22 bp, Homo sapiens
attagtagcacacagagatcag

SEQ ID NO: 9320450 - DNA, 19 bp, Homo sapiens
attagtagctagtgcctgg

SEQ ID NO: 9320451 - DNA, 22 bp, Homo sapiens
attagtagctgtaataactggg

SEQ ID NO: 9320452 - DNA, 22 bp, Homo sapiens
attagtagtagttagcagcctc

SEQ ID NO: 9320453 - DNA, 22 bp, Homo sapiens
attctttacattggcttcttcc

SEQ ID NO: 9320454 - DNA, 22 bp, Homo sapiens
attctttagttggcttcttgcc

SEQ ID NO: 9320455 - DNA, 22 bp, Homo sapiens
gcagctgctggagggaggcagg

SEQ ID NO: 9320456 - DNA, 22 bp, Homo sapiens
attgatttctgcttactcactg

SEQ ID NO: 9320457 - DNA, 22 bp, Homo sapiens
gcagggctgactcagccaccct

SEQ ID NO: 9320458 - DNA, 22 bp, Homo sapiens
attgcaaagaaatacatgctta

SEQ ID NO: 9320459 - DNA, 22 bp, Homo sapiens
gcagggctgagtcatgtgtgcc

SEQ ID NO: 9320460 - DNA, 22 bp, Homo sapiens
gcagggctgatggcttccctca

SEQ ID NO: 9320461 - DNA, 18 bp, Homo sapiens
gcagggctgcacacgcat

SEQ ID NO: 9320462 - DNA, 22 bp, Homo sapiens
gcagggctgatgttattgacga

SEQ ID NO: 9320463 - DNA, 22 bp, Homo sapiens
gcagggctgctgaaacttgttt

SEQ ID NO: 9320464 - DNA, 22 bp, Homo sapiens
gcagggctgcagagggcactgt

SEQ ID NO: 9320465 - DNA, 22 bp, Homo sapiens
gcagggctgcagagggcactgt

SEQ ID NO: 9320466 - DNA, 22 bp, Homo sapiens
gcaggcctttatccctgcctca

SEQ ID NO: 9320467 - DNA, 22 bp, Homo sapiens
attgacttccatagctacctgg

SEQ ID NO: 9320468 - DNA, 22 bp, Homo sapiens
attgacttaaaggctctggtta

SEQ ID NO: 9320469 - DNA, 22 bp, Homo sapiens
attgactttcccttctcctcat

SEQ ID NO: 9320470 - DNA, 22 bp, Homo sapiens
gcaggcctgcaggtatggccgg

SEQ ID NO: 9320471 - DNA, 22 bp, Homo sapiens
gcaggcctgtcttgctcgccct

SEQ ID NO: 9320472 - DNA, 22 bp, Homo sapiens
gcatattttcacaagctcttgg

SEQ ID NO: 9320473 - DNA, 22 bp, Homo sapiens
gcatattagtaatctttcaaca

SEQ ID NO: 9320474 - DNA, 22 bp, Homo sapiens
gcatagtcagtaggattctcaa

SEQ ID NO: 9320475 - DNA, 22 bp, Homo sapiens
gcagggctgggacttactggta

SEQ ID NO: 9320476 - DNA, 18 bp, Homo sapiens
gcagggctggacaagtca

SEQ ID NO: 9320477 - DNA, 22 bp, Homo sapiens
gccaaataccattaaccagaaa

SEQ ID NO: 9320478 - DNA, 20 bp, Homo sapiens
gccaacgcgctggggctgcc

SEQ ID NO: 9320479 - DNA, 22 bp, Homo sapiens
gccaagaaagaacagcagggaa

SEQ ID NO: 9320480 - DNA, 22 bp, Homo sapiens
gccaagaaggtggggacatgca

SEQ ID NO: 9320481 - DNA, 21 bp, Homo sapiens
gccaagaacaagacagacatg

SEQ ID NO: 9320482 - DNA, 22 bp, Homo sapiens
gccaagaatgcgacagccgtca

SEQ ID NO: 9320483 - DNA, 22 bp, Homo sapiens
gccaagagtttccagctgcaag

SEQ ID NO: 9320484 - DNA, 22 bp, Homo sapiens
gccaagatggctggaaggctag

SEQ ID NO: 9320485 - DNA, 22 bp, Homo sapiens
attgtcttctggtcttatcttt

SEQ ID NO: 9320486 - DNA, 22 bp, Homo sapiens
attgtcttgtacgtttgcctgt

SEQ ID NO: 9320487 - DNA, 22 bp, Homo sapiens
attgtctttggtgcttccagga

SEQ ID NO: 9320488 - DNA, 22 bp, Homo sapiens
gagagcagactctcaaagctgg

SEQ ID NO: 9320489 - DNA, 22 bp, Homo sapiens
atggaggatgtgcagcatgggc

SEQ ID NO: 9320490 - DNA, 22 bp, Homo sapiens
gagagaggcctccatgtactga

SEQ ID NO: 9320491 - DNA, 22 bp, Homo sapiens
gagagagaagtgggtgtcacct

SEQ ID NO: 9320492 - DNA, 22 bp, Homo sapiens
atggctttcctgggacatgggc

SEQ ID NO: 9320493 - DNA, 22 bp, Homo sapiens
atggctttcagatttctatgtt

SEQ ID NO: 9320494 - DNA, 22 bp, Homo sapiens
atggcttttaactttgatggca

SEQ ID NO: 9320495 - DNA, 22 bp, Homo sapiens
atggctttctgtgtttccgtag

SEQ ID NO: 9320496 - DNA, 22 bp, Homo sapiens
atggctttctctaatgtggtat

SEQ ID NO: 9320497 - DNA, 22 bp, Homo sapiens
atggctttgactgtaagtggta

SEQ ID NO: 9320498 - DNA, 22 bp, Homo sapiens
atggctttgaagttcagctttt

SEQ ID NO: 9320499 - DNA, 22 bp, Homo sapiens
atggctggcactggcctgggtt

SEQ ID NO: 9320500 - DNA, 22 bp, Homo sapiens
atggctggcatccaggtgggct

SEQ ID NO: 9320501 - DNA, 22 bp, Homo sapiens
atggccaagcttactctgttgt

SEQ ID NO: 9320502 - DNA, 22 bp, Homo sapiens
atggccaagcatgcctgtggcc

SEQ ID NO: 9320503 - DNA, 22 bp, Homo sapiens
atggccaagaagtattcctgac

SEQ ID NO: 9320504 - DNA, 22 bp, Homo sapiens
atggccaaatctaaactgttgg

SEQ ID NO: 9320505 - DNA, 22 bp, Homo sapiens
atggccaagaatatttctcaac

SEQ ID NO: 9320506 - DNA, 22 bp, Homo sapiens
atgggagaaacatcatgaggca

SEQ ID NO: 9320507 - DNA, 22 bp, Homo sapiens
atgggctgacccagtcgtggca

SEQ ID NO: 9320508 - DNA, 22 bp, Homo sapiens
atgggctgaggaagctcctgag

SEQ ID NO: 9320509 - DNA, 22 bp, Homo sapiens
atgggagaaacatcatgaggca

SEQ ID NO: 9320510 - DNA, 22 bp, Homo sapiens
atgggctgggatctgagtgtca

SEQ ID NO: 9320511 - DNA, 22 bp, Homo sapiens
atgggctgtccattgctggctg

SEQ ID NO: 9320512 - DNA, 20 bp, Homo sapiens
atgggctggttaggaagtgt

SEQ ID NO: 9320513 - DNA, 22 bp, Homo sapiens
atgggctggggaagctcactcc

SEQ ID NO: 9320514 - DNA, 22 bp, Homo sapiens
atggggagagcctctgtcccca

SEQ ID NO: 9320515 - DNA, 22 bp, Homo sapiens
atggggaagagccagtgagctg

SEQ ID NO: 9320516 - DNA, 22 bp, Homo sapiens
atgggctgtgggaccctggacc

SEQ ID NO: 9320517 - DNA, 22 bp, Homo sapiens
gaggcagcatctatggtgggaa

SEQ ID NO: 9320518 - DNA, 22 bp, Homo sapiens
gaggcagcctcagtggacctcg

SEQ ID NO: 9320519 - DNA, 22 bp, Homo sapiens
gaggcagcagggctggttcctt

SEQ ID NO: 9320520 - DNA, 22 bp, Homo sapiens
atggtggtagaagcactatgtg

SEQ ID NO: 9320521 - DNA, 22 bp, Homo sapiens
gaggagaagctattggaaggac

SEQ ID NO: 9320522 - DNA, 22 bp, Homo sapiens
gaggaaggctaaggggcttaga

SEQ ID NO: 9320523 - DNA, 22 bp, Homo sapiens
atggtctgatgtcccatggctt

SEQ ID NO: 9320524 - DNA, 22 bp, Homo sapiens
gaggtggcgcgccatccctgcc

SEQ ID NO: 9320525 - DNA, 22 bp, Homo sapiens
gaggtggcactgtgaggagcac

SEQ ID NO: 9320526 - DNA, 22 bp, Homo sapiens
gaggtggcactgtgaggagcac

SEQ ID NO: 9320527 - DNA, 22 bp, Homo sapiens
gaggtggcccttgctcagcctt

SEQ ID NO: 9320528 - DNA, 22 bp, Homo sapiens
gaggtggcctcaagcagtcttc

SEQ ID NO: 9320529 - DNA, 22 bp, Homo sapiens
gaggtggccaagcgaggaaggg

SEQ ID NO: 9320530 - DNA, 22 bp, Homo sapiens
atgttgagagctgagatcagcc

SEQ ID NO: 9320531 - DNA, 22 bp, Homo sapiens
atgttgtttttgtcccagaagg

SEQ ID NO: 9320532 - DNA, 22 bp, Homo sapiens
atgttgttttttcataaagtat

SEQ ID NO: 9320533 - DNA, 22 bp, Homo sapiens
atgttgttaaatgggtgtattt

SEQ ID NO: 9320534 - DNA, 22 bp, Homo sapiens
atgttgtaggtctcatggtaca

SEQ ID NO: 9320535 - DNA, 22 bp, Homo sapiens
atgttgtattatgttattgtct

SEQ ID NO: 9320536 - DNA, 22 bp, Homo sapiens
atgtttaaagggttgagaaata

SEQ ID NO: 9320537 - DNA, 22 bp, Homo sapiens
gagttccttctgcctcagcttg

SEQ ID NO: 9320538 - DNA, 19 bp, Homo sapiens
gagttcctgcaaggcctcc

SEQ ID NO: 9320539 - DNA, 16 bp, Homo sapiens
gagttcaatggcagag

SEQ ID NO: 9320540 - DNA, 22 bp, Homo sapiens
atgtttaaggaactggtttgct

SEQ ID NO: 9320541 - DNA, 22 bp, Homo sapiens
gataatgtaattttatgttcac

SEQ ID NO: 9320542 - DNA, 22 bp, Homo sapiens
gataatgtgccgataatttcta

SEQ ID NO: 9320543 - DNA, 22 bp, Homo sapiens
gataatttctccatctcaaggt

SEQ ID NO: 9320544 - DNA, 22 bp, Homo sapiens
gataattttagtctgaaaattg

SEQ ID NO: 9320545 - DNA, 22 bp, Homo sapiens
gataatttgatacctcaatcag

SEQ ID NO: 9320546 - DNA, 22 bp, Homo sapiens
gatacaaaatataaatggagag

SEQ ID NO: 9320547 - DNA, 22 bp, Homo sapiens
gatatgaagtggcattgtgaag

SEQ ID NO: 9320548 - DNA, 22 bp, Homo sapiens
gatatattttccatggtctgca

SEQ ID NO: 9320549 - DNA, 22 bp, Homo sapiens
gatatatttggaccagagcatt

SEQ ID NO: 9320550 - DNA, 22 bp, Homo sapiens
atgtctgcaaatatctgccagt

SEQ ID NO: 9320551 - DNA, 22 bp, Homo sapiens
atgtctgctattcatagggaaa

SEQ ID NO: 9320552 - DNA, 22 bp, Homo sapiens
gagggctgaagattgtggcccc

SEQ ID NO: 9320553 - DNA, 22 bp, Homo sapiens
atgtgaggaagaaagaggtaag

SEQ ID NO: 9320554 - DNA, 22 bp, Homo sapiens
atgtgagggaaatcagtcagaa

SEQ ID NO: 9320555 - DNA, 22 bp, Homo sapiens
atgtgagggctcaggctgactg

SEQ ID NO: 9320556 - DNA, 22 bp, Homo sapiens
atgtctacatttctgaccatga

SEQ ID NO: 9320557 - DNA, 22 bp, Homo sapiens
atgtctacctcgatggagccat

SEQ ID NO: 9320558 - DNA, 20 bp, Homo sapiens
atgtcctgttgctgccccag

SEQ ID NO: 9320559 - DNA, 22 bp, Homo sapiens
atgtcctggtcctccaccatgg

SEQ ID NO: 9320560 - DNA, 22 bp, Homo sapiens
atgtcctcttctgcctcaggcc

SEQ ID NO: 9320561 - DNA, 21 bp, Homo sapiens
atgtcctggctaccagcgcag

SEQ ID NO: 9320562 - DNA, 20 bp, Homo sapiens
atgtcctgcttctcctcacc

SEQ ID NO: 9320563 - DNA, 20 bp, Homo sapiens
atgtcctcagccactgccct

SEQ ID NO: 9320564 - DNA, 22 bp, Homo sapiens
gacaattgcttttgccgaataa

SEQ ID NO: 9320565 - DNA, 21 bp, Homo sapiens
gacacaaagggtagtaatggt

SEQ ID NO: 9320566 - DNA, 22 bp, Homo sapiens
gacatttgttaaagcacttagc

SEQ ID NO: 9320567 - DNA, 22 bp, Homo sapiens
gacatttattagaaaactatca

SEQ ID NO: 9320568 - DNA, 22 bp, Homo sapiens
gacataataatctgacctagat

SEQ ID NO: 9320569 - DNA, 22 bp, Homo sapiens
gacataatcctcctcacctact

SEQ ID NO: 9320570 - DNA, 22 bp, Homo sapiens
gaccttgtgatccgcccgcctt

SEQ ID NO: 9320571 - DNA, 22 bp, Homo sapiens
atgctctaagcttagtgaggca

SEQ ID NO: 9320572 - DNA, 22 bp, Homo sapiens
gacggcagaaactcatgaggtc

SEQ ID NO: 9320573 - DNA, 22 bp, Homo sapiens
gactggcttgccacccaggatc

SEQ ID NO: 9320574 - DNA, 22 bp, Homo sapiens
gactggctctatctccttggcg

SEQ ID NO: 9320575 - DNA, 22 bp, Homo sapiens
gactggaaagcctgtcctcaga

SEQ ID NO: 9320576 - DNA, 22 bp, Homo sapiens
gaataatagcagaaattagcag

SEQ ID NO: 9320577 - DNA, 22 bp, Homo sapiens
gaagtcttcatctgatgctctg

SEQ ID NO: 9320578 - DNA, 22 bp, Homo sapiens
gaataattgtgatgcttgaagt

SEQ ID NO: 9320579 - DNA, 22 bp, Homo sapiens
gaatcaattgtgaagactatga

SEQ ID NO: 9320580 - DNA, 22 bp, Homo sapiens
gacaatctagataatctgtctc

SEQ ID NO: 9320581 - DNA, 22 bp, Homo sapiens
gaaggctggctttctgagagca

SEQ ID NO: 9320582 - DNA, 22 bp, Homo sapiens
gaaggctggctttctgagagca

SEQ ID NO: 9320583 - DNA, 19 bp, Homo sapiens
gaacaaacttaaacttttc

SEQ ID NO: 9320584 - DNA, 22 bp, Homo sapiens
gaacaaacatttttggcagtat

SEQ ID NO: 9320585 - DNA, 22 bp, Homo sapiens
gaacaaacagtcaggacagtct

SEQ ID NO: 9320586 - DNA, 22 bp, Homo sapiens
gaaggctgtcagagaggagggc

SEQ ID NO: 9320587 - DNA, 22 bp, Homo sapiens
gaaggctggggcatcagtgaaa

SEQ ID NO: 9320588 - DNA, 22 bp, Homo sapiens
atgatattattctagcccagag

SEQ ID NO: 9320589 - DNA, 22 bp, Homo sapiens
atgatatttgcaatgtgcttgc

SEQ ID NO: 9320590 - DNA, 22 bp, Homo sapiens
atgatattttagtaaagtgata

SEQ ID NO: 9320591 - DNA, 22 bp, Homo sapiens
atgatggaatattattcaggca

SEQ ID NO: 9320592 - DNA, 22 bp, Homo sapiens
gaaacatttgttgagtacttgc

SEQ ID NO: 9320593 - DNA, 22 bp, Homo sapiens
gaaaccacagtacccaggaaaa

SEQ ID NO: 9320594 - DNA, 22 bp, Homo sapiens
atgacagatgctgtggggaggt

SEQ ID NO: 9320595 - DNA, 22 bp, Homo sapiens
gaaaatgttagcttcatagtca

SEQ ID NO: 9320596 - DNA, 22 bp, Homo sapiens
ctttcttgcataatttgaaacc

SEQ ID NO: 9320597 - DNA, 22 bp, Homo sapiens
ctttcttgcataatttgaaacc

SEQ ID NO: 9320598 - DNA, 20 bp, Homo sapiens
gaaacattggcagcaactga

SEQ ID NO: 9320599 - DNA, 22 bp, Homo sapiens
gaaacattggtctgccccttat

SEQ ID NO: 9320600 - DNA, 22 bp, Homo sapiens
atctggaggcctgtcttatccc

SEQ ID NO: 9320601 - DNA, 22 bp, Homo sapiens
atctggaggattctgggacttg

SEQ ID NO: 9320602 - DNA, 22 bp, Homo sapiens
atctggagatgggtctgtcacc

SEQ ID NO: 9320603 - DNA, 22 bp, Homo sapiens
cttctttaatgtatacaaaaga

SEQ ID NO: 9320604 - DNA, 22 bp, Homo sapiens
cttctttaatgtatacaaaaga

SEQ ID NO: 9320605 - DNA, 22 bp, Homo sapiens
ctttcccttagccccattctat

SEQ ID NO: 9320606 - DNA, 22 bp, Homo sapiens
ctttccctgcttagaaggattt

SEQ ID NO: 9320607 - DNA, 22 bp, Homo sapiens
ctttccagtttctaagtacagt

SEQ ID NO: 9320608 - DNA, 22 bp, Homo sapiens
ctttcccttttgccttgcgtgg

SEQ ID NO: 9320609 - DNA, 19 bp, Homo sapiens
ctttccagctcgagcaatt

SEQ ID NO: 9320610 - DNA, 22 bp, Homo sapiens
ctttccagcatttccttgtgaa

SEQ ID NO: 9320611 - DNA, 22 bp, Homo sapiens
ctttccagtaccaggaagcgga

SEQ ID NO: 9320612 - DNA, 22 bp, Homo sapiens
ctttccaggtctaaaggcaggg

SEQ ID NO: 9320613 - DNA, 22 bp, Homo sapiens
ctttccaggctgagtttgcttg

SEQ ID NO: 9320614 - DNA, 19 bp, Homo sapiens
ctttccaggagatgctgag

SEQ ID NO: 9320615 - DNA, 22 bp, Homo sapiens
ctttccaggacttgcatttctg

SEQ ID NO: 9320616 - DNA, 22 bp, Homo sapiens
ctttccaggaatcctcacagcc

SEQ ID NO: 9320617 - DNA, 22 bp, Homo sapiens
atgaaaatactgtggttgatag

SEQ ID NO: 9320618 - DNA, 22 bp, Homo sapiens
atgaaaagttcgatctagaagg

SEQ ID NO: 9320619 - DNA, 22 bp, Homo sapiens
atgaaaatgtacatgtgtataa

SEQ ID NO: 9320620 - DNA, 19 bp, Homo sapiens
atgaaacacagtggcctgg

SEQ ID NO: 9320621 - DNA, 22 bp, Homo sapiens
ctttctgattttaagctctaat

SEQ ID NO: 9320622 - DNA, 22 bp, Homo sapiens
ctttctgatgtaaggaactagg

SEQ ID NO: 9320623 - DNA, 22 bp, Homo sapiens
ctttctgaagtttaagttctaa

SEQ ID NO: 9320624 - DNA, 22 bp, Homo sapiens
ctttctgaaagacattttaact

SEQ ID NO: 9320625 - DNA, 22 bp, Homo sapiens
ctttctgaggagacgggctttg

SEQ ID NO: 9320626 - DNA, 22 bp, Homo sapiens
ctttctgagtccaacccctgat

SEQ ID NO: 9320627 - DNA, 22 bp, Homo sapiens
ctttctgatccctgcaaccctc

SEQ ID NO: 9320628 - DNA, 23 bp, Homo sapiens
atgaacattagtttcagatattg

SEQ ID NO: 9320629 - DNA, 22 bp, Homo sapiens
ctgaggagcgttggtcacgtgt

SEQ ID NO: 9320630 - DNA, 22 bp, Homo sapiens
ctgaggagcaaccccgtgccct

SEQ ID NO: 9320631 - DNA, 22 bp, Homo sapiens
ctgaggagcagctggcccgcta

SEQ ID NO: 9320632 - DNA, 22 bp, Homo sapiens
agttatattccatagattcaga

SEQ ID NO: 9320633 - DNA, 22 bp, Homo sapiens
ctgatccagagccaaccaaggc

SEQ ID NO: 9320634 - DNA, 22 bp, Homo sapiens
ctgcagggtttcgccagttgtg

SEQ ID NO: 9320635 - DNA, 22 bp, Homo sapiens
ctgcatgaagtcttttttatag

SEQ ID NO: 9320636 - DNA, 22 bp, Homo sapiens
ctgcagagagtgccgggcagcc

SEQ ID NO: 9320637 - DNA, 22 bp, Homo sapiens
ctgcagagatgaagaaggtggc

SEQ ID NO: 9320638 - DNA, 22 bp, Homo sapiens
ctgcagggagaggggacagcct

SEQ ID NO: 9320639 - DNA, 20 bp, Homo sapiens
ctgcagggtgagtgggcgat

SEQ ID NO: 9320640 - DNA, 23 bp, Homo sapiens
ataactgagccgaggcttaagaa

SEQ ID NO: 9320641 - DNA, 22 bp, Homo sapiens
ataacttcagggctgtgacaga

SEQ ID NO: 9320642 - DNA, 22 bp, Homo sapiens
ataagcagggtcaaatgcctac

SEQ ID NO: 9320643 - DNA, 22 bp, Homo sapiens
ataagcagggtcaaatgcctac

SEQ ID NO: 9320644 - DNA, 22 bp, Homo sapiens
atacaaattataggccccatcc

SEQ ID NO: 9320645 - DNA, 22 bp, Homo sapiens
atacaaatttatagatgcattt

SEQ ID NO: 9320646 - DNA, 22 bp, Homo sapiens
atacaaatttatagatgcattt

SEQ ID NO: 9320647 - DNA, 22 bp, Homo sapiens
atacaaatcctctgggatggta

SEQ ID NO: 9320648 - DNA, 22 bp, Homo sapiens
ctgctgaggtatactatgtgac

SEQ ID NO: 9320649 - DNA, 22 bp, Homo sapiens
ctgctgatcagggcaaagcaaa

SEQ ID NO: 9320650 - DNA, 22 bp, Homo sapiens
ctgctgaggccttccctgtcct

SEQ ID NO: 9320651 - DNA, 22 bp, Homo sapiens
ctgcctctcaggtccctgagat

SEQ ID NO: 9320652 - DNA, 22 bp, Homo sapiens
ctgcctctccccagagtggccc

SEQ ID NO: 9320653 - DNA, 22 bp, Homo sapiens
ctgcctctcagcctgaccgcca

SEQ ID NO: 9320654 - DNA, 22 bp, Homo sapiens
ataaatgattcagcaggaaata

SEQ ID NO: 9320655 - DNA, 22 bp, Homo sapiens
ctgcctctgcgtcccacagagt

SEQ ID NO: 9320656 - DNA, 22 bp, Homo sapiens
ctgcctctgcgtcccacagagt

SEQ ID NO: 9320657 - DNA, 22 bp, Homo sapiens
ataacagatgtgaagtgctaat

SEQ ID NO: 9320658 - DNA, 22 bp, Homo sapiens
atagacttggttagtaaatttg

SEQ ID NO: 9320659 - DNA, 22 bp, Homo sapiens
atagatttgaatttaagacttg

SEQ ID NO: 9320660 - DNA, 22 bp, Homo sapiens
atagcaaagcctggcacaatga

SEQ ID NO: 9320661 - DNA, 22 bp, Homo sapiens
atagcaaaaatgaacaaagctt

SEQ ID NO: 9320662 - DNA, 22 bp, Homo sapiens
ctggctccatctttgcttcctg

SEQ ID NO: 9320663 - DNA, 22 bp, Homo sapiens
ctggctccatccttgagctctg

SEQ ID NO: 9320664 - DNA, 22 bp, Homo sapiens
ctggctccattactcagcatct

SEQ ID NO: 9320665 - DNA, 22 bp, Homo sapiens
ctggctcccgaagccctcagtg

SEQ ID NO: 9320666 - DNA, 22 bp, Homo sapiens
atagcacaatattacctttatg

SEQ ID NO: 9320667 - DNA, 22 bp, Homo sapiens
atagcacaatgacttgggtatc

SEQ ID NO: 9320668 - DNA, 22 bp, Homo sapiens
atagcagaaaccaagcttcttc

SEQ ID NO: 9320669 - DNA, 22 bp, Homo sapiens
ctggctggccatgcagcgccag

SEQ ID NO: 9320670 - DNA, 22 bp, Homo sapiens
ctggctggcagatgctcttgct

SEQ ID NO: 9320671 - DNA, 22 bp, Homo sapiens
ctggctggcagatgctcttgct

SEQ ID NO: 9320672 - DNA, 22 bp, Homo sapiens
atagcacatcactccagtgagt

SEQ ID NO: 9320673 - DNA, 22 bp, Homo sapiens
ctggctggagtgcaggtgagtg

SEQ ID NO: 9320674 - DNA, 16 bp, Homo sapiens
atacattcattcccag

SEQ ID NO: 9320675 - DNA, 22 bp, Homo sapiens
atacctgcagtattttattgtt

SEQ ID NO: 9320676 - DNA, 22 bp, Homo sapiens
atacctgtgtatccacaagcgt

SEQ ID NO: 9320677 - DNA, 17 bp, Homo sapiens
atacagtttattttaca

SEQ ID NO: 9320678 - DNA, 22 bp, Homo sapiens
ctggagaagcattcaaataatt

SEQ ID NO: 9320679 - DNA, 17 bp, Homo sapiens
ctggagaagcctgtgga

SEQ ID NO: 9320680 - DNA, 22 bp, Homo sapiens
ctggagaagtactgagacattt

SEQ ID NO: 9320681 - DNA, 22 bp, Homo sapiens
ctggagaattctatgaaatatt

SEQ ID NO: 9320682 - DNA, 22 bp, Homo sapiens
atccaggcattctgacttcaag

SEQ ID NO: 9320683 - DNA, 22 bp, Homo sapiens
atccaggccccaagaccccgac

SEQ ID NO: 9320684 - DNA, 22 bp, Homo sapiens
atccaggccttgaagtaccagt

SEQ ID NO: 9320685 - DNA, 22 bp, Homo sapiens
atccaggcctgagtctggtcct

SEQ ID NO: 9320686 - DNA, 22 bp, Homo sapiens
atccaccctgtggtggctttct

SEQ ID NO: 9320687 - DNA, 22 bp, Homo sapiens
atccaccctgtggtggctttct

SEQ ID NO: 9320688 - DNA, 22 bp, Homo sapiens
atccaggcttcagctgcctact

SEQ ID NO: 9320689 - DNA, 22 bp, Homo sapiens
atccaggctgtctaatgggaga

SEQ ID NO: 9320690 - DNA, 22 bp, Homo sapiens
atccaggcttaatgggagccac

SEQ ID NO: 9320691 - DNA, 22 bp, Homo sapiens
atccaggctgcgggtctcaagt

SEQ ID NO: 9320692 - DNA, 22 bp, Homo sapiens
atccaggctgctatgaggatga

SEQ ID NO: 9320693 - DNA, 22 bp, Homo sapiens
atccaggctgggtgtggctact

SEQ ID NO: 9320694 - DNA, 22 bp, Homo sapiens
atccaggctggagtgcattggt

SEQ ID NO: 9320695 - DNA, 22 bp, Homo sapiens
atccaggctgctttctatgccc

SEQ ID NO: 9320696 - DNA, 22 bp, Homo sapiens
ctgtgtgcatagttgtgctcaa

SEQ ID NO: 9320697 - DNA, 22 bp, Homo sapiens
atccaggcgaatgcagaaggcc

SEQ ID NO: 9320698 - DNA, 22 bp, Homo sapiens
ctgtgtggcctcaagccagcct

SEQ ID NO: 9320699 - DNA, 22 bp, Homo sapiens
ctgtgtggactggttgaggccc

SEQ ID NO: 9320700 - DNA, 22 bp, Homo sapiens
ctgtgtgctcggatggactcgt

SEQ ID NO: 9320701 - DNA, 22 bp, Homo sapiens
ctgtgtgtcatttgtcaatcct

SEQ ID NO: 9320702 - DNA, 22 bp, Homo sapiens
ctgtgtgtcctcggacgagttt

SEQ ID NO: 9320703 - DNA, 22 bp, Homo sapiens
atcctgggcaagtcaatgtccc

SEQ ID NO: 9320704 - DNA, 22 bp, Homo sapiens
atcctgggcaaagtatgctgtc

SEQ ID NO: 9320705 - DNA, 18 bp, Homo sapiens
atcctgggccagtctttc

SEQ ID NO: 9320706 - DNA, 22 bp, Homo sapiens
atcctgggcagttttgagtgct

SEQ ID NO: 9320707 - DNA, 22 bp, Homo sapiens
atcctgggcagtgtgtcactct

SEQ ID NO: 9320708 - DNA, 22 bp, Homo sapiens
atcctgggggcagctggaaaca

SEQ ID NO: 9320709 - DNA, 22 bp, Homo sapiens
atcctgggtaagttccttttaa

SEQ ID NO: 9320710 - DNA, 22 bp, Homo sapiens
atcctgggcctcagaggtgtgt

SEQ ID NO: 9320711 - DNA, 22 bp, Homo sapiens
atcctgggctgcaccctcagcc

SEQ ID NO: 9320712 - DNA, 19 bp, Homo sapiens
atcctgggtcctccagctg

SEQ ID NO: 9320713 - DNA, 22 bp, Homo sapiens
atcctgggtttgtgagtttatg

SEQ ID NO: 9320714 - DNA, 22 bp, Homo sapiens
atcagagattgtagtatgtgca

SEQ ID NO: 9320715 - DNA, 22 bp, Homo sapiens
atcagagaagtttcactggcat

SEQ ID NO: 9320716 - DNA, 22 bp, Homo sapiens
atcagagaaatggagggcgctt

SEQ ID NO: 9320717 - DNA, 22 bp, Homo sapiens
atcagagacaaaaccagcactt

SEQ ID NO: 9320718 - DNA, 22 bp, Homo sapiens
atcagagaccggtcaagtcatg

SEQ ID NO: 9320719 - DNA, 22 bp, Homo sapiens
atcagagatggctccagtgctc

SEQ ID NO: 9320720 - DNA, 22 bp, Homo sapiens
ctgtggccttggaccagcatct

SEQ ID NO: 9320721 - DNA, 22 bp, Homo sapiens
ctgtggcctttgttggaggtcc

SEQ ID NO: 9320722 - DNA, 21 bp, Homo sapiens
ctgtggcctggctagcaccgt

SEQ ID NO: 9320723 - DNA, 22 bp, Homo sapiens
ctgtggcctgtgccagaactgg

SEQ ID NO: 9320724 - DNA, 23 bp, Homo sapiens
ctgtggccctgcttcatgcagcc

SEQ ID NO: 9320725 - DNA, 22 bp, Homo sapiens
ctgtggagtgtagatgctgggt

SEQ ID NO: 9320726 - DNA, 22 bp, Homo sapiens
ctgtggctcaattgcctactga

SEQ ID NO: 9320727 - DNA, 22 bp, Homo sapiens
cttcctcatgtgcaatgcaagc

SEQ ID NO: 9320728 - DNA, 18 bp, Homo sapiens
cttcctcatcgctctccc

SEQ ID NO: 9320729 - DNA, 22 bp, Homo sapiens
cttcctcccggcccatgctctg

SEQ ID NO: 9320730 - DNA, 22 bp, Homo sapiens
cttcctcaggcattagctggac

SEQ ID NO: 9320731 - DNA, 22 bp, Homo sapiens
cttcctcacggtgcaacaggaa

SEQ ID NO: 9320732 - DNA, 22 bp, Homo sapiens
atcctgtgcaatgactgcatct

SEQ ID NO: 9320733 - DNA, 22 bp, Homo sapiens
cttagagatgggttttacttag

SEQ ID NO: 9320734 - DNA, 22 bp, Homo sapiens
cttagagccttactcttcttgt

SEQ ID NO: 9320735 - DNA, 22 bp, Homo sapiens
atctctgcatccctcaaggttg

SEQ ID NO: 9320736 - DNA, 22 bp, Homo sapiens
cttcctccgaagaagttgctgg

SEQ ID NO: 9320737 - DNA, 22 bp, Homo sapiens
atctctgcgtccccagcatcga

SEQ ID NO: 9320738 - DNA, 22 bp, Homo sapiens
atctgaagtggagaaaaatata

SEQ ID NO: 9320739 - DNA, 22 bp, Homo sapiens
atctgatttgtaattttagaaa

SEQ ID NO: 9320740 - DNA, 22 bp, Homo sapiens
atattactctgatttagtaaat

SEQ ID NO: 9320741 - DNA, 22 bp, Homo sapiens
atattagcagtgatcaaaatgg

SEQ ID NO: 9320742 - DNA, 22 bp, Homo sapiens
atattacataaacatgagtgaa

SEQ ID NO: 9320743 - DNA, 22 bp, Homo sapiens
atattagtgtaggtagctaata

SEQ ID NO: 9320744 - DNA, 22 bp, Homo sapiens
atatgcatgtacgtgtgcacaa

SEQ ID NO: 9320745 - DNA, 22 bp, Homo sapiens
atatgcatttacctggcatata

SEQ ID NO: 9320746 - DNA, 22 bp, Homo sapiens
ctgggctgagcctgggctgtgt

SEQ ID NO: 9320747 - DNA, 22 bp, Homo sapiens
ctgggctgaaggctccccacac

SEQ ID NO: 9320748 - DNA, 22 bp, Homo sapiens
ctgggctgagcctgggctgtgt

SEQ ID NO: 9320749 - DNA, 22 bp, Homo sapiens
ctgggctgagctgtggaaactc

SEQ ID NO: 9320750 - DNA, 22 bp, Homo sapiens
atattcactgggtactaaaaag

SEQ ID NO: 9320751 - DNA, 22 bp, Homo sapiens
atattcactgagcataaagcca

SEQ ID NO: 9320752 - DNA, 19 bp, Homo sapiens
ctgggctgaggtctgcctt

SEQ ID NO: 9320753 - DNA, 22 bp, Homo sapiens
ctgggctctggggtcccggtgc

SEQ ID NO: 9320754 - DNA, 22 bp, Homo sapiens
ctgggctctgcggtgtcgctct

SEQ ID NO: 9320755 - DNA, 22 bp, Homo sapiens
ctgggctgaaagtgttccttga

SEQ ID NO: 9320756 - DNA, 22 bp, Homo sapiens
atattataagttatttcaagtt

SEQ ID NO: 9320757 - DNA, 22 bp, Homo sapiens
atattatggccccatctaagct

SEQ ID NO: 9320758 - DNA, 22 bp, Homo sapiens
atattatagacagagtcttctg

SEQ ID NO: 9320759 - DNA, 22 bp, Homo sapiens
ctgggctcagatgagaggaagg

SEQ ID NO: 9320760 - DNA, 22 bp, Homo sapiens
ctgggcctggtagggcttgaaa

SEQ ID NO: 9320761 - DNA, 22 bp, Homo sapiens
ctggctggccggagcgaggcgg

SEQ ID NO: 9320762 - DNA, 22 bp, Homo sapiens
ctggctgggagcgagctgctca

SEQ ID NO: 9320763 - DNA, 22 bp, Homo sapiens
ctggctgggagcgagctgctca

SEQ ID NO: 9320764 - DNA, 22 bp, Homo sapiens
ctggctgtttcaggcagtgtcc

SEQ ID NO: 9320765 - DNA, 22 bp, Homo sapiens
ctggctgtgtcttggaggagct

SEQ ID NO: 9320766 - DNA, 22 bp, Homo sapiens
ctggcttcctcaggagcagtgg

SEQ ID NO: 9320767 - DNA, 22 bp, Homo sapiens
ctggcttcctcaggagcagtgg

SEQ ID NO: 9320768 - DNA, 22 bp, Homo sapiens
ctggcttcctcaggagcagtgg

SEQ ID NO: 9320769 - DNA, 22 bp, Homo sapiens
ctggcttccctgtcttatggaa

SEQ ID NO: 9320770 - DNA, 22 bp, Homo sapiens
ctggcttccaccatggcccctg

SEQ ID NO: 9320771 - DNA, 22 bp, Homo sapiens
ctggcttcagctgccatcaatg

SEQ ID NO: 9320772 - DNA, 22 bp, Homo sapiens
ctggcttccatgctgtagtggc

SEQ ID NO: 9320773 - DNA, 22 bp, Homo sapiens
atcaaagtgatttgtaaacagg

SEQ ID NO: 9320774 - DNA, 21 bp, Homo sapiens
atattgtaggtaaagtgcagg

SEQ ID NO: 9320775 - DNA, 22 bp, Homo sapiens
atattgtactagggttacatgt

SEQ ID NO: 9320776 - DNA, 22 bp, Homo sapiens
atattgtactagggttacatgt

SEQ ID NO: 9320777 - DNA, 22 bp, Homo sapiens
atcacattctttcaaagcagtc

SEQ ID NO: 9320778 - DNA, 22 bp, Homo sapiens
atcacattctttcaaagcagtc

SEQ ID NO: 9320779 - DNA, 22 bp, Homo sapiens
atcagaagcaggaggaatgaag

SEQ ID NO: 9320780 - DNA, 22 bp, Homo sapiens
agttagtacaagaaagatgaac

SEQ ID NO: 9320781 - DNA, 22 bp, Homo sapiens
agttagtactgaggacccagac

SEQ ID NO: 9320782 - DNA, 22 bp, Homo sapiens
agttagtagacttttccattta

SEQ ID NO: 9320783 - DNA, 22 bp, Homo sapiens
agttagttatggtccaacctcc

SEQ ID NO: 9320784 - DNA, 22 bp, Homo sapiens
agttagttttgtaattccaccc

SEQ ID NO: 9320785 - DNA, 22 bp, Homo sapiens
agttagtatgcattaccctcca

SEQ ID NO: 9320786 - DNA, 22 bp, Homo sapiens
agttagtatacaaagtaacagc

SEQ ID NO: 9320787 - DNA, 22 bp, Homo sapiens
agttagtatttgttgttctcca

SEQ ID NO: 9320788 - DNA, 22 bp, Homo sapiens
agttataatctgctactgatat

SEQ ID NO: 9320789 - DNA, 22 bp, Homo sapiens
ctgagcagcaacccagagcctc

SEQ ID NO: 9320790 - DNA, 22 bp, Homo sapiens
ctgaggagaggtggcctgtgtt

SEQ ID NO: 9320791 - DNA, 22 bp, Homo sapiens
ctgaggagaggtggcctgtgtt

SEQ ID NO: 9320792 - DNA, 22 bp, Homo sapiens
ctgaggagaggtggcctgtgtt

SEQ ID NO: 9320793 - DNA, 22 bp, Homo sapiens
ctgaggagagatcacgtggtgt

SEQ ID NO: 9320794 - DNA, 22 bp, Homo sapiens
ctgaggagagatcacgtggtgt

SEQ ID NO: 9320795 - DNA, 22 bp, Homo sapiens
ctgagcagcagggagactggtg

SEQ ID NO: 9320796 - DNA, 22 bp, Homo sapiens
ctgaatggcgagttagttagtt

SEQ ID NO: 9320797 - DNA, 22 bp, Homo sapiens
ctgaatggaatcatccctgctt

SEQ ID NO: 9320798 - DNA, 22 bp, Homo sapiens
ctgaatgatataagatctttct

SEQ ID NO: 9320799 - DNA, 22 bp, Homo sapiens
ctgaatgataatcttttgctgg

SEQ ID NO: 9320800 - DNA, 22 bp, Homo sapiens
ctgaatgaaatcaaggactgag

SEQ ID NO: 9320801 - DNA, 22 bp, Homo sapiens
ctgaatgactgaagtcacaatt

SEQ ID NO: 9320802 - DNA, 22 bp, Homo sapiens
ctgaatgaatggtttgtcttat

SEQ ID NO: 9320803 - DNA, 22 bp, Homo sapiens
ctgaatgaggaaaagagtgagg

SEQ ID NO: 9320804 - DNA, 22 bp, Homo sapiens
ctgaatgagggattctgagggc

SEQ ID NO: 9320805 - DNA, 22 bp, Homo sapiens
ctgaatgagtggatttttcatt

SEQ ID NO: 9320806 - DNA, 22 bp, Homo sapiens
ctctgggaagggctgagcactg

SEQ ID NO: 9320807 - DNA, 22 bp, Homo sapiens
ctctggctttgctcatgcatcc

SEQ ID NO: 9320808 - DNA, 22 bp, Homo sapiens
ctctgggaccatggcaagtgcg

SEQ ID NO: 9320809 - DNA, 22 bp, Homo sapiens
ctctgggaccacgtgactctgc

SEQ ID NO: 9320810 - DNA, 22 bp, Homo sapiens
ctctgggcttacctgcttcctg

SEQ ID NO: 9320811 - DNA, 22 bp, Homo sapiens
ctctggcttctaccttgcagtt

SEQ ID NO: 9320812 - DNA, 22 bp, Homo sapiens
ctctgctcaccagccatgtgat

SEQ ID NO: 9320813 - DNA, 22 bp, Homo sapiens
ctctgcctgtctcatcctgcaa

SEQ ID NO: 9320814 - DNA, 22 bp, Homo sapiens
ctctgcctgtgtcgccaccaca

SEQ ID NO: 9320815 - DNA, 22 bp, Homo sapiens
ctctgcctgcccaccgacccat

SEQ ID NO: 9320816 - DNA, 22 bp, Homo sapiens
ctctgcctgtctcatcctgcaa

SEQ ID NO: 9320817 - DNA, 22 bp, Homo sapiens
ctctgagcagaggccgtggcta

SEQ ID NO: 9320818 - DNA, 22 bp, Homo sapiens
ctctgagcccgctgcagcccca

SEQ ID NO: 9320819 - DNA, 22 bp, Homo sapiens
ctctcatagtgagtgtggtcca

SEQ ID NO: 9320820 - DNA, 22 bp, Homo sapiens
ctctcagtttcctcaactgtaa

SEQ ID NO: 9320821 - DNA, 19 bp, Homo sapiens
ctctcagcctgtctccttg

SEQ ID NO: 9320822 - DNA, 22 bp, Homo sapiens
ctctcagcaggaaagcatgcaa

SEQ ID NO: 9320823 - DNA, 22 bp, Homo sapiens
ctctcagtgccacacagccatt

SEQ ID NO: 9320824 - DNA, 22 bp, Homo sapiens
ctctcagggtccctgcggagga

SEQ ID NO: 9320825 - DNA, 22 bp, Homo sapiens
ctctcagggcaggtggcctttc

SEQ ID NO: 9320826 - DNA, 22 bp, Homo sapiens
ctctcagggacccagccagcct

SEQ ID NO: 9320827 - DNA, 22 bp, Homo sapiens
agtcttcactcttcactactat

SEQ ID NO: 9320828 - DNA, 22 bp, Homo sapiens
ctccagctcgcgagctctgctc

SEQ ID NO: 9320829 - DNA, 22 bp, Homo sapiens
ctccagctagggctggcttact

SEQ ID NO: 9320830 - DNA, 22 bp, Homo sapiens
ctccagagccagtgcttttcca

SEQ ID NO: 9320831 - DNA, 22 bp, Homo sapiens
ctccagagatccattgaatgta

SEQ ID NO: 9320832 - DNA, 22 bp, Homo sapiens
ctccaggctcgtccaagatcga

SEQ ID NO: 9320833 - DNA, 22 bp, Homo sapiens
ctccaggcgggaggcggttcca

SEQ ID NO: 9320834 - DNA, 22 bp, Homo sapiens
ctccaggcgggaggcggttcca

SEQ ID NO: 9320835 - DNA, 22 bp, Homo sapiens
ctccaggcgcttaccaagcgct

SEQ ID NO: 9320836 - DNA, 22 bp, Homo sapiens
ctccaggaaagtcaggcttaga

SEQ ID NO: 9320837 - DNA, 22 bp, Homo sapiens
ctccaggcttcaagggccggcc

SEQ ID NO: 9320838 - DNA, 22 bp, Homo sapiens
ctccaggctggggtgcaggttg

SEQ ID NO: 9320839 - DNA, 22 bp, Homo sapiens
ctccaggctggggtgcaggttg

SEQ ID NO: 9320840 - DNA, 22 bp, Homo sapiens
ctccaggctggatccaagtcaa

SEQ ID NO: 9320841 - DNA, 22 bp, Homo sapiens
ctccaggaaagcctgaggcccg

SEQ ID NO: 9320842 - DNA, 22 bp, Homo sapiens
ctccagctttagctctccaggg

SEQ ID NO: 9320843 - DNA, 22 bp, Homo sapiens
ctcattgcagctgcattactgt

SEQ ID NO: 9320844 - DNA, 22 bp, Homo sapiens
ctcatgcccagagccactgttg

SEQ ID NO: 9320845 - DNA, 22 bp, Homo sapiens
ctcatctgtctgggctggtttt

SEQ ID NO: 9320846 - DNA, 22 bp, Homo sapiens
agtcctgggtccagcaggtcct

SEQ ID NO: 9320847 - DNA, 22 bp, Homo sapiens
agtcccttctcaaagtgtgcgg

SEQ ID NO: 9320848 - DNA, 22 bp, Homo sapiens
agtccgcctgctgccgtggcag

SEQ ID NO: 9320849 - DNA, 22 bp, Homo sapiens
agtcctggcatataggtcctca

SEQ ID NO: 9320850 - DNA, 18 bp, Homo sapiens
agtcctggagatcaccaa

SEQ ID NO: 9320851 - DNA, 22 bp, Homo sapiens
agtcctaggccctgctccagat

SEQ ID NO: 9320852 - DNA, 22 bp, Homo sapiens
agtcctggacttggagtcaggg

SEQ ID NO: 9320853 - DNA, 22 bp, Homo sapiens
ctcctgggaaaggctggacaca

SEQ ID NO: 9320854 - DNA, 22 bp, Homo sapiens
ctcctgggaaatgaaggggcag

SEQ ID NO: 9320855 - DNA, 22 bp, Homo sapiens
ctcctgggaatttagttgtgag

SEQ ID NO: 9320856 - DNA, 20 bp, Homo sapiens
ctcctgggactgctggttat

SEQ ID NO: 9320857 - DNA, 20 bp, Homo sapiens
ctcctgggactgctggttat

SEQ ID NO: 9320858 - DNA, 22 bp, Homo sapiens
ctcctggggccatggaaggaac

SEQ ID NO: 9320859 - DNA, 22 bp, Homo sapiens
ctcctggggcacttagaagcaa

SEQ ID NO: 9320860 - DNA, 22 bp, Homo sapiens
ctcctgggggacagcggcaggg

SEQ ID NO: 9320861 - DNA, 22 bp, Homo sapiens
ctcctgggtcattgccagcaaa

SEQ ID NO: 9320862 - DNA, 22 bp, Homo sapiens
ctctcagactgaagggcctgtg

SEQ ID NO: 9320863 - DNA, 22 bp, Homo sapiens
ctctcagaagtttatgtcagaa

SEQ ID NO: 9320864 - DNA, 18 bp, Homo sapiens
ctccagggaactcagtca

SEQ ID NO: 9320865 - DNA, 22 bp, Homo sapiens
ctcccaggttgattctttccct

SEQ ID NO: 9320866 - DNA, 22 bp, Homo sapiens
ctccagggaaaggggcgtccgc

SEQ ID NO: 9320867 - DNA, 18 bp, Homo sapiens
ctccagggaactcagtca

SEQ ID NO: 9320868 - DNA, 22 bp, Homo sapiens
ctccctccaaataagactcggg

SEQ ID NO: 9320869 - DNA, 22 bp, Homo sapiens
ctccctccctacgtgagctcac

SEQ ID NO: 9320870 - DNA, 22 bp, Homo sapiens
ctccctccctacgtgagctcac

SEQ ID NO: 9320871 - DNA, 22 bp, Homo sapiens
ctcctcagaacagccttggctg

SEQ ID NO: 9320872 - DNA, 22 bp, Homo sapiens
ctcctcagaagagggtaacaca

SEQ ID NO: 9320873 - DNA, 22 bp, Homo sapiens
ctcctcagactttccttgtccg

SEQ ID NO: 9320874 - DNA, 22 bp, Homo sapiens
ctcctaggacgccgctgctcct

SEQ ID NO: 9320875 - DNA, 22 bp, Homo sapiens
ctcctaggacgccgctgctcct

SEQ ID NO: 9320876 - DNA, 22 bp, Homo sapiens
ctcctcacacccactgcaacca

SEQ ID NO: 9320877 - DNA, 18 bp, Homo sapiens
cctgtgtgtgttgcaggc

SEQ ID NO: 9320878 - DNA, 22 bp, Homo sapiens
aggtgggcaatgaggcctgagt

SEQ ID NO: 9320879 - DNA, 22 bp, Homo sapiens
aggtggggaggagtgtctcttt

SEQ ID NO: 9320880 - DNA, 22 bp, Homo sapiens
cctgtctccctggcatggctca

SEQ ID NO: 9320881 - DNA, 22 bp, Homo sapiens
cctgtctccctggcatggctca

SEQ ID NO: 9320882 - DNA, 22 bp, Homo sapiens
cctgtcccccaggcctgtacca

SEQ ID NO: 9320883 - DNA, 22 bp, Homo sapiens
cctgtcccaagcagggctggcc

SEQ ID NO: 9320884 - DNA, 22 bp, Homo sapiens
cctgtcccctcacaatgccact

SEQ ID NO: 9320885 - DNA, 19 bp, Homo sapiens
cctgtgagaggacaggtgt

SEQ ID NO: 9320886 - DNA, 20 bp, Homo sapiens
cctgtctcctcttacctggc

SEQ ID NO: 9320887 - DNA, 22 bp, Homo sapiens
cctgtgcatccggtggtcattg

SEQ ID NO: 9320888 - DNA, 20 bp, Homo sapiens
cctgggctccaggagccccg

SEQ ID NO: 9320889 - DNA, 22 bp, Homo sapiens
cctgggcttctgtctagatgtt

SEQ ID NO: 9320890 - DNA, 22 bp, Homo sapiens
cctgggcttggttgttgagaac

SEQ ID NO: 9320891 - DNA, 22 bp, Homo sapiens
cctgtcagggtttgcctcagaa

SEQ ID NO: 9320892 - DNA, 22 bp, Homo sapiens
cctgggctttgagggcaggatg

SEQ ID NO: 9320893 - DNA, 22 bp, Homo sapiens
cctggctctgggatcttcgctt

SEQ ID NO: 9320894 - DNA, 22 bp, Homo sapiens
cctggctctgggatcttcgctt

SEQ ID NO: 9320895 - DNA, 22 bp, Homo sapiens
cctgggctcaggcttgggcagc

SEQ ID NO: 9320896 - DNA, 22 bp, Homo sapiens
cctgggctccactccaagagca

SEQ ID NO: 9320897 - DNA, 22 bp, Homo sapiens
cctgggctcaccatgccttgga

SEQ ID NO: 9320898 - DNA, 22 bp, Homo sapiens
cctgggctcaggcttgggcagc

SEQ ID NO: 9320899 - DNA, 22 bp, Homo sapiens
cctgggctcaggcttgggcagc

SEQ ID NO: 9320900 - DNA, 22 bp, Homo sapiens
cctgggctcaagtgatggtccc

SEQ ID NO: 9320901 - DNA, 22 bp, Homo sapiens
aggtccagttttctgacaaggg

SEQ ID NO: 9320902 - DNA, 22 bp, Homo sapiens
aggtccagttttctgacaaggg

SEQ ID NO: 9320903 - DNA, 22 bp, Homo sapiens
aggtccatcgtggatgaactgc

SEQ ID NO: 9320904 - DNA, 22 bp, Homo sapiens
cctggctctgcagccactccag

SEQ ID NO: 9320905 - DNA, 22 bp, Homo sapiens
cctggctctgaggtatgcctgg

SEQ ID NO: 9320906 - DNA, 22 bp, Homo sapiens
cctggctctgcgtgcagctccg

SEQ ID NO: 9320907 - DNA, 22 bp, Homo sapiens
cctggctctgccacttactgcc

SEQ ID NO: 9320908 - DNA, 22 bp, Homo sapiens
cctgccagcatcttcagcccct

SEQ ID NO: 9320909 - DNA, 22 bp, Homo sapiens
cctgccagatcccctgagctga

SEQ ID NO: 9320910 - DNA, 22 bp, Homo sapiens
cctgccagagcagcttgtcctc

SEQ ID NO: 9320911 - DNA, 22 bp, Homo sapiens
cctgcagatgtgggacagctgt

SEQ ID NO: 9320912 - DNA, 22 bp, Homo sapiens
cctgcagaggtcaggccagaaa

SEQ ID NO: 9320913 - DNA, 22 bp, Homo sapiens
cctgcagagcaggagaggcatc

SEQ ID NO: 9320914 - DNA, 23 bp, Homo sapiens
aggtaggttattgctgctacctg

SEQ ID NO: 9320915 - DNA, 22 bp, Homo sapiens
aggtagggaagaaggcatgaaa

SEQ ID NO: 9320916 - DNA, 22 bp, Homo sapiens
aggtagggaagaaggcatgaaa

SEQ ID NO: 9320917 - DNA, 22 bp, Homo sapiens
cctgccagcgcttatctctcgg

SEQ ID NO: 9320918 - DNA, 22 bp, Homo sapiens
cctgccagcgcttatctctcgg

SEQ ID NO: 9320919 - DNA, 22 bp, Homo sapiens
aggtaggagttgatggatgttc

SEQ ID NO: 9320920 - DNA, 22 bp, Homo sapiens
aggtacagggtgaaagtttatg

SEQ ID NO: 9320921 - DNA, 22 bp, Homo sapiens
aggtaggatgggtggagatgat

SEQ ID NO: 9320922 - DNA, 19 bp, Homo sapiens
ctagggcttggcagcaggc

SEQ ID NO: 9320923 - DNA, 22 bp, Homo sapiens
ctagtcactcagcactgacaaa

SEQ ID NO: 9320924 - DNA, 22 bp, Homo sapiens
ctagtcactgtaataatctgct

SEQ ID NO: 9320925 - DNA, 22 bp, Homo sapiens
ctagtcacgtctttcagttacc

SEQ ID NO: 9320926 - DNA, 22 bp, Homo sapiens
ctagtcacacagtaaggacggg

SEQ ID NO: 9320927 - DNA, 23 bp, Homo sapiens
ctagtaaatcctgaatagcaggc

SEQ ID NO: 9320928 - DNA, 22 bp, Homo sapiens
ctagtaaatcagaagctgtggg

SEQ ID NO: 9320929 - DNA, 22 bp, Homo sapiens
ctagtagacagaaatgtccagt

SEQ ID NO: 9320930 - DNA, 22 bp, Homo sapiens
ctagtagcccattttggatacc

SEQ ID NO: 9320931 - DNA, 22 bp, Homo sapiens
ctagtagcccggtgtcctctga

SEQ ID NO: 9320932 - DNA, 22 bp, Homo sapiens
agtccagggagcccaggctttg

SEQ ID NO: 9320933 - DNA, 22 bp, Homo sapiens
ctagaagtttgggtccattaag

SEQ ID NO: 9320934 - DNA, 22 bp, Homo sapiens
ctagaaattctgattcagtagg

SEQ ID NO: 9320935 - DNA, 22 bp, Homo sapiens
agtatgcatatttcaaagtaag

SEQ ID NO: 9320936 - DNA, 22 bp, Homo sapiens
ctaaggaaaaggatatatatgt

SEQ ID NO: 9320937 - DNA, 22 bp, Homo sapiens
agtatttagcatagtggttagt

SEQ ID NO: 9320938 - DNA, 22 bp, Homo sapiens
ctaccagaattttggatcaact

SEQ ID NO: 9320939 - DNA, 22 bp, Homo sapiens
ctagaaatctctgtttacatca

SEQ ID NO: 9320940 - DNA, 22 bp, Homo sapiens
ctacatttgttcaaataagctg

SEQ ID NO: 9320941 - DNA, 22 bp, Homo sapiens
ctacattttgtgattatgaaat

SEQ ID NO: 9320942 - DNA, 22 bp, Homo sapiens
cgcaggctttagaatctgctac

SEQ ID NO: 9320943 - DNA, 19 bp, Homo sapiens
cgcaggcttcgggtcgctc

SEQ ID NO: 9320944 - DNA, 22 bp, Homo sapiens
cgcaggctcggttcacagagca

SEQ ID NO: 9320945 - DNA, 22 bp, Homo sapiens
cgcaggctggcgcggagtggca

SEQ ID NO: 9320946 - DNA, 22 bp, Homo sapiens
cgcaggggaggaaggtacacct

SEQ ID NO: 9320947 - DNA, 22 bp, Homo sapiens
cctgttcttgtctcattggcta

SEQ ID NO: 9320948 - DNA, 22 bp, Homo sapiens
cctgttctaatcttggggcaga

SEQ ID NO: 9320949 - DNA, 22 bp, Homo sapiens
cgcaggcaagagagtacagtta

SEQ ID NO: 9320950 - DNA, 22 bp, Homo sapiens
cgcaggcacagagtggacagcg

SEQ ID NO: 9320951 - DNA, 22 bp, Homo sapiens
cgaggccatgcatgctgaggac

SEQ ID NO: 9320952 - DNA, 22 bp, Homo sapiens
cgcaggctccggggtgccctgg

SEQ ID NO: 9320953 - DNA, 22 bp, Homo sapiens
cctgtgtttcaccaaaagagtc

SEQ ID NO: 9320954 - DNA, 22 bp, Homo sapiens
cggctcagctagcttggcccca

SEQ ID NO: 9320955 - DNA, 22 bp, Homo sapiens
cgggctccgggtctttgcagtc

SEQ ID NO: 9320956 - DNA, 22 bp, Homo sapiens
ctaagcaagttccactctacaa

SEQ ID NO: 9320957 - DNA, 22 bp, Homo sapiens
agtacaattatatttagatggt

SEQ ID NO: 9320958 - DNA, 22 bp, Homo sapiens
agtacaatgtctgacacagtag

SEQ ID NO: 9320959 - DNA, 22 bp, Homo sapiens
agggctgacagtggcgtggcgt

SEQ ID NO: 9320960 - DNA, 22 bp, Homo sapiens
agggctgacctaagctccactt

SEQ ID NO: 9320961 - DNA, 22 bp, Homo sapiens
agggctgagaatgacagggccg

SEQ ID NO: 9320962 - DNA, 20 bp, Homo sapiens
agggctgagaagggactagc

SEQ ID NO: 9320963 - DNA, 22 bp, Homo sapiens
agggctgagactaaggccagat

SEQ ID NO: 9320964 - DNA, 18 bp, Homo sapiens
cctcagggagatccagtg

SEQ ID NO: 9320965 - DNA, 22 bp, Homo sapiens
agggctgagcccaggcatgtag

SEQ ID NO: 9320966 - DNA, 22 bp, Homo sapiens
cctcaggggtgcccacagctgc

SEQ ID NO: 9320967 - DNA, 23 bp, Homo sapiens
cctcaggggacctgtgagcctga

SEQ ID NO: 9320968 - DNA, 23 bp, Homo sapiens
cctcaggggacctgtgagcctga

SEQ ID NO: 9320969 - DNA, 22 bp, Homo sapiens
cctcagggtctgaggagaccgt

SEQ ID NO: 9320970 - DNA, 22 bp, Homo sapiens
cctcagggtctctcacagcacc

SEQ ID NO: 9320971 - DNA, 23 bp, Homo sapiens
cctcagggtctagcagagagaag

SEQ ID NO: 9320972 - DNA, 23 bp, Homo sapiens
cctcagggtctagcagagagaag

SEQ ID NO: 9320973 - DNA, 23 bp, Homo sapiens
cctcagggtctagcagagagaag

SEQ ID NO: 9320974 - DNA, 22 bp, Homo sapiens
cctcagggtctctcacagcacc

SEQ ID NO: 9320975 - DNA, 22 bp, Homo sapiens
cctcagggttcggatgagaaca

SEQ ID NO: 9320976 - DNA, 22 bp, Homo sapiens
cctcagggttcggatgagaaca

SEQ ID NO: 9320977 - DNA, 22 bp, Homo sapiens
cctcagggtggcatcagatctt

SEQ ID NO: 9320978 - DNA, 22 bp, Homo sapiens
agggctttgatggcattctcat

SEQ ID NO: 9320979 - DNA, 22 bp, Homo sapiens
cctcagggtggcatcagatctt

SEQ ID NO: 9320980 - DNA, 22 bp, Homo sapiens
agggctttggccccctgctgca

SEQ ID NO: 9320981 - DNA, 22 bp, Homo sapiens
agggctttggccccctgctgca

SEQ ID NO: 9320982 - DNA, 22 bp, Homo sapiens
agggctttgcaatgcacagtgg

SEQ ID NO: 9320983 - DNA, 22 bp, Homo sapiens
agggctttgatgtccatgagga

SEQ ID NO: 9320984 - DNA, 19 bp, Homo sapiens
agggctttgtgtgctgctc

SEQ ID NO: 9320985 - DNA, 22 bp, Homo sapiens
agggctttgtggcagtcactat

SEQ ID NO: 9320986 - DNA, 22 bp, Homo sapiens
agggctttgtttaggtgaccac

SEQ ID NO: 9320987 - DNA, 19 bp, Homo sapiens
agggctttgtgtgctgctc

SEQ ID NO: 9320988 - DNA, 22 bp, Homo sapiens
agggcttttgcaatccaagtct

SEQ ID NO: 9320989 - DNA, 22 bp, Homo sapiens
agggcttttgagcgcacgtctg

SEQ ID NO: 9320990 - DNA, 22 bp, Homo sapiens
ccctggcaagtgctgtgtagct

SEQ ID NO: 9320991 - DNA, 22 bp, Homo sapiens
agggcctgtgcttcctgagata

SEQ ID NO: 9320992 - DNA, 22 bp, Homo sapiens
cctaaggaccagggcttccagc

SEQ ID NO: 9320993 - DNA, 22 bp, Homo sapiens
cctacaggaaattgtatcaaaa

SEQ ID NO: 9320994 - DNA, 22 bp, Homo sapiens
cctaagtctctgccttacgcca

SEQ ID NO: 9320995 - DNA, 22 bp, Homo sapiens
agggcctggcttcactttctca

SEQ ID NO: 9320996 - DNA, 22 bp, Homo sapiens
agggcctgtcagcggtgtcctg

SEQ ID NO: 9320997 - DNA, 22 bp, Homo sapiens
agggcctgtgaattctccctgc

SEQ ID NO: 9320998 - DNA, 22 bp, Homo sapiens
aggggtctatcctgagatggtc

SEQ ID NO: 9320999 - DNA, 20 bp, Homo sapiens
cctctgtgtcctgtgtcata

SEQ ID NO: 9321000 - DNA, 22 bp, Homo sapiens
agggggctggagacacctcctc

SEQ ID NO: 9321001 - DNA, 22 bp, Homo sapiens
aggggctgactggaaagtgcca

SEQ ID NO: 9321002 - DNA, 22 bp, Homo sapiens
aggggcctggttggcctctgtt

SEQ ID NO: 9321003 - DNA, 22 bp, Homo sapiens
cctcgacctccccaggctcagg

SEQ ID NO: 9321004 - DNA, 22 bp, Homo sapiens
aggggaagattatacttttgaa

SEQ ID NO: 9321005 - DNA, 22 bp, Homo sapiens
aggggaaggccagcctgtagag

SEQ ID NO: 9321006 - DNA, 22 bp, Homo sapiens
aggggaagagccctttacatgg

SEQ ID NO: 9321007 - DNA, 21 bp, Homo sapiens
aggggaagtagagttttgatt

SEQ ID NO: 9321008 - DNA, 22 bp, Homo sapiens
cccaggccagaacttggttgct

SEQ ID NO: 9321009 - DNA, 22 bp, Homo sapiens
cccaggccctggcagagcttgt

SEQ ID NO: 9321010 - DNA, 22 bp, Homo sapiens
cccaggccccagggcttgtcag

SEQ ID NO: 9321011 - DNA, 22 bp, Homo sapiens
cccaggcctggtctgggccagt

SEQ ID NO: 9321012 - DNA, 17 bp, Homo sapiens
cccaggccgccgggagc

SEQ ID NO: 9321013 - DNA, 22 bp, Homo sapiens
agggagctgtggtcagctcagt

SEQ ID NO: 9321014 - DNA, 22 bp, Homo sapiens
aggcttggctggcagccctggg

SEQ ID NO: 9321015 - DNA, 22 bp, Homo sapiens
aggctttggggcattctgtgtt

SEQ ID NO: 9321016 - DNA, 22 bp, Homo sapiens
aggcttttatacattgctgacc

SEQ ID NO: 9321017 - DNA, 22 bp, Homo sapiens
agggaaactagactgcctttct

SEQ ID NO: 9321018 - DNA, 22 bp, Homo sapiens
aggcttttgtggtgtggaatgg

SEQ ID NO: 9321019 - DNA, 22 bp, Homo sapiens
agggaaaggtagtgaggtcaca

SEQ ID NO: 9321020 - DNA, 22 bp, Homo sapiens
cccaggaacagggctcagaccc

SEQ ID NO: 9321021 - DNA, 22 bp, Homo sapiens
cccaggaaatgggctcttgcct

SEQ ID NO: 9321022 - DNA, 22 bp, Homo sapiens
cccaggaaggtggtctgtggct

SEQ ID NO: 9321023 - DNA, 19 bp, Homo sapiens
ccccttaggggttaagcct

SEQ ID NO: 9321024 - DNA, 22 bp, Homo sapiens
cccctggggatcagctggaatt

SEQ ID NO: 9321025 - DNA, 18 bp, Homo sapiens
ccctgaggctagcatgct

SEQ ID NO: 9321026 - DNA, 22 bp, Homo sapiens
ccctgaggctgaggataggtgg

SEQ ID NO: 9321027 - DNA, 22 bp, Homo sapiens
ccctgaggggagtggtgaggtg

SEQ ID NO: 9321028 - DNA, 22 bp, Homo sapiens
ccctgaggggagtggtgaggtg

SEQ ID NO: 9321029 - DNA, 22 bp, Homo sapiens
ccctgaggcctcaggttcattg

SEQ ID NO: 9321030 - DNA, 22 bp, Homo sapiens
ccctgaggcaaaggctagagtt

SEQ ID NO: 9321031 - DNA, 22 bp, Homo sapiens
agggcagaccacgtgcaaggat

SEQ ID NO: 9321032 - DNA, 22 bp, Homo sapiens
agggcagactaggatggaagtg

SEQ ID NO: 9321033 - DNA, 22 bp, Homo sapiens
agggcagaccacgtgcaaggat

SEQ ID NO: 9321034 - DNA, 22 bp, Homo sapiens
agggcagagaaatgtagttgag

SEQ ID NO: 9321035 - DNA, 22 bp, Homo sapiens
cccctgccagctatccctgaac

SEQ ID NO: 9321036 - DNA, 22 bp, Homo sapiens
cccctgctggcctgctggtttc

SEQ ID NO: 9321037 - DNA, 21 bp, Homo sapiens
cccctgggagccctgtcagta

SEQ ID NO: 9321038 - DNA, 22 bp, Homo sapiens
cccaccctgggaagctaggcag

SEQ ID NO: 9321039 - DNA, 22 bp, Homo sapiens
cccaccctgggctacacatcca

SEQ ID NO: 9321040 - DNA, 22 bp, Homo sapiens
cccacctctcagagagccttgc

SEQ ID NO: 9321041 - DNA, 22 bp, Homo sapiens
cccactccctacgacacgctcc

SEQ ID NO: 9321042 - DNA, 22 bp, Homo sapiens
cccactccctgcacgcctgccg

SEQ ID NO: 9321043 - DNA, 22 bp, Homo sapiens
cccacgtcgaacttgctccaga

SEQ ID NO: 9321044 - DNA, 22 bp, Homo sapiens
cccactctggctcccttctagt

SEQ ID NO: 9321045 - DNA, 22 bp, Homo sapiens
aggctgtgacagggtcatggag

SEQ ID NO: 9321046 - DNA, 22 bp, Homo sapiens
cccactctggctcccttctagt

SEQ ID NO: 9321047 - DNA, 22 bp, Homo sapiens
cccactccctgcacgcctgccg

SEQ ID NO: 9321048 - DNA, 22 bp, Homo sapiens
cccactcctggagctagggctc

SEQ ID NO: 9321049 - DNA, 22 bp, Homo sapiens
aggctgtgactacgcagggaag

SEQ ID NO: 9321050 - DNA, 22 bp, Homo sapiens
aggctgtgcattttggagggcc

SEQ ID NO: 9321051 - DNA, 22 bp, Homo sapiens
aggctgtggtgctgaaggaggg

SEQ ID NO: 9321052 - DNA, 22 bp, Homo sapiens
aggctgtggtgctgaaggaggg

SEQ ID NO: 9321053 - DNA, 22 bp, Homo sapiens
cccagaggtgcttcagaggtgc

SEQ ID NO: 9321054 - DNA, 22 bp, Homo sapiens
aggctgtgggagttgagagtct

SEQ ID NO: 9321055 - DNA, 22 bp, Homo sapiens
aggctgtgggaatggctgcttg

SEQ ID NO: 9321056 - DNA, 22 bp, Homo sapiens
aggctgtggccctggtctagca

SEQ ID NO: 9321057 - DNA, 22 bp, Homo sapiens
aggctgtggcatcacatcagga

SEQ ID NO: 9321058 - DNA, 22 bp, Homo sapiens
aggctgtgcgaggtctcagagt

SEQ ID NO: 9321059 - DNA, 22 bp, Homo sapiens
ccagtgtattatttgagaaatt

SEQ ID NO: 9321060 - DNA, 19 bp, Homo sapiens
aggctgcccagtctctgcc

SEQ ID NO: 9321061 - DNA, 21 bp, Homo sapiens
aggctgcatttatatggtgtg

SEQ ID NO: 9321062 - DNA, 22 bp, Homo sapiens
aggctgcagcttgtctcgtggg

SEQ ID NO: 9321063 - DNA, 22 bp, Homo sapiens
aggctgcaggtctgggtcatgt

SEQ ID NO: 9321064 - DNA, 23 bp, Homo sapiens
aggctgcagaagaatagggtcat

SEQ ID NO: 9321065 - DNA, 22 bp, Homo sapiens
cccacacactggctgctgccaa

SEQ ID NO: 9321066 - DNA, 16 bp, Homo sapiens
ccaggtggggctgtga

SEQ ID NO: 9321067 - DNA, 22 bp, Homo sapiens
ccaggtgcctccagtcacagtg

SEQ ID NO: 9321068 - DNA, 22 bp, Homo sapiens
ccagggcagcagaattggggca

SEQ ID NO: 9321069 - DNA, 22 bp, Homo sapiens
ccagggcagcagaattggggca

SEQ ID NO: 9321070 - DNA, 22 bp, Homo sapiens
ccaggtggtgaaagtgggccct

SEQ ID NO: 9321071 - DNA, 23 bp, Homo sapiens
ccagtaaacccttcctcagtgtc

SEQ ID NO: 9321072 - DNA, 22 bp, Homo sapiens
ccagtaaattacttgatgtcat

SEQ ID NO: 9321073 - DNA, 22 bp, Homo sapiens
ccagtaaaccaagtgtttacta

SEQ ID NO: 9321074 - DNA, 22 bp, Homo sapiens
ccagtaaaaagcgacaggaagt

SEQ ID NO: 9321075 - DNA, 22 bp, Homo sapiens
aggctcagcatctgattcatat

SEQ ID NO: 9321076 - DNA, 21 bp, Homo sapiens
aggctcagcaggtgtataaag

SEQ ID NO: 9321077 - DNA, 22 bp, Homo sapiens
aggctcagcccaaggtggagag

SEQ ID NO: 9321078 - DNA, 22 bp, Homo sapiens
aggctcagcccctgggaggaga

SEQ ID NO: 9321079 - DNA, 22 bp, Homo sapiens
ccaggcctttcttcttggtctg

SEQ ID NO: 9321080 - DNA, 22 bp, Homo sapiens
aggctcagatccttgtgtcctg

SEQ ID NO: 9321081 - DNA, 22 bp, Homo sapiens
aggctcagattcacatttggtt

SEQ ID NO: 9321082 - DNA, 22 bp, Homo sapiens
ccaggccttccagtacgcagaa

SEQ ID NO: 9321083 - DNA, 22 bp, Homo sapiens
ccaggccttccagtacgcagaa

SEQ ID NO: 9321084 - DNA, 22 bp, Homo sapiens
ccaggccttctgaggacactct

SEQ ID NO: 9321085 - DNA, 22 bp, Homo sapiens
ccaggcctgtgttgtgtggagg

SEQ ID NO: 9321086 - DNA, 22 bp, Homo sapiens
ccaggcctgtgcaaggagggag

SEQ ID NO: 9321087 - DNA, 20 bp, Homo sapiens
ccaggcctgggcctgctcta

SEQ ID NO: 9321088 - DNA, 22 bp, Homo sapiens
ccaggcctcacctgcccaccta

SEQ ID NO: 9321089 - DNA, 20 bp, Homo sapiens
ccaggcctgggcctgctcta

SEQ ID NO: 9321090 - DNA, 22 bp, Homo sapiens
aggcaggtgagtcaaaacagac

SEQ ID NO: 9321091 - DNA, 19 bp, Homo sapiens
aggcaggtgcagaggtccc

SEQ ID NO: 9321092 - DNA, 19 bp, Homo sapiens
aggcaggtgcagaggtccc

SEQ ID NO: 9321093 - DNA, 22 bp, Homo sapiens
ccagaggatgctggtcagcctc

SEQ ID NO: 9321094 - DNA, 22 bp, Homo sapiens
ccagaggcatgttcaaagcaat

SEQ ID NO: 9321095 - DNA, 22 bp, Homo sapiens
aggcaggtagaaggatctttat

SEQ ID NO: 9321096 - DNA, 22 bp, Homo sapiens
aggcaggtagaaggatctttat

SEQ ID NO: 9321097 - DNA, 22 bp, Homo sapiens
aggcaggtctgtatctagtctc

SEQ ID NO: 9321098 - DNA, 22 bp, Homo sapiens
aggcaggtctgtatctagtctc

SEQ ID NO: 9321099 - DNA, 22 bp, Homo sapiens
aggcaggtcccctggaaggcac

SEQ ID NO: 9321100 - DNA, 22 bp, Homo sapiens
aggcaggtcacatgcttggcga

SEQ ID NO: 9321101 - DNA, 22 bp, Homo sapiens
ccagaggttccaggctagggag

SEQ ID NO: 9321102 - DNA, 21 bp, Homo sapiens
ccagaggttctgggcctccct

SEQ ID NO: 9321103 - DNA, 19 bp, Homo sapiens
ccagaggtttgctgggcct

SEQ ID NO: 9321104 - DNA, 19 bp, Homo sapiens
ccagaggtttgctgggcct

SEQ ID NO: 9321105 - DNA, 22 bp, Homo sapiens
ccagaggtggtggtgtctagaa

SEQ ID NO: 9321106 - DNA, 22 bp, Homo sapiens
ccagaggttacaccctcagccc

SEQ ID NO: 9321107 - DNA, 22 bp, Homo sapiens
ccagaggtggtggtgtctagaa

SEQ ID NO: 9321108 - DNA, 22 bp, Homo sapiens
ccagaggttactttgccttgga

SEQ ID NO: 9321109 - DNA, 22 bp, Homo sapiens
ccagaggttactttgccttgga

SEQ ID NO: 9321110 - DNA, 22 bp, Homo sapiens
ccagaggtggtgggtgctacag

SEQ ID NO: 9321111 - DNA, 22 bp, Homo sapiens
ccagaggtggtcatagaaagca

SEQ ID NO: 9321112 - DNA, 22 bp, Homo sapiens
ccagaggtgggagtgatctggt

SEQ ID NO: 9321113 - DNA, 22 bp, Homo sapiens
ccagaggtggaagattgttttg

SEQ ID NO: 9321114 - DNA, 22 bp, Homo sapiens
ccagaggtgggagtgatctggt

SEQ ID NO: 9321115 - DNA, 20 bp, Homo sapiens
ccagaggctgacagactttg

SEQ ID NO: 9321116 - DNA, 22 bp, Homo sapiens
ccagaggtggaagattgttttg

SEQ ID NO: 9321117 - DNA, 22 bp, Homo sapiens
ccagaggctggcaagggctcct

SEQ ID NO: 9321118 - DNA, 22 bp, Homo sapiens
ccagaggctggcaagggctcct

SEQ ID NO: 9321119 - DNA, 22 bp, Homo sapiens
ccagaggcggaggtttgcagtg

SEQ ID NO: 9321120 - DNA, 21 bp, Homo sapiens
ccagaggcctctcttggccac

SEQ ID NO: 9321121 - DNA, 18 bp, Homo sapiens
ccagaggcccgggcaggc

SEQ ID NO: 9321122 - DNA, 22 bp, Homo sapiens
aggccctgcccagagctcctcg

SEQ ID NO: 9321123 - DNA, 22 bp, Homo sapiens
aggccctgacctgggagatcta

SEQ ID NO: 9321124 - DNA, 22 bp, Homo sapiens
ccagccctgaaccctgctgcat

SEQ ID NO: 9321125 - DNA, 23 bp, Homo sapiens
ccagccctccaccagctctaggc

SEQ ID NO: 9321126 - DNA, 17 bp, Homo sapiens
ccagccctcgcgctttt

SEQ ID NO: 9321127 - DNA, 22 bp, Homo sapiens
ccagccagatgataagctctat

SEQ ID NO: 9321128 - DNA, 22 bp, Homo sapiens
ccagccactgggccactgccag

SEQ ID NO: 9321129 - DNA, 22 bp, Homo sapiens
ccagcagggaaaaacccaccaa

SEQ ID NO: 9321130 - DNA, 22 bp, Homo sapiens
aggccctgctttccagagctca

SEQ ID NO: 9321131 - DNA, 22 bp, Homo sapiens
ccagctccaggtagatgggcag

SEQ ID NO: 9321132 - DNA, 22 bp, Homo sapiens
ccagctccattgcttagtgtaa

SEQ ID NO: 9321133 - DNA, 22 bp, Homo sapiens
ccagctcccctcagcaggtaat

SEQ ID NO: 9321134 - DNA, 22 bp, Homo sapiens
ccagctcccattcttcacctgt

SEQ ID NO: 9321135 - DNA, 23 bp, Homo sapiens
ccagctcccaggtctgaggactg

SEQ ID NO: 9321136 - DNA, 22 bp, Homo sapiens
ccagctccgggagttgctgctg

SEQ ID NO: 9321137 - DNA, 22 bp, Homo sapiens
ccagctccctgaagcctggtct

SEQ ID NO: 9321138 - DNA, 22 bp, Homo sapiens
ccagctcccgcaggctgcacag

SEQ ID NO: 9321139 - DNA, 22 bp, Homo sapiens
ccaggaggggtctctgtctccc

SEQ ID NO: 9321140 - DNA, 22 bp, Homo sapiens
aggcctgggacgggagccgtga

SEQ ID NO: 9321141 - DNA, 16 bp, Homo sapiens
aggctcagaggctgga

SEQ ID NO: 9321142 - DNA, 20 bp, Homo sapiens
aggctcagagcagtagtaca

SEQ ID NO: 9321143 - DNA, 20 bp, Homo sapiens
aggctcagatacccagggaa

SEQ ID NO: 9321144 - DNA, 22 bp, Homo sapiens
aggctcagaggtgagcatctgc

SEQ ID NO: 9321145 - DNA, 20 bp, Homo sapiens
ccaggcactgtcccatgcag

SEQ ID NO: 9321146 - DNA, 22 bp, Homo sapiens
ccaggcactcagagactgggac

SEQ ID NO: 9321147 - DNA, 22 bp, Homo sapiens
ccaggcactcagagactgggac

SEQ ID NO: 9321148 - DNA, 22 bp, Homo sapiens
ccaggcacggtggctcatgcct

SEQ ID NO: 9321149 - DNA, 21 bp, Homo sapiens
aggctcagagatcaaacagta

SEQ ID NO: 9321150 - DNA, 22 bp, Homo sapiens
aggctcagagagctgtgtccat

SEQ ID NO: 9321151 - DNA, 22 bp, Homo sapiens
aggctcagagatgagtaagcac

SEQ ID NO: 9321152 - DNA, 21 bp, Homo sapiens
aggctcagagagaaactcttg

SEQ ID NO: 9321153 - DNA, 22 bp, Homo sapiens
aggctcagacaggaaaagtaac

SEQ ID NO: 9321154 - DNA, 22 bp, Homo sapiens
aggcctgggtgttcaccagaag

SEQ ID NO: 9321155 - DNA, 22 bp, Homo sapiens
aggcctgggtctcgtgcctacc

SEQ ID NO: 9321156 - DNA, 22 bp, Homo sapiens
aggcctggtgaatgaagtatct

SEQ ID NO: 9321157 - DNA, 19 bp, Homo sapiens
aggcctggggttttgcact

SEQ ID NO: 9321158 - DNA, 22 bp, Homo sapiens
aggcctgggcaagaaggggcgt

SEQ ID NO: 9321159 - DNA, 22 bp, Homo sapiens
caggatggccccggggctgtgc

SEQ ID NO: 9321160 - DNA, 22 bp, Homo sapiens
caggatggagagttgttggttg

SEQ ID NO: 9321161 - DNA, 22 bp, Homo sapiens
caggatggagggagggctgtta

SEQ ID NO: 9321162 - DNA, 22 bp, Homo sapiens
caggatggagagtgaggggtca

SEQ ID NO: 9321163 - DNA, 22 bp, Homo sapiens
caggagcaaggagcagtgggat

SEQ ID NO: 9321164 - DNA, 22 bp, Homo sapiens
caggagcagagggtggtcagca

SEQ ID NO: 9321165 - DNA, 18 bp, Homo sapiens
caggagcaggagttgaac

SEQ ID NO: 9321166 - DNA, 22 bp, Homo sapiens
caggagccagaggcggatggag

SEQ ID NO: 9321167 - DNA, 18 bp, Homo sapiens
caggagcaggagttgaac

SEQ ID NO: 9321168 - DNA, 22 bp, Homo sapiens
caggagcatgctgatgccagaa

SEQ ID NO: 9321169 - DNA, 22 bp, Homo sapiens
caggagcatgctgatgccagaa

SEQ ID NO: 9321170 - DNA, 22 bp, Homo sapiens
caggcacacagcacatggcctg

SEQ ID NO: 9321171 - DNA, 22 bp, Homo sapiens
caggcacacaggctccctgggc

SEQ ID NO: 9321172 - DNA, 22 bp, Homo sapiens
caggcacacaggctccctgggc

SEQ ID NO: 9321173 - DNA, 22 bp, Homo sapiens
caggcagagtgaggtggtctaa

SEQ ID NO: 9321174 - DNA, 22 bp, Homo sapiens
caggcagagtgaggtggtctaa

SEQ ID NO: 9321175 - DNA, 22 bp, Homo sapiens
caggcacacccactggtgcaga

SEQ ID NO: 9321176 - DNA, 22 bp, Homo sapiens
caggatgggatgtagtgggccc

SEQ ID NO: 9321177 - DNA, 22 bp, Homo sapiens
caggatgggtgtcggccagcac

SEQ ID NO: 9321178 - DNA, 22 bp, Homo sapiens
caggcacaatgagcgccatctt

SEQ ID NO: 9321179 - DNA, 22 bp, Homo sapiens
caggcacacagcacatggcctg

SEQ ID NO: 9321180 - DNA, 22 bp, Homo sapiens
cagctgggtttagtggggtgtg

SEQ ID NO: 9321181 - DNA, 22 bp, Homo sapiens
cagctgggtttagtggggtgtg

SEQ ID NO: 9321182 - DNA, 22 bp, Homo sapiens
caggactagatgttgggcagtt

SEQ ID NO: 9321183 - DNA, 20 bp, Homo sapiens
caggacagcgcaatcggagg

SEQ ID NO: 9321184 - DNA, 22 bp, Homo sapiens
caggcaggtgcagattcctctt

SEQ ID NO: 9321185 - DNA, 22 bp, Homo sapiens
caggcaggtcagtgaagaagga

SEQ ID NO: 9321186 - DNA, 22 bp, Homo sapiens
caggcagctcaaccttgggagc

SEQ ID NO: 9321187 - DNA, 22 bp, Homo sapiens
caggcagggagctggaaaggat

SEQ ID NO: 9321188 - DNA, 22 bp, Homo sapiens
caggcagggagctggaaaggat

SEQ ID NO: 9321189 - DNA, 22 bp, Homo sapiens
caggcagggagctggaaaggat

SEQ ID NO: 9321190 - DNA, 22 bp, Homo sapiens
caggcagcctgcggtctgcaca

SEQ ID NO: 9321191 - DNA, 22 bp, Homo sapiens
caggcagccttctcgtctcaca

SEQ ID NO: 9321192 - DNA, 22 bp, Homo sapiens
caggcagcgtcctgcttcctgt

SEQ ID NO: 9321193 - DNA, 22 bp, Homo sapiens
agcttcccaggagaatcaggga

SEQ ID NO: 9321194 - DNA, 21 bp, Homo sapiens
caggctctgctgggtgctggg

SEQ ID NO: 9321195 - DNA, 21 bp, Homo sapiens
caggctctgctgggtgctggg

SEQ ID NO: 9321196 - DNA, 21 bp, Homo sapiens
caggctctgctgggtgctggg

SEQ ID NO: 9321197 - DNA, 21 bp, Homo sapiens
caggctctgctagaggagcct

SEQ ID NO: 9321198 - DNA, 21 bp, Homo sapiens
caggctctgctagaggagcct

SEQ ID NO: 9321199 - DNA, 22 bp, Homo sapiens
caggcccataatgcaaatattt

SEQ ID NO: 9321200 - DNA, 22 bp, Homo sapiens
caggcccatttgtagccacttt

SEQ ID NO: 9321201 - DNA, 22 bp, Homo sapiens
caggcccatctgctcccaggct

SEQ ID NO: 9321202 - DNA, 18 bp, Homo sapiens
cagggctgtggggtcact

SEQ ID NO: 9321203 - DNA, 18 bp, Homo sapiens
cagggctgtggggtcact

SEQ ID NO: 9321204 - DNA, 22 bp, Homo sapiens
aggaagagctggaccagaggac

SEQ ID NO: 9321205 - DNA, 22 bp, Homo sapiens
aggaaaggcctcagcagaaacc

SEQ ID NO: 9321206 - DNA, 23 bp, Homo sapiens
cagggctgggcttggtgttaggc

SEQ ID NO: 9321207 - DNA, 22 bp, Homo sapiens
cagggctggctgtggcaatctc

SEQ ID NO: 9321208 - DNA, 22 bp, Homo sapiens
cagggctggcttccaagttgtt

SEQ ID NO: 9321209 - DNA, 22 bp, Homo sapiens
agctttgggattcaggcaggaa

SEQ ID NO: 9321210 - DNA, 22 bp, Homo sapiens
cagggctggatttcatttctag

SEQ ID NO: 9321211 - DNA, 22 bp, Homo sapiens
cagggctggctcatgaaaagtt

SEQ ID NO: 9321212 - DNA, 22 bp, Homo sapiens
cagggattcagctgaaggaggc

SEQ ID NO: 9321213 - DNA, 22 bp, Homo sapiens
caggctcttttggtggcaagga

SEQ ID NO: 9321214 - DNA, 22 bp, Homo sapiens
cagggcagtaacgggaacatct

SEQ ID NO: 9321215 - DNA, 22 bp, Homo sapiens
cagggcagggccacaccccctg

SEQ ID NO: 9321216 - DNA, 22 bp, Homo sapiens
cagggcagggatgttgcggcag

SEQ ID NO: 9321217 - DNA, 22 bp, Homo sapiens
aggaagtgctaagagaacatca

SEQ ID NO: 9321218 - DNA, 22 bp, Homo sapiens
cagggcttgaatcaaggaagtc

SEQ ID NO: 9321219 - DNA, 22 bp, Homo sapiens
cagggcttgaatcaaggaagtc

SEQ ID NO: 9321220 - DNA, 22 bp, Homo sapiens
cagggcttcgatggatggatgg

SEQ ID NO: 9321221 - DNA, 22 bp, Homo sapiens
cagggcttcgctcctggtgcac

SEQ ID NO: 9321222 - DNA, 22 bp, Homo sapiens
cagggcttctataccaattcat

SEQ ID NO: 9321223 - DNA, 22 bp, Homo sapiens
cagggcttcttggcatttgctg

SEQ ID NO: 9321224 - DNA, 22 bp, Homo sapiens
cagggcttcactaggaaccctc

SEQ ID NO: 9321225 - DNA, 22 bp, Homo sapiens
cagggctgttagctgctgctct

SEQ ID NO: 9321226 - DNA, 22 bp, Homo sapiens
cagggctgttagctgctgctct

SEQ ID NO: 9321227 - DNA, 18 bp, Homo sapiens
aggacacattcttccctc

SEQ ID NO: 9321228 - DNA, 22 bp, Homo sapiens
aggacactgctgaggatcagat

SEQ ID NO: 9321229 - DNA, 22 bp, Homo sapiens
aggacagacctaggactggagc

SEQ ID NO: 9321230 - DNA, 22 bp, Homo sapiens
aggacagagcctgtgcagaccg

SEQ ID NO: 9321231 - DNA, 22 bp, Homo sapiens
aggaatattactttgcttttat

SEQ ID NO: 9321232 - DNA, 22 bp, Homo sapiens
aggaataacctcattgcttttt

SEQ ID NO: 9321233 - DNA, 22 bp, Homo sapiens
aggaatagctgttaaagtcaat

SEQ ID NO: 9321234 - DNA, 20 bp, Homo sapiens
cagtatctgaagccacacaa

SEQ ID NO: 9321235 - DNA, 22 bp, Homo sapiens
cagtatttggtaattggctacc

SEQ ID NO: 9321236 - DNA, 22 bp, Homo sapiens
cagtatttggaatatagctaag

SEQ ID NO: 9321237 - DNA, 22 bp, Homo sapiens
aggacagagggaccagagccca

SEQ ID NO: 9321238 - DNA, 22 bp, Homo sapiens
aggacagagggaccagagccca

SEQ ID NO: 9321239 - DNA, 22 bp, Homo sapiens
cagtaaagcatgtatgtcttca

SEQ ID NO: 9321240 - DNA, 22 bp, Homo sapiens
cagtaaagagccttcattaaat

SEQ ID NO: 9321241 - DNA, 22 bp, Homo sapiens
aggcaggaggatcatggatgca

SEQ ID NO: 9321242 - DNA, 22 bp, Homo sapiens
aggcaggagtgaccctgacagg

SEQ ID NO: 9321243 - DNA, 18 bp, Homo sapiens
aggcaggatcctggcctc

SEQ ID NO: 9321244 - DNA, 23 bp, Homo sapiens
ccacaggcacagaggcttgcatc

SEQ ID NO: 9321245 - DNA, 22 bp, Homo sapiens
aggcaggagcaagccctacaag

SEQ ID NO: 9321246 - DNA, 17 bp, Homo sapiens
aggcaggagattggaga

SEQ ID NO: 9321247 - DNA, 22 bp, Homo sapiens
aggcaggaaccctgtgtgcgcc

SEQ ID NO: 9321248 - DNA, 19 bp, Homo sapiens
ccacagagcatgctgaggc

SEQ ID NO: 9321249 - DNA, 22 bp, Homo sapiens
aggcaggaaaatcgcttgaacc

SEQ ID NO: 9321250 - DNA, 22 bp, Homo sapiens
aggcaggaaaatcgcttgaacc

SEQ ID NO: 9321251 - DNA, 22 bp, Homo sapiens
ccacagaccttggcttccacct

SEQ ID NO: 9321252 - DNA, 22 bp, Homo sapiens
ccacagagactctgcaggactg

SEQ ID NO: 9321253 - DNA, 22 bp, Homo sapiens
ccaatgatggtgcccacgatga

SEQ ID NO: 9321254 - DNA, 22 bp, Homo sapiens
catttctgttctcttcctgtac

SEQ ID NO: 9321255 - DNA, 22 bp, Homo sapiens
ccacctggggcctctgagtctc

SEQ ID NO: 9321256 - DNA, 22 bp, Homo sapiens
ccactagtttaataccttcctt

SEQ ID NO: 9321257 - DNA, 23 bp, Homo sapiens
ccactagcacctgttcaacttct

SEQ ID NO: 9321258 - DNA, 22 bp, Homo sapiens
aggcaagcagtcagtctatgag

SEQ ID NO: 9321259 - DNA, 22 bp, Homo sapiens
aggcaaggaagaattctcccct

SEQ ID NO: 9321260 - DNA, 23 bp, Homo sapiens
aggcaagggtgtaaaggaaatga

SEQ ID NO: 9321261 - DNA, 22 bp, Homo sapiens
cattgctttgtgcatatttaaa

SEQ ID NO: 9321262 - DNA, 22 bp, Homo sapiens
cattgcttgatagctgaaaatt

SEQ ID NO: 9321263 - DNA, 22 bp, Homo sapiens
cattgcttatctagttcacata

SEQ ID NO: 9321264 - DNA, 22 bp, Homo sapiens
cattgcttatttcagctaaagt

SEQ ID NO: 9321265 - DNA, 22 bp, Homo sapiens
cattgcttcctatgtcccttct

SEQ ID NO: 9321266 - DNA, 22 bp, Homo sapiens
aggcaaggtgctacagacagtg

SEQ ID NO: 9321267 - DNA, 22 bp, Homo sapiens
aggcaagtgcattagaagagca

SEQ ID NO: 9321268 - DNA, 22 bp, Homo sapiens
catttattggcatgtagtaggt

SEQ ID NO: 9321269 - DNA, 22 bp, Homo sapiens
catttcacagtaaagtgatttc

SEQ ID NO: 9321270 - DNA, 22 bp, Homo sapiens
catttattggttaggccagcag

SEQ ID NO: 9321271 - DNA, 22 bp, Homo sapiens
catttattggttaggccagcag

SEQ ID NO: 9321272 - DNA, 22 bp, Homo sapiens
catttattggcatgtagtaggt

SEQ ID NO: 9321273 - DNA, 22 bp, Homo sapiens
catttattggcatgtagtaggt

SEQ ID NO: 9321274 - DNA, 22 bp, Homo sapiens
catttattggttaggccagcag

SEQ ID NO: 9321275 - DNA, 22 bp, Homo sapiens
cagtgtgtcctcagaatatata

SEQ ID NO: 9321276 - DNA, 22 bp, Homo sapiens
cagtgtgtcctcagaatatata

SEQ ID NO: 9321277 - DNA, 22 bp, Homo sapiens
cagtgtgtagaaggccgattta

SEQ ID NO: 9321278 - DNA, 22 bp, Homo sapiens
cagtgtgtgactctgggggtac

SEQ ID NO: 9321279 - DNA, 22 bp, Homo sapiens
cagtgtgtctcttgtcctggct

SEQ ID NO: 9321280 - DNA, 22 bp, Homo sapiens
cagtgtgtggattgcccttgca

SEQ ID NO: 9321281 - DNA, 22 bp, Homo sapiens
cagtgtgtttcatgtaggtcct

SEQ ID NO: 9321282 - DNA, 22 bp, Homo sapiens
cagtgttactgggcctgggtgt

SEQ ID NO: 9321283 - DNA, 22 bp, Homo sapiens
cagtgtgtggatcctcccagga

SEQ ID NO: 9321284 - DNA, 21 bp, Homo sapiens
cagtgttgatatttaatacat

SEQ ID NO: 9321285 - DNA, 22 bp, Homo sapiens
cagtgtttagatcaagaaggcc

SEQ ID NO: 9321286 - DNA, 22 bp, Homo sapiens
cagtgtttaatcattgtgaatt

SEQ ID NO: 9321287 - DNA, 23 bp, Homo sapiens
aggagccagccctgttctcagta

SEQ ID NO: 9321288 - DNA, 22 bp, Homo sapiens
aggagccagaatccagactcgg

SEQ ID NO: 9321289 - DNA, 22 bp, Homo sapiens
aggagccagcgttcctcaggat

SEQ ID NO: 9321290 - DNA, 22 bp, Homo sapiens
aggagccagcgttcctcaggat

SEQ ID NO: 9321291 - DNA, 21 bp, Homo sapiens
aggagccagcctgtcagtcta

SEQ ID NO: 9321292 - DNA, 23 bp, Homo sapiens
aggagccaggtgcagcccttgtg

SEQ ID NO: 9321293 - DNA, 22 bp, Homo sapiens
aggagccaggaaacctgctctg

SEQ ID NO: 9321294 - DNA, 22 bp, Homo sapiens
cagtccagagcccaccagagga

SEQ ID NO: 9321295 - DNA, 22 bp, Homo sapiens
cagtccagctcatcagtggcac

SEQ ID NO: 9321296 - DNA, 22 bp, Homo sapiens
cataacatgtacatataaatgc

SEQ ID NO: 9321297 - DNA, 22 bp, Homo sapiens
cataactgttaagataattttt

SEQ ID NO: 9321298 - DNA, 22 bp, Homo sapiens
aggaggcctctatccagagaga

SEQ ID NO: 9321299 - DNA, 22 bp, Homo sapiens
aggaggcagatgcttggctgta

SEQ ID NO: 9321300 - DNA, 17 bp, Homo sapiens
aggagctgggggtggtg

SEQ ID NO: 9321301 - DNA, 16 bp, Homo sapiens
aggagctgggtaggag

SEQ ID NO: 9321302 - DNA, 22 bp, Homo sapiens
aggagctgggttcctttggtgg

SEQ ID NO: 9321303 - DNA, 22 bp, Homo sapiens
aggagctgggttcctttggtgg

SEQ ID NO: 9321304 - DNA, 22 bp, Homo sapiens
aggagctgtcatttgattcaca

SEQ ID NO: 9321305 - DNA, 22 bp, Homo sapiens
aggagctgtcatttgattcaca

SEQ ID NO: 9321306 - DNA, 22 bp, Homo sapiens
aggagctgtcagagtgccagag

SEQ ID NO: 9321307 - DNA, 22 bp, Homo sapiens
aggagctgtcagagtgccagag

SEQ ID NO: 9321308 - DNA, 22 bp, Homo sapiens
aggagctggtagtctcattggg

SEQ ID NO: 9321309 - DNA, 22 bp, Homo sapiens
aggaggcctgcagctgccattc

SEQ ID NO: 9321310 - DNA, 22 bp, Homo sapiens
aggaggctgaactagggtctgg

SEQ ID NO: 9321311 - DNA, 22 bp, Homo sapiens
aggaggctgaactagggtctgg

SEQ ID NO: 9321312 - DNA, 22 bp, Homo sapiens
catctcttcattagcattattg

SEQ ID NO: 9321313 - DNA, 22 bp, Homo sapiens
catctctccacggcagctctcg

SEQ ID NO: 9321314 - DNA, 22 bp, Homo sapiens
catctcagtgtacagggagtct

SEQ ID NO: 9321315 - DNA, 22 bp, Homo sapiens
catctcatagtgcagtgctgta

SEQ ID NO: 9321316 - DNA, 20 bp, Homo sapiens
catctcctgcctccatgttc

SEQ ID NO: 9321317 - DNA, 22 bp, Homo sapiens
catctccaggagttctactcat

SEQ ID NO: 9321318 - DNA, 22 bp, Homo sapiens
catgaggatccaggtgacaggc

SEQ ID NO: 9321319 - DNA, 22 bp, Homo sapiens
catgaggtcagggggagccggt

SEQ ID NO: 9321320 - DNA, 22 bp, Homo sapiens
catgagatttgggaggggccag

SEQ ID NO: 9321321 - DNA, 23 bp, Homo sapiens
aggatgtaggatgtatggcagag

SEQ ID NO: 9321322 - DNA, 22 bp, Homo sapiens
aggatggggtctgcagcctggt

SEQ ID NO: 9321323 - DNA, 22 bp, Homo sapiens
aggatggggtctgcagcctggt

SEQ ID NO: 9321324 - DNA, 23 bp, Homo sapiens
aggatgtaggatgtatggcagag

SEQ ID NO: 9321325 - DNA, 23 bp, Homo sapiens
aggatgtaggatgtatggcagag

SEQ ID NO: 9321326 - DNA, 22 bp, Homo sapiens
aggatggcttgcaggaggctgt

SEQ ID NO: 9321327 - DNA, 22 bp, Homo sapiens
aggatggcttgcaggaggctgt

SEQ ID NO: 9321328 - DNA, 22 bp, Homo sapiens
catcttgtgaggaccttcttgc

SEQ ID NO: 9321329 - DNA, 22 bp, Homo sapiens
tgccctgggagttggagctgct

SEQ ID NO: 9321330 - DNA, 22 bp, Homo sapiens
cccaggctcccaggtgggacaa

SEQ ID NO: 9321331 - DNA, 22 bp, Homo sapiens
cccaggctcccaggtgggacaa

SEQ ID NO: 9321332 - DNA, 22 bp, Homo sapiens
cccaggctcactgtccgcttcc

SEQ ID NO: 9321333 - DNA, 22 bp, Homo sapiens
cccaggctcactgtccgcttcc

SEQ ID NO: 9321334 - DNA, 22 bp, Homo sapiens
cccaggctcagactggcttgtt

SEQ ID NO: 9321335 - DNA, 22 bp, Homo sapiens
cccaggctagaaaggccaacaa

SEQ ID NO: 9321336 - DNA, 22 bp, Homo sapiens
cccaggctagtatgatatcagt

SEQ ID NO: 9321337 - DNA, 23 bp, Homo sapiens
cccaggctacaaattatgctctg

SEQ ID NO: 9321338 - DNA, 23 bp, Homo sapiens
cccaggctacaaattatgctctg

SEQ ID NO: 9321339 - DNA, 22 bp, Homo sapiens
tgcccagctattcctttcttag

SEQ ID NO: 9321340 - DNA, 22 bp, Homo sapiens
cccaggcagtgtgtgcatgcgt

SEQ ID NO: 9321341 - DNA, 22 bp, Homo sapiens
tgcccagcgcccacattctgtc

SEQ ID NO: 9321342 - DNA, 22 bp, Homo sapiens
tgcccagcccctatccctggga

SEQ ID NO: 9321343 - DNA, 22 bp, Homo sapiens
tgccagcttttgactatcttag

SEQ ID NO: 9321344 - DNA, 22 bp, Homo sapiens
tgccagcttctaaggacccagg

SEQ ID NO: 9321345 - DNA, 22 bp, Homo sapiens
tgccagctgttcccacccaaaa

SEQ ID NO: 9321346 - DNA, 21 bp, Homo sapiens
tgccagctgctgcatctgtct

SEQ ID NO: 9321347 - DNA, 22 bp, Homo sapiens
tgccagctgacagcagagacaa

SEQ ID NO: 9321348 - DNA, 22 bp, Homo sapiens
cccaggctggggctcctccagc

SEQ ID NO: 9321349 - DNA, 22 bp, Homo sapiens
cccaggctggcctccgcagtgc

SEQ ID NO: 9321350 - DNA, 22 bp, Homo sapiens
cccaggctggcctccgcagtgc

SEQ ID NO: 9321351 - DNA, 22 bp, Homo sapiens
cccaggctggatttcggtggca

SEQ ID NO: 9321352 - DNA, 22 bp, Homo sapiens
tgccctggtagacacagactgt

SEQ ID NO: 9321353 - DNA, 22 bp, Homo sapiens
cccaggctgagttagaggtgtc

SEQ ID NO: 9321354 - DNA, 22 bp, Homo sapiens
cccaggctggaattccaggcct

SEQ ID NO: 9321355 - DNA, 22 bp, Homo sapiens
cccaggctggaattccaggcct

SEQ ID NO: 9321356 - DNA, 22 bp, Homo sapiens
cccaggctggagtgcaatggca

SEQ ID NO: 9321357 - DNA, 22 bp, Homo sapiens
cccaggctggagtgcagtggcg

SEQ ID NO: 9321358 - DNA, 22 bp, Homo sapiens
cccaggctggagtgcaatggtg

SEQ ID NO: 9321359 - DNA, 22 bp, Homo sapiens
cccaggggttctgagcagcagc

SEQ ID NO: 9321360 - DNA, 22 bp, Homo sapiens
tgccttcctggagctgaaggct

SEQ ID NO: 9321361 - DNA, 22 bp, Homo sapiens
tgccttcctggagctgaaggct

SEQ ID NO: 9321362 - DNA, 22 bp, Homo sapiens
tgccttcatccatgttatagtg

SEQ ID NO: 9321363 - DNA, 22 bp, Homo sapiens
ccctgaggaaagggtggagggc

SEQ ID NO: 9321364 - DNA, 22 bp, Homo sapiens
ccctgaggaaagggtggagggc

SEQ ID NO: 9321365 - DNA, 22 bp, Homo sapiens
ccctgagcccatagttgacatt

SEQ ID NO: 9321366 - DNA, 22 bp, Homo sapiens
ccctgagcgtgaggaggaagta

SEQ ID NO: 9321367 - DNA, 18 bp, Homo sapiens
ccctgagatgatgctgtg

SEQ ID NO: 9321368 - DNA, 20 bp, Homo sapiens
ccctgagaccagagagcagc

SEQ ID NO: 9321369 - DNA, 18 bp, Homo sapiens
ccctgaagggcaagataa

SEQ ID NO: 9321370 - DNA, 19 bp, Homo sapiens
ccctcttgcacaaagcaaa

SEQ ID NO: 9321371 - DNA, 19 bp, Homo sapiens
ccctcttgcacaaagcaaa

SEQ ID NO: 9321372 - DNA, 22 bp, Homo sapiens
ccctctacagggaagcgctttc

SEQ ID NO: 9321373 - DNA, 22 bp, Homo sapiens
ccctctacagggaagcgctttc

SEQ ID NO: 9321374 - DNA, 18 bp, Homo sapiens
ccctctcctgctagtggg

SEQ ID NO: 9321375 - DNA, 18 bp, Homo sapiens
ccctctcctgctagtggg

SEQ ID NO: 9321376 - DNA, 22 bp, Homo sapiens
ccctctcctggctgcatggagc

SEQ ID NO: 9321377 - DNA, 22 bp, Homo sapiens
tggaagggagctggaatttgga

SEQ ID NO: 9321378 - DNA, 22 bp, Homo sapiens
ccctcgctctaggcagccctgt

SEQ ID NO: 9321379 - DNA, 22 bp, Homo sapiens
ccctctacagggaagcgctttc

SEQ ID NO: 9321380 - DNA, 22 bp, Homo sapiens
ccctccttaccaccacagctcc

SEQ ID NO: 9321381 - DNA, 22 bp, Homo sapiens
cccgctccttacctgtccaacc

SEQ ID NO: 9321382 - DNA, 22 bp, Homo sapiens
ccccttctctgcaagcctgctc

SEQ ID NO: 9321383 - DNA, 22 bp, Homo sapiens
ccccttctgtgtcctgtcagcc

SEQ ID NO: 9321384 - DNA, 22 bp, Homo sapiens
tgctggctttttggtccttgct

SEQ ID NO: 9321385 - DNA, 22 bp, Homo sapiens
tgctggctttctgtccctggca

SEQ ID NO: 9321386 - DNA, 22 bp, Homo sapiens
tgctggctacattattgctgtc

SEQ ID NO: 9321387 - DNA, 22 bp, Homo sapiens
tgctggcctgtccacgggctgt

SEQ ID NO: 9321388 - DNA, 22 bp, Homo sapiens
tgctggcctcggcgctgggcct

SEQ ID NO: 9321389 - DNA, 22 bp, Homo sapiens
tgctggagcccaggcggccttt

SEQ ID NO: 9321390 - DNA, 22 bp, Homo sapiens
ccccaccctcgctccatttcgg

SEQ ID NO: 9321391 - DNA, 21 bp, Homo sapiens
tgctggccatgtgctgggcat

SEQ ID NO: 9321392 - DNA, 22 bp, Homo sapiens
ccccaccagcaccctctctatc

SEQ ID NO: 9321393 - DNA, 22 bp, Homo sapiens
cccattcatcctcgcttccttc

SEQ ID NO: 9321394 - DNA, 22 bp, Homo sapiens
ccccaaaacttagtgacttaaa

SEQ ID NO: 9321395 - DNA, 22 bp, Homo sapiens
ccccaaaattcttaagttgaat

SEQ ID NO: 9321396 - DNA, 18 bp, Homo sapiens
ccccaaaagtcaccctgg

SEQ ID NO: 9321397 - DNA, 22 bp, Homo sapiens
tggcagggtgggcttcagcccc

SEQ ID NO: 9321398 - DNA, 22 bp, Homo sapiens
tggcagggttggccaccttacc

SEQ ID NO: 9321399 - DNA, 22 bp, Homo sapiens
tggcagggtgggcttcagcccc

SEQ ID NO: 9321400 - DNA, 22 bp, Homo sapiens
tggcagggtggcaacttttggt

SEQ ID NO: 9321401 - DNA, 22 bp, Homo sapiens
tggcaggtagagttctgagatg

SEQ ID NO: 9321402 - DNA, 18 bp, Homo sapiens
tggcaggtagactcaggt

SEQ ID NO: 9321403 - DNA, 22 bp, Homo sapiens
tggcaggtacccattggctgta

SEQ ID NO: 9321404 - DNA, 18 bp, Homo sapiens
cctcagaggcaaattgtt

SEQ ID NO: 9321405 - DNA, 22 bp, Homo sapiens
cctcagaggcagatggtaagaa

SEQ ID NO: 9321406 - DNA, 22 bp, Homo sapiens
cctcagaggtgtggcatctctg

SEQ ID NO: 9321407 - DNA, 22 bp, Homo sapiens
cctcagaggttctgtgtgggaa

SEQ ID NO: 9321408 - DNA, 22 bp, Homo sapiens
cctcagaggtgaacatcagtgc

SEQ ID NO: 9321409 - DNA, 23 bp, Homo sapiens
cctcagaggcctcatagtctggc

SEQ ID NO: 9321410 - DNA, 22 bp, Homo sapiens
cctcagaggcatggttagaata

SEQ ID NO: 9321411 - DNA, 22 bp, Homo sapiens
tggcagaggctctgtgatgttg

SEQ ID NO: 9321412 - DNA, 22 bp, Homo sapiens
tggcagaggaggctcagattga

SEQ ID NO: 9321413 - DNA, 19 bp, Homo sapiens
tggcagaggcagtttgtac

SEQ ID NO: 9321414 - DNA, 22 bp, Homo sapiens
cctagagccgcacctcctccac

SEQ ID NO: 9321415 - DNA, 22 bp, Homo sapiens
cctaaggaaagccaaagaggcc

SEQ ID NO: 9321416 - DNA, 18 bp, Homo sapiens
cctagcctccaagctcat

SEQ ID NO: 9321417 - DNA, 18 bp, Homo sapiens
cctagcctccaagctcat

SEQ ID NO: 9321418 - DNA, 21 bp, Homo sapiens
cctagcctcttacccagcttt

SEQ ID NO: 9321419 - DNA, 22 bp, Homo sapiens
cctagccttcggcctacccatc

SEQ ID NO: 9321420 - DNA, 22 bp, Homo sapiens
cctagccttcggcctacccatc

SEQ ID NO: 9321421 - DNA, 22 bp, Homo sapiens
cctagatgggatggcggccggg

SEQ ID NO: 9321422 - DNA, 22 bp, Homo sapiens
cccttcctggagtaccctctgt

SEQ ID NO: 9321423 - DNA, 22 bp, Homo sapiens
cccttcctgggtgtcccggagt

SEQ ID NO: 9321424 - DNA, 19 bp, Homo sapiens
tggcagaggacaaggactt

SEQ ID NO: 9321425 - DNA, 22 bp, Homo sapiens
cccttctctttcactcactatt

SEQ ID NO: 9321426 - DNA, 22 bp, Homo sapiens
cccttctctttcactcactatt

SEQ ID NO: 9321427 - DNA, 22 bp, Homo sapiens
cccttctctttcactcactatt

SEQ ID NO: 9321428 - DNA, 22 bp, Homo sapiens
cctcagagtaggtctcagctgt

SEQ ID NO: 9321429 - DNA, 22 bp, Homo sapiens
cctcagaggttttcattctgta

SEQ ID NO: 9321430 - DNA, 22 bp, Homo sapiens
cctcagagtctagtaaataata

SEQ ID NO: 9321431 - DNA, 22 bp, Homo sapiens
cctcagagttatttgaagtgaa

SEQ ID NO: 9321432 - DNA, 22 bp, Homo sapiens
cctcagagttggaatcacattt

SEQ ID NO: 9321433 - DNA, 22 bp, Homo sapiens
cctcagagttggccacgagagc

SEQ ID NO: 9321434 - DNA, 22 bp, Homo sapiens
cctcagagtttaagatgtcaga

SEQ ID NO: 9321435 - DNA, 17 bp, Homo sapiens
cctcagcttctttcctc

SEQ ID NO: 9321436 - DNA, 22 bp, Homo sapiens
cctcagctgtcttttccgaggt

SEQ ID NO: 9321437 - DNA, 22 bp, Homo sapiens
cctcagggaatgggaggctggg

SEQ ID NO: 9321438 - DNA, 22 bp, Homo sapiens
cctcaggcttacgggcaatgga

SEQ ID NO: 9321439 - DNA, 22 bp, Homo sapiens
cctcaggctctgggtgcctacc

SEQ ID NO: 9321440 - DNA, 22 bp, Homo sapiens
tggcctgggcatgaagcatcgt

SEQ ID NO: 9321441 - DNA, 22 bp, Homo sapiens
tggcctggctgccctgtctgga

SEQ ID NO: 9321442 - DNA, 22 bp, Homo sapiens
tggcctgggccggcagatatac

SEQ ID NO: 9321443 - DNA, 22 bp, Homo sapiens
tggcctggggaagaccatgggc

SEQ ID NO: 9321444 - DNA, 22 bp, Homo sapiens
tggcctgggcctgccggtgcaa

SEQ ID NO: 9321445 - DNA, 21 bp, Homo sapiens
cctcatcaaactttcacttgc

SEQ ID NO: 9321446 - DNA, 22 bp, Homo sapiens
cctcagggactccatgctgcag

SEQ ID NO: 9321447 - DNA, 22 bp, Homo sapiens
cctcagggacgggatcacttgg

SEQ ID NO: 9321448 - DNA, 18 bp, Homo sapiens
cctcagggagagagacgc

SEQ ID NO: 9321449 - DNA, 18 bp, Homo sapiens
cctcagggagagagacgc

SEQ ID NO: 9321450 - DNA, 22 bp, Homo sapiens
cctcagtgagtgtttccttctt

SEQ ID NO: 9321451 - DNA, 22 bp, Homo sapiens
tggcctggctcacagtgagatt

SEQ ID NO: 9321452 - DNA, 18 bp, Homo sapiens
cctccaagtccccagcct

SEQ ID NO: 9321453 - DNA, 22 bp, Homo sapiens
cctcatgagaactgggctcctg

SEQ ID NO: 9321454 - DNA, 22 bp, Homo sapiens
cctccaaccataggtccagggg

SEQ ID NO: 9321455 - DNA, 22 bp, Homo sapiens
tggctggctagtgggcaggatt

SEQ ID NO: 9321456 - DNA, 22 bp, Homo sapiens
tggctgctagccagagcttcag

SEQ ID NO: 9321457 - DNA, 22 bp, Homo sapiens
tggctggctggaccacacctgc

SEQ ID NO: 9321458 - DNA, 22 bp, Homo sapiens
tggctggctagtgggcaggatt

SEQ ID NO: 9321459 - DNA, 18 bp, Homo sapiens
tggctggctctgtcatct

SEQ ID NO: 9321460 - DNA, 18 bp, Homo sapiens
tggctggctctgtcatct

SEQ ID NO: 9321461 - DNA, 22 bp, Homo sapiens
tggctgagaagttctggtggga

SEQ ID NO: 9321462 - DNA, 22 bp, Homo sapiens
tggctctgtcactgtgagctat

SEQ ID NO: 9321463 - DNA, 22 bp, Homo sapiens
tggcttcagggttgtcttcagc

SEQ ID NO: 9321464 - DNA, 22 bp, Homo sapiens
tggcttcagtctcatcttggaa

SEQ ID NO: 9321465 - DNA, 22 bp, Homo sapiens
tggcttcagggttgtcttcagc

SEQ ID NO: 9321466 - DNA, 22 bp, Homo sapiens
tggcttcagttcctgtgttgtt

SEQ ID NO: 9321467 - DNA, 22 bp, Homo sapiens
tggcttcaggcagaatttagac

SEQ ID NO: 9321468 - DNA, 17 bp, Homo sapiens
tggcttcaggctgagca

SEQ ID NO: 9321469 - DNA, 22 bp, Homo sapiens
tggcttcatctgcagcactgcc

SEQ ID NO: 9321470 - DNA, 22 bp, Homo sapiens
tggcttcatctgcagcactgcc

SEQ ID NO: 9321471 - DNA, 22 bp, Homo sapiens
tggcttcatctgcagcactgcc

SEQ ID NO: 9321472 - DNA, 22 bp, Homo sapiens
tggcttcagtttcccagtctgg

SEQ ID NO: 9321473 - DNA, 22 bp, Homo sapiens
tggcttcatcactcgggctgcc

SEQ ID NO: 9321474 - DNA, 20 bp, Homo sapiens
tggcttcataatggtttctg

SEQ ID NO: 9321475 - DNA, 22 bp, Homo sapiens
tggcttcagtttcccagtctgg

SEQ ID NO: 9321476 - DNA, 22 bp, Homo sapiens
tggcttcattcagcatgacagt

SEQ ID NO: 9321477 - DNA, 22 bp, Homo sapiens
tggcttcattattgtttttcct

SEQ ID NO: 9321478 - DNA, 22 bp, Homo sapiens
tggcttcatgtagtttgagttg

SEQ ID NO: 9321479 - DNA, 22 bp, Homo sapiens
tggcttcatggcaagtcttagt

SEQ ID NO: 9321480 - DNA, 22 bp, Homo sapiens
tggcttcatggctgtgcaatct

SEQ ID NO: 9321481 - DNA, 21 bp, Homo sapiens
tggcttcatttgcaacccact

SEQ ID NO: 9321482 - DNA, 22 bp, Homo sapiens
tggcttcattctgtagttaaaa

SEQ ID NO: 9321483 - DNA, 22 bp, Homo sapiens
tggcttccaaaggaatgggcct

SEQ ID NO: 9321484 - DNA, 22 bp, Homo sapiens
tggcttcattcagcatgacagt

SEQ ID NO: 9321485 - DNA, 22 bp, Homo sapiens
tggcttcattctcctgtgaata

SEQ ID NO: 9321486 - DNA, 22 bp, Homo sapiens
tggcttcattctcctgtgaata

SEQ ID NO: 9321487 - DNA, 22 bp, Homo sapiens
tggctggctttcttgtatttac

SEQ ID NO: 9321488 - DNA, 22 bp, Homo sapiens
tggctggcttgttcactgactg

SEQ ID NO: 9321489 - DNA, 20 bp, Homo sapiens
tggctggcttgtatttcctt

SEQ ID NO: 9321490 - DNA, 22 bp, Homo sapiens
tggctggctgtcaaggaaagcc

SEQ ID NO: 9321491 - DNA, 22 bp, Homo sapiens
tggctggctgtcagtaggctgt

SEQ ID NO: 9321492 - DNA, 22 bp, Homo sapiens
tggctggctgtccagctgggca

SEQ ID NO: 9321493 - DNA, 22 bp, Homo sapiens
tggctggctgtccagctgggca

SEQ ID NO: 9321494 - DNA, 22 bp, Homo sapiens
tggctggctgtccagctgggca

SEQ ID NO: 9321495 - DNA, 22 bp, Homo sapiens
tggctggctgtcagtaggctgt

SEQ ID NO: 9321496 - DNA, 22 bp, Homo sapiens
cctctgcgtctctccacactga

SEQ ID NO: 9321497 - DNA, 19 bp, Homo sapiens
cctctgctccagtttcctt

SEQ ID NO: 9321498 - DNA, 22 bp, Homo sapiens
cctctgcctgcacatcatcctg

SEQ ID NO: 9321499 - DNA, 20 bp, Homo sapiens
cctctgcctttctagtctga

SEQ ID NO: 9321500 - DNA, 22 bp, Homo sapiens
cctctgcccttttcctgtatca

SEQ ID NO: 9321501 - DNA, 18 bp, Homo sapiens
cctctgccatagccagca

SEQ ID NO: 9321502 - DNA, 22 bp, Homo sapiens
tggcttccagagctgctccacc

SEQ ID NO: 9321503 - DNA, 22 bp, Homo sapiens
tggcttccaaattatccctaga

SEQ ID NO: 9321504 - DNA, 22 bp, Homo sapiens
tggcttccaaattatccctaga

SEQ ID NO: 9321505 - DNA, 19 bp, Homo sapiens
tggcttccatctctctcat

SEQ ID NO: 9321506 - DNA, 22 bp, Homo sapiens
tgggaaggaactgcctttagct

SEQ ID NO: 9321507 - DNA, 22 bp, Homo sapiens
tgggaaggatacgttacaagat

SEQ ID NO: 9321508 - DNA, 22 bp, Homo sapiens
tgggaaggacgtgtcagtggca

SEQ ID NO: 9321509 - DNA, 22 bp, Homo sapiens
tgggaaggacgtgtcagtggca

SEQ ID NO: 9321510 - DNA, 22 bp, Homo sapiens
tgggctgctgcggtgctcttgg

SEQ ID NO: 9321511 - DNA, 22 bp, Homo sapiens
cctgagctccagtagcagccag

SEQ ID NO: 9321512 - DNA, 22 bp, Homo sapiens
cctgagctagggaaggaagacc

SEQ ID NO: 9321513 - DNA, 22 bp, Homo sapiens
cctgagctcaaagggtgcctgg

SEQ ID NO: 9321514 - DNA, 22 bp, Homo sapiens
cctgagctcaagaaggtgacca

SEQ ID NO: 9321515 - DNA, 22 bp, Homo sapiens
tgggctggagcttgttgcttcc

SEQ ID NO: 9321516 - DNA, 22 bp, Homo sapiens
tgggctgcttcctcagctgaga

SEQ ID NO: 9321517 - DNA, 22 bp, Homo sapiens
cctgagcctggctcatgcactc

SEQ ID NO: 9321518 - DNA, 19 bp, Homo sapiens
cctcttcctctgacactat

SEQ ID NO: 9321519 - DNA, 17 bp, Homo sapiens
cctcttcctctcagctg

SEQ ID NO: 9321520 - DNA, 22 bp, Homo sapiens
cctcttctaggtttcagcctgc

SEQ ID NO: 9321521 - DNA, 22 bp, Homo sapiens
cctcttctcaactccagccaga

SEQ ID NO: 9321522 - DNA, 22 bp, Homo sapiens
cctgagcacacatcagaatcac

SEQ ID NO: 9321523 - DNA, 22 bp, Homo sapiens
cctgagcatcagcgcctcctta

SEQ ID NO: 9321524 - DNA, 22 bp, Homo sapiens
cctgagcagctctgaggggcga

SEQ ID NO: 9321525 - DNA, 22 bp, Homo sapiens
tgggccagtttctcattgaaat

SEQ ID NO: 9321526 - DNA, 22 bp, Homo sapiens
cctgagcctgagtggtgcaggg

SEQ ID NO: 9321527 - DNA, 22 bp, Homo sapiens
tgaggcagaaaatagcagttca

SEQ ID NO: 9321528 - DNA, 22 bp, Homo sapiens
tgaggcagaaattcctgttttc

SEQ ID NO: 9321529 - DNA, 22 bp, Homo sapiens
tgaggcagagtaagatacatga

SEQ ID NO: 9321530 - DNA, 22 bp, Homo sapiens
tgaggcagcaattgattattca

SEQ ID NO: 9321531 - DNA, 22 bp, Homo sapiens
tgaggcagagtaagatacatga

SEQ ID NO: 9321532 - DNA, 22 bp, Homo sapiens
tgaggcagatatttattgggtt

SEQ ID NO: 9321533 - DNA, 23 bp, Homo sapiens
tgaggacctctcaggggccaggc

SEQ ID NO: 9321534 - DNA, 22 bp, Homo sapiens
tgagacgaagtcttgctctgtt

SEQ ID NO: 9321535 - DNA, 22 bp, Homo sapiens
tgagacagttggtgaaatctaa

SEQ ID NO: 9321536 - DNA, 22 bp, Homo sapiens
ccaggtgctagcaatcactgtc

SEQ ID NO: 9321537 - DNA, 22 bp, Homo sapiens
tgagaagggttggagaaataat

SEQ ID NO: 9321538 - DNA, 22 bp, Homo sapiens
tgagaatgaatcttttgctttc

SEQ ID NO: 9321539 - DNA, 22 bp, Homo sapiens
ccaggggctctcagggtgtgtg

SEQ ID NO: 9321540 - DNA, 22 bp, Homo sapiens
tgacataagttggtagaaagga

SEQ ID NO: 9321541 - DNA, 22 bp, Homo sapiens
ccagggcttcagaggttttggc

SEQ ID NO: 9321542 - DNA, 22 bp, Homo sapiens
ccagggctgctgtgggactcca

SEQ ID NO: 9321543 - DNA, 22 bp, Homo sapiens
ccagggctgctgtgggactcca

SEQ ID NO: 9321544 - DNA, 22 bp, Homo sapiens
ccagggcttcagttagtggtga

SEQ ID NO: 9321545 - DNA, 22 bp, Homo sapiens
ccagggcttcagttagtggtga

SEQ ID NO: 9321546 - DNA, 22 bp, Homo sapiens
ccagggcttcccacgtgccctg

SEQ ID NO: 9321547 - DNA, 22 bp, Homo sapiens
ccagggcttcccacgtgccctg

SEQ ID NO: 9321548 - DNA, 22 bp, Homo sapiens
ccagggcttggtggcttgtatc

SEQ ID NO: 9321549 - DNA, 19 bp, Homo sapiens
ccagggctttaagttgagg

SEQ ID NO: 9321550 - DNA, 19 bp, Homo sapiens
ccagggctttaagttgagg

SEQ ID NO: 9321551 - DNA, 19 bp, Homo sapiens
ccagggctttaagttgagg

SEQ ID NO: 9321552 - DNA, 22 bp, Homo sapiens
ccagggctttatctgcctttga

SEQ ID NO: 9321553 - DNA, 22 bp, Homo sapiens
ccagggctttgccaaagtccag

SEQ ID NO: 9321554 - DNA, 22 bp, Homo sapiens
ccagggctttgccaaagtccag

SEQ ID NO: 9321555 - DNA, 22 bp, Homo sapiens
ccagggctttgccaaagtccag

SEQ ID NO: 9321556 - DNA, 22 bp, Homo sapiens
ccaggggaaacagggagcactc

SEQ ID NO: 9321557 - DNA, 20 bp, Homo sapiens
ccaggctggcaaatgggggc

SEQ ID NO: 9321558 - DNA, 22 bp, Homo sapiens
ccaggctggagtgcaatggcgt

SEQ ID NO: 9321559 - DNA, 22 bp, Homo sapiens
ccaggctggagtgcagtggcac

SEQ ID NO: 9321560 - DNA, 22 bp, Homo sapiens
ccaggctggagtgcagtggcac

SEQ ID NO: 9321561 - DNA, 23 bp, Homo sapiens
tgaatgcgagatgacagctccca

SEQ ID NO: 9321562 - DNA, 22 bp, Homo sapiens
tgaatgatttgggtgcattcag

SEQ ID NO: 9321563 - DNA, 22 bp, Homo sapiens
tgaatgatgtataatattgaga

SEQ ID NO: 9321564 - DNA, 22 bp, Homo sapiens
tgaatgattaaaacccggacta

SEQ ID NO: 9321565 - DNA, 23 bp, Homo sapiens
tgaatgattgtactgagctttta

SEQ ID NO: 9321566 - DNA, 22 bp, Homo sapiens
tgaatgatttcttaggcaattg

SEQ ID NO: 9321567 - DNA, 22 bp, Homo sapiens
tgaatgatggtgtgttcttgcc

SEQ ID NO: 9321568 - DNA, 23 bp, Homo sapiens
tgaatgatggtgctcctcatctt

SEQ ID NO: 9321569 - DNA, 21 bp, Homo sapiens
tgaatgatgccccagagttgt

SEQ ID NO: 9321570 - DNA, 22 bp, Homo sapiens
tgaatgatgcagtataatgata

SEQ ID NO: 9321571 - DNA, 22 bp, Homo sapiens
tgaatgatgcatttgtttccca

SEQ ID NO: 9321572 - DNA, 21 bp, Homo sapiens
tgaatgatctggttgcctttt

SEQ ID NO: 9321573 - DNA, 22 bp, Homo sapiens
tgaatgatgaggggagaataat

SEQ ID NO: 9321574 - DNA, 22 bp, Homo sapiens
tgaatgatctccgattagtcct

SEQ ID NO: 9321575 - DNA, 22 bp, Homo sapiens
tgaatgatctagttttgtagac

SEQ ID NO: 9321576 - DNA, 22 bp, Homo sapiens
tgaatgatatgtgaaaaggaac

SEQ ID NO: 9321577 - DNA, 22 bp, Homo sapiens
tgaatgatatattgggaataat

SEQ ID NO: 9321578 - DNA, 22 bp, Homo sapiens
tgaatgatacagaattatgtag

SEQ ID NO: 9321579 - DNA, 22 bp, Homo sapiens
tgaagttgttaaggttgccatt

SEQ ID NO: 9321580 - DNA, 22 bp, Homo sapiens
tgaggtagtagatttttgtcca

SEQ ID NO: 9321581 - DNA, 22 bp, Homo sapiens
tgaggtaggtgtcgagagaggt

SEQ ID NO: 9321582 - DNA, 22 bp, Homo sapiens
tgaggtagtgattgtagaagtg

SEQ ID NO: 9321583 - DNA, 22 bp, Homo sapiens
tgaggtaggttgaaagatagat

SEQ ID NO: 9321584 - DNA, 22 bp, Homo sapiens
ccatcctggcctcgctgtccac

SEQ ID NO: 9321585 - DNA, 22 bp, Homo sapiens
ccatcctggccttgctgtccac

SEQ ID NO: 9321586 - DNA, 22 bp, Homo sapiens
ccatgcagtgctggagctgatt

SEQ ID NO: 9321587 - DNA, 22 bp, Homo sapiens
ccatgcccacgttgtggctcag

SEQ ID NO: 9321588 - DNA, 22 bp, Homo sapiens
ccatgccttcctttccctggaa

SEQ ID NO: 9321589 - DNA, 22 bp, Homo sapiens
tgagggctaaattgtggcaggt

SEQ ID NO: 9321590 - DNA, 22 bp, Homo sapiens
tgagggcaaagtggtgctgagg

SEQ ID NO: 9321591 - DNA, 23 bp, Homo sapiens
tgaggctgattgatttttgctca

SEQ ID NO: 9321592 - DNA, 23 bp, Homo sapiens
tgaggctgattgatttttgctca

SEQ ID NO: 9321593 - DNA, 22 bp, Homo sapiens
tgagggctccccgctgctgtgt

SEQ ID NO: 9321594 - DNA, 20 bp, Homo sapiens
tgagggctaaccagactctg

SEQ ID NO: 9321595 - DNA, 22 bp, Homo sapiens
ccagtgttgaacagtatttgga

SEQ ID NO: 9321596 - DNA, 22 bp, Homo sapiens
ccagtgtttacagttgaacaaa

SEQ ID NO: 9321597 - DNA, 22 bp, Homo sapiens
tgaggcagcctgcattaaagag

SEQ ID NO: 9321598 - DNA, 22 bp, Homo sapiens
tgaggcagcccactttccttag

SEQ ID NO: 9321599 - DNA, 22 bp, Homo sapiens
tgaggcagcattcttcaagaca

SEQ ID NO: 9321600 - DNA, 22 bp, Homo sapiens
tgaggcagcaattgtattgtat

SEQ ID NO: 9321601 - DNA, 22 bp, Homo sapiens
ccagtcgtgacaaccaaaaata

SEQ ID NO: 9321602 - DNA, 19 bp, Homo sapiens
ccagtctccttgcagcatc

SEQ ID NO: 9321603 - DNA, 22 bp, Homo sapiens
ccagtcctcagatggtctgtgc

SEQ ID NO: 9321604 - DNA, 22 bp, Homo sapiens
ccattaaaattgtgacatagga

SEQ ID NO: 9321605 - DNA, 22 bp, Homo sapiens
tgatttcttccttgtcattaga

SEQ ID NO: 9321606 - DNA, 22 bp, Homo sapiens
tgattttacttagcatgatgtt

SEQ ID NO: 9321607 - DNA, 22 bp, Homo sapiens
tgattttattgaaacttcactt

SEQ ID NO: 9321608 - DNA, 23 bp, Homo sapiens
tgattttaaaaagtaagttatca

SEQ ID NO: 9321609 - DNA, 22 bp, Homo sapiens
cccaccctcaagggtgtctata

SEQ ID NO: 9321610 - DNA, 22 bp, Homo sapiens
cccacttcatgggcaggaagga

SEQ ID NO: 9321611 - DNA, 22 bp, Homo sapiens
tgcaaatagcctatatttatag

SEQ ID NO: 9321612 - DNA, 22 bp, Homo sapiens
tgcaaatattccatgctgttca

SEQ ID NO: 9321613 - DNA, 22 bp, Homo sapiens
tgcaaaggggacagagtccact

SEQ ID NO: 9321614 - DNA, 22 bp, Homo sapiens
tgcaaaggtttgtgcttggaaa

SEQ ID NO: 9321615 - DNA, 21 bp, Homo sapiens
tgcaaaggtatttagggggta

SEQ ID NO: 9321616 - DNA, 22 bp, Homo sapiens
tgcaaagggctttgcatacaga

SEQ ID NO: 9321617 - DNA, 22 bp, Homo sapiens
tgcaaaggaggccaaaccaagt

SEQ ID NO: 9321618 - DNA, 22 bp, Homo sapiens
tgcaaaggcctttaggttgaaa

SEQ ID NO: 9321619 - DNA, 22 bp, Homo sapiens
tgcaaaggcatctgggaaggtt

SEQ ID NO: 9321620 - DNA, 21 bp, Homo sapiens
tgcaaaggacctgaggtagga

SEQ ID NO: 9321621 - DNA, 22 bp, Homo sapiens
tgcaaaggaggatgggaaagaa

SEQ ID NO: 9321622 - DNA, 18 bp, Homo sapiens
tgcaaaggacactgagat

SEQ ID NO: 9321623 - DNA, 23 bp, Homo sapiens
tgcaaataacaaggagtttaagg

SEQ ID NO: 9321624 - DNA, 22 bp, Homo sapiens
cccagacagtcaagaggcctgc

SEQ ID NO: 9321625 - DNA, 22 bp, Homo sapiens
tgcacacatatgagcatgtgtg

SEQ ID NO: 9321626 - DNA, 22 bp, Homo sapiens
tgcacacatgtttacaagcatc

SEQ ID NO: 9321627 - DNA, 22 bp, Homo sapiens
tgcacacatgtatgtatatgtg

SEQ ID NO: 9321628 - DNA, 22 bp, Homo sapiens
tgcacacattaaggatacacag

SEQ ID NO: 9321629 - DNA, 22 bp, Homo sapiens
tgcacacattctatggggctga

SEQ ID NO: 9321630 - DNA, 22 bp, Homo sapiens
ccaggccagcaggcacacctgc

SEQ ID NO: 9321631 - DNA, 22 bp, Homo sapiens
ccaggccagagtgcagtggcac

SEQ ID NO: 9321632 - DNA, 22 bp, Homo sapiens
ccaggccagcgctggctggagg

SEQ ID NO: 9321633 - DNA, 22 bp, Homo sapiens
ccaggccagcctggagcatggc

SEQ ID NO: 9321634 - DNA, 22 bp, Homo sapiens
tcttcagagatgtaacatatgg

SEQ ID NO: 9321635 - DNA, 22 bp, Homo sapiens
tcttcagaggagctgaatatat

SEQ ID NO: 9321636 - DNA, 22 bp, Homo sapiens
tcttcagaaaattatcacttgt

SEQ ID NO: 9321637 - DNA, 22 bp, Homo sapiens
tcttcagactgttgttcttttg

SEQ ID NO: 9321638 - DNA, 22 bp, Homo sapiens
tcttcagactccaaatgtttta

SEQ ID NO: 9321639 - DNA, 22 bp, Homo sapiens
tcttcagacccttagctgtgat

SEQ ID NO: 9321640 - DNA, 22 bp, Homo sapiens
tcttcagaagatcacatcagtg

SEQ ID NO: 9321641 - DNA, 22 bp, Homo sapiens
tcttcagagtgaaagtctgtga

SEQ ID NO: 9321642 - DNA, 22 bp, Homo sapiens
ccaggagtctggatgaggtgtc

SEQ ID NO: 9321643 - DNA, 22 bp, Homo sapiens
ccaggagtggctggtgaccttc

SEQ ID NO: 9321644 - DNA, 19 bp, Homo sapiens
ccaggagtggtggggtgag

SEQ ID NO: 9321645 - DNA, 22 bp, Homo sapiens
ccaggaggttgaggctgcagtg

SEQ ID NO: 9321646 - DNA, 22 bp, Homo sapiens
ccaggagttggaagctgccatg

SEQ ID NO: 9321647 - DNA, 18 bp, Homo sapiens
ccaggccatgaacctctg

SEQ ID NO: 9321648 - DNA, 19 bp, Homo sapiens
ccaggccatcccagttccc

SEQ ID NO: 9321649 - DNA, 22 bp, Homo sapiens
ccaggccagtgtttggtccagg

SEQ ID NO: 9321650 - DNA, 22 bp, Homo sapiens
ccaggccagggctgcagcgagc

SEQ ID NO: 9321651 - DNA, 22 bp, Homo sapiens
tctttgaaaagatattcctcct

SEQ ID NO: 9321652 - DNA, 22 bp, Homo sapiens
ccaggcctgcatctgctgcgca

SEQ ID NO: 9321653 - DNA, 22 bp, Homo sapiens
ccaggcctgcattccctctcag

SEQ ID NO: 9321654 - DNA, 22 bp, Homo sapiens
tctttcttggtattctgagcta

SEQ ID NO: 9321655 - DNA, 22 bp, Homo sapiens
tctttcttggtattctgagcta

SEQ ID NO: 9321656 - DNA, 22 bp, Homo sapiens
tctttcttcagccctgtaagat

SEQ ID NO: 9321657 - DNA, 22 bp, Homo sapiens
tctttcttctttcatagtgtga

SEQ ID NO: 9321658 - DNA, 22 bp, Homo sapiens
ccaggctggagtgcaatggcat

SEQ ID NO: 9321659 - DNA, 22 bp, Homo sapiens
ccaggctggagtgcaatggcgt

SEQ ID NO: 9321660 - DNA, 22 bp, Homo sapiens
ccaggctggagtgcaatggcgt

SEQ ID NO: 9321661 - DNA, 22 bp, Homo sapiens
ccaggctggagtgcaatggcat

SEQ ID NO: 9321662 - DNA, 22 bp, Homo sapiens
ccaggctggagtgcaatggcat

SEQ ID NO: 9321663 - DNA, 22 bp, Homo sapiens
tctttggctatgatttactgtt

SEQ ID NO: 9321664 - DNA, 22 bp, Homo sapiens
tctttggctgcctgaagcccaa

SEQ ID NO: 9321665 - DNA, 22 bp, Homo sapiens
tctttggctttgccacacccaa

SEQ ID NO: 9321666 - DNA, 23 bp, Homo sapiens
ccaggctctttcacctgctattc

SEQ ID NO: 9321667 - DNA, 22 bp, Homo sapiens
ccaggctctgttccccgaggag

SEQ ID NO: 9321668 - DNA, 22 bp, Homo sapiens
ccaggctctgttccccgaggag

SEQ ID NO: 9321669 - DNA, 22 bp, Homo sapiens
ccaggctctgtgtgggctagag

SEQ ID NO: 9321670 - DNA, 22 bp, Homo sapiens
ccaggctctgtgtgggctagag

SEQ ID NO: 9321671 - DNA, 22 bp, Homo sapiens
ccaggctctgtgtgggctagag

SEQ ID NO: 9321672 - DNA, 21 bp, Homo sapiens
ccaggctcctgaggctggtca

SEQ ID NO: 9321673 - DNA, 22 bp, Homo sapiens
ccaggcctggccaggggatgcc

SEQ ID NO: 9321674 - DNA, 22 bp, Homo sapiens
ccaggctctgtctggtcagaag

SEQ ID NO: 9321675 - DNA, 22 bp, Homo sapiens
ccaggctctgtctggtcagaag

SEQ ID NO: 9321676 - DNA, 21 bp, Homo sapiens
ccaggctcctgaggctggtca

SEQ ID NO: 9321677 - DNA, 21 bp, Homo sapiens
ccaggctcctgaggctggtca

SEQ ID NO: 9321678 - DNA, 22 bp, Homo sapiens
ccaggcctggaccatgccaggg

SEQ ID NO: 9321679 - DNA, 22 bp, Homo sapiens
ccaggcctggacgggtggcctg

SEQ ID NO: 9321680 - DNA, 22 bp, Homo sapiens
tctggcaggggttctgcacttg

SEQ ID NO: 9321681 - DNA, 22 bp, Homo sapiens
tctggcctatttctgtcagatc

SEQ ID NO: 9321682 - DNA, 22 bp, Homo sapiens
tctggcaggcaatcggctctgg

SEQ ID NO: 9321683 - DNA, 22 bp, Homo sapiens
tctggccttatctgtccaagcc

SEQ ID NO: 9321684 - DNA, 22 bp, Homo sapiens
tctggcctgggcctgccggtgc

SEQ ID NO: 9321685 - DNA, 22 bp, Homo sapiens
tctggcctgaaagtccatgctt

SEQ ID NO: 9321686 - DNA, 22 bp, Homo sapiens
tctggcagcagcatcagtggct

SEQ ID NO: 9321687 - DNA, 22 bp, Homo sapiens
tctggcagctatcctctggcca

SEQ ID NO: 9321688 - DNA, 22 bp, Homo sapiens
tctggcagctcagttcaggtct

SEQ ID NO: 9321689 - DNA, 22 bp, Homo sapiens
tctggcagctctcctcggcgga

SEQ ID NO: 9321690 - DNA, 18 bp, Homo sapiens
ccaggacaggcaaaaggt

SEQ ID NO: 9321691 - DNA, 22 bp, Homo sapiens
ccaggacaggagttggcttcgc

SEQ ID NO: 9321692 - DNA, 22 bp, Homo sapiens
ccaggacagggagacgggagcc

SEQ ID NO: 9321693 - DNA, 22 bp, Homo sapiens
ccaggacactgcttcacagcag

SEQ ID NO: 9321694 - DNA, 22 bp, Homo sapiens
ccaggacagtgaacatgtaaga

SEQ ID NO: 9321695 - DNA, 22 bp, Homo sapiens
ccaggacatgttgcaagtttat

SEQ ID NO: 9321696 - DNA, 22 bp, Homo sapiens
ccaggacacgatttttagtctg

SEQ ID NO: 9321697 - DNA, 17 bp, Homo sapiens
tctggccttcctgaact

SEQ ID NO: 9321698 - DNA, 22 bp, Homo sapiens
ccaggactcaatgaccacaggg

SEQ ID NO: 9321699 - DNA, 22 bp, Homo sapiens
ccaggactcagtggggaaaggg

SEQ ID NO: 9321700 - DNA, 22 bp, Homo sapiens
tctgggtttgaagtagagccca

SEQ ID NO: 9321701 - DNA, 22 bp, Homo sapiens
tctggtaataggcaatagcttg

SEQ ID NO: 9321702 - DNA, 22 bp, Homo sapiens
tctgggagcctgaaagtgaatg

SEQ ID NO: 9321703 - DNA, 22 bp, Homo sapiens
tctggtggtgggccacaagcat

SEQ ID NO: 9321704 - DNA, 21 bp, Homo sapiens
tctggtctgctgtggacctgg

SEQ ID NO: 9321705 - DNA, 20 bp, Homo sapiens
tctggtccaggtcttcatgg

SEQ ID NO: 9321706 - DNA, 20 bp, Homo sapiens
ccaggactgctggggactct

SEQ ID NO: 9321707 - DNA, 22 bp, Homo sapiens
ccaggactgcagggggcgagga

SEQ ID NO: 9321708 - DNA, 22 bp, Homo sapiens
ccaggactttaagtccagcact

SEQ ID NO: 9321709 - DNA, 22 bp, Homo sapiens
tctggcagcaagtctgtttctc

SEQ ID NO: 9321710 - DNA, 22 bp, Homo sapiens
ccagctctgccaagcgtcagct

SEQ ID NO: 9321711 - DNA, 22 bp, Homo sapiens
ccagctgcaggggagcagtgga

SEQ ID NO: 9321712 - DNA, 22 bp, Homo sapiens
ccagctctgattttgacctcca

SEQ ID NO: 9321713 - DNA, 22 bp, Homo sapiens
ccagctctgcagggcctggggt

SEQ ID NO: 9321714 - DNA, 22 bp, Homo sapiens
ccagctctctgtcctccccaca

SEQ ID NO: 9321715 - DNA, 22 bp, Homo sapiens
ccagagactggctgagagatct

SEQ ID NO: 9321716 - DNA, 22 bp, Homo sapiens
ccagagaccagaacatggggat

SEQ ID NO: 9321717 - DNA, 22 bp, Homo sapiens
ccagagagaaatggatttgagt

SEQ ID NO: 9321718 - DNA, 22 bp, Homo sapiens
tctcagaatcaggacctacttc

SEQ ID NO: 9321719 - DNA, 22 bp, Homo sapiens
tctcagaattgtgtccactggg

SEQ ID NO: 9321720 - DNA, 22 bp, Homo sapiens
tctcagagaaatgtgtcaccat

SEQ ID NO: 9321721 - DNA, 22 bp, Homo sapiens
tctcagagaacagttggtgctt

SEQ ID NO: 9321722 - DNA, 22 bp, Homo sapiens
tctgctttgaccttcttgatgc

SEQ ID NO: 9321723 - DNA, 22 bp, Homo sapiens
tctgctttgctgcctcctgatc

SEQ ID NO: 9321724 - DNA, 22 bp, Homo sapiens
tctgctttgctgcctcctgatc

SEQ ID NO: 9321725 - DNA, 22 bp, Homo sapiens
tctgcttctgtgaaggcagtct

SEQ ID NO: 9321726 - DNA, 23 bp, Homo sapiens
tctgcttctgtattttttcccat

SEQ ID NO: 9321727 - DNA, 22 bp, Homo sapiens
tctgcttctcctacttcatggg

SEQ ID NO: 9321728 - DNA, 22 bp, Homo sapiens
tctgcttaacaacagcacagag

SEQ ID NO: 9321729 - DNA, 22 bp, Homo sapiens
tctgcttcacttccccaagctt

SEQ ID NO: 9321730 - DNA, 22 bp, Homo sapiens
tccaggagacacaaggtacata

SEQ ID NO: 9321731 - DNA, 22 bp, Homo sapiens
tccaggagaccagatgtaggcc

SEQ ID NO: 9321732 - DNA, 19 bp, Homo sapiens
tccaggagcaaagccagtt

SEQ ID NO: 9321733 - DNA, 22 bp, Homo sapiens
tcccaaaaaaggtatgttgaag

SEQ ID NO: 9321734 - DNA, 20 bp, Homo sapiens
tcccaaaattctactttatc

SEQ ID NO: 9321735 - DNA, 22 bp, Homo sapiens
catgggctacagaagcatgctg

SEQ ID NO: 9321736 - DNA, 22 bp, Homo sapiens
tcccaccaggtgaccatttcat

SEQ ID NO: 9321737 - DNA, 22 bp, Homo sapiens
tcccacccatcctgcatctctt

SEQ ID NO: 9321738 - DNA, 22 bp, Homo sapiens
tcccacccatcctgcatctctt

SEQ ID NO: 9321739 - DNA, 22 bp, Homo sapiens
cattctgcgatcctcaagcaca

SEQ ID NO: 9321740 - DNA, 22 bp, Homo sapiens
cattctgcatttggaaggggca

SEQ ID NO: 9321741 - DNA, 22 bp, Homo sapiens
cattagctatctgtttacatta

SEQ ID NO: 9321742 - DNA, 22 bp, Homo sapiens
cattagcaggcactaagaaggt

SEQ ID NO: 9321743 - DNA, 22 bp, Homo sapiens
cattctctacactcctgccctg

SEQ ID NO: 9321744 - DNA, 22 bp, Homo sapiens
tcccactcccaggcaggcctct

SEQ ID NO: 9321745 - DNA, 22 bp, Homo sapiens
cattgtctggtaggaagtgggc

SEQ ID NO: 9321746 - DNA, 22 bp, Homo sapiens
tccctcctggccgtcaccgctg

SEQ ID NO: 9321747 - DNA, 22 bp, Homo sapiens
catttattgagtggccacagtg

SEQ ID NO: 9321748 - DNA, 22 bp, Homo sapiens
catttattgagtggccacagtg

SEQ ID NO: 9321749 - DNA, 20 bp, Homo sapiens
tccctggggccctacttcct

SEQ ID NO: 9321750 - DNA, 22 bp, Homo sapiens
tccctggggtatcgctgaggca

SEQ ID NO: 9321751 - DNA, 22 bp, Homo sapiens
tccctgggtcctgcttgctctc

SEQ ID NO: 9321752 - DNA, 22 bp, Homo sapiens
tccctctctagcctgttcagta

SEQ ID NO: 9321753 - DNA, 22 bp, Homo sapiens
catttattagttagttcgatgt

SEQ ID NO: 9321754 - DNA, 22 bp, Homo sapiens
catttattcagctcagtcggtt

SEQ ID NO: 9321755 - DNA, 22 bp, Homo sapiens
catttattcagctcagtcggtt

SEQ ID NO: 9321756 - DNA, 22 bp, Homo sapiens
catttattcagctcagtcggtt

SEQ ID NO: 9321757 - DNA, 22 bp, Homo sapiens
catttattagttagttcgatgt

SEQ ID NO: 9321758 - DNA, 22 bp, Homo sapiens
catttattagttagttcgatgt

SEQ ID NO: 9321759 - DNA, 22 bp, Homo sapiens
catttattcatttgctagggct

SEQ ID NO: 9321760 - DNA, 22 bp, Homo sapiens
catttattcatttgctagggct

SEQ ID NO: 9321761 - DNA, 22 bp, Homo sapiens
catttattcatttgctagggct

SEQ ID NO: 9321762 - DNA, 22 bp, Homo sapiens
catttattctcagatccttgtc

SEQ ID NO: 9321763 - DNA, 22 bp, Homo sapiens
catttattctcagatccttgtc

SEQ ID NO: 9321764 - DNA, 22 bp, Homo sapiens
catttattctcagatccttgtc

SEQ ID NO: 9321765 - DNA, 22 bp, Homo sapiens
catttattcatgatctgtagct

SEQ ID NO: 9321766 - DNA, 22 bp, Homo sapiens
catttattcatgatctgtagct

SEQ ID NO: 9321767 - DNA, 22 bp, Homo sapiens
catttattcatgatctgtagct

SEQ ID NO: 9321768 - DNA, 22 bp, Homo sapiens
tcctgggagagtttgattcatt

SEQ ID NO: 9321769 - DNA, 22 bp, Homo sapiens
tcctgggcttaagtgatcctcc

SEQ ID NO: 9321770 - DNA, 22 bp, Homo sapiens
tcctgggagcccttgctccacc

SEQ ID NO: 9321771 - DNA, 22 bp, Homo sapiens
tcctggcaggtctgagaggtct

SEQ ID NO: 9321772 - DNA, 22 bp, Homo sapiens
tcctggcaggtcagcaggagca

SEQ ID NO: 9321773 - DNA, 22 bp, Homo sapiens
tcctggcaggtcagcaggagca

SEQ ID NO: 9321774 - DNA, 22 bp, Homo sapiens
tcctggcagcccgcaggtgctg

SEQ ID NO: 9321775 - DNA, 22 bp, Homo sapiens
tcctggcagcccgcaggtgctg

SEQ ID NO: 9321776 - DNA, 22 bp, Homo sapiens
tcctggcagggtggcagcgggt

SEQ ID NO: 9321777 - DNA, 22 bp, Homo sapiens
ccacacagtcagtttccaagaa

SEQ ID NO: 9321778 - DNA, 19 bp, Homo sapiens
ccacacagtgtgcaattta

SEQ ID NO: 9321779 - DNA, 22 bp, Homo sapiens
ccaagaggttgtgaggcaggca

SEQ ID NO: 9321780 - DNA, 22 bp, Homo sapiens
ccaaggagaatgacaccatgga

SEQ ID NO: 9321781 - DNA, 22 bp, Homo sapiens
ccaaggagctcatattcttgtt

SEQ ID NO: 9321782 - DNA, 20 bp, Homo sapiens
ccaaggattggcaagcagca

SEQ ID NO: 9321783 - DNA, 22 bp, Homo sapiens
ccaaggagtagagcaggaagct

SEQ ID NO: 9321784 - DNA, 22 bp, Homo sapiens
tcctggcagagagcatgaggcc

SEQ ID NO: 9321785 - DNA, 22 bp, Homo sapiens
ccaaggcttcccagagatgctc

SEQ ID NO: 9321786 - DNA, 22 bp, Homo sapiens
ccaaggcttcccagagatgctc

SEQ ID NO: 9321787 - DNA, 22 bp, Homo sapiens
tcctggaggacagaggcatctc

SEQ ID NO: 9321788 - DNA, 22 bp, Homo sapiens
ccaaggctgtcattcagtagct

SEQ ID NO: 9321789 - DNA, 22 bp, Homo sapiens
ccaaggctcctcagctggtctt

SEQ ID NO: 9321790 - DNA, 22 bp, Homo sapiens
ccaaggctcctcagctggtctt

SEQ ID NO: 9321791 - DNA, 22 bp, Homo sapiens
ccaaggccttgaaggcgcgggg

SEQ ID NO: 9321792 - DNA, 22 bp, Homo sapiens
ccaaggccatcaggtaggtcct

SEQ ID NO: 9321793 - DNA, 18 bp, Homo sapiens
ccaaggcccctgctgggg

SEQ ID NO: 9321794 - DNA, 22 bp, Homo sapiens
tctaatccttgctacctgggtg

SEQ ID NO: 9321795 - DNA, 22 bp, Homo sapiens
tctaatcctatggtggggaggg

SEQ ID NO: 9321796 - DNA, 22 bp, Homo sapiens
tctaaggagccaggactattag

SEQ ID NO: 9321797 - DNA, 22 bp, Homo sapiens
tctaaggacagttattactggg

SEQ ID NO: 9321798 - DNA, 22 bp, Homo sapiens
tctaaggacattggctttggag

SEQ ID NO: 9321799 - DNA, 22 bp, Homo sapiens
ccactgtataagcaaaatgaaa

SEQ ID NO: 9321800 - DNA, 22 bp, Homo sapiens
ccactgctagagatgcatcccc

SEQ ID NO: 9321801 - DNA, 22 bp, Homo sapiens
ccactgtaagtttgaaaataac

SEQ ID NO: 9321802 - DNA, 22 bp, Homo sapiens
ccactgtcttttccaggctgaa

SEQ ID NO: 9321803 - DNA, 22 bp, Homo sapiens
tctaagcagaactgaagctctg

SEQ ID NO: 9321804 - DNA, 22 bp, Homo sapiens
tcctttatgtgagttgtttccc

SEQ ID NO: 9321805 - DNA, 22 bp, Homo sapiens
tccttcccaggtgtcgccgcct

SEQ ID NO: 9321806 - DNA, 22 bp, Homo sapiens
tccttggggacgctgacatcgt

SEQ ID NO: 9321807 - DNA, 22 bp, Homo sapiens
tccttccatggtggggctgctt

SEQ ID NO: 9321808 - DNA, 22 bp, Homo sapiens
tccttccaggtccagggatgtg

SEQ ID NO: 9321809 - DNA, 19 bp, Homo sapiens
tccttccagttcctggggt

SEQ ID NO: 9321810 - DNA, 21 bp, Homo sapiens
tccttcagttctgcactttct

SEQ ID NO: 9321811 - DNA, 22 bp, Homo sapiens
tccttcagttatcacagtactg

SEQ ID NO: 9321812 - DNA, 22 bp, Homo sapiens
tccttcagtgtcccgctcaggt

SEQ ID NO: 9321813 - DNA, 17 bp, Homo sapiens
tccttcagtgcctctgc

SEQ ID NO: 9321814 - DNA, 22 bp, Homo sapiens
tcctgtttttgtaatcgactct

SEQ ID NO: 9321815 - DNA, 22 bp, Homo sapiens
tcctgggctttgtttctctcct

SEQ ID NO: 9321816 - DNA, 22 bp, Homo sapiens
tcctgggcttgctcctccagct

SEQ ID NO: 9321817 - DNA, 22 bp, Homo sapiens
tcctgggcttagtggctaggtc

SEQ ID NO: 9321818 - DNA, 22 bp, Homo sapiens
tcctgggcttcacagactctgt

SEQ ID NO: 9321819 - DNA, 18 bp, Homo sapiens
tcagagcaaacagaagcc

SEQ ID NO: 9321820 - DNA, 22 bp, Homo sapiens
tcagagcaaattcctgtgagcc

SEQ ID NO: 9321821 - DNA, 22 bp, Homo sapiens
tcagagcaacttttcctgcttt

SEQ ID NO: 9321822 - DNA, 22 bp, Homo sapiens
tcagagattcacgtcagtccca

SEQ ID NO: 9321823 - DNA, 21 bp, Homo sapiens
tcagagagtcacagtgaactg

SEQ ID NO: 9321824 - DNA, 22 bp, Homo sapiens
tcaatattcttctttagtagga

SEQ ID NO: 9321825 - DNA, 22 bp, Homo sapiens
tcagagttggcagtaaaacaca

SEQ ID NO: 9321826 - DNA, 22 bp, Homo sapiens
tcagaggatcatgtccctactc

SEQ ID NO: 9321827 - DNA, 22 bp, Homo sapiens
tcagaggagatggttaccaggg

SEQ ID NO: 9321828 - DNA, 22 bp, Homo sapiens
tcagatgagtgctttcagctgc

SEQ ID NO: 9321829 - DNA, 22 bp, Homo sapiens
cagtttttgccattaagagtaa

SEQ ID NO: 9321830 - DNA, 17 bp, Homo sapiens
cataaaacagttctatt

SEQ ID NO: 9321831 - DNA, 22 bp, Homo sapiens
cagtttttcaaaattacatgat

SEQ ID NO: 9321832 - DNA, 22 bp, Homo sapiens
cataaaagccacctatttaaag

SEQ ID NO: 9321833 - DNA, 22 bp, Homo sapiens
cataaaaggtagcagtttgaaa

SEQ ID NO: 9321834 - DNA, 23 bp, Homo sapiens
cataaaatattagtatggtagca

SEQ ID NO: 9321835 - DNA, 18 bp, Homo sapiens
cataattttctttcttta

SEQ ID NO: 9321836 - DNA, 22 bp, Homo sapiens
cataattttccatggtttgcta

SEQ ID NO: 9321837 - DNA, 22 bp, Homo sapiens
cataattaaattctgggcaaga

SEQ ID NO: 9321838 - DNA, 22 bp, Homo sapiens
cataatttcccaagagattgaa

SEQ ID NO: 9321839 - DNA, 22 bp, Homo sapiens
cataattagtcatgttatgcat

SEQ ID NO: 9321840 - DNA, 22 bp, Homo sapiens
cataatatctccgattacttgc

SEQ ID NO: 9321841 - DNA, 22 bp, Homo sapiens
cataatatctccgattacttgc

SEQ ID NO: 9321842 - DNA, 22 bp, Homo sapiens
tcagcaggtgctttgtttactc

SEQ ID NO: 9321843 - DNA, 22 bp, Homo sapiens
tcagcaggtggtgggcaggtga

SEQ ID NO: 9321844 - DNA, 22 bp, Homo sapiens
tcagcaggtgcctcagattctt

SEQ ID NO: 9321845 - DNA, 22 bp, Homo sapiens
tcagcaggtgaacatcatgcca

SEQ ID NO: 9321846 - DNA, 22 bp, Homo sapiens
tcagcaggtctgaggcggggcc

SEQ ID NO: 9321847 - DNA, 22 bp, Homo sapiens
tcagcagggtttgacttctaat

SEQ ID NO: 9321848 - DNA, 22 bp, Homo sapiens
catagaaacttgcagcaagcac

SEQ ID NO: 9321849 - DNA, 22 bp, Homo sapiens
tcaggcctcaagctgctttaag

SEQ ID NO: 9321850 - DNA, 22 bp, Homo sapiens
catagaaatcaggtgagaatct

SEQ ID NO: 9321851 - DNA, 22 bp, Homo sapiens
catctgccactctctcccacca

SEQ ID NO: 9321852 - DNA, 22 bp, Homo sapiens
catctgtcatcaaccctggcta

SEQ ID NO: 9321853 - DNA, 22 bp, Homo sapiens
catctgttaaagtctaatgaaa

SEQ ID NO: 9321854 - DNA, 22 bp, Homo sapiens
catctgtttttgtcaattacat

SEQ ID NO: 9321855 - DNA, 22 bp, Homo sapiens
catctgtttcctaatctgtagc

SEQ ID NO: 9321856 - DNA, 22 bp, Homo sapiens
catctgttgagttctccgtgct

SEQ ID NO: 9321857 - DNA, 22 bp, Homo sapiens
catctgttctatccacgttgct

SEQ ID NO: 9321858 - DNA, 22 bp, Homo sapiens
catctgttcactcggcatgtat

SEQ ID NO: 9321859 - DNA, 22 bp, Homo sapiens
catctgttgcttcctaacaagt

SEQ ID NO: 9321860 - DNA, 22 bp, Homo sapiens
catgaaattgctcctttggtgc

SEQ ID NO: 9321861 - DNA, 22 bp, Homo sapiens
catgaaattgtattggcctcaa

SEQ ID NO: 9321862 - DNA, 22 bp, Homo sapiens
catgaacaaatcctgcgagtat

SEQ ID NO: 9321863 - DNA, 22 bp, Homo sapiens
catgaaatttgaagtacagcaa

SEQ ID NO: 9321864 - DNA, 19 bp, Homo sapiens
tcagtcatatatctgcacc

SEQ ID NO: 9321865 - DNA, 22 bp, Homo sapiens
catctcacagcaaactgctgaa

SEQ ID NO: 9321866 - DNA, 22 bp, Homo sapiens
tcagtgcattgttcattgtagg

SEQ ID NO: 9321867 - DNA, 22 bp, Homo sapiens
tcagtgcattcatgggtggctg

SEQ ID NO: 9321868 - DNA, 22 bp, Homo sapiens
tcagtgccaattctgccatggg

SEQ ID NO: 9321869 - DNA, 22 bp, Homo sapiens
catggcagagaaggggaactgg

SEQ ID NO: 9321870 - DNA, 22 bp, Homo sapiens
catggcagctttgggaggagga

SEQ ID NO: 9321871 - DNA, 22 bp, Homo sapiens
catggcaggaaggacatgcact

SEQ ID NO: 9321872 - DNA, 22 bp, Homo sapiens
catggcagagcctgcaggtggg

SEQ ID NO: 9321873 - DNA, 22 bp, Homo sapiens
catggcagcctgccctgcttgc

SEQ ID NO: 9321874 - DNA, 22 bp, Homo sapiens
catggcagctcctccagtgtga

SEQ ID NO: 9321875 - DNA, 23 bp, Homo sapiens
tccaggagaattccagggcccgg

SEQ ID NO: 9321876 - DNA, 22 bp, Homo sapiens
catggcagtgattcagcctttg

SEQ ID NO: 9321877 - DNA, 22 bp, Homo sapiens
catggcagggctgtgggcaggt

SEQ ID NO: 9321878 - DNA, 22 bp, Homo sapiens
catggcaggcttcttcagcctt

SEQ ID NO: 9321879 - DNA, 22 bp, Homo sapiens
catggcaggaggctgctggcag

SEQ ID NO: 9321880 - DNA, 22 bp, Homo sapiens
catggcaggaggctgctggcag

SEQ ID NO: 9321881 - DNA, 22 bp, Homo sapiens
catgacatctgcttagtatgaa

SEQ ID NO: 9321882 - DNA, 20 bp, Homo sapiens
catgagaagggcagtgtgag

SEQ ID NO: 9321883 - DNA, 22 bp, Homo sapiens
cagggagcagcccctagaagta

SEQ ID NO: 9321884 - DNA, 22 bp, Homo sapiens
cagggagcaggctctgtccatc

SEQ ID NO: 9321885 - DNA, 22 bp, Homo sapiens
cagggagcactgcgagcggcag

SEQ ID NO: 9321886 - DNA, 22 bp, Homo sapiens
taggaggcatttgctcccaggg

SEQ ID NO: 9321887 - DNA, 22 bp, Homo sapiens
taggaggccatccagcctgcct

SEQ ID NO: 9321888 - DNA, 22 bp, Homo sapiens
taggcaggtgtgcactgcccac

SEQ ID NO: 9321889 - DNA, 22 bp, Homo sapiens
taggcagggattagggttgatt

SEQ ID NO: 9321890 - DNA, 22 bp, Homo sapiens
taggcagggattagggttgatt

SEQ ID NO: 9321891 - DNA, 19 bp, Homo sapiens
tagcttcacgtggtctaga

SEQ ID NO: 9321892 - DNA, 22 bp, Homo sapiens
tagcttcagggaaaccactgct

SEQ ID NO: 9321893 - DNA, 22 bp, Homo sapiens
tagcttcagtggccctagacac

SEQ ID NO: 9321894 - DNA, 22 bp, Homo sapiens
tagcttcatgcttcaccacgct

SEQ ID NO: 9321895 - DNA, 22 bp, Homo sapiens
tagcttatcccacagtgcccag

SEQ ID NO: 9321896 - DNA, 22 bp, Homo sapiens
tagcttccctagctaaagaggt

SEQ ID NO: 9321897 - DNA, 22 bp, Homo sapiens
cagggccattggcgtggctgtc

SEQ ID NO: 9321898 - DNA, 22 bp, Homo sapiens
cagggctccatgcagggactcc

SEQ ID NO: 9321899 - DNA, 22 bp, Homo sapiens
caggggtggctgcagcagaggt

SEQ ID NO: 9321900 - DNA, 22 bp, Homo sapiens
cagggtcatggcacctgcacgg

SEQ ID NO: 9321901 - DNA, 22 bp, Homo sapiens
cagggtcaagagactccagcag

SEQ ID NO: 9321902 - DNA, 22 bp, Homo sapiens
cagggtctgaaactgatcacag

SEQ ID NO: 9321903 - DNA, 22 bp, Homo sapiens
caggggctgtttgcctcaggcc

SEQ ID NO: 9321904 - DNA, 17 bp, Homo sapiens
cagggctgtctgcctag

SEQ ID NO: 9321905 - DNA, 22 bp, Homo sapiens
cagggctgtctccaaaggcccc

SEQ ID NO: 9321906 - DNA, 17 bp, Homo sapiens
cagggctgtctgcctag

SEQ ID NO: 9321907 - DNA, 22 bp, Homo sapiens
cagggctgtgcccatcttcccc

SEQ ID NO: 9321908 - DNA, 22 bp, Homo sapiens
cagggctgtggctttgtgctgt

SEQ ID NO: 9321909 - DNA, 22 bp, Homo sapiens
cagggctgtggaaaactggtgc

SEQ ID NO: 9321910 - DNA, 22 bp, Homo sapiens
cagggctccatgcagggactcc

SEQ ID NO: 9321911 - DNA, 22 bp, Homo sapiens
cagggctcttccggagcaggga

SEQ ID NO: 9321912 - DNA, 22 bp, Homo sapiens
cagggctcttccggagcaggga

SEQ ID NO: 9321913 - DNA, 22 bp, Homo sapiens
cagggctgaaatcaaggtgtag

SEQ ID NO: 9321914 - DNA, 18 bp, Homo sapiens
taggctgggggctgtagt

SEQ ID NO: 9321915 - DNA, 18 bp, Homo sapiens
taggctgggggctgtagt

SEQ ID NO: 9321916 - DNA, 18 bp, Homo sapiens
taggctgggggctgtagt

SEQ ID NO: 9321917 - DNA, 22 bp, Homo sapiens
taggctgggggtaggaattgag

SEQ ID NO: 9321918 - DNA, 22 bp, Homo sapiens
taggctgggggtaggaattgag

SEQ ID NO: 9321919 - DNA, 22 bp, Homo sapiens
taggctgggctgagctggacgg

SEQ ID NO: 9321920 - DNA, 22 bp, Homo sapiens
taggctgggctgagctggacgg

SEQ ID NO: 9321921 - DNA, 22 bp, Homo sapiens
taggctgggctgagctggacgg

SEQ ID NO: 9321922 - DNA, 22 bp, Homo sapiens
cagggctgaactgagcttgtga

SEQ ID NO: 9321923 - DNA, 22 bp, Homo sapiens
cagggctgaagaaattcaaaag

SEQ ID NO: 9321924 - DNA, 22 bp, Homo sapiens
taggctgggcctgccttccagg

SEQ ID NO: 9321925 - DNA, 22 bp, Homo sapiens
taggctgggcctgccttccagg

SEQ ID NO: 9321926 - DNA, 22 bp, Homo sapiens
cagggctgtaaattagtgctga

SEQ ID NO: 9321927 - DNA, 22 bp, Homo sapiens
cagggctggtttgtcgaagaaa

SEQ ID NO: 9321928 - DNA, 22 bp, Homo sapiens
cagggctgtaaattagtgctga

SEQ ID NO: 9321929 - DNA, 23 bp, Homo sapiens
cagggctggtagggaagagcgtg

SEQ ID NO: 9321930 - DNA, 22 bp, Homo sapiens
cagggctgggttaaaagcaggg

SEQ ID NO: 9321931 - DNA, 22 bp, Homo sapiens
caggtggggggcttccgagcct

SEQ ID NO: 9321932 - DNA, 22 bp, Homo sapiens
tattatgcataggcaataatgg

SEQ ID NO: 9321933 - DNA, 22 bp, Homo sapiens
caggtgggtacatcacagagac

SEQ ID NO: 9321934 - DNA, 22 bp, Homo sapiens
caggtgggtacatcacagagac

SEQ ID NO: 9321935 - DNA, 22 bp, Homo sapiens
caggtgggtacatcacagagac

SEQ ID NO: 9321936 - DNA, 22 bp, Homo sapiens
caggtgggtacatcacagagac

SEQ ID NO: 9321937 - DNA, 22 bp, Homo sapiens
tattagttgcaaaacattgact

SEQ ID NO: 9321938 - DNA, 22 bp, Homo sapiens
tattagtaatacctgtctcata

SEQ ID NO: 9321939 - DNA, 22 bp, Homo sapiens
tattatgaggtatttggacttt

SEQ ID NO: 9321940 - DNA, 22 bp, Homo sapiens
tattatgaggcttagggatgac

SEQ ID NO: 9321941 - DNA, 22 bp, Homo sapiens
tattatgaggggcagagggcat

SEQ ID NO: 9321942 - DNA, 22 bp, Homo sapiens
tattatgatcccagccctggag

SEQ ID NO: 9321943 - DNA, 22 bp, Homo sapiens
tattatgatcgtgactcaagga

SEQ ID NO: 9321944 - DNA, 22 bp, Homo sapiens
tattatgattcggacgtggcag

SEQ ID NO: 9321945 - DNA, 22 bp, Homo sapiens
tattatgcaaatattcctacct

SEQ ID NO: 9321946 - DNA, 20 bp, Homo sapiens
tattatgacctgtgttctgg

SEQ ID NO: 9321947 - DNA, 22 bp, Homo sapiens
tattatgagccaggtgctgtct

SEQ ID NO: 9321948 - DNA, 22 bp, Homo sapiens
tattatgaggactggtgtaagg

SEQ ID NO: 9321949 - DNA, 22 bp, Homo sapiens
caggtggcatgactgcctacaa

SEQ ID NO: 9321950 - DNA, 22 bp, Homo sapiens
caggtggcattgtcccgccagc

SEQ ID NO: 9321951 - DNA, 22 bp, Homo sapiens
caggtggcagaggtctctggaa

SEQ ID NO: 9321952 - DNA, 22 bp, Homo sapiens
caggtgcttctgtaagaaagac

SEQ ID NO: 9321953 - DNA, 22 bp, Homo sapiens
caggtggatctctaaggactga

SEQ ID NO: 9321954 - DNA, 19 bp, Homo sapiens
caggtggcgctctacaggg

SEQ ID NO: 9321955 - DNA, 23 bp, Homo sapiens
caggtggctccacgaggggtggg

SEQ ID NO: 9321956 - DNA, 22 bp, Homo sapiens
caggtggctaacggcctcatag

SEQ ID NO: 9321957 - DNA, 22 bp, Homo sapiens
caggtccaaggttcctgaatag

SEQ ID NO: 9321958 - DNA, 22 bp, Homo sapiens
caggtccaagagatcctcctac

SEQ ID NO: 9321959 - DNA, 22 bp, Homo sapiens
caggtccaattgcgctaaaatc

SEQ ID NO: 9321960 - DNA, 22 bp, Homo sapiens
caggtccacagcccatcactgc

SEQ ID NO: 9321961 - DNA, 22 bp, Homo sapiens
caggtccaactatttatctgtg

SEQ ID NO: 9321962 - DNA, 22 bp, Homo sapiens
caggtgctcccagagaagtgct

SEQ ID NO: 9321963 - DNA, 22 bp, Homo sapiens
caggtgctctgctgcaggtaag

SEQ ID NO: 9321964 - DNA, 22 bp, Homo sapiens
caggtgctgcgtggcggagctg

SEQ ID NO: 9321965 - DNA, 22 bp, Homo sapiens
caggtgctgtcctgcacatgtc

SEQ ID NO: 9321966 - DNA, 22 bp, Homo sapiens
caggtgcctcaggatgagacaa

SEQ ID NO: 9321967 - DNA, 22 bp, Homo sapiens
caggtcaaaggttagttatgtt

SEQ ID NO: 9321968 - DNA, 22 bp, Homo sapiens
caggtcagaggtagatgagatg

SEQ ID NO: 9321969 - DNA, 22 bp, Homo sapiens
caggtacacaggacaaagtact

SEQ ID NO: 9321970 - DNA, 22 bp, Homo sapiens
caggtagaggctgccatcagct

SEQ ID NO: 9321971 - DNA, 22 bp, Homo sapiens
cagtcatttggcacctactgta

SEQ ID NO: 9321972 - DNA, 22 bp, Homo sapiens
cagtcattggctaaagctccct

SEQ ID NO: 9321973 - DNA, 22 bp, Homo sapiens
cagtcacttacaaaaatataat

SEQ ID NO: 9321974 - DNA, 22 bp, Homo sapiens
tatttgtttctagtggcagcaa

SEQ ID NO: 9321975 - DNA, 22 bp, Homo sapiens
tatttgtttctagtggcagcaa

SEQ ID NO: 9321976 - DNA, 22 bp, Homo sapiens
cagtcacataggtatacacata

SEQ ID NO: 9321977 - DNA, 17 bp, Homo sapiens
cagtcacaggtcttttc

SEQ ID NO: 9321978 - DNA, 22 bp, Homo sapiens
cagtcacacaagtggacttggg

SEQ ID NO: 9321979 - DNA, 22 bp, Homo sapiens
cagtcacattgccctgcattta

SEQ ID NO: 9321980 - DNA, 22 bp, Homo sapiens
caggtgggtgtatgaatgcaaa

SEQ ID NO: 9321981 - DNA, 22 bp, Homo sapiens
caggtgggtgtatgaatgcaaa

SEQ ID NO: 9321982 - DNA, 22 bp, Homo sapiens
caggtgggtgtatgaatgcaaa

SEQ ID NO: 9321983 - DNA, 22 bp, Homo sapiens
tcaaaaatgttttatattggta

SEQ ID NO: 9321984 - DNA, 22 bp, Homo sapiens
tattttatctgccagagtggag

SEQ ID NO: 9321985 - DNA, 19 bp, Homo sapiens
tcaaaacacaaatggttga

SEQ ID NO: 9321986 - DNA, 22 bp, Homo sapiens
tcaagcagcagatcaagagcta

SEQ ID NO: 9321987 - DNA, 22 bp, Homo sapiens
tcaagcacttacagtctggtaa

SEQ ID NO: 9321988 - DNA, 22 bp, Homo sapiens
tcaaaacccagccatcaggact

SEQ ID NO: 9321989 - DNA, 22 bp, Homo sapiens
taatgttacactgcatggttca

SEQ ID NO: 9321990 - DNA, 22 bp, Homo sapiens
caggcatgcttctgtctgggca

SEQ ID NO: 9321991 - DNA, 22 bp, Homo sapiens
caggcatgcttctgtctgggca

SEQ ID NO: 9321992 - DNA, 22 bp, Homo sapiens
caggcatgagccaggcccctcc

SEQ ID NO: 9321993 - DNA, 22 bp, Homo sapiens
caggccaggtggcaggcaaaac

SEQ ID NO: 9321994 - DNA, 22 bp, Homo sapiens
caggccaggtggcaggcaaaac

SEQ ID NO: 9321995 - DNA, 22 bp, Homo sapiens
caggccagtgggaaatagggat

SEQ ID NO: 9321996 - DNA, 22 bp, Homo sapiens
caggccagggttgagaagagaa

SEQ ID NO: 9321997 - DNA, 22 bp, Homo sapiens
caggccaggtgctctagaatca

SEQ ID NO: 9321998 - DNA, 19 bp, Homo sapiens
caggccagtgtcagggggc

SEQ ID NO: 9321999 - DNA, 22 bp, Homo sapiens
caggccattaccgctgagaccc

SEQ ID NO: 9322000 - DNA, 22 bp, Homo sapiens
caggcccacgaggcacacagag

SEQ ID NO: 9322001 - DNA, 22 bp, Homo sapiens
tacaaaaaattgatactgacga

SEQ ID NO: 9322002 - DNA, 22 bp, Homo sapiens
caggcacccagcccagtcgcac

SEQ ID NO: 9322003 - DNA, 22 bp, Homo sapiens
caggcaccacactaggggctga

SEQ ID NO: 9322004 - DNA, 22 bp, Homo sapiens
caggcaccacactaggggctga

SEQ ID NO: 9322005 - DNA, 22 bp, Homo sapiens
caggcacctttgtgcatgggca

SEQ ID NO: 9322006 - DNA, 22 bp, Homo sapiens
caggcacctcacgtgggtccca

SEQ ID NO: 9322007 - DNA, 22 bp, Homo sapiens
caggcacctgtgtgtctcaggg

SEQ ID NO: 9322008 - DNA, 22 bp, Homo sapiens
caggcacctcacgtgggtccca

SEQ ID NO: 9322009 - DNA, 22 bp, Homo sapiens
caggcagagttagagcaactgg

SEQ ID NO: 9322010 - DNA, 22 bp, Homo sapiens
caggcagagctgaagatagatg

SEQ ID NO: 9322011 - DNA, 22 bp, Homo sapiens
caggcagagccaatcgtggggt

SEQ ID NO: 9322012 - DNA, 22 bp, Homo sapiens
caggcacctttgtgcatgggca

SEQ ID NO: 9322013 - DNA, 22 bp, Homo sapiens
caggcagatgctgacaagagtt

SEQ ID NO: 9322014 - DNA, 22 bp, Homo sapiens
caggcagagttagtgatttagg

SEQ ID NO: 9322015 - DNA, 22 bp, Homo sapiens
caggcagatatgttcgctttaa

SEQ ID NO: 9322016 - DNA, 21 bp, Homo sapiens
taataattccactacagagta

SEQ ID NO: 9322017 - DNA, 22 bp, Homo sapiens
taataattggcaatgttgagca

SEQ ID NO: 9322018 - DNA, 22 bp, Homo sapiens
caggcagatttgctgccctcca

SEQ ID NO: 9322019 - DNA, 22 bp, Homo sapiens
caggcagcagaggagtgtggga

SEQ ID NO: 9322020 - DNA, 22 bp, Homo sapiens
gtgcttcctgtattgattccat

SEQ ID NO: 9322021 - DNA, 22 bp, Homo sapiens
gtgcttcctcagtgtttaagga

SEQ ID NO: 9322022 - DNA, 22 bp, Homo sapiens
gtgcttcctccttaaactgtca

SEQ ID NO: 9322023 - DNA, 20 bp, Homo sapiens
gtgcttcctcgcaagttgca

SEQ ID NO: 9322024 - DNA, 22 bp, Homo sapiens
gtgcttcctctgccaacactct

SEQ ID NO: 9322025 - DNA, 22 bp, Homo sapiens
gtgcttcctgcctggtgccttt

SEQ ID NO: 9322026 - DNA, 22 bp, Homo sapiens
gtgcttcccattagaactgtga

SEQ ID NO: 9322027 - DNA, 22 bp, Homo sapiens
gtgcttccccaagccacagcct

SEQ ID NO: 9322028 - DNA, 22 bp, Homo sapiens
gtgcttcctaggtaagtaggta

SEQ ID NO: 9322029 - DNA, 22 bp, Homo sapiens
gtgcttcctcagaggttcccat

SEQ ID NO: 9322030 - DNA, 22 bp, Homo sapiens
gtgcttccatctagagggtcac

SEQ ID NO: 9322031 - DNA, 22 bp, Homo sapiens
gtgctgttttgagtgctacccc

SEQ ID NO: 9322032 - DNA, 22 bp, Homo sapiens
cagctcaagtttcccaggtcag

SEQ ID NO: 9322033 - DNA, 22 bp, Homo sapiens
cagctcagacgcaggtcgagca

SEQ ID NO: 9322034 - DNA, 22 bp, Homo sapiens
taaggcaggaactggctgtttt

SEQ ID NO: 9322035 - DNA, 23 bp, Homo sapiens
cagctcagcacataggaggtact

SEQ ID NO: 9322036 - DNA, 22 bp, Homo sapiens
taaggcagcctcagggtagggt

SEQ ID NO: 9322037 - DNA, 22 bp, Homo sapiens
taaggcagctgagcttctaaca

SEQ ID NO: 9322038 - DNA, 22 bp, Homo sapiens
taaggcagcctcagggtagggt

SEQ ID NO: 9322039 - DNA, 23 bp, Homo sapiens
cagctcagagtgtgtcctgtttc

SEQ ID NO: 9322040 - DNA, 22 bp, Homo sapiens
taagtcctagatgattcacaga

SEQ ID NO: 9322041 - DNA, 22 bp, Homo sapiens
caggcgtcactgccacgggtat

SEQ ID NO: 9322042 - DNA, 22 bp, Homo sapiens
caggctagattggggccagtag

SEQ ID NO: 9322043 - DNA, 22 bp, Homo sapiens
caggctacatttgctctgagaa

SEQ ID NO: 9322044 - DNA, 22 bp, Homo sapiens
caggctcaagccctgcttatat

SEQ ID NO: 9322045 - DNA, 22 bp, Homo sapiens
tactttacagtattagataatt

SEQ ID NO: 9322046 - DNA, 22 bp, Homo sapiens
tactttatattgtggctggcca

SEQ ID NO: 9322047 - DNA, 18 bp, Homo sapiens
tactttattccccctcca

SEQ ID NO: 9322048 - DNA, 22 bp, Homo sapiens
caggccttttttcctgcagtgt

SEQ ID NO: 9322049 - DNA, 22 bp, Homo sapiens
caggccttgtcaagaaaatgcc

SEQ ID NO: 9322050 - DNA, 20 bp, Homo sapiens
caggcctctgggggccctgg

SEQ ID NO: 9322051 - DNA, 20 bp, Homo sapiens
caggcctctgggggccctgg

SEQ ID NO: 9322052 - DNA, 19 bp, Homo sapiens
caggcctctggtctgctgt

SEQ ID NO: 9322053 - DNA, 22 bp, Homo sapiens
caggcctctccttagtctggca

SEQ ID NO: 9322054 - DNA, 22 bp, Homo sapiens
caggcctctccttagtctggca

SEQ ID NO: 9322055 - DNA, 22 bp, Homo sapiens
caggcctctatggtcagctgag

SEQ ID NO: 9322056 - DNA, 22 bp, Homo sapiens
caggcccagcccttagccaggt

SEQ ID NO: 9322057 - DNA, 22 bp, Homo sapiens
caggcctgatacactgaactct

SEQ ID NO: 9322058 - DNA, 22 bp, Homo sapiens
caggcctgagacatctgagata

SEQ ID NO: 9322059 - DNA, 22 bp, Homo sapiens
caggcctgaccctgagcttcac

SEQ ID NO: 9322060 - DNA, 22 bp, Homo sapiens
caggcctcttccatgcagcagc

SEQ ID NO: 9322061 - DNA, 22 bp, Homo sapiens
cagggacaaagtgagaaaggaa

SEQ ID NO: 9322062 - DNA, 22 bp, Homo sapiens
caggctttcaggacagcgagcc

SEQ ID NO: 9322063 - DNA, 22 bp, Homo sapiens
caggcttgtgtctcagctgcag

SEQ ID NO: 9322064 - DNA, 22 bp, Homo sapiens
caggcttggcagggaggctggt

SEQ ID NO: 9322065 - DNA, 22 bp, Homo sapiens
caggcttggagggcagtggcat

SEQ ID NO: 9322066 - DNA, 22 bp, Homo sapiens
caggctgggaacgccacccgct

SEQ ID NO: 9322067 - DNA, 22 bp, Homo sapiens
caggctgggaacgccacccgct

SEQ ID NO: 9322068 - DNA, 22 bp, Homo sapiens
caggctggcaatgcgtcaagca

SEQ ID NO: 9322069 - DNA, 22 bp, Homo sapiens
caggctggcaatgcgtcaagca

SEQ ID NO: 9322070 - DNA, 22 bp, Homo sapiens
caggctgggactgacccctgct

SEQ ID NO: 9322071 - DNA, 22 bp, Homo sapiens
caggctgggactgacccctgct

SEQ ID NO: 9322072 - DNA, 22 bp, Homo sapiens
tagaaaatggccaagcaggact

SEQ ID NO: 9322073 - DNA, 22 bp, Homo sapiens
caggctgccgaggctgcagaat

SEQ ID NO: 9322074 - DNA, 22 bp, Homo sapiens
caggctgccctagcttggacat

SEQ ID NO: 9322075 - DNA, 22 bp, Homo sapiens
caggctgcagtgcagtggctat

SEQ ID NO: 9322076 - DNA, 22 bp, Homo sapiens
caggctgccaaggctggggagg

SEQ ID NO: 9322077 - DNA, 22 bp, Homo sapiens
caggctggagttcagtggtgtg

SEQ ID NO: 9322078 - DNA, 22 bp, Homo sapiens
caggctggagttcagtggtgtg

SEQ ID NO: 9322079 - DNA, 22 bp, Homo sapiens
caggctggagttcagtggtgtg

SEQ ID NO: 9322080 - DNA, 22 bp, Homo sapiens
caggctggagtgcagtggtgcc

SEQ ID NO: 9322081 - DNA, 22 bp, Homo sapiens
caggctgccgtgaagcaggcct

SEQ ID NO: 9322082 - DNA, 22 bp, Homo sapiens
ttaggcatgcaagattaagctc

SEQ ID NO: 9322083 - DNA, 22 bp, Homo sapiens
ttaggctactgtgactttcctg

SEQ ID NO: 9322084 - DNA, 17 bp, Homo sapiens
cctttctctttcatctc

SEQ ID NO: 9322085 - DNA, 17 bp, Homo sapiens
cctttctctttcatctc

SEQ ID NO: 9322086 - DNA, 22 bp, Homo sapiens
cctttctctatcgacccatcgc

SEQ ID NO: 9322087 - DNA, 22 bp, Homo sapiens
cctttcaaattacatgactgct

SEQ ID NO: 9322088 - DNA, 22 bp, Homo sapiens
cctttattcaattagtcctaat

SEQ ID NO: 9322089 - DNA, 22 bp, Homo sapiens
ttcatctgctggtttttggcat

SEQ ID NO: 9322090 - DNA, 22 bp, Homo sapiens
ttcatctgcttcttcctattcc

SEQ ID NO: 9322091 - DNA, 22 bp, Homo sapiens
ttcatctgcttcttgattttgc

SEQ ID NO: 9322092 - DNA, 21 bp, Homo sapiens
ttcatctggccgtattccagg

SEQ ID NO: 9322093 - DNA, 22 bp, Homo sapiens
ttcatctggaatttatgttata

SEQ ID NO: 9322094 - DNA, 22 bp, Homo sapiens
ttcatctggaagttcccaaggc

SEQ ID NO: 9322095 - DNA, 22 bp, Homo sapiens
ttcatctgtagcatcttccaat

SEQ ID NO: 9322096 - DNA, 22 bp, Homo sapiens
ttcatctgtacgccaagtactc

SEQ ID NO: 9322097 - DNA, 22 bp, Homo sapiens
ttcatctggtctagtttttagt

SEQ ID NO: 9322098 - DNA, 22 bp, Homo sapiens
ttcatgaaaaggtctatttctt

SEQ ID NO: 9322099 - DNA, 22 bp, Homo sapiens
ttcatctgtagtttttccaagg

SEQ ID NO: 9322100 - DNA, 22 bp, Homo sapiens
cggtccaggatggctggcaagc

SEQ ID NO: 9322101 - DNA, 22 bp, Homo sapiens
cggtccagagctagttcattgc

SEQ ID NO: 9322102 - DNA, 22 bp, Homo sapiens
cggtccagggaacgcccccgcc

SEQ ID NO: 9322103 - DNA, 22 bp, Homo sapiens
cggtctcccgtgtgtgtgcgct

SEQ ID NO: 9322104 - DNA, 22 bp, Homo sapiens
cggtggtctcctgcgacatgaa

SEQ ID NO: 9322105 - DNA, 22 bp, Homo sapiens
cggtggtcataagtggctggcg

SEQ ID NO: 9322106 - DNA, 22 bp, Homo sapiens
cggtggtcacaaacaatgacta

SEQ ID NO: 9322107 - DNA, 22 bp, Homo sapiens
cggtggtcattatactcctttc

SEQ ID NO: 9322108 - DNA, 22 bp, Homo sapiens
cggtggtcccaagagggtggca

SEQ ID NO: 9322109 - DNA, 15 bp, Homo sapiens
ctaaaatccctgggc

SEQ ID NO: 9322110 - DNA, 22 bp, Homo sapiens
ctaaaattacctaccagtttag

SEQ ID NO: 9322111 - DNA, 22 bp, Homo sapiens
ttcatgaatatattgaattagc

SEQ ID NO: 9322112 - DNA, 22 bp, Homo sapiens
ttcatgaacgaacatatgtata

SEQ ID NO: 9322113 - DNA, 22 bp, Homo sapiens
ttcatgaaagtgtatcttgtgg

SEQ ID NO: 9322114 - DNA, 22 bp, Homo sapiens
ttcagggagagcgggacgggtg

SEQ ID NO: 9322115 - DNA, 22 bp, Homo sapiens
ttcaggcccaacgcacagcttc

SEQ ID NO: 9322116 - DNA, 22 bp, Homo sapiens
cggggcttggaccagccacccc

SEQ ID NO: 9322117 - DNA, 22 bp, Homo sapiens
ttcagggcagacagaagagatg

SEQ ID NO: 9322118 - DNA, 22 bp, Homo sapiens
ttcagggcagacagaagagatg

SEQ ID NO: 9322119 - DNA, 22 bp, Homo sapiens
ttcagggcagctagaaccagga

SEQ ID NO: 9322120 - DNA, 22 bp, Homo sapiens
ttcagggcagctagaaccagga

SEQ ID NO: 9322121 - DNA, 22 bp, Homo sapiens
ttcagggcagagagttcaggga

SEQ ID NO: 9322122 - DNA, 22 bp, Homo sapiens
ttcagggcatgagggacacatc

SEQ ID NO: 9322123 - DNA, 22 bp, Homo sapiens
ttcagcaaaatatctcagatag

SEQ ID NO: 9322124 - DNA, 22 bp, Homo sapiens
ttcaggattctttcagactggg

SEQ ID NO: 9322125 - DNA, 22 bp, Homo sapiens
ttcagaggctgtatgactagat

SEQ ID NO: 9322126 - DNA, 22 bp, Homo sapiens
ttcagaggacaaccagccatct

SEQ ID NO: 9322127 - DNA, 22 bp, Homo sapiens
ttcacacagcaactgtatgaat

SEQ ID NO: 9322128 - DNA, 22 bp, Homo sapiens
ttcagagggttttagggtcaga

SEQ ID NO: 9322129 - DNA, 22 bp, Homo sapiens
ttcagagggacattcaagggaa

SEQ ID NO: 9322130 - DNA, 22 bp, Homo sapiens
ttcagaggggctaagtacttgc

SEQ ID NO: 9322131 - DNA, 22 bp, Homo sapiens
ttcagaggggctaagtacttgc

SEQ ID NO: 9322132 - DNA, 22 bp, Homo sapiens
ttcagaggtaagggtctcagaa

SEQ ID NO: 9322133 - DNA, 22 bp, Homo sapiens
ttcagaggtagagaggatcttg

SEQ ID NO: 9322134 - DNA, 20 bp, Homo sapiens
ttcagaggtgaagttgtggt

SEQ ID NO: 9322135 - DNA, 22 bp, Homo sapiens
ttcagaggttagagcagtggga

SEQ ID NO: 9322136 - DNA, 22 bp, Homo sapiens
ttcagaggtgggctgagaggat

SEQ ID NO: 9322137 - DNA, 22 bp, Homo sapiens
ttcagaggtagagaggatcttg

SEQ ID NO: 9322138 - DNA, 22 bp, Homo sapiens
ttcagaggtagagaggatcttg

SEQ ID NO: 9322139 - DNA, 22 bp, Homo sapiens
ttcagaggtgggctgagaggat

SEQ ID NO: 9322140 - DNA, 22 bp, Homo sapiens
ttcagaggttagagcagtggga

SEQ ID NO: 9322141 - DNA, 22 bp, Homo sapiens
ttcagaggtttccgggccatgc

SEQ ID NO: 9322142 - DNA, 22 bp, Homo sapiens
ctacttccaggggtggggctca

SEQ ID NO: 9322143 - DNA, 22 bp, Homo sapiens
ctagaaaaatactttattgtga

SEQ ID NO: 9322144 - DNA, 22 bp, Homo sapiens
ctactgccattgtctctgccat

SEQ ID NO: 9322145 - DNA, 22 bp, Homo sapiens
ctactgccattgtctctgccat

SEQ ID NO: 9322146 - DNA, 22 bp, Homo sapiens
ctactgtaatagatgaatttga

SEQ ID NO: 9322147 - DNA, 22 bp, Homo sapiens
ctaccttcaagttcctccctct

SEQ ID NO: 9322148 - DNA, 22 bp, Homo sapiens
ttcctgggctgcagagagcacc

SEQ ID NO: 9322149 - DNA, 22 bp, Homo sapiens
ttcctgggctttcccctctggt

SEQ ID NO: 9322150 - DNA, 21 bp, Homo sapiens
ttcctggggaaggagctgcct

SEQ ID NO: 9322151 - DNA, 22 bp, Homo sapiens
ctacagagaattgtgtgatttt

SEQ ID NO: 9322152 - DNA, 22 bp, Homo sapiens
ttcctgggactggagcagccca

SEQ ID NO: 9322153 - DNA, 22 bp, Homo sapiens
ttcctgggaggctgtgtacttg

SEQ ID NO: 9322154 - DNA, 22 bp, Homo sapiens
ttcctgggattattgtcaagca

SEQ ID NO: 9322155 - DNA, 22 bp, Homo sapiens
ttcctgggagctagccacatct

SEQ ID NO: 9322156 - DNA, 22 bp, Homo sapiens
ttcctgggctctggctggccta

SEQ ID NO: 9322157 - DNA, 22 bp, Homo sapiens
ttcctgggccttaaatcttttg

SEQ ID NO: 9322158 - DNA, 22 bp, Homo sapiens
ttcctgggcaggacgagagtct

SEQ ID NO: 9322159 - DNA, 22 bp, Homo sapiens
ctacagagttcacaggatttta

SEQ ID NO: 9322160 - DNA, 22 bp, Homo sapiens
ctacaggctcagggagccctct

SEQ ID NO: 9322161 - DNA, 22 bp, Homo sapiens
ctatgcttcagagttccaggtg

SEQ ID NO: 9322162 - DNA, 22 bp, Homo sapiens
ctatgcttacctctatggatac

SEQ ID NO: 9322163 - DNA, 22 bp, Homo sapiens
ctatgctttagtaatattctca

SEQ ID NO: 9322164 - DNA, 22 bp, Homo sapiens
ctatggctcaattctagtggtt

SEQ ID NO: 9322165 - DNA, 22 bp, Homo sapiens
ctattacaatctgctactatga

SEQ ID NO: 9322166 - DNA, 22 bp, Homo sapiens
ctagcacagtatggtatcagat

SEQ ID NO: 9322167 - DNA, 22 bp, Homo sapiens
ctagccataggaagacacagaa

SEQ ID NO: 9322168 - DNA, 22 bp, Homo sapiens
ctagccagactcaagggccacc

SEQ ID NO: 9322169 - DNA, 22 bp, Homo sapiens
ctagccagatgattcccaaata

SEQ ID NO: 9322170 - DNA, 22 bp, Homo sapiens
ctatatatatcatcttccagtt

SEQ ID NO: 9322171 - DNA, 22 bp, Homo sapiens
ctagccaacaccttattttctg

SEQ ID NO: 9322172 - DNA, 22 bp, Homo sapiens
ctagcacagcccattcagtcta

SEQ ID NO: 9322173 - DNA, 22 bp, Homo sapiens
ctagcacagcccattcagtcta

SEQ ID NO: 9322174 - DNA, 19 bp, Homo sapiens
ctattagcttgggcatcat

SEQ ID NO: 9322175 - DNA, 22 bp, Homo sapiens
ctattacatttctggacattca

SEQ ID NO: 9322176 - DNA, 22 bp, Homo sapiens
ctattattatcctaatttctgt

SEQ ID NO: 9322177 - DNA, 22 bp, Homo sapiens
ctcaagtgtgagttttaaagtc

SEQ ID NO: 9322178 - DNA, 22 bp, Homo sapiens
ctcaagttggcatgaacaaatt

SEQ ID NO: 9322179 - DNA, 22 bp, Homo sapiens
ctcacagggttctatcgaagag

SEQ ID NO: 9322180 - DNA, 22 bp, Homo sapiens
ctcacaggcatctcatcaggct

SEQ ID NO: 9322181 - DNA, 22 bp, Homo sapiens
ctcacaggcggtaattcaggga

SEQ ID NO: 9322182 - DNA, 22 bp, Homo sapiens
ctcacaggcatctcatcaggct

SEQ ID NO: 9322183 - DNA, 22 bp, Homo sapiens
ctcacagagcctctgtgtcttc

SEQ ID NO: 9322184 - DNA, 22 bp, Homo sapiens
ctcacagatatttgcttcaggt

SEQ ID NO: 9322185 - DNA, 22 bp, Homo sapiens
ctcacagatgatgtctatgtgg

SEQ ID NO: 9322186 - DNA, 22 bp, Homo sapiens
ctcacagatgttctcctttagg

SEQ ID NO: 9322187 - DNA, 22 bp, Homo sapiens
tggggctgtgagactacaggat

SEQ ID NO: 9322188 - DNA, 22 bp, Homo sapiens
tggggctgtgagactacaggat

SEQ ID NO: 9322189 - DNA, 22 bp, Homo sapiens
tggggctgtggattctcacgaa

SEQ ID NO: 9322190 - DNA, 22 bp, Homo sapiens
cctgggaggctgaggctgcagt

SEQ ID NO: 9322191 - DNA, 19 bp, Homo sapiens
cctgggagtcagctgaagg

SEQ ID NO: 9322192 - DNA, 22 bp, Homo sapiens
cctgggagtgtcagacttgctt

SEQ ID NO: 9322193 - DNA, 22 bp, Homo sapiens
cctgggagtgtcagacttgctt

SEQ ID NO: 9322194 - DNA, 22 bp, Homo sapiens
cctgggatgctgtcctcatcta

SEQ ID NO: 9322195 - DNA, 22 bp, Homo sapiens
cctgggatgctgtcctcatcta

SEQ ID NO: 9322196 - DNA, 22 bp, Homo sapiens
cctgggagtggcactcacagca

SEQ ID NO: 9322197 - DNA, 22 bp, Homo sapiens
cctgggcaacatagtgagacct

SEQ ID NO: 9322198 - DNA, 22 bp, Homo sapiens
cctgggcaacatagtgagacct

SEQ ID NO: 9322199 - DNA, 22 bp, Homo sapiens
cctgggcaacatagtgagaccc

SEQ ID NO: 9322200 - DNA, 22 bp, Homo sapiens
cctgggcaacatagtgagaccc

SEQ ID NO: 9322201 - DNA, 22 bp, Homo sapiens
tgtgtattaatgtttgtatatg

SEQ ID NO: 9322202 - DNA, 20 bp, Homo sapiens
cctggtgtatttcctggggt

SEQ ID NO: 9322203 - DNA, 22 bp, Homo sapiens
cctgggtgtcatgggcagctgg

SEQ ID NO: 9322204 - DNA, 22 bp, Homo sapiens
tgttcagttaacacagacacca

SEQ ID NO: 9322205 - DNA, 23 bp, Homo sapiens
tgttacaagcaccacaggtggct

SEQ ID NO: 9322206 - DNA, 22 bp, Homo sapiens
tgttacaactatagatcccaag

SEQ ID NO: 9322207 - DNA, 22 bp, Homo sapiens
tgttaatatactaaaatccact

SEQ ID NO: 9322208 - DNA, 21 bp, Homo sapiens
cctgggctgtggtttggagac

SEQ ID NO: 9322209 - DNA, 22 bp, Homo sapiens
cctgggctgggcgtctcatggg

SEQ ID NO: 9322210 - DNA, 22 bp, Homo sapiens
cctgggcttacgacctctgact

SEQ ID NO: 9322211 - DNA, 22 bp, Homo sapiens
cctgggcttccacgagcagagg

SEQ ID NO: 9322212 - DNA, 22 bp, Homo sapiens
cctgggctgctcatggggatga

SEQ ID NO: 9322213 - DNA, 22 bp, Homo sapiens
cctgggctgctcatggggatga

SEQ ID NO: 9322214 - DNA, 22 bp, Homo sapiens
cctgggctgctcatggggatga

SEQ ID NO: 9322215 - DNA, 22 bp, Homo sapiens
cctgggctgaagtcaagtgtgg

SEQ ID NO: 9322216 - DNA, 22 bp, Homo sapiens
cctgggctggagtacagcagtg

SEQ ID NO: 9322217 - DNA, 22 bp, Homo sapiens
cctgggctggagtacagcagtg

SEQ ID NO: 9322218 - DNA, 22 bp, Homo sapiens
cctgggctctgtcagaattggg

SEQ ID NO: 9322219 - DNA, 22 bp, Homo sapiens
cctgggctgcatgatggcattt

SEQ ID NO: 9322220 - DNA, 22 bp, Homo sapiens
cctgggctcaagtgatcctcct

SEQ ID NO: 9322221 - DNA, 22 bp, Homo sapiens
cctgggctctgaggagggagtc

SEQ ID NO: 9322222 - DNA, 22 bp, Homo sapiens
cctgggctctgaggagggagtc

SEQ ID NO: 9322223 - DNA, 22 bp, Homo sapiens
cctgggctctgaggagggagtc

SEQ ID NO: 9322224 - DNA, 22 bp, Homo sapiens
cctgggctctgaggagggagtc

SEQ ID NO: 9322225 - DNA, 22 bp, Homo sapiens
cctgtgctggctttattctcag

SEQ ID NO: 9322226 - DNA, 21 bp, Homo sapiens
ttaaagctatggtagtgggct

SEQ ID NO: 9322227 - DNA, 22 bp, Homo sapiens
ttaaaggatctttgtcattaat

SEQ ID NO: 9322228 - DNA, 22 bp, Homo sapiens
ttaaaggaattgagtttcttgt

SEQ ID NO: 9322229 - DNA, 17 bp, Homo sapiens
ttaaaggatgctctctc

SEQ ID NO: 9322230 - DNA, 22 bp, Homo sapiens
cctgtgctcccatagcttctgt

SEQ ID NO: 9322231 - DNA, 23 bp, Homo sapiens
cctgtctgtgctgggtggacaca

SEQ ID NO: 9322232 - DNA, 22 bp, Homo sapiens
cctgtctgtttcattccttgtt

SEQ ID NO: 9322233 - DNA, 22 bp, Homo sapiens
cctgtctggccttccacggggg

SEQ ID NO: 9322234 - DNA, 22 bp, Homo sapiens
cctgtctgtcctctcatgagcc

SEQ ID NO: 9322235 - DNA, 18 bp, Homo sapiens
cctgtctggggtccccac

SEQ ID NO: 9322236 - DNA, 22 bp, Homo sapiens
cctgtctggggactccctgggt

SEQ ID NO: 9322237 - DNA, 22 bp, Homo sapiens
cctgtctggtgagggggttgca

SEQ ID NO: 9322238 - DNA, 22 bp, Homo sapiens
cctgtctgcatgatccctgcca

SEQ ID NO: 9322239 - DNA, 22 bp, Homo sapiens
cctgtctgcatgagtgagcata

SEQ ID NO: 9322240 - DNA, 22 bp, Homo sapiens
cctgtctctttcaatctgagag

SEQ ID NO: 9322241 - DNA, 20 bp, Homo sapiens
cctgtctgcaatggaggtca

SEQ ID NO: 9322242 - DNA, 22 bp, Homo sapiens
cctgtctctgttaccacatttg

SEQ ID NO: 9322243 - DNA, 22 bp, Homo sapiens
cctgtctctgttaccacatttg

SEQ ID NO: 9322244 - DNA, 22 bp, Homo sapiens
ccttcctcatccatttctcttg

SEQ ID NO: 9322245 - DNA, 22 bp, Homo sapiens
ccttccctaaagcgtcgcttag

SEQ ID NO: 9322246 - DNA, 17 bp, Homo sapiens
ccttcctcatctccttc

SEQ ID NO: 9322247 - DNA, 17 bp, Homo sapiens
ccttcctcatctccttc

SEQ ID NO: 9322248 - DNA, 22 bp, Homo sapiens
ccttcagtcccatgtttctctt

SEQ ID NO: 9322249 - DNA, 22 bp, Homo sapiens
ccttcaggtcatatatgtcaga

SEQ ID NO: 9322250 - DNA, 22 bp, Homo sapiens
ccttcccatgcagcctgtctga

SEQ ID NO: 9322251 - DNA, 22 bp, Homo sapiens
ccttccccaggtgctcactgtc

SEQ ID NO: 9322252 - DNA, 22 bp, Homo sapiens
cctgtgtgctgatgacgacaga

SEQ ID NO: 9322253 - DNA, 23 bp, Homo sapiens
cctgtgtgcccttaattcacagc

SEQ ID NO: 9322254 - DNA, 22 bp, Homo sapiens
cctgtgtgcacacgaggccatg

SEQ ID NO: 9322255 - DNA, 20 bp, Homo sapiens
cctgtgtggtttgcactaca

SEQ ID NO: 9322256 - DNA, 22 bp, Homo sapiens
cctgtgtggtagccagcggtgc

SEQ ID NO: 9322257 - DNA, 20 bp, Homo sapiens
cctgtgtggccagctgaggc

SEQ ID NO: 9322258 - DNA, 22 bp, Homo sapiens
cctgtgtggaaaccgcatgacg

SEQ ID NO: 9322259 - DNA, 22 bp, Homo sapiens
ccttcgagatttaaacactgat

SEQ ID NO: 9322260 - DNA, 21 bp, Homo sapiens
ccttctccacagggtctccgg

SEQ ID NO: 9322261 - DNA, 22 bp, Homo sapiens
ccttctcagccccagctcccgc

SEQ ID NO: 9322262 - DNA, 23 bp, Homo sapiens
ttacttttgcaccaacctaatat

SEQ ID NO: 9322263 - DNA, 21 bp, Homo sapiens
ttactaaacaaaacatgcagg

SEQ ID NO: 9322264 - DNA, 22 bp, Homo sapiens
cctttattcaattagtcctaat

SEQ ID NO: 9322265 - DNA, 22 bp, Homo sapiens
ctgcaggcatttattcatgcaa

SEQ ID NO: 9322266 - DNA, 22 bp, Homo sapiens
ctgcactgacttccccggctgc

SEQ ID NO: 9322267 - DNA, 22 bp, Homo sapiens
ctgcactgagcatctaacctta

SEQ ID NO: 9322268 - DNA, 22 bp, Homo sapiens
ctgcaccctcaaactcctgggc

SEQ ID NO: 9322269 - DNA, 19 bp, Homo sapiens
ctgcagggatgtgcagagt

SEQ ID NO: 9322270 - DNA, 22 bp, Homo sapiens
ctgcagggatgtgaggcccgtt

SEQ ID NO: 9322271 - DNA, 22 bp, Homo sapiens
ctgcagggcagaagggcataga

SEQ ID NO: 9322272 - DNA, 22 bp, Homo sapiens
ctgcagggcagaagggcataga

SEQ ID NO: 9322273 - DNA, 22 bp, Homo sapiens
ctgcagggcagggcctcctggc

SEQ ID NO: 9322274 - DNA, 22 bp, Homo sapiens
ctgcagggcttaccttgctctg

SEQ ID NO: 9322275 - DNA, 22 bp, Homo sapiens
ctgcaggggcagtccacttcct

SEQ ID NO: 9322276 - DNA, 22 bp, Homo sapiens
ctgcagggcccaaggtcaacgg

SEQ ID NO: 9322277 - DNA, 20 bp, Homo sapiens
ctgcaaaatgacattaggaa

SEQ ID NO: 9322278 - DNA, 22 bp, Homo sapiens
ctgcacagctggccagggagag

SEQ ID NO: 9322279 - DNA, 22 bp, Homo sapiens
ctgcacagcctgtctgggggcc

SEQ ID NO: 9322280 - DNA, 22 bp, Homo sapiens
ctgcacaggggatgagggcagt

SEQ ID NO: 9322281 - DNA, 22 bp, Homo sapiens
ctgaggccagctgcagagctct

SEQ ID NO: 9322282 - DNA, 22 bp, Homo sapiens
ctgaggcatgggaagttgggtg

SEQ ID NO: 9322283 - DNA, 21 bp, Homo sapiens
ctgaggcatgcaggcctgggc

SEQ ID NO: 9322284 - DNA, 22 bp, Homo sapiens
ctgaatcatggtcattagttta

SEQ ID NO: 9322285 - DNA, 21 bp, Homo sapiens
ctgacatgtggaaaaggagag

SEQ ID NO: 9322286 - DNA, 22 bp, Homo sapiens
ctctttctcattgtcagcagaa

SEQ ID NO: 9322287 - DNA, 22 bp, Homo sapiens
ctctttcctcgatgggctcctg

SEQ ID NO: 9322288 - DNA, 22 bp, Homo sapiens
ctctttggatagaattacaaag

SEQ ID NO: 9322289 - DNA, 22 bp, Homo sapiens
ctctttggatgtttatgataag

SEQ ID NO: 9322290 - DNA, 22 bp, Homo sapiens
ctctttggagaagcacgtatta

SEQ ID NO: 9322291 - DNA, 22 bp, Homo sapiens
ctgagccaaccacagcaggagc

SEQ ID NO: 9322292 - DNA, 20 bp, Homo sapiens
ctgagccaactctcttcttg

SEQ ID NO: 9322293 - DNA, 22 bp, Homo sapiens
ctgagccagtagtcagggacaa

SEQ ID NO: 9322294 - DNA, 22 bp, Homo sapiens
ctctgcttttatgtgccggcgc

SEQ ID NO: 9322295 - DNA, 22 bp, Homo sapiens
ctctgcttttatgtgccggcgc

SEQ ID NO: 9322296 - DNA, 22 bp, Homo sapiens
ctctgctttgtaagttgtgagg

SEQ ID NO: 9322297 - DNA, 22 bp, Homo sapiens
ctctgctttttagggagcctag

SEQ ID NO: 9322298 - DNA, 22 bp, Homo sapiens
ctctgctttttaaaaggagtcc

SEQ ID NO: 9322299 - DNA, 22 bp, Homo sapiens
ctctgctttctcaaaccctgtg

SEQ ID NO: 9322300 - DNA, 22 bp, Homo sapiens
ctctgctttcctcttacacact

SEQ ID NO: 9322301 - DNA, 22 bp, Homo sapiens
ctctgctttctcaaaccctgtg

SEQ ID NO: 9322302 - DNA, 20 bp, Homo sapiens
ctctgctttccacctttcag

SEQ ID NO: 9322303 - DNA, 20 bp, Homo sapiens
ctctgctttaggagagtcag

SEQ ID NO: 9322304 - DNA, 22 bp, Homo sapiens
tttgcctgggaattctagtgta

SEQ ID NO: 9322305 - DNA, 22 bp, Homo sapiens
ctctgcctcagtgatttcttta

SEQ ID NO: 9322306 - DNA, 19 bp, Homo sapiens
ctctgcctccctcctgggt

SEQ ID NO: 9322307 - DNA, 19 bp, Homo sapiens
ctctgcctccctcctgggt

SEQ ID NO: 9322308 - DNA, 22 bp, Homo sapiens
ctctgccctcgcacatctgcca

SEQ ID NO: 9322309 - DNA, 19 bp, Homo sapiens
ctctgcctccctcctgggt

SEQ ID NO: 9322310 - DNA, 22 bp, Homo sapiens
ctctgcccgcggatgccacgtc

SEQ ID NO: 9322311 - DNA, 22 bp, Homo sapiens
ctctgcccgtgcctttcccagt

SEQ ID NO: 9322312 - DNA, 22 bp, Homo sapiens
ctctgcccgcggatgccacgtc

SEQ ID NO: 9322313 - DNA, 22 bp, Homo sapiens
ctctgccaccatgcttcctgac

SEQ ID NO: 9322314 - DNA, 22 bp, Homo sapiens
ctctgccagtttctggcctcag

SEQ ID NO: 9322315 - DNA, 22 bp, Homo sapiens
ctctgccagccaaagtcatcac

SEQ ID NO: 9322316 - DNA, 21 bp, Homo sapiens
ctctgcccagggcctcctgcc

SEQ ID NO: 9322317 - DNA, 19 bp, Homo sapiens
ctctgccatttgctgcctg

SEQ ID NO: 9322318 - DNA, 22 bp, Homo sapiens
ctctgcccacgtcttgcccaga

SEQ ID NO: 9322319 - DNA, 22 bp, Homo sapiens
ctcttagtttgtaaaaataatt

SEQ ID NO: 9322320 - DNA, 22 bp, Homo sapiens
ctctgttaagccatgtaagtac

SEQ ID NO: 9322321 - DNA, 22 bp, Homo sapiens
ctctgttaagtatcctttgctg

SEQ ID NO: 9322322 - DNA, 22 bp, Homo sapiens
ctctgttacagccccctgcctc

SEQ ID NO: 9322323 - DNA, 22 bp, Homo sapiens
ctctgttaagtctggaatgaaa

SEQ ID NO: 9322324 - DNA, 22 bp, Homo sapiens
ctcttatagacactcttctata

SEQ ID NO: 9322325 - DNA, 22 bp, Homo sapiens
ctcttccatattactcagggta

SEQ ID NO: 9322326 - DNA, 22 bp, Homo sapiens
ctcttcagttgttgcatattct

SEQ ID NO: 9322327 - DNA, 21 bp, Homo sapiens
ctcttcagtggtgagctcttc

SEQ ID NO: 9322328 - DNA, 22 bp, Homo sapiens
ctcttcagatatacagtactct

SEQ ID NO: 9322329 - DNA, 22 bp, Homo sapiens
ctcttcagcaatgctttagtcc

SEQ ID NO: 9322330 - DNA, 22 bp, Homo sapiens
ctcttcagcctatttgagtgca

SEQ ID NO: 9322331 - DNA, 22 bp, Homo sapiens
ctcttcactgagataatcctag

SEQ ID NO: 9322332 - DNA, 22 bp, Homo sapiens
ctcttcaggaatatgtcagtca

SEQ ID NO: 9322333 - DNA, 22 bp, Homo sapiens
ctcttcaggatggcttgtgatg

SEQ ID NO: 9322334 - DNA, 22 bp, Homo sapiens
ctcttcaggatggcttgtgatg

SEQ ID NO: 9322335 - DNA, 22 bp, Homo sapiens
ctcttcaggtttctgctctgga

SEQ ID NO: 9322336 - DNA, 22 bp, Homo sapiens
ctcttcagtaaatgacactgtt

SEQ ID NO: 9322337 - DNA, 22 bp, Homo sapiens
ttttcacttaaggaatttcatg

SEQ ID NO: 9322338 - DNA, 22 bp, Homo sapiens
tttgttctgaaaatcttccctt

SEQ ID NO: 9322339 - DNA, 22 bp, Homo sapiens
tttgttctgaaaactcaagtcc

SEQ ID NO: 9322340 - DNA, 22 bp, Homo sapiens
tttgtacatataaatcttgtat

SEQ ID NO: 9322341 - DNA, 22 bp, Homo sapiens
tttgtacatatataaaatctgt

SEQ ID NO: 9322342 - DNA, 22 bp, Homo sapiens
ctcatctgtatatagtgaatga

SEQ ID NO: 9322343 - DNA, 22 bp, Homo sapiens
ctcatctggcttcagtaacagt

SEQ ID NO: 9322344 - DNA, 22 bp, Homo sapiens
ttcttttacattaagatttcag

SEQ ID NO: 9322345 - DNA, 22 bp, Homo sapiens
ttcttttagaatttcctaaggt

SEQ ID NO: 9322346 - DNA, 22 bp, Homo sapiens
ttgtacaaaggatttggaagag

SEQ ID NO: 9322347 - DNA, 22 bp, Homo sapiens
ctccaccacacatctgtccacc

SEQ ID NO: 9322348 - DNA, 22 bp, Homo sapiens
ctccacggcccattgggcagga

SEQ ID NO: 9322349 - DNA, 22 bp, Homo sapiens
ctccacccaaatctcaccttga

SEQ ID NO: 9322350 - DNA, 22 bp, Homo sapiens
ttgtacaaatgcatattcctgg

SEQ ID NO: 9322351 - DNA, 22 bp, Homo sapiens
ttgtacaacacatattctacag

SEQ ID NO: 9322352 - DNA, 22 bp, Homo sapiens
ctccagatgtatactttccaag

SEQ ID NO: 9322353 - DNA, 22 bp, Homo sapiens
ctccagatccagctgagctgca

SEQ ID NO: 9322354 - DNA, 22 bp, Homo sapiens
ctccagattcctgctggcagaa

SEQ ID NO: 9322355 - DNA, 22 bp, Homo sapiens
ctccacagctgtaaatataggg

SEQ ID NO: 9322356 - DNA, 19 bp, Homo sapiens
ctccacagggattgtgatt

SEQ ID NO: 9322357 - DNA, 22 bp, Homo sapiens
ctccacagagatgctgattgta

SEQ ID NO: 9322358 - DNA, 20 bp, Homo sapiens
ctccaaggcttgcaggaggc

SEQ ID NO: 9322359 - DNA, 22 bp, Homo sapiens
ctccaaggctctggtgctgagg

SEQ ID NO: 9322360 - DNA, 18 bp, Homo sapiens
ctccaaggtctctggctt

SEQ ID NO: 9322361 - DNA, 20 bp, Homo sapiens
ctccaaattcctgaggataa

SEQ ID NO: 9322362 - DNA, 23 bp, Homo sapiens
ctccaaggcccaactgtctaggc

SEQ ID NO: 9322363 - DNA, 22 bp, Homo sapiens
ctcccactcctggctcaccaca

SEQ ID NO: 9322364 - DNA, 22 bp, Homo sapiens
ctcccactcctggctcaccaca

SEQ ID NO: 9322365 - DNA, 22 bp, Homo sapiens
ctcccactcctggctcaccaca

SEQ ID NO: 9322366 - DNA, 22 bp, Homo sapiens
ctcccagaggtgtcattcgagc

SEQ ID NO: 9322367 - DNA, 22 bp, Homo sapiens
ctcccagccttcgccagtctga

SEQ ID NO: 9322368 - DNA, 22 bp, Homo sapiens
ctcccaggactcagaggagaag

SEQ ID NO: 9322369 - DNA, 22 bp, Homo sapiens
tttaatatccagtggatacaaa

SEQ ID NO: 9322370 - DNA, 22 bp, Homo sapiens
tttaatatttctttcctgaagc

SEQ ID NO: 9322371 - DNA, 22 bp, Homo sapiens
tttaatatctcacacttccatg

SEQ ID NO: 9322372 - DNA, 15 bp, Homo sapiens
tttaatatggagtta

SEQ ID NO: 9322373 - DNA, 22 bp, Homo sapiens
tttaatattctgcattctcctt

SEQ ID NO: 9322374 - DNA, 22 bp, Homo sapiens
ctcccaggactggctctaactg

SEQ ID NO: 9322375 - DNA, 22 bp, Homo sapiens
ctcccaggcacagggaggagcc

SEQ ID NO: 9322376 - DNA, 22 bp, Homo sapiens
ctcccaggcacagggaggagcc

SEQ ID NO: 9322377 - DNA, 22 bp, Homo sapiens
ctcccaggcagggctgcccact

SEQ ID NO: 9322378 - DNA, 22 bp, Homo sapiens
ctcccaggccatgctctagcca

SEQ ID NO: 9322379 - DNA, 22 bp, Homo sapiens
ctcccaggccatgctctagcca

SEQ ID NO: 9322380 - DNA, 22 bp, Homo sapiens
ttgtctttggaaatttaatgtt

SEQ ID NO: 9322381 - DNA, 22 bp, Homo sapiens
ttgtctttcccagcttctagag

SEQ ID NO: 9322382 - DNA, 22 bp, Homo sapiens
ttgtctttcccagcttctagag

SEQ ID NO: 9322383 - DNA, 22 bp, Homo sapiens
ttgtctttcccagcttctagag

SEQ ID NO: 9322384 - DNA, 22 bp, Homo sapiens
ttgtcttaaatggatggacaat

SEQ ID NO: 9322385 - DNA, 20 bp, Homo sapiens
ctccagcccctgccctggtc

SEQ ID NO: 9322386 - DNA, 22 bp, Homo sapiens
ctccatggaaccggggctgctt

SEQ ID NO: 9322387 - DNA, 22 bp, Homo sapiens
tttatttaccttatgtcctcca

SEQ ID NO: 9322388 - DNA, 22 bp, Homo sapiens
tttatttaccttatgtcctcca

SEQ ID NO: 9322389 - DNA, 22 bp, Homo sapiens
tttatttaaagtcgtgtgttaa

SEQ ID NO: 9322390 - DNA, 18 bp, Homo sapiens
ctcctccacagcccctgc

SEQ ID NO: 9322391 - DNA, 22 bp, Homo sapiens
ctcctccagtgggtccctcagg

SEQ ID NO: 9322392 - DNA, 22 bp, Homo sapiens
ctcctccagtgggtccctcagg

SEQ ID NO: 9322393 - DNA, 22 bp, Homo sapiens
ctcctccagcttccagtggctc

SEQ ID NO: 9322394 - DNA, 22 bp, Homo sapiens
tttattccagtgtttctcaaat

SEQ ID NO: 9322395 - DNA, 22 bp, Homo sapiens
tttattccagtgtttctcaaat

SEQ ID NO: 9322396 - DNA, 22 bp, Homo sapiens
tttattccatgtgtctatgacc

SEQ ID NO: 9322397 - DNA, 18 bp, Homo sapiens
tttattcctgcccccagc

SEQ ID NO: 9322398 - DNA, 18 bp, Homo sapiens
tttattcctgcccccagc

SEQ ID NO: 9322399 - DNA, 22 bp, Homo sapiens
tttattgttgttagtcataagt

SEQ ID NO: 9322400 - DNA, 22 bp, Homo sapiens
tttagtagaaatatttgggcct

SEQ ID NO: 9322401 - DNA, 22 bp, Homo sapiens
tttagtagaaatatttgggcct

SEQ ID NO: 9322402 - DNA, 22 bp, Homo sapiens
tttagtaggcactaggagggga

SEQ ID NO: 9322403 - DNA, 22 bp, Homo sapiens
tttagtaggaaattgtcttata

SEQ ID NO: 9322404 - DNA, 22 bp, Homo sapiens
tttagtagctacagttagaagg

SEQ ID NO: 9322405 - DNA, 22 bp, Homo sapiens
tttagtagaatgatacagggca

SEQ ID NO: 9322406 - DNA, 22 bp, Homo sapiens
tttagtagaatagtatatcaaa

SEQ ID NO: 9322407 - DNA, 22 bp, Homo sapiens
tttagtagatgcagcattattt

SEQ ID NO: 9322408 - DNA, 22 bp, Homo sapiens
tttagtagtgacagattctggg

SEQ ID NO: 9322409 - DNA, 22 bp, Homo sapiens
tttagtatataaaaagagaagt

SEQ ID NO: 9322410 - DNA, 22 bp, Homo sapiens
tttaggttttttcacgtggcta

SEQ ID NO: 9322411 - DNA, 22 bp, Homo sapiens
tttagtctgactattacctcca

SEQ ID NO: 9322412 - DNA, 22 bp, Homo sapiens
tttagtctagtctcctcagaaa

SEQ ID NO: 9322413 - DNA, 22 bp, Homo sapiens
tttagtattctctatttccatc

SEQ ID NO: 9322414 - DNA, 22 bp, Homo sapiens
ctcctccacagagtccttgcca

SEQ ID NO: 9322415 - DNA, 18 bp, Homo sapiens
ctcctccacagcccctgc

SEQ ID NO: 9322416 - DNA, 22 bp, Homo sapiens
ctccctcacaaagcattctctt

SEQ ID NO: 9322417 - DNA, 22 bp, Homo sapiens
ctcccctgagcatagactctgt

SEQ ID NO: 9322418 - DNA, 22 bp, Homo sapiens
ctcccctccttaggtcttctag

SEQ ID NO: 9322419 - DNA, 22 bp, Homo sapiens
ctcccgagttcaagctattttc

SEQ ID NO: 9322420 - DNA, 22 bp, Homo sapiens
ctccccattgtgacctcatcca

SEQ ID NO: 9322421 - DNA, 23 bp, Homo sapiens
ctccccagtgtcctcatgcatct

SEQ ID NO: 9322422 - DNA, 22 bp, Homo sapiens
ctcccccttagctcttgtcttt

SEQ ID NO: 9322423 - DNA, 20 bp, Homo sapiens
ctctctctccattcccaggg

SEQ ID NO: 9322424 - DNA, 20 bp, Homo sapiens
ctctctctccattcccaggg

SEQ ID NO: 9322425 - DNA, 22 bp, Homo sapiens
ctctctctatgcgttgttccta

SEQ ID NO: 9322426 - DNA, 17 bp, Homo sapiens
ctctccttcctctgagg

SEQ ID NO: 9322427 - DNA, 22 bp, Homo sapiens
ctctctcttgtgttgctgcaga

SEQ ID NO: 9322428 - DNA, 20 bp, Homo sapiens
ctctctctccattcccaggg

SEQ ID NO: 9322429 - DNA, 22 bp, Homo sapiens
ctctctcttgtgttgctgcaga

SEQ ID NO: 9322430 - DNA, 22 bp, Homo sapiens
ctctctctttagaagcgtctgg

SEQ ID NO: 9322431 - DNA, 22 bp, Homo sapiens
tttccttgggtctcttagtggc

SEQ ID NO: 9322432 - DNA, 22 bp, Homo sapiens
ctctcctggtgtggaggacagg

SEQ ID NO: 9322433 - DNA, 22 bp, Homo sapiens
ctctccagtcatattctcagtc

SEQ ID NO: 9322434 - DNA, 22 bp, Homo sapiens
ctctccagtcatattctcagtc

SEQ ID NO: 9322435 - DNA, 22 bp, Homo sapiens
ctctccaggttagagcacttat

SEQ ID NO: 9322436 - DNA, 22 bp, Homo sapiens
ctctccaggggtagatgccttc

SEQ ID NO: 9322437 - DNA, 22 bp, Homo sapiens
tttcctcaactgtcaaatgggg

SEQ ID NO: 9322438 - DNA, 22 bp, Homo sapiens
tttcctcacacagaagatcttg

SEQ ID NO: 9322439 - DNA, 22 bp, Homo sapiens
tttcctcacttcatgagagttt

SEQ ID NO: 9322440 - DNA, 22 bp, Homo sapiens
tttcctcactcatgtcatcagt

SEQ ID NO: 9322441 - DNA, 22 bp, Homo sapiens
ctctccaggagctcagagtcta

SEQ ID NO: 9322442 - DNA, 22 bp, Homo sapiens
ctctccaggctgggacaggacc

SEQ ID NO: 9322443 - DNA, 22 bp, Homo sapiens
ctctccaggctgggacaggacc

SEQ ID NO: 9322444 - DNA, 22 bp, Homo sapiens
ctctccaggcgaggtcctactg

SEQ ID NO: 9322445 - DNA, 22 bp, Homo sapiens
ctctccaggcgaggtcctactg

SEQ ID NO: 9322446 - DNA, 22 bp, Homo sapiens
ctctccaggagctcagagtcta

SEQ ID NO: 9322447 - DNA, 22 bp, Homo sapiens
tttcacaaatgtctttaacttg

SEQ ID NO: 9322448 - DNA, 22 bp, Homo sapiens
tttcacaggtatccacgggtct

SEQ ID NO: 9322449 - DNA, 22 bp, Homo sapiens
tttcacataaatattatgccta

SEQ ID NO: 9322450 - DNA, 22 bp, Homo sapiens
tttcacagttagcatgaggact

SEQ ID NO: 9322451 - DNA, 22 bp, Homo sapiens
tttcacataaatattatgccta

SEQ ID NO: 9322452 - DNA, 22 bp, Homo sapiens
tttcacagttagcatgaggact

SEQ ID NO: 9322453 - DNA, 22 bp, Homo sapiens
tttcctaaggctcattttaaaa

SEQ ID NO: 9322454 - DNA, 22 bp, Homo sapiens
tttcctaaggtagtgataattt

SEQ ID NO: 9322455 - DNA, 22 bp, Homo sapiens
gaggaaaataacaactaagggc

SEQ ID NO: 9322456 - DNA, 20 bp, Homo sapiens
gaggaaaagctgccaggcct

SEQ ID NO: 9322457 - DNA, 22 bp, Homo sapiens
gaggaaaagagacaggttattg

SEQ ID NO: 9322458 - DNA, 22 bp, Homo sapiens
gaggaaaataacaactaagggc

SEQ ID NO: 9322459 - DNA, 22 bp, Homo sapiens
gaggaaaatattcagggaggtt

SEQ ID NO: 9322460 - DNA, 22 bp, Homo sapiens
gaggaaaatattcagggaggtt

SEQ ID NO: 9322461 - DNA, 19 bp, Homo sapiens
gaggagctatcggagacag

SEQ ID NO: 9322462 - DNA, 22 bp, Homo sapiens
gaggagctgttccctcacctct

SEQ ID NO: 9322463 - DNA, 22 bp, Homo sapiens
gaggagcctggccccacatcca

SEQ ID NO: 9322464 - DNA, 22 bp, Homo sapiens
gaggagccctgttccccaggcc

SEQ ID NO: 9322465 - DNA, 22 bp, Homo sapiens
gaggaggctaagtgggctctgg

SEQ ID NO: 9322466 - DNA, 22 bp, Homo sapiens
gaggaggctaagtgggctctgg

SEQ ID NO: 9322467 - DNA, 22 bp, Homo sapiens
gaggcaagcccagtgggtctaa

SEQ ID NO: 9322468 - DNA, 22 bp, Homo sapiens
gaggaggcacttgagcagatgt

SEQ ID NO: 9322469 - DNA, 22 bp, Homo sapiens
gaggaggccagtggaaggaagc

SEQ ID NO: 9322470 - DNA, 22 bp, Homo sapiens
gaggaggccagtggaaggaagc

SEQ ID NO: 9322471 - DNA, 22 bp, Homo sapiens
gaggaggcactagttagtgaca

SEQ ID NO: 9322472 - DNA, 22 bp, Homo sapiens
gaggcagaggaaggtggtctct

SEQ ID NO: 9322473 - DNA, 22 bp, Homo sapiens
gaggcagaggaaggtggtctct

SEQ ID NO: 9322474 - DNA, 22 bp, Homo sapiens
gaggcacatcacttggtgcatt

SEQ ID NO: 9322475 - DNA, 22 bp, Homo sapiens
gaggcagagactccaccttcag

SEQ ID NO: 9322476 - DNA, 22 bp, Homo sapiens
gaggcagagaccttcaggacct

SEQ ID NO: 9322477 - DNA, 22 bp, Homo sapiens
gaggcagaagttgcagtgagca

SEQ ID NO: 9322478 - DNA, 22 bp, Homo sapiens
gagctaggctagggggagtcgc

SEQ ID NO: 9322479 - DNA, 22 bp, Homo sapiens
gagctaggatatcatgagggta

SEQ ID NO: 9322480 - DNA, 22 bp, Homo sapiens
gagcctgcccagccctgtccac

SEQ ID NO: 9322481 - DNA, 22 bp, Homo sapiens
gagcctgcaggcctcggcctca

SEQ ID NO: 9322482 - DNA, 22 bp, Homo sapiens
gagcctgcagctttcacagcat

SEQ ID NO: 9322483 - DNA, 22 bp, Homo sapiens
gagcctcgtggcggccactgcg

SEQ ID NO: 9322484 - DNA, 22 bp, Homo sapiens
gagcctcgtggcggccactgcg

SEQ ID NO: 9322485 - DNA, 22 bp, Homo sapiens
gagcctgcctctagtctctaga

SEQ ID NO: 9322486 - DNA, 22 bp, Homo sapiens
gagcctgcccctccaccaggat

SEQ ID NO: 9322487 - DNA, 22 bp, Homo sapiens
gagcctggacatctcaggccca

SEQ ID NO: 9322488 - DNA, 22 bp, Homo sapiens
gagcctggattgaagtgggtgg

SEQ ID NO: 9322489 - DNA, 22 bp, Homo sapiens
gagcctggattgaagtgggtgg

SEQ ID NO: 9322490 - DNA, 22 bp, Homo sapiens
gagcctggatagccttgttcca

SEQ ID NO: 9322491 - DNA, 22 bp, Homo sapiens
gagcctggatagccttgttcca

SEQ ID NO: 9322492 - DNA, 22 bp, Homo sapiens
gagctgagacacactttggcaa

SEQ ID NO: 9322493 - DNA, 22 bp, Homo sapiens
gagctgtgttcatgaggagaaa

SEQ ID NO: 9322494 - DNA, 22 bp, Homo sapiens
gagcttcagctgccatgactgt

SEQ ID NO: 9322495 - DNA, 22 bp, Homo sapiens
gagcttcagcgtgtgctaaggg

SEQ ID NO: 9322496 - DNA, 18 bp, Homo sapiens
gagcttcaggctaacctg

SEQ ID NO: 9322497 - DNA, 22 bp, Homo sapiens
gagcttcacgggggacagcatt

SEQ ID NO: 9322498 - DNA, 22 bp, Homo sapiens
gagcttcagaatttaacagact

SEQ ID NO: 9322499 - DNA, 22 bp, Homo sapiens
gagcttcagagaccacttaact

SEQ ID NO: 9322500 - DNA, 20 bp, Homo sapiens
gagcttcaactcagcaaaca

SEQ ID NO: 9322501 - DNA, 21 bp, Homo sapiens
gagctgttactctctctggag

SEQ ID NO: 9322502 - DNA, 22 bp, Homo sapiens
gagctgtttgtgacaggctgtg

SEQ ID NO: 9322503 - DNA, 22 bp, Homo sapiens
gagctgttcaaggacaggcacg

SEQ ID NO: 9322504 - DNA, 22 bp, Homo sapiens
gagcttggacaccttggcaggt

SEQ ID NO: 9322505 - DNA, 22 bp, Homo sapiens
gagacaatttctaagatgcttc

SEQ ID NO: 9322506 - DNA, 22 bp, Homo sapiens
gagacacaaacacatttagagg

SEQ ID NO: 9322507 - DNA, 22 bp, Homo sapiens
gagaggctcagggacttgctga

SEQ ID NO: 9322508 - DNA, 22 bp, Homo sapiens
gagaggcttaagggctgtgaag

SEQ ID NO: 9322509 - DNA, 22 bp, Homo sapiens
gagatgctgaaatctgagtgta

SEQ ID NO: 9322510 - DNA, 22 bp, Homo sapiens
gagatgatgagatttggaactt

SEQ ID NO: 9322511 - DNA, 22 bp, Homo sapiens
gagatgatctctttcagctctg

SEQ ID NO: 9322512 - DNA, 22 bp, Homo sapiens
gagaaggatgtggctcatagct

SEQ ID NO: 9322513 - DNA, 22 bp, Homo sapiens
gagaagggatatggcttcttga

SEQ ID NO: 9322514 - DNA, 22 bp, Homo sapiens
gacctccagcggccctgcagag

SEQ ID NO: 9322515 - DNA, 22 bp, Homo sapiens
gacctcgtgatctgccagcctt

SEQ ID NO: 9322516 - DNA, 22 bp, Homo sapiens
gacctctcaggaatctcacatg

SEQ ID NO: 9322517 - DNA, 22 bp, Homo sapiens
gacctcgtgatccgcccgcttt

SEQ ID NO: 9322518 - DNA, 22 bp, Homo sapiens
gacctcgtgatccgccctcctt

SEQ ID NO: 9322519 - DNA, 22 bp, Homo sapiens
gacctccgtgtacacctcccag

SEQ ID NO: 9322520 - DNA, 22 bp, Homo sapiens
gacctcgtgatctgccggcctt

SEQ ID NO: 9322521 - DNA, 22 bp, Homo sapiens
gagaaggagtagctgacctggg

SEQ ID NO: 9322522 - DNA, 22 bp, Homo sapiens
gagcagcaagcactcaaaggct

SEQ ID NO: 9322523 - DNA, 22 bp, Homo sapiens
gagcagcagattgtctccatgg

SEQ ID NO: 9322524 - DNA, 22 bp, Homo sapiens
gagcagcacttgaggcatgtca

SEQ ID NO: 9322525 - DNA, 22 bp, Homo sapiens
gagcagcaaagggagggtaaat

SEQ ID NO: 9322526 - DNA, 22 bp, Homo sapiens
gagcagcactgagttagcagct

SEQ ID NO: 9322527 - DNA, 22 bp, Homo sapiens
gagcagcagctgggccaggttc

SEQ ID NO: 9322528 - DNA, 18 bp, Homo sapiens
gagcagcaggatcaagaa

SEQ ID NO: 9322529 - DNA, 22 bp, Homo sapiens
gagcagcaggtggctgtgatgg

SEQ ID NO: 9322530 - DNA, 22 bp, Homo sapiens
gagcagcaggccaggttgcagg

SEQ ID NO: 9322531 - DNA, 22 bp, Homo sapiens
gagcagcatctccggcttaaag

SEQ ID NO: 9322532 - DNA, 22 bp, Homo sapiens
gagcagcaggtggggctggctt

SEQ ID NO: 9322533 - DNA, 23 bp, Homo sapiens
gagatgtgggtttgttcagtgtc

SEQ ID NO: 9322534 - DNA, 22 bp, Homo sapiens
gagatggaaaactgctggtagt

SEQ ID NO: 9322535 - DNA, 22 bp, Homo sapiens
gagatggaatctgtgtggaggg

SEQ ID NO: 9322536 - DNA, 22 bp, Homo sapiens
gagatggagaaggaagctgttt

SEQ ID NO: 9322537 - DNA, 22 bp, Homo sapiens
gagccaagcaccacattaagtt

SEQ ID NO: 9322538 - DNA, 22 bp, Homo sapiens
gagccaagggcgtgctggagag

SEQ ID NO: 9322539 - DNA, 22 bp, Homo sapiens
gagccaagggttgccatggaga

SEQ ID NO: 9322540 - DNA, 22 bp, Homo sapiens
gagcagctgcagtgcagaccct

SEQ ID NO: 9322541 - DNA, 22 bp, Homo sapiens
gagcagctggacaggcctccct

SEQ ID NO: 9322542 - DNA, 22 bp, Homo sapiens
gagcagcagttgttacaatgat

SEQ ID NO: 9322543 - DNA, 22 bp, Homo sapiens
gagccaggggtcagctccgagg

SEQ ID NO: 9322544 - DNA, 22 bp, Homo sapiens
gagccagggctgtgagctgagc

SEQ ID NO: 9322545 - DNA, 22 bp, Homo sapiens
gagccaggttggaggctgcagt

SEQ ID NO: 9322546 - DNA, 22 bp, Homo sapiens
gagccaggtcgggccgcggcga

SEQ ID NO: 9322547 - DNA, 22 bp, Homo sapiens
gagccaggtcgggccgcggcga

SEQ ID NO: 9322548 - DNA, 22 bp, Homo sapiens
gagccagagatccaggatggct

SEQ ID NO: 9322549 - DNA, 22 bp, Homo sapiens
gagccagactgcctgaagctca

SEQ ID NO: 9322550 - DNA, 22 bp, Homo sapiens
gagccagaaaagctgcctgact

SEQ ID NO: 9322551 - DNA, 22 bp, Homo sapiens
gagccagattttatgcaagaca

SEQ ID NO: 9322552 - DNA, 22 bp, Homo sapiens
gagccagattttatgcaagaca

SEQ ID NO: 9322553 - DNA, 22 bp, Homo sapiens
ctttcacagcttgaaaagtatt

SEQ ID NO: 9322554 - DNA, 22 bp, Homo sapiens
ctttcacagcacaagcctgcct

SEQ ID NO: 9322555 - DNA, 22 bp, Homo sapiens
ctttcacagtcctgactgagcg

SEQ ID NO: 9322556 - DNA, 22 bp, Homo sapiens
ctttcaatgtgcctgccttggg

SEQ ID NO: 9322557 - DNA, 22 bp, Homo sapiens
ctttcaatcaaagtttctagtg

SEQ ID NO: 9322558 - DNA, 22 bp, Homo sapiens
gaacaggcataagcatttgcat

SEQ ID NO: 9322559 - DNA, 21 bp, Homo sapiens
gaacaggaaaagctggcttca

SEQ ID NO: 9322560 - DNA, 22 bp, Homo sapiens
gaaatgcataatcttagtagat

SEQ ID NO: 9322561 - DNA, 22 bp, Homo sapiens
gaaatgattttagtttatcatg

SEQ ID NO: 9322562 - DNA, 22 bp, Homo sapiens
gaaatgcagaacctgagaccat

SEQ ID NO: 9322563 - DNA, 22 bp, Homo sapiens
gaaatgcagattctgattctgt

SEQ ID NO: 9322564 - DNA, 22 bp, Homo sapiens
gaagattggggcctctgcaccc

SEQ ID NO: 9322565 - DNA, 22 bp, Homo sapiens
gaagattgaaggctgggaatta

SEQ ID NO: 9322566 - DNA, 20 bp, Homo sapiens
gaagatgggtagaggcacag

SEQ ID NO: 9322567 - DNA, 22 bp, Homo sapiens
gaagatttttcttaatgctccg

SEQ ID NO: 9322568 - DNA, 22 bp, Homo sapiens
gaagaccatattcagcaggcat

SEQ ID NO: 9322569 - DNA, 20 bp, Homo sapiens
gaagacacagagttcatctc

SEQ ID NO: 9322570 - DNA, 21 bp, Homo sapiens
gaagacacataacctctctcc

SEQ ID NO: 9322571 - DNA, 22 bp, Homo sapiens
gaagacacctactgtcatttct

SEQ ID NO: 9322572 - DNA, 22 bp, Homo sapiens
gaagacactaaactggggcttc

SEQ ID NO: 9322573 - DNA, 22 bp, Homo sapiens
gaagacactaaggcccagggag

SEQ ID NO: 9322574 - DNA, 22 bp, Homo sapiens
gaagacactctgcagagttatc

SEQ ID NO: 9322575 - DNA, 22 bp, Homo sapiens
gaagacacaattggtgggtcca

SEQ ID NO: 9322576 - DNA, 22 bp, Homo sapiens
gaatagatcctcatttattgat

SEQ ID NO: 9322577 - DNA, 22 bp, Homo sapiens
gaatatatttctcttaccttta

SEQ ID NO: 9322578 - DNA, 22 bp, Homo sapiens
gaaggaaaggtctcatgccttt

SEQ ID NO: 9322579 - DNA, 22 bp, Homo sapiens
gaaggaaatctgtgatttatgc

SEQ ID NO: 9322580 - DNA, 22 bp, Homo sapiens
gaaggaaaaatactctgtaagg

SEQ ID NO: 9322581 - DNA, 22 bp, Homo sapiens
gaaggaaaacagatctgcctga

SEQ ID NO: 9322582 - DNA, 22 bp, Homo sapiens
gaagcttcgtggctcttcaaat

SEQ ID NO: 9322583 - DNA, 22 bp, Homo sapiens
gaagcttcgtggctcttcaaat

SEQ ID NO: 9322584 - DNA, 22 bp, Homo sapiens
gaagcttctggcatttctcaaa

SEQ ID NO: 9322585 - DNA, 22 bp, Homo sapiens
gaagcctcattgacctccactg

SEQ ID NO: 9322586 - DNA, 22 bp, Homo sapiens
gaagcctcaacatctctgcgtc

SEQ ID NO: 9322587 - DNA, 22 bp, Homo sapiens
gaagtttagagtgttgtaattt

SEQ ID NO: 9322588 - DNA, 22 bp, Homo sapiens
gaagtttaggttcttatgttta

SEQ ID NO: 9322589 - DNA, 22 bp, Homo sapiens
gaagtttatttcaatctattca

SEQ ID NO: 9322590 - DNA, 22 bp, Homo sapiens
gaagtttatggtgcttgtaagg

SEQ ID NO: 9322591 - DNA, 23 bp, Homo sapiens
gaatacagagataaatagaacac

SEQ ID NO: 9322592 - DNA, 19 bp, Homo sapiens
gaatacagataataagcag

SEQ ID NO: 9322593 - DNA, 22 bp, Homo sapiens
gacaggctggcaatgccctgct

SEQ ID NO: 9322594 - DNA, 22 bp, Homo sapiens
gacaggcttcctaagtgccaga

SEQ ID NO: 9322595 - DNA, 22 bp, Homo sapiens
gacaggctttgagtcccagaac

SEQ ID NO: 9322596 - DNA, 22 bp, Homo sapiens
gacagggctgtgggaggagcag

SEQ ID NO: 9322597 - DNA, 22 bp, Homo sapiens
gacagggctgtgggaggagcag

SEQ ID NO: 9322598 - DNA, 21 bp, Homo sapiens
gacaggggaagaagcaaggag

SEQ ID NO: 9322599 - DNA, 21 bp, Homo sapiens
gacaggggaagaagcaaggag

SEQ ID NO: 9322600 - DNA, 22 bp, Homo sapiens
gacaggggctttgcatgcttta

SEQ ID NO: 9322601 - DNA, 22 bp, Homo sapiens
gacacagaatttactcccgata

SEQ ID NO: 9322602 - DNA, 22 bp, Homo sapiens
gacacagaattcccctccaagt

SEQ ID NO: 9322603 - DNA, 22 bp, Homo sapiens
gacacagacagttagaggtaat

SEQ ID NO: 9322604 - DNA, 22 bp, Homo sapiens
gacacagaccaccaggccctgg

SEQ ID NO: 9322605 - DNA, 22 bp, Homo sapiens
gacacagagacttgcagttgta

SEQ ID NO: 9322606 - DNA, 22 bp, Homo sapiens
gacacagaaggtcacatgttca

SEQ ID NO: 9322607 - DNA, 22 bp, Homo sapiens
gacacagaatgggtgctcagta

SEQ ID NO: 9322608 - DNA, 22 bp, Homo sapiens
gacacagaaggtcacatgttca

SEQ ID NO: 9322609 - DNA, 22 bp, Homo sapiens
ctggggtgtgctcagagcaggg

SEQ ID NO: 9322610 - DNA, 20 bp, Homo sapiens
ctgggtctccttctgcttaa

SEQ ID NO: 9322611 - DNA, 22 bp, Homo sapiens
ctgggtctggctactgcttcct

SEQ ID NO: 9322612 - DNA, 22 bp, Homo sapiens
ctggggtgtgctcagagcaggg

SEQ ID NO: 9322613 - DNA, 22 bp, Homo sapiens
ctggggtgtgctcagagcaggg

SEQ ID NO: 9322614 - DNA, 22 bp, Homo sapiens
ctggggctgcggtggaggagcc

SEQ ID NO: 9322615 - DNA, 22 bp, Homo sapiens
ctggggctgcggacgggagccc

SEQ ID NO: 9322616 - DNA, 22 bp, Homo sapiens
ctggggctgcggacgggagccc

SEQ ID NO: 9322617 - DNA, 22 bp, Homo sapiens
ctggggctgcagcgatcttcat

SEQ ID NO: 9322618 - DNA, 20 bp, Homo sapiens
ctggggaggaggatgtgttc

SEQ ID NO: 9322619 - DNA, 22 bp, Homo sapiens
ctggggcattgggagaggcctg

SEQ ID NO: 9322620 - DNA, 22 bp, Homo sapiens
ctggggctctctggaatgcttg

SEQ ID NO: 9322621 - DNA, 22 bp, Homo sapiens
ctggggctcactttggtcaggc

SEQ ID NO: 9322622 - DNA, 22 bp, Homo sapiens
ctggggctcactccagccctgg

SEQ ID NO: 9322623 - DNA, 22 bp, Homo sapiens
ctggggctcactccagccctgg

SEQ ID NO: 9322624 - DNA, 22 bp, Homo sapiens
ctgggctgcttgctgaaggggt

SEQ ID NO: 9322625 - DNA, 22 bp, Homo sapiens
ctgggctgcttgctgaaggggt

SEQ ID NO: 9322626 - DNA, 20 bp, Homo sapiens
ctggggagctgctcccacga

SEQ ID NO: 9322627 - DNA, 20 bp, Homo sapiens
ctggggagctgctcccacga

SEQ ID NO: 9322628 - DNA, 22 bp, Homo sapiens
ctgggctggacacacttaacct

SEQ ID NO: 9322629 - DNA, 23 bp, Homo sapiens
ctgggctgcttgagtccctggct

SEQ ID NO: 9322630 - DNA, 22 bp, Homo sapiens
ctgggctgctcagccccctcgc

SEQ ID NO: 9322631 - DNA, 22 bp, Homo sapiens
ctgggctgctgtccactagggt

SEQ ID NO: 9322632 - DNA, 22 bp, Homo sapiens
ctgggctgcggtggtaggttgt

SEQ ID NO: 9322633 - DNA, 22 bp, Homo sapiens
ctgggctgcgggcgcccctcca

SEQ ID NO: 9322634 - DNA, 22 bp, Homo sapiens
ctgggctgcggttctctgaagc

SEQ ID NO: 9322635 - DNA, 20 bp, Homo sapiens
ctgggctgcccagctatggg

SEQ ID NO: 9322636 - DNA, 22 bp, Homo sapiens
ctgggctgccaggtaggcacac

SEQ ID NO: 9322637 - DNA, 22 bp, Homo sapiens
ctgggctgccaggtaggcacac

SEQ ID NO: 9322638 - DNA, 22 bp, Homo sapiens
ctgggctgcaggagtggggcaa

SEQ ID NO: 9322639 - DNA, 22 bp, Homo sapiens
ctgggctgcagcgggagcgacg

SEQ ID NO: 9322640 - DNA, 22 bp, Homo sapiens
ctgggctgcagcgggagcgacg

SEQ ID NO: 9322641 - DNA, 22 bp, Homo sapiens
ctgggctgcagcgggagcgacg

SEQ ID NO: 9322642 - DNA, 22 bp, Homo sapiens
ctgggctgcatcaaagaggcat

SEQ ID NO: 9322643 - DNA, 22 bp, Homo sapiens
ctgggctgcatcaaagaggcat

SEQ ID NO: 9322644 - DNA, 22 bp, Homo sapiens
ctgggctgcagttcctggtcct

SEQ ID NO: 9322645 - DNA, 22 bp, Homo sapiens
ctgggctgcagttcctggtcct

SEQ ID NO: 9322646 - DNA, 22 bp, Homo sapiens
ctgggctgcaggagtggggcaa

SEQ ID NO: 9322647 - DNA, 22 bp, Homo sapiens
ctgggctgcaggagtggggcaa

SEQ ID NO: 9322648 - DNA, 22 bp, Homo sapiens
ctgggaggattcattgaggtga

SEQ ID NO: 9322649 - DNA, 22 bp, Homo sapiens
ctgggagctcagccctggggtg

SEQ ID NO: 9322650 - DNA, 22 bp, Homo sapiens
ctggctttgttctgattgcttc

SEQ ID NO: 9322651 - DNA, 22 bp, Homo sapiens
ctggcttttcctaaactgggaa

SEQ ID NO: 9322652 - DNA, 22 bp, Homo sapiens
ctggcttttgcaggtgttgcta

SEQ ID NO: 9322653 - DNA, 22 bp, Homo sapiens
ctggcttttggaaacaggctca

SEQ ID NO: 9322654 - DNA, 22 bp, Homo sapiens
ctggcttttttcccattatgca

SEQ ID NO: 9322655 - DNA, 18 bp, Homo sapiens
ctggctttcttatccatc

SEQ ID NO: 9322656 - DNA, 22 bp, Homo sapiens
ctggctttgctggactgggagt

SEQ ID NO: 9322657 - DNA, 22 bp, Homo sapiens
ctggctttctctgtggtgttca

SEQ ID NO: 9322658 - DNA, 22 bp, Homo sapiens
ctggctttctgacatgttactg

SEQ ID NO: 9322659 - DNA, 22 bp, Homo sapiens
ctggctttctatttggtgctat

SEQ ID NO: 9322660 - DNA, 22 bp, Homo sapiens
ctggctgtgctgactgagaggg

SEQ ID NO: 9322661 - DNA, 22 bp, Homo sapiens
ctggctttacctcactggggct

SEQ ID NO: 9322662 - DNA, 22 bp, Homo sapiens
ctggctttcattcattcaggcc

SEQ ID NO: 9322663 - DNA, 22 bp, Homo sapiens
ctggctttcatttcaagcacgt

SEQ ID NO: 9322664 - DNA, 22 bp, Homo sapiens
ctgggcatggacagctgcacag

SEQ ID NO: 9322665 - DNA, 22 bp, Homo sapiens
ctgggcatgaaaaggatgccag

SEQ ID NO: 9322666 - DNA, 22 bp, Homo sapiens
ctgggccaagaagttgtgtatg

SEQ ID NO: 9322667 - DNA, 22 bp, Homo sapiens
ctgggccacatcagatgaagac

SEQ ID NO: 9322668 - DNA, 22 bp, Homo sapiens
ctgggccacaagcctgtgtgat

SEQ ID NO: 9322669 - DNA, 22 bp, Homo sapiens
ctgggaggcggagcttgcagtg

SEQ ID NO: 9322670 - DNA, 22 bp, Homo sapiens
ctgggaggcggagcttgcagtg

SEQ ID NO: 9322671 - DNA, 22 bp, Homo sapiens
ctgggaggcagtctctctagaa

SEQ ID NO: 9322672 - DNA, 22 bp, Homo sapiens
ctgggaggcagaggttgcagtg

SEQ ID NO: 9322673 - DNA, 22 bp, Homo sapiens
ctgccaccaaatagctgcatga

SEQ ID NO: 9322674 - DNA, 22 bp, Homo sapiens
ctggcagcatttttttcagaag

SEQ ID NO: 9322675 - DNA, 22 bp, Homo sapiens
ctggcagcttcaggacactcgg

SEQ ID NO: 9322676 - DNA, 22 bp, Homo sapiens
ctggcagcttcctttgcatctg

SEQ ID NO: 9322677 - DNA, 20 bp, Homo sapiens
ctggcaggagcgagtctacc

SEQ ID NO: 9322678 - DNA, 22 bp, Homo sapiens
ctggcaggagctgtggccgtag

SEQ ID NO: 9322679 - DNA, 22 bp, Homo sapiens
ctggcaggcaaattggtgggag

SEQ ID NO: 9322680 - DNA, 22 bp, Homo sapiens
ctggcaggcggcagagcccagg

SEQ ID NO: 9322681 - DNA, 22 bp, Homo sapiens
ctggcaggctctctggtcggtt

SEQ ID NO: 9322682 - DNA, 22 bp, Homo sapiens
ctggccacccatgcctccctga

SEQ ID NO: 9322683 - DNA, 22 bp, Homo sapiens
ctggccagatgttacgtccaat

SEQ ID NO: 9322684 - DNA, 22 bp, Homo sapiens
ctggccagagttggagggtgtg

SEQ ID NO: 9322685 - DNA, 21 bp, Homo sapiens
ctggccactgcacctcttcct

SEQ ID NO: 9322686 - DNA, 22 bp, Homo sapiens
ctggccactgattcctcccctg

SEQ ID NO: 9322687 - DNA, 22 bp, Homo sapiens
ctggccactgcacctcttcctt

SEQ ID NO: 9322688 - DNA, 22 bp, Homo sapiens
ctggccagcctgtcgatgccct

SEQ ID NO: 9322689 - DNA, 22 bp, Homo sapiens
ctggccctatgagcctcctgat

SEQ ID NO: 9322690 - DNA, 22 bp, Homo sapiens
ctggcctggtctggcctctcca

SEQ ID NO: 9322691 - DNA, 22 bp, Homo sapiens
ctggctcttgcgactcagcttg

SEQ ID NO: 9322692 - DNA, 22 bp, Homo sapiens
ctggctgcaggaaggagtgggc

SEQ ID NO: 9322693 - DNA, 22 bp, Homo sapiens
ctggctgcaggaaggagtgggc

SEQ ID NO: 9322694 - DNA, 22 bp, Homo sapiens
ctggctgcaggatgaggctgcc

SEQ ID NO: 9322695 - DNA, 22 bp, Homo sapiens
ctggctgcaggatgaggctgcc

SEQ ID NO: 9322696 - DNA, 22 bp, Homo sapiens
ctggctcttctgggttctgtgt

SEQ ID NO: 9322697 - DNA, 22 bp, Homo sapiens
ctggctcttctgggttctgtgt

SEQ ID NO: 9322698 - DNA, 22 bp, Homo sapiens
ctggctgccacttcagggtctt

SEQ ID NO: 9322699 - DNA, 22 bp, Homo sapiens
ctggctgcctggagtgagggag

SEQ ID NO: 9322700 - DNA, 22 bp, Homo sapiens
ctggctgcctatagtctccctt

SEQ ID NO: 9322701 - DNA, 22 bp, Homo sapiens
ctggctgcttgggacagccatg

SEQ ID NO: 9322702 - DNA, 22 bp, Homo sapiens
ctggctgctggcctgaggatgc

SEQ ID NO: 9322703 - DNA, 22 bp, Homo sapiens
ctggctgcgtctgctctgacag

SEQ ID NO: 9322704 - DNA, 22 bp, Homo sapiens
ctggctgtgaaatggcagtgtc

SEQ ID NO: 9322705 - DNA, 22 bp, Homo sapiens
ctggctggacttgtgcatgtca

SEQ ID NO: 9322706 - DNA, 20 bp, Homo sapiens
ctggctggaaacttagcctt

SEQ ID NO: 9322707 - DNA, 22 bp, Homo sapiens
ctgttctgtctcatgttgcaca

SEQ ID NO: 9322708 - DNA, 22 bp, Homo sapiens
ctgttgctaagtagtgcaggta

SEQ ID NO: 9322709 - DNA, 22 bp, Homo sapiens
ctgttgcatgactgtgcatgct

SEQ ID NO: 9322710 - DNA, 22 bp, Homo sapiens
ctgttgcatcatggctcttaat

SEQ ID NO: 9322711 - DNA, 22 bp, Homo sapiens
ctgttgctgaggttcaagggtc

SEQ ID NO: 9322712 - DNA, 22 bp, Homo sapiens
ctgttgctctgaacaggtcttg

SEQ ID NO: 9322713 - DNA, 17 bp, Homo sapiens
ctgttccccactactca

SEQ ID NO: 9322714 - DNA, 22 bp, Homo sapiens
ctgttccagatcaggacaccgt

SEQ ID NO: 9322715 - DNA, 22 bp, Homo sapiens
ctgttattttcctctgaactct

SEQ ID NO: 9322716 - DNA, 22 bp, Homo sapiens
ctgttaatggaggactacagga

SEQ ID NO: 9322717 - DNA, 22 bp, Homo sapiens
ctgtgtctaatcaggtcagtca

SEQ ID NO: 9322718 - DNA, 22 bp, Homo sapiens
ctgtgtagtatttgtacacata

SEQ ID NO: 9322719 - DNA, 22 bp, Homo sapiens
ctgtgtcctcccgctgcaccca

SEQ ID NO: 9322720 - DNA, 20 bp, Homo sapiens
ctgtggctcatgcatctgcc

SEQ ID NO: 9322721 - DNA, 22 bp, Homo sapiens
ctgtgagggccagagtcagggc

SEQ ID NO: 9322722 - DNA, 22 bp, Homo sapiens
ctgtgagggtcacagccatgcc

SEQ ID NO: 9322723 - DNA, 22 bp, Homo sapiens
ctgtgagggtcacagccatgcc

SEQ ID NO: 9322724 - DNA, 22 bp, Homo sapiens
ctgtgcagtaggtcagggctgg

SEQ ID NO: 9322725 - DNA, 22 bp, Homo sapiens
ctgtgcagtgtggggtaggcct

SEQ ID NO: 9322726 - DNA, 23 bp, Homo sapiens
ctgtgcccggggctccacctgat

SEQ ID NO: 9322727 - DNA, 22 bp, Homo sapiens
ctgtgccccacagagctccaca

SEQ ID NO: 9322728 - DNA, 22 bp, Homo sapiens
ctgtggccagagcgccgttgac

SEQ ID NO: 9322729 - DNA, 22 bp, Homo sapiens
ctgtggccagatggtgccagtt

SEQ ID NO: 9322730 - DNA, 22 bp, Homo sapiens
ctgtggccccaccctcttggcc

SEQ ID NO: 9322731 - DNA, 22 bp, Homo sapiens
ctgtcctgatggtgccactggt

SEQ ID NO: 9322732 - DNA, 22 bp, Homo sapiens
ctgtcctgagttcttggaggtc

SEQ ID NO: 9322733 - DNA, 22 bp, Homo sapiens
ctgtcctgaggcaggtggcctg

SEQ ID NO: 9322734 - DNA, 22 bp, Homo sapiens
ctgtcctgaggcaggtggcctg

SEQ ID NO: 9322735 - DNA, 22 bp, Homo sapiens
ctgtcctgcagttgggggcagg

SEQ ID NO: 9322736 - DNA, 22 bp, Homo sapiens
ctgtcctgccagtcctggactc

SEQ ID NO: 9322737 - DNA, 22 bp, Homo sapiens
ctgtcctgcccaccctgcaggg

SEQ ID NO: 9322738 - DNA, 22 bp, Homo sapiens
ctgtcctgtagctccatcagtc

SEQ ID NO: 9322739 - DNA, 22 bp, Homo sapiens
ctgtcctggtgctggggatccc

SEQ ID NO: 9322740 - DNA, 22 bp, Homo sapiens
ctgtccctgagcaactcctgtt

SEQ ID NO: 9322741 - DNA, 22 bp, Homo sapiens
ctgtcctgaaagggagattggg

SEQ ID NO: 9322742 - DNA, 22 bp, Homo sapiens
cttgtcttgcacacggttgcca

SEQ ID NO: 9322743 - DNA, 21 bp, Homo sapiens
cttgtcttgcttagaatagac

SEQ ID NO: 9322744 - DNA, 22 bp, Homo sapiens
cttgtattatggttcgcttagt

SEQ ID NO: 9322745 - DNA, 22 bp, Homo sapiens
cttgtattgcaaactggccagg

SEQ ID NO: 9322746 - DNA, 22 bp, Homo sapiens
cttgtagacccctggactcacg

SEQ ID NO: 9322747 - DNA, 22 bp, Homo sapiens
cttcctggatgagcaggctgat

SEQ ID NO: 9322748 - DNA, 22 bp, Homo sapiens
cttgacattcttaataatttta

SEQ ID NO: 9322749 - DNA, 22 bp, Homo sapiens
cttcctgggtcagcctggaggt

SEQ ID NO: 9322750 - DNA, 22 bp, Homo sapiens
cttcctggctcggtgcctcacc

SEQ ID NO: 9322751 - DNA, 22 bp, Homo sapiens
cttgcagatgtgactaaattaa

SEQ ID NO: 9322752 - DNA, 20 bp, Homo sapiens
cttgattctttgatgaggta

SEQ ID NO: 9322753 - DNA, 22 bp, Homo sapiens
cttgattctcagaatgcttgct

SEQ ID NO: 9322754 - DNA, 22 bp, Homo sapiens
cttgcaaacactcaaagccatc

SEQ ID NO: 9322755 - DNA, 22 bp, Homo sapiens
cttgcaaagtagctgagaggtt

SEQ ID NO: 9322756 - DNA, 22 bp, Homo sapiens
cttgatgactcaggaggaggag

SEQ ID NO: 9322757 - DNA, 22 bp, Homo sapiens
cttcagctgtggtctccaaggc

SEQ ID NO: 9322758 - DNA, 22 bp, Homo sapiens
cttcagtatcctccacatgtta

SEQ ID NO: 9322759 - DNA, 22 bp, Homo sapiens
cttcagtctccaatgctctgtg

SEQ ID NO: 9322760 - DNA, 22 bp, Homo sapiens
cttcagtccttaagccaagcaa

SEQ ID NO: 9322761 - DNA, 22 bp, Homo sapiens
cttcagtccccagcaagctgtt

SEQ ID NO: 9322762 - DNA, 22 bp, Homo sapiens
cttcagggtgacgcaggctgca

SEQ ID NO: 9322763 - DNA, 19 bp, Homo sapiens
cttcagggaggggccaggc

SEQ ID NO: 9322764 - DNA, 22 bp, Homo sapiens
cttcagggaggagcatgggttc

SEQ ID NO: 9322765 - DNA, 19 bp, Homo sapiens
cttcagggaggggccaggc

SEQ ID NO: 9322766 - DNA, 22 bp, Homo sapiens
cttcctctgcctcccgtgctca

SEQ ID NO: 9322767 - DNA, 22 bp, Homo sapiens
cttcagtgttcccatctgtaaa

SEQ ID NO: 9322768 - DNA, 19 bp, Homo sapiens
ctgttgctggggctctctt

SEQ ID NO: 9322769 - DNA, 22 bp, Homo sapiens
cttattctactccacaagctct

SEQ ID NO: 9322770 - DNA, 22 bp, Homo sapiens
cttattcttgtcttattgtgct

SEQ ID NO: 9322771 - DNA, 22 bp, Homo sapiens
cttatttaatgagggttagaat

SEQ ID NO: 9322772 - DNA, 22 bp, Homo sapiens
cttcagaactataaaaagtact

SEQ ID NO: 9322773 - DNA, 22 bp, Homo sapiens
cttcagcatctttttcttgggg

SEQ ID NO: 9322774 - DNA, 17 bp, Homo sapiens
ggacacagctcatggct

SEQ ID NO: 9322775 - DNA, 22 bp, Homo sapiens
ggacaaaaatcagccatctcta

SEQ ID NO: 9322776 - DNA, 22 bp, Homo sapiens
ggaatgttctggaacaccgctt

SEQ ID NO: 9322777 - DNA, 22 bp, Homo sapiens
ggaatctttgaaggattttaag

SEQ ID NO: 9322778 - DNA, 20 bp, Homo sapiens
ggaatctttgcaggaaaata

SEQ ID NO: 9322779 - DNA, 22 bp, Homo sapiens
ggaatgatggtgcctagattat

SEQ ID NO: 9322780 - DNA, 22 bp, Homo sapiens
ggaatgtaacgtgaccaagttc

SEQ ID NO: 9322781 - DNA, 22 bp, Homo sapiens
ggaagcactgaggcagagaggg

SEQ ID NO: 9322782 - DNA, 22 bp, Homo sapiens
ggaatcttaatggcatggagtt

SEQ ID NO: 9322783 - DNA, 22 bp, Homo sapiens
ggaagatttcccgtagctgtgc

SEQ ID NO: 9322784 - DNA, 22 bp, Homo sapiens
ggaagattttccattcctcttt

SEQ ID NO: 9322785 - DNA, 22 bp, Homo sapiens
ggaagattcagttatctcatga

SEQ ID NO: 9322786 - DNA, 18 bp, Homo sapiens
ggaagattggctatgtgc

SEQ ID NO: 9322787 - DNA, 22 bp, Homo sapiens
gctttattttgtgagggattac

SEQ ID NO: 9322788 - DNA, 22 bp, Homo sapiens
gctttattttgtgagggattac

SEQ ID NO: 9322789 - DNA, 22 bp, Homo sapiens
gctttcaaatcctaattccaac

SEQ ID NO: 9322790 - DNA, 22 bp, Homo sapiens
gctttcaaggaatttggtattt

SEQ ID NO: 9322791 - DNA, 20 bp, Homo sapiens
gctttcaagcttgtcattgt

SEQ ID NO: 9322792 - DNA, 18 bp, Homo sapiens
gctttcaatttctttcct

SEQ ID NO: 9322793 - DNA, 22 bp, Homo sapiens
ggagagaattcagcttaagatt

SEQ ID NO: 9322794 - DNA, 22 bp, Homo sapiens
ggagagaactgacctgaaagga

SEQ ID NO: 9322795 - DNA, 22 bp, Homo sapiens
ggagacagtggtagggcctaag

SEQ ID NO: 9322796 - DNA, 22 bp, Homo sapiens
ggagcagggaattacagcgcag

SEQ ID NO: 9322797 - DNA, 22 bp, Homo sapiens
ggagcagatgtcttcatggcct

SEQ ID NO: 9322798 - DNA, 22 bp, Homo sapiens
ggagagaccctggagaaggtcc

SEQ ID NO: 9322799 - DNA, 22 bp, Homo sapiens
ggacagtattcattggagagaa

SEQ ID NO: 9322800 - DNA, 22 bp, Homo sapiens
ggacaggtgcaaagggcacatg

SEQ ID NO: 9322801 - DNA, 22 bp, Homo sapiens
ggacaggtgactgcccagagtg

SEQ ID NO: 9322802 - DNA, 22 bp, Homo sapiens
ggacagggtaagtactagtgtg

SEQ ID NO: 9322803 - DNA, 22 bp, Homo sapiens
ggacatggaaatcggcttgctc

SEQ ID NO: 9322804 - DNA, 22 bp, Homo sapiens
ggacatgattagcagggagagc

SEQ ID NO: 9322805 - DNA, 21 bp, Homo sapiens
ggacatgaggcaggagaggct

SEQ ID NO: 9322806 - DNA, 22 bp, Homo sapiens
ggagacagtatggcttgtagct

SEQ ID NO: 9322807 - DNA, 22 bp, Homo sapiens
gctgtgtatcagatgccacggg

SEQ ID NO: 9322808 - DNA, 22 bp, Homo sapiens
gctgtgtcagaaactctgggga

SEQ ID NO: 9322809 - DNA, 22 bp, Homo sapiens
gctgtgtgaccctagccagtag

SEQ ID NO: 9322810 - DNA, 22 bp, Homo sapiens
gctgtgtcctcacacagccttt

SEQ ID NO: 9322811 - DNA, 22 bp, Homo sapiens
gctttatgtaagtccaaaggca

SEQ ID NO: 9322812 - DNA, 18 bp, Homo sapiens
gctttatttcttggggaa

SEQ ID NO: 9322813 - DNA, 18 bp, Homo sapiens
gctttatttcttggggaa

SEQ ID NO: 9322814 - DNA, 20 bp, Homo sapiens
gcttgcccacatctgcactg

SEQ ID NO: 9322815 - DNA, 22 bp, Homo sapiens
gcttgcaagataggttacttaa

SEQ ID NO: 9322816 - DNA, 22 bp, Homo sapiens
gcttgactaggctctggcgaca

SEQ ID NO: 9322817 - DNA, 20 bp, Homo sapiens
gcttcttttctggcccatga

SEQ ID NO: 9322818 - DNA, 22 bp, Homo sapiens
gcttctttggcaaccctgacat

SEQ ID NO: 9322819 - DNA, 22 bp, Homo sapiens
gctgtgggacaggtccagccag

SEQ ID NO: 9322820 - DNA, 22 bp, Homo sapiens
gctgtgggtaaacgctgagggt

SEQ ID NO: 9322821 - DNA, 19 bp, Homo sapiens
gctgtgggacagcagggtg

SEQ ID NO: 9322822 - DNA, 22 bp, Homo sapiens
gctggggctgggctgaggaaga

SEQ ID NO: 9322823 - DNA, 19 bp, Homo sapiens
gctggggcctgaccagaca

SEQ ID NO: 9322824 - DNA, 22 bp, Homo sapiens
gctgggcttggtttccctgctt

SEQ ID NO: 9322825 - DNA, 22 bp, Homo sapiens
gctggggaggcagcagagaaca

SEQ ID NO: 9322826 - DNA, 22 bp, Homo sapiens
gctggggagggcgtcaaggcca

SEQ ID NO: 9322827 - DNA, 22 bp, Homo sapiens
gctggggaggcagcagagaaca

SEQ ID NO: 9322828 - DNA, 22 bp, Homo sapiens
gctggagaacccaggaggaaga

SEQ ID NO: 9322829 - DNA, 22 bp, Homo sapiens
gctggagaaacaggaggaggaa

SEQ ID NO: 9322830 - DNA, 22 bp, Homo sapiens
gctggagagataggcatggggt

SEQ ID NO: 9322831 - DNA, 22 bp, Homo sapiens
gctggctgccttactttgtgga

SEQ ID NO: 9322832 - DNA, 22 bp, Homo sapiens
gctggctgcgtcatcacagggc

SEQ ID NO: 9322833 - DNA, 22 bp, Homo sapiens
gctggctgcgtcatcacagggc

SEQ ID NO: 9322834 - DNA, 22 bp, Homo sapiens
gctggctgctgttgagacttgt

SEQ ID NO: 9322835 - DNA, 22 bp, Homo sapiens
gctggctgctaggacagctaca

SEQ ID NO: 9322836 - DNA, 23 bp, Homo sapiens
gctggctggcagtaaaggttgtt

SEQ ID NO: 9322837 - DNA, 22 bp, Homo sapiens
gctggctggcgggtgcgtcctc

SEQ ID NO: 9322838 - DNA, 22 bp, Homo sapiens
gctggctggatggttggttcgc

SEQ ID NO: 9322839 - DNA, 22 bp, Homo sapiens
gctggctggcacgttcgcacgt

SEQ ID NO: 9322840 - DNA, 22 bp, Homo sapiens
gctggctggagtgagctaccct

SEQ ID NO: 9322841 - DNA, 22 bp, Homo sapiens
gctggctggagtaaggagggag

SEQ ID NO: 9322842 - DNA, 22 bp, Homo sapiens
gctggctggaggtgaggaagaa

SEQ ID NO: 9322843 - DNA, 22 bp, Homo sapiens
gctggctggaatgggagaagaa

SEQ ID NO: 9322844 - DNA, 22 bp, Homo sapiens
gctggctggaactagcagttgg

SEQ ID NO: 9322845 - DNA, 19 bp, Homo sapiens
gctggctggaggagggaca

SEQ ID NO: 9322846 - DNA, 22 bp, Homo sapiens
gctggctggaggagggaggttg

SEQ ID NO: 9322847 - DNA, 22 bp, Homo sapiens
gctggctggaggagggaggttg

SEQ ID NO: 9322848 - DNA, 22 bp, Homo sapiens
gctgggctgtagtttgctgacc

SEQ ID NO: 9322849 - DNA, 23 bp, Homo sapiens
gctgggcttactctttcagtgag

SEQ ID NO: 9322850 - DNA, 21 bp, Homo sapiens
gctggctttcctggatgtgca

SEQ ID NO: 9322851 - DNA, 22 bp, Homo sapiens
gctggctttgtcaagggcagca

SEQ ID NO: 9322852 - DNA, 22 bp, Homo sapiens
gctggctgttggaggtacctgc

SEQ ID NO: 9322853 - DNA, 22 bp, Homo sapiens
gctggctgttgaataatggcat

SEQ ID NO: 9322854 - DNA, 21 bp, Homo sapiens
gctggctggctgaccggcctt

SEQ ID NO: 9322855 - DNA, 22 bp, Homo sapiens
gctggctgtgattttgccaaca

SEQ ID NO: 9322856 - DNA, 22 bp, Homo sapiens
gctggctgtggcttaagcaaac

SEQ ID NO: 9322857 - DNA, 22 bp, Homo sapiens
gctggctgtgggctccacgctc

SEQ ID NO: 9322858 - DNA, 22 bp, Homo sapiens
gctggctgtgttccttctgcca

SEQ ID NO: 9322859 - DNA, 22 bp, Homo sapiens
gctggctgtgttccttctgcca

SEQ ID NO: 9322860 - DNA, 22 bp, Homo sapiens
gctggctgtgttccttctgcca

SEQ ID NO: 9322861 - DNA, 22 bp, Homo sapiens
gctggctgtgtttcatctctga

SEQ ID NO: 9322862 - DNA, 19 bp, Homo sapiens
gctgagggccacccagccc

SEQ ID NO: 9322863 - DNA, 22 bp, Homo sapiens
gctgagggctgtaacagcagag

SEQ ID NO: 9322864 - DNA, 22 bp, Homo sapiens
gctgagggcatgtgtggcgact

SEQ ID NO: 9322865 - DNA, 22 bp, Homo sapiens
gctgccccagctgggggctgga

SEQ ID NO: 9322866 - DNA, 22 bp, Homo sapiens
gctgccctacccgaggcactct

SEQ ID NO: 9322867 - DNA, 22 bp, Homo sapiens
gctgcttctcctccctggggat

SEQ ID NO: 9322868 - DNA, 22 bp, Homo sapiens
gctgcttctctgatggagtcca

SEQ ID NO: 9322869 - DNA, 22 bp, Homo sapiens
gctgcttcctttcctgctgacc

SEQ ID NO: 9322870 - DNA, 22 bp, Homo sapiens
gctgcttcctagaaggcccagt

SEQ ID NO: 9322871 - DNA, 22 bp, Homo sapiens
gctgcttcagggacgtgccagc

SEQ ID NO: 9322872 - DNA, 22 bp, Homo sapiens
gctgctccgtctgagctctggt

SEQ ID NO: 9322873 - DNA, 22 bp, Homo sapiens
gctgctccagtgttctgtctag

SEQ ID NO: 9322874 - DNA, 22 bp, Homo sapiens
gctctgggccatcctggccggg

SEQ ID NO: 9322875 - DNA, 22 bp, Homo sapiens
gctctgggccatcctggccggg

SEQ ID NO: 9322876 - DNA, 22 bp, Homo sapiens
gctctgggccgggcaccagcct

SEQ ID NO: 9322877 - DNA, 22 bp, Homo sapiens
gctctgggaattcagaaagcct

SEQ ID NO: 9322878 - DNA, 22 bp, Homo sapiens
gctctgggattaccagccttag

SEQ ID NO: 9322879 - DNA, 22 bp, Homo sapiens
gctctggggatgcttctgccgt

SEQ ID NO: 9322880 - DNA, 23 bp, Homo sapiens
gctgaatgtaatgttctttgggt

SEQ ID NO: 9322881 - DNA, 18 bp, Homo sapiens
gctgaatgtctgctttgc

SEQ ID NO: 9322882 - DNA, 22 bp, Homo sapiens
gctgaatgaatgtattttaaaa

SEQ ID NO: 9322883 - DNA, 22 bp, Homo sapiens
gctctgggaaggatcgtagtga

SEQ ID NO: 9322884 - DNA, 22 bp, Homo sapiens
gctctgggaactgactgccttc

SEQ ID NO: 9322885 - DNA, 22 bp, Homo sapiens
gctctggcttggggcactcgtc

SEQ ID NO: 9322886 - DNA, 22 bp, Homo sapiens
gctccgccacgcccactcctac

SEQ ID NO: 9322887 - DNA, 22 bp, Homo sapiens
gctccctgtgctctgagtgata

SEQ ID NO: 9322888 - DNA, 23 bp, Homo sapiens
gctccctgtgctccaggagatgc

SEQ ID NO: 9322889 - DNA, 22 bp, Homo sapiens
gctcctccctgtgcagacccag

SEQ ID NO: 9322890 - DNA, 22 bp, Homo sapiens
gctgaggctgggagcagcctgt

SEQ ID NO: 9322891 - DNA, 22 bp, Homo sapiens
gctgaggctcctcgggaggaca

SEQ ID NO: 9322892 - DNA, 22 bp, Homo sapiens
gctgaggccccagggtgatggg

SEQ ID NO: 9322893 - DNA, 22 bp, Homo sapiens
gctgaggcctcagaaggctgag

SEQ ID NO: 9322894 - DNA, 22 bp, Homo sapiens
gctgaggctcaagtcatgggtc

SEQ ID NO: 9322895 - DNA, 22 bp, Homo sapiens
gctgagagcggccagctgggaa

SEQ ID NO: 9322896 - DNA, 22 bp, Homo sapiens
gctgagagatcaaggcaggatt

SEQ ID NO: 9322897 - DNA, 22 bp, Homo sapiens
gctgagagcaaagcatgtctag

SEQ ID NO: 9322898 - DNA, 17 bp, Homo sapiens
gctgagaggcagcacag

SEQ ID NO: 9322899 - DNA, 21 bp, Homo sapiens
gctgagaggttgggaagttca

SEQ ID NO: 9322900 - DNA, 22 bp, Homo sapiens
gctgagaggcagccagaccctc

SEQ ID NO: 9322901 - DNA, 22 bp, Homo sapiens
gctgagacttccactgccatct

SEQ ID NO: 9322902 - DNA, 22 bp, Homo sapiens
gctcccacaaccttcttgctcc

SEQ ID NO: 9322903 - DNA, 22 bp, Homo sapiens
gctcccaccaggcagacctacc

SEQ ID NO: 9322904 - DNA, 22 bp, Homo sapiens
gctcccaccaggcagacctacc

SEQ ID NO: 9322905 - DNA, 22 bp, Homo sapiens
gctcccacaaccttcttgctcc

SEQ ID NO: 9322906 - DNA, 22 bp, Homo sapiens
gctcccaccgccgctatgggta

SEQ ID NO: 9322907 - DNA, 22 bp, Homo sapiens
gctcccaccgccgctatgggta

SEQ ID NO: 9322908 - DNA, 22 bp, Homo sapiens
gctcccaccttaaccttcacat

SEQ ID NO: 9322909 - DNA, 22 bp, Homo sapiens
gctcccacctccagcctgagtt

SEQ ID NO: 9322910 - DNA, 22 bp, Homo sapiens
gctcccacctccagcctgagtt

SEQ ID NO: 9322911 - DNA, 22 bp, Homo sapiens
gctcccactgcagccctgagcc

SEQ ID NO: 9322912 - DNA, 22 bp, Homo sapiens
gctcccactgcagccctgagcc

SEQ ID NO: 9322913 - DNA, 22 bp, Homo sapiens
gctcccacctttgctatcagta

SEQ ID NO: 9322914 - DNA, 22 bp, Homo sapiens
gctcccacgcaattcttttcag

SEQ ID NO: 9322915 - DNA, 22 bp, Homo sapiens
gctcccaccttaaccttcacat

SEQ ID NO: 9322916 - DNA, 22 bp, Homo sapiens
gctcccacctttgctatcagta

SEQ ID NO: 9322917 - DNA, 22 bp, Homo sapiens
gctcccacgcaattcttttcag

SEQ ID NO: 9322918 - DNA, 22 bp, Homo sapiens
gctcccagaaccaaggctgggg

SEQ ID NO: 9322919 - DNA, 20 bp, Homo sapiens
gctccaggtcagagaggacg

SEQ ID NO: 9322920 - DNA, 22 bp, Homo sapiens
gctccaggtgaatcctctcacc

SEQ ID NO: 9322921 - DNA, 22 bp, Homo sapiens
gctccaggtgaatcctctcacc

SEQ ID NO: 9322922 - DNA, 22 bp, Homo sapiens
gctccaggtatttgccctttta

SEQ ID NO: 9322923 - DNA, 22 bp, Homo sapiens
gctccaggtgtcccaggtaaaa

SEQ ID NO: 9322924 - DNA, 22 bp, Homo sapiens
gctccaggtgtcccaggtaaaa

SEQ ID NO: 9322925 - DNA, 22 bp, Homo sapiens
gctccaggtggcttatttgtat

SEQ ID NO: 9322926 - DNA, 22 bp, Homo sapiens
gctccctgcagctgagagttcc

SEQ ID NO: 9322927 - DNA, 22 bp, Homo sapiens
gctccctgactcagttcctgag

SEQ ID NO: 9322928 - DNA, 22 bp, Homo sapiens
gctccctggtagccatgctctc

SEQ ID NO: 9322929 - DNA, 23 bp, Homo sapiens
gctccctgtccctgcacttaggc

SEQ ID NO: 9322930 - DNA, 20 bp, Homo sapiens
gctccctggtagaaatgttt

SEQ ID NO: 9322931 - DNA, 22 bp, Homo sapiens
gctccaggcagagcctctttcg

SEQ ID NO: 9322932 - DNA, 22 bp, Homo sapiens
gctccaggataataaagttgtt

SEQ ID NO: 9322933 - DNA, 22 bp, Homo sapiens
gctccaggaggctcccgcgtct

SEQ ID NO: 9322934 - DNA, 22 bp, Homo sapiens
gctccagggtcagctcagaact

SEQ ID NO: 9322935 - DNA, 22 bp, Homo sapiens
gctccagggtcagctcagaact

SEQ ID NO: 9322936 - DNA, 22 bp, Homo sapiens
gctccagggtggatgacaattc

SEQ ID NO: 9322937 - DNA, 22 bp, Homo sapiens
gctccagggagtacatttatca

SEQ ID NO: 9322938 - DNA, 22 bp, Homo sapiens
gctccagggacccaagagaaaa

SEQ ID NO: 9322939 - DNA, 22 bp, Homo sapiens
gctcagcgtggacctggagctt

SEQ ID NO: 9322940 - DNA, 22 bp, Homo sapiens
gctcagagttaattggatgggt

SEQ ID NO: 9322941 - DNA, 22 bp, Homo sapiens
gctcagagttaaatatagtgct

SEQ ID NO: 9322942 - DNA, 22 bp, Homo sapiens
gctcagagttaattggatgggt

SEQ ID NO: 9322943 - DNA, 22 bp, Homo sapiens
gctcagaggccaagtgcccgcc

SEQ ID NO: 9322944 - DNA, 22 bp, Homo sapiens
gctcagaggccactgttggaaa

SEQ ID NO: 9322945 - DNA, 22 bp, Homo sapiens
gctcagagggaacaaggggctg

SEQ ID NO: 9322946 - DNA, 22 bp, Homo sapiens
gctcagagcttgaagttccact

SEQ ID NO: 9322947 - DNA, 22 bp, Homo sapiens
gctcagaggaggcctttaccta

SEQ ID NO: 9322948 - DNA, 22 bp, Homo sapiens
gctcagaggatgctcctttatg

SEQ ID NO: 9322949 - DNA, 22 bp, Homo sapiens
gctcagaggagcatcataagga

SEQ ID NO: 9322950 - DNA, 22 bp, Homo sapiens
gctcagaggcacgacctcttgg

SEQ ID NO: 9322951 - DNA, 19 bp, Homo sapiens
gctcagagtccccctgcgg

SEQ ID NO: 9322952 - DNA, 22 bp, Homo sapiens
gctcagagtggcctggctaggg

SEQ ID NO: 9322953 - DNA, 17 bp, Homo sapiens
gctcagagtacacgtgt

SEQ ID NO: 9322954 - DNA, 21 bp, Homo sapiens
gctcagagtattgcactgttt

SEQ ID NO: 9322955 - DNA, 22 bp, Homo sapiens
gctcagagggttttggccaagt

SEQ ID NO: 9322956 - DNA, 19 bp, Homo sapiens
gctcagagggccctgtgct

SEQ ID NO: 9322957 - DNA, 23 bp, Homo sapiens
gctcagaggtttttctctggatg

SEQ ID NO: 9322958 - DNA, 22 bp, Homo sapiens
gctcagaggttgttcttgggtt

SEQ ID NO: 9322959 - DNA, 23 bp, Homo sapiens
gctcagaggtgaaatgttttggg

SEQ ID NO: 9322960 - DNA, 22 bp, Homo sapiens
gccttggctgttggagcttgat

SEQ ID NO: 9322961 - DNA, 22 bp, Homo sapiens
gccttgggacggaggggtcacc

SEQ ID NO: 9322962 - DNA, 22 bp, Homo sapiens
gccttgggattcttggatgctc

SEQ ID NO: 9322963 - DNA, 22 bp, Homo sapiens
gccttgggggtgaaagaggcta

SEQ ID NO: 9322964 - DNA, 22 bp, Homo sapiens
gccttgggccagctgctctgga

SEQ ID NO: 9322965 - DNA, 22 bp, Homo sapiens
gccttgggcacaggcagggccc

SEQ ID NO: 9322966 - DNA, 22 bp, Homo sapiens
gccttggctgccaagctgctga

SEQ ID NO: 9322967 - DNA, 23 bp, Homo sapiens
gccttggcgatccgtggggcatc

SEQ ID NO: 9322968 - DNA, 22 bp, Homo sapiens
gccttggccttcctaggcctga

SEQ ID NO: 9322969 - DNA, 22 bp, Homo sapiens
gccttggccaacaccttgcaaa

SEQ ID NO: 9322970 - DNA, 19 bp, Homo sapiens
gccttggcattctctgctt

SEQ ID NO: 9322971 - DNA, 22 bp, Homo sapiens
gccttggccttcctaggcctga

SEQ ID NO: 9322972 - DNA, 20 bp, Homo sapiens
gcctgagctattgccaggat

SEQ ID NO: 9322973 - DNA, 20 bp, Homo sapiens
gcctgagctccgcctcctgt

SEQ ID NO: 9322974 - DNA, 20 bp, Homo sapiens
gcctgagctccgcctcctgt

SEQ ID NO: 9322975 - DNA, 22 bp, Homo sapiens
gccttgctttgcttctggacag

SEQ ID NO: 9322976 - DNA, 22 bp, Homo sapiens
gcctctgggtgacgaaaggtga

SEQ ID NO: 9322977 - DNA, 22 bp, Homo sapiens
gcctctggggttaatagagttt

SEQ ID NO: 9322978 - DNA, 22 bp, Homo sapiens
gcctctggggcagctgagtcat

SEQ ID NO: 9322979 - DNA, 22 bp, Homo sapiens
gcctctgggggctcagacctgt

SEQ ID NO: 9322980 - DNA, 19 bp, Homo sapiens
gcctgagccagccatgcaa

SEQ ID NO: 9322981 - DNA, 22 bp, Homo sapiens
gcctctgtaggagtgagagcat

SEQ ID NO: 9322982 - DNA, 22 bp, Homo sapiens
gcctctgtggctcagccttgct

SEQ ID NO: 9322983 - DNA, 22 bp, Homo sapiens
gcctgagcagctatacacacag

SEQ ID NO: 9322984 - DNA, 22 bp, Homo sapiens
gcctttcctgctctggcattca

SEQ ID NO: 9322985 - DNA, 22 bp, Homo sapiens
gcctttatcagtttcatggctt

SEQ ID NO: 9322986 - DNA, 22 bp, Homo sapiens
gcctttatatttttctggtgtt

SEQ ID NO: 9322987 - DNA, 22 bp, Homo sapiens
gcctttatatccctgatatcta

SEQ ID NO: 9322988 - DNA, 17 bp, Homo sapiens
gcctttatacatgctgc

SEQ ID NO: 9322989 - DNA, 22 bp, Homo sapiens
gcctttatcttcctgattcaga

SEQ ID NO: 9322990 - DNA, 22 bp, Homo sapiens
gcggtccaggagcgcaggtcct

SEQ ID NO: 9322991 - DNA, 22 bp, Homo sapiens
gcggtggggaaaggaggtgctg

SEQ ID NO: 9322992 - DNA, 22 bp, Homo sapiens
gcggtgggggaaaggagcggtt

SEQ ID NO: 9322993 - DNA, 22 bp, Homo sapiens
gcggtgggggaaaggagcggtt

SEQ ID NO: 9322994 - DNA, 22 bp, Homo sapiens
gcggtggggaaaggaggtgctg

SEQ ID NO: 9322995 - DNA, 22 bp, Homo sapiens
gcgtggcttagagtggggtacc

SEQ ID NO: 9322996 - DNA, 22 bp, Homo sapiens
gcgtggcttagagtggggtacc

SEQ ID NO: 9322997 - DNA, 22 bp, Homo sapiens
gcgtggggcagcccagggcttc

SEQ ID NO: 9322998 - DNA, 22 bp, Homo sapiens
gctacaggagctgtcacatgct

SEQ ID NO: 9322999 - DNA, 23 bp, Homo sapiens
gcaggacaacagagtgggaaggc

SEQ ID NO: 9323000 - DNA, 22 bp, Homo sapiens
gcaggacaaaatttccagggtg

SEQ ID NO: 9323001 - DNA, 22 bp, Homo sapiens
gcagcctcaaactccccagctc

SEQ ID NO: 9323002 - DNA, 22 bp, Homo sapiens
gcagccctcgggtactcacgtg

SEQ ID NO: 9323003 - DNA, 22 bp, Homo sapiens
gcagatggtggggcaggaaaat

SEQ ID NO: 9323004 - DNA, 22 bp, Homo sapiens
gcagatggtgggggaggagtac

SEQ ID NO: 9323005 - DNA, 22 bp, Homo sapiens
gcagatggtggaggcaagaggc

SEQ ID NO: 9323006 - DNA, 22 bp, Homo sapiens
gcagatggtgccatgtcttgtg

SEQ ID NO: 9323007 - DNA, 21 bp, Homo sapiens
gcagatgggagtcatcaggct

SEQ ID NO: 9323008 - DNA, 21 bp, Homo sapiens
gcagatgggagtcatcaggct

SEQ ID NO: 9323009 - DNA, 22 bp, Homo sapiens
gcagatggctcagacactgggg

SEQ ID NO: 9323010 - DNA, 22 bp, Homo sapiens
gcagatggctgagcctgcagat

SEQ ID NO: 9323011 - DNA, 22 bp, Homo sapiens
gcagatggctgagcctgcagat

SEQ ID NO: 9323012 - DNA, 22 bp, Homo sapiens
gcagatgggagccccaggggag

SEQ ID NO: 9323013 - DNA, 22 bp, Homo sapiens
gcagatgggagccccaggggag

SEQ ID NO: 9323014 - DNA, 23 bp, Homo sapiens
gcagatggccccagagtgctgcc

SEQ ID NO: 9323015 - DNA, 22 bp, Homo sapiens
gcagatggctcagacactgggg

SEQ ID NO: 9323016 - DNA, 22 bp, Homo sapiens
gcagatggcgcagtggaagttc

SEQ ID NO: 9323017 - DNA, 22 bp, Homo sapiens
gcagatggcagcccaggctggg

SEQ ID NO: 9323018 - DNA, 23 bp, Homo sapiens
gcagatggccccagagtgctgcc

SEQ ID NO: 9323019 - DNA, 22 bp, Homo sapiens
gcagatggcagcccaggctggg

SEQ ID NO: 9323020 - DNA, 18 bp, Homo sapiens
gcagatggagattcaggg

SEQ ID NO: 9323021 - DNA, 22 bp, Homo sapiens
gcagatggagataaatggaact

SEQ ID NO: 9323022 - DNA, 22 bp, Homo sapiens
gcagatggagacgaggttccgc

SEQ ID NO: 9323023 - DNA, 22 bp, Homo sapiens
gcagatggatcacctgaggtcg

SEQ ID NO: 9323024 - DNA, 22 bp, Homo sapiens
gcagcccaggaggcgggagccc

SEQ ID NO: 9323025 - DNA, 22 bp, Homo sapiens
gcagcccaggctcgctcactgc

SEQ ID NO: 9323026 - DNA, 22 bp, Homo sapiens
gcagatggtgggggaggagtac

SEQ ID NO: 9323027 - DNA, 22 bp, Homo sapiens
gcagatgtaatggctggaggtc

SEQ ID NO: 9323028 - DNA, 22 bp, Homo sapiens
gcagcccagagcgcaggacccc

SEQ ID NO: 9323029 - DNA, 22 bp, Homo sapiens
gcagggacacctttgtgaagct

SEQ ID NO: 9323030 - DNA, 22 bp, Homo sapiens
gcagggaccaaaagaggcagta

SEQ ID NO: 9323031 - DNA, 22 bp, Homo sapiens
gcagggaccaaaagaggcagta

SEQ ID NO: 9323032 - DNA, 22 bp, Homo sapiens
gcagggctctgctgtagtccta

SEQ ID NO: 9323033 - DNA, 22 bp, Homo sapiens
gcagggacctatgacgatggaa

SEQ ID NO: 9323034 - DNA, 22 bp, Homo sapiens
gcagggctggggctgctcctga

SEQ ID NO: 9323035 - DNA, 22 bp, Homo sapiens
gcagggctgaaggtcccaggcc

SEQ ID NO: 9323036 - DNA, 22 bp, Homo sapiens
gcagggctggggctgctcctga

SEQ ID NO: 9323037 - DNA, 22 bp, Homo sapiens
gcagggctgggtcctgtctcat

SEQ ID NO: 9323038 - DNA, 22 bp, Homo sapiens
gcagggctgggtgggagacaga

SEQ ID NO: 9323039 - DNA, 22 bp, Homo sapiens
gcagggctgtaatttgagcctg

SEQ ID NO: 9323040 - DNA, 22 bp, Homo sapiens
gcagggctgtggacactttggt

SEQ ID NO: 9323041 - DNA, 22 bp, Homo sapiens
gcagggctgggtgggagacaga

SEQ ID NO: 9323042 - DNA, 22 bp, Homo sapiens
gcagggctgggtgggagacaga

SEQ ID NO: 9323043 - DNA, 22 bp, Homo sapiens
gcagggctgtttagtgaatagg

SEQ ID NO: 9323044 - DNA, 22 bp, Homo sapiens
gcagggctgttcaggagggtgg

SEQ ID NO: 9323045 - DNA, 22 bp, Homo sapiens
gcagggctgttcaggagggtgg

SEQ ID NO: 9323046 - DNA, 22 bp, Homo sapiens
gcagggctgtggacactttggt

SEQ ID NO: 9323047 - DNA, 22 bp, Homo sapiens
gcagggctttttgaaacatggt

SEQ ID NO: 9323048 - DNA, 22 bp, Homo sapiens
gcagggcttgcagcagctagac

SEQ ID NO: 9323049 - DNA, 22 bp, Homo sapiens
gcagggcttagaaatggtggct

SEQ ID NO: 9323050 - DNA, 22 bp, Homo sapiens
gcagggcttagaaatggtggct

SEQ ID NO: 9323051 - DNA, 22 bp, Homo sapiens
gcaggcagttatttagtagaat

SEQ ID NO: 9323052 - DNA, 19 bp, Homo sapiens
gcaggcagtggcattcgga

SEQ ID NO: 9323053 - DNA, 22 bp, Homo sapiens
gcaggcagtcatctttcatatt

SEQ ID NO: 9323054 - DNA, 19 bp, Homo sapiens
gcaggcagtggcattcgga

SEQ ID NO: 9323055 - DNA, 22 bp, Homo sapiens
gcagggaagatcttggagctgc

SEQ ID NO: 9323056 - DNA, 22 bp, Homo sapiens
gcagggaagatcttggagctgc

SEQ ID NO: 9323057 - DNA, 22 bp, Homo sapiens
gcaggcagaggtggaggagaca

SEQ ID NO: 9323058 - DNA, 16 bp, Homo sapiens
gcaggacactcagaca

SEQ ID NO: 9323059 - DNA, 22 bp, Homo sapiens
gcaggacacagatgcaaggcca

SEQ ID NO: 9323060 - DNA, 19 bp, Homo sapiens
gcaggcagctggggtatcc

SEQ ID NO: 9323061 - DNA, 22 bp, Homo sapiens
gcaggcagccacgattcccttg

SEQ ID NO: 9323062 - DNA, 22 bp, Homo sapiens
gcaggcagatcacctgtcagga

SEQ ID NO: 9323063 - DNA, 22 bp, Homo sapiens
gcaaagacccaggtgtctatcc

SEQ ID NO: 9323064 - DNA, 22 bp, Homo sapiens
gcaaagactgcaattacttttg

SEQ ID NO: 9323065 - DNA, 22 bp, Homo sapiens
gaggccagtgtgctgtgttttc

SEQ ID NO: 9323066 - DNA, 22 bp, Homo sapiens
gcaaagggaaagtggcagggtc

SEQ ID NO: 9323067 - DNA, 22 bp, Homo sapiens
gcaaagcagaaccctctctatc

SEQ ID NO: 9323068 - DNA, 22 bp, Homo sapiens
gcaaagcaatcaggagtagcat

SEQ ID NO: 9323069 - DNA, 22 bp, Homo sapiens
gcaaagcacaccctcagagttt

SEQ ID NO: 9323070 - DNA, 22 bp, Homo sapiens
gcaaagcaaatgcctgaaggcg

SEQ ID NO: 9323071 - DNA, 22 bp, Homo sapiens
gcaaagcaagattcagatgtag

SEQ ID NO: 9323072 - DNA, 22 bp, Homo sapiens
gcacagggctgccaggcggctt

SEQ ID NO: 9323073 - DNA, 22 bp, Homo sapiens
gcacaggctccggaggagagct

SEQ ID NO: 9323074 - DNA, 22 bp, Homo sapiens
gcacaggctccggaggagagct

SEQ ID NO: 9323075 - DNA, 22 bp, Homo sapiens
gcacaggccatgggaggacagc

SEQ ID NO: 9323076 - DNA, 22 bp, Homo sapiens
gcacacagaatcagtgggcata

SEQ ID NO: 9323077 - DNA, 22 bp, Homo sapiens
gcacacagtactatatgctaca

SEQ ID NO: 9323078 - DNA, 22 bp, Homo sapiens
gcacacagtagggattcaatga

SEQ ID NO: 9323079 - DNA, 22 bp, Homo sapiens
gcacacagaacatttggatcct

SEQ ID NO: 9323080 - DNA, 22 bp, Homo sapiens
gcaaatacatgttgagcaccta

SEQ ID NO: 9323081 - DNA, 22 bp, Homo sapiens
gcaaatattcaagacttttcca

SEQ ID NO: 9323082 - DNA, 22 bp, Homo sapiens
gcacacagtatatgctcattaa

SEQ ID NO: 9323083 - DNA, 19 bp, Homo sapiens
gcacacagtagggctggca

SEQ ID NO: 9323084 - DNA, 22 bp, Homo sapiens
gcacagttgtgacaaccatcgc

SEQ ID NO: 9323085 - DNA, 22 bp, Homo sapiens
gcacatccaatgattgttttga

SEQ ID NO: 9323086 - DNA, 22 bp, Homo sapiens
gcacagtgggtggtcatgtaca

SEQ ID NO: 9323087 - DNA, 22 bp, Homo sapiens
gcagactggtcttcagccttgg

SEQ ID NO: 9323088 - DNA, 22 bp, Homo sapiens
gcagactgtacctggaagaggg

SEQ ID NO: 9323089 - DNA, 22 bp, Homo sapiens
gcagactgcgagcgtgctggtg

SEQ ID NO: 9323090 - DNA, 22 bp, Homo sapiens
gcagactgtacactggactttg

SEQ ID NO: 9323091 - DNA, 22 bp, Homo sapiens
gcagacttataatctgtcccag

SEQ ID NO: 9323092 - DNA, 22 bp, Homo sapiens
gcagatggagataaatggaact

SEQ ID NO: 9323093 - DNA, 22 bp, Homo sapiens
gcagaggtctagcaccaagaat

SEQ ID NO: 9323094 - DNA, 22 bp, Homo sapiens
gcagaggtctcttcaaaataat

SEQ ID NO: 9323095 - DNA, 22 bp, Homo sapiens
gcagaggtgaccagcagcaggg

SEQ ID NO: 9323096 - DNA, 22 bp, Homo sapiens
gcagaggtgagaagggcctccc

SEQ ID NO: 9323097 - DNA, 22 bp, Homo sapiens
gcagagtggtttcagagttgag

SEQ ID NO: 9323098 - DNA, 22 bp, Homo sapiens
gcagagggtcctgtgccagcag

SEQ ID NO: 9323099 - DNA, 22 bp, Homo sapiens
gcagaggtcctagccaggagtc

SEQ ID NO: 9323100 - DNA, 22 bp, Homo sapiens
gcagaggtcctagccaggagtc

SEQ ID NO: 9323101 - DNA, 22 bp, Homo sapiens
gcagaggtcaaatacctcattt

SEQ ID NO: 9323102 - DNA, 22 bp, Homo sapiens
gcagaggatcaggctctggaaa

SEQ ID NO: 9323103 - DNA, 22 bp, Homo sapiens
gcagaggatagcatatgaacct

SEQ ID NO: 9323104 - DNA, 22 bp, Homo sapiens
gccagctctcattgtataggct

SEQ ID NO: 9323105 - DNA, 22 bp, Homo sapiens
gccaggcactgctctaagccct

SEQ ID NO: 9323106 - DNA, 22 bp, Homo sapiens
gccagctcagtttcaaagtagg

SEQ ID NO: 9323107 - DNA, 22 bp, Homo sapiens
gccagctcccaagtgagcccct

SEQ ID NO: 9323108 - DNA, 22 bp, Homo sapiens
gccagctccgcaggatggcgcg

SEQ ID NO: 9323109 - DNA, 22 bp, Homo sapiens
gccagctctgtggctgtacttg

SEQ ID NO: 9323110 - DNA, 22 bp, Homo sapiens
gccagctcttgatgggtgggta

SEQ ID NO: 9323111 - DNA, 21 bp, Homo sapiens
gccagcggccgccctccagga

SEQ ID NO: 9323112 - DNA, 22 bp, Homo sapiens
gccagctcagtgccaggcccct

SEQ ID NO: 9323113 - DNA, 22 bp, Homo sapiens
gccagctcagatgcaggaagga

SEQ ID NO: 9323114 - DNA, 22 bp, Homo sapiens
gccaccagtgggggcctgggca

SEQ ID NO: 9323115 - DNA, 22 bp, Homo sapiens
gccaccccaacctccctaagtt

SEQ ID NO: 9323116 - DNA, 21 bp, Homo sapiens
gccacccctggcacaggtgct

SEQ ID NO: 9323117 - DNA, 21 bp, Homo sapiens
gccagggagttaaagagtctt

SEQ ID NO: 9323118 - DNA, 22 bp, Homo sapiens
gccagggcaggggagcatctgc

SEQ ID NO: 9323119 - DNA, 22 bp, Homo sapiens
gccagggctcgcggtccctcgt

SEQ ID NO: 9323120 - DNA, 22 bp, Homo sapiens
gccagggaggctgtagggtcct

SEQ ID NO: 9323121 - DNA, 22 bp, Homo sapiens
gccagggaacccaagggcctca

SEQ ID NO: 9323122 - DNA, 22 bp, Homo sapiens
gccaggcatgtcctctgcagaa

SEQ ID NO: 9323123 - DNA, 22 bp, Homo sapiens
gccaggcaggtgtcggagccct

SEQ ID NO: 9323124 - DNA, 22 bp, Homo sapiens
gccaggcagccaccctctgcga

SEQ ID NO: 9323125 - DNA, 22 bp, Homo sapiens
gccaggcagcaggaagccagtg

SEQ ID NO: 9323126 - DNA, 22 bp, Homo sapiens
gccaggcagccaccctctgcga

SEQ ID NO: 9323127 - DNA, 22 bp, Homo sapiens
gccaggcagatatgtgagctta

SEQ ID NO: 9323128 - DNA, 22 bp, Homo sapiens
gccaggcagagccccgtgcagc

SEQ ID NO: 9323129 - DNA, 22 bp, Homo sapiens
gccaggcagatatgtgagctta

SEQ ID NO: 9323130 - DNA, 22 bp, Homo sapiens
gcagtgggagcttaggcagtgc

SEQ ID NO: 9323131 - DNA, 22 bp, Homo sapiens
gcagtggccacatggaggagga

SEQ ID NO: 9323132 - DNA, 22 bp, Homo sapiens
gcatgcaggagagaaagacggc

SEQ ID NO: 9323133 - DNA, 19 bp, Homo sapiens
gcatgcagagtaagaaggt

SEQ ID NO: 9323134 - DNA, 22 bp, Homo sapiens
gcaggggagtccactctatgca

SEQ ID NO: 9323135 - DNA, 22 bp, Homo sapiens
gcaggggagtggcaggcccgga

SEQ ID NO: 9323136 - DNA, 22 bp, Homo sapiens
gcagtggatggccagcaggggc

SEQ ID NO: 9323137 - DNA, 17 bp, Homo sapiens
gcagtggaggggtagtt

SEQ ID NO: 9323138 - DNA, 22 bp, Homo sapiens
gccacatgtcatgtgctcagta

SEQ ID NO: 9323139 - DNA, 22 bp, Homo sapiens
gccaccagcagaaaaggggcca

SEQ ID NO: 9323140 - DNA, 22 bp, Homo sapiens
gcatgctgcccagggactctct

SEQ ID NO: 9323141 - DNA, 22 bp, Homo sapiens
gcatggctattatgaggcagaa

SEQ ID NO: 9323142 - DNA, 22 bp, Homo sapiens
gcatggctgctccctggctgca

SEQ ID NO: 9323143 - DNA, 22 bp, Homo sapiens
gccctgggattgggtggaggct

SEQ ID NO: 9323144 - DNA, 22 bp, Homo sapiens
gccctggcctggcgcgttgtca

SEQ ID NO: 9323145 - DNA, 22 bp, Homo sapiens
gccctgggcaaggttctggcca

SEQ ID NO: 9323146 - DNA, 15 bp, Homo sapiens
gccccaggaatcaaa

SEQ ID NO: 9323147 - DNA, 22 bp, Homo sapiens
gccccaggataaatttgtaaga

SEQ ID NO: 9323148 - DNA, 17 bp, Homo sapiens
gccctggagccaggcta

SEQ ID NO: 9323149 - DNA, 22 bp, Homo sapiens
gccccagcctcccgagtagctg

SEQ ID NO: 9323150 - DNA, 22 bp, Homo sapiens
gcctcccttggtgtctcccggg

SEQ ID NO: 9323151 - DNA, 22 bp, Homo sapiens
gcctcctgaagtgctgggatta

SEQ ID NO: 9323152 - DNA, 22 bp, Homo sapiens
gcctcctatcatttccttgctt

SEQ ID NO: 9323153 - DNA, 22 bp, Homo sapiens
gcctctggagttgcttgtaaat

SEQ ID NO: 9323154 - DNA, 22 bp, Homo sapiens
gcctctggagtcgcagcgtctt

SEQ ID NO: 9323155 - DNA, 22 bp, Homo sapiens
gcctctggcttctgcatcagtg

SEQ ID NO: 9323156 - DNA, 22 bp, Homo sapiens
gcctcctgagtagctgggattg

SEQ ID NO: 9323157 - DNA, 22 bp, Homo sapiens
gccccacctgctaccttccagc

SEQ ID NO: 9323158 - DNA, 22 bp, Homo sapiens
gcccaggactcagggtgtcgcg

SEQ ID NO: 9323159 - DNA, 16 bp, Homo sapiens
gcccaggacgggaggc

SEQ ID NO: 9323160 - DNA, 22 bp, Homo sapiens
gcccaggagcctggagatgtgt

SEQ ID NO: 9323161 - DNA, 22 bp, Homo sapiens
gcccaggagaggccagggctga

SEQ ID NO: 9323162 - DNA, 22 bp, Homo sapiens
gcccaggaaataaaagtgggct

SEQ ID NO: 9323163 - DNA, 22 bp, Homo sapiens
gcccaggaaagatagggcctca

SEQ ID NO: 9323164 - DNA, 22 bp, Homo sapiens
gcccagctggcttccagcacat

SEQ ID NO: 9323165 - DNA, 22 bp, Homo sapiens
gcccagcttttcacttccacac

SEQ ID NO: 9323166 - DNA, 20 bp, Homo sapiens
gcccaggaatttgcatttct

SEQ ID NO: 9323167 - DNA, 22 bp, Homo sapiens
gcccaggaagttgaggctgccg

SEQ ID NO: 9323168 - DNA, 22 bp, Homo sapiens
gcccaggaagtgactcagatgt

SEQ ID NO: 9323169 - DNA, 22 bp, Homo sapiens
gcccaggaaatgccccgtggtg

SEQ ID NO: 9323170 - DNA, 22 bp, Homo sapiens
gcccaggaagccaccgggaagt

SEQ ID NO: 9323171 - DNA, 17 bp, Homo sapiens
gcccaggaaggacggcc

SEQ ID NO: 9323172 - DNA, 22 bp, Homo sapiens
gcccagcactcctctctgacat

SEQ ID NO: 9323173 - DNA, 22 bp, Homo sapiens
ggcctcagaggaggtgtgagtc

SEQ ID NO: 9323174 - DNA, 22 bp, Homo sapiens
ggcctcagtttcttcaactgta

SEQ ID NO: 9323175 - DNA, 22 bp, Homo sapiens
ggcctcagggttgggcccatta

SEQ ID NO: 9323176 - DNA, 22 bp, Homo sapiens
ggccttggggtggccttgtccc

SEQ ID NO: 9323177 - DNA, 17 bp, Homo sapiens
ggccttgggctgctctt

SEQ ID NO: 9323178 - DNA, 22 bp, Homo sapiens
ggccttgggctggctgcagtat

SEQ ID NO: 9323179 - DNA, 22 bp, Homo sapiens
ggccttggtgccatggccagtt

SEQ ID NO: 9323180 - DNA, 22 bp, Homo sapiens
ggccttggtgctctgtgttgca

SEQ ID NO: 9323181 - DNA, 22 bp, Homo sapiens
ggccttggttctgtcacagccg

SEQ ID NO: 9323182 - DNA, 22 bp, Homo sapiens
ggcctgagtcacatcaggagag

SEQ ID NO: 9323183 - DNA, 22 bp, Homo sapiens
ggccaggttgggtggaagtggc

SEQ ID NO: 9323184 - DNA, 22 bp, Homo sapiens
ggccatctgcctcaatgtgtgc

SEQ ID NO: 9323185 - DNA, 22 bp, Homo sapiens
ggccagggggcttcagactcca

SEQ ID NO: 9323186 - DNA, 21 bp, Homo sapiens
ggccacaagcggaggagccgc

SEQ ID NO: 9323187 - DNA, 22 bp, Homo sapiens
ggccacaagtggtcctgagtcc

SEQ ID NO: 9323188 - DNA, 19 bp, Homo sapiens
ggccaggctgactgtggtc

SEQ ID NO: 9323189 - DNA, 22 bp, Homo sapiens
ggcatgtgcctgaggtcacaca

SEQ ID NO: 9323190 - DNA, 18 bp, Homo sapiens
ggcatgtgagtgctgagg

SEQ ID NO: 9323191 - DNA, 22 bp, Homo sapiens
ggcatgtctgatggcccaagtc

SEQ ID NO: 9323192 - DNA, 22 bp, Homo sapiens
ggcatggggtgtatgtggcacg

SEQ ID NO: 9323193 - DNA, 20 bp, Homo sapiens
ggcatgggtggggctcccag

SEQ ID NO: 9323194 - DNA, 19 bp, Homo sapiens
ggcatggtcggaagagctc

SEQ ID NO: 9323195 - DNA, 22 bp, Homo sapiens
ggcaggtggacgtgctaaagct

SEQ ID NO: 9323196 - DNA, 22 bp, Homo sapiens
ggcaggtggaagttggcagagc

SEQ ID NO: 9323197 - DNA, 22 bp, Homo sapiens
ggcaggtggaagttggcagagc

SEQ ID NO: 9323198 - DNA, 22 bp, Homo sapiens
ggcaggtgtgagatcgaggcca

SEQ ID NO: 9323199 - DNA, 22 bp, Homo sapiens
ggcaggtggtaaggatttcata

SEQ ID NO: 9323200 - DNA, 22 bp, Homo sapiens
ggcagtcccagcccagaggcgc

SEQ ID NO: 9323201 - DNA, 22 bp, Homo sapiens
ggcagtcccaggctgcatgttg

SEQ ID NO: 9323202 - DNA, 22 bp, Homo sapiens
ggcatgggccgaggtgcctcct

SEQ ID NO: 9323203 - DNA, 22 bp, Homo sapiens
ggcatgggccgaggtgcctcct

SEQ ID NO: 9323204 - DNA, 22 bp, Homo sapiens
ggcatggggtgtatgtggcacg

SEQ ID NO: 9323205 - DNA, 22 bp, Homo sapiens
ggcatggggtgtatgtggcacg

SEQ ID NO: 9323206 - DNA, 22 bp, Homo sapiens
ggcagtgaacagaaatgcagaa

SEQ ID NO: 9323207 - DNA, 20 bp, Homo sapiens
ggcagtcttcctcatttctt

SEQ ID NO: 9323208 - DNA, 22 bp, Homo sapiens
ggcagtctagctaggatgtcac

SEQ ID NO: 9323209 - DNA, 22 bp, Homo sapiens
ggcagtgaatctgagagcctgg

SEQ ID NO: 9323210 - DNA, 22 bp, Homo sapiens
ggcagtgaatgaaacagaggct

SEQ ID NO: 9323211 - DNA, 22 bp, Homo sapiens
ggcagaggtagctggaaccagg

SEQ ID NO: 9323212 - DNA, 20 bp, Homo sapiens
ggcagagggcctgggagaag

SEQ ID NO: 9323213 - DNA, 22 bp, Homo sapiens
ggcaggagggcggacaatgacc

SEQ ID NO: 9323214 - DNA, 22 bp, Homo sapiens
ggcaggagggcggacaatgacc

SEQ ID NO: 9323215 - DNA, 22 bp, Homo sapiens
ggcaggaggaagagttagcacc

SEQ ID NO: 9323216 - DNA, 22 bp, Homo sapiens
ggcaggcaagtctgctctgtga

SEQ ID NO: 9323217 - DNA, 22 bp, Homo sapiens
ggcaggcaaggcagcctggtga

SEQ ID NO: 9323218 - DNA, 22 bp, Homo sapiens
ggcaggcactgtgttttgtgtt

SEQ ID NO: 9323219 - DNA, 22 bp, Homo sapiens
ggcagaggagctggaaacatgg

SEQ ID NO: 9323220 - DNA, 22 bp, Homo sapiens
ggcagaggaggggtgaatttgc

SEQ ID NO: 9323221 - DNA, 20 bp, Homo sapiens
ggcagagggcctgggagaag

SEQ ID NO: 9323222 - DNA, 17 bp, Homo sapiens
ggcaccagacggagagt

SEQ ID NO: 9323223 - DNA, 22 bp, Homo sapiens
ggcacagccactttggagaact

SEQ ID NO: 9323224 - DNA, 21 bp, Homo sapiens
ggagtcagggtctggctgggg

SEQ ID NO: 9323225 - DNA, 22 bp, Homo sapiens
ggagtcagtgatcgcgtgtctc

SEQ ID NO: 9323226 - DNA, 22 bp, Homo sapiens
ggagtcatctcagctgagaggc

SEQ ID NO: 9323227 - DNA, 22 bp, Homo sapiens
ggagtctgactctgaccctgga

SEQ ID NO: 9323228 - DNA, 19 bp, Homo sapiens
ggagtctgagcccaggtat

SEQ ID NO: 9323229 - DNA, 22 bp, Homo sapiens
ggagtcagaatggcagggtggt

SEQ ID NO: 9323230 - DNA, 22 bp, Homo sapiens
ggagtcagcctgtcagagtgta

SEQ ID NO: 9323231 - DNA, 22 bp, Homo sapiens
ggagtcaggagcaggctgggct

SEQ ID NO: 9323232 - DNA, 22 bp, Homo sapiens
ggagccagagcactggggagcc

SEQ ID NO: 9323233 - DNA, 23 bp, Homo sapiens
ggagccagcctgtggggagcggg

SEQ ID NO: 9323234 - DNA, 19 bp, Homo sapiens
ggagccagctgtggaaggc

SEQ ID NO: 9323235 - DNA, 22 bp, Homo sapiens
ggcaagaaggcttcaggtagct

SEQ ID NO: 9323236 - DNA, 22 bp, Homo sapiens
ggcaacctgagcttgtggagaa

SEQ ID NO: 9323237 - DNA, 22 bp, Homo sapiens
ggcaaatttgtcttaagacacc

SEQ ID NO: 9323238 - DNA, 22 bp, Homo sapiens
ggcaaattgctgcaattactta

SEQ ID NO: 9323239 - DNA, 22 bp, Homo sapiens
ggcaaaggaaccaggccacact

SEQ ID NO: 9323240 - DNA, 22 bp, Homo sapiens
ggcaaaggaaaacgtctcagct

SEQ ID NO: 9323241 - DNA, 22 bp, Homo sapiens
ggcaagatccaaggggctagga

SEQ ID NO: 9323242 - DNA, 20 bp, Homo sapiens
ggcaagcaactgagggagga

SEQ ID NO: 9323243 - DNA, 22 bp, Homo sapiens
ggcaaactacatttttgaaata

SEQ ID NO: 9323244 - DNA, 22 bp, Homo sapiens
ggagtgctgggccgctgccaac

SEQ ID NO: 9323245 - DNA, 22 bp, Homo sapiens
ggagtgcaggtagcacaggaaa

SEQ ID NO: 9323246 - DNA, 23 bp, Homo sapiens
ggagtgcaatggcgccatctcgg

SEQ ID NO: 9323247 - DNA, 22 bp, Homo sapiens
ggagtgcagctcacaggacatc

SEQ ID NO: 9323248 - DNA, 22 bp, Homo sapiens
ggagtgagtactggagtagctg

SEQ ID NO: 9323249 - DNA, 22 bp, Homo sapiens
ggctctggctcctggctttgtg

SEQ ID NO: 9323250 - DNA, 22 bp, Homo sapiens
ggctctggcgtccaatggagcg

SEQ ID NO: 9323251 - DNA, 19 bp, Homo sapiens
ggctctggcggctgtagcc

SEQ ID NO: 9323252 - DNA, 22 bp, Homo sapiens
ggctctggcaaggggaggctac

SEQ ID NO: 9323253 - DNA, 22 bp, Homo sapiens
ggctctggagacatgtggagag

SEQ ID NO: 9323254 - DNA, 22 bp, Homo sapiens
ggctcttgttcgtaccatggct

SEQ ID NO: 9323255 - DNA, 22 bp, Homo sapiens
ggctcttgcccgcccaggctgg

SEQ ID NO: 9323256 - DNA, 22 bp, Homo sapiens
ggctcttgagaggcacaggttt

SEQ ID NO: 9323257 - DNA, 22 bp, Homo sapiens
ggctgagaatcaacaacctgct

SEQ ID NO: 9323258 - DNA, 22 bp, Homo sapiens
ggctgagaacaggcccagcctc

SEQ ID NO: 9323259 - DNA, 22 bp, Homo sapiens
ggctgaaggatgaaagctgcag

SEQ ID NO: 9323260 - DNA, 22 bp, Homo sapiens
ggctgacctcgcccctacatct

SEQ ID NO: 9323261 - DNA, 22 bp, Homo sapiens
ggcgctgtcgtgagctcgcccg

SEQ ID NO: 9323262 - DNA, 22 bp, Homo sapiens
ggctccaccctgcttccagaag

SEQ ID NO: 9323263 - DNA, 22 bp, Homo sapiens
ggctccagaaacttcagtccat

SEQ ID NO: 9323264 - DNA, 22 bp, Homo sapiens
ggctccagaaatcatagagcag

SEQ ID NO: 9323265 - DNA, 16 bp, Homo sapiens
ggctccagaatagcga

SEQ ID NO: 9323266 - DNA, 22 bp, Homo sapiens
ggctccagaggccttacctgca

SEQ ID NO: 9323267 - DNA, 22 bp, Homo sapiens
ggctccagatgtcccctggcaa

SEQ ID NO: 9323268 - DNA, 22 bp, Homo sapiens
ggctccaggagatgctgggcag

SEQ ID NO: 9323269 - DNA, 22 bp, Homo sapiens
ggctccaggagggccttggcca

SEQ ID NO: 9323270 - DNA, 18 bp, Homo sapiens
ggctccaggacctaccca

SEQ ID NO: 9323271 - DNA, 22 bp, Homo sapiens
ggctccaggaacctcctctcct

SEQ ID NO: 9323272 - DNA, 22 bp, Homo sapiens
ggctccaggaacctcctctcct

SEQ ID NO: 9323273 - DNA, 22 bp, Homo sapiens
ggctccagctaatggtttctat

SEQ ID NO: 9323274 - DNA, 22 bp, Homo sapiens
ggctccagccctggctcttcac

SEQ ID NO: 9323275 - DNA, 22 bp, Homo sapiens
ggctccagatgtctcctggcaa

SEQ ID NO: 9323276 - DNA, 22 bp, Homo sapiens
ggctgggctgctgggtcagagc

SEQ ID NO: 9323277 - DNA, 22 bp, Homo sapiens
ggctgggccgcggctacccaga

SEQ ID NO: 9323278 - DNA, 22 bp, Homo sapiens
ggctgggcctctccctcagctg

SEQ ID NO: 9323279 - DNA, 22 bp, Homo sapiens
ggctgggctccgggagcatgcg

SEQ ID NO: 9323280 - DNA, 22 bp, Homo sapiens
ggctgggctccgggagcatgcg

SEQ ID NO: 9323281 - DNA, 22 bp, Homo sapiens
ggctgggccagggcctgtggac

SEQ ID NO: 9323282 - DNA, 22 bp, Homo sapiens
ggctgggcatccatccatgaga

SEQ ID NO: 9323283 - DNA, 23 bp, Homo sapiens
ggctgagactacaggcgcttgcc

SEQ ID NO: 9323284 - DNA, 22 bp, Homo sapiens
ggctggcttgccaagctcaggg

SEQ ID NO: 9323285 - DNA, 22 bp, Homo sapiens
ggctggcttggtgagctgtcac

SEQ ID NO: 9323286 - DNA, 22 bp, Homo sapiens
ggctggcttgcggagtcacaga

SEQ ID NO: 9323287 - DNA, 22 bp, Homo sapiens
ggctgggaggccgtgctgacct

SEQ ID NO: 9323288 - DNA, 22 bp, Homo sapiens
gggcagctctggctgtgggaag

SEQ ID NO: 9323289 - DNA, 22 bp, Homo sapiens
gggcacaggaatttgggatgtg

SEQ ID NO: 9323290 - DNA, 23 bp, Homo sapiens
gggcatggagtgtaggtggaagg

SEQ ID NO: 9323291 - DNA, 22 bp, Homo sapiens
gggcatggaggtctgtctgcag

SEQ ID NO: 9323292 - DNA, 18 bp, Homo sapiens
gggcatggatgcagcatc

SEQ ID NO: 9323293 - DNA, 19 bp, Homo sapiens
gggcatggatgagcttacc

SEQ ID NO: 9323294 - DNA, 16 bp, Homo sapiens
gggcaggaatcagggt

SEQ ID NO: 9323295 - DNA, 22 bp, Homo sapiens
gggcaggagaaggtggatgtcc

SEQ ID NO: 9323296 - DNA, 22 bp, Homo sapiens
gggagctgtgggattggttgag

SEQ ID NO: 9323297 - DNA, 19 bp, Homo sapiens
gggagctgtctgcccgtgg

SEQ ID NO: 9323298 - DNA, 22 bp, Homo sapiens
gggaggaaagagaagtggtcca

SEQ ID NO: 9323299 - DNA, 22 bp, Homo sapiens
gggaggaaagagaagtggtcca

SEQ ID NO: 9323300 - DNA, 22 bp, Homo sapiens
gggatggggagctggaaagggg

SEQ ID NO: 9323301 - DNA, 22 bp, Homo sapiens
gggaggagcttggagattcact

SEQ ID NO: 9323302 - DNA, 22 bp, Homo sapiens
gggaggagctgagtgtgtgtgc

SEQ ID NO: 9323303 - DNA, 22 bp, Homo sapiens
gggatggggagctggaaagggg

SEQ ID NO: 9323304 - DNA, 22 bp, Homo sapiens
gggcaagcagtgaggacagcac

SEQ ID NO: 9323305 - DNA, 22 bp, Homo sapiens
gggcaagaagctggaagcattc

SEQ ID NO: 9323306 - DNA, 22 bp, Homo sapiens
gggacatctttctagtcagggt

SEQ ID NO: 9323307 - DNA, 22 bp, Homo sapiens
gggacatctttctagtcagggt

SEQ ID NO: 9323308 - DNA, 22 bp, Homo sapiens
gggacaggctgagacttgagct

SEQ ID NO: 9323309 - DNA, 22 bp, Homo sapiens
ggcttgggagcaggcatgtgac

SEQ ID NO: 9323310 - DNA, 22 bp, Homo sapiens
ggctttaaggagtaaaaatgcc

SEQ ID NO: 9323311 - DNA, 19 bp, Homo sapiens
ggctttaactcttgtagct

SEQ ID NO: 9323312 - DNA, 22 bp, Homo sapiens
ggctttaacaacagaaatttat

SEQ ID NO: 9323313 - DNA, 22 bp, Homo sapiens
ggctttaacagcagctttgctg

SEQ ID NO: 9323314 - DNA, 22 bp, Homo sapiens
ggctttaaacactgaaattgca

SEQ ID NO: 9323315 - DNA, 22 bp, Homo sapiens
ggcttggcttgggctcagaggc

SEQ ID NO: 9323316 - DNA, 22 bp, Homo sapiens
ggctttactatatggtacattt

SEQ ID NO: 9323317 - DNA, 16 bp, Homo sapiens
ggctttaatttatccc

SEQ ID NO: 9323318 - DNA, 22 bp, Homo sapiens
gggagctgtaagggacaggtag

SEQ ID NO: 9323319 - DNA, 22 bp, Homo sapiens
gggagctggttcctgccctcca

SEQ ID NO: 9323320 - DNA, 22 bp, Homo sapiens
gggagctggttcctgccctcca

SEQ ID NO: 9323321 - DNA, 22 bp, Homo sapiens
gggagctggggcatttataccc

SEQ ID NO: 9323322 - DNA, 22 bp, Homo sapiens
gggagctgggctggttttgctg

SEQ ID NO: 9323323 - DNA, 18 bp, Homo sapiens
gggagctgggaagctggt

SEQ ID NO: 9323324 - DNA, 22 bp, Homo sapiens
gggagctgtagtccagataccg

SEQ ID NO: 9323325 - DNA, 22 bp, Homo sapiens
gggagctgtcatcagtgttgtc

SEQ ID NO: 9323326 - DNA, 22 bp, Homo sapiens
gggagctgtaagggacaggtag

SEQ ID NO: 9323327 - DNA, 22 bp, Homo sapiens
gggagctgtaagggacaggtag

SEQ ID NO: 9323328 - DNA, 22 bp, Homo sapiens
gggagctggcggattccccagg

SEQ ID NO: 9323329 - DNA, 18 bp, Homo sapiens
gggagctgggaagctggt

SEQ ID NO: 9323330 - DNA, 22 bp, Homo sapiens
gggagaggttacccgagcaact

SEQ ID NO: 9323331 - DNA, 22 bp, Homo sapiens
gggagaggttacccgagcaact

SEQ ID NO: 9323332 - DNA, 22 bp, Homo sapiens
gggagagaattattgccagacc

SEQ ID NO: 9323333 - DNA, 22 bp, Homo sapiens
gggagactagtgctatgttttc

SEQ ID NO: 9323334 - DNA, 22 bp, Homo sapiens
gggagagagagctcatgttgaa

SEQ ID NO: 9323335 - DNA, 22 bp, Homo sapiens
gggagagcgcgctagggccgag

SEQ ID NO: 9323336 - DNA, 20 bp, Homo sapiens
ggtggccgtagcgggcggcg

SEQ ID NO: 9323337 - DNA, 18 bp, Homo sapiens
ggtggcggggatggaggt

SEQ ID NO: 9323338 - DNA, 22 bp, Homo sapiens
ggtttattgaaggccaccccac

SEQ ID NO: 9323339 - DNA, 22 bp, Homo sapiens
ggtttattgaaggccaccccac

SEQ ID NO: 9323340 - DNA, 22 bp, Homo sapiens
ggtgtgtgtggattagcatgcc

SEQ ID NO: 9323341 - DNA, 22 bp, Homo sapiens
ggtgtgtggttttgatacagtc

SEQ ID NO: 9323342 - DNA, 19 bp, Homo sapiens
ggtgtgtgctggggcctgt

SEQ ID NO: 9323343 - DNA, 22 bp, Homo sapiens
ggtgtgggtccttgtgcttgct

SEQ ID NO: 9323344 - DNA, 22 bp, Homo sapiens
ggtgtgtgaggagtcacttagt

SEQ ID NO: 9323345 - DNA, 22 bp, Homo sapiens
ggtgtgggaactacaggttttt

SEQ ID NO: 9323346 - DNA, 22 bp, Homo sapiens
ggtgtgggagagattctttcct

SEQ ID NO: 9323347 - DNA, 21 bp, Homo sapiens
ggtgtgggatggactgaacca

SEQ ID NO: 9323348 - DNA, 22 bp, Homo sapiens
ggtgtgggcagatgccctactt

SEQ ID NO: 9323349 - DNA, 22 bp, Homo sapiens
ggtgtgggccctgatgtcagca

SEQ ID NO: 9323350 - DNA, 22 bp, Homo sapiens
ggtgtggggaggttctgcttct

SEQ ID NO: 9323351 - DNA, 22 bp, Homo sapiens
ggtgtgggggcaagtttgagat

SEQ ID NO: 9323352 - DNA, 22 bp, Homo sapiens
ggtgtgggggcagctctgatat

SEQ ID NO: 9323353 - DNA, 22 bp, Homo sapiens
ggtgtgggtcagctttattaat

SEQ ID NO: 9323354 - DNA, 22 bp, Homo sapiens
ggtctcaggagactggagagca

SEQ ID NO: 9323355 - DNA, 22 bp, Homo sapiens
ggtctcaggagactggagagca

SEQ ID NO: 9323356 - DNA, 22 bp, Homo sapiens
ggtctcagccctcgccagcagc

SEQ ID NO: 9323357 - DNA, 22 bp, Homo sapiens
ggtctcaggtagggcctaggaa

SEQ ID NO: 9323358 - DNA, 22 bp, Homo sapiens
ggtctcaggtagggcctaggaa

SEQ ID NO: 9323359 - DNA, 22 bp, Homo sapiens
ggtctcagtgaaggagtgtgct

SEQ ID NO: 9323360 - DNA, 22 bp, Homo sapiens
ggtctccaaagctgcattgatg

SEQ ID NO: 9323361 - DNA, 22 bp, Homo sapiens
ggtctccaaagcttaggactac

SEQ ID NO: 9323362 - DNA, 22 bp, Homo sapiens
ggtcagcagtgcagggcagagc

SEQ ID NO: 9323363 - DNA, 22 bp, Homo sapiens
ggtcagcagccatgccatgaat

SEQ ID NO: 9323364 - DNA, 22 bp, Homo sapiens
ggtcagcaatttggactgggct

SEQ ID NO: 9323365 - DNA, 22 bp, Homo sapiens
ggtcgctgtgtaggttcagcta

SEQ ID NO: 9323366 - DNA, 22 bp, Homo sapiens
ggtctacagagagaaatgaagc

SEQ ID NO: 9323367 - DNA, 22 bp, Homo sapiens
ggtctacattgagagagctgct

SEQ ID NO: 9323368 - DNA, 22 bp, Homo sapiens
ggtcggggatggccaggctccc

SEQ ID NO: 9323369 - DNA, 22 bp, Homo sapiens
ggtctcagactggcaggcagtg

SEQ ID NO: 9323370 - DNA, 22 bp, Homo sapiens
ggtctcagactggcaggcagtg

SEQ ID NO: 9323371 - DNA, 22 bp, Homo sapiens
ggtaggggcagggccaagctgt

SEQ ID NO: 9323372 - DNA, 22 bp, Homo sapiens
ggtcagagccatggagcaactg

SEQ ID NO: 9323373 - DNA, 22 bp, Homo sapiens
ggtcagagctggagagataggg

SEQ ID NO: 9323374 - DNA, 22 bp, Homo sapiens
gggtggcatagggtgatggctt

SEQ ID NO: 9323375 - DNA, 22 bp, Homo sapiens
gggtggcatagggtgatggctt

SEQ ID NO: 9323376 - DNA, 22 bp, Homo sapiens
gggtggcacaggtgcagagggt

SEQ ID NO: 9323377 - DNA, 22 bp, Homo sapiens
gggtggcagctgttgccaaggt

SEQ ID NO: 9323378 - DNA, 22 bp, Homo sapiens
gggtggcaggattggcaggagt

SEQ ID NO: 9323379 - DNA, 22 bp, Homo sapiens
gggtggcaggattggcaggagt

SEQ ID NO: 9323380 - DNA, 22 bp, Homo sapiens
gggtggaggagaacaggcccca

SEQ ID NO: 9323381 - DNA, 22 bp, Homo sapiens
gggtaggatggtagaagggacc

SEQ ID NO: 9323382 - DNA, 22 bp, Homo sapiens
gggtagggtgacttaggctggc

SEQ ID NO: 9323383 - DNA, 22 bp, Homo sapiens
ggggctggtggtggtttctcca

SEQ ID NO: 9323384 - DNA, 22 bp, Homo sapiens
ggggtgggcgtgcagggacacc

SEQ ID NO: 9323385 - DNA, 22 bp, Homo sapiens
ggggtgggcgtgcagggacacc

SEQ ID NO: 9323386 - DNA, 22 bp, Homo sapiens
ggggtgtggacggctgtgccag

SEQ ID NO: 9323387 - DNA, 22 bp, Homo sapiens
ggggtgtggacggctgtgccag

SEQ ID NO: 9323388 - DNA, 22 bp, Homo sapiens
ggggtggggttactcattgtgc

SEQ ID NO: 9323389 - DNA, 22 bp, Homo sapiens
ggggtgtgagtagagctgggga

SEQ ID NO: 9323390 - DNA, 22 bp, Homo sapiens
ggggctcacacctccctaaggg

SEQ ID NO: 9323391 - DNA, 22 bp, Homo sapiens
ggggctcatgctgtttggtctt

SEQ ID NO: 9323392 - DNA, 22 bp, Homo sapiens
ggggctgagaattcagtctcgg

SEQ ID NO: 9323393 - DNA, 22 bp, Homo sapiens
ggggctgatggaactcaggcct

SEQ ID NO: 9323394 - DNA, 22 bp, Homo sapiens
ggggctggctcactaagagact

SEQ ID NO: 9323395 - DNA, 22 bp, Homo sapiens
ggggaaggaaagttattagcag

SEQ ID NO: 9323396 - DNA, 22 bp, Homo sapiens
ggggaaggatatgattagacta

SEQ ID NO: 9323397 - DNA, 22 bp, Homo sapiens
ggggcggggctctgagaagcat

SEQ ID NO: 9323398 - DNA, 22 bp, Homo sapiens
ggggcctccagcactaggcagc

SEQ ID NO: 9323399 - DNA, 22 bp, Homo sapiens
ggggaagaggcgtgatggatcc

SEQ ID NO: 9323400 - DNA, 22 bp, Homo sapiens
gggctttagattgcagaggatt

SEQ ID NO: 9323401 - DNA, 22 bp, Homo sapiens
gggctttatgagattgagatct

SEQ ID NO: 9323402 - DNA, 22 bp, Homo sapiens
gggcatgtacataatctagaaa

SEQ ID NO: 9323403 - DNA, 22 bp, Homo sapiens
gggcatggtggcaggcacctgt

SEQ ID NO: 9323404 - DNA, 22 bp, Homo sapiens
gggcatggtggcaggcacctgt

SEQ ID NO: 9323405 - DNA, 22 bp, Homo sapiens
gggcatggtgatgtgcacctgt

SEQ ID NO: 9323406 - DNA, 22 bp, Homo sapiens
gggcatggccaggtgaggggtc

SEQ ID NO: 9323407 - DNA, 22 bp, Homo sapiens
gggcatggccaggtgaggggtc

SEQ ID NO: 9323408 - DNA, 22 bp, Homo sapiens
gggctgagattggtgccctgtc

SEQ ID NO: 9323409 - DNA, 22 bp, Homo sapiens
gggctgagagtgactgttctgt

SEQ ID NO: 9323410 - DNA, 22 bp, Homo sapiens
gggctgagagctggaatctgag

SEQ ID NO: 9323411 - DNA, 22 bp, Homo sapiens
gggctgagagctggaatctgag

SEQ ID NO: 9323412 - DNA, 22 bp, Homo sapiens
gggctgagctaagctgggttga

SEQ ID NO: 9323413 - DNA, 22 bp, Homo sapiens
gggctgagccatttgaaccttg

SEQ ID NO: 9323414 - DNA, 22 bp, Homo sapiens
gggctgagccacagcttttgtt

SEQ ID NO: 9323415 - DNA, 22 bp, Homo sapiens
gggctgagcacatactgacagc

SEQ ID NO: 9323416 - DNA, 22 bp, Homo sapiens
gggctgaggctaccactggtct

SEQ ID NO: 9323417 - DNA, 22 bp, Homo sapiens
gggctgaggctaccactggtct

SEQ ID NO: 9323418 - DNA, 22 bp, Homo sapiens
gggctgagtgggcctcttactt

SEQ ID NO: 9323419 - DNA, 22 bp, Homo sapiens
gggctgagggccaattcctact

SEQ ID NO: 9323420 - DNA, 22 bp, Homo sapiens
gggctgagtgtcccaggccgaa

SEQ ID NO: 9323421 - DNA, 22 bp, Homo sapiens
gggctgagttcctgcctcactc

SEQ ID NO: 9323422 - DNA, 22 bp, Homo sapiens
gggctgagttcctgcctcactc

SEQ ID NO: 9323423 - DNA, 22 bp, Homo sapiens
gggctgatcgcttgagctcagg

SEQ ID NO: 9323424 - DNA, 22 bp, Homo sapiens
gggctgcacagatcttcaaggg

SEQ ID NO: 9323425 - DNA, 22 bp, Homo sapiens
gggctgatgtgacagaactctc

SEQ ID NO: 9323426 - DNA, 22 bp, Homo sapiens
gggctgccaagcctgcctgcct

SEQ ID NO: 9323427 - DNA, 22 bp, Homo sapiens
gggctgcctgagcatctcctcc

SEQ ID NO: 9323428 - DNA, 22 bp, Homo sapiens
gggctgccttttaattcttccc

SEQ ID NO: 9323429 - DNA, 22 bp, Homo sapiens
gggcttcttgccatggggacgg

SEQ ID NO: 9323430 - DNA, 22 bp, Homo sapiens
gggcttgctaagaagagcgcat

SEQ ID NO: 9323431 - DNA, 22 bp, Homo sapiens
gggcttcttgcaggggcaacat

SEQ ID NO: 9323432 - DNA, 22 bp, Homo sapiens
gggcttgctgatttgggcagga

SEQ ID NO: 9323433 - DNA, 22 bp, Homo sapiens
gggcttgcttaaggtcacccgg

SEQ ID NO: 9323434 - DNA, 22 bp, Homo sapiens
gtcctgggaaggaagccaggga

SEQ ID NO: 9323435 - DNA, 22 bp, Homo sapiens
gtcctgggagatgggaccctga

SEQ ID NO: 9323436 - DNA, 17 bp, Homo sapiens
gtcctgggaggagagag

SEQ ID NO: 9323437 - DNA, 20 bp, Homo sapiens
gtcctgggagccacagcaca

SEQ ID NO: 9323438 - DNA, 22 bp, Homo sapiens
gtcctgggcatgcagggctttc

SEQ ID NO: 9323439 - DNA, 22 bp, Homo sapiens
gtcctgggcatgcagggctttc

SEQ ID NO: 9323440 - DNA, 22 bp, Homo sapiens
gtcctgggaggggctggtcctg

SEQ ID NO: 9323441 - DNA, 22 bp, Homo sapiens
gtcctgggaggggctggtcctg

SEQ ID NO: 9323442 - DNA, 22 bp, Homo sapiens
gtcctgggcccaggggctgcct

SEQ ID NO: 9323443 - DNA, 22 bp, Homo sapiens
gtccccagctaatctctttgcc

SEQ ID NO: 9323444 - DNA, 22 bp, Homo sapiens
gtccccagctgtgacgagagcc

SEQ ID NO: 9323445 - DNA, 22 bp, Homo sapiens
gtccccagagctggtggtggtt

SEQ ID NO: 9323446 - DNA, 22 bp, Homo sapiens
gtccccagaaaggtgaggcagg

SEQ ID NO: 9323447 - DNA, 22 bp, Homo sapiens
gtccaaaagagccagccgggcg

SEQ ID NO: 9323448 - DNA, 22 bp, Homo sapiens
gtccaagagtcaagaagggggc

SEQ ID NO: 9323449 - DNA, 19 bp, Homo sapiens
gtatttcaggacaagacgt

SEQ ID NO: 9323450 - DNA, 22 bp, Homo sapiens
gtaaaacctgcttttcaacacc

SEQ ID NO: 9323451 - DNA, 22 bp, Homo sapiens
ggttttaactacagaattgcaa

SEQ ID NO: 9323452 - DNA, 22 bp, Homo sapiens
ggtttctcaccttcagcactac

SEQ ID NO: 9323453 - DNA, 22 bp, Homo sapiens
ggtttcaatgagaagtgcttgt

SEQ ID NO: 9323454 - DNA, 22 bp, Homo sapiens
gtaaaacatgttttaactagga

SEQ ID NO: 9323455 - DNA, 22 bp, Homo sapiens
gtaaaacaagctttatggttcc

SEQ ID NO: 9323456 - DNA, 22 bp, Homo sapiens
gtatttataggggaatgagagt

SEQ ID NO: 9323457 - DNA, 22 bp, Homo sapiens
gtatttaattccattaagttag

SEQ ID NO: 9323458 - DNA, 22 bp, Homo sapiens
gtatttataggggaatgagagt

SEQ ID NO: 9323459 - DNA, 22 bp, Homo sapiens
gtatttataggggaatgagagt

SEQ ID NO: 9323460 - DNA, 22 bp, Homo sapiens
gtattccttcagaagacgttta

SEQ ID NO: 9323461 - DNA, 22 bp, Homo sapiens
gtattcctgcaaatagcagtga

SEQ ID NO: 9323462 - DNA, 22 bp, Homo sapiens
gtattctgggccgattacaaaa

SEQ ID NO: 9323463 - DNA, 22 bp, Homo sapiens
gtattcctaagtcatgacaaat

SEQ ID NO: 9323464 - DNA, 20 bp, Homo sapiens
gtattctgtattctgctcag

SEQ ID NO: 9323465 - DNA, 22 bp, Homo sapiens
gtattctgtttacagtgagcaa

SEQ ID NO: 9323466 - DNA, 22 bp, Homo sapiens
gtattagctgttagctacatca

SEQ ID NO: 9323467 - DNA, 22 bp, Homo sapiens
gtattagctgccttggagctaa

SEQ ID NO: 9323468 - DNA, 22 bp, Homo sapiens
gtattagcaagagttgtgattt

SEQ ID NO: 9323469 - DNA, 22 bp, Homo sapiens
gtagaagtgatgtcatgttata

SEQ ID NO: 9323470 - DNA, 22 bp, Homo sapiens
gtagaatatatggttagtattg

SEQ ID NO: 9323471 - DNA, 22 bp, Homo sapiens
gtagaaatgtaaccaggagata

SEQ ID NO: 9323472 - DNA, 22 bp, Homo sapiens
gtctgctggtgcctggcctgcg

SEQ ID NO: 9323473 - DNA, 22 bp, Homo sapiens
gtctgcctcagccgggggccgc

SEQ ID NO: 9323474 - DNA, 22 bp, Homo sapiens
gtcctgggcctgctgaggctga

SEQ ID NO: 9323475 - DNA, 22 bp, Homo sapiens
gtcctgggcctgctgaggctga

SEQ ID NO: 9323476 - DNA, 22 bp, Homo sapiens
gtcctgggcggagggctgctgt

SEQ ID NO: 9323477 - DNA, 22 bp, Homo sapiens
gtcctggggaatacagaagccg

SEQ ID NO: 9323478 - DNA, 22 bp, Homo sapiens
gtcctgggcggagggctgctgt

SEQ ID NO: 9323479 - DNA, 22 bp, Homo sapiens
gtcctggggatacagaagtgaa

SEQ ID NO: 9323480 - DNA, 22 bp, Homo sapiens
gtcctggggattatagagtgtt

SEQ ID NO: 9323481 - DNA, 22 bp, Homo sapiens
gtctgcccttggcctgggactt

SEQ ID NO: 9323482 - DNA, 22 bp, Homo sapiens
gtctgccctgcagacatgcctc

SEQ ID NO: 9323483 - DNA, 22 bp, Homo sapiens
gtctgccctcacgccagctggg

SEQ ID NO: 9323484 - DNA, 22 bp, Homo sapiens
gtcctgggggcagctgtgtcca

SEQ ID NO: 9323485 - DNA, 22 bp, Homo sapiens
gtcctgggggcagctgtgtcca

SEQ ID NO: 9323486 - DNA, 22 bp, Homo sapiens
gtgaaaataaggctggttcttg

SEQ ID NO: 9323487 - DNA, 22 bp, Homo sapiens
gtgaaactgctttgtaaactgt

SEQ ID NO: 9323488 - DNA, 22 bp, Homo sapiens
gtgaaggagttatcagtggtta

SEQ ID NO: 9323489 - DNA, 22 bp, Homo sapiens
gtgcagagaaggagcagtagtt

SEQ ID NO: 9323490 - DNA, 22 bp, Homo sapiens
gtgcagacccacgtccagggcc

SEQ ID NO: 9323491 - DNA, 22 bp, Homo sapiens
gtgcagaccttagttcaagcca

SEQ ID NO: 9323492 - DNA, 22 bp, Homo sapiens
gtgcacatcgtgcaggtttgtt

SEQ ID NO: 9323493 - DNA, 22 bp, Homo sapiens
gtgcagaggacgtggcggcctc

SEQ ID NO: 9323494 - DNA, 21 bp, Homo sapiens
gtgcagaggaatgtagggggc

SEQ ID NO: 9323495 - DNA, 22 bp, Homo sapiens
gtgcagagcaagggctgagggc

SEQ ID NO: 9323496 - DNA, 22 bp, Homo sapiens
gtgcagatcctgattgcagttc

SEQ ID NO: 9323497 - DNA, 22 bp, Homo sapiens
gtgcagagtgtctgtggactga

SEQ ID NO: 9323498 - DNA, 20 bp, Homo sapiens
gtgcagaggcagcctgtggg

SEQ ID NO: 9323499 - DNA, 22 bp, Homo sapiens
gtgcagtgaccctggagagctg

SEQ ID NO: 9323500 - DNA, 22 bp, Homo sapiens
gtgcaggtttaggaagcagctc

SEQ ID NO: 9323501 - DNA, 22 bp, Homo sapiens
gtgcagttgaagcatggggaga

SEQ ID NO: 9323502 - DNA, 22 bp, Homo sapiens
gttggggtaccttgaggctggg

SEQ ID NO: 9323503 - DNA, 22 bp, Homo sapiens
gttggggtaccttgaggctggg

SEQ ID NO: 9323504 - DNA, 22 bp, Homo sapiens
gttgggatgatttagtcaagca

SEQ ID NO: 9323505 - DNA, 22 bp, Homo sapiens
gttgggctcattacagcctgct

SEQ ID NO: 9323506 - DNA, 22 bp, Homo sapiens
gttgggctgggagctgccctga

SEQ ID NO: 9323507 - DNA, 22 bp, Homo sapiens
gttggtgatgccacacatattt

SEQ ID NO: 9323508 - DNA, 22 bp, Homo sapiens
gttgtaaatacagcagataatt

SEQ ID NO: 9323509 - DNA, 22 bp, Homo sapiens
gttgtaaatacagtactgaaac

SEQ ID NO: 9323510 - DNA, 19 bp, Homo sapiens
gttgtaaatggaggtttct

SEQ ID NO: 9323511 - DNA, 22 bp, Homo sapiens
gttgtaaatgactggcattggg

SEQ ID NO: 9323512 - DNA, 22 bp, Homo sapiens
gttgaggtgatgccagccctgc

SEQ ID NO: 9323513 - DNA, 22 bp, Homo sapiens
gttcatgtgactactatgacct

SEQ ID NO: 9323514 - DNA, 22 bp, Homo sapiens
gttcatgatgaggaaaacagga

SEQ ID NO: 9323515 - DNA, 22 bp, Homo sapiens
gttcagtttgacaacctttata

SEQ ID NO: 9323516 - DNA, 22 bp, Homo sapiens
gttcagtttgagattaccatgg

SEQ ID NO: 9323517 - DNA, 22 bp, Homo sapiens
gttcagtcacgtgcccaagttc

SEQ ID NO: 9323518 - DNA, 22 bp, Homo sapiens
gttcagcacaggtgctcagaca

SEQ ID NO: 9323519 - DNA, 22 bp, Homo sapiens
gttcagcaagtactcagtccac

SEQ ID NO: 9323520 - DNA, 22 bp, Homo sapiens
gttcagagtattaattgattta

SEQ ID NO: 9323521 - DNA, 21 bp, Homo sapiens
gttcagagattattgagtcat

SEQ ID NO: 9323522 - DNA, 22 bp, Homo sapiens
gttcagagaaagagacacctta

SEQ ID NO: 9323523 - DNA, 22 bp, Homo sapiens
gttacaaaggaagcttcactgc

SEQ ID NO: 9323524 - DNA, 22 bp, Homo sapiens
gttacaaaggactgggggccac

SEQ ID NO: 9323525 - DNA, 22 bp, Homo sapiens
gtgctctatgaggatatagggt

SEQ ID NO: 9323526 - DNA, 22 bp, Homo sapiens
gtgctctcctggctgccctgac

SEQ ID NO: 9323527 - DNA, 22 bp, Homo sapiens
gtgctccctccttcctcaagga

SEQ ID NO: 9323528 - DNA, 22 bp, Homo sapiens
gtgctccctccttcctcaagga

SEQ ID NO: 9323529 - DNA, 22 bp, Homo sapiens
gtgctcaggggcaatcctggga

SEQ ID NO: 9323530 - DNA, 22 bp, Homo sapiens
gttacaaagcacttcaagtgaa

SEQ ID NO: 9323531 - DNA, 18 bp, Homo sapiens
gttaattttgaagttcat

SEQ ID NO: 9323532 - DNA, 22 bp, Homo sapiens
gttaatttgcagctttcgagct

SEQ ID NO: 9323533 - DNA, 22 bp, Homo sapiens
gttacaaactcaggtgccaaaa

SEQ ID NO: 9323534 - DNA, 22 bp, Homo sapiens
gttaaggctgagcaggacactg

SEQ ID NO: 9323535 - DNA, 22 bp, Homo sapiens
gttaataaaggtatagaatcag

SEQ ID NO: 9323536 - DNA, 22 bp, Homo sapiens
gttaatatttacctgtcaagaa

SEQ ID NO: 9323537 - DNA, 22 bp, Homo sapiens
gttaatttagtagagtccagat

SEQ ID NO: 9323538 - DNA, 22 bp, Homo sapiens
gtgtgccttaagctctatagac

SEQ ID NO: 9323539 - DNA, 22 bp, Homo sapiens
gtgtgccttaagctctatagac

SEQ ID NO: 9323540 - DNA, 23 bp, Homo sapiens
gtgtgcctttatcttctgtactc

SEQ ID NO: 9323541 - DNA, 23 bp, Homo sapiens
gtgtgcctttatcttctgtactc

SEQ ID NO: 9323542 - DNA, 22 bp, Homo sapiens
gtgtgcctcgccaagctgtcgg

SEQ ID NO: 9323543 - DNA, 22 bp, Homo sapiens
gtgtgcctgtatcatggtaacc

SEQ ID NO: 9323544 - DNA, 22 bp, Homo sapiens
gtgtgcctgacatgatggttaa

SEQ ID NO: 9323545 - DNA, 22 bp, Homo sapiens
gtgtgcctatgagtggtgaaca

SEQ ID NO: 9323546 - DNA, 22 bp, Homo sapiens
gtgtgcctcccattagggtgta

SEQ ID NO: 9323547 - DNA, 22 bp, Homo sapiens
gtgtgggacgggtgagtggcca

SEQ ID NO: 9323548 - DNA, 22 bp, Homo sapiens
gttttctttgaatgcttctaga

SEQ ID NO: 9323549 - DNA, 21 bp, Homo sapiens
gttttctttgatagagggaag

SEQ ID NO: 9323550 - DNA, 22 bp, Homo sapiens
gttttcttcctgcaattggcat

SEQ ID NO: 9323551 - DNA, 22 bp, Homo sapiens
gtttccagccctgcaggtttaa

SEQ ID NO: 9323552 - DNA, 22 bp, Homo sapiens
gtttccagcctcctgggtaaag

SEQ ID NO: 9323553 - DNA, 22 bp, Homo sapiens
gtttccagcctagagatggtga

SEQ ID NO: 9323554 - DNA, 22 bp, Homo sapiens
gtttccagagatcatttacata

SEQ ID NO: 9323555 - DNA, 22 bp, Homo sapiens
gtttccagagggaatatttgct

SEQ ID NO: 9323556 - DNA, 22 bp, Homo sapiens
gtttccagccaatcccctcagg

SEQ ID NO: 9323557 - DNA, 22 bp, Homo sapiens
gtttccagagtgagggcacttg

SEQ ID NO: 9323558 - DNA, 22 bp, Homo sapiens
gtttccaggcactttttctgct

SEQ ID NO: 9323559 - DNA, 22 bp, Homo sapiens
gtttccagcttgggcccgggga

SEQ ID NO: 9323560 - DNA, 22 bp, Homo sapiens
gtttccaggaggctacacctga

SEQ ID NO: 9323561 - DNA, 22 bp, Homo sapiens
gtttccaggaagggttgggagg

SEQ ID NO: 9323562 - DNA, 22 bp, Homo sapiens
gtttccagctcttagcaaaggc

SEQ ID NO: 9323563 - DNA, 22 bp, Homo sapiens
gtttccagctttctgatgcttg

SEQ ID NO: 9323564 - DNA, 22 bp, Homo sapiens
gtttccaggcagggtgattctc

SEQ ID NO: 9323565 - DNA, 22 bp, Homo sapiens
gtttccaggcgatatcagctgc

SEQ ID NO: 9323566 - DNA, 22 bp, Homo sapiens
gtttccaggcccctccctagac

SEQ ID NO: 9323567 - DNA, 22 bp, Homo sapiens
gtttccagggctctcttcatga

SEQ ID NO: 9323568 - DNA, 22 bp, Homo sapiens
gtttccaggctgggcagcgagc

SEQ ID NO: 9323569 - DNA, 22 bp, Homo sapiens
gtttccaggctttggtatggtt

SEQ ID NO: 9323570 - DNA, 22 bp, Homo sapiens
gtttccagtcaacttgtgtgtg

SEQ ID NO: 9323571 - DNA, 22 bp, Homo sapiens
gttttgttttgagtcaactcca

SEQ ID NO: 9323572 - DNA, 22 bp, Homo sapiens
gtttttatatcctgtggagtgt

SEQ ID NO: 9323573 - DNA, 22 bp, Homo sapiens
gtttttattgtgtaaatgtggg

SEQ ID NO: 9323574 - DNA, 22 bp, Homo sapiens
gtttttatctaatagcagttat

SEQ ID NO: 9323575 - DNA, 22 bp, Homo sapiens
taaaagttttagttgtacataa

SEQ ID NO: 9323576 - DNA, 22 bp, Homo sapiens
taaaatgcacagcagttgaaag

SEQ ID NO: 9323577 - DNA, 22 bp, Homo sapiens
taaaatgccagaccagttcacg

SEQ ID NO: 9323578 - DNA, 22 bp, Homo sapiens
taaaattgcggtgaatatttcc

SEQ ID NO: 9323579 - DNA, 22 bp, Homo sapiens
taaaatttgtccctgagtgttg

SEQ ID NO: 9323580 - DNA, 22 bp, Homo sapiens
taaagggctaatgtgtgactgg

SEQ ID NO: 9323581 - DNA, 22 bp, Homo sapiens
taaacagaattcaggcaagata

SEQ ID NO: 9323582 - DNA, 22 bp, Homo sapiens
taaacaattcctctctaggcat

SEQ ID NO: 9323583 - DNA, 22 bp, Homo sapiens
taaattatgttccatgtccttt

SEQ ID NO: 9323584 - DNA, 22 bp, Homo sapiens
taaattctgatcaagttccttc

SEQ ID NO: 9323585 - DNA, 22 bp, Homo sapiens
taaattgcataagtacaaatga

SEQ ID NO: 9323586 - DNA, 22 bp, Homo sapiens
taaattgctgattttagatgct

SEQ ID NO: 9323587 - DNA, 18 bp, Homo sapiens
taaattgcttcacctgag

SEQ ID NO: 9323588 - DNA, 22 bp, Homo sapiens
taactctttactatacatttat

SEQ ID NO: 9323589 - DNA, 22 bp, Homo sapiens
taactagatgtgagaatattca

SEQ ID NO: 9323590 - DNA, 22 bp, Homo sapiens
taattacaaagcaagcacaggg

SEQ ID NO: 9323591 - DNA, 22 bp, Homo sapiens
taattacaggtccaaaacaatc

SEQ ID NO: 9323592 - DNA, 22 bp, Homo sapiens
taattactggaaatttcaaata

SEQ ID NO: 9323593 - DNA, 22 bp, Homo sapiens
taattacagaggtttgccagtt

SEQ ID NO: 9323594 - DNA, 22 bp, Homo sapiens
taattataaactgcagtaggta

SEQ ID NO: 9323595 - DNA, 22 bp, Homo sapiens
taattataacagttacatctta

SEQ ID NO: 9323596 - DNA, 22 bp, Homo sapiens
taattatacaaaaaggcatgca

SEQ ID NO: 9323597 - DNA, 22 bp, Homo sapiens
tacaaacttgttttaagtaagt

SEQ ID NO: 9323598 - DNA, 22 bp, Homo sapiens
tacaaagaggtaattgcatata

SEQ ID NO: 9323599 - DNA, 22 bp, Homo sapiens
tacaaagaggcagctccatttt

SEQ ID NO: 9323600 - DNA, 22 bp, Homo sapiens
taattatagccgctattttgct

SEQ ID NO: 9323601 - DNA, 22 bp, Homo sapiens
tacaaaggcggtttttctgggc

SEQ ID NO: 9323602 - DNA, 22 bp, Homo sapiens
tacaaaggagtagagaaggctt

SEQ ID NO: 9323603 - DNA, 22 bp, Homo sapiens
tacaaaggcaggtttcccagga

SEQ ID NO: 9323604 - DNA, 22 bp, Homo sapiens
tacaaaggcaggtttcccagga

SEQ ID NO: 9323605 - DNA, 19 bp, Homo sapiens
tacaaaggaggatgtaaaa

SEQ ID NO: 9323606 - DNA, 22 bp, Homo sapiens
tacaaaggaggtgcatagaaca

SEQ ID NO: 9323607 - DNA, 21 bp, Homo sapiens
tacaaagggaaattctggctc

SEQ ID NO: 9323608 - DNA, 22 bp, Homo sapiens
tacaaagggaatattggcttta

SEQ ID NO: 9323609 - DNA, 22 bp, Homo sapiens
tacaaaggcttaaagagatttc

SEQ ID NO: 9323610 - DNA, 22 bp, Homo sapiens
tacaaagggattggggtggata

SEQ ID NO: 9323611 - DNA, 22 bp, Homo sapiens
tacaaaggtatctttcctagat

SEQ ID NO: 9323612 - DNA, 22 bp, Homo sapiens
tacaaaggtatctttcctagat

SEQ ID NO: 9323613 - DNA, 22 bp, Homo sapiens
tacaaagggggaagagattctg

SEQ ID NO: 9323614 - DNA, 22 bp, Homo sapiens
tacaaagtcacattgaaatgaa

SEQ ID NO: 9323615 - DNA, 22 bp, Homo sapiens
tacaaagtaatgtataatatcg

SEQ ID NO: 9323616 - DNA, 22 bp, Homo sapiens
tacaaaggagactctgtattta

SEQ ID NO: 9323617 - DNA, 22 bp, Homo sapiens
tacaaaggagataaattggagg

SEQ ID NO: 9323618 - DNA, 22 bp, Homo sapiens
tacaaaggagaatagggtagca

SEQ ID NO: 9323619 - DNA, 22 bp, Homo sapiens
tacaaaggacagcagaaaaata

SEQ ID NO: 9323620 - DNA, 22 bp, Homo sapiens
tacaaaggaaacttcttttccc

SEQ ID NO: 9323621 - DNA, 22 bp, Homo sapiens
tacaaagctactcgagggcagg

SEQ ID NO: 9323622 - DNA, 22 bp, Homo sapiens
tacaaagatagtgttagagtaa

SEQ ID NO: 9323623 - DNA, 22 bp, Homo sapiens
taaggccagcatgaatgcagca

SEQ ID NO: 9323624 - DNA, 22 bp, Homo sapiens
taaggctaggaattctctgaag

SEQ ID NO: 9323625 - DNA, 22 bp, Homo sapiens
taaggctcttgagatggggaga

SEQ ID NO: 9323626 - DNA, 22 bp, Homo sapiens
taaggcagtgagaagaaacagg

SEQ ID NO: 9323627 - DNA, 22 bp, Homo sapiens
taaggcagtagtgtctgtaggg

SEQ ID NO: 9323628 - DNA, 22 bp, Homo sapiens
taaggcagtgaaactattctgt

SEQ ID NO: 9323629 - DNA, 22 bp, Homo sapiens
taaggcagttttgcctgagata

SEQ ID NO: 9323630 - DNA, 22 bp, Homo sapiens
taaggcataaggaagatttgga

SEQ ID NO: 9323631 - DNA, 22 bp, Homo sapiens
taaggcaggactggatagctat

SEQ ID NO: 9323632 - DNA, 22 bp, Homo sapiens
taaggcaggtatggtaccaggc

SEQ ID NO: 9323633 - DNA, 22 bp, Homo sapiens
taaggcaggtagatgactacgg

SEQ ID NO: 9323634 - DNA, 22 bp, Homo sapiens
taaggcaggctttcatccagag

SEQ ID NO: 9323635 - DNA, 19 bp, Homo sapiens
taataagcaatatggaagt

SEQ ID NO: 9323636 - DNA, 22 bp, Homo sapiens
taataagcgtagaaggtatatc

SEQ ID NO: 9323637 - DNA, 22 bp, Homo sapiens
taagtgggtttgtaatgtgcct

SEQ ID NO: 9323638 - DNA, 22 bp, Homo sapiens
taagtgggtgaagaggaaatat

SEQ ID NO: 9323639 - DNA, 22 bp, Homo sapiens
taagtgggcgccttgaattact

SEQ ID NO: 9323640 - DNA, 22 bp, Homo sapiens
taagtgggctcaggtgcttgga

SEQ ID NO: 9323641 - DNA, 22 bp, Homo sapiens
taatactagtgaatagcaggat

SEQ ID NO: 9323642 - DNA, 22 bp, Homo sapiens
taatacctggccttgatacagt

SEQ ID NO: 9323643 - DNA, 22 bp, Homo sapiens
taatacctagagatgatacaaa

SEQ ID NO: 9323644 - DNA, 22 bp, Homo sapiens
taagtagatgcaaaatggagtt

SEQ ID NO: 9323645 - DNA, 22 bp, Homo sapiens
taagtagactgttgaacttggt

SEQ ID NO: 9323646 - DNA, 22 bp, Homo sapiens
taagtaaatttataatgtgatt

SEQ ID NO: 9323647 - DNA, 22 bp, Homo sapiens
tacaggcatgtagcatggtgat

SEQ ID NO: 9323648 - DNA, 22 bp, Homo sapiens
tacaggagctgctctgtgatac

SEQ ID NO: 9323649 - DNA, 19 bp, Homo sapiens
tacaggaggcctgcaatct

SEQ ID NO: 9323650 - DNA, 20 bp, Homo sapiens
tacaggagtgagtgggtggg

SEQ ID NO: 9323651 - DNA, 22 bp, Homo sapiens
tacatctagccttacaattatt

SEQ ID NO: 9323652 - DNA, 22 bp, Homo sapiens
tacatatactgagtgatttgct

SEQ ID NO: 9323653 - DNA, 22 bp, Homo sapiens
tacatatagacagttactctag

SEQ ID NO: 9323654 - DNA, 22 bp, Homo sapiens
tacatatagacagttactctag

SEQ ID NO: 9323655 - DNA, 22 bp, Homo sapiens
tacatttgatttccactcatct

SEQ ID NO: 9323656 - DNA, 22 bp, Homo sapiens
tacagaaagggatgattgatct

SEQ ID NO: 9323657 - DNA, 22 bp, Homo sapiens
tacaaagtcagaataacaggtg

SEQ ID NO: 9323658 - DNA, 20 bp, Homo sapiens
tacaacaagtagagacatac

SEQ ID NO: 9323659 - DNA, 22 bp, Homo sapiens
tacactgaatactagttttcct

SEQ ID NO: 9323660 - DNA, 22 bp, Homo sapiens
tatatcatggagattaacattc

SEQ ID NO: 9323661 - DNA, 22 bp, Homo sapiens
tatatctgggaaccaaaggggg

SEQ ID NO: 9323662 - DNA, 19 bp, Homo sapiens
tatatattttggggttgtg

SEQ ID NO: 9323663 - DNA, 19 bp, Homo sapiens
tatatattttggggttgtg

SEQ ID NO: 9323664 - DNA, 22 bp, Homo sapiens
tatatattcttaagtagtgtag

SEQ ID NO: 9323665 - DNA, 22 bp, Homo sapiens
tatagcatatacagataagctg

SEQ ID NO: 9323666 - DNA, 22 bp, Homo sapiens
tatcctgctttgttcctcttga

SEQ ID NO: 9323667 - DNA, 21 bp, Homo sapiens
tatctacagtgtccattcagt

SEQ ID NO: 9323668 - DNA, 22 bp, Homo sapiens
tatctactcctctttcagatgc

SEQ ID NO: 9323669 - DNA, 22 bp, Homo sapiens
tatgacattgctttttagaact

SEQ ID NO: 9323670 - DNA, 22 bp, Homo sapiens
tatgacattttcccagatttat

SEQ ID NO: 9323671 - DNA, 22 bp, Homo sapiens
tatgacattttgccagcattgc

SEQ ID NO: 9323672 - DNA, 22 bp, Homo sapiens
tatgacattttgccagcattgc

SEQ ID NO: 9323673 - DNA, 22 bp, Homo sapiens
tatgacttatttcatcagttct

SEQ ID NO: 9323674 - DNA, 22 bp, Homo sapiens
tatgacttttcccaattcagga

SEQ ID NO: 9323675 - DNA, 22 bp, Homo sapiens
tatgactttggaaaaattactt

SEQ ID NO: 9323676 - DNA, 22 bp, Homo sapiens
taggtgagtttggggaagatag

SEQ ID NO: 9323677 - DNA, 22 bp, Homo sapiens
taggggtgtttcgagagaggtt

SEQ ID NO: 9323678 - DNA, 22 bp, Homo sapiens
taggtcagaacaagcagtatcg

SEQ ID NO: 9323679 - DNA, 20 bp, Homo sapiens
taggtgagggcagatagagg

SEQ ID NO: 9323680 - DNA, 22 bp, Homo sapiens
taggtgagggagcattgtgaga

SEQ ID NO: 9323681 - DNA, 20 bp, Homo sapiens
taggtccaatgctcgtcttc

SEQ ID NO: 9323682 - DNA, 22 bp, Homo sapiens
taggtccacaagatcaatgcag

SEQ ID NO: 9323683 - DNA, 22 bp, Homo sapiens
taggtccacagatttggtttct

SEQ ID NO: 9323684 - DNA, 22 bp, Homo sapiens
taggtccagcacggtgtagctt

SEQ ID NO: 9323685 - DNA, 22 bp, Homo sapiens
tataaatgcacttttgaaatat

SEQ ID NO: 9323686 - DNA, 22 bp, Homo sapiens
tataaatgccaggactttagat

SEQ ID NO: 9323687 - DNA, 22 bp, Homo sapiens
tataactgagaagatacatagt

SEQ ID NO: 9323688 - DNA, 17 bp, Homo sapiens
tatacacagacagactg

SEQ ID NO: 9323689 - DNA, 22 bp, Homo sapiens
tataatttatcatgtcacagtt

SEQ ID NO: 9323690 - DNA, 22 bp, Homo sapiens
tataattttaagtggtaaatta

SEQ ID NO: 9323691 - DNA, 22 bp, Homo sapiens
tataatttggggaaagtggtgt

SEQ ID NO: 9323692 - DNA, 22 bp, Homo sapiens
tataattttagaagagatggaa

SEQ ID NO: 9323693 - DNA, 22 bp, Homo sapiens
tatacacacctccaaagcagga

SEQ ID NO: 9323694 - DNA, 22 bp, Homo sapiens
tatttataccaggtgatcggag

SEQ ID NO: 9323695 - DNA, 22 bp, Homo sapiens
tatttataatctgccaaagaga

SEQ ID NO: 9323696 - DNA, 22 bp, Homo sapiens
tatttataccaggtgatcggag

SEQ ID NO: 9323697 - DNA, 22 bp, Homo sapiens
tatttatattctgccttctgct

SEQ ID NO: 9323698 - DNA, 21 bp, Homo sapiens
tatttattaatttgtaaggct

SEQ ID NO: 9323699 - DNA, 21 bp, Homo sapiens
tatttattaatttgtaaggct

SEQ ID NO: 9323700 - DNA, 22 bp, Homo sapiens
tatttatattctgccttctgct

SEQ ID NO: 9323701 - DNA, 22 bp, Homo sapiens
tatttatgtatgtggatgtgtt

SEQ ID NO: 9323702 - DNA, 22 bp, Homo sapiens
tatttatgtctctgcagagaat

SEQ ID NO: 9323703 - DNA, 22 bp, Homo sapiens
tatttatgtctctgcagagaat

SEQ ID NO: 9323704 - DNA, 22 bp, Homo sapiens
tatttataacagtgagaacggg

SEQ ID NO: 9323705 - DNA, 22 bp, Homo sapiens
tatttataatctgccaaagaga

SEQ ID NO: 9323706 - DNA, 22 bp, Homo sapiens
tatttctccctataccctccaa

SEQ ID NO: 9323707 - DNA, 22 bp, Homo sapiens
tatttctccaagggggccctct

SEQ ID NO: 9323708 - DNA, 22 bp, Homo sapiens
tatttctaagctgtaagtctga

SEQ ID NO: 9323709 - DNA, 22 bp, Homo sapiens
tatttattcattcagcaagcat

SEQ ID NO: 9323710 - DNA, 22 bp, Homo sapiens
tatttattcattcagcaagcat

SEQ ID NO: 9323711 - DNA, 22 bp, Homo sapiens
tatttattcattcagcaagcat

SEQ ID NO: 9323712 - DNA, 22 bp, Homo sapiens
tatttattggacagtgttgctg

SEQ ID NO: 9323713 - DNA, 22 bp, Homo sapiens
tatttattggacagtgttgctg

SEQ ID NO: 9323714 - DNA, 22 bp, Homo sapiens
tatttattctttgtactgcctt

SEQ ID NO: 9323715 - DNA, 22 bp, Homo sapiens
tatttattctttgtactgcctt

SEQ ID NO: 9323716 - DNA, 22 bp, Homo sapiens
tattctgatttcaagtgagagt

SEQ ID NO: 9323717 - DNA, 22 bp, Homo sapiens
tattctgcatgaaaataaacag

SEQ ID NO: 9323718 - DNA, 22 bp, Homo sapiens
tattctgctaagtgatttctac

SEQ ID NO: 9323719 - DNA, 22 bp, Homo sapiens
tattctgcttcccgtggcacaa

SEQ ID NO: 9323720 - DNA, 22 bp, Homo sapiens
tattcttagccagcagcctggg

SEQ ID NO: 9323721 - DNA, 22 bp, Homo sapiens
tattagcttgtttggcaggatg

SEQ ID NO: 9323722 - DNA, 22 bp, Homo sapiens
tattagctttagcctttggatg

SEQ ID NO: 9323723 - DNA, 22 bp, Homo sapiens
tattagcttctggttttgttct

SEQ ID NO: 9323724 - DNA, 22 bp, Homo sapiens
tattcatgtgttggaaaggaac

SEQ ID NO: 9323725 - DNA, 22 bp, Homo sapiens
tattcatgggggtccaggtacc

SEQ ID NO: 9323726 - DNA, 22 bp, Homo sapiens
tattcctgttccccatcaccac

SEQ ID NO: 9323727 - DNA, 22 bp, Homo sapiens
tattcatgggaggtcacaactt

SEQ ID NO: 9323728 - DNA, 21 bp, Homo sapiens
tatgagatatacttattcttt

SEQ ID NO: 9323729 - DNA, 22 bp, Homo sapiens
tatgagataatagatgtgtaaa

SEQ ID NO: 9323730 - DNA, 22 bp, Homo sapiens
tatgagatattcccagcgtcta

SEQ ID NO: 9323731 - DNA, 22 bp, Homo sapiens
tatgagatcccttttcctagag

SEQ ID NO: 9323732 - DNA, 22 bp, Homo sapiens
tatgagatcccttttcctagag

SEQ ID NO: 9323733 - DNA, 22 bp, Homo sapiens
tatgagatttggattcagtgaa

SEQ ID NO: 9323734 - DNA, 20 bp, Homo sapiens
tatgagatttgacctcaaca

SEQ ID NO: 9323735 - DNA, 22 bp, Homo sapiens
tatgtacaatcagcagttcata

SEQ ID NO: 9323736 - DNA, 22 bp, Homo sapiens
tatgtcctgctactctctcatg

SEQ ID NO: 9323737 - DNA, 22 bp, Homo sapiens
tatgtacagtccttaacttaaa

SEQ ID NO: 9323738 - DNA, 22 bp, Homo sapiens
tatgtacaccaaggattgaaaa

SEQ ID NO: 9323739 - DNA, 22 bp, Homo sapiens
tatgtacacatacacttgtaat

SEQ ID NO: 9323740 - DNA, 22 bp, Homo sapiens
tatgtacacacacatgcatgta

SEQ ID NO: 9323741 - DNA, 22 bp, Homo sapiens
tatgtgtggcagctgggagtgt

SEQ ID NO: 9323742 - DNA, 23 bp, Homo sapiens
tattagcaattcccacagagcag

SEQ ID NO: 9323743 - DNA, 22 bp, Homo sapiens
tattagctccagtactgttgcc

SEQ ID NO: 9323744 - DNA, 22 bp, Homo sapiens
tattagctgtgtaactctggtt

SEQ ID NO: 9323745 - DNA, 21 bp, Homo sapiens
tattagcttctggtgctgttt

SEQ ID NO: 9323746 - DNA, 22 bp, Homo sapiens
tattagctcatgatttcggtgg

SEQ ID NO: 9323747 - DNA, 17 bp, Homo sapiens
tattagctagcttccag

SEQ ID NO: 9323748 - DNA, 22 bp, Homo sapiens
tattactgaaaaggcaaagtag

SEQ ID NO: 9323749 - DNA, 22 bp, Homo sapiens
tattactgttacttcacactgt

SEQ ID NO: 9323750 - DNA, 22 bp, Homo sapiens
tatgtgagtctaattgtgtagt

SEQ ID NO: 9323751 - DNA, 22 bp, Homo sapiens
tatgtctttttctcactatagt

SEQ ID NO: 9323752 - DNA, 22 bp, Homo sapiens
taggctgggcattctggccagg

SEQ ID NO: 9323753 - DNA, 22 bp, Homo sapiens
taggctgggagcctgaggctag

SEQ ID NO: 9323754 - DNA, 22 bp, Homo sapiens
taggctgggagcctgaggctag

SEQ ID NO: 9323755 - DNA, 22 bp, Homo sapiens
taggctgggcattctggccagg

SEQ ID NO: 9323756 - DNA, 22 bp, Homo sapiens
taggctgggcattctggccagg

SEQ ID NO: 9323757 - DNA, 22 bp, Homo sapiens
taggcagaaaggaaggcaagtt

SEQ ID NO: 9323758 - DNA, 22 bp, Homo sapiens
tagggcagagcttgtacacgat

SEQ ID NO: 9323759 - DNA, 22 bp, Homo sapiens
tagctttacaaagtgctgcacc

SEQ ID NO: 9323760 - DNA, 22 bp, Homo sapiens
tagctttcagaatccactgagt

SEQ ID NO: 9323761 - DNA, 22 bp, Homo sapiens
tagctttccttctagccctgaa

SEQ ID NO: 9323762 - DNA, 22 bp, Homo sapiens
tagctttaggatggttctcttg

SEQ ID NO: 9323763 - DNA, 22 bp, Homo sapiens
tagctttctcaattttctgcca

SEQ ID NO: 9323764 - DNA, 22 bp, Homo sapiens
tagcttttagtacttaatggct

SEQ ID NO: 9323765 - DNA, 22 bp, Homo sapiens
taggaaaaagaggctggcaagg

SEQ ID NO: 9323766 - DNA, 22 bp, Homo sapiens
taggaaaaatacagaattatat

SEQ ID NO: 9323767 - DNA, 22 bp, Homo sapiens
taggaaaacgtgattttctcac

SEQ ID NO: 9323768 - DNA, 22 bp, Homo sapiens
taggaaaagtctagattgatga

SEQ ID NO: 9323769 - DNA, 22 bp, Homo sapiens
taggaaaagcacaggatgttct

SEQ ID NO: 9323770 - DNA, 22 bp, Homo sapiens
taggataggatggagacagaat

SEQ ID NO: 9323771 - DNA, 22 bp, Homo sapiens
taggaaaatatctcttattggg

SEQ ID NO: 9323772 - DNA, 22 bp, Homo sapiens
taggacagtagctggtgcacag

SEQ ID NO: 9323773 - DNA, 22 bp, Homo sapiens
taggacagtttactttggttac

SEQ ID NO: 9323774 - DNA, 22 bp, Homo sapiens
tagcccctgcctttgaacctgg

SEQ ID NO: 9323775 - DNA, 22 bp, Homo sapiens
tagccgggtgtggtggaactcc

SEQ ID NO: 9323776 - DNA, 22 bp, Homo sapiens
tagcctctctcctccacaacct

SEQ ID NO: 9323777 - DNA, 22 bp, Homo sapiens
tagcgaggtgtttctaggactg

SEQ ID NO: 9323778 - DNA, 22 bp, Homo sapiens
tagctctgaccaagagactgag

SEQ ID NO: 9323779 - DNA, 22 bp, Homo sapiens
tagctctgtgctctggatctgt

SEQ ID NO: 9323780 - DNA, 22 bp, Homo sapiens
tagctctgtcacatacactgca

SEQ ID NO: 9323781 - DNA, 21 bp, Homo sapiens
tagctttaatattcccacatt

SEQ ID NO: 9323782 - DNA, 22 bp, Homo sapiens
tagctgttttgccataagcgct

SEQ ID NO: 9323783 - DNA, 22 bp, Homo sapiens
tagctgtttcagtgcagcagaa

SEQ ID NO: 9323784 - DNA, 22 bp, Homo sapiens
tagctgttgggagagggctaga

SEQ ID NO: 9323785 - DNA, 22 bp, Homo sapiens
tagctgttcatgtggctttatg

SEQ ID NO: 9323786 - DNA, 22 bp, Homo sapiens
tagctgttcaagttcctggaaa

SEQ ID NO: 9323787 - DNA, 22 bp, Homo sapiens
tagctgttattttgctacccat

SEQ ID NO: 9323788 - DNA, 22 bp, Homo sapiens
tagctgaagggcatttaataaa

SEQ ID NO: 9323789 - DNA, 22 bp, Homo sapiens
tagaggtgttgttgatatagaa

SEQ ID NO: 9323790 - DNA, 22 bp, Homo sapiens
tagaggtgtcactttgggaagt

SEQ ID NO: 9323791 - DNA, 20 bp, Homo sapiens
tagaggtgggatttgggttt

SEQ ID NO: 9323792 - DNA, 22 bp, Homo sapiens
tagaggtgttgacgccaaggta

SEQ ID NO: 9323793 - DNA, 22 bp, Homo sapiens
tagaggtgttcattctctccat

SEQ ID NO: 9323794 - DNA, 22 bp, Homo sapiens
tagaggtactcccctcaaagtt

SEQ ID NO: 9323795 - DNA, 22 bp, Homo sapiens
tagaggtagatggtcagccaat

SEQ ID NO: 9323796 - DNA, 22 bp, Homo sapiens
tagaggtgacactgagaccata

SEQ ID NO: 9323797 - DNA, 22 bp, Homo sapiens
tagaggtgagacttcagtgaca

SEQ ID NO: 9323798 - DNA, 22 bp, Homo sapiens
tagaggtgagattgtggtgctg

SEQ ID NO: 9323799 - DNA, 22 bp, Homo sapiens
tagaggtgagccatcaaggggc

SEQ ID NO: 9323800 - DNA, 22 bp, Homo sapiens
tagaggtgagaggaactttgga

SEQ ID NO: 9323801 - DNA, 22 bp, Homo sapiens
tagaggtgagatattttatttt

SEQ ID NO: 9323802 - DNA, 22 bp, Homo sapiens
tagcagcattaattccatttgc

SEQ ID NO: 9323803 - DNA, 22 bp, Homo sapiens
tagcagcatcctgtggtgatgg

SEQ ID NO: 9323804 - DNA, 22 bp, Homo sapiens
tagcagcatgtaagtgagtaga

SEQ ID NO: 9323805 - DNA, 23 bp, Homo sapiens
tagcagcatttttagcctctgtc

SEQ ID NO: 9323806 - DNA, 22 bp, Homo sapiens
tagcagcatttttgtagagtat

SEQ ID NO: 9323807 - DNA, 22 bp, Homo sapiens
tagcagcaggggaaacagctgt

SEQ ID NO: 9323808 - DNA, 17 bp, Homo sapiens
tagcagcagtaattgtg

SEQ ID NO: 9323809 - DNA, 22 bp, Homo sapiens
tagcagcagtggtgtatttaga

SEQ ID NO: 9323810 - DNA, 22 bp, Homo sapiens
tagaaagtactaaatttaactg

SEQ ID NO: 9323811 - DNA, 21 bp, Homo sapiens
tagaaagtcaaagctatcagc

SEQ ID NO: 9323812 - DNA, 22 bp, Homo sapiens
tagaaagcatgcaagtttgatg

SEQ ID NO: 9323813 - DNA, 19 bp, Homo sapiens
tagaaagccagaaaacaga

SEQ ID NO: 9323814 - DNA, 22 bp, Homo sapiens
tagaaagcgttaaatctacaga

SEQ ID NO: 9323815 - DNA, 22 bp, Homo sapiens
tagaaagcgttaaatctacaga

SEQ ID NO: 9323816 - DNA, 22 bp, Homo sapiens
tagaaagccctgtgttcactgc

SEQ ID NO: 9323817 - DNA, 22 bp, Homo sapiens
tagaaagcttggggtgtttaaa

SEQ ID NO: 9323818 - DNA, 22 bp, Homo sapiens
tagaaagctgagtaatacattt

SEQ ID NO: 9323819 - DNA, 22 bp, Homo sapiens
tagaaagctggaggaattcttt

SEQ ID NO: 9323820 - DNA, 22 bp, Homo sapiens
tagaaatgcagtgtactgtgtc

SEQ ID NO: 9323821 - DNA, 22 bp, Homo sapiens
tagaaatgattgagctgtaata

SEQ ID NO: 9323822 - DNA, 22 bp, Homo sapiens
tagaaatgagccatggtagagc

SEQ ID NO: 9323823 - DNA, 22 bp, Homo sapiens
tagaaatgaatgtttaaaagtc

SEQ ID NO: 9323824 - DNA, 21 bp, Homo sapiens
tagaggcaggagggactgcag

SEQ ID NO: 9323825 - DNA, 22 bp, Homo sapiens
tagaggcttctactgctcactt

SEQ ID NO: 9323826 - DNA, 22 bp, Homo sapiens
tagaggcattgcttaatttcag

SEQ ID NO: 9323827 - DNA, 22 bp, Homo sapiens
tagaggcataagagggaagcag

SEQ ID NO: 9323828 - DNA, 22 bp, Homo sapiens
tagaatgttcacctttaaatga

SEQ ID NO: 9323829 - DNA, 22 bp, Homo sapiens
tagaatgacctcctcttagctt

SEQ ID NO: 9323830 - DNA, 22 bp, Homo sapiens
tagaattttctgctttgatagt

SEQ ID NO: 9323831 - DNA, 22 bp, Homo sapiens
tagacaaaagggggcagatatg

SEQ ID NO: 9323832 - DNA, 22 bp, Homo sapiens
tagacaaactgatacttggcga

SEQ ID NO: 9323833 - DNA, 22 bp, Homo sapiens
tagaaacagaaaactgtaatag

SEQ ID NO: 9323834 - DNA, 22 bp, Homo sapiens
tagaaaagccccagctggaggg

SEQ ID NO: 9323835 - DNA, 22 bp, Homo sapiens
tagaaacctcagggaaatcttt

SEQ ID NO: 9323836 - DNA, 22 bp, Homo sapiens
tagaaacatgttctgttctgtt

SEQ ID NO: 9323837 - DNA, 22 bp, Homo sapiens
tacttttctgtgtggcagtcac

SEQ ID NO: 9323838 - DNA, 22 bp, Homo sapiens
tacttttcataatgaagcagca

SEQ ID NO: 9323839 - DNA, 22 bp, Homo sapiens
tagaaaagaagtctggccggga

SEQ ID NO: 9323840 - DNA, 22 bp, Homo sapiens
taccaaaagcttgtttcataca

SEQ ID NO: 9323841 - DNA, 19 bp, Homo sapiens
tacatttgtgtacacttgt

SEQ ID NO: 9323842 - DNA, 22 bp, Homo sapiens
tcccagggactgggctaggctt

SEQ ID NO: 9323843 - DNA, 22 bp, Homo sapiens
tcccacaggggctctgtgggtt

SEQ ID NO: 9323844 - DNA, 21 bp, Homo sapiens
tcccagggtcttatgggatgt

SEQ ID NO: 9323845 - DNA, 22 bp, Homo sapiens
tcccagggtgaaatgcagtagg

SEQ ID NO: 9323846 - DNA, 22 bp, Homo sapiens
tcccagggttacagccagggca

SEQ ID NO: 9323847 - DNA, 22 bp, Homo sapiens
tcccagtttttctccactaagg

SEQ ID NO: 9323848 - DNA, 20 bp, Homo sapiens
tcccatcacgcctgtgccag

SEQ ID NO: 9323849 - DNA, 20 bp, Homo sapiens
tcccatcacgcctgtgccag

SEQ ID NO: 9323850 - DNA, 18 bp, Homo sapiens
tcccatcatcctctccag

SEQ ID NO: 9323851 - DNA, 22 bp, Homo sapiens
tcccatcatctgttctggctac

SEQ ID NO: 9323852 - DNA, 22 bp, Homo sapiens
tccccaccccagaactactagg

SEQ ID NO: 9323853 - DNA, 22 bp, Homo sapiens
tccccacctaagatacccatct

SEQ ID NO: 9323854 - DNA, 22 bp, Homo sapiens
tccccacctacacactgctcct

SEQ ID NO: 9323855 - DNA, 22 bp, Homo sapiens
tccccaggaaggcccttcctgg

SEQ ID NO: 9323856 - DNA, 22 bp, Homo sapiens
tccccaggaatcaggtggttgc

SEQ ID NO: 9323857 - DNA, 22 bp, Homo sapiens
tccccaggactaagttgcaatc

SEQ ID NO: 9323858 - DNA, 22 bp, Homo sapiens
tccccactcaccactggccaaa

SEQ ID NO: 9323859 - DNA, 22 bp, Homo sapiens
tccccaggaaattctgattctt

SEQ ID NO: 9323860 - DNA, 20 bp, Homo sapiens
tccccagggcatcaggagca

SEQ ID NO: 9323861 - DNA, 22 bp, Homo sapiens
tccccagggctgcagagggtgt

SEQ ID NO: 9323862 - DNA, 22 bp, Homo sapiens
tccccaggagttttactttgca

SEQ ID NO: 9323863 - DNA, 22 bp, Homo sapiens
tccccaggagcaatgattcagt

SEQ ID NO: 9323864 - DNA, 22 bp, Homo sapiens
tccccaggggcctgggcacagt

SEQ ID NO: 9323865 - DNA, 22 bp, Homo sapiens
tccccaggggcatctctctgct

SEQ ID NO: 9323866 - DNA, 22 bp, Homo sapiens
tccccagggtccctgcttccat

SEQ ID NO: 9323867 - DNA, 22 bp, Homo sapiens
tccaggctctaggctgctctcc

SEQ ID NO: 9323868 - DNA, 22 bp, Homo sapiens
tccaggctcctgactttttggg

SEQ ID NO: 9323869 - DNA, 22 bp, Homo sapiens
tccaggctcagcacttgctact

SEQ ID NO: 9323870 - DNA, 22 bp, Homo sapiens
tccaggctaggtttacaggaca

SEQ ID NO: 9323871 - DNA, 22 bp, Homo sapiens
tccaggccactgcagaggctct

SEQ ID NO: 9323872 - DNA, 22 bp, Homo sapiens
tccaggccacgacctcctggat

SEQ ID NO: 9323873 - DNA, 22 bp, Homo sapiens
tccaggctctcaggtgtcagca

SEQ ID NO: 9323874 - DNA, 22 bp, Homo sapiens
tccaggctgacgcagctattta

SEQ ID NO: 9323875 - DNA, 19 bp, Homo sapiens
tccaggctgagagtcagct

SEQ ID NO: 9323876 - DNA, 21 bp, Homo sapiens
tccaggctgatgatgtcaact

SEQ ID NO: 9323877 - DNA, 19 bp, Homo sapiens
tccaggcatccttcaggct

SEQ ID NO: 9323878 - DNA, 22 bp, Homo sapiens
tccaggcatgtcccaagccgga

SEQ ID NO: 9323879 - DNA, 22 bp, Homo sapiens
tccaggccacatggatggcgat

SEQ ID NO: 9323880 - DNA, 22 bp, Homo sapiens
tccaggccacatggatggcgat

SEQ ID NO: 9323881 - DNA, 22 bp, Homo sapiens
tccaggccaatgtagcaggccc

SEQ ID NO: 9323882 - DNA, 22 bp, Homo sapiens
tccaggccaatgtagcaggccc

SEQ ID NO: 9323883 - DNA, 22 bp, Homo sapiens
tccaggcattccagccattcca

SEQ ID NO: 9323884 - DNA, 22 bp, Homo sapiens
tccaggccaatgtagcaggccc

SEQ ID NO: 9323885 - DNA, 22 bp, Homo sapiens
tccaggagggggagccgtgccg

SEQ ID NO: 9323886 - DNA, 22 bp, Homo sapiens
tccaggaggtagtgcttaattt

SEQ ID NO: 9323887 - DNA, 22 bp, Homo sapiens
tccaggaggtatgagtggcccc

SEQ ID NO: 9323888 - DNA, 22 bp, Homo sapiens
tccaggagtcagacagatggtg

SEQ ID NO: 9323889 - DNA, 22 bp, Homo sapiens
tccaggagtgctggttagagta

SEQ ID NO: 9323890 - DNA, 22 bp, Homo sapiens
tccaggagtggggcagaggtct

SEQ ID NO: 9323891 - DNA, 22 bp, Homo sapiens
tccaggagtggggcagaggtct

SEQ ID NO: 9323892 - DNA, 21 bp, Homo sapiens
tccaggagttctaataggtgt

SEQ ID NO: 9323893 - DNA, 22 bp, Homo sapiens
tccaggatggtgacggtggcca

SEQ ID NO: 9323894 - DNA, 22 bp, Homo sapiens
tccaggcagggcagccatcaag

SEQ ID NO: 9323895 - DNA, 20 bp, Homo sapiens
tccaggcagctcagagtgtc

SEQ ID NO: 9323896 - DNA, 22 bp, Homo sapiens
tccaggcataatgcccagtggt

SEQ ID NO: 9323897 - DNA, 22 bp, Homo sapiens
tcccaagccctggatgcctcag

SEQ ID NO: 9323898 - DNA, 22 bp, Homo sapiens
tcccaaggccaggcatctagaa

SEQ ID NO: 9323899 - DNA, 22 bp, Homo sapiens
tccatgagacagatactgtaag

SEQ ID NO: 9323900 - DNA, 22 bp, Homo sapiens
tccatgagggacactggatgct

SEQ ID NO: 9323901 - DNA, 20 bp, Homo sapiens
tccatgagttagagactata

SEQ ID NO: 9323902 - DNA, 22 bp, Homo sapiens
tccatgagggacactggatgct

SEQ ID NO: 9323903 - DNA, 22 bp, Homo sapiens
tccatctcacctgcactctgcg

SEQ ID NO: 9323904 - DNA, 22 bp, Homo sapiens
tccatccctgactcctcctgga

SEQ ID NO: 9323905 - DNA, 22 bp, Homo sapiens
tccatccattttctttgctgtt

SEQ ID NO: 9323906 - DNA, 22 bp, Homo sapiens
tccatccataccacttggagac

SEQ ID NO: 9323907 - DNA, 22 bp, Homo sapiens
tccaggctgcaaggccacaggg

SEQ ID NO: 9323908 - DNA, 22 bp, Homo sapiens
tccaggctgcagtcttgccctc

SEQ ID NO: 9323909 - DNA, 22 bp, Homo sapiens
tccaggctgccacagtgcaacg

SEQ ID NO: 9323910 - DNA, 22 bp, Homo sapiens
tccagggccaagtcatggaacc

SEQ ID NO: 9323911 - DNA, 22 bp, Homo sapiens
tccagggccaagtcatggaacc

SEQ ID NO: 9323912 - DNA, 19 bp, Homo sapiens
tccagggcaggaacatgta

SEQ ID NO: 9323913 - DNA, 22 bp, Homo sapiens
tccagggcagccgcgggtgcgc

SEQ ID NO: 9323914 - DNA, 22 bp, Homo sapiens
tccagggcagccgcgggtgcgc

SEQ ID NO: 9323915 - DNA, 22 bp, Homo sapiens
tccagggccccccagttgcacg

SEQ ID NO: 9323916 - DNA, 22 bp, Homo sapiens
tccagggccatgaagttgcaca

SEQ ID NO: 9323917 - DNA, 22 bp, Homo sapiens
tccagggccccccagttgcacg

SEQ ID NO: 9323918 - DNA, 22 bp, Homo sapiens
tccagggccatgaagttgcaca

SEQ ID NO: 9323919 - DNA, 22 bp, Homo sapiens
tccagggccatgaagttgcaca

SEQ ID NO: 9323920 - DNA, 22 bp, Homo sapiens
tccagggccccccagttgcacg

SEQ ID NO: 9323921 - DNA, 22 bp, Homo sapiens
tccagggccacagaggatgcta

SEQ ID NO: 9323922 - DNA, 22 bp, Homo sapiens
tccagggccacagaggatgcta

SEQ ID NO: 9323923 - DNA, 22 bp, Homo sapiens
tccagggccacagaggatgcta

SEQ ID NO: 9323924 - DNA, 22 bp, Homo sapiens
tccagggccatctccatgaggc

SEQ ID NO: 9323925 - DNA, 22 bp, Homo sapiens
tccagggcgtgtgtgaaggaaa

SEQ ID NO: 9323926 - DNA, 22 bp, Homo sapiens
tccagggctacaaggcaccaga

SEQ ID NO: 9323927 - DNA, 22 bp, Homo sapiens
tccagggctacaaggcaccaga

SEQ ID NO: 9323928 - DNA, 20 bp, Homo sapiens
tccagggctagggagctcat

SEQ ID NO: 9323929 - DNA, 22 bp, Homo sapiens
tccagggcgtgtgtgaaggaaa

SEQ ID NO: 9323930 - DNA, 22 bp, Homo sapiens
tccagggccttacctcttcaga

SEQ ID NO: 9323931 - DNA, 21 bp, Homo sapiens
tccagggcgggcgcacggaga

SEQ ID NO: 9323932 - DNA, 22 bp, Homo sapiens
tccagggccttacctcttcaga

SEQ ID NO: 9323933 - DNA, 22 bp, Homo sapiens
tccagggcctgaggttgaagtg

SEQ ID NO: 9323934 - DNA, 20 bp, Homo sapiens
tccagggccctggctcctct

SEQ ID NO: 9323935 - DNA, 22 bp, Homo sapiens
tccagggctccccaacatccag

SEQ ID NO: 9323936 - DNA, 22 bp, Homo sapiens
tccagggctccccaacatccag

SEQ ID NO: 9323937 - DNA, 20 bp, Homo sapiens
tccagggctagggagctcat

SEQ ID NO: 9323938 - DNA, 22 bp, Homo sapiens
tccatcagcatgcaggctgttc

SEQ ID NO: 9323939 - DNA, 22 bp, Homo sapiens
tccatcagattccctcctgaga

SEQ ID NO: 9323940 - DNA, 22 bp, Homo sapiens
tccatcactattatctacaaca

SEQ ID NO: 9323941 - DNA, 22 bp, Homo sapiens
tccagagggcgatggctggggg

SEQ ID NO: 9323942 - DNA, 22 bp, Homo sapiens
tccagagggcgatggctggggg

SEQ ID NO: 9323943 - DNA, 22 bp, Homo sapiens
tccagaggggcagccctgtgct

SEQ ID NO: 9323944 - DNA, 22 bp, Homo sapiens
tccagaggtatgtagagagtat

SEQ ID NO: 9323945 - DNA, 22 bp, Homo sapiens
tccagaggcagctgcggtcagg

SEQ ID NO: 9323946 - DNA, 22 bp, Homo sapiens
tccagaggctccaaagggagat

SEQ ID NO: 9323947 - DNA, 22 bp, Homo sapiens
tccagaggctccaaagggagat

SEQ ID NO: 9323948 - DNA, 22 bp, Homo sapiens
tccagaggctctgagggagagt

SEQ ID NO: 9323949 - DNA, 22 bp, Homo sapiens
tccagaggctctgagggagagt

SEQ ID NO: 9323950 - DNA, 21 bp, Homo sapiens
tccagaggaggacagactcag

SEQ ID NO: 9323951 - DNA, 22 bp, Homo sapiens
tccagaggcaaaaaggtatgga

SEQ ID NO: 9323952 - DNA, 22 bp, Homo sapiens
tccagaggcaaaaaggtatgga

SEQ ID NO: 9323953 - DNA, 22 bp, Homo sapiens
tccagagctgtcctactgtgag

SEQ ID NO: 9323954 - DNA, 22 bp, Homo sapiens
tccagagctgagggtcagtaga

SEQ ID NO: 9323955 - DNA, 22 bp, Homo sapiens
tccagagctgggtctgtgctca

SEQ ID NO: 9323956 - DNA, 22 bp, Homo sapiens
tccagcaggtccgagacaagtt

SEQ ID NO: 9323957 - DNA, 22 bp, Homo sapiens
tccagcaggtgtttgccaactt

SEQ ID NO: 9323958 - DNA, 22 bp, Homo sapiens
tccagcagcccgaaggcccatc

SEQ ID NO: 9323959 - DNA, 22 bp, Homo sapiens
tccagcagccacacctctggac

SEQ ID NO: 9323960 - DNA, 18 bp, Homo sapiens
tccagcagcatagtttcc

SEQ ID NO: 9323961 - DNA, 23 bp, Homo sapiens
tccagcagccaagaagggtagaa

SEQ ID NO: 9323962 - DNA, 22 bp, Homo sapiens
tccagcagagtctctgaggggg

SEQ ID NO: 9323963 - DNA, 22 bp, Homo sapiens
tccagcagaccatcaaggctca

SEQ ID NO: 9323964 - DNA, 23 bp, Homo sapiens
tccagcagagccttccaggaggg

SEQ ID NO: 9323965 - DNA, 20 bp, Homo sapiens
tccagagagtggcaaagctc

SEQ ID NO: 9323966 - DNA, 22 bp, Homo sapiens
tccagagaggtttctccatgct

SEQ ID NO: 9323967 - DNA, 17 bp, Homo sapiens
tccagagcacagagctc

SEQ ID NO: 9323968 - DNA, 22 bp, Homo sapiens
tccagagatctctcttccctgt

SEQ ID NO: 9323969 - DNA, 22 bp, Homo sapiens
tccagagataactatttaggag

SEQ ID NO: 9323970 - DNA, 22 bp, Homo sapiens
tccagagccccagtctagtggg

SEQ ID NO: 9323971 - DNA, 22 bp, Homo sapiens
tccagagcaggtggtcagaagg

SEQ ID NO: 9323972 - DNA, 22 bp, Homo sapiens
tccagagctaattcagcagctg

SEQ ID NO: 9323973 - DNA, 18 bp, Homo sapiens
tccagagctactgtggtg

SEQ ID NO: 9323974 - DNA, 18 bp, Homo sapiens
tccagagctactgtggtg

SEQ ID NO: 9323975 - DNA, 22 bp, Homo sapiens
tccagagcctgcgcactggctg

SEQ ID NO: 9323976 - DNA, 22 bp, Homo sapiens
tccagagcctgcgcactggctg

SEQ ID NO: 9323977 - DNA, 22 bp, Homo sapiens
tccagagcctgcgcactggctg

SEQ ID NO: 9323978 - DNA, 22 bp, Homo sapiens
tccagagcctttccacccactt

SEQ ID NO: 9323979 - DNA, 22 bp, Homo sapiens
tccagcttccagtggctggctg

SEQ ID NO: 9323980 - DNA, 22 bp, Homo sapiens
tccagctggggcagtggctggg

SEQ ID NO: 9323981 - DNA, 22 bp, Homo sapiens
tccagctctgcttcacagtctc

SEQ ID NO: 9323982 - DNA, 22 bp, Homo sapiens
tccagctctgcttcacagtctc

SEQ ID NO: 9323983 - DNA, 18 bp, Homo sapiens
tccagctctgccacttac

SEQ ID NO: 9323984 - DNA, 21 bp, Homo sapiens
tccagctctcatagtgttcca

SEQ ID NO: 9323985 - DNA, 22 bp, Homo sapiens
tccagctctaaggctgatagcc

SEQ ID NO: 9323986 - DNA, 22 bp, Homo sapiens
tccagctctgattctcactagc

SEQ ID NO: 9323987 - DNA, 18 bp, Homo sapiens
tccagctctgccacttac

SEQ ID NO: 9323988 - DNA, 22 bp, Homo sapiens
tccagctctgattctcactagc

SEQ ID NO: 9323989 - DNA, 22 bp, Homo sapiens
tccagctctaacatgctgggcc

SEQ ID NO: 9323990 - DNA, 21 bp, Homo sapiens
tccagctcctgccactcctta

SEQ ID NO: 9323991 - DNA, 21 bp, Homo sapiens
tccagctcctgccactcctta

SEQ ID NO: 9323992 - DNA, 22 bp, Homo sapiens
tccagctcctgagttcactgct

SEQ ID NO: 9323993 - DNA, 22 bp, Homo sapiens
tccagctcctgagttcactgct

SEQ ID NO: 9323994 - DNA, 18 bp, Homo sapiens
tccagctcacagatgggc

SEQ ID NO: 9323995 - DNA, 22 bp, Homo sapiens
tccagctcagatgcagggatca

SEQ ID NO: 9323996 - DNA, 22 bp, Homo sapiens
tccagcctttctactcactgag

SEQ ID NO: 9323997 - DNA, 22 bp, Homo sapiens
tccagctcaaattcagcttcca

SEQ ID NO: 9323998 - DNA, 22 bp, Homo sapiens
tccagctcaaattcagcttcca

SEQ ID NO: 9323999 - DNA, 22 bp, Homo sapiens
tccagctcaaagtgctcctgtc

SEQ ID NO: 9324000 - DNA, 22 bp, Homo sapiens
tccagctcctctacccgatgcg

SEQ ID NO: 9324001 - DNA, 20 bp, Homo sapiens
tccagctccgtgttcttcct

SEQ ID NO: 9324002 - DNA, 23 bp, Homo sapiens
tccagctcccttcaatggcactg

SEQ ID NO: 9324003 - DNA, 22 bp, Homo sapiens
tccagctcatctgtctccatta

SEQ ID NO: 9324004 - DNA, 22 bp, Homo sapiens
tccagctcatctgtctccatta

SEQ ID NO: 9324005 - DNA, 22 bp, Homo sapiens
tccagctccacagcctccctgt

SEQ ID NO: 9324006 - DNA, 22 bp, Homo sapiens
tccagctccacagcctccctgt

SEQ ID NO: 9324007 - DNA, 22 bp, Homo sapiens
tccagctcccactctcactgct

SEQ ID NO: 9324008 - DNA, 22 bp, Homo sapiens
tccagctcccactctcactgct

SEQ ID NO: 9324009 - DNA, 21 bp, Homo sapiens
tccagcctttccctcacttcc

SEQ ID NO: 9324010 - DNA, 22 bp, Homo sapiens
tccagcaggttggtcaggtgca

SEQ ID NO: 9324011 - DNA, 22 bp, Homo sapiens
tccagcagtccatgtgagacac

SEQ ID NO: 9324012 - DNA, 22 bp, Homo sapiens
tccagcagtgctctagagcgtg

SEQ ID NO: 9324013 - DNA, 22 bp, Homo sapiens
tccagcagtgctcaggactcac

SEQ ID NO: 9324014 - DNA, 22 bp, Homo sapiens
tcaggccagcaccatccctatc

SEQ ID NO: 9324015 - DNA, 22 bp, Homo sapiens
tcaggccagcaccatccctatc

SEQ ID NO: 9324016 - DNA, 22 bp, Homo sapiens
tcaggcctgcaaatgaatggta

SEQ ID NO: 9324017 - DNA, 22 bp, Homo sapiens
tcaggccacggctcactgagac

SEQ ID NO: 9324018 - DNA, 22 bp, Homo sapiens
tcaggccacttcacaggtgatt

SEQ ID NO: 9324019 - DNA, 22 bp, Homo sapiens
tcaggccacttcacaggtgatt

SEQ ID NO: 9324020 - DNA, 22 bp, Homo sapiens
tcaggcctgcaaggagagtccc

SEQ ID NO: 9324021 - DNA, 22 bp, Homo sapiens
tcaggcctgcaggcttcctgga

SEQ ID NO: 9324022 - DNA, 20 bp, Homo sapiens
tcaggcagtggggaaaggca

SEQ ID NO: 9324023 - DNA, 22 bp, Homo sapiens
tcaggcagtggtaaatgagtta

SEQ ID NO: 9324024 - DNA, 22 bp, Homo sapiens
tcaggcagtggtaaatgagtta

SEQ ID NO: 9324025 - DNA, 19 bp, Homo sapiens
tcaggcagttattcacaaa

SEQ ID NO: 9324026 - DNA, 22 bp, Homo sapiens
tcaggccacggctcactgagac

SEQ ID NO: 9324027 - DNA, 22 bp, Homo sapiens
tcaggcagtctgactccggagg

SEQ ID NO: 9324028 - DNA, 21 bp, Homo sapiens
tcaggcagtgcaaatacatgg

SEQ ID NO: 9324029 - DNA, 18 bp, Homo sapiens
tcaggagtttgtggatgg

SEQ ID NO: 9324030 - DNA, 22 bp, Homo sapiens
tcaggagtgataccatttgtca

SEQ ID NO: 9324031 - DNA, 19 bp, Homo sapiens
tcaggagttagttgtgctc

SEQ ID NO: 9324032 - DNA, 22 bp, Homo sapiens
tcaggagttgaaggggatcctg

SEQ ID NO: 9324033 - DNA, 22 bp, Homo sapiens
tcagggaaacctaaggaagcca

SEQ ID NO: 9324034 - DNA, 22 bp, Homo sapiens
tcagggaaaggggagagtcatt

SEQ ID NO: 9324035 - DNA, 22 bp, Homo sapiens
tcaggccttcagacctggcccg

SEQ ID NO: 9324036 - DNA, 22 bp, Homo sapiens
tcaggcctgtgctggaggagat

SEQ ID NO: 9324037 - DNA, 22 bp, Homo sapiens
tcaggcctgctgtatgatggat

SEQ ID NO: 9324038 - DNA, 22 bp, Homo sapiens
tcagcctttgaagggctgcagg

SEQ ID NO: 9324039 - DNA, 22 bp, Homo sapiens
tcagctatgttaatagccttct

SEQ ID NO: 9324040 - DNA, 22 bp, Homo sapiens
tcagctccacagctcctctgcc

SEQ ID NO: 9324041 - DNA, 20 bp, Homo sapiens
tcagccttctcatcctgggg

SEQ ID NO: 9324042 - DNA, 18 bp, Homo sapiens
tcagcctgttgtctgcct

SEQ ID NO: 9324043 - DNA, 22 bp, Homo sapiens
tcagcctggtgattcctctgtc

SEQ ID NO: 9324044 - DNA, 22 bp, Homo sapiens
tcagccttgcttctggactggt

SEQ ID NO: 9324045 - DNA, 22 bp, Homo sapiens
tcagccttctgaggacctggga

SEQ ID NO: 9324046 - DNA, 22 bp, Homo sapiens
tcagcctggcaggatggcctgg

SEQ ID NO: 9324047 - DNA, 22 bp, Homo sapiens
tcagctcctcagagcctcagtt

SEQ ID NO: 9324048 - DNA, 22 bp, Homo sapiens
tcagctcctcagagcctcagtt

SEQ ID NO: 9324049 - DNA, 22 bp, Homo sapiens
tcagctcctatactttgtcctg

SEQ ID NO: 9324050 - DNA, 22 bp, Homo sapiens
tcagcctgctccaagtgctgcc

SEQ ID NO: 9324051 - DNA, 22 bp, Homo sapiens
tcagcctgcgtcatggtgacac

SEQ ID NO: 9324052 - DNA, 22 bp, Homo sapiens
tcagcaggcagaaatctgcaga

SEQ ID NO: 9324053 - DNA, 22 bp, Homo sapiens
tcagcaggcaccggaagtgttt

SEQ ID NO: 9324054 - DNA, 21 bp, Homo sapiens
tcagcaggcaccagaaggctg

SEQ ID NO: 9324055 - DNA, 22 bp, Homo sapiens
tcagcaggcacggacaggctgc

SEQ ID NO: 9324056 - DNA, 22 bp, Homo sapiens
tcagcacttggatttcagagat

SEQ ID NO: 9324057 - DNA, 22 bp, Homo sapiens
tcagcactttgaagcagaagga

SEQ ID NO: 9324058 - DNA, 22 bp, Homo sapiens
tcagcacttttactctctttgc

SEQ ID NO: 9324059 - DNA, 22 bp, Homo sapiens
tcagcactttttaaagcagcat

SEQ ID NO: 9324060 - DNA, 22 bp, Homo sapiens
tcagcaggcacaccaaaaactg

SEQ ID NO: 9324061 - DNA, 22 bp, Homo sapiens
tcagggacccctctgagtggag

SEQ ID NO: 9324062 - DNA, 22 bp, Homo sapiens
tcagggaccaccactcacccag

SEQ ID NO: 9324063 - DNA, 22 bp, Homo sapiens
tcagggacgtgagctcagagtc

SEQ ID NO: 9324064 - DNA, 22 bp, Homo sapiens
tcagggacaggatgggcatttc

SEQ ID NO: 9324065 - DNA, 22 bp, Homo sapiens
tcagggacagttcttagggtgg

SEQ ID NO: 9324066 - DNA, 22 bp, Homo sapiens
tcagggacaataagggaattga

SEQ ID NO: 9324067 - DNA, 21 bp, Homo sapiens
tcagtgacaggtgctgacctc

SEQ ID NO: 9324068 - DNA, 22 bp, Homo sapiens
tcagtgactccttcttcctgct

SEQ ID NO: 9324069 - DNA, 22 bp, Homo sapiens
tcagtgcagaatagtgatgcat

SEQ ID NO: 9324070 - DNA, 22 bp, Homo sapiens
tcagtgcagcggcagcagctct

SEQ ID NO: 9324071 - DNA, 22 bp, Homo sapiens
tcagtgcaaaaaatgggctaga

SEQ ID NO: 9324072 - DNA, 22 bp, Homo sapiens
tcagtgtaagttatgtagatgt

SEQ ID NO: 9324073 - DNA, 18 bp, Homo sapiens
tcagtgtagatctgtgta

SEQ ID NO: 9324074 - DNA, 22 bp, Homo sapiens
tcattactataacctaatcctt

SEQ ID NO: 9324075 - DNA, 22 bp, Homo sapiens
tcattacagtgtttatatgtct

SEQ ID NO: 9324076 - DNA, 22 bp, Homo sapiens
tcattattctctttaatgttct

SEQ ID NO: 9324077 - DNA, 22 bp, Homo sapiens
tcattcagagagaatgttccag

SEQ ID NO: 9324078 - DNA, 22 bp, Homo sapiens
tcattcaatgtaagcatatata

SEQ ID NO: 9324079 - DNA, 22 bp, Homo sapiens
tcattatttgctttagttatgt

SEQ ID NO: 9324080 - DNA, 18 bp, Homo sapiens
tcattattgtttctggag

SEQ ID NO: 9324081 - DNA, 22 bp, Homo sapiens
tcatatatttagttgtgcaaca

SEQ ID NO: 9324082 - DNA, 22 bp, Homo sapiens
tcatatgtcactcatgggcata

SEQ ID NO: 9324083 - DNA, 22 bp, Homo sapiens
tcatagttctgttttgaaggat

SEQ ID NO: 9324084 - DNA, 22 bp, Homo sapiens
tcatagttatggagattaagga

SEQ ID NO: 9324085 - DNA, 22 bp, Homo sapiens
tcatagttttacttagtggtgt

SEQ ID NO: 9324086 - DNA, 22 bp, Homo sapiens
tcatatttatatgttggcacag

SEQ ID NO: 9324087 - DNA, 22 bp, Homo sapiens
tcatatttcaaaatggctggag

SEQ ID NO: 9324088 - DNA, 22 bp, Homo sapiens
tcatatttagttcacgctcaat

SEQ ID NO: 9324089 - DNA, 22 bp, Homo sapiens
tcatatttaggcctttaattca

SEQ ID NO: 9324090 - DNA, 20 bp, Homo sapiens
tcatattgatgtagagcagc

SEQ ID NO: 9324091 - DNA, 22 bp, Homo sapiens
tcatatttaggcctttaattca

SEQ ID NO: 9324092 - DNA, 21 bp, Homo sapiens
tcatatttctcttgctattgt

SEQ ID NO: 9324093 - DNA, 22 bp, Homo sapiens
tatttcttcgggattcaagcta

SEQ ID NO: 9324094 - DNA, 22 bp, Homo sapiens
tcaaggaaaagataacttgatg

SEQ ID NO: 9324095 - DNA, 22 bp, Homo sapiens
tcaaggaagatagctattatga

SEQ ID NO: 9324096 - DNA, 20 bp, Homo sapiens
tcaaggaatgtcattttgtt

SEQ ID NO: 9324097 - DNA, 22 bp, Homo sapiens
tcaaggaatgactatatgagga

SEQ ID NO: 9324098 - DNA, 22 bp, Homo sapiens
tcaaggaagtcttattgcacag

SEQ ID NO: 9324099 - DNA, 22 bp, Homo sapiens
tcaaggaatttagtttagtaaa

SEQ ID NO: 9324100 - DNA, 22 bp, Homo sapiens
tcaaggaagggatattcttgaa

SEQ ID NO: 9324101 - DNA, 22 bp, Homo sapiens
tcaaggaaggtctgttgctcca

SEQ ID NO: 9324102 - DNA, 22 bp, Homo sapiens
tcaagagaagtgctccacagta

SEQ ID NO: 9324103 - DNA, 22 bp, Homo sapiens
tcaagtagaactataatgatgt

SEQ ID NO: 9324104 - DNA, 22 bp, Homo sapiens
tcaagtagtacccaatgcgtgg

SEQ ID NO: 9324105 - DNA, 22 bp, Homo sapiens
tcacacatgagtaaatacaggg

SEQ ID NO: 9324106 - DNA, 22 bp, Homo sapiens
tcacagaaagctgtgtcctgac

SEQ ID NO: 9324107 - DNA, 22 bp, Homo sapiens
tcacaaagtgaagtgtgtcatg

SEQ ID NO: 9324108 - DNA, 22 bp, Homo sapiens
tcacaaagggagggatagctgg

SEQ ID NO: 9324109 - DNA, 22 bp, Homo sapiens
tcacaaagagaattgtgggtgt

SEQ ID NO: 9324110 - DNA, 19 bp, Homo sapiens
tcacaggcatctccccaga

SEQ ID NO: 9324111 - DNA, 22 bp, Homo sapiens
tcacaggcaaagaagattggtg

SEQ ID NO: 9324112 - DNA, 22 bp, Homo sapiens
tcacagctccagactgcaactc

SEQ ID NO: 9324113 - DNA, 22 bp, Homo sapiens
tcacagggtatctgggatggat

SEQ ID NO: 9324114 - DNA, 20 bp, Homo sapiens
tcacaggggaccaggagcag

SEQ ID NO: 9324115 - DNA, 21 bp, Homo sapiens
tcacaggctcagggagagagt

SEQ ID NO: 9324116 - DNA, 22 bp, Homo sapiens
tcacaggctccagggcctggat

SEQ ID NO: 9324117 - DNA, 22 bp, Homo sapiens
tcacaggctccagggcctggat

SEQ ID NO: 9324118 - DNA, 22 bp, Homo sapiens
tcacaggcccaaaccacgctta

SEQ ID NO: 9324119 - DNA, 19 bp, Homo sapiens
tcacaggcatctccccaga

SEQ ID NO: 9324120 - DNA, 22 bp, Homo sapiens
tcacaggcctggggcagagggc

SEQ ID NO: 9324121 - DNA, 22 bp, Homo sapiens
tcacaggcccaaaccacgctta

SEQ ID NO: 9324122 - DNA, 22 bp, Homo sapiens
tcacaggctaaatttatgcagg

SEQ ID NO: 9324123 - DNA, 22 bp, Homo sapiens
tcacaggcctggggcagagggc

SEQ ID NO: 9324124 - DNA, 22 bp, Homo sapiens
tcacaggctggtctccgaggac

SEQ ID NO: 9324125 - DNA, 22 bp, Homo sapiens
tcacaggctctccaccatgagg

SEQ ID NO: 9324126 - DNA, 22 bp, Homo sapiens
tcacaggctggtctccgaggac

SEQ ID NO: 9324127 - DNA, 22 bp, Homo sapiens
tcacaggctctagggattaaga

SEQ ID NO: 9324128 - DNA, 23 bp, Homo sapiens
tcacagggcactggctggggttg

SEQ ID NO: 9324129 - DNA, 22 bp, Homo sapiens
tcacaggcttgtgaacattgca

SEQ ID NO: 9324130 - DNA, 22 bp, Homo sapiens
tcacaggcttgtgaacattgca

SEQ ID NO: 9324131 - DNA, 22 bp, Homo sapiens
tcacaggctggtctccgaggac

SEQ ID NO: 9324132 - DNA, 22 bp, Homo sapiens
tcactttggaagatagcacatc

SEQ ID NO: 9324133 - DNA, 22 bp, Homo sapiens
tcactagtcatcaacttccatt

SEQ ID NO: 9324134 - DNA, 23 bp, Homo sapiens
tcactagtcaagtgcctttgagt

SEQ ID NO: 9324135 - DNA, 22 bp, Homo sapiens
tcactagtcgcggggggaggta

SEQ ID NO: 9324136 - DNA, 21 bp, Homo sapiens
tcactagtgccttctgtcatt

SEQ ID NO: 9324137 - DNA, 22 bp, Homo sapiens
tcacattttccttggtatctgt

SEQ ID NO: 9324138 - DNA, 22 bp, Homo sapiens
tcacattttcatattctctgag

SEQ ID NO: 9324139 - DNA, 22 bp, Homo sapiens
tcacattttctactactgtacg

SEQ ID NO: 9324140 - DNA, 22 bp, Homo sapiens
tcacattttcttaggaaactta

SEQ ID NO: 9324141 - DNA, 22 bp, Homo sapiens
tcacattttatctgagattgac

SEQ ID NO: 9324142 - DNA, 22 bp, Homo sapiens
tcacattttcaaaagctggtgc

SEQ ID NO: 9324143 - DNA, 22 bp, Homo sapiens
tcacattttatctgagattgac

SEQ ID NO: 9324144 - DNA, 22 bp, Homo sapiens
tcacattttttactggacttaa

SEQ ID NO: 9324145 - DNA, 22 bp, Homo sapiens
tcacattttttactggacttaa

SEQ ID NO: 9324146 - DNA, 22 bp, Homo sapiens
tcagaggaaacaatctttagta

SEQ ID NO: 9324147 - DNA, 23 bp, Homo sapiens
tcagagaggccccctgcagagat

SEQ ID NO: 9324148 - DNA, 23 bp, Homo sapiens
tcagagaggccccctgcagagat

SEQ ID NO: 9324149 - DNA, 22 bp, Homo sapiens
tcagagcaccacacagttccct

SEQ ID NO: 9324150 - DNA, 22 bp, Homo sapiens
tcagagccaatcatggtgcatt

SEQ ID NO: 9324151 - DNA, 22 bp, Homo sapiens
tcagagcattagaggtttgtat

SEQ ID NO: 9324152 - DNA, 20 bp, Homo sapiens
tcagagcagttggcttgtct

SEQ ID NO: 9324153 - DNA, 22 bp, Homo sapiens
tcagagcatgtgggctgcagtt

SEQ ID NO: 9324154 - DNA, 22 bp, Homo sapiens
tcagcactcgctacctagtaaa

SEQ ID NO: 9324155 - DNA, 22 bp, Homo sapiens
tcagcactgaaattcttcacat

SEQ ID NO: 9324156 - DNA, 22 bp, Homo sapiens
tcagcactatacattttgaata

SEQ ID NO: 9324157 - DNA, 22 bp, Homo sapiens
tcagcaccagttatcctcaggg

SEQ ID NO: 9324158 - DNA, 20 bp, Homo sapiens
tcagcacagctgacaaggtt

SEQ ID NO: 9324159 - DNA, 22 bp, Homo sapiens
tcagcacttactagtggccttt

SEQ ID NO: 9324160 - DNA, 22 bp, Homo sapiens
tcagcactgtgtccagtctccc

SEQ ID NO: 9324161 - DNA, 22 bp, Homo sapiens
tcagcactgtgtccagtctccc

SEQ ID NO: 9324162 - DNA, 22 bp, Homo sapiens
tcagcactgtcttttatttgaa

SEQ ID NO: 9324163 - DNA, 22 bp, Homo sapiens
tcagcactgtctattagtgaga

SEQ ID NO: 9324164 - DNA, 22 bp, Homo sapiens
tcagcactggcgctgggcaggt

SEQ ID NO: 9324165 - DNA, 22 bp, Homo sapiens
tcagcactgatgtttcagaaga

SEQ ID NO: 9324166 - DNA, 22 bp, Homo sapiens
tcagcactgaatctggatttgc

SEQ ID NO: 9324167 - DNA, 22 bp, Homo sapiens
tcagcactgatagaagtcaata

SEQ ID NO: 9324168 - DNA, 22 bp, Homo sapiens
tcagagaagcttaagctgtaat

SEQ ID NO: 9324169 - DNA, 22 bp, Homo sapiens
ttctttagcaacttggatttag

SEQ ID NO: 9324170 - DNA, 22 bp, Homo sapiens
ttctgtttcctgccttcccatt

SEQ ID NO: 9324171 - DNA, 22 bp, Homo sapiens
ttctgtttattcctaggagctc

SEQ ID NO: 9324172 - DNA, 22 bp, Homo sapiens
ttctgttagaattttgaaaata

SEQ ID NO: 9324173 - DNA, 22 bp, Homo sapiens
ttctgttatcattaagcattat

SEQ ID NO: 9324174 - DNA, 22 bp, Homo sapiens
ttctgttactgttggtcataac

SEQ ID NO: 9324175 - DNA, 22 bp, Homo sapiens
ttctgttacaagtgaaaaaatg

SEQ ID NO: 9324176 - DNA, 22 bp, Homo sapiens
ttctgttacttgcaaccacagg

SEQ ID NO: 9324177 - DNA, 22 bp, Homo sapiens
ttctgttagaattgagctttat

SEQ ID NO: 9324178 - DNA, 22 bp, Homo sapiens
ttctgttagcattctgatctcc

SEQ ID NO: 9324179 - DNA, 22 bp, Homo sapiens
ttctggtttaagaaagtgctgg

SEQ ID NO: 9324180 - DNA, 22 bp, Homo sapiens
ttctgttacatggggcacagtg

SEQ ID NO: 9324181 - DNA, 22 bp, Homo sapiens
ttctgttactctggtctgctgt

SEQ ID NO: 9324182 - DNA, 22 bp, Homo sapiens
ttctgttacctttgtgagtttc

SEQ ID NO: 9324183 - DNA, 21 bp, Homo sapiens
ttctgttttttgtaccagggc

SEQ ID NO: 9324184 - DNA, 22 bp, Homo sapiens
ttcttaaaacttatggacaggt

SEQ ID NO: 9324185 - DNA, 22 bp, Homo sapiens
ttctgggcccactgtagcatcc

SEQ ID NO: 9324186 - DNA, 17 bp, Homo sapiens
ttctgaccctagagctc

SEQ ID NO: 9324187 - DNA, 22 bp, Homo sapiens
ttctcttttcaccagttgctaa

SEQ ID NO: 9324188 - DNA, 20 bp, Homo sapiens
ttctgcttttgcttagggac

SEQ ID NO: 9324189 - DNA, 22 bp, Homo sapiens
ttctgcttctgtgtgtcccagg

SEQ ID NO: 9324190 - DNA, 20 bp, Homo sapiens
ttctgcttgcaaatatcaag

SEQ ID NO: 9324191 - DNA, 22 bp, Homo sapiens
ttctgcttggttcttggtatga

SEQ ID NO: 9324192 - DNA, 22 bp, Homo sapiens
ttctgcttattcaaatgatctt

SEQ ID NO: 9324193 - DNA, 22 bp, Homo sapiens
ttctgcttagagggcatttgca

SEQ ID NO: 9324194 - DNA, 22 bp, Homo sapiens
ttctgcttattctgtagccttt

SEQ ID NO: 9324195 - DNA, 22 bp, Homo sapiens
ttctgcttcactggcctggagg

SEQ ID NO: 9324196 - DNA, 22 bp, Homo sapiens
ttctgctttcagttcttctggg

SEQ ID NO: 9324197 - DNA, 22 bp, Homo sapiens
ttctgctttggttccatggatg

SEQ ID NO: 9324198 - DNA, 22 bp, Homo sapiens
ttctgcttttattgccagagtt

SEQ ID NO: 9324199 - DNA, 22 bp, Homo sapiens
ttctgcttttctctgtctgagt

SEQ ID NO: 9324200 - DNA, 22 bp, Homo sapiens
ttctgcttttagctaaactata

SEQ ID NO: 9324201 - DNA, 22 bp, Homo sapiens
ttctgccttcagtcctctgact

SEQ ID NO: 9324202 - DNA, 21 bp, Homo sapiens
ttctgccttcccctagctggg

SEQ ID NO: 9324203 - DNA, 22 bp, Homo sapiens
ttctgctatgaaaaaagtgctg

SEQ ID NO: 9324204 - DNA, 22 bp, Homo sapiens
ttctgcctggcaggaggactgt

SEQ ID NO: 9324205 - DNA, 22 bp, Homo sapiens
ttctgcctgccccagagaggcc

SEQ ID NO: 9324206 - DNA, 22 bp, Homo sapiens
ttctgcctgatgtagtcatacc

SEQ ID NO: 9324207 - DNA, 21 bp, Homo sapiens
ttctgctgttcaccaccaccc

SEQ ID NO: 9324208 - DNA, 22 bp, Homo sapiens
ttctgctgctgctgcacccaat

SEQ ID NO: 9324209 - DNA, 22 bp, Homo sapiens
ttctgctccaccacttccagca

SEQ ID NO: 9324210 - DNA, 22 bp, Homo sapiens
ttctgctctgacttgcaaggaa

SEQ ID NO: 9324211 - DNA, 21 bp, Homo sapiens
ttctgctccagctcctctggg

SEQ ID NO: 9324212 - DNA, 21 bp, Homo sapiens
ttctgctccagctcctctggg

SEQ ID NO: 9324213 - DNA, 22 bp, Homo sapiens
ttctgctctgacttgcaaggaa

SEQ ID NO: 9324214 - DNA, 22 bp, Homo sapiens
ttctgctgaagccagggagcaa

SEQ ID NO: 9324215 - DNA, 22 bp, Homo sapiens
ttgatgttgctcttaacagtat

SEQ ID NO: 9324216 - DNA, 22 bp, Homo sapiens
ttgatgttcctgtacaatctga

SEQ ID NO: 9324217 - DNA, 22 bp, Homo sapiens
ttgatgttcataaatgatacag

SEQ ID NO: 9324218 - DNA, 22 bp, Homo sapiens
ttgattctagaatcttccctct

SEQ ID NO: 9324219 - DNA, 22 bp, Homo sapiens
ttgattcagagaagattggccc

SEQ ID NO: 9324220 - DNA, 20 bp, Homo sapiens
ttgattcaagggctgatgga

SEQ ID NO: 9324221 - DNA, 22 bp, Homo sapiens
ttgattcagaaaaagatggaga

SEQ ID NO: 9324222 - DNA, 22 bp, Homo sapiens
ttgatcatcttgtgctgacggc

SEQ ID NO: 9324223 - DNA, 23 bp, Homo sapiens
ttgagtcttataggattgaggtg

SEQ ID NO: 9324224 - DNA, 22 bp, Homo sapiens
ttgatctttataatagttttga

SEQ ID NO: 9324225 - DNA, 22 bp, Homo sapiens
ttgatgaacacagataatcagt

SEQ ID NO: 9324226 - DNA, 22 bp, Homo sapiens
ttgatgaaggtagatttgaaat

SEQ ID NO: 9324227 - DNA, 22 bp, Homo sapiens
ttgatcttcatcgaaatattgt

SEQ ID NO: 9324228 - DNA, 22 bp, Homo sapiens
ttgcaaatgtgaataattacac

SEQ ID NO: 9324229 - DNA, 22 bp, Homo sapiens
ttgcaaatggaggcctggcagc

SEQ ID NO: 9324230 - DNA, 20 bp, Homo sapiens
ttgcaaatatctattgattg

SEQ ID NO: 9324231 - DNA, 22 bp, Homo sapiens
ttgcaaataatagcctgaaact

SEQ ID NO: 9324232 - DNA, 21 bp, Homo sapiens
ttgatttagcagatctagctg

SEQ ID NO: 9324233 - DNA, 21 bp, Homo sapiens
ttgatttagcagatctagctg

SEQ ID NO: 9324234 - DNA, 22 bp, Homo sapiens
ttgatttatagaatgttcaagc

SEQ ID NO: 9324235 - DNA, 22 bp, Homo sapiens
ttgagcccaggaggcctgggtg

SEQ ID NO: 9324236 - DNA, 22 bp, Homo sapiens
ttgagcccaggaggcctgggtg

SEQ ID NO: 9324237 - DNA, 23 bp, Homo sapiens
ttgagctcagtagctctgctggt

SEQ ID NO: 9324238 - DNA, 22 bp, Homo sapiens
ttgagcaggaactagaagatag

SEQ ID NO: 9324239 - DNA, 21 bp, Homo sapiens
ttgagcagaaatgtgtatgcc

SEQ ID NO: 9324240 - DNA, 22 bp, Homo sapiens
ttgagatggagtctcgcactgt

SEQ ID NO: 9324241 - DNA, 22 bp, Homo sapiens
ttgagatggagtctcactctgt

SEQ ID NO: 9324242 - DNA, 22 bp, Homo sapiens
ttgagatggagtcttgctctct

SEQ ID NO: 9324243 - DNA, 22 bp, Homo sapiens
ttgagatgggctttatgttcag

SEQ ID NO: 9324244 - DNA, 22 bp, Homo sapiens
ttgagatgtcttttggcattat

SEQ ID NO: 9324245 - DNA, 22 bp, Homo sapiens
ttgaatgaggaagagcactggc

SEQ ID NO: 9324246 - DNA, 22 bp, Homo sapiens
ttgaatgagtgttttactcatg

SEQ ID NO: 9324247 - DNA, 22 bp, Homo sapiens
ttgaatgagaagttattgccat

SEQ ID NO: 9324248 - DNA, 22 bp, Homo sapiens
ttgaatgatcctatctagcaca

SEQ ID NO: 9324249 - DNA, 22 bp, Homo sapiens
ttgagatggagcttcactcttg

SEQ ID NO: 9324250 - DNA, 22 bp, Homo sapiens
ttgagatggagcctcagtcttg

SEQ ID NO: 9324251 - DNA, 22 bp, Homo sapiens
ttgagatgacttaaatttggga

SEQ ID NO: 9324252 - DNA, 22 bp, Homo sapiens
ttgagatgaggtagaagccaat

SEQ ID NO: 9324253 - DNA, 22 bp, Homo sapiens
ttgaatgaagtccctttttact

SEQ ID NO: 9324254 - DNA, 20 bp, Homo sapiens
ttgaatgaatgtctggctca

SEQ ID NO: 9324255 - DNA, 22 bp, Homo sapiens
ttctttatgcttctgtttaggc

SEQ ID NO: 9324256 - DNA, 22 bp, Homo sapiens
ttctttatcctatttgtaggtg

SEQ ID NO: 9324257 - DNA, 22 bp, Homo sapiens
ttctttatcagttactcatagg

SEQ ID NO: 9324258 - DNA, 22 bp, Homo sapiens
ttctttattgagacttcattgt

SEQ ID NO: 9324259 - DNA, 22 bp, Homo sapiens
ttctttattgagacttcattgt

SEQ ID NO: 9324260 - DNA, 22 bp, Homo sapiens
ttagagctgggatggattttcc

SEQ ID NO: 9324261 - DNA, 21 bp, Homo sapiens
ttcaacaaagggaataagttt

SEQ ID NO: 9324262 - DNA, 22 bp, Homo sapiens
ttcaaagggaaaagcaggctgg

SEQ ID NO: 9324263 - DNA, 22 bp, Homo sapiens
ttcaacatttgatacaagtcag

SEQ ID NO: 9324264 - DNA, 22 bp, Homo sapiens
ttcaacatgttctacataaggg

SEQ ID NO: 9324265 - DNA, 22 bp, Homo sapiens
ttcaaccattgtgtaagacagt

SEQ ID NO: 9324266 - DNA, 22 bp, Homo sapiens
ttcaactattatgaataaaatt

SEQ ID NO: 9324267 - DNA, 22 bp, Homo sapiens
ttcacaaagctggagcatttcc

SEQ ID NO: 9324268 - DNA, 22 bp, Homo sapiens
ttcacaggttgaagcctaatcc

SEQ ID NO: 9324269 - DNA, 22 bp, Homo sapiens
ttcaatttcataatatctagct

SEQ ID NO: 9324270 - DNA, 22 bp, Homo sapiens
ttcacaaaacactattttctgg

SEQ ID NO: 9324271 - DNA, 22 bp, Homo sapiens
ttcacaaaacactattttctgg

SEQ ID NO: 9324272 - DNA, 22 bp, Homo sapiens
ttcacaaaaatgctgaacagtt

SEQ ID NO: 9324273 - DNA, 22 bp, Homo sapiens
ttcatgcttgttcctccacctg

SEQ ID NO: 9324274 - DNA, 20 bp, Homo sapiens
ttcatgctggaggggctggc

SEQ ID NO: 9324275 - DNA, 22 bp, Homo sapiens
ttcagtgacttacctggagcca

SEQ ID NO: 9324276 - DNA, 22 bp, Homo sapiens
ttcagtgccgtgctgggtcgct

SEQ ID NO: 9324277 - DNA, 20 bp, Homo sapiens
ttcagggctttggggacacc

SEQ ID NO: 9324278 - DNA, 22 bp, Homo sapiens
ttcagtatgtgtaaactacttt

SEQ ID NO: 9324279 - DNA, 22 bp, Homo sapiens
ttcagtagggccctcacacagt

SEQ ID NO: 9324280 - DNA, 22 bp, Homo sapiens
ttcacattcagaaaaagcccgt

SEQ ID NO: 9324281 - DNA, 22 bp, Homo sapiens
ttcacattatcaggattgtttc

SEQ ID NO: 9324282 - DNA, 22 bp, Homo sapiens
ttcacattataatcagttctgc

SEQ ID NO: 9324283 - DNA, 22 bp, Homo sapiens
ttcacattagtggttctatata

SEQ ID NO: 9324284 - DNA, 22 bp, Homo sapiens
ttcacagtggctgtgccatttg

SEQ ID NO: 9324285 - DNA, 22 bp, Homo sapiens
ttccttcaaacgcctcctgcac

SEQ ID NO: 9324286 - DNA, 22 bp, Homo sapiens
ttccttagttatttggtcccct

SEQ ID NO: 9324287 - DNA, 22 bp, Homo sapiens
ttccttatcttctgaaatgggc

SEQ ID NO: 9324288 - DNA, 22 bp, Homo sapiens
ttccttagtgcctcttccgctg

SEQ ID NO: 9324289 - DNA, 22 bp, Homo sapiens
ttccttagctcctcatggcctg

SEQ ID NO: 9324290 - DNA, 22 bp, Homo sapiens
ttccttagcctgccttccaggg

SEQ ID NO: 9324291 - DNA, 22 bp, Homo sapiens
ttctaagagagtacaagcaatt

SEQ ID NO: 9324292 - DNA, 22 bp, Homo sapiens
ttccttctgaagcctttgtgtt

SEQ ID NO: 9324293 - DNA, 22 bp, Homo sapiens
ttccttctcagccctcgaggat

SEQ ID NO: 9324294 - DNA, 22 bp, Homo sapiens
ttcctgtgaagccggtggtctc

SEQ ID NO: 9324295 - DNA, 22 bp, Homo sapiens
ttctaagtgattctagctggac

SEQ ID NO: 9324296 - DNA, 23 bp, Homo sapiens
ttctaaggtatggtttatacctg

SEQ ID NO: 9324297 - DNA, 19 bp, Homo sapiens
ttctaatgttacattttgg

SEQ ID NO: 9324298 - DNA, 22 bp, Homo sapiens
ttctacttgccaaatgacacat

SEQ ID NO: 9324299 - DNA, 22 bp, Homo sapiens
ttctacaatatgaataatgaag

SEQ ID NO: 9324300 - DNA, 22 bp, Homo sapiens
ttctacaaatatttactgttcc

SEQ ID NO: 9324301 - DNA, 22 bp, Homo sapiens
ttctagctttttgcaccaaggt

SEQ ID NO: 9324302 - DNA, 22 bp, Homo sapiens
ttctactttagcatgctcattc

SEQ ID NO: 9324303 - DNA, 22 bp, Homo sapiens
ttcctcacactcccccattcga

SEQ ID NO: 9324304 - DNA, 22 bp, Homo sapiens
ttcctcaacaacttccctacag

SEQ ID NO: 9324305 - DNA, 22 bp, Homo sapiens
ttcctagggcagagccgctggg

SEQ ID NO: 9324306 - DNA, 22 bp, Homo sapiens
ttcctacaattagagcctcttt

SEQ ID NO: 9324307 - DNA, 22 bp, Homo sapiens
ttcctcagcacaaagccaagat

SEQ ID NO: 9324308 - DNA, 22 bp, Homo sapiens
ttcctcagagggcgctggggaa

SEQ ID NO: 9324309 - DNA, 22 bp, Homo sapiens
ttcctcagccagcacttagggg

SEQ ID NO: 9324310 - DNA, 22 bp, Homo sapiens
ttcctcagccaaggctgggatc

SEQ ID NO: 9324311 - DNA, 22 bp, Homo sapiens
ttcctcagagagacagaaacta

SEQ ID NO: 9324312 - DNA, 22 bp, Homo sapiens
ttcctcagaaaatactgtccaa

SEQ ID NO: 9324313 - DNA, 22 bp, Homo sapiens
ttcctcagaccctcattgtgag

SEQ ID NO: 9324314 - DNA, 20 bp, Homo sapiens
ttcctcaggagaggatgtta

SEQ ID NO: 9324315 - DNA, 22 bp, Homo sapiens
ttcctcaggctgctttcacata

SEQ ID NO: 9324316 - DNA, 22 bp, Homo sapiens
ttcctcagctttagactatgaa

SEQ ID NO: 9324317 - DNA, 22 bp, Homo sapiens
ttcctcagctggcctgattggg

SEQ ID NO: 9324318 - DNA, 22 bp, Homo sapiens
ttcctcagctcagcgagagaga

SEQ ID NO: 9324319 - DNA, 22 bp, Homo sapiens
ttcctcagctgtttgggctcat

SEQ ID NO: 9324320 - DNA, 22 bp, Homo sapiens
ttcctcagctgtgtcctggcga

SEQ ID NO: 9324321 - DNA, 22 bp, Homo sapiens
ttcctcagtgcccccatacggt

SEQ ID NO: 9324322 - DNA, 22 bp, Homo sapiens
ttcctcagggcggatgggcagg

SEQ ID NO: 9324323 - DNA, 22 bp, Homo sapiens
ttcctcaggtgctacaaagcag

SEQ ID NO: 9324324 - DNA, 22 bp, Homo sapiens
ttcctcagtgatggattcaacg

SEQ ID NO: 9324325 - DNA, 22 bp, Homo sapiens
ttcctcagggaggctagcagta

SEQ ID NO: 9324326 - DNA, 22 bp, Homo sapiens
ttcctcaggactgttgacttcc

SEQ ID NO: 9324327 - DNA, 22 bp, Homo sapiens
ttcctcaggcttccctttgtcc

SEQ ID NO: 9324328 - DNA, 22 bp, Homo sapiens
ttcctcagttagtgcctgaggc

SEQ ID NO: 9324329 - DNA, 22 bp, Homo sapiens
ttcctcatctgtgcacctcact

SEQ ID NO: 9324330 - DNA, 22 bp, Homo sapiens
ttcctcatggggttccttcaga

SEQ ID NO: 9324331 - DNA, 22 bp, Homo sapiens
ttcctctggaggctctaggaga

SEQ ID NO: 9324332 - DNA, 22 bp, Homo sapiens
ttccagaaatctttcagctcaa

SEQ ID NO: 9324333 - DNA, 22 bp, Homo sapiens
ttcctaagtcctgccagcagtc

SEQ ID NO: 9324334 - DNA, 22 bp, Homo sapiens
ttccctggaaagccatgcagtc

SEQ ID NO: 9324335 - DNA, 20 bp, Homo sapiens
ttccctggaaggagaagcag

SEQ ID NO: 9324336 - DNA, 22 bp, Homo sapiens
ttccagagaggctcatgttccc

SEQ ID NO: 9324337 - DNA, 22 bp, Homo sapiens
ttccagagcccatgctctaggc

SEQ ID NO: 9324338 - DNA, 22 bp, Homo sapiens
ttccagaagatggcagcaaagg

SEQ ID NO: 9324339 - DNA, 22 bp, Homo sapiens
ttccagaagcctccatattact

SEQ ID NO: 9324340 - DNA, 22 bp, Homo sapiens
ttccagaatagatggagctcta

SEQ ID NO: 9324341 - DNA, 22 bp, Homo sapiens
ttccagaatagatggagctcta

SEQ ID NO: 9324342 - DNA, 21 bp, Homo sapiens
ttactttagaaattgcctttt

SEQ ID NO: 9324343 - DNA, 22 bp, Homo sapiens
ttacttctttggccttcagcca

SEQ ID NO: 9324344 - DNA, 22 bp, Homo sapiens
ttacttcttacaaaagaaatat

SEQ ID NO: 9324345 - DNA, 22 bp, Homo sapiens
ttacttcttgtctcatgcctat

SEQ ID NO: 9324346 - DNA, 22 bp, Homo sapiens
ttacattttggggtaaggataa

SEQ ID NO: 9324347 - DNA, 22 bp, Homo sapiens
ttactcgtgacaatgtccttga

SEQ ID NO: 9324348 - DNA, 20 bp, Homo sapiens
ttactcagttcctgccatgc

SEQ ID NO: 9324349 - DNA, 22 bp, Homo sapiens
ttactctgaatgtttctactga

SEQ ID NO: 9324350 - DNA, 22 bp, Homo sapiens
ttactggctgggcctgagggct

SEQ ID NO: 9324351 - DNA, 21 bp, Homo sapiens
ttagaagctaatgcagctggt

SEQ ID NO: 9324352 - DNA, 21 bp, Homo sapiens
ttagaaagctcactacagtta

SEQ ID NO: 9324353 - DNA, 22 bp, Homo sapiens
ttactttagggatgttttgctt

SEQ ID NO: 9324354 - DNA, 22 bp, Homo sapiens
ttactttatctcctagattcca

SEQ ID NO: 9324355 - DNA, 22 bp, Homo sapiens
ttactttatctcctagattcca

SEQ ID NO: 9324356 - DNA, 22 bp, Homo sapiens
ttacagtaatcgagtgttgtgg

SEQ ID NO: 9324357 - DNA, 22 bp, Homo sapiens
ttacacttgaaaacaggattta

SEQ ID NO: 9324358 - DNA, 19 bp, Homo sapiens
ttacacttctgctttgtga

SEQ ID NO: 9324359 - DNA, 22 bp, Homo sapiens
ttacacttctgaaagcctaggt

SEQ ID NO: 9324360 - DNA, 22 bp, Homo sapiens
ttacacttgtaaatggcatgta

SEQ ID NO: 9324361 - DNA, 22 bp, Homo sapiens
ttacacttgggtgtggatttta

SEQ ID NO: 9324362 - DNA, 22 bp, Homo sapiens
ttacacttacctgtccattgaa

SEQ ID NO: 9324363 - DNA, 22 bp, Homo sapiens
ttacacttagggtttgtcagag

SEQ ID NO: 9324364 - DNA, 22 bp, Homo sapiens
ttacacttctaaaaaaagcagg

SEQ ID NO: 9324365 - DNA, 22 bp, Homo sapiens
ttacacttatctagagccatgg

SEQ ID NO: 9324366 - DNA, 20 bp, Homo sapiens
ttacactttgtagcattttt

SEQ ID NO: 9324367 - DNA, 22 bp, Homo sapiens
ttacacttgtaattatataacg

SEQ ID NO: 9324368 - DNA, 22 bp, Homo sapiens
ttacactttaaatccagcttgt

SEQ ID NO: 9324369 - DNA, 22 bp, Homo sapiens
ttacactttggcaagctattaa

SEQ ID NO: 9324370 - DNA, 22 bp, Homo sapiens
ttacatattatccaaaactgct

SEQ ID NO: 9324371 - DNA, 22 bp, Homo sapiens
ttacacattgcagatcaaaatg

SEQ ID NO: 9324372 - DNA, 22 bp, Homo sapiens
ttacacagcttctatccttgaa

SEQ ID NO: 9324373 - DNA, 22 bp, Homo sapiens
ttacacagacatggcatcatga

SEQ ID NO: 9324374 - DNA, 22 bp, Homo sapiens
ttacacagtatccaaggttctt

SEQ ID NO: 9324375 - DNA, 21 bp, Homo sapiens
ttaatttattcatgatagcta

SEQ ID NO: 9324376 - DNA, 22 bp, Homo sapiens
ttaattttaacctgtttgtgtc

SEQ ID NO: 9324377 - DNA, 22 bp, Homo sapiens
ttaattttctcatctgtgaaat

SEQ ID NO: 9324378 - DNA, 22 bp, Homo sapiens
ttaatttttatgtatagtgtgt

SEQ ID NO: 9324379 - DNA, 22 bp, Homo sapiens
ttacaaacaacagacatttatt

SEQ ID NO: 9324380 - DNA, 22 bp, Homo sapiens
ttacacaagttctttaacctat

SEQ ID NO: 9324381 - DNA, 22 bp, Homo sapiens
ttacacaacatctgtattatta

SEQ ID NO: 9324382 - DNA, 22 bp, Homo sapiens
ttacaaactgtcatatagtatt

SEQ ID NO: 9324383 - DNA, 22 bp, Homo sapiens
ttaatttatgtccaaaccagat

SEQ ID NO: 9324384 - DNA, 22 bp, Homo sapiens
ttaatttatacataatcacagg

SEQ ID NO: 9324385 - DNA, 22 bp, Homo sapiens
ttaattcagtcaaagaaaccat

SEQ ID NO: 9324386 - DNA, 22 bp, Homo sapiens
ttaattacaaaacacataggtt

SEQ ID NO: 9324387 - DNA, 22 bp, Homo sapiens
ttaattactaagcacaatgcaa

SEQ ID NO: 9324388 - DNA, 22 bp, Homo sapiens
ttaattactggcatggtggttg

SEQ ID NO: 9324389 - DNA, 22 bp, Homo sapiens
ttaaggaatgtgcagtttatat

SEQ ID NO: 9324390 - DNA, 22 bp, Homo sapiens
ttaaggaaagattagcatttgt

SEQ ID NO: 9324391 - DNA, 22 bp, Homo sapiens
ttaaggaaccacagcatgttag

SEQ ID NO: 9324392 - DNA, 22 bp, Homo sapiens
ttaaggaaggtgaatttcttgg

SEQ ID NO: 9324393 - DNA, 22 bp, Homo sapiens
ttaaggaaggagtcttaaatgg

SEQ ID NO: 9324394 - DNA, 22 bp, Homo sapiens
ttaaggaacttgtctttctctt

SEQ ID NO: 9324395 - DNA, 20 bp, Homo sapiens
ttaagaaaagcacatcctgc

SEQ ID NO: 9324396 - DNA, 22 bp, Homo sapiens
ttaacaggagtaactctagaaa

SEQ ID NO: 9324397 - DNA, 22 bp, Homo sapiens
ttaaatattatgttgtctgcaa

SEQ ID NO: 9324398 - DNA, 22 bp, Homo sapiens
ttaaatgacgggactgggtttt

SEQ ID NO: 9324399 - DNA, 22 bp, Homo sapiens
ttaaatcaggcatcatttcagt

SEQ ID NO: 9324400 - DNA, 22 bp, Homo sapiens
ttaaatctgttctcatgtctgt

SEQ ID NO: 9324401 - DNA, 22 bp, Homo sapiens
ttaaatcagtaggctactcctt

SEQ ID NO: 9324402 - DNA, 22 bp, Homo sapiens
ttaaatgagatgttcagatatt

SEQ ID NO: 9324403 - DNA, 22 bp, Homo sapiens
tgtttacatagtagctgccctg

SEQ ID NO: 9324404 - DNA, 22 bp, Homo sapiens
tgtttacatatttggtctcaga

SEQ ID NO: 9324405 - DNA, 19 bp, Homo sapiens
tgtttacatgtttcttcag

SEQ ID NO: 9324406 - DNA, 22 bp, Homo sapiens
tgtttacatggaggttttcagc

SEQ ID NO: 9324407 - DNA, 22 bp, Homo sapiens
tgtttcaggacctatcttttag

SEQ ID NO: 9324408 - DNA, 22 bp, Homo sapiens
tgtttctttgtagatattcttt

SEQ ID NO: 9324409 - DNA, 22 bp, Homo sapiens
tgtttcttgataaagcagaaaa

SEQ ID NO: 9324410 - DNA, 22 bp, Homo sapiens
tgttctgccagcacttctcagc

SEQ ID NO: 9324411 - DNA, 22 bp, Homo sapiens
tgttctgcaagccctgccacct

SEQ ID NO: 9324412 - DNA, 22 bp, Homo sapiens
tgttctgcaatgctgcctcctt

SEQ ID NO: 9324413 - DNA, 22 bp, Homo sapiens
tgttctcttttcctgctgagcc

SEQ ID NO: 9324414 - DNA, 22 bp, Homo sapiens
tgttctaaattgctagctggaa

SEQ ID NO: 9324415 - DNA, 22 bp, Homo sapiens
tgtttaataattctatgatagt

SEQ ID NO: 9324416 - DNA, 22 bp, Homo sapiens
tgtttacaagccacttgttaag

SEQ ID NO: 9324417 - DNA, 22 bp, Homo sapiens
tgtttacagggtgattttacct

SEQ ID NO: 9324418 - DNA, 22 bp, Homo sapiens
tgtttacacaatagtctctctc

SEQ ID NO: 9324419 - DNA, 22 bp, Homo sapiens
tgtttacaaggagtttatattg

SEQ ID NO: 9324420 - DNA, 22 bp, Homo sapiens
tgttattctctgcctacaagtc

SEQ ID NO: 9324421 - DNA, 22 bp, Homo sapiens
tgttattctgatgtgcaggata

SEQ ID NO: 9324422 - DNA, 22 bp, Homo sapiens
tgttattctctgcctacaagtc

SEQ ID NO: 9324423 - DNA, 22 bp, Homo sapiens
tgttatgaacttctagaaaaca

SEQ ID NO: 9324424 - DNA, 22 bp, Homo sapiens
tgttatcacttagacatgctag

SEQ ID NO: 9324425 - DNA, 22 bp, Homo sapiens
tgttatcagagagaggtgctgt

SEQ ID NO: 9324426 - DNA, 20 bp, Homo sapiens
tgttcagaaatgcagagagg

SEQ ID NO: 9324427 - DNA, 22 bp, Homo sapiens
tgtgttgtgacattcttggatg

SEQ ID NO: 9324428 - DNA, 21 bp, Homo sapiens
tgtgtttgagactatgtttcc

SEQ ID NO: 9324429 - DNA, 22 bp, Homo sapiens
tgtgtttgaggcatgttgcaga

SEQ ID NO: 9324430 - DNA, 19 bp, Homo sapiens
tgtgttcaaactccatctc

SEQ ID NO: 9324431 - DNA, 22 bp, Homo sapiens
tgtgttcaagattagttctagt

SEQ ID NO: 9324432 - DNA, 22 bp, Homo sapiens
tgtgttctggaaagctcactga

SEQ ID NO: 9324433 - DNA, 22 bp, Homo sapiens
tgtgttcttaaaagcagtgata

SEQ ID NO: 9324434 - DNA, 22 bp, Homo sapiens
tgtgttggctgccggcacagga

SEQ ID NO: 9324435 - DNA, 22 bp, Homo sapiens
tgtgttggcttgcctgttaggc

SEQ ID NO: 9324436 - DNA, 22 bp, Homo sapiens
tgtgttggtagatctgaggtct

SEQ ID NO: 9324437 - DNA, 22 bp, Homo sapiens
tgtgtgcagctgaaaagcgctg

SEQ ID NO: 9324438 - DNA, 22 bp, Homo sapiens
tgtggagcctcaaggccatctc

SEQ ID NO: 9324439 - DNA, 22 bp, Homo sapiens
tcccctctctgcgctcccaggt

SEQ ID NO: 9324440 - DNA, 22 bp, Homo sapiens
tcccctgcagatgagggcagtg

SEQ ID NO: 9324441 - DNA, 22 bp, Homo sapiens
tcccctgcagcgcctgcttcta

SEQ ID NO: 9324442 - DNA, 18 bp, Homo sapiens
tcccctgctctggtgctc

SEQ ID NO: 9324443 - DNA, 22 bp, Homo sapiens
tccccctcattacctcattcaa

SEQ ID NO: 9324444 - DNA, 22 bp, Homo sapiens
tccccaggtcctgtcggctcct

SEQ ID NO: 9324445 - DNA, 22 bp, Homo sapiens
tgtggcagagagagcttccttg

SEQ ID NO: 9324446 - DNA, 22 bp, Homo sapiens
tgtggaggtttaagtaatggga

SEQ ID NO: 9324447 - DNA, 22 bp, Homo sapiens
tgtggcctctcaggcttgatca

SEQ ID NO: 9324448 - DNA, 23 bp, Homo sapiens
tgtggcctgcagctctggtttgg

SEQ ID NO: 9324449 - DNA, 22 bp, Homo sapiens
tgtggcctgattttgcatctct

SEQ ID NO: 9324450 - DNA, 22 bp, Homo sapiens
tgtggggaggctgcagtgctgc

SEQ ID NO: 9324451 - DNA, 22 bp, Homo sapiens
tgtggggaggctgcagtgctgc

SEQ ID NO: 9324452 - DNA, 19 bp, Homo sapiens
tgtggggagtcagggggct

SEQ ID NO: 9324453 - DNA, 19 bp, Homo sapiens
tgtggggagtcagggggct

SEQ ID NO: 9324454 - DNA, 19 bp, Homo sapiens
tgtggggagtcagggggct

SEQ ID NO: 9324455 - DNA, 19 bp, Homo sapiens
tgtggggagtcagggggct

SEQ ID NO: 9324456 - DNA, 22 bp, Homo sapiens
tgtgggtgctcagagtaccccc

SEQ ID NO: 9324457 - DNA, 19 bp, Homo sapiens
tgtggtctctgttctcagg

SEQ ID NO: 9324458 - DNA, 21 bp, Homo sapiens
tgtggtcttttagttccatca

SEQ ID NO: 9324459 - DNA, 22 bp, Homo sapiens
tgtggttgaaggttattactta

SEQ ID NO: 9324460 - DNA, 22 bp, Homo sapiens
tgtgtaaaagattagtttacta

SEQ ID NO: 9324461 - DNA, 22 bp, Homo sapiens
tgtgtaaagcttgttccagaaa

SEQ ID NO: 9324462 - DNA, 22 bp, Homo sapiens
tgtgtaaaatgagcctaaagtc

SEQ ID NO: 9324463 - DNA, 22 bp, Homo sapiens
tgtgtaaaatctgattaatact

SEQ ID NO: 9324464 - DNA, 21 bp, Homo sapiens
tgtgtaaagttgaaatcctgt

SEQ ID NO: 9324465 - DNA, 19 bp, Homo sapiens
tgtgtaaagtctgtggtca

SEQ ID NO: 9324466 - DNA, 22 bp, Homo sapiens
tgtgtaaattatttttaatgat

SEQ ID NO: 9324467 - DNA, 22 bp, Homo sapiens
tgtgtaaaatctgattaatact

SEQ ID NO: 9324468 - DNA, 22 bp, Homo sapiens
tgtgtaaatggcatctctcagc

SEQ ID NO: 9324469 - DNA, 22 bp, Homo sapiens
tgtgtaaattatttttaatgat

SEQ ID NO: 9324470 - DNA, 22 bp, Homo sapiens
tgtgtaaatggactgtgaatta

SEQ ID NO: 9324471 - DNA, 22 bp, Homo sapiens
tgtgtaaatttatttacataaa

SEQ ID NO: 9324472 - DNA, 22 bp, Homo sapiens
tgtgtgaaggaatatatactca

SEQ ID NO: 9324473 - DNA, 22 bp, Homo sapiens
tttttgaaggctgatgtgatta

SEQ ID NO: 9324474 - DNA, 22 bp, Homo sapiens
tttttctaatggcttaggatgt

SEQ ID NO: 9324475 - DNA, 20 bp, Homo sapiens
tttttccttctctacaggca

SEQ ID NO: 9324476 - DNA, 22 bp, Homo sapiens
tttttgctaatccccagccact

SEQ ID NO: 9324477 - DNA, 22 bp, Homo sapiens
ttttggctccagtggtttgtgc

SEQ ID NO: 9324478 - DNA, 22 bp, Homo sapiens
ttttggctccagtggtttgtgc

SEQ ID NO: 9324479 - DNA, 22 bp, Homo sapiens
ttttggctacaaagagcctagt

SEQ ID NO: 9324480 - DNA, 22 bp, Homo sapiens
ttttggctctgcaggtttgcac

SEQ ID NO: 9324481 - DNA, 22 bp, Homo sapiens
ttttggctctgcaggtttgcac

SEQ ID NO: 9324482 - DNA, 22 bp, Homo sapiens
ttttgaataattcagaaacagc

SEQ ID NO: 9324483 - DNA, 22 bp, Homo sapiens
ttttgagatggagtcttgctct

SEQ ID NO: 9324484 - DNA, 22 bp, Homo sapiens
ttttgagatggtgtctcgctcc

SEQ ID NO: 9324485 - DNA, 22 bp, Homo sapiens
ttttgaaagggtgatttggctt

SEQ ID NO: 9324486 - DNA, 22 bp, Homo sapiens
ttttgaaagccaggtttgtatg

SEQ ID NO: 9324487 - DNA, 22 bp, Homo sapiens
ttttgaaagagtcctgctacag

SEQ ID NO: 9324488 - DNA, 22 bp, Homo sapiens
ttttggcaaaggcattctcttt

SEQ ID NO: 9324489 - DNA, 19 bp, Homo sapiens
ttttccttctcctcttaat

SEQ ID NO: 9324490 - DNA, 22 bp, Homo sapiens
ttttatgagaatgcgccacttg

SEQ ID NO: 9324491 - DNA, 22 bp, Homo sapiens
ttttatgaagataattttctga

SEQ ID NO: 9324492 - DNA, 22 bp, Homo sapiens
ttttccttctgatactccattt

SEQ ID NO: 9324493 - DNA, 22 bp, Homo sapiens
ttttcctttcatcaggacaaag

SEQ ID NO: 9324494 - DNA, 22 bp, Homo sapiens
ttttctaacatctagtaatttg

SEQ ID NO: 9324495 - DNA, 23 bp, Homo sapiens
ttttcctttggacaggctgtatt

SEQ ID NO: 9324496 - DNA, 22 bp, Homo sapiens
ttttcttctacctgctgtccaa

SEQ ID NO: 9324497 - DNA, 22 bp, Homo sapiens
tttggcagcacccgccatctat

SEQ ID NO: 9324498 - DNA, 22 bp, Homo sapiens
tttgtacatgtaagattgcatc

SEQ ID NO: 9324499 - DNA, 22 bp, Homo sapiens
tttgtacatcctaattctgagt

SEQ ID NO: 9324500 - DNA, 22 bp, Homo sapiens
tttggaagggaaccaaaacatg

SEQ ID NO: 9324501 - DNA, 22 bp, Homo sapiens
tttggatttggggatggagtat

SEQ ID NO: 9324502 - DNA, 22 bp, Homo sapiens
tttctttatcctcctttgcaca

SEQ ID NO: 9324503 - DNA, 22 bp, Homo sapiens
tttctttccatgagcctatgta

SEQ ID NO: 9324504 - DNA, 22 bp, Homo sapiens
tttgcaaatatgtgtttctatt

SEQ ID NO: 9324505 - DNA, 22 bp, Homo sapiens
tttgcaaataccatgaaacttg

SEQ ID NO: 9324506 - DNA, 20 bp, Homo sapiens
tttgatttcacaaggccagt

SEQ ID NO: 9324507 - DNA, 22 bp, Homo sapiens
tttgttcactgagcaatgatta

SEQ ID NO: 9324508 - DNA, 22 bp, Homo sapiens
tttgtttacaaaaataagcagt

SEQ ID NO: 9324509 - DNA, 22 bp, Homo sapiens
tttgttgtgaacagaataatat

SEQ ID NO: 9324510 - DNA, 22 bp, Homo sapiens
tttgttgtctagcatgaggtgc

SEQ ID NO: 9324511 - DNA, 22 bp, Homo sapiens
tttgttgtactgggattagact

SEQ ID NO: 9324512 - DNA, 22 bp, Homo sapiens
tttgtataagaacattctagca

SEQ ID NO: 9324513 - DNA, 22 bp, Homo sapiens
tttgtataagaacattctagca

SEQ ID NO: 9324514 - DNA, 22 bp, Homo sapiens
tttgtacctgtgggaatacaga

SEQ ID NO: 9324515 - DNA, 22 bp, Homo sapiens
tttgtaccagccacatatgaaa

SEQ ID NO: 9324516 - DNA, 22 bp, Homo sapiens
tttgtagaaagggttgtatgaa

SEQ ID NO: 9324517 - DNA, 22 bp, Homo sapiens
tttgtagaactgtagaacaatg

SEQ ID NO: 9324518 - DNA, 22 bp, Homo sapiens
ttttatattgagtgagagttcc

SEQ ID NO: 9324519 - DNA, 22 bp, Homo sapiens
ttttatattgagtgagagttcc

SEQ ID NO: 9324520 - DNA, 22 bp, Homo sapiens
ttttatatggcacattggttgg

SEQ ID NO: 9324521 - DNA, 20 bp, Homo sapiens
ttttatatgtagggtatatg

SEQ ID NO: 9324522 - DNA, 22 bp, Homo sapiens
ttttatatggcacattggttgg

SEQ ID NO: 9324523 - DNA, 22 bp, Homo sapiens
ttttataaagagagtcagttgg

SEQ ID NO: 9324524 - DNA, 22 bp, Homo sapiens
ttttataagcaagaaagggaaa

SEQ ID NO: 9324525 - DNA, 22 bp, Homo sapiens
tttgtttgaaagtctctacagc

SEQ ID NO: 9324526 - DNA, 22 bp, Homo sapiens
tttgtttgaaagtctctacagc

SEQ ID NO: 9324527 - DNA, 22 bp, Homo sapiens
tttgtttgcggcacatagtttg

SEQ ID NO: 9324528 - DNA, 22 bp, Homo sapiens
tttgtttggcaacttggtaaag

SEQ ID NO: 9324529 - DNA, 22 bp, Homo sapiens
tttgtttggcaacttggtaaag

SEQ ID NO: 9324530 - DNA, 22 bp, Homo sapiens
tttgtttactcattcattgatg

SEQ ID NO: 9324531 - DNA, 22 bp, Homo sapiens
tttgtttagatggtaaatcagt

SEQ ID NO: 9324532 - DNA, 22 bp, Homo sapiens
tttgttttcaatgtgtcattca

SEQ ID NO: 9324533 - DNA, 22 bp, Homo sapiens
tttgttttcaatgtgtcattca

SEQ ID NO: 9324534 - DNA, 22 bp, Homo sapiens
tttgttttcaatgtgtcattca

SEQ ID NO: 9324535 - DNA, 22 bp, Homo sapiens
ttttagaagttcacttgggttt

SEQ ID NO: 9324536 - DNA, 22 bp, Homo sapiens
ttttagaagtgcctatcctatg

SEQ ID NO: 9324537 - DNA, 22 bp, Homo sapiens
ttggtgtgactaaggcagtgtg

SEQ ID NO: 9324538 - DNA, 22 bp, Homo sapiens
ttggggtggaagtgaggatcat

SEQ ID NO: 9324539 - DNA, 22 bp, Homo sapiens
ttgcaagggcatgtgtgcgtgt

SEQ ID NO: 9324540 - DNA, 16 bp, Homo sapiens
ttgcaaggcgtttata

SEQ ID NO: 9324541 - DNA, 22 bp, Homo sapiens
ttgcaaggtgataaaagaatga

SEQ ID NO: 9324542 - DNA, 22 bp, Homo sapiens
ttgcaaggtcatcatgcattgg

SEQ ID NO: 9324543 - DNA, 22 bp, Homo sapiens
ttgcaacatctgaacatttatc

SEQ ID NO: 9324544 - DNA, 22 bp, Homo sapiens
ttgcaaattcgtcactgttaaa

SEQ ID NO: 9324545 - DNA, 22 bp, Homo sapiens
ttgtctactaagaaagacaatt

SEQ ID NO: 9324546 - DNA, 22 bp, Homo sapiens
ttgtctacattttgtggcatgt

SEQ ID NO: 9324547 - DNA, 17 bp, Homo sapiens
ttgtctacctagcagaa

SEQ ID NO: 9324548 - DNA, 22 bp, Homo sapiens
ttggttttcaggggcaggataa

SEQ ID NO: 9324549 - DNA, 22 bp, Homo sapiens
ttggtttagagagtgtggttac

SEQ ID NO: 9324550 - DNA, 22 bp, Homo sapiens
ttggtttagcaacttcctgtgt

SEQ ID NO: 9324551 - DNA, 22 bp, Homo sapiens
ttggtttaggaactggcttgga

SEQ ID NO: 9324552 - DNA, 22 bp, Homo sapiens
ttgtgaatgcttaatatgtttc

SEQ ID NO: 9324553 - DNA, 22 bp, Homo sapiens
ttgtgaatagtgctgcagtaaa

SEQ ID NO: 9324554 - DNA, 22 bp, Homo sapiens
ttgtctgacttctttagttact

SEQ ID NO: 9324555 - DNA, 22 bp, Homo sapiens
ttgtctctgccatgcttgaggg

SEQ ID NO: 9324556 - DNA, 22 bp, Homo sapiens
ttgtctctgtgtggcttcccta

SEQ ID NO: 9324557 - DNA, 22 bp, Homo sapiens
ttgtttgtaaggctcttagaat

SEQ ID NO: 9324558 - DNA, 22 bp, Homo sapiens
ttgtttggaacttggtgccacc

SEQ ID NO: 9324559 - DNA, 22 bp, Homo sapiens
ttgttttattctgcaatttccc

SEQ ID NO: 9324560 - DNA, 22 bp, Homo sapiens
ttgttttatctttctacagact

SEQ ID NO: 9324561 - DNA, 22 bp, Homo sapiens
ttgttttagtaggtacactgag

SEQ ID NO: 9324562 - DNA, 22 bp, Homo sapiens
ttgttttaagccagtctgccta

SEQ ID NO: 9324563 - DNA, 22 bp, Homo sapiens
ttgttttaatgagggaggttga

SEQ ID NO: 9324564 - DNA, 22 bp, Homo sapiens
ttgttttaagccagtctgccta

SEQ ID NO: 9324565 - DNA, 18 bp, Homo sapiens
ttgttttaagactctgtc

SEQ ID NO: 9324566 - DNA, 20 bp, Homo sapiens
ttgttttaaatcctggatga

SEQ ID NO: 9324567 - DNA, 22 bp, Homo sapiens
ttgttttaacctagtgtttatg

SEQ ID NO: 9324568 - DNA, 22 bp, Homo sapiens
ttgttttaacgactcagcttgt

SEQ ID NO: 9324569 - DNA, 22 bp, Homo sapiens
ttgttttaacgactcagcttgt

SEQ ID NO: 9324570 - DNA, 22 bp, Homo sapiens
ttgttacagcagcaatagaaaa

SEQ ID NO: 9324571 - DNA, 22 bp, Homo sapiens
ttgttacagcagtgatttcaga

SEQ ID NO: 9324572 - DNA, 22 bp, Homo sapiens
ttgtgttttcttatggcataaa

SEQ ID NO: 9324573 - DNA, 22 bp, Homo sapiens
ttgttactgttctacatacagt

SEQ ID NO: 9324574 - DNA, 22 bp, Homo sapiens
ttgttagtgcaatgtttggtga

SEQ ID NO: 9324575 - DNA, 22 bp, Homo sapiens
ttgttagtttcagacacttgcc

SEQ ID NO: 9324576 - DNA, 22 bp, Homo sapiens
ttgttagtaagtgacaaaaatc

SEQ ID NO: 9324577 - DNA, 22 bp, Homo sapiens
ttgttagtttatataatgtagt

SEQ ID NO: 9324578 - DNA, 19 bp, Homo sapiens
ttgtgtgtcagtcagagtt

SEQ ID NO: 9324579 - DNA, 22 bp, Homo sapiens
ttgtgtgtgagccttcaccaca

SEQ ID NO: 9324580 - DNA, 22 bp, Homo sapiens
ttgtgtttcccttgcatattcc

SEQ ID NO: 9324581 - DNA, 22 bp, Homo sapiens
ttgtgtttctggccaagatgga

SEQ ID NO: 9324582 - DNA, 22 bp, Homo sapiens
ttgtgtgtttgtagaaaatcca

SEQ ID NO: 9324583 - DNA, 22 bp, Homo sapiens
ttgtgtgtgtaactttatgaga

SEQ ID NO: 9324584 - DNA, 22 bp, Homo sapiens
tttataaacagtaccacggtgc

SEQ ID NO: 9324585 - DNA, 22 bp, Homo sapiens
tttataaaatagactgggtcta

SEQ ID NO: 9324586 - DNA, 22 bp, Homo sapiens
tttataaacagtaccacggtgc

SEQ ID NO: 9324587 - DNA, 22 bp, Homo sapiens
tttataacttagtttggttgaa

SEQ ID NO: 9324588 - DNA, 22 bp, Homo sapiens
tttagttttgatgaaaatgcca

SEQ ID NO: 9324589 - DNA, 22 bp, Homo sapiens
tttataaaatagactgggtcta

SEQ ID NO: 9324590 - DNA, 22 bp, Homo sapiens
tttagttattgttacagtatga

SEQ ID NO: 9324591 - DNA, 22 bp, Homo sapiens
tttagttcataaaaccagggtg

SEQ ID NO: 9324592 - DNA, 22 bp, Homo sapiens
tttagttctgagacagtgggaa

SEQ ID NO: 9324593 - DNA, 22 bp, Homo sapiens
tttagtttgatgttctactcct

SEQ ID NO: 9324594 - DNA, 20 bp, Homo sapiens
tttagtttcttctgaggtgt

SEQ ID NO: 9324595 - DNA, 22 bp, Homo sapiens
tttagttttaactgaaagctat

SEQ ID NO: 9324596 - DNA, 22 bp, Homo sapiens
tttatactccactctgcaagcg

SEQ ID NO: 9324597 - DNA, 22 bp, Homo sapiens
tttatacatggagaatttttgc

SEQ ID NO: 9324598 - DNA, 22 bp, Homo sapiens
tttatactccactctgcaagcg

SEQ ID NO: 9324599 - DNA, 22 bp, Homo sapiens
tttatacttcataatgtctatt

SEQ ID NO: 9324600 - DNA, 22 bp, Homo sapiens
tttatactccactctgcaagcg

SEQ ID NO: 9324601 - DNA, 22 bp, Homo sapiens
tttataattatctctactctta

SEQ ID NO: 9324602 - DNA, 22 bp, Homo sapiens
tttatataacagagactgctat

SEQ ID NO: 9324603 - DNA, 22 bp, Homo sapiens
tttatagatgtctgtattataa

SEQ ID NO: 9324604 - DNA, 22 bp, Homo sapiens
tttattatccagtgttgtcatg

SEQ ID NO: 9324605 - DNA, 22 bp, Homo sapiens
tttattatgatggacaccttcg

SEQ ID NO: 9324606 - DNA, 22 bp, Homo sapiens
tttattattctgttctctctac

SEQ ID NO: 9324607 - DNA, 22 bp, Homo sapiens
tttattattctctggagaatgt

SEQ ID NO: 9324608 - DNA, 22 bp, Homo sapiens
tttattatgtacaggcactata

SEQ ID NO: 9324609 - DNA, 22 bp, Homo sapiens
tttattatgtacaggcactata

SEQ ID NO: 9324610 - DNA, 22 bp, Homo sapiens
tttattagattatcaaagaggt

SEQ ID NO: 9324611 - DNA, 22 bp, Homo sapiens
tttattagattatcaaagaggt

SEQ ID NO: 9324612 - DNA, 22 bp, Homo sapiens
tttattatagtggtggggactg

SEQ ID NO: 9324613 - DNA, 22 bp, Homo sapiens
tttattagtgcttgtatcactg

SEQ ID NO: 9324614 - DNA, 22 bp, Homo sapiens
tttatttggcatccagggagaa

SEQ ID NO: 9324615 - DNA, 22 bp, Homo sapiens
tttatttggcatccagggagaa

SEQ ID NO: 9324616 - DNA, 22 bp, Homo sapiens
tttatttggcatctctgccaag

SEQ ID NO: 9324617 - DNA, 22 bp, Homo sapiens
tttatttggcatctctgccaag

SEQ ID NO: 9324618 - DNA, 23 bp, Homo sapiens
tttatttatttaggctgagggat

SEQ ID NO: 9324619 - DNA, 22 bp, Homo sapiens
tttattattctgttctctctac

SEQ ID NO: 9324620 - DNA, 22 bp, Homo sapiens
tttatttcttagtttgccacag

SEQ ID NO: 9324621 - DNA, 22 bp, Homo sapiens
tttatttgaatcaggggagaat

SEQ ID NO: 9324622 - DNA, 19 bp, Homo sapiens
tttatttgagacatgcctt

SEQ ID NO: 9324623 - DNA, 22 bp, Homo sapiens
tttatttgtcttgccatttagt

SEQ ID NO: 9324624 - DNA, 22 bp, Homo sapiens
tttacgaaaagtgactaatagg

SEQ ID NO: 9324625 - DNA, 22 bp, Homo sapiens
tttacttctgcatttcccctag

SEQ ID NO: 9324626 - DNA, 22 bp, Homo sapiens
tttacttcatttccagtgagga

SEQ ID NO: 9324627 - DNA, 22 bp, Homo sapiens
tttaaaatcagatgggagttgg

SEQ ID NO: 9324628 - DNA, 22 bp, Homo sapiens
tttaaaatcagatgggagttgg

SEQ ID NO: 9324629 - DNA, 22 bp, Homo sapiens
tttaaaatttagacctctccac

SEQ ID NO: 9324630 - DNA, 22 bp, Homo sapiens
tttaatttgaaatgagtaaccc

SEQ ID NO: 9324631 - DNA, 21 bp, Homo sapiens
tttaatttgcatgtatgacgc

SEQ ID NO: 9324632 - DNA, 22 bp, Homo sapiens
tttaatttgtatttctagaggg

SEQ ID NO: 9324633 - DNA, 22 bp, Homo sapiens
tttaattttctgggcccagcag

SEQ ID NO: 9324634 - DNA, 22 bp, Homo sapiens
tttaattttcctggtaggcctg

SEQ ID NO: 9324635 - DNA, 22 bp, Homo sapiens
tttaattttcctcttcctggag

SEQ ID NO: 9324636 - DNA, 22 bp, Homo sapiens
tttctgctttctatccttgtca

SEQ ID NO: 9324637 - DNA, 22 bp, Homo sapiens
tttctgctttcagagtgagaca

SEQ ID NO: 9324638 - DNA, 22 bp, Homo sapiens
tttctgcttccttgagaaggag

SEQ ID NO: 9324639 - DNA, 22 bp, Homo sapiens
tttctgcttctcagaccctgaa

SEQ ID NO: 9324640 - DNA, 22 bp, Homo sapiens
tttctgcttaggactctgtgga

SEQ ID NO: 9324641 - DNA, 22 bp, Homo sapiens
tttctgcttgagagaattgctg

SEQ ID NO: 9324642 - DNA, 22 bp, Homo sapiens
tttctgctgtgtaaaatgaggg

SEQ ID NO: 9324643 - DNA, 22 bp, Homo sapiens
tttctgctcgctctcaatcagg

SEQ ID NO: 9324644 - DNA, 22 bp, Homo sapiens
tttctgctgtgctttcttgcgt

SEQ ID NO: 9324645 - DNA, 22 bp, Homo sapiens
tttctgtacacccactattcat

SEQ ID NO: 9324646 - DNA, 22 bp, Homo sapiens
tttctggcagcgggacaggggt

SEQ ID NO: 9324647 - DNA, 22 bp, Homo sapiens
tttctgagaaattaaacacttt

SEQ ID NO: 9324648 - DNA, 22 bp, Homo sapiens
tttctgctaatcttttactgag

SEQ ID NO: 9324649 - DNA, 22 bp, Homo sapiens
tttctgctcatcctagtggagc

SEQ ID NO: 9324650 - DNA, 22 bp, Homo sapiens
tttctgaataactctatgatat

SEQ ID NO: 9324651 - DNA, 22 bp, Homo sapiens
tttctgaagggcagcagactct

SEQ ID NO: 9324652 - DNA, 22 bp, Homo sapiens
tttctctagctattcattaaat

SEQ ID NO: 9324653 - DNA, 22 bp, Homo sapiens
tttctcctgagttccacgctac

SEQ ID NO: 9324654 - DNA, 17 bp, Homo sapiens
tttctccttccatctca

SEQ ID NO: 9324655 - DNA, 21 bp, Homo sapiens
tttctgaaggcaacatctatc

SEQ ID NO: 9324656 - DNA, 22 bp, Homo sapiens
tttctcttcactgtgtgcctca

SEQ ID NO: 9324657 - DNA, 22 bp, Homo sapiens
tttctcttcactgtgtgcctca

SEQ ID NO: 9324658 - DNA, 22 bp, Homo sapiens
tttctctttgacaggaatcaga

SEQ ID NO: 9324659 - DNA, 22 bp, Homo sapiens
tttctgtctgacatccctgcct

SEQ ID NO: 9324660 - DNA, 22 bp, Homo sapiens
tttctgtgaattataaaatttg

SEQ ID NO: 9324661 - DNA, 22 bp, Homo sapiens
tttctgtattttgtcataacct

SEQ ID NO: 9324662 - DNA, 22 bp, Homo sapiens
tttcttatattctgtcattgtt

SEQ ID NO: 9324663 - DNA, 22 bp, Homo sapiens
tttctgtggattttccattcaa

SEQ ID NO: 9324664 - DNA, 22 bp, Homo sapiens
tttcttatgagcaagactctat

SEQ ID NO: 9324665 - DNA, 21 bp, Homo sapiens
tttcttcactttgccccatgt

SEQ ID NO: 9324666 - DNA, 22 bp, Homo sapiens
tttcttctatgtgtgatatttt

SEQ ID NO: 9324667 - DNA, 22 bp, Homo sapiens
tttcttctcatccctgaaatca

SEQ ID NO: 9324668 - DNA, 22 bp, Homo sapiens
tttcttctaggactaataagag

SEQ ID NO: 9324669 - DNA, 22 bp, Homo sapiens
tttctttaaaggaactctgttt

SEQ ID NO: 9324670 - DNA, 22 bp, Homo sapiens
tttctttaggctgtgttgccaa

SEQ ID NO: 9324671 - DNA, 22 bp, Homo sapiens
tttctttaggctgtgttgccaa

SEQ ID NO: 9324672 - DNA, 22 bp, Homo sapiens
tttcttctctaatctcaatgat

SEQ ID NO: 9324673 - DNA, 22 bp, Homo sapiens
tttcttgtaagatgtttattaa

SEQ ID NO: 9324674 - DNA, 22 bp, Homo sapiens
tttcttgtacactggaatttat

SEQ ID NO: 9324675 - DNA, 22 bp, Homo sapiens
tttcctctgggccctgccaccc

SEQ ID NO: 9324676 - DNA, 22 bp, Homo sapiens
tttccaaaatgaatctaatgca

SEQ ID NO: 9324677 - DNA, 22 bp, Homo sapiens
tttcattgtctacatatgacat

SEQ ID NO: 9324678 - DNA, 22 bp, Homo sapiens
tttcaggccatagcacagggaa

SEQ ID NO: 9324679 - DNA, 22 bp, Homo sapiens
tttcagcactttaggcagcagg

SEQ ID NO: 9324680 - DNA, 17 bp, Homo sapiens
tttcagattcactttct

SEQ ID NO: 9324681 - DNA, 22 bp, Homo sapiens
tttcagatgtgtgtctctgaag

SEQ ID NO: 9324682 - DNA, 22 bp, Homo sapiens
tttcagattatctcaactttgg

SEQ ID NO: 9324683 - DNA, 22 bp, Homo sapiens
tttcagatggaggtttaggaca

SEQ ID NO: 9324684 - DNA, 22 bp, Homo sapiens
tttcagatgcaattaattttca

SEQ ID NO: 9324685 - DNA, 22 bp, Homo sapiens
tttctacattcaaaaactacca

SEQ ID NO: 9324686 - DNA, 22 bp, Homo sapiens
tttctaaggtgatcctttctta

SEQ ID NO: 9324687 - DNA, 22 bp, Homo sapiens
tttctcatagtcatgcctctta

SEQ ID NO: 9324688 - DNA, 21 bp, Homo sapiens
tttctccaagtgactgattcc

SEQ ID NO: 9324689 - DNA, 22 bp, Homo sapiens
tttctccctttataagactgta

SEQ ID NO: 9324690 - DNA, 22 bp, Homo sapiens
tttctccctccactacaggctc

SEQ ID NO: 9324691 - DNA, 18 bp, Homo sapiens
tttctcagactctctttc

SEQ ID NO: 9324692 - DNA, 22 bp, Homo sapiens
tttctcagaggagccagacggt

SEQ ID NO: 9324693 - DNA, 22 bp, Homo sapiens
tttctagaaatagagatagagt

SEQ ID NO: 9324694 - DNA, 22 bp, Homo sapiens
tttctagaagatggctaataag

SEQ ID NO: 9324695 - DNA, 22 bp, Homo sapiens
tttctcagtgtagcttttcaag

SEQ ID NO: 9324696 - DNA, 22 bp, Homo sapiens
aggagccagttccaccccagga

SEQ ID NO: 9324697 - DNA, 22 bp, Homo sapiens
aggagccagcgttcctcaggat

SEQ ID NO: 9324698 - DNA, 22 bp, Homo sapiens
aggaagagctggaccagaggac

SEQ ID NO: 9324699 - DNA, 22 bp, Homo sapiens
agcttcctacaaccatctcaga

SEQ ID NO: 9324700 - DNA, 22 bp, Homo sapiens
caggcacacccactggtgcaga

SEQ ID NO: 9324701 - DNA, 22 bp, Homo sapiens
caggagcagagggtggtcagca

SEQ ID NO: 9324702 - DNA, 22 bp, Homo sapiens
caggagcccagagtcctcagct

SEQ ID NO: 9324703 - DNA, 22 bp, Homo sapiens
ccagaggctggcaagggctcct

SEQ ID NO: 9324704 - DNA, 22 bp, Homo sapiens
ccagaggtggtggtgtctagaa

SEQ ID NO: 9324705 - DNA, 23 bp, Homo sapiens
agggccaggtgcggaaacagctc

SEQ ID NO: 9324706 - DNA, 22 bp, Homo sapiens
cccctgggtccaggcttctctg

SEQ ID NO: 9324707 - DNA, 22 bp, Homo sapiens
ccctgaggagagcgcttcccga

SEQ ID NO: 9324708 - DNA, 21 bp, Homo sapiens
aggggaagtagagttttgatt

SEQ ID NO: 9324709 - DNA, 22 bp, Homo sapiens
aggggaagagccctttacatgg

SEQ ID NO: 9324710 - DNA, 22 bp, Homo sapiens
aggggaagattatacttttgaa

SEQ ID NO: 9324711 - DNA, 18 bp, Homo sapiens
cctcagggagatccagtg

SEQ ID NO: 9324712 - DNA, 22 bp, Homo sapiens
cctactctgagcgcctccgcat

SEQ ID NO: 9324713 - DNA, 22 bp, Homo sapiens
cgggctcagcccggcccctcgc

SEQ ID NO: 9324714 - DNA, 21 bp, Homo sapiens
cctgccaggaaactgagtgtc

SEQ ID NO: 9324715 - DNA, 22 bp, Homo sapiens
cctgccagatcccctgagctga

SEQ ID NO: 9324716 - DNA, 22 bp, Homo sapiens
ctcctagatgtcttcagagaaa

SEQ ID NO: 9324717 - DNA, 22 bp, Homo sapiens
ctccagggaaaggggcgtccgc

SEQ ID NO: 9324718 - DNA, 22 bp, Homo sapiens
ctccctcagaggagcacctgtt

SEQ ID NO: 9324719 - DNA, 19 bp, Homo sapiens
ctctgcatatgtgaggata

SEQ ID NO: 9324720 - DNA, 22 bp, Homo sapiens
ctctggggaagcagccagctgg

SEQ ID NO: 9324721 - DNA, 22 bp, Homo sapiens
cttcctcacggtgcaacaggaa

SEQ ID NO: 9324722 - DNA, 22 bp, Homo sapiens
cttcctcaggcattagctggac

SEQ ID NO: 9324723 - DNA, 22 bp, Homo sapiens
atcctgggctgcaccctcagcc

SEQ ID NO: 9324724 - DNA, 22 bp, Homo sapiens
atcctgggcagtgtgtcactct

SEQ ID NO: 9324725 - DNA, 22 bp, Homo sapiens
ctggctcccctacttcttattg

SEQ ID NO: 9324726 - DNA, 22 bp, Homo sapiens
ctggctccatctttgcttcctg

SEQ ID NO: 9324727 - DNA, 22 bp, Homo sapiens
ctggcccattgccttctctctc

SEQ ID NO: 9324728 - DNA, 22 bp, Homo sapiens
ctgcaaggctggggtgagctgg

SEQ ID NO: 9324729 - DNA, 22 bp, Homo sapiens
ctttccaggaatcctcacagcc

SEQ ID NO: 9324730 - DNA, 22 bp, Homo sapiens
gaggagaagggcacggagaaaa

SEQ ID NO: 9324731 - DNA, 22 bp, Homo sapiens
gaggagaagctaagaaacacag

SEQ ID NO: 9324732 - DNA, 22 bp, Homo sapiens
gagatggggaataggagcaagc

SEQ ID NO: 9324733 - DNA, 22 bp, Homo sapiens
gccaggtgagaggactgaggct

SEQ ID NO: 9324734 - DNA, 21 bp, Homo sapiens
gcctagggagatgggactgcc

SEQ ID NO: 9324735 - DNA, 22 bp, Homo sapiens
caaaatgatgtgattttattgt

SEQ ID NO: 9324736 - DNA, 22 bp, Homo sapiens
cagcagctgcgtgcccaggccg

SEQ ID NO: 9324737 - DNA, 22 bp, Homo sapiens
gtcccaggcaggccactggcag

SEQ ID NO: 9324738 - DNA, 22 bp, Homo sapiens
cacctgggctttctctgggact

SEQ ID NO: 9324739 - DNA, 22 bp, Homo sapiens
cacctgggtcattgctggtgtt

SEQ ID NO: 9324740 - DNA, 22 bp, Homo sapiens
cagaaaggtatgtgtgcctttg

SEQ ID NO: 9324741 - DNA, 22 bp, Homo sapiens
ggaaggggagctggaaagggta

SEQ ID NO: 9324742 - DNA, 22 bp, Homo sapiens
atcctgggaagtggcctcctcc

SEQ ID NO: 9324743 - DNA, 21 bp, Homo sapiens
aggtgcaggcctcaagcccca

SEQ ID NO: 9324744 - DNA, 22 bp, Homo sapiens
actggtcctctgccagcagctg

SEQ ID NO: 9324745 - DNA, 22 bp, Homo sapiens
acagtgagatccaagggcaggc

SEQ ID NO: 9324746 - DNA, 22 bp, Homo sapiens
aggggagcttgaggcatggcct

SEQ ID NO: 9324747 - DNA, 22 bp, Homo sapiens
aggggagcccctggtcctggtg

SEQ ID NO: 9324748 - DNA, 22 bp, Homo sapiens
agggccagtcgtgtattactgt

SEQ ID NO: 9324749 - DNA, 22 bp, Homo sapiens
agggccagttcagaggacatgg

SEQ ID NO: 9324750 - DNA, 22 bp, Homo sapiens
agggccagcccataatgccaaa

SEQ ID NO: 9324751 - DNA, 22 bp, Homo sapiens
agggccagcactcctggcagga

SEQ ID NO: 9324752 - DNA, 22 bp, Homo sapiens
aggctccagtctcctctggcag

SEQ ID NO: 9324753 - DNA, 22 bp, Homo sapiens
aggctctctctgccagccgtgc

SEQ ID NO: 9324754 - DNA, 22 bp, Homo sapiens
aggctctcctccccaggaccat

SEQ ID NO: 9324755 - DNA, 22 bp, Homo sapiens
aggctctccagagagctgcttt

SEQ ID NO: 9324756 - DNA, 22 bp, Homo sapiens
aggctctcaatatgatccagtc

SEQ ID NO: 9324757 - DNA, 22 bp, Homo sapiens
cacatgtcccctctaggggctt

SEQ ID NO: 9324758 - DNA, 19 bp, Homo sapiens
agcaggctaggctgcctct

SEQ ID NO: 9324759 - DNA, 18 bp, Homo sapiens
actgcaggagaggtgagg

SEQ ID NO: 9324760 - DNA, 22 bp, Homo sapiens
tccagggctcattccctctgca

SEQ ID NO: 9324761 - DNA, 20 bp, Homo sapiens
tccagggctagggagctcat

SEQ ID NO: 9324762 - DNA, 22 bp, Homo sapiens
tccagggctacaaggcaccaga

SEQ ID NO: 9324763 - DNA, 22 bp, Homo sapiens
tccagggccagtccttgtctgt

SEQ ID NO: 9324764 - DNA, 20 bp, Homo sapiens
tccagggccctggctcctct

SEQ ID NO: 9324765 - DNA, 22 bp, Homo sapiens
tccatgcaaacagtggctagct

SEQ ID NO: 9324766 - DNA, 22 bp, Homo sapiens
tccatgcagcagcctcccagcc

SEQ ID NO: 9324767 - DNA, 22 bp, Homo sapiens
tccaggagtgtgtgctaatggg

SEQ ID NO: 9324768 - DNA, 22 bp, Homo sapiens
tccaggagtgataaggccactg

SEQ ID NO: 9324769 - DNA, 22 bp, Homo sapiens
tccaggagggttttctgccttc

SEQ ID NO: 9324770 - DNA, 22 bp, Homo sapiens
tccccaggggcatctctctgct

SEQ ID NO: 9324771 - DNA, 22 bp, Homo sapiens
tcccatgtaagaaggagacagg

SEQ ID NO: 9324772 - DNA, 22 bp, Homo sapiens
tcccatgtgactcagctgcctg

SEQ ID NO: 9324773 - DNA, 22 bp, Homo sapiens
tcccagtttttctccactaagg

SEQ ID NO: 9324774 - DNA, 22 bp, Homo sapiens
tagggatgacgaaaggacagag

SEQ ID NO: 9324775 - DNA, 22 bp, Homo sapiens
tagggagatgcaagggacggag

SEQ ID NO: 9324776 - DNA, 22 bp, Homo sapiens
gtgctccctccttcctcaagga

SEQ ID NO: 9324777 - DNA, 22 bp, Homo sapiens
gtgcactggagttcgtacagat

SEQ ID NO: 9324778 - DNA, 22 bp, Homo sapiens
gtcccccacacttccatgtcac

SEQ ID NO: 9324779 - DNA, 22 bp, Homo sapiens
gggagaggttacccgagcaact

SEQ ID NO: 9324780 - DNA, 22 bp, Homo sapiens
gggcacagcccagtggggtccc

SEQ ID NO: 9324781 - DNA, 22 bp, Homo sapiens
gggcagctgtcttggttctcaa

SEQ ID NO: 9324782 - DNA, 22 bp, Homo sapiens
ggctgggctccgggagcatgcg

SEQ ID NO: 9324783 - DNA, 23 bp, Homo sapiens
ggagccagcctgtggggagcggg

SEQ ID NO: 9324784 - DNA, 22 bp, Homo sapiens
ggagccagagcactggggagcc

SEQ ID NO: 9324785 - DNA, 22 bp, Homo sapiens
ggccagggggcttcagactcca

SEQ ID NO: 9324786 - DNA, 22 bp, Homo sapiens
ggccagggcctggggactgtcc

SEQ ID NO: 9324787 - DNA, 22 bp, Homo sapiens
ggcctctgttctgcattcctcc

SEQ ID NO: 9324788 - DNA, 22 bp, Homo sapiens
gcatgcagagtccctctgcatt

SEQ ID NO: 9324789 - DNA, 22 bp, Homo sapiens
gcagggcttgcagcagctagac

SEQ ID NO: 9324790 - DNA, 22 bp, Homo sapiens
gcagggctggggctgctcctga

SEQ ID NO: 9324791 - DNA, 22 bp, Homo sapiens
gcagggctgggtcctgtctcat

SEQ ID NO: 9324792 - DNA, 20 bp, Homo sapiens
gcagcctcaacaggcacagc

SEQ ID NO: 9324793 - DNA, 22 bp, Homo sapiens
gctgccctacccgaggcactct

SEQ ID NO: 9324794 - DNA, 22 bp, Homo sapiens
gctgccctaatatcacatgtta

SEQ ID NO: 9324795 - DNA, 22 bp, Homo sapiens
gctgccctgtttagccagggtt

SEQ ID NO: 9324796 - DNA, 22 bp, Homo sapiens
cttgccaggatcagagtcacag

SEQ ID NO: 9324797 - DNA, 22 bp, Homo sapiens
ctgtggccagtcccacacctcc

SEQ ID NO: 9324798 - DNA, 19 bp, Homo sapiens
ctggccaggccaggggccc

SEQ ID NO: 9324799 - DNA, 22 bp, Homo sapiens
ctggggcccatcgagggctgag

SEQ ID NO: 9324800 - DNA, 22 bp, Homo sapiens
gagaatgatgatttccaatttc

SEQ ID NO: 9324801 - DNA, 22 bp, Homo sapiens
ctctccaggagctcagagtcta

SEQ ID NO: 9324802 - DNA, 22 bp, Homo sapiens
ctctccaggcgaggtcctactg

SEQ ID NO: 9324803 - DNA, 22 bp, Homo sapiens
ctctccaggctgggacaggacc

SEQ ID NO: 9324804 - DNA, 22 bp, Homo sapiens
ctctccaggggtagatgccttc

SEQ ID NO: 9324805 - DNA, 22 bp, Homo sapiens
ctctccagggcatgagttccac

SEQ ID NO: 9324806 - DNA, 22 bp, Homo sapiens
ctctccaggttagagcacttat

SEQ ID NO: 9324807 - DNA, 23 bp, Homo sapiens
ctccccagtgtcctcatgcatct

SEQ ID NO: 9324808 - DNA, 18 bp, Homo sapiens
ctcctccacagcccctgc

SEQ ID NO: 9324809 - DNA, 22 bp, Homo sapiens
ctcctccacagacctactgaat

SEQ ID NO: 9324810 - DNA, 22 bp, Homo sapiens
ctcctccagtgggtccctcagg

SEQ ID NO: 9324811 - DNA, 22 bp, Homo sapiens
ctcccaggccatgctctagcca

SEQ ID NO: 9324812 - DNA, 22 bp, Homo sapiens
ctcccaggcagggctgcccact

SEQ ID NO: 9324813 - DNA, 22 bp, Homo sapiens
ctcccaggcacagggaggagcc

SEQ ID NO: 9324814 - DNA, 22 bp, Homo sapiens
ctcccaggactggctctaactg

SEQ ID NO: 9324815 - DNA, 22 bp, Homo sapiens
ctcccaggactcagaggagaag

SEQ ID NO: 9324816 - DNA, 22 bp, Homo sapiens
ctccaagggtcttccaccagga

SEQ ID NO: 9324817 - DNA, 22 bp, Homo sapiens
ctctgccagccaaagtcatcac

SEQ ID NO: 9324818 - DNA, 22 bp, Homo sapiens
ctctgccatctcactgggtcct

SEQ ID NO: 9324819 - DNA, 22 bp, Homo sapiens
ctgcacaggggatgagggcagt

SEQ ID NO: 9324820 - DNA, 22 bp, Homo sapiens
ctgcacagtgggtggggcgtca

SEQ ID NO: 9324821 - DNA, 22 bp, Homo sapiens
ctgcacagcctgtctgggggcc

SEQ ID NO: 9324822 - DNA, 22 bp, Homo sapiens
ctgcacagctggccagggagag

SEQ ID NO: 9324823 - DNA, 22 bp, Homo sapiens
ctgcacagggatatggggagct

SEQ ID NO: 9324824 - DNA, 22 bp, Homo sapiens
ctgcacagagcagggcagacac

SEQ ID NO: 9324825 - DNA, 22 bp, Homo sapiens
ctgcactgagaccctctttgct

SEQ ID NO: 9324826 - DNA, 20 bp, Homo sapiens
ctgcactgaacatgtctgag

SEQ ID NO: 9324827 - DNA, 22 bp, Homo sapiens
ctgcactgaagaaaggagctct

SEQ ID NO: 9324828 - DNA, 18 bp, Homo sapiens
ctgcactcccgcctgggc

SEQ ID NO: 9324829 - DNA, 18 bp, Homo sapiens
ctgcactgtgggtagctc

SEQ ID NO: 9324830 - DNA, 22 bp, Homo sapiens
ctgcactgtgtattccttggct

SEQ ID NO: 9324831 - DNA, 21 bp, Homo sapiens
ccttctccacagggtctccgg

SEQ ID NO: 9324832 - DNA, 22 bp, Homo sapiens
cctgggagtgtgccatctctgt

SEQ ID NO: 9324833 - DNA, 22 bp, Homo sapiens
cctgggagtggcactcacagca

SEQ ID NO: 9324834 - DNA, 19 bp, Homo sapiens
tcctggggaggggcatggc

SEQ ID NO: 9324835 - DNA, 22 bp, Homo sapiens
tccttcctgcaggccaagtcct

SEQ ID NO: 9324836 - DNA, 22 bp, Homo sapiens
tccctctccctattgcctggag

SEQ ID NO: 9324837 - DNA, 22 bp, Homo sapiens
tccctgggtcctgcttgctctc

SEQ ID NO: 9324838 - DNA, 22 bp, Homo sapiens
tccctgggtcattctctggcac

SEQ ID NO: 9324839 - DNA, 20 bp, Homo sapiens
tccctggggccctacttcct

SEQ ID NO: 9324840 - DNA, 22 bp, Homo sapiens
tccaggagatacactgcaccag

SEQ ID NO: 9324841 - DNA, 22 bp, Homo sapiens
ccagctgctctcttctccgcca

SEQ ID NO: 9324842 - DNA, 20 bp, Homo sapiens
tctggtccaggtcttcatgg

SEQ ID NO: 9324843 - DNA, 22 bp, Homo sapiens
tctggtccccattccaggtggg

SEQ ID NO: 9324844 - DNA, 22 bp, Homo sapiens
tctggtccctgtgtcacctctc

SEQ ID NO: 9324845 - DNA, 22 bp, Homo sapiens
tctggtccctgctcacttcttg

SEQ ID NO: 9324846 - DNA, 22 bp, Homo sapiens
ccagtctcttccctcctgccag

SEQ ID NO: 9324847 - DNA, 22 bp, Homo sapiens
ccaggtgctcttgccagggctg

SEQ ID NO: 9324848 - DNA, 22 bp, Homo sapiens
ccaggtgctgaccggtcagatt

SEQ ID NO: 9324849 - DNA, 20 bp, Homo sapiens
cctctgcctttctagtctga

SEQ ID NO: 9324850 - DNA, 22 bp, Homo sapiens
cccttctctttcactcactatt

SEQ ID NO: 9324851 - DNA, 22 bp, Homo sapiens
ccctctcctggctgcatggagc

SEQ ID NO: 9324852 - DNA, 22 bp, Homo sapiens
ccctctccctgcagaatgtggc

SEQ ID NO: 9324853 - DNA, 23 bp, Homo sapiens
cccagggacacgatgacacctcc

SEQ ID NO: 9324854 - DNA, 22 bp, Homo sapiens
tcccctctggttgacccaggag

SEQ ID NO: 9324855 - DNA, 22 bp, Homo sapiens
aggagggagcttaagccaggca

SEQ ID NO: 9324856 - DNA, 19 bp, Homo sapiens
aggagaagtagcagaaatt

SEQ ID NO: 9324857 - DNA, 22 bp, Homo sapiens
aggagaagtaaggctagatgat

SEQ ID NO: 9324858 - DNA, 22 bp, Homo sapiens
caggaagagaacatggaggctg

SEQ ID NO: 9324859 - DNA, 22 bp, Homo sapiens
caggaggacatactggctcaca

SEQ ID NO: 9324860 - DNA, 16 bp, Homo sapiens
agggccagaagcatca

SEQ ID NO: 9324861 - DNA, 22 bp, Homo sapiens
cctgaggacacacgctgcagga

SEQ ID NO: 9324862 - DNA, 22 bp, Homo sapiens
cctgaggacatcagcatcacct

SEQ ID NO: 9324863 - DNA, 22 bp, Homo sapiens
cctgaggatattcaccagcatg

SEQ ID NO: 9324864 - DNA, 22 bp, Homo sapiens
cctgaggaggtgaagtctccat

SEQ ID NO: 9324865 - DNA, 22 bp, Homo sapiens
agggagaagagaacaaagccct

SEQ ID NO: 9324866 - DNA, 22 bp, Homo sapiens
aggcttcttgcttccaaatgca

SEQ ID NO: 9324867 - DNA, 22 bp, Homo sapiens
aggcaggggagctggaagggta

SEQ ID NO: 9324868 - DNA, 22 bp, Homo sapiens
ccatgcacaccagcaggcagac

SEQ ID NO: 9324869 - DNA, 22 bp, Homo sapiens
cctggtccttacgtcattgctt

SEQ ID NO: 9324870 - DNA, 22 bp, Homo sapiens
cctggtcccattgcggctgcct

SEQ ID NO: 9324871 - DNA, 22 bp, Homo sapiens
cctggctcagcagctctttctc

SEQ ID NO: 9324872 - DNA, 22 bp, Homo sapiens
ctccagggagctgcgggagcca

SEQ ID NO: 9324873 - DNA, 22 bp, Homo sapiens
ctcccagggtagggagagacta

SEQ ID NO: 9324874 - DNA, 22 bp, Homo sapiens
ctcccagggtctaggctgctgg

SEQ ID NO: 9324875 - DNA, 22 bp, Homo sapiens
ctcccaggtgtcccttctgcca

SEQ ID NO: 9324876 - DNA, 22 bp, Homo sapiens
ctcccaggttacatctgagcct

SEQ ID NO: 9324877 - DNA, 22 bp, Homo sapiens
ctgccctggtcccatggctgat

SEQ ID NO: 9324878 - DNA, 22 bp, Homo sapiens
atctccagcagtgcttttgagc

SEQ ID NO: 9324879 - DNA, 22 bp, Homo sapiens
ctgtccagcttggctcctgggg

SEQ ID NO: 9324880 - DNA, 22 bp, Homo sapiens
ctgtccagcacatgtctgcccc

SEQ ID NO: 9324881 - DNA, 22 bp, Homo sapiens
ggcaaggggtcaggctgagaca

SEQ ID NO: 9324882 - DNA, 22 bp, Homo sapiens
cactgcactccagcctgggcaa

SEQ ID NO: 9324883 - DNA, 22 bp, Homo sapiens
ggccagggaggagaggcccctg

SEQ ID NO: 9324884 - DNA, 22 bp, Homo sapiens
cacctgggctttctctggaact

SEQ ID NO: 9324885 - DNA, 22 bp, Homo sapiens
gctgccctgtctgcagcaggac

SEQ ID NO: 9324886 - DNA, 22 bp, Homo sapiens
gctgccctgacaagctactccc

SEQ ID NO: 9324887 - DNA, 22 bp, Homo sapiens
gctgccctcccagggcaagctt

SEQ ID NO: 9324888 - DNA, 22 bp, Homo sapiens
gctgggcttgtggccagctggg

SEQ ID NO: 9324889 - DNA, 22 bp, Homo sapiens
gctggggagctagacctcagca

SEQ ID NO: 9324890 - DNA, 22 bp, Homo sapiens
atgcaggttgtatctgaagcca

SEQ ID NO: 9324891 - DNA, 19 bp, Homo sapiens
atgagctggcatttcaggt

SEQ ID NO: 9324892 - DNA, 22 bp, Homo sapiens
gaatttcctctaaacccctgag

SEQ ID NO: 9324893 - DNA, 22 bp, Homo sapiens
cttctccctggcttctgcacac

SEQ ID NO: 9324894 - DNA, 22 bp, Homo sapiens
gccatctgctgctctccagtgt

SEQ ID NO: 9324895 - DNA, 22 bp, Homo sapiens
gctcccagggacactggccact

SEQ ID NO: 9324896 - DNA, 22 bp, Homo sapiens
gctcccaggatgaggagccagg

SEQ ID NO: 9324897 - DNA, 21 bp, Homo sapiens
acactgcaggtgaagtgcact

SEQ ID NO: 9324898 - DNA, 22 bp, Homo sapiens
acactgcatttcaacaaggccc

SEQ ID NO: 9324899 - DNA, 22 bp, Homo sapiens
acactgcagcatcagctacgga

SEQ ID NO: 9324900 - DNA, 22 bp, Homo sapiens
acctgccaagcatcagtggcag

SEQ ID NO: 9324901 - DNA, 22 bp, Homo sapiens
acctgaggcctccccagcagac

SEQ ID NO: 9324902 - DNA, 22 bp, Homo sapiens
agtcccagtgacttggccagaa

SEQ ID NO: 9324903 - DNA, 22 bp, Homo sapiens
agtcccagtgagatgagccacg

SEQ ID NO: 9324904 - DNA, 22 bp, Homo sapiens
acagtccccataccacctgtcc

SEQ ID NO: 9324905 - DNA, 22 bp, Homo sapiens
aggaagaacctaagaaagtctc

SEQ ID NO: 9324906 - DNA, 22 bp, Homo sapiens
aggccagggcactgctctttag

SEQ ID NO: 9324907 - DNA, 22 bp, Homo sapiens
aggccagggtcccacactcgca

SEQ ID NO: 9324908 - DNA, 22 bp, Homo sapiens
aggcctctgttccccatgtttt

SEQ ID NO: 9324909 - DNA, 18 bp, Homo sapiens
aggcctctgtgtgcccag

SEQ ID NO: 9324910 - DNA, 22 bp, Homo sapiens
aggcctcttgtcttcctcacat

SEQ ID NO: 9324911 - DNA, 22 bp, Homo sapiens
accagctcagaagccagaaaga

SEQ ID NO: 9324912 - DNA, 22 bp, Homo sapiens
agggggaggctgtgctgcgtct

SEQ ID NO: 9324913 - DNA, 22 bp, Homo sapiens
atgcactgggtgaggaaggaga

SEQ ID NO: 9324914 - DNA, 22 bp, Homo sapiens
agaggaagctgagatgcctctt

SEQ ID NO: 9324915 - DNA, 20 bp, Homo sapiens
agcctctgcccttcccactg

SEQ ID NO: 9324916 - DNA, 22 bp, Homo sapiens
cagcagctcaggctgcttccca

SEQ ID NO: 9324917 - DNA, 22 bp, Homo sapiens
agcaggctccaggctggccatc

SEQ ID NO: 9324918 - DNA, 22 bp, Homo sapiens
agcaggctccttccttctctgg

SEQ ID NO: 9324919 - DNA, 22 bp, Homo sapiens
agcaggctgatgggcatgcttg

SEQ ID NO: 9324920 - DNA, 22 bp, Homo sapiens
agcaggggctcctccacagcca

SEQ ID NO: 9324921 - DNA, 23 bp, Homo sapiens
agcaggctgcttctccacagctg

SEQ ID NO: 9324922 - DNA, 22 bp, Homo sapiens
gtgccaggcccagggagcgggg

SEQ ID NO: 9324923 - DNA, 22 bp, Homo sapiens
gtgccagggagtggaggagctt

SEQ ID NO: 9324924 - DNA, 20 bp, Homo sapiens
gtgccaggcaagacaggtgg

SEQ ID NO: 9324925 - DNA, 18 bp, Homo sapiens
gtgccaggaggcgcagcc

SEQ ID NO: 9324926 - DNA, 22 bp, Homo sapiens
gtctccagggctgctggcgcct

SEQ ID NO: 9324927 - DNA, 22 bp, Homo sapiens
gtcaccctcacggggactcctt

SEQ ID NO: 9324928 - DNA, 22 bp, Homo sapiens
gtcacctgtgccacatactggg

SEQ ID NO: 9324929 - DNA, 22 bp, Homo sapiens
ggggccagtaggagtgatgtac

SEQ ID NO: 9324930 - DNA, 22 bp, Homo sapiens
ggggccagcaatgttgaggaat

SEQ ID NO: 9324931 - DNA, 22 bp, Homo sapiens
gggcttctccctaaggactctg

SEQ ID NO: 9324932 - DNA, 22 bp, Homo sapiens
ggtcccaggaatctgtgttcta

SEQ ID NO: 9324933 - DNA, 22 bp, Homo sapiens
ggtcccagtcctctccctgcta

SEQ ID NO: 9324934 - DNA, 22 bp, Homo sapiens
ggcacctgtctgctcacagtga

SEQ ID NO: 9324935 - DNA, 22 bp, Homo sapiens
ggcacctggtaagtgctcagta

SEQ ID NO: 9324936 - DNA, 22 bp, Homo sapiens
ggcacctgatgactgcttccct

SEQ ID NO: 9324937 - DNA, 22 bp, Homo sapiens
ggctcactgcaacttccgcctc

SEQ ID NO: 9324938 - DNA, 22 bp, Homo sapiens
ggctcaccatggcctccctgct

SEQ ID NO: 9324939 - DNA, 22 bp, Homo sapiens
ggctcaccattttcactctctg

SEQ ID NO: 9324940 - DNA, 18 bp, Homo sapiens
gggctcacacaggtcatc

SEQ ID NO: 9324941 - DNA, 22 bp, Homo sapiens
gccaccctgacgccgcagaccc

SEQ ID NO: 9324942 - DNA, 22 bp, Homo sapiens
gcaaggagcctggaggtgagtg

SEQ ID NO: 9324943 - DNA, 17 bp, Homo sapiens
gcagccagtgcagcagg

SEQ ID NO: 9324944 - DNA, 22 bp, Homo sapiens
gcaggtgaatgatggactagga

SEQ ID NO: 9324945 - DNA, 20 bp, Homo sapiens
gctcagggcctgggtctgga

SEQ ID NO: 9324946 - DNA, 22 bp, Homo sapiens
gctcagggagagagggcagccg

SEQ ID NO: 9324947 - DNA, 22 bp, Homo sapiens
gctcccagatttcagccttgtg

SEQ ID NO: 9324948 - DNA, 22 bp, Homo sapiens
gctcagggcgcgagggacgtgg

SEQ ID NO: 9324949 - DNA, 22 bp, Homo sapiens
gctctccaggtctcatgcactg

SEQ ID NO: 9324950 - DNA, 22 bp, Homo sapiens
gctcccagcattgcttcccagg

SEQ ID NO: 9324951 - DNA, 20 bp, Homo sapiens
gctcccagcctgcagtcccc

SEQ ID NO: 9324952 - DNA, 22 bp, Homo sapiens
gctcccagctggagcctcaaca

SEQ ID NO: 9324953 - DNA, 22 bp, Homo sapiens
gctccccaggctggtcccctcg

SEQ ID NO: 9324954 - DNA, 22 bp, Homo sapiens
ggagccagggaagctgcttcct

SEQ ID NO: 9324955 - DNA, 22 bp, Homo sapiens
ggagccaggcatatcggggcac

SEQ ID NO: 9324956 - DNA, 22 bp, Homo sapiens
gctggtccattggcactgctca

SEQ ID NO: 9324957 - DNA, 22 bp, Homo sapiens
gctggtccagggcctctgtggg

SEQ ID NO: 9324958 - DNA, 22 bp, Homo sapiens
gctgtttcggcctcctggggaa

SEQ ID NO: 9324959 - DNA, 22 bp, Homo sapiens
tccaaggacgctggacccctgc

SEQ ID NO: 9324960 - DNA, 22 bp, Homo sapiens
tccaaggagcagatccagagga

SEQ ID NO: 9324961 - DNA, 22 bp, Homo sapiens
tccctcagatgagctcctagca

SEQ ID NO: 9324962 - DNA, 20 bp, Homo sapiens
tcccaggctccaccctagac

SEQ ID NO: 9324963 - DNA, 22 bp, Homo sapiens
tccctcagcttgtctccatgca

SEQ ID NO: 9324964 - DNA, 22 bp, Homo sapiens
tcctagggattcaacactgaac

SEQ ID NO: 9324965 - DNA, 22 bp, Homo sapiens
tccctgggaccggcagctcaca

SEQ ID NO: 9324966 - DNA, 22 bp, Homo sapiens
gacctgggtaaggggctgacaa

SEQ ID NO: 9324967 - DNA, 22 bp, Homo sapiens
gagaaggaagttgagccagcat

SEQ ID NO: 9324968 - DNA, 18 bp, Homo sapiens
ctgtcccatcctcaggtt

SEQ ID NO: 9324969 - DNA, 22 bp, Homo sapiens
ctgtcccagtgatcctgagtgc

SEQ ID NO: 9324970 - DNA, 22 bp, Homo sapiens
ctgtcccatactatctgggtga

SEQ ID NO: 9324971 - DNA, 22 bp, Homo sapiens
ctgtcccatccttactctaccc

SEQ ID NO: 9324972 - DNA, 22 bp, Homo sapiens
ctgtcccagccccgtactctaa

SEQ ID NO: 9324973 - DNA, 19 bp, Homo sapiens
ctgtcccagactctgctct

SEQ ID NO: 9324974 - DNA, 22 bp, Homo sapiens
ctggtaggggtgactgttatcg

SEQ ID NO: 9324975 - DNA, 23 bp, Homo sapiens
cggggccagggtcaggaccggtc

SEQ ID NO: 9324976 - DNA, 22 bp, Homo sapiens
ccttttgctctcccatccagaa

SEQ ID NO: 9324977 - DNA, 22 bp, Homo sapiens
ctcacctgggtcagacagttgt

SEQ ID NO: 9324978 - DNA, 22 bp, Homo sapiens
ctcacctgcaatcccttccagg

SEQ ID NO: 9324979 - DNA, 22 bp, Homo sapiens
ctcaggagtagttcagcagctg

SEQ ID NO: 9324980 - DNA, 22 bp, Homo sapiens
ctccaggaccagggctcctgga

SEQ ID NO: 9324981 - DNA, 22 bp, Homo sapiens
ctccagagggtcagactctgag

SEQ ID NO: 9324982 - DNA, 22 bp, Homo sapiens
ctgcgcaggggtggcgccagaa

SEQ ID NO: 9324983 - DNA, 22 bp, Homo sapiens
ctcttcctttcccttgagggtg

SEQ ID NO: 9324984 - DNA, 22 bp, Homo sapiens
ctgcaggagtgaaagcaggcct

SEQ ID NO: 9324985 - DNA, 22 bp, Homo sapiens
ctgcaggactgaaagatgaggt

SEQ ID NO: 9324986 - DNA, 22 bp, Homo sapiens
ctctgcacctacacaacaggaa

SEQ ID NO: 9324987 - DNA, 22 bp, Homo sapiens
ctctgcaccttgtaggaggcaa

SEQ ID NO: 9324988 - DNA, 22 bp, Homo sapiens
ctctgtgcttatgctccatggg

SEQ ID NO: 9324989 - DNA, 22 bp, Homo sapiens
ctccaggaggttgctgcttcct

SEQ ID NO: 9324990 - DNA, 22 bp, Homo sapiens
ctccaggagctgtgtctttctt

SEQ ID NO: 9324991 - DNA, 22 bp, Homo sapiens
ctccaggagggcttcctgtgat

SEQ ID NO: 9324992 - DNA, 22 bp, Homo sapiens
ccaggctcacctggagcccctg

SEQ ID NO: 9324993 - DNA, 22 bp, Homo sapiens
cctccccatgacccggtgctgg

SEQ ID NO: 9324994 - DNA, 22 bp, Homo sapiens
tggcctcggcatccagcaagag

SEQ ID NO: 9324995 - DNA, 22 bp, Homo sapiens
cctcttctgagtgagactccct

SEQ ID NO: 9324996 - DNA, 22 bp, Homo sapiens
tgggccagcaattgctgctcag

SEQ ID NO: 9324997 - DNA, 22 bp, Homo sapiens
tgggccagaagtatgcatgttt

SEQ ID NO: 9324998 - DNA, 21 bp, Homo sapiens
tgggccagatctgagtttcta

SEQ ID NO: 9324999 - DNA, 22 bp, Homo sapiens
cctgccagacgcaccagggggc

SEQ ID NO: 9325000 - DNA, 22 bp, Homo sapiens
cctgccaggagctggtgctgca

SEQ ID NO: 9325001 - DNA, 22 bp, Homo sapiens
cctgaggcttaatctgtcccaa

SEQ ID NO: 9325002 - DNA, 22 bp, Homo sapiens
cctgagggaaggatgctaccca

SEQ ID NO: 9325003 - DNA, 22 bp, Homo sapiens
cctgagggaacatgcacccaat

SEQ ID NO: 9325004 - DNA, 22 bp, Homo sapiens
cctgaggccctggctgtgctga

SEQ ID NO: 9325005 - DNA, 22 bp, Homo sapiens
cctggagggaccctggccctgt

SEQ ID NO: 9325006 - DNA, 22 bp, Homo sapiens
cctgccaggcgagtctaggcca

SEQ ID NO: 9325007 - DNA, 22 bp, Homo sapiens
cctgccaggccagtgagcttcc

SEQ ID NO: 9325008 - DNA, 22 bp, Homo sapiens
cctgccaggctttgggcttctg

SEQ ID NO: 9325009 - DNA, 18 bp, Homo sapiens
cctgccagtctggagcag

SEQ ID NO: 9325010 - DNA, 22 bp, Homo sapiens
tccacaggtatttctccttgct

SEQ ID NO: 9325011 - DNA, 22 bp, Homo sapiens
tctccctctgtaagatcagggg

SEQ ID NO: 9325012 - DNA, 22 bp, Homo sapiens
tcctctccatgtctcacgccac

SEQ ID NO: 9325013 - DNA, 22 bp, Homo sapiens
tctcctggccgggctgtcccct

SEQ ID NO: 9325014 - DNA, 22 bp, Homo sapiens
ttggagatatcacaccttcaca

SEQ ID NO: 9325015 - DNA, 22 bp, Homo sapiens
ttctccagacaggcagagggaa

SEQ ID NO: 9325016 - DNA, 22 bp, Homo sapiens
ttctccagaccctcctgcagac

SEQ ID NO: 9325017 - DNA, 22 bp, Homo sapiens
ttctccagaccactgcctctgt

SEQ ID NO: 9325018 - DNA, 22 bp, Homo sapiens
ttctctgctacatactagggct

SEQ ID NO: 9325019 - DNA, 22 bp, Homo sapiens
cagctccccatggttcctgaag

SEQ ID NO: 9325020 - DNA, 22 bp, Homo sapiens
cagagcagcagagcttccatgg

SEQ ID NO: 9325021 - DNA, 22 bp, Homo sapiens
gggggagctgttattggcaggg

SEQ ID NO: 9325022 - DNA, 22 bp, Homo sapiens
gctggtcctcaagggcacagcc

SEQ ID NO: 9325023 - DNA, 22 bp, Homo sapiens
ggaacagcgtggggctctcctg

SEQ ID NO: 9325024 - DNA, 18 bp, Homo sapiens
ggagagtgacagagtcgt

SEQ ID NO: 9325025 - DNA, 22 bp, Homo sapiens
ggctgctcacgcagccctccct

SEQ ID NO: 9325026 - DNA, 18 bp, Homo sapiens
ggctgctcgctctccccg

SEQ ID NO: 9325027 - DNA, 22 bp, Homo sapiens
ggaggtggaggttgcagtgagc

SEQ ID NO: 9325028 - DNA, 22 bp, Homo sapiens
cacccaggacaggccagatgtg

SEQ ID NO: 9325029 - DNA, 22 bp, Homo sapiens
gaggaaggagggaaagcgcgcg

SEQ ID NO: 9325030 - DNA, 22 bp, Homo sapiens
gaggaaggaatgcagtgtatgc

SEQ ID NO: 9325031 - DNA, 22 bp, Homo sapiens
gaggaaggctaaggggcttaga

SEQ ID NO: 9325032 - DNA, 22 bp, Homo sapiens
gagcagctgagctggaatgaga

SEQ ID NO: 9325033 - DNA, 22 bp, Homo sapiens
gagcagctcgagaaggaagcag

SEQ ID NO: 9325034 - DNA, 21 bp, Homo sapiens
gccactgcactccagcctggg

SEQ ID NO: 9325035 - DNA, 22 bp, Homo sapiens
gcactcaggactctcatcagta

SEQ ID NO: 9325036 - DNA, 22 bp, Homo sapiens
gcactcagtaccaggtcactgc

SEQ ID NO: 9325037 - DNA, 22 bp, Homo sapiens
gcagccagggctaagctgggga

SEQ ID NO: 9325038 - DNA, 22 bp, Homo sapiens
gcagccaggctacagcgggctt

SEQ ID NO: 9325039 - DNA, 22 bp, Homo sapiens
gctcagggctaaggctgagggg

SEQ ID NO: 9325040 - DNA, 22 bp, Homo sapiens
gctcgcagatcacctgggggcg

SEQ ID NO: 9325041 - DNA, 22 bp, Homo sapiens
gctcggtggccagcctgaggcc

SEQ ID NO: 9325042 - DNA, 17 bp, Homo sapiens
aggtgcagaggcagagc

SEQ ID NO: 9325043 - DNA, 21 bp, Homo sapiens
aggtgcagagccagggaccag

SEQ ID NO: 9325044 - DNA, 22 bp, Homo sapiens
cctgtgggaggggcctggcgcg

SEQ ID NO: 9325045 - DNA, 22 bp, Homo sapiens
ctcaccacaccgtcggcctcct

SEQ ID NO: 9325046 - DNA, 22 bp, Homo sapiens
ctcaccacagagcctgtccagc

SEQ ID NO: 9325047 - DNA, 22 bp, Homo sapiens
ctgagctctaatgtcagccttg

SEQ ID NO: 9325048 - DNA, 22 bp, Homo sapiens
ctggtcccagctctgccaccaa

SEQ ID NO: 9325049 - DNA, 22 bp, Homo sapiens
ctggtccctggacctccctgga

SEQ ID NO: 9325050 - DNA, 22 bp, Homo sapiens
aggctagaggcttctggcttca

SEQ ID NO: 9325051 - DNA, 22 bp, Homo sapiens
ccagggctcaggctcccagtgg

SEQ ID NO: 9325052 - DNA, 22 bp, Homo sapiens
agggcgacaatggagagcgttt

SEQ ID NO: 9325053 - DNA, 22 bp, Homo sapiens
cagtgaggagtccagggcagag

SEQ ID NO: 9325054 - DNA, 22 bp, Homo sapiens
aggaagagggtggcagataatc

SEQ ID NO: 9325055 - DNA, 22 bp, Homo sapiens
agctgggcaccccgctgcgtct

SEQ ID NO: 9325056 - DNA, 22 bp, Homo sapiens
aggagacataactatgatgaga

SEQ ID NO: 9325057 - DNA, 22 bp, Homo sapiens
aggaggggttctcgggtgctga

SEQ ID NO: 9325058 - DNA, 22 bp, Homo sapiens
aggaggggcatagaaatgtaat

SEQ ID NO: 9325059 - DNA, 19 bp, Homo sapiens
accaggagtatcagagctg

SEQ ID NO: 9325060 - DNA, 22 bp, Homo sapiens
accaggaggtgtttgctcaagt

SEQ ID NO: 9325061 - DNA, 22 bp, Homo sapiens
accctgggcttggcctgctcag

SEQ ID NO: 9325062 - DNA, 22 bp, Homo sapiens
accctgggggtggccagtgcca

SEQ ID NO: 9325063 - DNA, 23 bp, Homo sapiens
accctgggcaagtcacctaacct

SEQ ID NO: 9325064 - DNA, 22 bp, Homo sapiens
agtgctctgggtccactccaga

SEQ ID NO: 9325065 - DNA, 22 bp, Homo sapiens
actgccagtcattccacaattt

SEQ ID NO: 9325066 - DNA, 22 bp, Homo sapiens
atgaagctgtttattttagcag

SEQ ID NO: 9325067 - DNA, 22 bp, Homo sapiens
atgaagctgaggttctctttga

SEQ ID NO: 9325068 - DNA, 22 bp, Homo sapiens
atgaagctactgaatatttggt

SEQ ID NO: 9325069 - DNA, 22 bp, Homo sapiens
atgaagctctaaatgtacttag

SEQ ID NO: 9325070 - DNA, 22 bp, Homo sapiens
atgcaggttgggcaagtgtggg

SEQ ID NO: 9325071 - DNA, 22 bp, Homo sapiens
atgcaggtaaccacacttcaca

SEQ ID NO: 9325072 - DNA, 17 bp, Homo sapiens
atgcaggtgtgaggggc

SEQ ID NO: 9325073 - DNA, 22 bp, Homo sapiens
atgcaggttggatcctatgccc

SEQ ID NO: 9325074 - DNA, 22 bp, Homo sapiens
attggccatttgcatgtattat

SEQ ID NO: 9325075 - DNA, 22 bp, Homo sapiens
agcagtcttgagggatgctaga

SEQ ID NO: 9325076 - DNA, 22 bp, Homo sapiens
agcatgcaggaaccacatggca

SEQ ID NO: 9325077 - DNA, 22 bp, Homo sapiens
agcagctcaacagtgtctctat

SEQ ID NO: 9325078 - DNA, 18 bp, Homo sapiens
agcctgggctctgcctgg

SEQ ID NO: 9325079 - DNA, 22 bp, Homo sapiens
acacctgggtcagtgtgacagt

SEQ ID NO: 9325080 - DNA, 21 bp, Homo sapiens
agcaggaggcagtcacagctc

SEQ ID NO: 9325081 - DNA, 20 bp, Homo sapiens
acctggggttgcctgtgctc

SEQ ID NO: 9325082 - DNA, 20 bp, Homo sapiens
acctgggaaaaccttttcct

SEQ ID NO: 9325083 - DNA, 20 bp, Homo sapiens
acctgggattagatacccaa

SEQ ID NO: 9325084 - DNA, 22 bp, Homo sapiens
aagtggctaacagtccttgcct

SEQ ID NO: 9325085 - DNA, 22 bp, Homo sapiens
gcctggggccagcttgggctga

SEQ ID NO: 9325086 - DNA, 22 bp, Homo sapiens
gcctggggaacttgatcctgtc

SEQ ID NO: 9325087 - DNA, 22 bp, Homo sapiens
gcctggggtcccttgttggcac

SEQ ID NO: 9325088 - DNA, 22 bp, Homo sapiens
gcctggggcatgcagctgatac

SEQ ID NO: 9325089 - DNA, 22 bp, Homo sapiens
gcctggggggcatgtcataata

SEQ ID NO: 9325090 - DNA, 22 bp, Homo sapiens
gcctggggtctctgactcacag

SEQ ID NO: 9325091 - DNA, 22 bp, Homo sapiens
gcgccccatctacagtactttt

SEQ ID NO: 9325092 - DNA, 22 bp, Homo sapiens
gctctccagctacccctttagc

SEQ ID NO: 9325093 - DNA, 22 bp, Homo sapiens
gctgcactttgactgctggggt

SEQ ID NO: 9325094 - DNA, 22 bp, Homo sapiens
gctgcacttgagcctgggagaa

SEQ ID NO: 9325095 - DNA, 22 bp, Homo sapiens
gcttcctcaccttctcttgcat

SEQ ID NO: 9325096 - DNA, 22 bp, Homo sapiens
gcaggctccaactggaggagtt

SEQ ID NO: 9325097 - DNA, 22 bp, Homo sapiens
gcactctgccaggtctcctgat

SEQ ID NO: 9325098 - DNA, 22 bp, Homo sapiens
gcagggctcagccgctcccacc

SEQ ID NO: 9325099 - DNA, 22 bp, Homo sapiens
gggcactctgctcccagtgttt

SEQ ID NO: 9325100 - DNA, 22 bp, Homo sapiens
gggcactcagctgtagagcagg

SEQ ID NO: 9325101 - DNA, 22 bp, Homo sapiens
ggccaggagcaagccaggctct

SEQ ID NO: 9325102 - DNA, 22 bp, Homo sapiens
ggccaggaggcaggggctcaat

SEQ ID NO: 9325103 - DNA, 22 bp, Homo sapiens
ggccaggagctgcacagggctc

SEQ ID NO: 9325104 - DNA, 22 bp, Homo sapiens
ggcatctggatctgcttctccc

SEQ ID NO: 9325105 - DNA, 22 bp, Homo sapiens
gggggccatcttcaaggatgtg

SEQ ID NO: 9325106 - DNA, 20 bp, Homo sapiens
gggggccagcagcagacgcc

SEQ ID NO: 9325107 - DNA, 22 bp, Homo sapiens
ggggcagaaagcccacagagtg

SEQ ID NO: 9325108 - DNA, 22 bp, Homo sapiens
gggctctctttttggcctgccc

SEQ ID NO: 9325109 - DNA, 19 bp, Homo sapiens
gggctctactctcagtctt

SEQ ID NO: 9325110 - DNA, 22 bp, Homo sapiens
gggctctcaaggcagggcccca

SEQ ID NO: 9325111 - DNA, 21 bp, Homo sapiens
gggctctcctgaggccatgaa

SEQ ID NO: 9325112 - DNA, 22 bp, Homo sapiens
gggctctcgattagaccctggg

SEQ ID NO: 9325113 - DNA, 20 bp, Homo sapiens
tcagccattccttacctttc

SEQ ID NO: 9325114 - DNA, 22 bp, Homo sapiens
tcaggagcagggggaagctctg

SEQ ID NO: 9325115 - DNA, 21 bp, Homo sapiens
tcacctggcttctgacctggc

SEQ ID NO: 9325116 - DNA, 22 bp, Homo sapiens
tcactggggagcactgacatgt

SEQ ID NO: 9325117 - DNA, 17 bp, Homo sapiens
tcactgggcctgctccc

SEQ ID NO: 9325118 - DNA, 22 bp, Homo sapiens
tccctgggcttctccagacttg

SEQ ID NO: 9325119 - DNA, 22 bp, Homo sapiens
tccctggggatgttggcctgcc

SEQ ID NO: 9325120 - DNA, 22 bp, Homo sapiens
tccctgggcctatcttagctcc

SEQ ID NO: 9325121 - DNA, 22 bp, Homo sapiens
tccctgggcggacattctccca

SEQ ID NO: 9325122 - DNA, 22 bp, Homo sapiens
tccctgcagtaggcagccctcc

SEQ ID NO: 9325123 - DNA, 22 bp, Homo sapiens
tccctgcatttgggagagtgtc

SEQ ID NO: 9325124 - DNA, 22 bp, Homo sapiens
tccctgggccacagctgtgagc

SEQ ID NO: 9325125 - DNA, 22 bp, Homo sapiens
tccctgggcacaatctgctggc

SEQ ID NO: 9325126 - DNA, 22 bp, Homo sapiens
tccctgggcatcacgttgcttc

SEQ ID NO: 9325127 - DNA, 22 bp, Homo sapiens
tcctcctctatcagacagtgcc

SEQ ID NO: 9325128 - DNA, 22 bp, Homo sapiens
tccactgcagcttctgatggaa

SEQ ID NO: 9325129 - DNA, 20 bp, Homo sapiens
tccactgccggaccggggtt

SEQ ID NO: 9325130 - DNA, 23 bp, Homo sapiens
tccaggagaacccctgtctgtcc

SEQ ID NO: 9325131 - DNA, 21 bp, Homo sapiens
tcccagctgggtcagtgctgc

SEQ ID NO: 9325132 - DNA, 22 bp, Homo sapiens
gttactcttgagaggctgaggt

SEQ ID NO: 9325133 - DNA, 22 bp, Homo sapiens
tacctggggctgggctttgatt

SEQ ID NO: 9325134 - DNA, 22 bp, Homo sapiens
tacctgggaagtgggacctgag

SEQ ID NO: 9325135 - DNA, 22 bp, Homo sapiens
tagatgcatagagcacagcaca

SEQ ID NO: 9325136 - DNA, 22 bp, Homo sapiens
taggaaggtgtttttaaggagc

SEQ ID NO: 9325137 - DNA, 22 bp, Homo sapiens
ccttgtcctctggtttcctgtt

SEQ ID NO: 9325138 - DNA, 22 bp, Homo sapiens
cctgctcctgctattcttctgg

SEQ ID NO: 9325139 - DNA, 22 bp, Homo sapiens
cctggggagccgcctgagcccc

SEQ ID NO: 9325140 - DNA, 22 bp, Homo sapiens
cctggggagaagagcttccccc

SEQ ID NO: 9325141 - DNA, 22 bp, Homo sapiens
cctgtggaggctgctcagctgg

SEQ ID NO: 9325142 - DNA, 17 bp, Homo sapiens
cctgtggatgacacctg

SEQ ID NO: 9325143 - DNA, 22 bp, Homo sapiens
ctaacctgcatggcagctagaa

SEQ ID NO: 9325144 - DNA, 22 bp, Homo sapiens
cggctgggttcggctgcaggcc

SEQ ID NO: 9325145 - DNA, 22 bp, Homo sapiens
ctccttcctggttagcacctta

SEQ ID NO: 9325146 - DNA, 22 bp, Homo sapiens
ctcctcagttgtcccatggaga

SEQ ID NO: 9325147 - DNA, 22 bp, Homo sapiens
ctccctggaggcccagacctgg

SEQ ID NO: 9325148 - DNA, 22 bp, Homo sapiens
ctcccttcaggagaggctcaca

SEQ ID NO: 9325149 - DNA, 22 bp, Homo sapiens
ctccctggtctttcccatcatt

SEQ ID NO: 9325150 - DNA, 22 bp, Homo sapiens
ctccctggtgactcccaaagct

SEQ ID NO: 9325151 - DNA, 22 bp, Homo sapiens
ctccctggtgtcccctccagga

SEQ ID NO: 9325152 - DNA, 22 bp, Homo sapiens
ctccccaccttcgcggtccctg

SEQ ID NO: 9325153 - DNA, 22 bp, Homo sapiens
ctcccagggccatcgagtcact

SEQ ID NO: 9325154 - DNA, 22 bp, Homo sapiens
ctgcaggttaggagcactcctt

SEQ ID NO: 9325155 - DNA, 22 bp, Homo sapiens
ctgcagtgaaatcaggaagcaa

SEQ ID NO: 9325156 - DNA, 22 bp, Homo sapiens
ctgccctgagggcctgtgtgtt

SEQ ID NO: 9325157 - DNA, 22 bp, Homo sapiens
ctgccctgggagtacctgtcct

SEQ ID NO: 9325158 - DNA, 20 bp, Homo sapiens
ctgctccacccggctctcag

SEQ ID NO: 9325159 - DNA, 22 bp, Homo sapiens
gactgccagaatgtgaggcctg

SEQ ID NO: 9325160 - DNA, 21 bp, Homo sapiens
gagcatctccttcctcctgct

SEQ ID NO: 9325161 - DNA, 22 bp, Homo sapiens
ctgggcacttgctcacagctct

SEQ ID NO: 9325162 - DNA, 22 bp, Homo sapiens
ctgggcactttggggagcctac

SEQ ID NO: 9325163 - DNA, 22 bp, Homo sapiens
ctggggactttggttctccatg

SEQ ID NO: 9325164 - DNA, 22 bp, Homo sapiens
ctggggaccagtgtctgtttgt

SEQ ID NO: 9325165 - DNA, 22 bp, Homo sapiens
ctggggaccgagcaagctctgg

SEQ ID NO: 9325166 - DNA, 22 bp, Homo sapiens
cccaaggaataggatcccagga

SEQ ID NO: 9325167 - DNA, 22 bp, Homo sapiens
cccaaggacacgggcagggaca

SEQ ID NO: 9325168 - DNA, 16 bp, Homo sapiens
cccaaggagctccagg

SEQ ID NO: 9325169 - DNA, 22 bp, Homo sapiens
tgcaggaattttttgcagaaag

SEQ ID NO: 9325170 - DNA, 22 bp, Homo sapiens
ccagggctctgcttctgccatg

SEQ ID NO: 9325171 - DNA, 22 bp, Homo sapiens
tcttgcacttcatgaatatgtt

SEQ ID NO: 9325172 - DNA, 22 bp, Homo sapiens
ccaggagcctgggccaggctgg

SEQ ID NO: 9325173 - DNA, 22 bp, Homo sapiens
ccaggagcaggagctgcagctg

SEQ ID NO: 9325174 - DNA, 22 bp, Homo sapiens
ccaggagcaccaggcctgtgcc

SEQ ID NO: 9325175 - DNA, 22 bp, Homo sapiens
cccagtggctgtccccatgggc

SEQ ID NO: 9325176 - DNA, 22 bp, Homo sapiens
cctgcagggaatcgaggcagaa

SEQ ID NO: 9325177 - DNA, 22 bp, Homo sapiens
cctctccagcggcctcagggcc

SEQ ID NO: 9325178 - DNA, 22 bp, Homo sapiens
cctctccagttttaacgtgacc

SEQ ID NO: 9325179 - DNA, 22 bp, Homo sapiens
tccagggcatgctcagactcag

SEQ ID NO: 9325180 - DNA, 22 bp, Homo sapiens
tccagggcagtgactacagcgg

SEQ ID NO: 9325181 - DNA, 23 bp, Homo sapiens
cagggaggagatactgtgtatct

SEQ ID NO: 9325182 - DNA, 22 bp, Homo sapiens
cagggaggctgtcttatgcctg

SEQ ID NO: 9325183 - DNA, 22 bp, Homo sapiens
cagggagggacaattgtcacct

SEQ ID NO: 9325184 - DNA, 22 bp, Homo sapiens
ttctcctctgttaccttgcaaa

SEQ ID NO: 9325185 - DNA, 22 bp, Homo sapiens
ttctccagtcactgacttcgag

SEQ ID NO: 9325186 - DNA, 20 bp, Homo sapiens
ttctccagtgcggtagccat

SEQ ID NO: 9325187 - DNA, 22 bp, Homo sapiens
ttctccagctcatcagggaggg

SEQ ID NO: 9325188 - DNA, 19 bp, Homo sapiens
ttctccagcctgacctgag

SEQ ID NO: 9325189 - DNA, 22 bp, Homo sapiens
ttctccagcctattggcctatc

SEQ ID NO: 9325190 - DNA, 22 bp, Homo sapiens
ttctccaggcttgggccaggtc

SEQ ID NO: 9325191 - DNA, 22 bp, Homo sapiens
ttgccaggagacaaagtgggcc

SEQ ID NO: 9325192 - DNA, 22 bp, Homo sapiens
ttgccaggagacatctggagcc

SEQ ID NO: 9325193 - DNA, 22 bp, Homo sapiens
ttgccaggcttgtttctaggct

SEQ ID NO: 9325194 - DNA, 22 bp, Homo sapiens
ttgccagggaacagggagaggc

SEQ ID NO: 9325195 - DNA, 22 bp, Homo sapiens
ttgccagggtcaggatgagatc

SEQ ID NO: 9325196 - DNA, 22 bp, Homo sapiens
ttgccagggctttggtggcatc

SEQ ID NO: 9325197 - DNA, 22 bp, Homo sapiens
ttgccaggggacatctggagcc

SEQ ID NO: 9325198 - DNA, 22 bp, Homo sapiens
ccctggggctgagggatggccg

SEQ ID NO: 9325199 - DNA, 19 bp, Homo sapiens
ccctgggggtttctggtac

SEQ ID NO: 9325200 - DNA, 22 bp, Homo sapiens
cctccccacccacggctggtgg

SEQ ID NO: 9325201 - DNA, 22 bp, Homo sapiens
agggcagcctctcagcctaggt

SEQ ID NO: 9325202 - DNA, 22 bp, Homo sapiens
ccctggggagcaggcgaaggag

SEQ ID NO: 9325203 - DNA, 22 bp, Homo sapiens
agggccagggaagctgtatttt

SEQ ID NO: 9325204 - DNA, 22 bp, Homo sapiens
agggccagggaaacgatcagca

SEQ ID NO: 9325205 - DNA, 22 bp, Homo sapiens
agggccagctagagccctcgcc

SEQ ID NO: 9325206 - DNA, 22 bp, Homo sapiens
agggccagccgacttccagcct

SEQ ID NO: 9325207 - DNA, 19 bp, Homo sapiens
agggccaggattctggaac

SEQ ID NO: 9325208 - DNA, 22 bp, Homo sapiens
aggccaggaccattagcccaga

SEQ ID NO: 9325209 - DNA, 22 bp, Homo sapiens
aggccaggaatccttgtcccag

SEQ ID NO: 9325210 - DNA, 22 bp, Homo sapiens
ccaggctctatccctccttctt

SEQ ID NO: 9325211 - DNA, 22 bp, Homo sapiens
aggctccatggttctccctcag

SEQ ID NO: 9325212 - DNA, 22 bp, Homo sapiens
catgcactttgatggagagcgt

SEQ ID NO: 9325213 - DNA, 23 bp, Homo sapiens
aggagaagagatttccacatgca

SEQ ID NO: 9325214 - DNA, 21 bp, Homo sapiens
aggaggagagcttggcctacc

SEQ ID NO: 9325215 - DNA, 22 bp, Homo sapiens
caggacagacagaatgcctaac

SEQ ID NO: 9325216 - DNA, 22 bp, Homo sapiens
agtcccagatgacccagctact

SEQ ID NO: 9325217 - DNA, 22 bp, Homo sapiens
agtggctttttagtggcagatg

SEQ ID NO: 9325218 - DNA, 22 bp, Homo sapiens
ctctccatctgtgtgacctccc

SEQ ID NO: 9325219 - DNA, 22 bp, Homo sapiens
ctctccattccctacagttttc

SEQ ID NO: 9325220 - DNA, 22 bp, Homo sapiens
cctggaccaaacactggcctgg

SEQ ID NO: 9325221 - DNA, 22 bp, Homo sapiens
cctctgccacctcccacgaggc

SEQ ID NO: 9325222 - DNA, 19 bp, Homo sapiens
cctctgcatggaaacagct

SEQ ID NO: 9325223 - DNA, 22 bp, Homo sapiens
cctctgcagcagagagccagag

SEQ ID NO: 9325224 - DNA, 22 bp, Homo sapiens
ctgccaggcctcatcccagcca

SEQ ID NO: 9325225 - DNA, 22 bp, Homo sapiens
ctgccaggcagggagatggctg

SEQ ID NO: 9325226 - DNA, 22 bp, Homo sapiens
ctgccaggcagcagagggagaa

SEQ ID NO: 9325227 - DNA, 21 bp, Homo sapiens
ctgccaggatagcatgcaggc

SEQ ID NO: 9325228 - DNA, 22 bp, Homo sapiens
ctgccaggactgacgtcttcag

SEQ ID NO: 9325229 - DNA, 22 bp, Homo sapiens
ctgccaggcacgtgcagcatca

SEQ ID NO: 9325230 - DNA, 22 bp, Homo sapiens
ctgccaggcactgggctctgca

SEQ ID NO: 9325231 - DNA, 21 bp, Homo sapiens
ctgctctggggaccggctgtg

SEQ ID NO: 9325232 - DNA, 22 bp, Homo sapiens
ctgggcacagtggctcacgcct

SEQ ID NO: 9325233 - DNA, 22 bp, Homo sapiens
ctgggcacagcgttgggctctt

SEQ ID NO: 9325234 - DNA, 22 bp, Homo sapiens
ctgggtcccggcttctatccac

SEQ ID NO: 9325235 - DNA, 22 bp, Homo sapiens
cactggcattagtcacgaggca

SEQ ID NO: 9325236 - DNA, 22 bp, Homo sapiens
ggcactgggaatgcagtgatga

SEQ ID NO: 9325237 - DNA, 22 bp, Homo sapiens
ggatgttctggggttctcttgt

SEQ ID NO: 9325238 - DNA, 21 bp, Homo sapiens
cactgcagccttgacctgggc

SEQ ID NO: 9325239 - DNA, 22 bp, Homo sapiens
ggctagggatctagaccaggac

SEQ ID NO: 9325240 - DNA, 22 bp, Homo sapiens
cactgcagtaactctaggactg

SEQ ID NO: 9325241 - DNA, 22 bp, Homo sapiens
ggcatagatttctttaggttta

SEQ ID NO: 9325242 - DNA, 17 bp, Homo sapiens
caccctggctagtctga

SEQ ID NO: 9325243 - DNA, 22 bp, Homo sapiens
caccctggaatagtagttctgc

SEQ ID NO: 9325244 - DNA, 21 bp, Homo sapiens
gcctctccaaatcctgccttc

SEQ ID NO: 9325245 - DNA, 22 bp, Homo sapiens
gcctctccgagccactgcctct

SEQ ID NO: 9325246 - DNA, 22 bp, Homo sapiens
gcctctcctggagaaggcaggg

SEQ ID NO: 9325247 - DNA, 22 bp, Homo sapiens
atttattgagagggaggggaat

SEQ ID NO: 9325248 - DNA, 22 bp, Homo sapiens
gccaggagtgtgtggctatgtt

SEQ ID NO: 9325249 - DNA, 22 bp, Homo sapiens
gagaggaagccagggggtgttg

SEQ ID NO: 9325250 - DNA, 22 bp, Homo sapiens
gagctgggcctgcgagtgctgc

SEQ ID NO: 9325251 - DNA, 22 bp, Homo sapiens
agcaggagacatgggggtggtg

SEQ ID NO: 9325252 - DNA, 22 bp, Homo sapiens
cacaggaagctgactgctggca

SEQ ID NO: 9325253 - DNA, 21 bp, Homo sapiens
agctccctgtttcctcactct

SEQ ID NO: 9325254 - DNA, 22 bp, Homo sapiens
agctcccagggctgggcaagtt

SEQ ID NO: 9325255 - DNA, 22 bp, Homo sapiens
agccaggatggtctcgatcggc

SEQ ID NO: 9325256 - DNA, 22 bp, Homo sapiens
agagggagtgaaatggaataga

SEQ ID NO: 9325257 - DNA, 22 bp, Homo sapiens
acctgtgggcagaacctagtgc

SEQ ID NO: 9325258 - DNA, 22 bp, Homo sapiens
acctggagaaagcctctccctg

SEQ ID NO: 9325259 - DNA, 22 bp, Homo sapiens
aggcaggattgctgacaacaat

SEQ ID NO: 9325260 - DNA, 23 bp, Homo sapiens
agctgggcaaggatccgggctcc

SEQ ID NO: 9325261 - DNA, 22 bp, Homo sapiens
agggaagaggaccagagtctct

SEQ ID NO: 9325262 - DNA, 22 bp, Homo sapiens
actgcactccagcctgggcgac

SEQ ID NO: 9325263 - DNA, 22 bp, Homo sapiens
actgcactccagcctgggcggc

SEQ ID NO: 9325264 - DNA, 22 bp, Homo sapiens
actctccacccactcactctgt

SEQ ID NO: 9325265 - DNA, 22 bp, Homo sapiens
actctccagggatttaggatgg

SEQ ID NO: 9325266 - DNA, 22 bp, Homo sapiens
aagtctctggtgatgcaggaaa

SEQ ID NO: 9325267 - DNA, 22 bp, Homo sapiens
accgtgtctgacactttgggcg

SEQ ID NO: 9325268 - DNA, 22 bp, Homo sapiens
accctgcagggcagaggctggt

SEQ ID NO: 9325269 - DNA, 22 bp, Homo sapiens
aaggctcaaagaagctaagtga

SEQ ID NO: 9325270 - DNA, 22 bp, Homo sapiens
agaggctctggtgcagcatgca

SEQ ID NO: 9325271 - DNA, 22 bp, Homo sapiens
agaggctctaataccagcatgg

SEQ ID NO: 9325272 - DNA, 22 bp, Homo sapiens
aatgtggattcacaagtgctca

SEQ ID NO: 9325273 - DNA, 22 bp, Homo sapiens
aatgtggatgatactagtactt

SEQ ID NO: 9325274 - DNA, 17 bp, Homo sapiens
aatgtggaagtacatgc

SEQ ID NO: 9325275 - DNA, 22 bp, Homo sapiens
aatgtggacatctttgccttgt

SEQ ID NO: 9325276 - DNA, 22 bp, Homo sapiens
acactcagtaaacgacaatggg

SEQ ID NO: 9325277 - DNA, 18 bp, Homo sapiens
agcagagagtgaatggga

SEQ ID NO: 9325278 - DNA, 22 bp, Homo sapiens
aagagggctgcaatcttattgc

SEQ ID NO: 9325279 - DNA, 22 bp, Homo sapiens
gttcaagaccagcctggccaac

SEQ ID NO: 9325280 - DNA, 22 bp, Homo sapiens
ggaaggggtgggtgagcctcag

SEQ ID NO: 9325281 - DNA, 22 bp, Homo sapiens
ggagagggtgtggaaagttatc

SEQ ID NO: 9325282 - DNA, 22 bp, Homo sapiens
ggaggaagggtagcataatgta

SEQ ID NO: 9325283 - DNA, 16 bp, Homo sapiens
ggaggaaggcatagtg

SEQ ID NO: 9325284 - DNA, 22 bp, Homo sapiens
ggaggccagcctgaggctgagg

SEQ ID NO: 9325285 - DNA, 22 bp, Homo sapiens
ggcagaggaagctggaagtggg

SEQ ID NO: 9325286 - DNA, 22 bp, Homo sapiens
ggcagctggttctttccattaa

SEQ ID NO: 9325287 - DNA, 22 bp, Homo sapiens
ggagggggaagaagctaaagac

SEQ ID NO: 9325288 - DNA, 22 bp, Homo sapiens
ggagggggaattcagccccagc

SEQ ID NO: 9325289 - DNA, 20 bp, Homo sapiens
ggctcatcttgtctgctgac

SEQ ID NO: 9325290 - DNA, 22 bp, Homo sapiens
ggccatggtcatgggtgagctt

SEQ ID NO: 9325291 - DNA, 22 bp, Homo sapiens
ggctgctctgccttccagctgg

SEQ ID NO: 9325292 - DNA, 19 bp, Homo sapiens
ggctctcccttgagagagc

SEQ ID NO: 9325293 - DNA, 22 bp, Homo sapiens
gggccaggtggaccccagcctc

SEQ ID NO: 9325294 - DNA, 22 bp, Homo sapiens
gggcagcctcggtgcctgctgc

SEQ ID NO: 9325295 - DNA, 19 bp, Homo sapiens
gggcccagcatggagggtt

SEQ ID NO: 9325296 - DNA, 22 bp, Homo sapiens
gggacgagccccaggctggagg

SEQ ID NO: 9325297 - DNA, 20 bp, Homo sapiens
gccagaggccggcaggggct

SEQ ID NO: 9325298 - DNA, 22 bp, Homo sapiens
gcaggagaacaaagcaagctgc

SEQ ID NO: 9325299 - DNA, 22 bp, Homo sapiens
gatgtagacacttggaggctta

SEQ ID NO: 9325300 - DNA, 19 bp, Homo sapiens
gccatgggctggcagcaga

SEQ ID NO: 9325301 - DNA, 22 bp, Homo sapiens
gagggccaaagagcaagagcct

SEQ ID NO: 9325302 - DNA, 22 bp, Homo sapiens
gaggaagggctgcctgccgggc

SEQ ID NO: 9325303 - DNA, 22 bp, Homo sapiens
gaggaaggtcccatcagaattt

SEQ ID NO: 9325304 - DNA, 22 bp, Homo sapiens
gagctgggacatgggtcctctc

SEQ ID NO: 9325305 - DNA, 20 bp, Homo sapiens
gacaggagagttaggtaggt

SEQ ID NO: 9325306 - DNA, 22 bp, Homo sapiens
gagagctccttcaggaagcttc

SEQ ID NO: 9325307 - DNA, 18 bp, Homo sapiens
tggtgcctttcactcttc

SEQ ID NO: 9325308 - DNA, 22 bp, Homo sapiens
tgtctggtgggttgacaggcag

SEQ ID NO: 9325309 - DNA, 21 bp, Homo sapiens
cctgggagatcagctgccttc

SEQ ID NO: 9325310 - DNA, 22 bp, Homo sapiens
cctgggagccaagcctctgtgt

SEQ ID NO: 9325311 - DNA, 22 bp, Homo sapiens
cctggggaagtcacttctcttt

SEQ ID NO: 9325312 - DNA, 22 bp, Homo sapiens
cctgggtgatgtgctgccctcg

SEQ ID NO: 9325313 - DNA, 22 bp, Homo sapiens
cctgggtgaaatctctcctgca

SEQ ID NO: 9325314 - DNA, 22 bp, Homo sapiens
cctggggacctgcctcagccct

SEQ ID NO: 9325315 - DNA, 21 bp, Homo sapiens
cctgggccaaattccctggac

SEQ ID NO: 9325316 - DNA, 22 bp, Homo sapiens
tgctcccaaacgacctactgtg

SEQ ID NO: 9325317 - DNA, 23 bp, Homo sapiens
cctctccagacactgggccttgt

SEQ ID NO: 9325318 - DNA, 22 bp, Homo sapiens
cctcggggcaccgcggcctgct

SEQ ID NO: 9325319 - DNA, 22 bp, Homo sapiens
cctcggtttccacatctgtaca

SEQ ID NO: 9325320 - DNA, 22 bp, Homo sapiens
ccctccaggcactgccctcttc

SEQ ID NO: 9325321 - DNA, 22 bp, Homo sapiens
ctgccaggcctccgctgtcccc

SEQ ID NO: 9325322 - DNA, 22 bp, Homo sapiens
ctgccaggcctggggtgctgtc

SEQ ID NO: 9325323 - DNA, 22 bp, Homo sapiens
ctgccaggctgtcccaggtccg

SEQ ID NO: 9325324 - DNA, 22 bp, Homo sapiens
ctgccagggcatcctgtggtgg

SEQ ID NO: 9325325 - DNA, 22 bp, Homo sapiens
ctgccaggtgagctccaggcct

SEQ ID NO: 9325326 - DNA, 22 bp, Homo sapiens
ctgccaggttggcgctcgctct

SEQ ID NO: 9325327 - DNA, 22 bp, Homo sapiens
ctgccaggtgcctttgtgcagt

SEQ ID NO: 9325328 - DNA, 22 bp, Homo sapiens
ctgccaggtgccagggcgcggc

SEQ ID NO: 9325329 - DNA, 22 bp, Homo sapiens
ctgccatgcagttagtccctca

SEQ ID NO: 9325330 - DNA, 22 bp, Homo sapiens
ctgcctcatgctgcctgcagcc

SEQ ID NO: 9325331 - DNA, 22 bp, Homo sapiens
ctgcctggccacaacccagggt

SEQ ID NO: 9325332 - DNA, 22 bp, Homo sapiens
ctccaggggccagaagcctggc

SEQ ID NO: 9325333 - DNA, 22 bp, Homo sapiens
ctcctctccatcagcgccaccc

SEQ ID NO: 9325334 - DNA, 22 bp, Homo sapiens
ctcctgggctatgtctgcttgg

SEQ ID NO: 9325335 - DNA, 22 bp, Homo sapiens
ctctccagatctgctgagccag

SEQ ID NO: 9325336 - DNA, 22 bp, Homo sapiens
ctctccagcagatgtagtctgt

SEQ ID NO: 9325337 - DNA, 19 bp, Homo sapiens
ctctccagctccagtagct

SEQ ID NO: 9325338 - DNA, 22 bp, Homo sapiens
ctctccagcctttagcccacgc

SEQ ID NO: 9325339 - DNA, 22 bp, Homo sapiens
ctctccaggagagcactttgag

SEQ ID NO: 9325340 - DNA, 22 bp, Homo sapiens
ctctccaggactttggcccaat

SEQ ID NO: 9325341 - DNA, 22 bp, Homo sapiens
ctctccctatgcctcccaggag

SEQ ID NO: 9325342 - DNA, 20 bp, Homo sapiens
ctctcctcacccgtgtcagg

SEQ ID NO: 9325343 - DNA, 22 bp, Homo sapiens
ctctcctccaacagccctgccg

SEQ ID NO: 9325344 - DNA, 22 bp, Homo sapiens
ctctcctccaggaactcacagt

SEQ ID NO: 9325345 - DNA, 22 bp, Homo sapiens
cctgggtggctgcctgcctttc

SEQ ID NO: 9325346 - DNA, 22 bp, Homo sapiens
ttccttccgggcaccaggcact

SEQ ID NO: 9325347 - DNA, 22 bp, Homo sapiens
caggaagctgagctgcactgca

SEQ ID NO: 9325348 - DNA, 22 bp, Homo sapiens
caggaagctgatgtctagtcat

SEQ ID NO: 9325349 - DNA, 22 bp, Homo sapiens
caggaagcatctggctagctaa

SEQ ID NO: 9325350 - DNA, 22 bp, Homo sapiens
caggaggaagaactctgcaaca

SEQ ID NO: 9325351 - DNA, 22 bp, Homo sapiens
cagctggggagagacatggcag

SEQ ID NO: 9325352 - DNA, 22 bp, Homo sapiens
tctccagtgaatctcctcctgg

SEQ ID NO: 9325353 - DNA, 22 bp, Homo sapiens
tctccagtatctttccaatgaa

SEQ ID NO: 9325354 - DNA, 22 bp, Homo sapiens
ccagaggacttgggggctgaat

SEQ ID NO: 9325355 - DNA, 22 bp, Homo sapiens
tctgccagaagccagggtctgg

SEQ ID NO: 9325356 - DNA, 22 bp, Homo sapiens
tctgccagctctgtgggtctcg

SEQ ID NO: 9325357 - DNA, 22 bp, Homo sapiens
ccagctccaggactgggagctg

SEQ ID NO: 9325358 - DNA, 22 bp, Homo sapiens
ccaggaactcagctctgcactt

SEQ ID NO: 9325359 - DNA, 22 bp, Homo sapiens
ccagcttcggcaagcagacttt

SEQ ID NO: 9325360 - DNA, 22 bp, Homo sapiens
caggggcaggtgtgagatcatc

SEQ ID NO: 9325361 - DNA, 22 bp, Homo sapiens
tcaccagggctccagccagcct

SEQ ID NO: 9325362 - DNA, 22 bp, Homo sapiens
tctgtccagacgcctccgtgag

SEQ ID NO: 9325363 - DNA, 22 bp, Homo sapiens
tctgggtctttacccatggaat

SEQ ID NO: 9325364 - DNA, 19 bp, Homo sapiens
tctgcaagtgtcagaggcg

SEQ ID NO: 9325365 - DNA, 22 bp, Homo sapiens
tctgcaaggttcaggaaacctt

SEQ ID NO: 9325366 - DNA, 22 bp, Homo sapiens
tctgcactgggagcatgtctgg

SEQ ID NO: 9325367 - DNA, 22 bp, Homo sapiens
tctgcaggtagagctcaggaat

SEQ ID NO: 9325368 - DNA, 22 bp, Homo sapiens
tctgcaggcttggagtggcagc

SEQ ID NO: 9325369 - DNA, 22 bp, Homo sapiens
tctgcaggctgtacaggaagca

SEQ ID NO: 9325370 - DNA, 22 bp, Homo sapiens
tctgcaggcttataggatgggt

SEQ ID NO: 9325371 - DNA, 22 bp, Homo sapiens
tctgcaggctctagatgaggtt

SEQ ID NO: 9325372 - DNA, 21 bp, Homo sapiens
tctgccagtttctcttacttt

SEQ ID NO: 9325373 - DNA, 22 bp, Homo sapiens
tctgccagtggattcttattct

SEQ ID NO: 9325374 - DNA, 22 bp, Homo sapiens
tctgccagtggtttggccctga

SEQ ID NO: 9325375 - DNA, 23 bp, Homo sapiens
tctgcaagataatgaagatgata

SEQ ID NO: 9325376 - DNA, 22 bp, Homo sapiens
tctgctgctgcagctacactat

SEQ ID NO: 9325377 - DNA, 22 bp, Homo sapiens
tctggcccagcccctgatccca

SEQ ID NO: 9325378 - DNA, 22 bp, Homo sapiens
tctggccctatggcatgtacct

SEQ ID NO: 9325379 - DNA, 20 bp, Homo sapiens
tctggccccttcctgtcctg

SEQ ID NO: 9325380 - DNA, 23 bp, Homo sapiens
tctggccccattctttcccatgt

SEQ ID NO: 9325381 - DNA, 22 bp, Homo sapiens
tccttcctggggtctctgctgc

SEQ ID NO: 9325382 - DNA, 22 bp, Homo sapiens
tcctttgcttctgtcattctcc

SEQ ID NO: 9325383 - DNA, 22 bp, Homo sapiens
tcgttatagaacattcttgggt

SEQ ID NO: 9325384 - DNA, 22 bp, Homo sapiens
tctacctggagtccgttgttaa

SEQ ID NO: 9325385 - DNA, 22 bp, Homo sapiens
tctcacagccatttctccctct

SEQ ID NO: 9325386 - DNA, 20 bp, Homo sapiens
tctcacagacatcgtctcat

SEQ ID NO: 9325387 - DNA, 22 bp, Homo sapiens
tcctggggagggttctggctcc

SEQ ID NO: 9325388 - DNA, 22 bp, Homo sapiens
tcctggggctctttgatgtgat

SEQ ID NO: 9325389 - DNA, 22 bp, Homo sapiens
tcctggggctctgagcgagaca

SEQ ID NO: 9325390 - DNA, 22 bp, Homo sapiens
tcctggggctgcaaggcctgtc

SEQ ID NO: 9325391 - DNA, 16 bp, Homo sapiens
tcctggggatactgga

SEQ ID NO: 9325392 - DNA, 19 bp, Homo sapiens
tcctggggatgtggtcacc

SEQ ID NO: 9325393 - DNA, 22 bp, Homo sapiens
tcctggggaggtcgaggctgag

SEQ ID NO: 9325394 - DNA, 22 bp, Homo sapiens
tcctggggccagcactggtgga

SEQ ID NO: 9325395 - DNA, 22 bp, Homo sapiens
tcctggggccaggcacctctgg

SEQ ID NO: 9325396 - DNA, 22 bp, Homo sapiens
tcctggggctcatgggatttgt

SEQ ID NO: 9325397 - DNA, 22 bp, Homo sapiens
tcctggggttttggccgcagct

SEQ ID NO: 9325398 - DNA, 21 bp, Homo sapiens
tcctggggggtaggtgagttt

SEQ ID NO: 9325399 - DNA, 20 bp, Homo sapiens
tcctggggtaagccatggtc

SEQ ID NO: 9325400 - DNA, 22 bp, Homo sapiens
tcctggggtcctgactgcttcc

SEQ ID NO: 9325401 - DNA, 22 bp, Homo sapiens
tcctggggtgtgttttgctgct

SEQ ID NO: 9325402 - DNA, 22 bp, Homo sapiens
tcctggggtttagagggaagtg

SEQ ID NO: 9325403 - DNA, 22 bp, Homo sapiens
tcctgtcctgaggctccaggcc

SEQ ID NO: 9325404 - DNA, 22 bp, Homo sapiens
tctcacagtgcaggtctgtctc

SEQ ID NO: 9325405 - DNA, 19 bp, Homo sapiens
tctcacagtttccttgcct

SEQ ID NO: 9325406 - DNA, 22 bp, Homo sapiens
tctcacaggtgcacgtggctgt

SEQ ID NO: 9325407 - DNA, 22 bp, Homo sapiens
tctccaggaagccctccctgac

SEQ ID NO: 9325408 - DNA, 22 bp, Homo sapiens
tctcctggatggaccttctctt

SEQ ID NO: 9325409 - DNA, 22 bp, Homo sapiens
tctcctcaccaccagcagcaga

SEQ ID NO: 9325410 - DNA, 21 bp, Homo sapiens
tctccagtatccttctctgag

SEQ ID NO: 9325411 - DNA, 22 bp, Homo sapiens
tctcccagaagtcctcagtaca

SEQ ID NO: 9325412 - DNA, 22 bp, Homo sapiens
tctccccaaccatggcactcac

SEQ ID NO: 9325413 - DNA, 23 bp, Homo sapiens
tctccctcatgcctaggcctggg

SEQ ID NO: 9325414 - DNA, 22 bp, Homo sapiens
tctcccaggctgccctgtggac

SEQ ID NO: 9325415 - DNA, 22 bp, Homo sapiens
tctcccagaggatcccagtgga

SEQ ID NO: 9325416 - DNA, 22 bp, Homo sapiens
tctcccaggcaggagtgcagtg

SEQ ID NO: 9325417 - DNA, 22 bp, Homo sapiens
tctcccaggctggagtgcagtg

SEQ ID NO: 9325418 - DNA, 22 bp, Homo sapiens
tctctcagcattactcttacta

SEQ ID NO: 9325419 - DNA, 22 bp, Homo sapiens
tgcagaggagctggaaggctgg

SEQ ID NO: 9325420 - DNA, 21 bp, Homo sapiens
tgcacctgttcactgcagttc

SEQ ID NO: 9325421 - DNA, 21 bp, Homo sapiens
tgcacagggcccaggagagcc

SEQ ID NO: 9325422 - DNA, 22 bp, Homo sapiens
tgcagcctctctgcttcaggaa

SEQ ID NO: 9325423 - DNA, 19 bp, Homo sapiens
tgcaggaggactgagcaga

SEQ ID NO: 9325424 - DNA, 22 bp, Homo sapiens
tgcaggctcacctgccagggcc

SEQ ID NO: 9325425 - DNA, 21 bp, Homo sapiens
tgcaggctacttctgactcta

SEQ ID NO: 9325426 - DNA, 22 bp, Homo sapiens
tgcctagggcctaaccagagcc

SEQ ID NO: 9325427 - DNA, 19 bp, Homo sapiens
tgccctgcccgcagccttg

SEQ ID NO: 9325428 - DNA, 20 bp, Homo sapiens
tgccagggccagcagaggct

SEQ ID NO: 9325429 - DNA, 22 bp, Homo sapiens
tgccagggtcctgagggccttg

SEQ ID NO: 9325430 - DNA, 22 bp, Homo sapiens
tgccagggctgctactggctga

SEQ ID NO: 9325431 - DNA, 22 bp, Homo sapiens
tgcaggctctctgctgccagat

SEQ ID NO: 9325432 - DNA, 22 bp, Homo sapiens
tgcaggctccatgaggacaggc

SEQ ID NO: 9325433 - DNA, 22 bp, Homo sapiens
tgcaggctgcacccctgccctg

SEQ ID NO: 9325434 - DNA, 22 bp, Homo sapiens
tgcaggctgcagtctcaggtgg

SEQ ID NO: 9325435 - DNA, 22 bp, Homo sapiens
tgcaggctgccttcacagagcc

SEQ ID NO: 9325436 - DNA, 22 bp, Homo sapiens
tgcaggctgggaagagggacaa

SEQ ID NO: 9325437 - DNA, 21 bp, Homo sapiens
tgcaggctgtgcgctcctgcc

SEQ ID NO: 9325438 - DNA, 22 bp, Homo sapiens
tgcaggtgtgggcaggggagca

SEQ ID NO: 9325439 - DNA, 22 bp, Homo sapiens
tgcaggtgtctccagggcaggt

SEQ ID NO: 9325440 - DNA, 20 bp, Homo sapiens
tgcaggtgttggagaaggta

SEQ ID NO: 9325441 - DNA, 22 bp, Homo sapiens
tgaggccaatgaccctgggcag

SEQ ID NO: 9325442 - DNA, 22 bp, Homo sapiens
tgaggaagtggttgtatggttt

SEQ ID NO: 9325443 - DNA, 22 bp, Homo sapiens
tgaggaagggtgtgacggcacc

SEQ ID NO: 9325444 - DNA, 22 bp, Homo sapiens
tgctcccatgtgtgggtacaga

SEQ ID NO: 9325445 - DNA, 22 bp, Homo sapiens
tgctcccaggcattctctgttg

SEQ ID NO: 9325446 - DNA, 23 bp, Homo sapiens
tggccagggtactacacccaccc

SEQ ID NO: 9325447 - DNA, 22 bp, Homo sapiens
tggtgcaaaactaattgcggtt

SEQ ID NO: 9325448 - DNA, 22 bp, Homo sapiens
tggtgcctccagctgcttctcc

SEQ ID NO: 9325449 - DNA, 22 bp, Homo sapiens
tggggcaccttgtatctctaag

SEQ ID NO: 9325450 - DNA, 22 bp, Homo sapiens
tggtatgaccgtggtgcaagca

SEQ ID NO: 9325451 - DNA, 23 bp, Homo sapiens
tgggcgaggcaggagtggagcac

SEQ ID NO: 9325452 - DNA, 22 bp, Homo sapiens
tgggcgaggcccagggctgcgt

SEQ ID NO: 9325453 - DNA, 22 bp, Homo sapiens
tgggccaggggcctcttctgat

SEQ ID NO: 9325454 - DNA, 22 bp, Homo sapiens
tgggccaggcatgtgatcagca

SEQ ID NO: 9325455 - DNA, 22 bp, Homo sapiens
tgggccagggcacccagtccag

SEQ ID NO: 9325456 - DNA, 22 bp, Homo sapiens
tgtggaaaaaccacaagtttgg

SEQ ID NO: 9325457 - DNA, 22 bp, Homo sapiens
aactagtaaaagcaacagtata

SEQ ID NO: 9325458 - DNA, 22 bp, Homo sapiens
aacagacatatttttaatatgc

SEQ ID NO: 9325459 - DNA, 22 bp, Homo sapiens
aagaaattaaggaatgcaacga

SEQ ID NO: 9325460 - DNA, 22 bp, Homo sapiens
aagagattgtcagagatatgcc

SEQ ID NO: 9325461 - DNA, 22 bp, Homo sapiens
aagagatttctgtaaaatgtaa

SEQ ID NO: 9325462 - DNA, 22 bp, Homo sapiens
aagatgtgtctcatcagggtgt

SEQ ID NO: 9325463 - DNA, 22 bp, Homo sapiens
aagatgtgtccattctttgctc

SEQ ID NO: 9325464 - DNA, 22 bp, Homo sapiens
aatgtgctccaattgtctactt

SEQ ID NO: 9325465 - DNA, 22 bp, Homo sapiens
aatgtgctccactccaggctgc

SEQ ID NO: 9325466 - DNA, 22 bp, Homo sapiens
aatgtcttcagtgtatacatgg

SEQ ID NO: 9325467 - DNA, 22 bp, Homo sapiens
acaacacatgtgtatatgtgtg

SEQ ID NO: 9325468 - DNA, 21 bp, Homo sapiens
actgatattaaccttataaca

SEQ ID NO: 9325469 - DNA, 22 bp, Homo sapiens
agaaattattagtgaatagtct

SEQ ID NO: 9325470 - DNA, 22 bp, Homo sapiens
agaaattatgcagtagttttat

SEQ ID NO: 9325471 - DNA, 22 bp, Homo sapiens
acatggaagcaaagttctattt

SEQ ID NO: 9325472 - DNA, 22 bp, Homo sapiens
acagttaataagtagtaagtca

SEQ ID NO: 9325473 - DNA, 22 bp, Homo sapiens
acagttaactggagagcgagtt

SEQ ID NO: 9325474 - DNA, 22 bp, Homo sapiens
actgtgttcctctttggtatcc

SEQ ID NO: 9325475 - DNA, 22 bp, Homo sapiens
atatccagcagcaggtgagtat

SEQ ID NO: 9325476 - DNA, 22 bp, Homo sapiens
atatcctttactgtgtcacaga

SEQ ID NO: 9325477 - DNA, 22 bp, Homo sapiens
atccagaagcatgtgtaatttg

SEQ ID NO: 9325478 - DNA, 22 bp, Homo sapiens
attttctcacaatgcagaagga

SEQ ID NO: 9325479 - DNA, 22 bp, Homo sapiens
atgtctttattaatatcatgcc

SEQ ID NO: 9325480 - DNA, 22 bp, Homo sapiens
atgtctttataaatgtataatg

SEQ ID NO: 9325481 - DNA, 22 bp, Homo sapiens
atgtctttggctttgacatggc

SEQ ID NO: 9325482 - DNA, 22 bp, Homo sapiens
cttgtttaagccgctgttaagc

SEQ ID NO: 9325483 - DNA, 22 bp, Homo sapiens
atttccttgcaacttaggcatg

SEQ ID NO: 9325484 - DNA, 22 bp, Homo sapiens
caccagtttaacaatcaaaaga

SEQ ID NO: 9325485 - DNA, 22 bp, Homo sapiens
cacactaatttttcaagagttt

SEQ ID NO: 9325486 - DNA, 22 bp, Homo sapiens
caacatcagtcctcatgagaca

SEQ ID NO: 9325487 - DNA, 22 bp, Homo sapiens
atcctaaactggggaaatggat

SEQ ID NO: 9325488 - DNA, 22 bp, Homo sapiens
atcctaaactattgagaaagct

SEQ ID NO: 9325489 - DNA, 22 bp, Homo sapiens
atcctaaagaaatatttattaa

SEQ ID NO: 9325490 - DNA, 22 bp, Homo sapiens
atcctaaatccctggagagttg

SEQ ID NO: 9325491 - DNA, 22 bp, Homo sapiens
atatgtgtacgtgcagtatata

SEQ ID NO: 9325492 - DNA, 22 bp, Homo sapiens
atactcttcctagcgctgaaat

SEQ ID NO: 9325493 - DNA, 22 bp, Homo sapiens
ccagttagaactacatttccca

SEQ ID NO: 9325494 - DNA, 22 bp, Homo sapiens
ccagttacaagtgattcttggt

SEQ ID NO: 9325495 - DNA, 22 bp, Homo sapiens
cagtctaatctgttactcatta

SEQ ID NO: 9325496 - DNA, 22 bp, Homo sapiens
tatgttttaggaattaattgtt

SEQ ID NO: 9325497 - DNA, 22 bp, Homo sapiens
catgatctggtcctactgtggg

SEQ ID NO: 9325498 - DNA, 22 bp, Homo sapiens
catcacaaatgtaataatgtct

SEQ ID NO: 9325499 - DNA, 22 bp, Homo sapiens
tctgcgttgctcacgctgggag

SEQ ID NO: 9325500 - DNA, 22 bp, Homo sapiens
ccagataaatgagttcatattt

SEQ ID NO: 9325501 - DNA, 22 bp, Homo sapiens
ccaaatattaacaaagtaattt

SEQ ID NO: 9325502 - DNA, 22 bp, Homo sapiens
gtttacatatgtctgtctgcac

SEQ ID NO: 9325503 - DNA, 22 bp, Homo sapiens
gtttacatgtttttctcttaca

SEQ ID NO: 9325504 - DNA, 22 bp, Homo sapiens
gtttacatgtactcattatact

SEQ ID NO: 9325505 - DNA, 22 bp, Homo sapiens
ctctcctacatttcattcacaa

SEQ ID NO: 9325506 - DNA, 20 bp, Homo sapiens
tttacatccccaccagcaat

SEQ ID NO: 9325507 - DNA, 22 bp, Homo sapiens
cccagcttgctcaccattccca

SEQ ID NO: 9325508 - DNA, 22 bp, Homo sapiens
tgtctcttgagtttgttttaat

SEQ ID NO: 9325509 - DNA, 22 bp, Homo sapiens
gatccagcttctacacagagct

SEQ ID NO: 9325510 - DNA, 22 bp, Homo sapiens
gtgggctgaggggacaccaagg

SEQ ID NO: 9325511 - DNA, 22 bp, Homo sapiens
tgtgccttgtacagcattcaaa

SEQ ID NO: 9325512 - DNA, 19 bp, Homo sapiens
tgtgccttatactcacatt

SEQ ID NO: 9325513 - DNA, 22 bp, Homo sapiens
tgtgatttccagccattaaaaa

SEQ ID NO: 9325514 - DNA, 22 bp, Homo sapiens
tgtctcttggctctatcactta

SEQ ID NO: 9325515 - DNA, 22 bp, Homo sapiens
ttccagatgtttaagttctgct

SEQ ID NO: 9325516 - DNA, 22 bp, Homo sapiens
tgcatggtgtaattctaatgct

SEQ ID NO: 9325517 - DNA, 21 bp, Homo sapiens
tgcagctgacactggtatgcc

SEQ ID NO: 9325518 - DNA, 22 bp, Homo sapiens
tgcaacagactttattaactct

SEQ ID NO: 9325519 - DNA, 18 bp, Homo sapiens
tgcaactgaaagctttgt

SEQ ID NO: 9325520 - DNA, 22 bp, Homo sapiens
tgcaatctcggcactttgggag

SEQ ID NO: 9325521 - DNA, 22 bp, Homo sapiens
tgattaacgttttaggcatact

SEQ ID NO: 9325522 - DNA, 17 bp, Homo sapiens
tctctttccctttctgc

SEQ ID NO: 9325523 - DNA, 22 bp, Homo sapiens
tctcctaaggctgaatatctct

SEQ ID NO: 9325524 - DNA, 22 bp, Homo sapiens
tctttacacaagacaagaataa

SEQ ID NO: 9325525 - DNA, 21 bp, Homo sapiens
aagtaacaccactcctggagt

SEQ ID NO: 9325526 - DNA, 22 bp, Homo sapiens
accacagtgggccacaagaagt

SEQ ID NO: 9325527 - DNA, 22 bp, Homo sapiens
aatgtagttcacaattggtact

SEQ ID NO: 9325528 - DNA, 22 bp, Homo sapiens
acactaatcttttatttggttt

SEQ ID NO: 9325529 - DNA, 22 bp, Homo sapiens
acactaattaagctgctttact

SEQ ID NO: 9325530 - DNA, 22 bp, Homo sapiens
aatgtctttatttcaggtttac

SEQ ID NO: 9325531 - DNA, 22 bp, Homo sapiens
aatgtcttttgatacaagttac

SEQ ID NO: 9325532 - DNA, 22 bp, Homo sapiens
aaccagttgtatgtcctccagc

SEQ ID NO: 9325533 - DNA, 22 bp, Homo sapiens
aactatataatctgaaagtgaa

SEQ ID NO: 9325534 - DNA, 22 bp, Homo sapiens
attgggtacgattattttatgg

SEQ ID NO: 9325535 - DNA, 22 bp, Homo sapiens
agacaacaccaaatgctagtgt

SEQ ID NO: 9325536 - DNA, 22 bp, Homo sapiens
agacaacatgatcagcagtcct

SEQ ID NO: 9325537 - DNA, 22 bp, Homo sapiens
accagttaaagggaaattgaaa

SEQ ID NO: 9325538 - DNA, 22 bp, Homo sapiens
accagttacagcttatgtttga

SEQ ID NO: 9325539 - DNA, 22 bp, Homo sapiens
accagttattagccctacaact

SEQ ID NO: 9325540 - DNA, 22 bp, Homo sapiens
aggaaacagttggtaatgcata

SEQ ID NO: 9325541 - DNA, 22 bp, Homo sapiens
aggaaacatccttatctattct

SEQ ID NO: 9325542 - DNA, 19 bp, Homo sapiens
ccaaaggaagtttccctcc

SEQ ID NO: 9325543 - DNA, 22 bp, Homo sapiens
ccaaaggatgtccctgtgtttt

SEQ ID NO: 9325544 - DNA, 22 bp, Homo sapiens
aggatccagccagggtggagtt

SEQ ID NO: 9325545 - DNA, 22 bp, Homo sapiens
ccagaaatggccctagtcagag

SEQ ID NO: 9325546 - DNA, 22 bp, Homo sapiens
ccagaaatggccctcaggtgac

SEQ ID NO: 9325547 - DNA, 20 bp, Homo sapiens
ctgtccttttgttggaagac

SEQ ID NO: 9325548 - DNA, 22 bp, Homo sapiens
atccatggctaagtatatagag

SEQ ID NO: 9325549 - DNA, 22 bp, Homo sapiens
atctggttcttcttaggcatca

SEQ ID NO: 9325550 - DNA, 22 bp, Homo sapiens
agttaactaaattaagagacaa

SEQ ID NO: 9325551 - DNA, 22 bp, Homo sapiens
agttaacacaagtaagattcca

SEQ ID NO: 9325552 - DNA, 22 bp, Homo sapiens
gctccaggctgctctgtcccat

SEQ ID NO: 9325553 - DNA, 22 bp, Homo sapiens
gctccaggcgagctggaccaga

SEQ ID NO: 9325554 - DNA, 22 bp, Homo sapiens
caaatgtgttttttcttctaca

SEQ ID NO: 9325555 - DNA, 16 bp, Homo sapiens
attgttttcaattaga

SEQ ID NO: 9325556 - DNA, 22 bp, Homo sapiens
attgttttgtttcccagtgact

SEQ ID NO: 9325557 - DNA, 23 bp, Homo sapiens
attgtttttggctctcagggaat

SEQ ID NO: 9325558 - DNA, 22 bp, Homo sapiens
gaaaatgtgcctttgggtattg

SEQ ID NO: 9325559 - DNA, 19 bp, Homo sapiens
ggatccagaggatctgcca

SEQ ID NO: 9325560 - DNA, 22 bp, Homo sapiens
ggatccagtccagggctgtgtg

SEQ ID NO: 9325561 - DNA, 22 bp, Homo sapiens
ggatccagaggtgaagatggga

SEQ ID NO: 9325562 - DNA, 22 bp, Homo sapiens
cagaaattggaatagagaaata

SEQ ID NO: 9325563 - DNA, 22 bp, Homo sapiens
caagttaaatttgcatttcaga

SEQ ID NO: 9325564 - DNA, 22 bp, Homo sapiens
tggttacctattcatgaacatt

SEQ ID NO: 9325565 - DNA, 22 bp, Homo sapiens
tcttgcacttcatgaatatgtt

SEQ ID NO: 9325566 - DNA, 22 bp, Homo sapiens
ccagttaatcactgagtcctgt

SEQ ID NO: 9325567 - DNA, 22 bp, Homo sapiens
ccagttaaggaaacagcacgaa

SEQ ID NO: 9325568 - DNA, 22 bp, Homo sapiens
ccagttaaacaacatccatttc

SEQ ID NO: 9325569 - DNA, 22 bp, Homo sapiens
ctgtccttactgcttctggctt

SEQ ID NO: 9325570 - DNA, 22 bp, Homo sapiens
ctgttttgtaggtgagcacctt

SEQ ID NO: 9325571 - DNA, 22 bp, Homo sapiens
gaaagagaggggctgagatgca

SEQ ID NO: 9325572 - DNA, 22 bp, Homo sapiens
ctgcgttctgcctggcggccta

SEQ ID NO: 9325573 - DNA, 22 bp, Homo sapiens
ttcctaaaggataggtcagttt

SEQ ID NO: 9325574 - DNA, 22 bp, Homo sapiens
ttcctaaaagctgagtagagaa

SEQ ID NO: 9325575 - DNA, 22 bp, Homo sapiens
ttccagaaaaaaatgtatatct

SEQ ID NO: 9325576 - DNA, 22 bp, Homo sapiens
tgttttcgatcatttcacagta

SEQ ID NO: 9325577 - DNA, 20 bp, Homo sapiens
tgttttcgttagttcatctc

SEQ ID NO: 9325578 - DNA, 22 bp, Homo sapiens
ccttgtcttgcacagatgcagc

SEQ ID NO: 9325579 - DNA, 22 bp, Homo sapiens
tataccatgtgtgcacactccc

SEQ ID NO: 9325580 - DNA, 22 bp, Homo sapiens
tacatacacaaatatactgttt

SEQ ID NO: 9325581 - DNA, 22 bp, Homo sapiens
gtgcttttctgcagggtcctat

SEQ ID NO: 9325582 - DNA, 22 bp, Homo sapiens
gtttacattgctgtttgtgtct

SEQ ID NO: 9325583 - DNA, 22 bp, Homo sapiens
taactgtacctagataacgaac

SEQ ID NO: 9325584 - DNA, 22 bp, Homo sapiens
taactgtagaacaaaatgggct

SEQ ID NO: 9325585 - DNA, 22 bp, Homo sapiens
taactgtagttataaagctatc

SEQ ID NO: 9325586 - DNA, 22 bp, Homo sapiens
taactgtaatataaatatgagt

SEQ ID NO: 9325587 - DNA, 22 bp, Homo sapiens
tccagttagtgggcaaaattta

SEQ ID NO: 9325588 - DNA, 22 bp, Homo sapiens
tccaggaggaggaaggctgcca

SEQ ID NO: 9325589 - DNA, 22 bp, Homo sapiens
tccagaaaattttacagtgcct

SEQ ID NO: 9325590 - DNA, 22 bp, Homo sapiens
tccagaaacttttccagtctca

SEQ ID NO: 9325591 - DNA, 22 bp, Homo sapiens
tccagaaaaagtaatttatttg

SEQ ID NO: 9325592 - DNA, 22 bp, Homo sapiens
tccacgctgtgtgaccttgggc

SEQ ID NO: 9325593 - DNA, 22 bp, Homo sapiens
tcactaatgattttgaaagaag

SEQ ID NO: 9325594 - DNA, 22 bp, Homo sapiens
tcacacataaaaagaagactag

SEQ ID NO: 9325595 - DNA, 22 bp, Homo sapiens
tcacacatactcatgtgtgagt

SEQ ID NO: 9325596 - DNA, 22 bp, Homo sapiens
gtcttagatttcaccgataatg

SEQ ID NO: 9325597 - DNA, 22 bp, Homo sapiens
gcctaacttggctttgttcacc

SEQ ID NO: 9325598 - DNA, 16 bp, Homo sapiens
gctgggagggagaggt

SEQ ID NO: 9325599 - DNA, 22 bp, Homo sapiens
ttgtagtggccaaagaactctt

SEQ ID NO: 9325600 - DNA, 22 bp, Homo sapiens
ttgggctatgttatataatgtt

SEQ ID NO: 9325601 - DNA, 23 bp, Homo sapiens
ttgttcttggatcttcctgaagc

SEQ ID NO: 9325602 - DNA, 22 bp, Homo sapiens
tttaacatgttcaagaaacata

SEQ ID NO: 9325603 - DNA, 22 bp, Homo sapiens
tttacactgcttgaacaatctc

SEQ ID NO: 9325604 - DNA, 22 bp, Homo sapiens
tttacactgacagcacataagg

SEQ ID NO: 9325605 - DNA, 22 bp, Homo sapiens
tttcacaggattctgatgtagt

SEQ ID NO: 9325606 - DNA, 22 bp, Homo sapiens
ttctcctaggatcaggggtcct

SEQ ID NO: 9325607 - DNA, 22 bp, Homo sapiens
ttcccagtgattgaacatccct

SEQ ID NO: 9325608 - DNA, 22 bp, Homo sapiens
ttttccagatgaattccacagt

SEQ ID NO: 9325609 - DNA, 22 bp, Homo sapiens
ttttccagatggatactagaat

SEQ ID NO: 9325610 - DNA, 22 bp, Homo sapiens
ttttccagattggacttagtcc

SEQ ID NO: 9325611 - DNA, 22 bp, Homo sapiens
ttttccagcataggtacatata

SEQ ID NO: 9325612 - DNA, 20 bp, Homo sapiens
ttttccagaaagtatcattg

SEQ ID NO: 9325613 - DNA, 22 bp, Homo sapiens
tttggctagagaaattactata

SEQ ID NO: 9325614 - DNA, 22 bp, Homo sapiens
tttggctatttctcccatggtc

SEQ ID NO: 9325615 - DNA, 22 bp, Homo sapiens
tttggctaagttgtaatgtaaa

SEQ ID NO: 9325616 - DNA, 22 bp, Homo sapiens
cacagttatgggaaacgtagtt

SEQ ID NO: 9325617 - DNA, 22 bp, Homo sapiens
cacagttatatgttcacaagga

SEQ ID NO: 9325618 - DNA, 22 bp, Homo sapiens
cacagttagaggtagagtccag

SEQ ID NO: 9325619 - DNA, 22 bp, Homo sapiens
attcatggcagtggtaacgttt

SEQ ID NO: 9325620 - DNA, 22 bp, Homo sapiens
atttccttcagtgtttaatact

SEQ ID NO: 9325621 - DNA, 16 bp, Homo sapiens
atttccagattatgca

SEQ ID NO: 9325622 - DNA, 22 bp, Homo sapiens
atgtgggccgtgcgggtgtcct

SEQ ID NO: 9325623 - DNA, 22 bp, Homo sapiens
acacagctttgtgttgctccac

SEQ ID NO: 9325624 - DNA, 22 bp, Homo sapiens
aagagattggttataagagatt

SEQ ID NO: 9325625 - DNA, 22 bp, Homo sapiens
aagagattaaagtaacttgcct

SEQ ID NO: 9325626 - DNA, 22 bp, Homo sapiens
aagagattcctcactcagaatg

SEQ ID NO: 9325627 - DNA, 22 bp, Homo sapiens
aatagtgttgttcactcaggag

SEQ ID NO: 9325628 - DNA, 23 bp, Homo sapiens
aacatggagttgttcctttggcc

SEQ ID NO: 9325629 - DNA, 22 bp, Homo sapiens
accatccaaactgctttctgtg

SEQ ID NO: 9325630 - DNA, 22 bp, Homo sapiens
aatgtcacatacaatggcaagt

SEQ ID NO: 9325631 - DNA, 22 bp, Homo sapiens
aatgtcttacatttactgagca

SEQ ID NO: 9325632 - DNA, 22 bp, Homo sapiens
aatgtcttaaagtcgtgttaca

SEQ ID NO: 9325633 - DNA, 22 bp, Homo sapiens
aatgttccacagatatagcatg

SEQ ID NO: 9325634 - DNA, 21 bp, Homo sapiens
attaacttgttaacctaaagt

SEQ ID NO: 9325635 - DNA, 22 bp, Homo sapiens
attatccagcaccaatgtcaga

SEQ ID NO: 9325636 - DNA, 22 bp, Homo sapiens
ctttacatcctgtttcccgttt

SEQ ID NO: 9325637 - DNA, 22 bp, Homo sapiens
ctttacattaatttctactgat

SEQ ID NO: 9325638 - DNA, 22 bp, Homo sapiens
cttgtttattatgcactgtaga

SEQ ID NO: 9325639 - DNA, 22 bp, Homo sapiens
atgtgctttccaatgctgtagg

SEQ ID NO: 9325640 - DNA, 22 bp, Homo sapiens
atgtgcttgtaatgttaaatgt

SEQ ID NO: 9325641 - DNA, 21 bp, Homo sapiens
atgtgcttagctgctggtagt

SEQ ID NO: 9325642 - DNA, 22 bp, Homo sapiens
caatatataatgagtactttcc

SEQ ID NO: 9325643 - DNA, 22 bp, Homo sapiens
gggttcagtccctcttgctact

SEQ ID NO: 9325644 - DNA, 22 bp, Homo sapiens
cagattaagtgctcaacagtgt

SEQ ID NO: 9325645 - DNA, 22 bp, Homo sapiens
ctgggctgtcaatggccctctg

SEQ ID NO: 9325646 - DNA, 22 bp, Homo sapiens
atatcacaaacaagtctgtact

SEQ ID NO: 9325647 - DNA, 22 bp, Homo sapiens
cagttaaagtgcttatcacaga

SEQ ID NO: 9325648 - DNA, 22 bp, Homo sapiens
cagttaaacgggccatgtgagt

SEQ ID NO: 9325649 - DNA, 22 bp, Homo sapiens
cagttaaattctccagttacca

SEQ ID NO: 9325650 - DNA, 22 bp, Homo sapiens
cagttacagagccagttagaga

SEQ ID NO: 9325651 - DNA, 22 bp, Homo sapiens
cagttactcaataattcttgcg

SEQ ID NO: 9325652 - DNA, 22 bp, Homo sapiens
taggaaattaagtctcttttgt

SEQ ID NO: 9325653 - DNA, 22 bp, Homo sapiens
cctaaatagagtcagatgtaat

SEQ ID NO: 9325654 - DNA, 22 bp, Homo sapiens
ccaggtaacttgagaacatgag

SEQ ID NO: 9325655 - DNA, 22 bp, Homo sapiens
tttccacatcaccatgaggtga

SEQ ID NO: 9325656 - DNA, 22 bp, Homo sapiens
ttagttttctcatctatctcac

SEQ ID NO: 9325657 - DNA, 22 bp, Homo sapiens
ctggttaatccataaacagaga

SEQ ID NO: 9325658 - DNA, 22 bp, Homo sapiens
ctgtgtttctaagtaaaggagc

SEQ ID NO: 9325659 - DNA, 22 bp, Homo sapiens
ctgtgttttgattaaaaagcaa

SEQ ID NO: 9325660 - DNA, 22 bp, Homo sapiens
ctgtgtttgatgagaagccacc

SEQ ID NO: 9325661 - DNA, 22 bp, Homo sapiens
ctgtgtttgctatgcaaagaca

SEQ ID NO: 9325662 - DNA, 22 bp, Homo sapiens
tcctaaagtccaggtgggaatt

SEQ ID NO: 9325663 - DNA, 22 bp, Homo sapiens
tcctaaaggctgcttttatatt

SEQ ID NO: 9325664 - DNA, 20 bp, Homo sapiens
tcctaaagtcattgaatttc

SEQ ID NO: 9325665 - DNA, 22 bp, Homo sapiens
tcctaaatgattcagaaatttc

SEQ ID NO: 9325666 - DNA, 22 bp, Homo sapiens
tccaggtctaatttgtccttga

SEQ ID NO: 9325667 - DNA, 21 bp, Homo sapiens
tccaacatgcctgatggtgcc

SEQ ID NO: 9325668 - DNA, 22 bp, Homo sapiens
tccaacatttatcaaggttgtt

SEQ ID NO: 9325669 - DNA, 22 bp, Homo sapiens
tccaaagacttgctgtatgtaa

SEQ ID NO: 9325670 - DNA, 22 bp, Homo sapiens
tcagttaacaactatttattga

SEQ ID NO: 9325671 - DNA, 22 bp, Homo sapiens
tcagttaatggattctgtcaga

SEQ ID NO: 9325672 - DNA, 22 bp, Homo sapiens
tcactgcaacctccacctcctg

SEQ ID NO: 9325673 - DNA, 22 bp, Homo sapiens
tcactgcaacctccacctcccg

SEQ ID NO: 9325674 - DNA, 22 bp, Homo sapiens
tacacagtagagtataatgcgt

SEQ ID NO: 9325675 - DNA, 22 bp, Homo sapiens
tacacagtaaatggtaaataca

SEQ ID NO: 9325676 - DNA, 22 bp, Homo sapiens
taaatgtgtgtagccatctgtg

SEQ ID NO: 9325677 - DNA, 22 bp, Homo sapiens
taaatgtgtaaacctccattac

SEQ ID NO: 9325678 - DNA, 22 bp, Homo sapiens
taacatgttaagaaattagata

SEQ ID NO: 9325679 - DNA, 19 bp, Homo sapiens
taaagagaataccggtggc

SEQ ID NO: 9325680 - DNA, 22 bp, Homo sapiens
tatccaaacatatagtctctct

SEQ ID NO: 9325681 - DNA, 22 bp, Homo sapiens
gcccctgggagcagagccacca

SEQ ID NO: 9325682 - DNA, 22 bp, Homo sapiens
gtagttttctgaaaattacttt

SEQ ID NO: 9325683 - DNA, 22 bp, Homo sapiens
gtctaataactttcagtcattt

SEQ ID NO: 9325684 - DNA, 22 bp, Homo sapiens
tttcacagaaagaagctagttt

SEQ ID NO: 9325685 - DNA, 22 bp, Homo sapiens
tttcacagaggaggaagctgag

SEQ ID NO: 9325686 - DNA, 22 bp, Homo sapiens
tttcacagcatataggtgtact

SEQ ID NO: 9325687 - DNA, 19 bp, Homo sapiens
aaggaatggctttaagtag

SEQ ID NO: 9325688 - DNA, 22 bp, Homo sapiens
aaggaatgctctaggagggcag

SEQ ID NO: 9325689 - DNA, 21 bp, Homo sapiens
aaggaatgaatggatggatga

SEQ ID NO: 9325690 - DNA, 17 bp, Homo sapiens
aaggaatgtcagaagtt

SEQ ID NO: 9325691 - DNA, 16 bp, Homo sapiens
aaggaatgtcattctg

SEQ ID NO: 9325692 - DNA, 22 bp, Homo sapiens
agagcaacagagaaatttaggt

SEQ ID NO: 9325693 - DNA, 22 bp, Homo sapiens
aatgtgtctatgtggttcacag

SEQ ID NO: 9325694 - DNA, 22 bp, Homo sapiens
acaccagtttcttaagaatatt

SEQ ID NO: 9325695 - DNA, 22 bp, Homo sapiens
acacagttcaggatcaaatagc

SEQ ID NO: 9325696 - DNA, 22 bp, Homo sapiens
aaaggaatattcaaaacagtca

SEQ ID NO: 9325697 - DNA, 20 bp, Homo sapiens
aaaggaatatatgaagtata

SEQ ID NO: 9325698 - DNA, 22 bp, Homo sapiens
aaatgtgacagatgcagtacag

SEQ ID NO: 9325699 - DNA, 22 bp, Homo sapiens
aaaggaatgagcttctgttagg

SEQ ID NO: 9325700 - DNA, 22 bp, Homo sapiens
aagtaacatctgaacatgatgt

SEQ ID NO: 9325701 - DNA, 21 bp, Homo sapiens
aatatccaaatgattagatct

SEQ ID NO: 9325702 - DNA, 22 bp, Homo sapiens
aatatccacactgtgtccctgc

SEQ ID NO: 9325703 - DNA, 22 bp, Homo sapiens
aatatccaggtagatgtcttct

SEQ ID NO: 9325704 - DNA, 22 bp, Homo sapiens
aagttaattaacctctccatca

SEQ ID NO: 9325705 - DNA, 22 bp, Homo sapiens
acaaatatttactgaatccact

SEQ ID NO: 9325706 - DNA, 18 bp, Homo sapiens
cacaggctcccagtgagg

SEQ ID NO: 9325707 - DNA, 22 bp, Homo sapiens
atgtagtttggggctagattta

SEQ ID NO: 9325708 - DNA, 22 bp, Homo sapiens
atgtagttttggatggttgctg

SEQ ID NO: 9325709 - DNA, 22 bp, Homo sapiens
atgttcctcattcttgcaaccc

SEQ ID NO: 9325710 - DNA, 22 bp, Homo sapiens
agagattacagcagggtccagc

SEQ ID NO: 9325711 - DNA, 22 bp, Homo sapiens
agagattataacagtttggacc

SEQ ID NO: 9325712 - DNA, 22 bp, Homo sapiens
agagattagcctggattatgca

SEQ ID NO: 9325713 - DNA, 22 bp, Homo sapiens
agagattaatactctataattt

SEQ ID NO: 9325714 - DNA, 22 bp, Homo sapiens
agagattaagtcacttggtcag

SEQ ID NO: 9325715 - DNA, 22 bp, Homo sapiens
agcaatgttggcctatatacct

SEQ ID NO: 9325716 - DNA, 22 bp, Homo sapiens
agaaatgttgaatacatcagga

SEQ ID NO: 9325717 - DNA, 22 bp, Homo sapiens
ataggaaagaaaattatgtagg

SEQ ID NO: 9325718 - DNA, 22 bp, Homo sapiens
atagtgttagagccagtatgtt

SEQ ID NO: 9325719 - DNA, 22 bp, Homo sapiens
atagtgttgatagcagtggagt

SEQ ID NO: 9325720 - DNA, 22 bp, Homo sapiens
caaatgtggtttctcagcattc

SEQ ID NO: 9325721 - DNA, 22 bp, Homo sapiens
cagctaatcctctctatccaag

SEQ ID NO: 9325722 - DNA, 22 bp, Homo sapiens
caaaggaagctccttgatggcg

SEQ ID NO: 9325723 - DNA, 22 bp, Homo sapiens
caaaggaaatactaatctggaa

SEQ ID NO: 9325724 - DNA, 22 bp, Homo sapiens
caaatactctggatgtgtttgt

SEQ ID NO: 9325725 - DNA, 22 bp, Homo sapiens
gcctatctgtcaaatttctctg

SEQ ID NO: 9325726 - DNA, 22 bp, Homo sapiens
atgtccttggagtccactttcc

SEQ ID NO: 9325727 - DNA, 22 bp, Homo sapiens
atgtcctttgtatgcttgtact

SEQ ID NO: 9325728 - DNA, 17 bp, Homo sapiens
atgtgtctagtgcaacc

SEQ ID NO: 9325729 - DNA, 22 bp, Homo sapiens
agttatattccatagattcaga

SEQ ID NO: 9325730 - DNA, 22 bp, Homo sapiens
agttatatgtgaaaacacgtat

SEQ ID NO: 9325731 - DNA, 22 bp, Homo sapiens
agttagtacaagaaagatgaac

SEQ ID NO: 9325732 - DNA, 22 bp, Homo sapiens
agttaactctgaaaagacattt

SEQ ID NO: 9325733 - DNA, 22 bp, Homo sapiens
agtacaactagaaataggtgta

SEQ ID NO: 9325734 - DNA, 22 bp, Homo sapiens
ccagtcaagttgacacaccaag

SEQ ID NO: 9325735 - DNA, 22 bp, Homo sapiens
ccagtcaaaaggaagtcaatgt

SEQ ID NO: 9325736 - DNA, 22 bp, Homo sapiens
cagtaaatgcagatatagatac

SEQ ID NO: 9325737 - DNA, 22 bp, Homo sapiens
cattggaaaatgcatgcttttt

SEQ ID NO: 9325738 - DNA, 22 bp, Homo sapiens
tcttcctatgccaacattctgt

SEQ ID NO: 9325739 - DNA, 22 bp, Homo sapiens
tcttcctagaaggaagaaatct

SEQ ID NO: 9325740 - DNA, 22 bp, Homo sapiens
tcctaactaatttgtagcaaaa

SEQ ID NO: 9325741 - DNA, 22 bp, Homo sapiens
cattgtttgtaaaattccagta

SEQ ID NO: 9325742 - DNA, 18 bp, Homo sapiens
cattgtttccagaagacc

SEQ ID NO: 9325743 - DNA, 22 bp, Homo sapiens
ccactggttttattgtagctta

SEQ ID NO: 9325744 - DNA, 20 bp, Homo sapiens
tcctaataacctgaagaaat

SEQ ID NO: 9325745 - DNA, 22 bp, Homo sapiens
cagttgatgggactcatgtggg

SEQ ID NO: 9325746 - DNA, 22 bp, Homo sapiens
cagttagaggaggtaaagatgc

SEQ ID NO: 9325747 - DNA, 19 bp, Homo sapiens
taatccaaggctgctctta

SEQ ID NO: 9325748 - DNA, 22 bp, Homo sapiens
ctcaatgtagacctcaacatat

SEQ ID NO: 9325749 - DNA, 22 bp, Homo sapiens
ttcttttagaatttcctaaggt

SEQ ID NO: 9325750 - DNA, 22 bp, Homo sapiens
tttcctaaggtagtgataattt

SEQ ID NO: 9325751 - DNA, 22 bp, Homo sapiens
tttcctaatcccaatgacattt

SEQ ID NO: 9325752 - DNA, 22 bp, Homo sapiens
tttcctaaggctcattttaaaa

SEQ ID NO: 9325753 - DNA, 22 bp, Homo sapiens
tttcctaagatagatacttcag

SEQ ID NO: 9325754 - DNA, 22 bp, Homo sapiens
tttcacagtgctctgtaagtat

SEQ ID NO: 9325755 - DNA, 22 bp, Homo sapiens
gagattatggagaggacattct

SEQ ID NO: 9325756 - DNA, 22 bp, Homo sapiens
gagattataagatagagtcatt

SEQ ID NO: 9325757 - DNA, 22 bp, Homo sapiens
gaagattagaccatttccagct

SEQ ID NO: 9325758 - DNA, 22 bp, Homo sapiens
taactagtcatgtcataacacc

SEQ ID NO: 9325759 - DNA, 22 bp, Homo sapiens
tacatacatggtggaatggtta

SEQ ID NO: 9325760 - DNA, 22 bp, Homo sapiens
tatatccatttgtctgctaatt

SEQ ID NO: 9325761 - DNA, 22 bp, Homo sapiens
tatccaaagtggcatattatag

SEQ ID NO: 9325762 - DNA, 22 bp, Homo sapiens
tatccatgcctttgtgccttag

SEQ ID NO: 9325763 - DNA, 22 bp, Homo sapiens
tgtgtcttacataattacatgt

SEQ ID NO: 9325764 - DNA, 22 bp, Homo sapiens
tgtgttttgtgtgacccagctc

SEQ ID NO: 9325765 - DNA, 22 bp, Homo sapiens
tgttccttctggcttttacatc

SEQ ID NO: 9325766 - DNA, 22 bp, Homo sapiens
ttaacaaaaatatcaggcatca

SEQ ID NO: 9325767 - DNA, 22 bp, Homo sapiens
tgttttggttttcaccgagtcc

SEQ ID NO: 9325768 - DNA, 22 bp, Homo sapiens
ttacatccttcaaagtcactca

SEQ ID NO: 9325769 - DNA, 22 bp, Homo sapiens
ttactcttaatggcaacaactg

SEQ ID NO: 9325770 - DNA, 22 bp, Homo sapiens
ttactctttggtgttaagttca

SEQ ID NO: 9325771 - DNA, 22 bp, Homo sapiens
ttactcttccaaatgaatttca

SEQ ID NO: 9325772 - DNA, 22 bp, Homo sapiens
ttcctaatcacgaacattattt

SEQ ID NO: 9325773 - DNA, 22 bp, Homo sapiens
tttctcctaactcaaatttaag

SEQ ID NO: 9325774 - DNA, 22 bp, Homo sapiens
tttctcctcatgactggttgtg

SEQ ID NO: 9325775 - DNA, 17 bp, Homo sapiens
tttctccttccatctca

SEQ ID NO: 9325776 - DNA, 22 bp, Homo sapiens
tttctcctgtgaggtcagaagt

SEQ ID NO: 9325777 - DNA, 22 bp, Homo sapiens
tttctccttgtgtctcctttga

SEQ ID NO: 9325778 - DNA, 22 bp, Homo sapiens
tttctcctgctagaacaaggag

SEQ ID NO: 9325779 - DNA, 21 bp, Homo sapiens
ttgtcctttagggcttgtctg

SEQ ID NO: 9325780 - DNA, 22 bp, Homo sapiens
ttgtcctttaatgtttagtatt

SEQ ID NO: 9325781 - DNA, 22 bp, Homo sapiens
ttgtccttgtgatagtttgctg

SEQ ID NO: 9325782 - DNA, 22 bp, Homo sapiens
ttgtccttagatgtggcctcca

SEQ ID NO: 9325783 - DNA, 23 bp, Homo sapiens
ttgtccttctgaaatatatctgg

SEQ ID NO: 9325784 - DNA, 22 bp, Homo sapiens
ttgtccttcatgttggatttat

SEQ ID NO: 9325785 - DNA, 22 bp, Homo sapiens
ttgtccttacctcaatctggaa

SEQ ID NO: 9325786 - DNA, 22 bp, Homo sapiens
ttgtccttccagactcttccac

SEQ ID NO: 9325787 - DNA, 22 bp, Homo sapiens
ttgcaactaaaagaacttgaca

SEQ ID NO: 9325788 - DNA, 22 bp, Homo sapiens
cattggaatgatcgttttgctg

SEQ ID NO: 9325789 - DNA, 22 bp, Homo sapiens
cattggtttgatattgccatgg

SEQ ID NO: 9325790 - DNA, 22 bp, Homo sapiens
cattggtttgatattgccatgg

SEQ ID NO: 9325791 - DNA, 22 bp, Homo sapiens
cattgtaagctgttgaatcctc

SEQ ID NO: 9325792 - DNA, 20 bp, Homo sapiens
aggcactgttgtctgtatcc

SEQ ID NO: 9325793 - DNA, 22 bp, Homo sapiens
aggcactgttcccagttatcct

SEQ ID NO: 9325794 - DNA, 22 bp, Homo sapiens
aggcactgtgggtgtggccgga

SEQ ID NO: 9325795 - DNA, 21 bp, Homo sapiens
aggcactgtttgtggtttggg

SEQ ID NO: 9325796 - DNA, 21 bp, Homo sapiens
aggcactgtttgtggtttggg

SEQ ID NO: 9325797 - DNA, 21 bp, Homo sapiens
aggcacttaaccaatgttagc

SEQ ID NO: 9325798 - DNA, 22 bp, Homo sapiens
catttattggcatgtagtaggt

SEQ ID NO: 9325799 - DNA, 22 bp, Homo sapiens
aggcactttacaatgtgtgaca

SEQ ID NO: 9325800 - DNA, 22 bp, Homo sapiens
aggcacttgtgactgtctgcat

SEQ ID NO: 9325801 - DNA, 22 bp, Homo sapiens
aggcacttgtgactgtctgcat

SEQ ID NO: 9325802 - DNA, 22 bp, Homo sapiens
aggcacttgtaattgcagtcat

SEQ ID NO: 9325803 - DNA, 22 bp, Homo sapiens
aggcacttggagttctttgccc

SEQ ID NO: 9325804 - DNA, 22 bp, Homo sapiens
aggcacttggaggtctctgccc

SEQ ID NO: 9325805 - DNA, 22 bp, Homo sapiens
aggcacttgcattgatgaggtc

SEQ ID NO: 9325806 - DNA, 22 bp, Homo sapiens
aggcacttgcattgatgaggtc

SEQ ID NO: 9325807 - DNA, 22 bp, Homo sapiens
aggcacttgaattgatgatgtt

SEQ ID NO: 9325808 - DNA, 22 bp, Homo sapiens
aggcacttgaattgatgatgtt

SEQ ID NO: 9325809 - DNA, 22 bp, Homo sapiens
aggcacttgattaatgtgaatt

SEQ ID NO: 9325810 - DNA, 22 bp, Homo sapiens
aggcacttgattaatgtgaatt

SEQ ID NO: 9325811 - DNA, 22 bp, Homo sapiens
aggcacttaacctactaactga

SEQ ID NO: 9325812 - DNA, 22 bp, Homo sapiens
aggcacttcatgggttcaagga

SEQ ID NO: 9325813 - DNA, 22 bp, Homo sapiens
aggcacttaataaggattcaat

SEQ ID NO: 9325814 - DNA, 22 bp, Homo sapiens
aggcacttctcaaattcatgcc

SEQ ID NO: 9325815 - DNA, 22 bp, Homo sapiens
aggcacttctcaaattcatgcc

SEQ ID NO: 9325816 - DNA, 22 bp, Homo sapiens
aggcacttcatgggttcaagga

SEQ ID NO: 9325817 - DNA, 22 bp, Homo sapiens
catttattggttaggccagcag

SEQ ID NO: 9325818 - DNA, 22 bp, Homo sapiens
catttcaaaagaattgccagaa

SEQ ID NO: 9325819 - DNA, 22 bp, Homo sapiens
catttcaaacagttacagctgc

SEQ ID NO: 9325820 - DNA, 22 bp, Homo sapiens
catttattggcatgtagtaggt

SEQ ID NO: 9325821 - DNA, 22 bp, Homo sapiens
catttattggttaggccagcag

SEQ ID NO: 9325822 - DNA, 22 bp, Homo sapiens
catttattggttaggccagcag

SEQ ID NO: 9325823 - DNA, 22 bp, Homo sapiens
catttattggttaggccagcag

SEQ ID NO: 9325824 - DNA, 22 bp, Homo sapiens
catttattggttaggccagcag

SEQ ID NO: 9325825 - DNA, 23 bp, Homo sapiens
catttcaacgaattttccttctg

SEQ ID NO: 9325826 - DNA, 22 bp, Homo sapiens
catttcaagtaacagattgctt

SEQ ID NO: 9325827 - DNA, 22 bp, Homo sapiens
catttcacaaatggccacatca

SEQ ID NO: 9325828 - DNA, 22 bp, Homo sapiens
catttcacagtaaagtgatttc

SEQ ID NO: 9325829 - DNA, 22 bp, Homo sapiens
catttctccgccgagatcactg

SEQ ID NO: 9325830 - DNA, 22 bp, Homo sapiens
catttcaatgccttcaacatag

SEQ ID NO: 9325831 - DNA, 22 bp, Homo sapiens
catttcaatgccttcaacatag

SEQ ID NO: 9325832 - DNA, 22 bp, Homo sapiens
aggcaaggtgctcttgctctat

SEQ ID NO: 9325833 - DNA, 22 bp, Homo sapiens
aggcaaggtgctacagacagtg

SEQ ID NO: 9325834 - DNA, 22 bp, Homo sapiens
aggcaaggtgctacagacagtg

SEQ ID NO: 9325835 - DNA, 17 bp, Homo sapiens
aggcaatgactgtggtt

SEQ ID NO: 9325836 - DNA, 22 bp, Homo sapiens
cattgcttcctatgtcccttct

SEQ ID NO: 9325837 - DNA, 22 bp, Homo sapiens
cattggaaaatgcatgcttttt

SEQ ID NO: 9325838 - DNA, 22 bp, Homo sapiens
cattgcttgatagctgaaaatt

SEQ ID NO: 9325839 - DNA, 22 bp, Homo sapiens
cattgctgcttccaggcacagg

SEQ ID NO: 9325840 - DNA, 22 bp, Homo sapiens
cattgctgtagtccagatgagg

SEQ ID NO: 9325841 - DNA, 22 bp, Homo sapiens
cattgctgttaattgtctctag

SEQ ID NO: 9325842 - DNA, 22 bp, Homo sapiens
cattgcttatttcagctaaagt

SEQ ID NO: 9325843 - DNA, 22 bp, Homo sapiens
cattgcattggattgtacttgt

SEQ ID NO: 9325844 - DNA, 22 bp, Homo sapiens
cattgcacttctgcttttcctc

SEQ ID NO: 9325845 - DNA, 22 bp, Homo sapiens
aggcaagggggcgccaccttcc

SEQ ID NO: 9325846 - DNA, 22 bp, Homo sapiens
aggcaagggggcgccaccttcc

SEQ ID NO: 9325847 - DNA, 22 bp, Homo sapiens
aggcaaggtgctacagacagtg

SEQ ID NO: 9325848 - DNA, 22 bp, Homo sapiens
aggcaaggtgctacagacagtg

SEQ ID NO: 9325849 - DNA, 20 bp, Homo sapiens
aggcaaggtagatgtctgct

SEQ ID NO: 9325850 - DNA, 20 bp, Homo sapiens
aggcaaggtagatgtctgct

SEQ ID NO: 9325851 - DNA, 22 bp, Homo sapiens
aggcaagcattgggaacagggc

SEQ ID NO: 9325852 - DNA, 22 bp, Homo sapiens
aggcaagaaactttctgggaga

SEQ ID NO: 9325853 - DNA, 22 bp, Homo sapiens
aggcaagagtgactacgtgaaa

SEQ ID NO: 9325854 - DNA, 23 bp, Homo sapiens
aggcaagaacgggttgttcaccc

SEQ ID NO: 9325855 - DNA, 22 bp, Homo sapiens
aggcaagaacagacatgggagt

SEQ ID NO: 9325856 - DNA, 22 bp, Homo sapiens
aggcaagaacagacatgggagt

SEQ ID NO: 9325857 - DNA, 22 bp, Homo sapiens
aggcaagaacagacatgggagt

SEQ ID NO: 9325858 - DNA, 22 bp, Homo sapiens
ccactcagcacagtggatgcag

SEQ ID NO: 9325859 - DNA, 22 bp, Homo sapiens
ccactcaggcctcctgctctcc

SEQ ID NO: 9325860 - DNA, 22 bp, Homo sapiens
ccacggccacccgctcatgggc

SEQ ID NO: 9325861 - DNA, 22 bp, Homo sapiens
ccacgctccctgatccctgctt

SEQ ID NO: 9325862 - DNA, 22 bp, Homo sapiens
ccacgagggaaccaggtggggt

SEQ ID NO: 9325863 - DNA, 22 bp, Homo sapiens
ccacgaggctatcctgctaggg

SEQ ID NO: 9325864 - DNA, 20 bp, Homo sapiens
ccacctggccaaggctgtgc

SEQ ID NO: 9325865 - DNA, 22 bp, Homo sapiens
ccaccttgggactgctcacccc

SEQ ID NO: 9325866 - DNA, 22 bp, Homo sapiens
ccacctggggctgtggcccctt

SEQ ID NO: 9325867 - DNA, 23 bp, Homo sapiens
ccacctggactctgggcaggtgc

SEQ ID NO: 9325868 - DNA, 22 bp, Homo sapiens
ccacccagcagaggaggcaaga

SEQ ID NO: 9325869 - DNA, 22 bp, Homo sapiens
ccacccagaccagggatctggg

SEQ ID NO: 9325870 - DNA, 20 bp, Homo sapiens
ccacccacgcgggctctgcc

SEQ ID NO: 9325871 - DNA, 22 bp, Homo sapiens
ccacatctaagccttcatgata

SEQ ID NO: 9325872 - DNA, 22 bp, Homo sapiens
ccacatcagaaatgtttactca

SEQ ID NO: 9325873 - DNA, 22 bp, Homo sapiens
ccacatcatggatacagttatg

SEQ ID NO: 9325874 - DNA, 21 bp, Homo sapiens
ccaccaggtcttctgctcggg

SEQ ID NO: 9325875 - DNA, 22 bp, Homo sapiens
ccaccaggctctgtccgagcgg

SEQ ID NO: 9325876 - DNA, 22 bp, Homo sapiens
ccaccaggcactcacagggaag

SEQ ID NO: 9325877 - DNA, 22 bp, Homo sapiens
ccaccaggcactcacagggaag

SEQ ID NO: 9325878 - DNA, 22 bp, Homo sapiens
ccacatctccctattgctcttt

SEQ ID NO: 9325879 - DNA, 22 bp, Homo sapiens
ccacatctcggtcccctctttg

SEQ ID NO: 9325880 - DNA, 22 bp, Homo sapiens
ccacatctatctttagtatgaa

SEQ ID NO: 9325881 - DNA, 20 bp, Homo sapiens
ccacccacgcgggctctgcc

SEQ ID NO: 9325882 - DNA, 22 bp, Homo sapiens
ccacccacaaccagctggctgt

SEQ ID NO: 9325883 - DNA, 22 bp, Homo sapiens
ccacccacaaccagctggctgt

SEQ ID NO: 9325884 - DNA, 21 bp, Homo sapiens
ccaccaggtcttctgctcggg

SEQ ID NO: 9325885 - DNA, 21 bp, Homo sapiens
ccaccaggtcttctgctcggg

SEQ ID NO: 9325886 - DNA, 22 bp, Homo sapiens
ccacagtttcttcatctataaa

SEQ ID NO: 9325887 - DNA, 22 bp, Homo sapiens
ccacagttattcatttgtgaca

SEQ ID NO: 9325888 - DNA, 22 bp, Homo sapiens
ccacagtggttgtggcatgtgg

SEQ ID NO: 9325889 - DNA, 20 bp, Homo sapiens
ccacagtggagactggagac

SEQ ID NO: 9325890 - DNA, 22 bp, Homo sapiens
catttgaaacctggaatctacc

SEQ ID NO: 9325891 - DNA, 22 bp, Homo sapiens
ccaatgagacagaaagagcctc

SEQ ID NO: 9325892 - DNA, 22 bp, Homo sapiens
ccacagaatgatgacacttcag

SEQ ID NO: 9325893 - DNA, 22 bp, Homo sapiens
catttctgtcacgttcttttat

SEQ ID NO: 9325894 - DNA, 22 bp, Homo sapiens
catttctgtgacacttccatct

SEQ ID NO: 9325895 - DNA, 22 bp, Homo sapiens
catttctgttctcttcctgtac

SEQ ID NO: 9325896 - DNA, 23 bp, Homo sapiens
catttctgggagatttataaaat

SEQ ID NO: 9325897 - DNA, 22 bp, Homo sapiens
ccacagagactctgcaggactg

SEQ ID NO: 9325898 - DNA, 19 bp, Homo sapiens
ccacagagactagaagaca

SEQ ID NO: 9325899 - DNA, 22 bp, Homo sapiens
ccacagagagtgtcagcctttg

SEQ ID NO: 9325900 - DNA, 22 bp, Homo sapiens
ccacagagacagagcccagggt

SEQ ID NO: 9325901 - DNA, 22 bp, Homo sapiens
ccacagagacagggtccttgct

SEQ ID NO: 9325902 - DNA, 23 bp, Homo sapiens
ccacagagctgccaattcctgtg

SEQ ID NO: 9325903 - DNA, 22 bp, Homo sapiens
aggcaggaaaatcgcttgaacc

SEQ ID NO: 9325904 - DNA, 19 bp, Homo sapiens
ccacagagcatgctgaggc

SEQ ID NO: 9325905 - DNA, 17 bp, Homo sapiens
aggcaggagattggaga

SEQ ID NO: 9325906 - DNA, 22 bp, Homo sapiens
aggcaggaggatcatggatgca

SEQ ID NO: 9325907 - DNA, 23 bp, Homo sapiens
ccacaggcacagaggcttgcatc

SEQ ID NO: 9325908 - DNA, 22 bp, Homo sapiens
ccacaggcggagtggcgggcag

SEQ ID NO: 9325909 - DNA, 20 bp, Homo sapiens
ccacagtggagactggagac

SEQ ID NO: 9325910 - DNA, 18 bp, Homo sapiens
aggcaggatcctggcctc

SEQ ID NO: 9325911 - DNA, 18 bp, Homo sapiens
aggcaggatcctggcctc

SEQ ID NO: 9325912 - DNA, 22 bp, Homo sapiens
aggcaggaggatcatggatgca

SEQ ID NO: 9325913 - DNA, 22 bp, Homo sapiens
aggagccaggaaacctgctctg

SEQ ID NO: 9325914 - DNA, 22 bp, Homo sapiens
aggagccaggaaacctgctctg

SEQ ID NO: 9325915 - DNA, 22 bp, Homo sapiens
aggagccaggccccatggggct

SEQ ID NO: 9325916 - DNA, 22 bp, Homo sapiens
aggagccacctaggagctgttt

SEQ ID NO: 9325917 - DNA, 22 bp, Homo sapiens
cagtgttgctaagttctgaact

SEQ ID NO: 9325918 - DNA, 22 bp, Homo sapiens
cagtgtgtttcatgtaggtcct

SEQ ID NO: 9325919 - DNA, 22 bp, Homo sapiens
cagtgtgtctcttgtcctggct

SEQ ID NO: 9325920 - DNA, 22 bp, Homo sapiens
cagtgtgtctcttgtcctggct

SEQ ID NO: 9325921 - DNA, 22 bp, Homo sapiens
cagtgtggtgagattccaggtg

SEQ ID NO: 9325922 - DNA, 22 bp, Homo sapiens
cagtccagctcatcagtggcac

SEQ ID NO: 9325923 - DNA, 22 bp, Homo sapiens
cagtccaggcctggaggagcca

SEQ ID NO: 9325924 - DNA, 22 bp, Homo sapiens
cagtccagctcatcagtggcac

SEQ ID NO: 9325925 - DNA, 22 bp, Homo sapiens
cagtccagctcatcagtggcac

SEQ ID NO: 9325926 - DNA, 22 bp, Homo sapiens
cagtccaggcctggaggagcca

SEQ ID NO: 9325927 - DNA, 22 bp, Homo sapiens
cagtccaggcctggaggagcca

SEQ ID NO: 9325928 - DNA, 22 bp, Homo sapiens
cagtccagagcccaccagagga

SEQ ID NO: 9325929 - DNA, 21 bp, Homo sapiens
cagtgtggtgaccagggtctc

SEQ ID NO: 9325930 - DNA, 22 bp, Homo sapiens
cagtgtgggtttgggaggagta

SEQ ID NO: 9325931 - DNA, 22 bp, Homo sapiens
cagtggttcctgttcttctggg

SEQ ID NO: 9325932 - DNA, 22 bp, Homo sapiens
cagtggttctcaatcaggaatg

SEQ ID NO: 9325933 - DNA, 22 bp, Homo sapiens
cagtgtgcctgaatcaagtgtt

SEQ ID NO: 9325934 - DNA, 20 bp, Homo sapiens
cagtccaggctgcagcatct

SEQ ID NO: 9325935 - DNA, 22 bp, Homo sapiens
aggagccatccccatgagaggt

SEQ ID NO: 9325936 - DNA, 22 bp, Homo sapiens
cataacattaagcctctatttc

SEQ ID NO: 9325937 - DNA, 22 bp, Homo sapiens
cataacatctgtgaagcaggaa

SEQ ID NO: 9325938 - DNA, 22 bp, Homo sapiens
cataactgggagatccaagggt

SEQ ID NO: 9325939 - DNA, 22 bp, Homo sapiens
aggagctgtcagagtgccagag

SEQ ID NO: 9325940 - DNA, 22 bp, Homo sapiens
aggagctgtcagagtgccagag

SEQ ID NO: 9325941 - DNA, 22 bp, Homo sapiens
aggagctgtgaatgggaggggt

SEQ ID NO: 9325942 - DNA, 22 bp, Homo sapiens
aggagctgtgaatgggaggggt

SEQ ID NO: 9325943 - DNA, 22 bp, Homo sapiens
aggagctggtagtctcattggg

SEQ ID NO: 9325944 - DNA, 22 bp, Homo sapiens
aggagctgggttcctttggtgg

SEQ ID NO: 9325945 - DNA, 22 bp, Homo sapiens
aggagctgtcagagtgccagag

SEQ ID NO: 9325946 - DNA, 22 bp, Homo sapiens
aggagctggtagtctcattggg

SEQ ID NO: 9325947 - DNA, 16 bp, Homo sapiens
aggagctgggtaggag

SEQ ID NO: 9325948 - DNA, 17 bp, Homo sapiens
aggagctgggggtggtg

SEQ ID NO: 9325949 - DNA, 17 bp, Homo sapiens
aggagctgggggtggtg

SEQ ID NO: 9325950 - DNA, 16 bp, Homo sapiens
aggagctgggtaggag

SEQ ID NO: 9325951 - DNA, 22 bp, Homo sapiens
aggaggcagatgcttggctgta

SEQ ID NO: 9325952 - DNA, 22 bp, Homo sapiens
aggaggcagatgcttggctgta

SEQ ID NO: 9325953 - DNA, 22 bp, Homo sapiens
aggaggcagatgcttggctgta

SEQ ID NO: 9325954 - DNA, 22 bp, Homo sapiens
aggaggcaggaagtctatggga

SEQ ID NO: 9325955 - DNA, 22 bp, Homo sapiens
aggaggcaggaagtctatggga

SEQ ID NO: 9325956 - DNA, 22 bp, Homo sapiens
aggaggcagatgcttggctgta

SEQ ID NO: 9325957 - DNA, 22 bp, Homo sapiens
aggaggcagatgcttggctgta

SEQ ID NO: 9325958 - DNA, 22 bp, Homo sapiens
aggagctgtgaatgggaggggt

SEQ ID NO: 9325959 - DNA, 22 bp, Homo sapiens
aggaggccgggattctggagat

SEQ ID NO: 9325960 - DNA, 22 bp, Homo sapiens
catcttgtgaatttctgattct

SEQ ID NO: 9325961 - DNA, 22 bp, Homo sapiens
catcttcaggtgttttccatca

SEQ ID NO: 9325962 - DNA, 22 bp, Homo sapiens
catcttcaggggctacatctgt

SEQ ID NO: 9325963 - DNA, 22 bp, Homo sapiens
catcttcaggggctacatctgt

SEQ ID NO: 9325964 - DNA, 22 bp, Homo sapiens
catcttcattttgtccagtact

SEQ ID NO: 9325965 - DNA, 22 bp, Homo sapiens
aggatggcttgcaggaggctgt

SEQ ID NO: 9325966 - DNA, 22 bp, Homo sapiens
aggatggcttgcaggaggctgt

SEQ ID NO: 9325967 - DNA, 22 bp, Homo sapiens
aggatggggtctgcagcctggt

SEQ ID NO: 9325968 - DNA, 22 bp, Homo sapiens
aggatgggcctgggatatgctt

SEQ ID NO: 9325969 - DNA, 23 bp, Homo sapiens
aggatgtaggatgtatggcagag

SEQ ID NO: 9325970 - DNA, 23 bp, Homo sapiens
aggatgtaggatgtatggcagag

SEQ ID NO: 9325971 - DNA, 22 bp, Homo sapiens
aggatggggtctgcagcctggt

SEQ ID NO: 9325972 - DNA, 22 bp, Homo sapiens
aggatggggtctgcagcctggt

SEQ ID NO: 9325973 - DNA, 22 bp, Homo sapiens
aggatgtcagcattggctagag

SEQ ID NO: 9325974 - DNA, 22 bp, Homo sapiens
aggatgtcagtcagcttggatt

SEQ ID NO: 9325975 - DNA, 22 bp, Homo sapiens
aggatgtcagcattggctagag

SEQ ID NO: 9325976 - DNA, 22 bp, Homo sapiens
aggatgtcagcattggctagag

SEQ ID NO: 9325977 - DNA, 20 bp, Homo sapiens
aggatgtccccgagggcctg

SEQ ID NO: 9325978 - DNA, 20 bp, Homo sapiens
aggatgtccccgagggcctg

SEQ ID NO: 9325979 - DNA, 22 bp, Homo sapiens
aggatgtccacccagaccttgc

SEQ ID NO: 9325980 - DNA, 22 bp, Homo sapiens
aggatgtgccaccagctttgca

SEQ ID NO: 9325981 - DNA, 22 bp, Homo sapiens
aggatgtctctggaccaggatg

SEQ ID NO: 9325982 - DNA, 22 bp, Homo sapiens
aggatgtctgctgctgtgggct

SEQ ID NO: 9325983 - DNA, 22 bp, Homo sapiens
aggatgtctgctgctgtgggct

SEQ ID NO: 9325984 - DNA, 22 bp, Homo sapiens
aggatgtctctccagcctggag

SEQ ID NO: 9325985 - DNA, 23 bp, Homo sapiens
aggatgtcgaatgttagagtgag

SEQ ID NO: 9325986 - DNA, 22 bp, Homo sapiens
aggatgtctctccagcctggag

SEQ ID NO: 9325987 - DNA, 22 bp, Homo sapiens
catgagagacattctgtgtgaa

SEQ ID NO: 9325988 - DNA, 22 bp, Homo sapiens
catgaggtcagggggagccggt

SEQ ID NO: 9325989 - DNA, 19 bp, Homo sapiens
catgaggcagctgcacccc

SEQ ID NO: 9325990 - DNA, 22 bp, Homo sapiens
catgaggatgggcagctgggga

SEQ ID NO: 9325991 - DNA, 18 bp, Homo sapiens
catgagctgcccctagac

SEQ ID NO: 9325992 - DNA, 22 bp, Homo sapiens
catgagatttgggaggggccag

SEQ ID NO: 9325993 - DNA, 22 bp, Homo sapiens
catgagcataaatcagtcacga

SEQ ID NO: 9325994 - DNA, 22 bp, Homo sapiens
catctcatttattccaactcag

SEQ ID NO: 9325995 - DNA, 22 bp, Homo sapiens
catctcatcctgccctaaaaca

SEQ ID NO: 9325996 - DNA, 22 bp, Homo sapiens
catctcccacttccttgggggt

SEQ ID NO: 9325997 - DNA, 22 bp, Homo sapiens
catctccaggagttctactcat

SEQ ID NO: 9325998 - DNA, 20 bp, Homo sapiens
catctcctgcctccatgttc

SEQ ID NO: 9325999 - DNA, 20 bp, Homo sapiens
catctcctgcctccatgttc

SEQ ID NO: 9326000 - DNA, 22 bp, Homo sapiens
catctctccacggcagctctcg

SEQ ID NO: 9326001 - DNA, 22 bp, Homo sapiens
catctcctttggtctacttcca

SEQ ID NO: 9326002 - DNA, 22 bp, Homo sapiens
catctcctttggtctacttcca

SEQ ID NO: 9326003 - DNA, 22 bp, Homo sapiens
catctcatagtgcagtgctgta

SEQ ID NO: 9326004 - DNA, 22 bp, Homo sapiens
catctcatagtgcagtgctgta

SEQ ID NO: 9326005 - DNA, 22 bp, Homo sapiens
catctcatcctgccctaaaaca

SEQ ID NO: 9326006 - DNA, 22 bp, Homo sapiens
catctcatcagtgagagtcagc

SEQ ID NO: 9326007 - DNA, 22 bp, Homo sapiens
catacatatgtggatgtcatat

SEQ ID NO: 9326008 - DNA, 22 bp, Homo sapiens
catacatatgcatgtgtgtata

SEQ ID NO: 9326009 - DNA, 22 bp, Homo sapiens
catccaaactctcattatctgt

SEQ ID NO: 9326010 - DNA, 22 bp, Homo sapiens
catctctccacggcagctctcg

SEQ ID NO: 9326011 - DNA, 22 bp, Homo sapiens
catctctccacggcagctctcg

SEQ ID NO: 9326012 - DNA, 22 bp, Homo sapiens
catctctgagacctcagctggg

SEQ ID NO: 9326013 - DNA, 22 bp, Homo sapiens
catctctccacggcagctctcg

SEQ ID NO: 9326014 - DNA, 22 bp, Homo sapiens
catctctgagacctcagctggg

SEQ ID NO: 9326015 - DNA, 22 bp, Homo sapiens
catctctgtgtccccagagctt

SEQ ID NO: 9326016 - DNA, 22 bp, Homo sapiens
catctctgtgtccccagagctt

SEQ ID NO: 9326017 - DNA, 22 bp, Homo sapiens
catctctgtgtccccagagctt

SEQ ID NO: 9326018 - DNA, 22 bp, Homo sapiens
catctctgtgtccccagagctt

SEQ ID NO: 9326019 - DNA, 22 bp, Homo sapiens
catcttcacatatttccaatga

SEQ ID NO: 9326020 - DNA, 22 bp, Homo sapiens
catacaaatgtgtccaggctct

SEQ ID NO: 9326021 - DNA, 22 bp, Homo sapiens
catacaaatgtgtccaggctct

SEQ ID NO: 9326022 - DNA, 22 bp, Homo sapiens
aggaggctgaactagggtctgg

SEQ ID NO: 9326023 - DNA, 22 bp, Homo sapiens
aggaggcctggctggggagatc

SEQ ID NO: 9326024 - DNA, 23 bp, Homo sapiens
aggaggcctgaaactgaggctga

SEQ ID NO: 9326025 - DNA, 22 bp, Homo sapiens
aggaggcctgcagctgccattc

SEQ ID NO: 9326026 - DNA, 22 bp, Homo sapiens
aggaggctctcaggtcctcccc

SEQ ID NO: 9326027 - DNA, 22 bp, Homo sapiens
aggaggctctcaggtcctcccc

SEQ ID NO: 9326028 - DNA, 22 bp, Homo sapiens
aggaggccttggggcttagagc

SEQ ID NO: 9326029 - DNA, 22 bp, Homo sapiens
aggaggcctgttttctcctgga

SEQ ID NO: 9326030 - DNA, 22 bp, Homo sapiens
catacatactgagtggactgat

SEQ ID NO: 9326031 - DNA, 22 bp, Homo sapiens
catacataccactgctgtcttt

SEQ ID NO: 9326032 - DNA, 22 bp, Homo sapiens
catacaatcaagttctttatta

SEQ ID NO: 9326033 - DNA, 22 bp, Homo sapiens
cagtaaatgagaagctagtaat

SEQ ID NO: 9326034 - DNA, 22 bp, Homo sapiens
cagtaacacaaccactccgtga

SEQ ID NO: 9326035 - DNA, 22 bp, Homo sapiens
cagtaacagtgatcacctgtgg

SEQ ID NO: 9326036 - DNA, 22 bp, Homo sapiens
cagtaacagtgatcacctgtgg

SEQ ID NO: 9326037 - DNA, 22 bp, Homo sapiens
cagtaaacactagcattcttgg

SEQ ID NO: 9326038 - DNA, 22 bp, Homo sapiens
aggacagagggaccagagccca

SEQ ID NO: 9326039 - DNA, 22 bp, Homo sapiens
aggacagagggaccagagccca

SEQ ID NO: 9326040 - DNA, 22 bp, Homo sapiens
aggacagagggaccagagccca

SEQ ID NO: 9326041 - DNA, 22 bp, Homo sapiens
aggacagagggaccagagccca

SEQ ID NO: 9326042 - DNA, 22 bp, Homo sapiens
aggacagatttttggccaccag

SEQ ID NO: 9326043 - DNA, 21 bp, Homo sapiens
aggacagatgtaggaataaag

SEQ ID NO: 9326044 - DNA, 22 bp, Homo sapiens
cagtatttggaatatagctaag

SEQ ID NO: 9326045 - DNA, 22 bp, Homo sapiens
cagtatttggaatatagctaag

SEQ ID NO: 9326046 - DNA, 22 bp, Homo sapiens
cagtatttgttccctatcaatg

SEQ ID NO: 9326047 - DNA, 22 bp, Homo sapiens
cagtatttgttacagcattagc

SEQ ID NO: 9326048 - DNA, 22 bp, Homo sapiens
cagtatttgttacagcattagc

SEQ ID NO: 9326049 - DNA, 22 bp, Homo sapiens
cagtatttatggcttgagtatt

SEQ ID NO: 9326050 - DNA, 22 bp, Homo sapiens
cagtatttatggcttgagtatt

SEQ ID NO: 9326051 - DNA, 22 bp, Homo sapiens
cagtatttcattcagaattgtt

SEQ ID NO: 9326052 - DNA, 22 bp, Homo sapiens
cagtaaggatgcacataactag

SEQ ID NO: 9326053 - DNA, 22 bp, Homo sapiens
cagtaagaatatgaatcaggat

SEQ ID NO: 9326054 - DNA, 22 bp, Homo sapiens
cagtaagagttgacaatggcca

SEQ ID NO: 9326055 - DNA, 22 bp, Homo sapiens
aggaatagaccacttcactgag

SEQ ID NO: 9326056 - DNA, 22 bp, Homo sapiens
aggaatatgagctgctgcagtg

SEQ ID NO: 9326057 - DNA, 22 bp, Homo sapiens
aggaatatgagctgctgcagtg

SEQ ID NO: 9326058 - DNA, 22 bp, Homo sapiens
aggaatatagttggaatgtagg

SEQ ID NO: 9326059 - DNA, 22 bp, Homo sapiens
aggaagtggggttctctcactg

SEQ ID NO: 9326060 - DNA, 23 bp, Homo sapiens
aggaagttaaggcagacagacag

SEQ ID NO: 9326061 - DNA, 23 bp, Homo sapiens
aggaagttatgaagggagaatag

SEQ ID NO: 9326062 - DNA, 18 bp, Homo sapiens
aggaatattcaaggtgct

SEQ ID NO: 9326063 - DNA, 22 bp, Homo sapiens
aggaatatggatttgctcagct

SEQ ID NO: 9326064 - DNA, 22 bp, Homo sapiens
aggaatattctcaagtggtcgt

SEQ ID NO: 9326065 - DNA, 22 bp, Homo sapiens
aggacaagctaaaggacttcct

SEQ ID NO: 9326066 - DNA, 22 bp, Homo sapiens
aggacaagacaaggaccagaga

SEQ ID NO: 9326067 - DNA, 22 bp, Homo sapiens
aggacaagacaaggaccagaga

SEQ ID NO: 9326068 - DNA, 22 bp, Homo sapiens
aggaatctgggcccaactgtgc

SEQ ID NO: 9326069 - DNA, 22 bp, Homo sapiens
aggacagagcctgtgcagaccg

SEQ ID NO: 9326070 - DNA, 22 bp, Homo sapiens
aggacagagcctgtgcagaccg

SEQ ID NO: 9326071 - DNA, 22 bp, Homo sapiens
aggacagacctaggactggagc

SEQ ID NO: 9326072 - DNA, 22 bp, Homo sapiens
aggacagacctaggactggagc

SEQ ID NO: 9326073 - DNA, 22 bp, Homo sapiens
aggacagagccctagtttcata

SEQ ID NO: 9326074 - DNA, 22 bp, Homo sapiens
aggacagacctaggactggagc

SEQ ID NO: 9326075 - DNA, 22 bp, Homo sapiens
aggacacatgcacaccctgcgt

SEQ ID NO: 9326076 - DNA, 22 bp, Homo sapiens
aggacacagtggtggggaaaag

SEQ ID NO: 9326077 - DNA, 22 bp, Homo sapiens
cagggctgttagctgctgctct

SEQ ID NO: 9326078 - DNA, 22 bp, Homo sapiens
cagggctgttagctgctgctct

SEQ ID NO: 9326079 - DNA, 22 bp, Homo sapiens
cagggcttactggaggctgctt

SEQ ID NO: 9326080 - DNA, 22 bp, Homo sapiens
cagggcttcgctcctggtgcac

SEQ ID NO: 9326081 - DNA, 22 bp, Homo sapiens
cagggcttcgtgtctcagtgct

SEQ ID NO: 9326082 - DNA, 22 bp, Homo sapiens
cagggcttcgctcctggtgcac

SEQ ID NO: 9326083 - DNA, 22 bp, Homo sapiens
caggtggtgcctccaggctggt

SEQ ID NO: 9326084 - DNA, 22 bp, Homo sapiens
caggtgggccatgaaaaatgac

SEQ ID NO: 9326085 - DNA, 22 bp, Homo sapiens
caggtggtgcctcctcccttcc

SEQ ID NO: 9326086 - DNA, 22 bp, Homo sapiens
caggtggtgcctcctcccttcc

SEQ ID NO: 9326087 - DNA, 22 bp, Homo sapiens
caggtggtgcctccaggctggt

SEQ ID NO: 9326088 - DNA, 22 bp, Homo sapiens
caggtggttccatgtttcatga

SEQ ID NO: 9326089 - DNA, 22 bp, Homo sapiens
caggtggttatgaggaaggtga

SEQ ID NO: 9326090 - DNA, 22 bp, Homo sapiens
caggtggttatgaggaaggtga

SEQ ID NO: 9326091 - DNA, 22 bp, Homo sapiens
aggaagtggataaaatagcttt

SEQ ID NO: 9326092 - DNA, 22 bp, Homo sapiens
aggaagtgctaagagaacatca

SEQ ID NO: 9326093 - DNA, 21 bp, Homo sapiens
aggaagtggccagattgggaa

SEQ ID NO: 9326094 - DNA, 21 bp, Homo sapiens
aggaagtggccagattgggaa

SEQ ID NO: 9326095 - DNA, 22 bp, Homo sapiens
caggtgtcggtcaggcggtttt

SEQ ID NO: 9326096 - DNA, 22 bp, Homo sapiens
caggtgtctaattctcaccccc

SEQ ID NO: 9326097 - DNA, 22 bp, Homo sapiens
aggaagtgaaagggaaggagtt

SEQ ID NO: 9326098 - DNA, 22 bp, Homo sapiens
caggtgtcggtcaggcggtttt

SEQ ID NO: 9326099 - DNA, 16 bp, Homo sapiens
caggtgtcagtcacct

SEQ ID NO: 9326100 - DNA, 22 bp, Homo sapiens
caggtggttgagagctgtaggc

SEQ ID NO: 9326101 - DNA, 22 bp, Homo sapiens
caggtggttgagagctgtaggc

SEQ ID NO: 9326102 - DNA, 22 bp, Homo sapiens
caggtggttgagagctgtaggc

SEQ ID NO: 9326103 - DNA, 22 bp, Homo sapiens
caggtggttccatgtttcatga

SEQ ID NO: 9326104 - DNA, 22 bp, Homo sapiens
caggtggttatgaggaaggtga

SEQ ID NO: 9326105 - DNA, 22 bp, Homo sapiens
caggtggtttgataggataact

SEQ ID NO: 9326106 - DNA, 22 bp, Homo sapiens
caggtggtttgataggataact

SEQ ID NO: 9326107 - DNA, 22 bp, Homo sapiens
caggtggttgtttggattctaa

SEQ ID NO: 9326108 - DNA, 22 bp, Homo sapiens
caggtggttgtttggattctaa

SEQ ID NO: 9326109 - DNA, 22 bp, Homo sapiens
caggtggttgtttggattctaa

SEQ ID NO: 9326110 - DNA, 16 bp, Homo sapiens
caggtgtcagtcacct

SEQ ID NO: 9326111 - DNA, 22 bp, Homo sapiens
caggtgtcagcagcactgtact

SEQ ID NO: 9326112 - DNA, 22 bp, Homo sapiens
caggtgtcagcagcactgtact

SEQ ID NO: 9326113 - DNA, 22 bp, Homo sapiens
caggtgtcaaaatactaagtgg

SEQ ID NO: 9326114 - DNA, 22 bp, Homo sapiens
caggtgtcaaaatactaagtgg

SEQ ID NO: 9326115 - DNA, 22 bp, Homo sapiens
caggtgtcaaaatactaagtgg

SEQ ID NO: 9326116 - DNA, 20 bp, Homo sapiens
caggtgtacagtgagctgag

SEQ ID NO: 9326117 - DNA, 22 bp, Homo sapiens
aggaagagctggaccagaggac

SEQ ID NO: 9326118 - DNA, 22 bp, Homo sapiens
aggaagagctggaccagaggac

SEQ ID NO: 9326119 - DNA, 22 bp, Homo sapiens
aggaagagctggaccagaggac

SEQ ID NO: 9326120 - DNA, 22 bp, Homo sapiens
aggaagagctggaccagaggac

SEQ ID NO: 9326121 - DNA, 22 bp, Homo sapiens
aggaagagctggaccagaggac

SEQ ID NO: 9326122 - DNA, 22 bp, Homo sapiens
aggaagagcccgggtgacataa

SEQ ID NO: 9326123 - DNA, 22 bp, Homo sapiens
aggaagagcccgggtgacataa

SEQ ID NO: 9326124 - DNA, 22 bp, Homo sapiens
aggaagagcattcacatggtag

SEQ ID NO: 9326125 - DNA, 22 bp, Homo sapiens
aggaagagcattcacatggtag

SEQ ID NO: 9326126 - DNA, 18 bp, Homo sapiens
cagggctgtggggtcact

SEQ ID NO: 9326127 - DNA, 18 bp, Homo sapiens
cagggctgtggggtcact

SEQ ID NO: 9326128 - DNA, 23 bp, Homo sapiens
aggaagaggcaatttctcttaga

SEQ ID NO: 9326129 - DNA, 22 bp, Homo sapiens
aggaagagctggaccagaggac

SEQ ID NO: 9326130 - DNA, 22 bp, Homo sapiens
aggaagagctggaccagaggac

SEQ ID NO: 9326131 - DNA, 22 bp, Homo sapiens
aggaagagctggaccagaggac

SEQ ID NO: 9326132 - DNA, 18 bp, Homo sapiens
cagggctgtggggtcact

SEQ ID NO: 9326133 - DNA, 18 bp, Homo sapiens
cagggctgtggggtcact

SEQ ID NO: 9326134 - DNA, 18 bp, Homo sapiens
cagggctgtggggtcact

SEQ ID NO: 9326135 - DNA, 22 bp, Homo sapiens
cagggctgttagctgctgctct

SEQ ID NO: 9326136 - DNA, 22 bp, Homo sapiens
cagggctgttagctgctgctct

SEQ ID NO: 9326137 - DNA, 23 bp, Homo sapiens
cagggctgggcttggtgttaggc

SEQ ID NO: 9326138 - DNA, 22 bp, Homo sapiens
cagggctgggttaaaagcaggg

SEQ ID NO: 9326139 - DNA, 23 bp, Homo sapiens
cagggctgggcttggtgttaggc

SEQ ID NO: 9326140 - DNA, 22 bp, Homo sapiens
cagggctggcttccaagttgtt

SEQ ID NO: 9326141 - DNA, 22 bp, Homo sapiens
cagggctggcttccaagttgtt

SEQ ID NO: 9326142 - DNA, 22 bp, Homo sapiens
cagggctggcttccaagttgtt

SEQ ID NO: 9326143 - DNA, 22 bp, Homo sapiens
cagggctggcttccaagttgtt

SEQ ID NO: 9326144 - DNA, 22 bp, Homo sapiens
cagggctgggttaaaagcaggg

SEQ ID NO: 9326145 - DNA, 22 bp, Homo sapiens
cagggctgggttaaaagcaggg

SEQ ID NO: 9326146 - DNA, 19 bp, Homo sapiens
aggaaaggatcaaaatagc

SEQ ID NO: 9326147 - DNA, 22 bp, Homo sapiens
cagggctgggttaaaagcaggg

SEQ ID NO: 9326148 - DNA, 22 bp, Homo sapiens
aggaaaggattggcttctctgt

SEQ ID NO: 9326149 - DNA, 22 bp, Homo sapiens
aggaaaggattggcttctctgt

SEQ ID NO: 9326150 - DNA, 22 bp, Homo sapiens
aggaaaggcctcagcagaaacc

SEQ ID NO: 9326151 - DNA, 22 bp, Homo sapiens
aggaaaggcctcagcagaaacc

SEQ ID NO: 9326152 - DNA, 21 bp, Homo sapiens
aggaaaggccagcacgtaggg

SEQ ID NO: 9326153 - DNA, 21 bp, Homo sapiens
aggaaaggccagcacgtaggg

SEQ ID NO: 9326154 - DNA, 21 bp, Homo sapiens
aggaaaggccagcacgtaggg

SEQ ID NO: 9326155 - DNA, 22 bp, Homo sapiens
aggaaaggcctttgcatttggt

SEQ ID NO: 9326156 - DNA, 22 bp, Homo sapiens
aggaaaggcctttgcatttggt

SEQ ID NO: 9326157 - DNA, 22 bp, Homo sapiens
aggaaaggcctcagcagaaacc

SEQ ID NO: 9326158 - DNA, 22 bp, Homo sapiens
cagggcagggatgttgcggcag

SEQ ID NO: 9326159 - DNA, 22 bp, Homo sapiens
cagggcagggccacaccccctg

SEQ ID NO: 9326160 - DNA, 22 bp, Homo sapiens
cagggcagggatgttgcggcag

SEQ ID NO: 9326161 - DNA, 22 bp, Homo sapiens
cagggcagggatgttgcggcag

SEQ ID NO: 9326162 - DNA, 22 bp, Homo sapiens
cagggcagggagcttagaatga

SEQ ID NO: 9326163 - DNA, 22 bp, Homo sapiens
cagggcagggagcttagaatga

SEQ ID NO: 9326164 - DNA, 22 bp, Homo sapiens
cagggcagggagcttagaatga

SEQ ID NO: 9326165 - DNA, 22 bp, Homo sapiens
cagggcagggagcttagaatga

SEQ ID NO: 9326166 - DNA, 22 bp, Homo sapiens
cagggcagggccacaccccctg

SEQ ID NO: 9326167 - DNA, 22 bp, Homo sapiens
cagggcagtaacgggaacatct

SEQ ID NO: 9326168 - DNA, 22 bp, Homo sapiens
cagggcagggccacaccccctg

SEQ ID NO: 9326169 - DNA, 22 bp, Homo sapiens
cagggcagtaacgggaacatct

SEQ ID NO: 9326170 - DNA, 22 bp, Homo sapiens
caggctcttttggtggcaagga

SEQ ID NO: 9326171 - DNA, 22 bp, Homo sapiens
caggctcttttggtggcaagga

SEQ ID NO: 9326172 - DNA, 22 bp, Homo sapiens
caggctcttccatcctgctgag

SEQ ID NO: 9326173 - DNA, 22 bp, Homo sapiens
caggctcttttggtggcaagga

SEQ ID NO: 9326174 - DNA, 22 bp, Homo sapiens
cagggcaggatgctgtgattat

SEQ ID NO: 9326175 - DNA, 22 bp, Homo sapiens
cagggcaggatgctgtgattat

SEQ ID NO: 9326176 - DNA, 22 bp, Homo sapiens
cagggcaggatgctgtgattat

SEQ ID NO: 9326177 - DNA, 22 bp, Homo sapiens
cagggcaggatgctgtgattat

SEQ ID NO: 9326178 - DNA, 22 bp, Homo sapiens
cagggcaggatgctgtgattat

SEQ ID NO: 9326179 - DNA, 22 bp, Homo sapiens
caggctgagctctggcctgggc

SEQ ID NO: 9326180 - DNA, 22 bp, Homo sapiens
caggctgagctctggcctgggc

SEQ ID NO: 9326181 - DNA, 22 bp, Homo sapiens
cagggatgtgatgagctgagcc

SEQ ID NO: 9326182 - DNA, 22 bp, Homo sapiens
cagggatgtgatgagctgagcc

SEQ ID NO: 9326183 - DNA, 22 bp, Homo sapiens
cagggctggctgtggcaatctc

SEQ ID NO: 9326184 - DNA, 22 bp, Homo sapiens
cagggctggctgtggcaatctc

SEQ ID NO: 9326185 - DNA, 22 bp, Homo sapiens
cagggctggctcatgaaaagtt

SEQ ID NO: 9326186 - DNA, 22 bp, Homo sapiens
cagggctggctcatgaaaagtt

SEQ ID NO: 9326187 - DNA, 22 bp, Homo sapiens
cagggctggctcatgaaaagtt

SEQ ID NO: 9326188 - DNA, 22 bp, Homo sapiens
cagggctggatttcatttctag

SEQ ID NO: 9326189 - DNA, 22 bp, Homo sapiens
cagggctggctcatgaaaagtt

SEQ ID NO: 9326190 - DNA, 20 bp, Homo sapiens
cagggctctgggcctggcct

SEQ ID NO: 9326191 - DNA, 22 bp, Homo sapiens
cagggctctgccttgagggatg

SEQ ID NO: 9326192 - DNA, 22 bp, Homo sapiens
agctttgggattcaggcaggaa

SEQ ID NO: 9326193 - DNA, 22 bp, Homo sapiens
agctttggccctggaggttact

SEQ ID NO: 9326194 - DNA, 22 bp, Homo sapiens
cagggcagtaacgggaacatct

SEQ ID NO: 9326195 - DNA, 22 bp, Homo sapiens
cagggcagtaacgggaacatct

SEQ ID NO: 9326196 - DNA, 22 bp, Homo sapiens
agctttgaagtatttggtctcc

SEQ ID NO: 9326197 - DNA, 22 bp, Homo sapiens
agctttgaatctggtgtttgca

SEQ ID NO: 9326198 - DNA, 22 bp, Homo sapiens
agctttgaaattatgtttcaga

SEQ ID NO: 9326199 - DNA, 22 bp, Homo sapiens
agctttgaatgagtgcattgca

SEQ ID NO: 9326200 - DNA, 22 bp, Homo sapiens
caggagtgaaatgaggcccagg

SEQ ID NO: 9326201 - DNA, 22 bp, Homo sapiens
caggagtctgttcctcatttgt

SEQ ID NO: 9326202 - DNA, 22 bp, Homo sapiens
caggatggagagtgaggggtca

SEQ ID NO: 9326203 - DNA, 22 bp, Homo sapiens
caggatggagagtgaggggtca

SEQ ID NO: 9326204 - DNA, 22 bp, Homo sapiens
caggagcccagagtcctcagct

SEQ ID NO: 9326205 - DNA, 22 bp, Homo sapiens
caggatggagggagggctgtta

SEQ ID NO: 9326206 - DNA, 22 bp, Homo sapiens
caggatggagggagggctgtta

SEQ ID NO: 9326207 - DNA, 22 bp, Homo sapiens
caggatggagagttgttggttg

SEQ ID NO: 9326208 - DNA, 22 bp, Homo sapiens
caggatggagggagggctgtta

SEQ ID NO: 9326209 - DNA, 22 bp, Homo sapiens
caggatggccccggggctgtgc

SEQ ID NO: 9326210 - DNA, 22 bp, Homo sapiens
caggatggccccggggctgtgc

SEQ ID NO: 9326211 - DNA, 22 bp, Homo sapiens
caggatggccccggggctgtgc

SEQ ID NO: 9326212 - DNA, 22 bp, Homo sapiens
caggatggcagagaaaagggtg

SEQ ID NO: 9326213 - DNA, 22 bp, Homo sapiens
caggatggcagagaaaagggtg

SEQ ID NO: 9326214 - DNA, 22 bp, Homo sapiens
caggagcagagggtggtcagca

SEQ ID NO: 9326215 - DNA, 22 bp, Homo sapiens
caggagcagagggtggtcagca

SEQ ID NO: 9326216 - DNA, 22 bp, Homo sapiens
caggagcaggcccaaggacaca

SEQ ID NO: 9326217 - DNA, 18 bp, Homo sapiens
caggagcaggagttgaac

SEQ ID NO: 9326218 - DNA, 22 bp, Homo sapiens
caggagcatgctgatgccagaa

SEQ ID NO: 9326219 - DNA, 22 bp, Homo sapiens
caggagcatgctgatgccagaa

SEQ ID NO: 9326220 - DNA, 22 bp, Homo sapiens
caggagcaggcccaaggacaca

SEQ ID NO: 9326221 - DNA, 22 bp, Homo sapiens
caggagccacattccaccttga

SEQ ID NO: 9326222 - DNA, 20 bp, Homo sapiens
caggcacactcattcctgct

SEQ ID NO: 9326223 - DNA, 22 bp, Homo sapiens
caggcacacccactggtgcaga

SEQ ID NO: 9326224 - DNA, 22 bp, Homo sapiens
caggcacacccactggtgcaga

SEQ ID NO: 9326225 - DNA, 22 bp, Homo sapiens
caggcagagtgaggtggtctaa

SEQ ID NO: 9326226 - DNA, 22 bp, Homo sapiens
caggcagcctgcggtctgcaca

SEQ ID NO: 9326227 - DNA, 20 bp, Homo sapiens
caggcacactcattcctgct

SEQ ID NO: 9326228 - DNA, 22 bp, Homo sapiens
caggcacacaggctccctgggc

SEQ ID NO: 9326229 - DNA, 22 bp, Homo sapiens
caggcacacagcacatggcctg

SEQ ID NO: 9326230 - DNA, 22 bp, Homo sapiens
caggcacacaggctccctgggc

SEQ ID NO: 9326231 - DNA, 22 bp, Homo sapiens
caggcacacaggctccctgggc

SEQ ID NO: 9326232 - DNA, 22 bp, Homo sapiens
caggcacacatccgtgagagat

SEQ ID NO: 9326233 - DNA, 22 bp, Homo sapiens
caggcacacatccgtgagagat

SEQ ID NO: 9326234 - DNA, 22 bp, Homo sapiens
caggcacacatccgtgagagat

SEQ ID NO: 9326235 - DNA, 22 bp, Homo sapiens
caggcacacagcacatggcctg

SEQ ID NO: 9326236 - DNA, 22 bp, Homo sapiens
caggcacacagcacatggcctg

SEQ ID NO: 9326237 - DNA, 22 bp, Homo sapiens
caggcacacagcacatggcctg

SEQ ID NO: 9326238 - DNA, 22 bp, Homo sapiens
caggcacaattatttccctttc

SEQ ID NO: 9326239 - DNA, 22 bp, Homo sapiens
caggatgggtgtcggccagcac

SEQ ID NO: 9326240 - DNA, 22 bp, Homo sapiens
caggatgggtgtcggccagcac

SEQ ID NO: 9326241 - DNA, 22 bp, Homo sapiens
caggatgggtgtcggccagcac

SEQ ID NO: 9326242 - DNA, 22 bp, Homo sapiens
caggatggtcagatgcattgtc

SEQ ID NO: 9326243 - DNA, 22 bp, Homo sapiens
caggatgggatgtagtgggccc

SEQ ID NO: 9326244 - DNA, 22 bp, Homo sapiens
caggatgggatgtagtgggccc

SEQ ID NO: 9326245 - DNA, 22 bp, Homo sapiens
caggatgggtgtcggccagcac

SEQ ID NO: 9326246 - DNA, 22 bp, Homo sapiens
caggatgggtgtcggccagcac

SEQ ID NO: 9326247 - DNA, 22 bp, Homo sapiens
caggatgggatgtagtgggccc

SEQ ID NO: 9326248 - DNA, 22 bp, Homo sapiens
caggatgggatgtagtgggccc

SEQ ID NO: 9326249 - DNA, 22 bp, Homo sapiens
caggacctaactcacctgtctc

SEQ ID NO: 9326250 - DNA, 22 bp, Homo sapiens
caggacgggcaaacaggatggt

SEQ ID NO: 9326251 - DNA, 22 bp, Homo sapiens
caggactcttgtcatcatcagt

SEQ ID NO: 9326252 - DNA, 22 bp, Homo sapiens
caggactcacttctcacatccc

SEQ ID NO: 9326253 - DNA, 22 bp, Homo sapiens
caggactcacttctcacatccc

SEQ ID NO: 9326254 - DNA, 22 bp, Homo sapiens
caggacagagcccagactgtgt

SEQ ID NO: 9326255 - DNA, 22 bp, Homo sapiens
caggagaaacataattttctgg

SEQ ID NO: 9326256 - DNA, 22 bp, Homo sapiens
caggagaaacataattttctgg

SEQ ID NO: 9326257 - DNA, 22 bp, Homo sapiens
caggacttattatagcattata

SEQ ID NO: 9326258 - DNA, 22 bp, Homo sapiens
caggactgtatccttggagaaa

SEQ ID NO: 9326259 - DNA, 22 bp, Homo sapiens
caggagaaatgtggctgctacc

SEQ ID NO: 9326260 - DNA, 22 bp, Homo sapiens
caggagaaggtttggagtgcag

SEQ ID NO: 9326261 - DNA, 22 bp, Homo sapiens
caggactgaagggcacagggaa

SEQ ID NO: 9326262 - DNA, 22 bp, Homo sapiens
caggactgatgttcctccagcc

SEQ ID NO: 9326263 - DNA, 22 bp, Homo sapiens
caggactgaagggcacagggaa

SEQ ID NO: 9326264 - DNA, 22 bp, Homo sapiens
caggactggctcgcagtgggtg

SEQ ID NO: 9326265 - DNA, 22 bp, Homo sapiens
caggactggctcgcagtgggtg

SEQ ID NO: 9326266 - DNA, 22 bp, Homo sapiens
caggactggaagtctcaagaga

SEQ ID NO: 9326267 - DNA, 22 bp, Homo sapiens
cagctgggtttagtggggtgtg

SEQ ID NO: 9326268 - DNA, 22 bp, Homo sapiens
cagctgggtttagtggggtgtg

SEQ ID NO: 9326269 - DNA, 22 bp, Homo sapiens
cagctgggtttagtggggtgtg

SEQ ID NO: 9326270 - DNA, 22 bp, Homo sapiens
cagctggtcaactgaatgaaca

SEQ ID NO: 9326271 - DNA, 22 bp, Homo sapiens
cagctggttcagtgtctggtga

SEQ ID NO: 9326272 - DNA, 22 bp, Homo sapiens
cagctggttggaagggagctga

SEQ ID NO: 9326273 - DNA, 22 bp, Homo sapiens
cagctggttatcagagaggcct

SEQ ID NO: 9326274 - DNA, 22 bp, Homo sapiens
cagctggttatcagagaggcct

SEQ ID NO: 9326275 - DNA, 22 bp, Homo sapiens
cagctggtgtccagggaagtgg

SEQ ID NO: 9326276 - DNA, 22 bp, Homo sapiens
cagctgtccttcctggtgggcg

SEQ ID NO: 9326277 - DNA, 22 bp, Homo sapiens
cagctgtccaaacacattaact

SEQ ID NO: 9326278 - DNA, 22 bp, Homo sapiens
cagctgtgtctaattatggctg

SEQ ID NO: 9326279 - DNA, 22 bp, Homo sapiens
cagctgtgtctaattatggctg

SEQ ID NO: 9326280 - DNA, 22 bp, Homo sapiens
agcttcctacaaccatctcaga

SEQ ID NO: 9326281 - DNA, 22 bp, Homo sapiens
agcttcccaggagaatcaggga

SEQ ID NO: 9326282 - DNA, 22 bp, Homo sapiens
agcttcccaggagaatcaggga

SEQ ID NO: 9326283 - DNA, 22 bp, Homo sapiens
agcttcccaggagaatcaggga

SEQ ID NO: 9326284 - DNA, 18 bp, Homo sapiens
agcttccctctgagaggg

SEQ ID NO: 9326285 - DNA, 22 bp, Homo sapiens
agcttcctgtcttctgcacaaa

SEQ ID NO: 9326286 - DNA, 21 bp, Homo sapiens
caggctctgctagaggagcct

SEQ ID NO: 9326287 - DNA, 21 bp, Homo sapiens
caggctctgctagaggagcct

SEQ ID NO: 9326288 - DNA, 22 bp, Homo sapiens
agcttctagcccatccagcagg

SEQ ID NO: 9326289 - DNA, 21 bp, Homo sapiens
caggctctgctgggtgctggg

SEQ ID NO: 9326290 - DNA, 21 bp, Homo sapiens
caggctctgctgggtgctggg

SEQ ID NO: 9326291 - DNA, 22 bp, Homo sapiens
caggctctgctgctacagctgt

SEQ ID NO: 9326292 - DNA, 22 bp, Homo sapiens
caggctcttccatcctgctgag

SEQ ID NO: 9326293 - DNA, 22 bp, Homo sapiens
caggctcttccatcctgctgag

SEQ ID NO: 9326294 - DNA, 21 bp, Homo sapiens
caggctctgctgggtgctggg

SEQ ID NO: 9326295 - DNA, 22 bp, Homo sapiens
caggctctgctgctacagctgt

SEQ ID NO: 9326296 - DNA, 22 bp, Homo sapiens
caggcccatgagggcagccaca

SEQ ID NO: 9326297 - DNA, 22 bp, Homo sapiens
caggcccatctgctcccaggct

SEQ ID NO: 9326298 - DNA, 22 bp, Homo sapiens
caggcccatctgctcccaggct

SEQ ID NO: 9326299 - DNA, 22 bp, Homo sapiens
caggcccattctaggcttgcta

SEQ ID NO: 9326300 - DNA, 22 bp, Homo sapiens
caggcccattctaggcttgcta

SEQ ID NO: 9326301 - DNA, 22 bp, Homo sapiens
caggcccatgagggcagccaca

SEQ ID NO: 9326302 - DNA, 22 bp, Homo sapiens
caggcccatgagggcagccaca

SEQ ID NO: 9326303 - DNA, 22 bp, Homo sapiens
caggcccatttgtagccacttt

SEQ ID NO: 9326304 - DNA, 22 bp, Homo sapiens
caggcccatttgtagccacttt

SEQ ID NO: 9326305 - DNA, 22 bp, Homo sapiens
agcttccattaactgctacact

SEQ ID NO: 9326306 - DNA, 22 bp, Homo sapiens
caggcccataatgcaaatattt

SEQ ID NO: 9326307 - DNA, 22 bp, Homo sapiens
caggcccatctgctcccaggct

SEQ ID NO: 9326308 - DNA, 22 bp, Homo sapiens
caggcccataatgcaaatattt

SEQ ID NO: 9326309 - DNA, 22 bp, Homo sapiens
caggcccagtgatcagggctct

SEQ ID NO: 9326310 - DNA, 22 bp, Homo sapiens
caggcccagtgatcagggctct

SEQ ID NO: 9326311 - DNA, 22 bp, Homo sapiens
caggcccagtgatcagggctct

SEQ ID NO: 9326312 - DNA, 22 bp, Homo sapiens
caggcccagggttattgggaaa

SEQ ID NO: 9326313 - DNA, 22 bp, Homo sapiens
caggcccaggtgtcgatgttcc

SEQ ID NO: 9326314 - DNA, 22 bp, Homo sapiens
agctgtctttaagtgagctttg

SEQ ID NO: 9326315 - DNA, 22 bp, Homo sapiens
agctgtctggaagttcctcatg

SEQ ID NO: 9326316 - DNA, 22 bp, Homo sapiens
caggcagcgtcctgcttcctgt

SEQ ID NO: 9326317 - DNA, 22 bp, Homo sapiens
caggcagcgtcctgcttcctgt

SEQ ID NO: 9326318 - DNA, 22 bp, Homo sapiens
caggcagcgctcgtggcctggc

SEQ ID NO: 9326319 - DNA, 22 bp, Homo sapiens
caggcagcgtcctgcttcctgt

SEQ ID NO: 9326320 - DNA, 22 bp, Homo sapiens
caggcagcgctcgtggcctggc

SEQ ID NO: 9326321 - DNA, 22 bp, Homo sapiens
caggcagcgctcgtggcctggc

SEQ ID NO: 9326322 - DNA, 22 bp, Homo sapiens
caggcagggagctggaaaggat

SEQ ID NO: 9326323 - DNA, 22 bp, Homo sapiens
caggcagctcgatgccttgttg

SEQ ID NO: 9326324 - DNA, 22 bp, Homo sapiens
caggcagctcaaccttgggagc

SEQ ID NO: 9326325 - DNA, 22 bp, Homo sapiens
caggcagctcaaccttgggagc

SEQ ID NO: 9326326 - DNA, 22 bp, Homo sapiens
caggcagctcaaccttgggagc

SEQ ID NO: 9326327 - DNA, 22 bp, Homo sapiens
caggcagctcaaccttgggagc

SEQ ID NO: 9326328 - DNA, 22 bp, Homo sapiens
caggcagctagatttataacaa

SEQ ID NO: 9326329 - DNA, 22 bp, Homo sapiens
caggcaggtcagtgaagaagga

SEQ ID NO: 9326330 - DNA, 22 bp, Homo sapiens
caggcaggtcagtgaagaagga

SEQ ID NO: 9326331 - DNA, 22 bp, Homo sapiens
caggcagggagctggaaaggat

SEQ ID NO: 9326332 - DNA, 22 bp, Homo sapiens
caggcagggagctggaaaggat

SEQ ID NO: 9326333 - DNA, 22 bp, Homo sapiens
caggcaggtcagtgaagaagga

SEQ ID NO: 9326334 - DNA, 22 bp, Homo sapiens
caggcaggtgcagattcctctt

SEQ ID NO: 9326335 - DNA, 22 bp, Homo sapiens
caggcaggtgcagattcctctt

SEQ ID NO: 9326336 - DNA, 22 bp, Homo sapiens
caggcagtggctcacagcaacc

SEQ ID NO: 9326337 - DNA, 22 bp, Homo sapiens
caggcaggtcagtgaagaagga

SEQ ID NO: 9326338 - DNA, 22 bp, Homo sapiens
caggcaggtgcagattcctctt

SEQ ID NO: 9326339 - DNA, 22 bp, Homo sapiens
caggcaggtcagtgaagaagga

SEQ ID NO: 9326340 - DNA, 22 bp, Homo sapiens
caggcaggtgcagattcctctt

SEQ ID NO: 9326341 - DNA, 22 bp, Homo sapiens
caggcagtgtcccaggaagcca

SEQ ID NO: 9326342 - DNA, 22 bp, Homo sapiens
caggcagtgtcccaggaagcca

SEQ ID NO: 9326343 - DNA, 22 bp, Homo sapiens
caggcagtgtcccaggaagcca

SEQ ID NO: 9326344 - DNA, 22 bp, Homo sapiens
caggcagtgtgacgctagggtt

SEQ ID NO: 9326345 - DNA, 22 bp, Homo sapiens
agctggtggaagggagcccaaa

SEQ ID NO: 9326346 - DNA, 22 bp, Homo sapiens
agctgtcaggcagaactgagct

SEQ ID NO: 9326347 - DNA, 22 bp, Homo sapiens
agctggtttgcaagtataatca

SEQ ID NO: 9326348 - DNA, 22 bp, Homo sapiens
agctggtttaggaaaaggtagg

SEQ ID NO: 9326349 - DNA, 22 bp, Homo sapiens
agctgtctacctgcagagtcct

SEQ ID NO: 9326350 - DNA, 22 bp, Homo sapiens
agctgtctctctggtgtccata

SEQ ID NO: 9326351 - DNA, 22 bp, Homo sapiens
agctgtcctggctcaggctgtg

SEQ ID NO: 9326352 - DNA, 17 bp, Homo sapiens
ccagtcacaccaccctt

SEQ ID NO: 9326353 - DNA, 21 bp, Homo sapiens
ccagtattatttctctatgta

SEQ ID NO: 9326354 - DNA, 17 bp, Homo sapiens
ccagtcacaccaccctt

SEQ ID NO: 9326355 - DNA, 22 bp, Homo sapiens
aggctgagtcgggaggatcact

SEQ ID NO: 9326356 - DNA, 22 bp, Homo sapiens
ccagtcacaggtgtgtttatat

SEQ ID NO: 9326357 - DNA, 22 bp, Homo sapiens
aggctgagtgctcccctagatg

SEQ ID NO: 9326358 - DNA, 17 bp, Homo sapiens
ccagtagcctgagatgt

SEQ ID NO: 9326359 - DNA, 22 bp, Homo sapiens
ccaggttggagttcagtggcgc

SEQ ID NO: 9326360 - DNA, 22 bp, Homo sapiens
ccaggtggtgaaagtgggccct

SEQ ID NO: 9326361 - DNA, 18 bp, Homo sapiens
ccaggtggtgacagagat

SEQ ID NO: 9326362 - DNA, 18 bp, Homo sapiens
ccaggtggtgacagagat

SEQ ID NO: 9326363 - DNA, 18 bp, Homo sapiens
ccaggtggtgacagagat

SEQ ID NO: 9326364 - DNA, 18 bp, Homo sapiens
ccaggtggtgacagagat

SEQ ID NO: 9326365 - DNA, 18 bp, Homo sapiens
ccaggtggtgacagagat

SEQ ID NO: 9326366 - DNA, 20 bp, Homo sapiens
ccaggtggtgcctggagagg

SEQ ID NO: 9326367 - DNA, 22 bp, Homo sapiens
ccaggtggtgcctctgttcgca

SEQ ID NO: 9326368 - DNA, 20 bp, Homo sapiens
ccaggtggtgcctggagagg

SEQ ID NO: 9326369 - DNA, 20 bp, Homo sapiens
ccaggtggtgcctggagagg

SEQ ID NO: 9326370 - DNA, 22 bp, Homo sapiens
ccaggtggtgcctctgttcgca

SEQ ID NO: 9326371 - DNA, 20 bp, Homo sapiens
ccaggtggtgcctggagagg

SEQ ID NO: 9326372 - DNA, 22 bp, Homo sapiens
ccaggtgtttggcctgcatgat

SEQ ID NO: 9326373 - DNA, 22 bp, Homo sapiens
ccaggtgtttggcctgcatgat

SEQ ID NO: 9326374 - DNA, 22 bp, Homo sapiens
ccaggtgttctttgtccctgtt

SEQ ID NO: 9326375 - DNA, 22 bp, Homo sapiens
ccaggtgttacacgagtgttaa

SEQ ID NO: 9326376 - DNA, 22 bp, Homo sapiens
ccaggtgttacacgagtgttaa

SEQ ID NO: 9326377 - DNA, 22 bp, Homo sapiens
ccaggtgtgtctggccccgaag

SEQ ID NO: 9326378 - DNA, 22 bp, Homo sapiens
ccaggtgttctttgtccctgtt

SEQ ID NO: 9326379 - DNA, 22 bp, Homo sapiens
ccaggtgttctttgtccctgtt

SEQ ID NO: 9326380 - DNA, 22 bp, Homo sapiens
ccaggtgtgtctggccccgaag

SEQ ID NO: 9326381 - DNA, 22 bp, Homo sapiens
ccaggtggttcaggtcaccata

SEQ ID NO: 9326382 - DNA, 22 bp, Homo sapiens
ccaggtggttcaggtcaccata

SEQ ID NO: 9326383 - DNA, 22 bp, Homo sapiens
ccaggtggttcaggtcaccata

SEQ ID NO: 9326384 - DNA, 20 bp, Homo sapiens
ccaggtggtgcctggagagg

SEQ ID NO: 9326385 - DNA, 22 bp, Homo sapiens
ccagggcagccaacccagatgc

SEQ ID NO: 9326386 - DNA, 22 bp, Homo sapiens
ccagggcagcagaattggggca

SEQ ID NO: 9326387 - DNA, 22 bp, Homo sapiens
ccagggcagcagaattggggca

SEQ ID NO: 9326388 - DNA, 22 bp, Homo sapiens
ccagggcagcgcccctccacgc

SEQ ID NO: 9326389 - DNA, 22 bp, Homo sapiens
ccagggcagccaacccagatgc

SEQ ID NO: 9326390 - DNA, 22 bp, Homo sapiens
ccagggcagccaacccagatgc

SEQ ID NO: 9326391 - DNA, 22 bp, Homo sapiens
ccagggcagccaacccagatgc

SEQ ID NO: 9326392 - DNA, 22 bp, Homo sapiens
ccaggtgcctccagtcacagtg

SEQ ID NO: 9326393 - DNA, 22 bp, Homo sapiens
ccaggtgctagcaatcactgtc

SEQ ID NO: 9326394 - DNA, 22 bp, Homo sapiens
ccaggtgcctccagtcacagtg

SEQ ID NO: 9326395 - DNA, 22 bp, Homo sapiens
ccaggtgcactcaagacctgct

SEQ ID NO: 9326396 - DNA, 22 bp, Homo sapiens
ccaggtggtgaaagtgggccct

SEQ ID NO: 9326397 - DNA, 16 bp, Homo sapiens
ccaggtggggctgtga

SEQ ID NO: 9326398 - DNA, 16 bp, Homo sapiens
ccaggtggggctgtga

SEQ ID NO: 9326399 - DNA, 22 bp, Homo sapiens
ccaggtggtgaaagtgggccct

SEQ ID NO: 9326400 - DNA, 16 bp, Homo sapiens
ccaggtggggctgtga

SEQ ID NO: 9326401 - DNA, 22 bp, Homo sapiens
ccaggtggtgaaagtgggccct

SEQ ID NO: 9326402 - DNA, 22 bp, Homo sapiens
ccaggtggtgaaagtgggccct

SEQ ID NO: 9326403 - DNA, 22 bp, Homo sapiens
ccagggcagcagaattggggca

SEQ ID NO: 9326404 - DNA, 22 bp, Homo sapiens
ccagggcagaaaaagagggaat

SEQ ID NO: 9326405 - DNA, 22 bp, Homo sapiens
ccagggcagaaaaagagggaat

SEQ ID NO: 9326406 - DNA, 22 bp, Homo sapiens
ccagggcagaaaaagagggaat

SEQ ID NO: 9326407 - DNA, 22 bp, Homo sapiens
ccagggcagaaaaagagggaat

SEQ ID NO: 9326408 - DNA, 22 bp, Homo sapiens
ccagggcacttaggcccagccc

SEQ ID NO: 9326409 - DNA, 22 bp, Homo sapiens
ccagggcacttaggcccagccc

SEQ ID NO: 9326410 - DNA, 22 bp, Homo sapiens
ccagggcacttaggcccagccc

SEQ ID NO: 9326411 - DNA, 22 bp, Homo sapiens
ccagggcacttaggcccagccc

SEQ ID NO: 9326412 - DNA, 22 bp, Homo sapiens
aggctctgtcaggcggagcagc

SEQ ID NO: 9326413 - DNA, 22 bp, Homo sapiens
aggctctgtcaggcggagcagc

SEQ ID NO: 9326414 - DNA, 22 bp, Homo sapiens
aggctctgtcaggcggagcagc

SEQ ID NO: 9326415 - DNA, 22 bp, Homo sapiens
aggctctgtcaggcggagcagc

SEQ ID NO: 9326416 - DNA, 19 bp, Homo sapiens
aggctctgtaggagagggc

SEQ ID NO: 9326417 - DNA, 19 bp, Homo sapiens
aggctctgtaggagagggc

SEQ ID NO: 9326418 - DNA, 19 bp, Homo sapiens
aggctctgtaggagagggc

SEQ ID NO: 9326419 - DNA, 19 bp, Homo sapiens
aggctctgtaggagagggc

SEQ ID NO: 9326420 - DNA, 22 bp, Homo sapiens
aggctctgtatgaaggtttggg

SEQ ID NO: 9326421 - DNA, 20 bp, Homo sapiens
ccaggcctgggcctgctcta

SEQ ID NO: 9326422 - DNA, 20 bp, Homo sapiens
ccaggcctgggcctgctcta

SEQ ID NO: 9326423 - DNA, 20 bp, Homo sapiens
ccaggcctgggcctgctcta

SEQ ID NO: 9326424 - DNA, 22 bp, Homo sapiens
ccaggcctcccttttccagcca

SEQ ID NO: 9326425 - DNA, 22 bp, Homo sapiens
ccaggcctcacctgcccaccta

SEQ ID NO: 9326426 - DNA, 22 bp, Homo sapiens
ccaggcctcccttttccagcca

SEQ ID NO: 9326427 - DNA, 20 bp, Homo sapiens
ccaggcctgggcctgctcta

SEQ ID NO: 9326428 - DNA, 22 bp, Homo sapiens
ccaggcctgtgttgtgtggagg

SEQ ID NO: 9326429 - DNA, 22 bp, Homo sapiens
ccaggcctgtgcaaggagggag

SEQ ID NO: 9326430 - DNA, 22 bp, Homo sapiens
ccaggcctgtgcaaggagggag

SEQ ID NO: 9326431 - DNA, 22 bp, Homo sapiens
ccaggcctgtgcaaggagggag

SEQ ID NO: 9326432 - DNA, 22 bp, Homo sapiens
ccaggcctgtgttgtgtggagg

SEQ ID NO: 9326433 - DNA, 22 bp, Homo sapiens
ccaggcctgtgttgtgtggagg

SEQ ID NO: 9326434 - DNA, 22 bp, Homo sapiens
ccaggccttccagtacgcagaa

SEQ ID NO: 9326435 - DNA, 22 bp, Homo sapiens
ccaggccttctgaggacactct

SEQ ID NO: 9326436 - DNA, 22 bp, Homo sapiens
ccaggccttctgaggacactct

SEQ ID NO: 9326437 - DNA, 22 bp, Homo sapiens
ccaggccttctgaggacactct

SEQ ID NO: 9326438 - DNA, 22 bp, Homo sapiens
ccaggcctttcttcttggtctg

SEQ ID NO: 9326439 - DNA, 22 bp, Homo sapiens
ccaggcctttcttcttggtctg

SEQ ID NO: 9326440 - DNA, 22 bp, Homo sapiens
ccaggcctttcttcttggtctg

SEQ ID NO: 9326441 - DNA, 22 bp, Homo sapiens
ccaggccttccagtacgcagaa

SEQ ID NO: 9326442 - DNA, 22 bp, Homo sapiens
ccaggccttctgaggacactct

SEQ ID NO: 9326443 - DNA, 22 bp, Homo sapiens
ccaggccttctgaggacactct

SEQ ID NO: 9326444 - DNA, 22 bp, Homo sapiens
ccaggccttctgaggacactct

SEQ ID NO: 9326445 - DNA, 22 bp, Homo sapiens
aggctcagattcacatttggtt

SEQ ID NO: 9326446 - DNA, 22 bp, Homo sapiens
aggctcagattcacatttggtt

SEQ ID NO: 9326447 - DNA, 22 bp, Homo sapiens
aggctcagatccttgtgtcctg

SEQ ID NO: 9326448 - DNA, 22 bp, Homo sapiens
ccaggcctttcttcttggtctg

SEQ ID NO: 9326449 - DNA, 20 bp, Homo sapiens
aggctcagatacccagggaa

SEQ ID NO: 9326450 - DNA, 22 bp, Homo sapiens
aggctcagatccttgtgtcctg

SEQ ID NO: 9326451 - DNA, 22 bp, Homo sapiens
aggctcagcccctgggaggaga

SEQ ID NO: 9326452 - DNA, 22 bp, Homo sapiens
aggctcagcccctgggaggaga

SEQ ID NO: 9326453 - DNA, 22 bp, Homo sapiens
aggctcagcctgggcctagagc

SEQ ID NO: 9326454 - DNA, 22 bp, Homo sapiens
aggctcagcctgggcctagagc

SEQ ID NO: 9326455 - DNA, 22 bp, Homo sapiens
aggctcagcctgggcctagagc

SEQ ID NO: 9326456 - DNA, 21 bp, Homo sapiens
aggctcagcaggtgtataaag

SEQ ID NO: 9326457 - DNA, 21 bp, Homo sapiens
aggctcagcaggtgtataaag

SEQ ID NO: 9326458 - DNA, 22 bp, Homo sapiens
aggctcagcatctgattcatat

SEQ ID NO: 9326459 - DNA, 22 bp, Homo sapiens
aggctcagcatctgattcatat

SEQ ID NO: 9326460 - DNA, 22 bp, Homo sapiens
aggctcagcccaaggtggagag

SEQ ID NO: 9326461 - DNA, 22 bp, Homo sapiens
aggctcagcccaaggtggagag

SEQ ID NO: 9326462 - DNA, 22 bp, Homo sapiens
aggctctgggaagcagtgagtt

SEQ ID NO: 9326463 - DNA, 22 bp, Homo sapiens
aggctctgggaagcagtgagtt

SEQ ID NO: 9326464 - DNA, 22 bp, Homo sapiens
aggctctgggaagcagtgagtt

SEQ ID NO: 9326465 - DNA, 22 bp, Homo sapiens
aggctctgggaagcagtgagtt

SEQ ID NO: 9326466 - DNA, 22 bp, Homo sapiens
aggctctgggaacagacgggtg

SEQ ID NO: 9326467 - DNA, 22 bp, Homo sapiens
aggctctgggaagcagtgagtt

SEQ ID NO: 9326468 - DNA, 22 bp, Homo sapiens
aggctctgggaagcagtgagtt

SEQ ID NO: 9326469 - DNA, 22 bp, Homo sapiens
aggctctgggaacagacgggtg

SEQ ID NO: 9326470 - DNA, 22 bp, Homo sapiens
aggctctgggaacagacgggtg

SEQ ID NO: 9326471 - DNA, 22 bp, Homo sapiens
aggctctgggaacagacgggtg

SEQ ID NO: 9326472 - DNA, 22 bp, Homo sapiens
aggctctgggaacagacgggtg

SEQ ID NO: 9326473 - DNA, 22 bp, Homo sapiens
aggctctgcttttctggatata

SEQ ID NO: 9326474 - DNA, 22 bp, Homo sapiens
aggctctggttggcaagtaaag

SEQ ID NO: 9326475 - DNA, 22 bp, Homo sapiens
aggctctggttggcaagtaaag

SEQ ID NO: 9326476 - DNA, 22 bp, Homo sapiens
aggctctggttggcaagtaaag

SEQ ID NO: 9326477 - DNA, 22 bp, Homo sapiens
aggctctggttcatcatgatgg

SEQ ID NO: 9326478 - DNA, 22 bp, Homo sapiens
aggctctggttcatcatgatgg

SEQ ID NO: 9326479 - DNA, 22 bp, Homo sapiens
aggctctggttggcaagtaaag

SEQ ID NO: 9326480 - DNA, 19 bp, Homo sapiens
aggctctgtaggagagggc

SEQ ID NO: 9326481 - DNA, 22 bp, Homo sapiens
aggctctggttggcaagtaaag

SEQ ID NO: 9326482 - DNA, 22 bp, Homo sapiens
aggctctgggctctagattttg

SEQ ID NO: 9326483 - DNA, 22 bp, Homo sapiens
aggctctggtgcagctgtaact

SEQ ID NO: 9326484 - DNA, 22 bp, Homo sapiens
aggctctggtgcagctgtaact

SEQ ID NO: 9326485 - DNA, 22 bp, Homo sapiens
cccacacactggctgctgccaa

SEQ ID NO: 9326486 - DNA, 22 bp, Homo sapiens
cccacacaaatcatggggagaa

SEQ ID NO: 9326487 - DNA, 22 bp, Homo sapiens
cccacacacatttatgatagga

SEQ ID NO: 9326488 - DNA, 22 bp, Homo sapiens
cccaataaaattcattttcatt

SEQ ID NO: 9326489 - DNA, 22 bp, Homo sapiens
cccacacaaatcatggggagaa

SEQ ID NO: 9326490 - DNA, 22 bp, Homo sapiens
cccacacatttttcacttaccg

SEQ ID NO: 9326491 - DNA, 18 bp, Homo sapiens
cccacacagcagtagctc

SEQ ID NO: 9326492 - DNA, 18 bp, Homo sapiens
cccacacagcagtagctc

SEQ ID NO: 9326493 - DNA, 22 bp, Homo sapiens
cccacacatttttcacttaccg

SEQ ID NO: 9326494 - DNA, 20 bp, Homo sapiens
cccacacccttcccacttgg

SEQ ID NO: 9326495 - DNA, 18 bp, Homo sapiens
cccacacagcagtagctc

SEQ ID NO: 9326496 - DNA, 22 bp, Homo sapiens
cccacacatttttcacttaccg

SEQ ID NO: 9326497 - DNA, 22 bp, Homo sapiens
ccagtgtgaacctcaccaccct

SEQ ID NO: 9326498 - DNA, 22 bp, Homo sapiens
ccattttattagtgacatttag

SEQ ID NO: 9326499 - DNA, 22 bp, Homo sapiens
ccattttgtctgacttcttgct

SEQ ID NO: 9326500 - DNA, 22 bp, Homo sapiens
ccattttgtctgacttcttgct

SEQ ID NO: 9326501 - DNA, 22 bp, Homo sapiens
ccattttgtctcctgaaatcta

SEQ ID NO: 9326502 - DNA, 22 bp, Homo sapiens
aggctgcaggtctgggtcatgt

SEQ ID NO: 9326503 - DNA, 22 bp, Homo sapiens
aggctgcagtgcaggtaggatt

SEQ ID NO: 9326504 - DNA, 22 bp, Homo sapiens
aggctgcagtgcaggtaggatt

SEQ ID NO: 9326505 - DNA, 22 bp, Homo sapiens
aggctgcatcccactttgtgta

SEQ ID NO: 9326506 - DNA, 21 bp, Homo sapiens
aggctgcatttatatggtgtg

SEQ ID NO: 9326507 - DNA, 22 bp, Homo sapiens
aggctgccaaagcttctgtctc

SEQ ID NO: 9326508 - DNA, 20 bp, Homo sapiens
aggctgccaggtctcacatc

SEQ ID NO: 9326509 - DNA, 20 bp, Homo sapiens
aggctgccaggtctcacatc

SEQ ID NO: 9326510 - DNA, 20 bp, Homo sapiens
aggctgccaggtctcacatc

SEQ ID NO: 9326511 - DNA, 22 bp, Homo sapiens
aggctgccagaagccttcagga

SEQ ID NO: 9326512 - DNA, 22 bp, Homo sapiens
aggctgccagaagccttcagga

SEQ ID NO: 9326513 - DNA, 22 bp, Homo sapiens
aggctgccagaagccttcagga

SEQ ID NO: 9326514 - DNA, 22 bp, Homo sapiens
aggctgccctgccgccagtggg

SEQ ID NO: 9326515 - DNA, 22 bp, Homo sapiens
aggctgccctgccgccagtggg

SEQ ID NO: 9326516 - DNA, 22 bp, Homo sapiens
aggctgccctgccgccagtggg

SEQ ID NO: 9326517 - DNA, 22 bp, Homo sapiens
aggctgccgcagccaatggttg

SEQ ID NO: 9326518 - DNA, 22 bp, Homo sapiens
aggctgccgcagccaatggttg

SEQ ID NO: 9326519 - DNA, 19 bp, Homo sapiens
aggctgcccagtctctgcc

SEQ ID NO: 9326520 - DNA, 19 bp, Homo sapiens
aggctgcccagtctctgcc

SEQ ID NO: 9326521 - DNA, 19 bp, Homo sapiens
aggctgcccagtctctgcc

SEQ ID NO: 9326522 - DNA, 19 bp, Homo sapiens
aggctgcccagtctctgcc

SEQ ID NO: 9326523 - DNA, 22 bp, Homo sapiens
ccagtgggtgctgggctctgcc

SEQ ID NO: 9326524 - DNA, 22 bp, Homo sapiens
ccagtgggtaggccatggtgag

SEQ ID NO: 9326525 - DNA, 22 bp, Homo sapiens
ccagtgggagggagctaggcca

SEQ ID NO: 9326526 - DNA, 20 bp, Homo sapiens
ccagtgggaagtgattaggt

SEQ ID NO: 9326527 - DNA, 22 bp, Homo sapiens
aggctgtgcgaggtctcagagt

SEQ ID NO: 9326528 - DNA, 22 bp, Homo sapiens
aggctgtggccctggtctagca

SEQ ID NO: 9326529 - DNA, 22 bp, Homo sapiens
aggctgtgggaatggctgcttg

SEQ ID NO: 9326530 - DNA, 22 bp, Homo sapiens
aggctgtgggaatggctgcttg

SEQ ID NO: 9326531 - DNA, 22 bp, Homo sapiens
aggctgtgggagttgagagtct

SEQ ID NO: 9326532 - DNA, 22 bp, Homo sapiens
cccagaggtgcttcagaggtgc

SEQ ID NO: 9326533 - DNA, 22 bp, Homo sapiens
cccagaggtgacatcccattct

SEQ ID NO: 9326534 - DNA, 22 bp, Homo sapiens
cccagaggttccttagggacca

SEQ ID NO: 9326535 - DNA, 20 bp, Homo sapiens
cccagaggttgcggcaggag

SEQ ID NO: 9326536 - DNA, 22 bp, Homo sapiens
cccagaggttccttagggacca

SEQ ID NO: 9326537 - DNA, 22 bp, Homo sapiens
cccagaggtgcttcagaggtgc

SEQ ID NO: 9326538 - DNA, 22 bp, Homo sapiens
aggctgtgcattttggagggcc

SEQ ID NO: 9326539 - DNA, 22 bp, Homo sapiens
aggctgtgcacagggcacctgc

SEQ ID NO: 9326540 - DNA, 22 bp, Homo sapiens
cccactcctggagctagggctc

SEQ ID NO: 9326541 - DNA, 22 bp, Homo sapiens
cccactgctgctctccatggca

SEQ ID NO: 9326542 - DNA, 22 bp, Homo sapiens
cccactctggctcccttctagt

SEQ ID NO: 9326543 - DNA, 22 bp, Homo sapiens
cccaccctgggctacacatcca

SEQ ID NO: 9326544 - DNA, 22 bp, Homo sapiens
cccaccctgggctacacatcca

SEQ ID NO: 9326545 - DNA, 18 bp, Homo sapiens
cccaccctggctcttagt

SEQ ID NO: 9326546 - DNA, 18 bp, Homo sapiens
cccaccctggctcttagt

SEQ ID NO: 9326547 - DNA, 18 bp, Homo sapiens
cccaccctggctcttagt

SEQ ID NO: 9326548 - DNA, 22 bp, Homo sapiens
cccacactcagttccccttggg

SEQ ID NO: 9326549 - DNA, 22 bp, Homo sapiens
ccagaggtggtggtgtctagaa

SEQ ID NO: 9326550 - DNA, 22 bp, Homo sapiens
ccagaggtggtgggtgctacag

SEQ ID NO: 9326551 - DNA, 22 bp, Homo sapiens
ccagaggtgggagtgatctggt

SEQ ID NO: 9326552 - DNA, 22 bp, Homo sapiens
ccagaggtgggagtgatctggt

SEQ ID NO: 9326553 - DNA, 22 bp, Homo sapiens
ccagaggtgggagtgatctggt

SEQ ID NO: 9326554 - DNA, 22 bp, Homo sapiens
ccagaggtggtggtgtctagaa

SEQ ID NO: 9326555 - DNA, 21 bp, Homo sapiens
ccagaggttctgggcctccct

SEQ ID NO: 9326556 - DNA, 22 bp, Homo sapiens
ccagagtcattttgagtcataa

SEQ ID NO: 9326557 - DNA, 22 bp, Homo sapiens
ccagagtagctgccctgcacct

SEQ ID NO: 9326558 - DNA, 22 bp, Homo sapiens
ccagagtcaggagctcatgtga

SEQ ID NO: 9326559 - DNA, 22 bp, Homo sapiens
ccagaggctggcaagggctcct

SEQ ID NO: 9326560 - DNA, 22 bp, Homo sapiens
ccagaggctggcaagggctcct

SEQ ID NO: 9326561 - DNA, 20 bp, Homo sapiens
ccagaggctgacagactttg

SEQ ID NO: 9326562 - DNA, 21 bp, Homo sapiens
ccagaggcctctcttggccac

SEQ ID NO: 9326563 - DNA, 22 bp, Homo sapiens
aggcaggtcccctggaaggcac

SEQ ID NO: 9326564 - DNA, 22 bp, Homo sapiens
aggcaggtcccctggaaggcac

SEQ ID NO: 9326565 - DNA, 22 bp, Homo sapiens
aggcaggtcccctggaaggcac

SEQ ID NO: 9326566 - DNA, 22 bp, Homo sapiens
aggcaggtctgtatctagtctc

SEQ ID NO: 9326567 - DNA, 22 bp, Homo sapiens
aggcaggtctgtatctagtctc

SEQ ID NO: 9326568 - DNA, 22 bp, Homo sapiens
aggcaggtgagtcaaaacagac

SEQ ID NO: 9326569 - DNA, 22 bp, Homo sapiens
aggcaggtctgtatctagtctc

SEQ ID NO: 9326570 - DNA, 22 bp, Homo sapiens
aggcaggtcccctggaaggcac

SEQ ID NO: 9326571 - DNA, 22 bp, Homo sapiens
aggcaggtagaaggatctttat

SEQ ID NO: 9326572 - DNA, 22 bp, Homo sapiens
aggcaggtagaaggatctttat

SEQ ID NO: 9326573 - DNA, 22 bp, Homo sapiens
aggcaggtcacatgcttggcga

SEQ ID NO: 9326574 - DNA, 22 bp, Homo sapiens
aggcaggtcacatgcttggcga

SEQ ID NO: 9326575 - DNA, 22 bp, Homo sapiens
aggcaggtcacatgcttggcga

SEQ ID NO: 9326576 - DNA, 22 bp, Homo sapiens
ccactcccttccggtccagggc

SEQ ID NO: 9326577 - DNA, 22 bp, Homo sapiens
ccactcccttccggtccagggc

SEQ ID NO: 9326578 - DNA, 20 bp, Homo sapiens
ccactccaggtgattctgat

SEQ ID NO: 9326579 - DNA, 18 bp, Homo sapiens
ccagaggcccgggcaggc

SEQ ID NO: 9326580 - DNA, 22 bp, Homo sapiens
ccagaggcatgttcaaagcaat

SEQ ID NO: 9326581 - DNA, 22 bp, Homo sapiens
ccagaggatgctggtcagcctc

SEQ ID NO: 9326582 - DNA, 22 bp, Homo sapiens
ccagaggcagacttacactcca

SEQ ID NO: 9326583 - DNA, 22 bp, Homo sapiens
ccagaggatgctggtcagcctc

SEQ ID NO: 9326584 - DNA, 20 bp, Homo sapiens
ccagagctgatggctgcccg

SEQ ID NO: 9326585 - DNA, 20 bp, Homo sapiens
ccagagctgatggctgcccg

SEQ ID NO: 9326586 - DNA, 19 bp, Homo sapiens
aggcaggtgcagaggtccc

SEQ ID NO: 9326587 - DNA, 22 bp, Homo sapiens
aggcaggtgagtcaaaacagac

SEQ ID NO: 9326588 - DNA, 19 bp, Homo sapiens
aggcaggtgcagaggtccc

SEQ ID NO: 9326589 - DNA, 19 bp, Homo sapiens
aggcaggtgcagaggtccc

SEQ ID NO: 9326590 - DNA, 19 bp, Homo sapiens
aggcaggtgcagaggtccc

SEQ ID NO: 9326591 - DNA, 19 bp, Homo sapiens
aggcaggtgcagaggtccc

SEQ ID NO: 9326592 - DNA, 22 bp, Homo sapiens
ccagcaggcagtcatatccttt

SEQ ID NO: 9326593 - DNA, 22 bp, Homo sapiens
ccagagtctgtgtgtgtcatcc

SEQ ID NO: 9326594 - DNA, 22 bp, Homo sapiens
ccagagtctgtgtgtgtcatcc

SEQ ID NO: 9326595 - DNA, 22 bp, Homo sapiens
ccagagtctatgagtcctcatt

SEQ ID NO: 9326596 - DNA, 22 bp, Homo sapiens
ccagagtcattttgagtcataa

SEQ ID NO: 9326597 - DNA, 22 bp, Homo sapiens
ccagcagggaaaaacccaccaa

SEQ ID NO: 9326598 - DNA, 22 bp, Homo sapiens
ccagccagatgataagctctat

SEQ ID NO: 9326599 - DNA, 22 bp, Homo sapiens
ccagccagaagtccgggcttct

SEQ ID NO: 9326600 - DNA, 22 bp, Homo sapiens
ccagccagcaagctcccagttc

SEQ ID NO: 9326601 - DNA, 22 bp, Homo sapiens
ccagccaggctggctgtggagg

SEQ ID NO: 9326602 - DNA, 22 bp, Homo sapiens
ccagccaggctggctgtggagg

SEQ ID NO: 9326603 - DNA, 22 bp, Homo sapiens
ccagccaggctggctgtggagg

SEQ ID NO: 9326604 - DNA, 22 bp, Homo sapiens
ccagccaggcattgcaaactga

SEQ ID NO: 9326605 - DNA, 22 bp, Homo sapiens
ccagccagggaaactttttctt

SEQ ID NO: 9326606 - DNA, 22 bp, Homo sapiens
ccagccagtatattccaaagcc

SEQ ID NO: 9326607 - DNA, 22 bp, Homo sapiens
ccagccagctggttggacgcct

SEQ ID NO: 9326608 - DNA, 22 bp, Homo sapiens
ccagccagctggttggacgcct

SEQ ID NO: 9326609 - DNA, 22 bp, Homo sapiens
ccagccagctggttggacgcct

SEQ ID NO: 9326610 - DNA, 22 bp, Homo sapiens
ccagccagccttgatctgagta

SEQ ID NO: 9326611 - DNA, 22 bp, Homo sapiens
ccagccagctgcccttggggcc

SEQ ID NO: 9326612 - DNA, 22 bp, Homo sapiens
ccagccagccttgatctgagta

SEQ ID NO: 9326613 - DNA, 17 bp, Homo sapiens
ccagccctcgcgctttt

SEQ ID NO: 9326614 - DNA, 23 bp, Homo sapiens
ccagccctccaccagctctaggc

SEQ ID NO: 9326615 - DNA, 22 bp, Homo sapiens
ccagccctcactgaggcctctc

SEQ ID NO: 9326616 - DNA, 23 bp, Homo sapiens
ccagccctccaccagctctaggc

SEQ ID NO: 9326617 - DNA, 22 bp, Homo sapiens
ccagccctgattagagaatgtc

SEQ ID NO: 9326618 - DNA, 22 bp, Homo sapiens
ccagccctgaaccctgctgcat

SEQ ID NO: 9326619 - DNA, 22 bp, Homo sapiens
ccagccctcggtagtcccatag

SEQ ID NO: 9326620 - DNA, 22 bp, Homo sapiens
ccagccctcggtagtcccatag

SEQ ID NO: 9326621 - DNA, 18 bp, Homo sapiens
ccagccctgcagcacctg

SEQ ID NO: 9326622 - DNA, 18 bp, Homo sapiens
ccagccctgcagcacctg

SEQ ID NO: 9326623 - DNA, 22 bp, Homo sapiens
aggccctgacctgggagatcta

SEQ ID NO: 9326624 - DNA, 22 bp, Homo sapiens
aggccctgcccagtgccacaag

SEQ ID NO: 9326625 - DNA, 22 bp, Homo sapiens
aggccctgcccagtgccacaag

SEQ ID NO: 9326626 - DNA, 22 bp, Homo sapiens
aggccctgcccagtgccacaag

SEQ ID NO: 9326627 - DNA, 23 bp, Homo sapiens
aggccctgcctgtccctcttttt

SEQ ID NO: 9326628 - DNA, 22 bp, Homo sapiens
aggcctgggtctcgtgcctacc

SEQ ID NO: 9326629 - DNA, 22 bp, Homo sapiens
aggcctgggtctcgtgcctacc

SEQ ID NO: 9326630 - DNA, 22 bp, Homo sapiens
aggcctgggcaagaaggggcgt

SEQ ID NO: 9326631 - DNA, 22 bp, Homo sapiens
aggcctgggcaagaaggggcgt

SEQ ID NO: 9326632 - DNA, 19 bp, Homo sapiens
aggcctggggttttgcact

SEQ ID NO: 9326633 - DNA, 22 bp, Homo sapiens
aggcctggtgtgccggatgcag

SEQ ID NO: 9326634 - DNA, 22 bp, Homo sapiens
aggcctggtgaatgaagtatct

SEQ ID NO: 9326635 - DNA, 22 bp, Homo sapiens
aggcctggtgaatgaagtatct

SEQ ID NO: 9326636 - DNA, 22 bp, Homo sapiens
aggcctgggtctcgtgcctacc

SEQ ID NO: 9326637 - DNA, 22 bp, Homo sapiens
aggcctgggtgttcaccagaag

SEQ ID NO: 9326638 - DNA, 21 bp, Homo sapiens
aggctcagagagaaactcttg

SEQ ID NO: 9326639 - DNA, 22 bp, Homo sapiens
aggctcagagagctgtgtccat

SEQ ID NO: 9326640 - DNA, 22 bp, Homo sapiens
aggctcagagagctgtgtccat

SEQ ID NO: 9326641 - DNA, 22 bp, Homo sapiens
aggctagaggcttctggcttca

SEQ ID NO: 9326642 - DNA, 22 bp, Homo sapiens
aggctagaggcttctggcttca

SEQ ID NO: 9326643 - DNA, 22 bp, Homo sapiens
aggctagaggcttctggcttca

SEQ ID NO: 9326644 - DNA, 22 bp, Homo sapiens
aggctcagagatgagtaagcac

SEQ ID NO: 9326645 - DNA, 22 bp, Homo sapiens
aggctcagagatgagtaagcac

SEQ ID NO: 9326646 - DNA, 22 bp, Homo sapiens
aggctcagagatgagtaagcac

SEQ ID NO: 9326647 - DNA, 22 bp, Homo sapiens
aggctcagagatgagtaagcac

SEQ ID NO: 9326648 - DNA, 21 bp, Homo sapiens
aggctcagagatcaaacagta

SEQ ID NO: 9326649 - DNA, 21 bp, Homo sapiens
aggctcagagatcaaacagta

SEQ ID NO: 9326650 - DNA, 22 bp, Homo sapiens
ccaggcacggtggctcatgcct

SEQ ID NO: 9326651 - DNA, 22 bp, Homo sapiens
ccaggcacggtggctcatgcct

SEQ ID NO: 9326652 - DNA, 22 bp, Homo sapiens
ccaggcactcacggggcactgg

SEQ ID NO: 9326653 - DNA, 22 bp, Homo sapiens
ccaggcaccatgttcttaggac

SEQ ID NO: 9326654 - DNA, 22 bp, Homo sapiens
ccaggcaccatgttcttaggac

SEQ ID NO: 9326655 - DNA, 22 bp, Homo sapiens
ccaggcaccatgttcttaggac

SEQ ID NO: 9326656 - DNA, 22 bp, Homo sapiens
ccaggcaccaaagtatgcttta

SEQ ID NO: 9326657 - DNA, 18 bp, Homo sapiens
ccaggcacctttaaatat

SEQ ID NO: 9326658 - DNA, 22 bp, Homo sapiens
ccaggcactcagagactgggac

SEQ ID NO: 9326659 - DNA, 22 bp, Homo sapiens
ccaggcactcagagactgggac

SEQ ID NO: 9326660 - DNA, 22 bp, Homo sapiens
ccaggcactgctcgaggtgcta

SEQ ID NO: 9326661 - DNA, 22 bp, Homo sapiens
ccaggcactgctcgaggtgcta

SEQ ID NO: 9326662 - DNA, 22 bp, Homo sapiens
ccaggcactgctcgaggtgcta

SEQ ID NO: 9326663 - DNA, 20 bp, Homo sapiens
ccaggcactgtcccatgcag

SEQ ID NO: 9326664 - DNA, 22 bp, Homo sapiens
ccaggcactggctgggttcttt

SEQ ID NO: 9326665 - DNA, 20 bp, Homo sapiens
aggctcagatacccagggaa

SEQ ID NO: 9326666 - DNA, 20 bp, Homo sapiens
aggctcagatacccagggaa

SEQ ID NO: 9326667 - DNA, 22 bp, Homo sapiens
ccaggcacaggtgggcctcaga

SEQ ID NO: 9326668 - DNA, 22 bp, Homo sapiens
ccaggcacaggtgggcctcaga

SEQ ID NO: 9326669 - DNA, 16 bp, Homo sapiens
aggctcagaggctgga

SEQ ID NO: 9326670 - DNA, 20 bp, Homo sapiens
aggctcagagcagtagtaca

SEQ ID NO: 9326671 - DNA, 16 bp, Homo sapiens
aggctcagaggctgga

SEQ ID NO: 9326672 - DNA, 16 bp, Homo sapiens
aggctcagaggctgga

SEQ ID NO: 9326673 - DNA, 22 bp, Homo sapiens
aggctcagaggtgagcatctgc

SEQ ID NO: 9326674 - DNA, 22 bp, Homo sapiens
aggctcagaggtgagcatctgc

SEQ ID NO: 9326675 - DNA, 22 bp, Homo sapiens
aggcctgggcaagaaggggcgt

SEQ ID NO: 9326676 - DNA, 22 bp, Homo sapiens
ccaggaggttgaggctgcagtg

SEQ ID NO: 9326677 - DNA, 22 bp, Homo sapiens
ccaggaggtggaggttgcggtg

SEQ ID NO: 9326678 - DNA, 22 bp, Homo sapiens
ccaggaggtggaggttgcggtg

SEQ ID NO: 9326679 - DNA, 22 bp, Homo sapiens
ccaggaggtggcaggacttgcc

SEQ ID NO: 9326680 - DNA, 22 bp, Homo sapiens
ccaggaggtggcaggacttgcc

SEQ ID NO: 9326681 - DNA, 22 bp, Homo sapiens
ccaggaggtggagattgcagtg

SEQ ID NO: 9326682 - DNA, 22 bp, Homo sapiens
ccaggaggggtctctgtctccc

SEQ ID NO: 9326683 - DNA, 22 bp, Homo sapiens
ccaggaggatgaggggcataga

SEQ ID NO: 9326684 - DNA, 22 bp, Homo sapiens
ccaggaggtctgagtgtggaca

SEQ ID NO: 9326685 - DNA, 22 bp, Homo sapiens
ccaggaggtgaaacttcaccag

SEQ ID NO: 9326686 - DNA, 22 bp, Homo sapiens
ccagctcccgcaggctgcacag

SEQ ID NO: 9326687 - DNA, 22 bp, Homo sapiens
ccagctccctgaagcctggtct

SEQ ID NO: 9326688 - DNA, 23 bp, Homo sapiens
ccagctcccaggtctgaggactg

SEQ ID NO: 9326689 - DNA, 22 bp, Homo sapiens
ccagctcccattcttcacctgt

SEQ ID NO: 9326690 - DNA, 23 bp, Homo sapiens
ccagctcccaggtctgaggactg

SEQ ID NO: 9326691 - DNA, 22 bp, Homo sapiens
ccagctcccgcaggctgcacag

SEQ ID NO: 9326692 - DNA, 21 bp, Homo sapiens
aggccctggaggtcagagaaa

SEQ ID NO: 9326693 - DNA, 21 bp, Homo sapiens
aggccctggaggtcagagaaa

SEQ ID NO: 9326694 - DNA, 22 bp, Homo sapiens
aggccctggcactgcctgggag

SEQ ID NO: 9326695 - DNA, 22 bp, Homo sapiens
aggccctgctttccagagctca

SEQ ID NO: 9326696 - DNA, 22 bp, Homo sapiens
aggccctggacactcaagccgg

SEQ ID NO: 9326697 - DNA, 22 bp, Homo sapiens
aggccctgctgaggcctccctc

SEQ ID NO: 9326698 - DNA, 22 bp, Homo sapiens
aggccctgctgaggcctccctc

SEQ ID NO: 9326699 - DNA, 22 bp, Homo sapiens
aggccctgctttccagagctca

SEQ ID NO: 9326700 - DNA, 22 bp, Homo sapiens
cctactctgagcgcctccgcat

SEQ ID NO: 9326701 - DNA, 22 bp, Homo sapiens
agggctcttcctttgcctctca

SEQ ID NO: 9326702 - DNA, 22 bp, Homo sapiens
agggctgacagtggcgtggcgt

SEQ ID NO: 9326703 - DNA, 22 bp, Homo sapiens
agggctgacagtggcgtggcgt

SEQ ID NO: 9326704 - DNA, 22 bp, Homo sapiens
agggctctttaggccgaggcca

SEQ ID NO: 9326705 - DNA, 22 bp, Homo sapiens
agggctgacctaagctccactt

SEQ ID NO: 9326706 - DNA, 22 bp, Homo sapiens
agggctgacagtggcgtggcgt

SEQ ID NO: 9326707 - DNA, 22 bp, Homo sapiens
cctactctgagcgcctccgcat

SEQ ID NO: 9326708 - DNA, 22 bp, Homo sapiens
cctactctgagcgcctccgcat

SEQ ID NO: 9326709 - DNA, 22 bp, Homo sapiens
cctaccagtaggaggccagaga

SEQ ID NO: 9326710 - DNA, 22 bp, Homo sapiens
cctactcactcttttcatgctt

SEQ ID NO: 9326711 - DNA, 22 bp, Homo sapiens
cctacggaggacaggttagcca

SEQ ID NO: 9326712 - DNA, 18 bp, Homo sapiens
cctacatcattgtgagag

SEQ ID NO: 9326713 - DNA, 18 bp, Homo sapiens
cctcagggagatccagtg

SEQ ID NO: 9326714 - DNA, 22 bp, Homo sapiens
agggctgaggcgagggagatgc

SEQ ID NO: 9326715 - DNA, 22 bp, Homo sapiens
agggctgaggcgagggagatgc

SEQ ID NO: 9326716 - DNA, 22 bp, Homo sapiens
agggctgagactaaggccagat

SEQ ID NO: 9326717 - DNA, 22 bp, Homo sapiens
agggctgagactaaggccagat

SEQ ID NO: 9326718 - DNA, 22 bp, Homo sapiens
agggctgagcccaggcatgtag

SEQ ID NO: 9326719 - DNA, 22 bp, Homo sapiens
agggctgagcccaggcatgtag

SEQ ID NO: 9326720 - DNA, 22 bp, Homo sapiens
agggctgagcccaggcatgtag

SEQ ID NO: 9326721 - DNA, 22 bp, Homo sapiens
agggctgagcccaggcatgtag

SEQ ID NO: 9326722 - DNA, 22 bp, Homo sapiens
agggctgagaatgacagggccg

SEQ ID NO: 9326723 - DNA, 22 bp, Homo sapiens
agggctgagactaaggccagat

SEQ ID NO: 9326724 - DNA, 22 bp, Homo sapiens
agggctgagactaaggccagat

SEQ ID NO: 9326725 - DNA, 20 bp, Homo sapiens
agggctgagaagggactagc

SEQ ID NO: 9326726 - DNA, 22 bp, Homo sapiens
agggctgacctaagctccactt

SEQ ID NO: 9326727 - DNA, 20 bp, Homo sapiens
agggctgagaagggactagc

SEQ ID NO: 9326728 - DNA, 20 bp, Homo sapiens
agggctgagaagggactagc

SEQ ID NO: 9326729 - DNA, 22 bp, Homo sapiens
agggctgagaatgacagggccg

SEQ ID NO: 9326730 - DNA, 22 bp, Homo sapiens
cctcaggtgtgggccagctgtc

SEQ ID NO: 9326731 - DNA, 22 bp, Homo sapiens
cctcaggtgtgggccagctgtc

SEQ ID NO: 9326732 - DNA, 22 bp, Homo sapiens
agggctgggctgcttgttgtca

SEQ ID NO: 9326733 - DNA, 22 bp, Homo sapiens
cctcagtcattggcctacactt

SEQ ID NO: 9326734 - DNA, 22 bp, Homo sapiens
cctcagggtctctcacagcacc

SEQ ID NO: 9326735 - DNA, 22 bp, Homo sapiens
cctcaggggtgcccacagctgc

SEQ ID NO: 9326736 - DNA, 22 bp, Homo sapiens
cctcagggtctgaggagaccgt

SEQ ID NO: 9326737 - DNA, 22 bp, Homo sapiens
cctcagggtctgaggagaccgt

SEQ ID NO: 9326738 - DNA, 22 bp, Homo sapiens
cctcaggggtgcccacagctgc

SEQ ID NO: 9326739 - DNA, 23 bp, Homo sapiens
cctcaggggacctgtgagcctga

SEQ ID NO: 9326740 - DNA, 23 bp, Homo sapiens
cctcaggggacctgtgagcctga

SEQ ID NO: 9326741 - DNA, 21 bp, Homo sapiens
agggcctgtgctctccaggtc

SEQ ID NO: 9326742 - DNA, 22 bp, Homo sapiens
agggcctgtgaattctccctgc

SEQ ID NO: 9326743 - DNA, 22 bp, Homo sapiens
agggcctgtctgtagaactgaa

SEQ ID NO: 9326744 - DNA, 22 bp, Homo sapiens
agggcctgtgaattctccctgc

SEQ ID NO: 9326745 - DNA, 21 bp, Homo sapiens
agggcctgtgctctccaggtc

SEQ ID NO: 9326746 - DNA, 21 bp, Homo sapiens
agggcctgtgctctccaggtc

SEQ ID NO: 9326747 - DNA, 22 bp, Homo sapiens
agggcctgtgctgagtagacga

SEQ ID NO: 9326748 - DNA, 22 bp, Homo sapiens
agggcctgtctgtagaactgaa

SEQ ID NO: 9326749 - DNA, 22 bp, Homo sapiens
agggcctgtccgctcccgcccg

SEQ ID NO: 9326750 - DNA, 22 bp, Homo sapiens
agggcctgtctgtagaactgaa

SEQ ID NO: 9326751 - DNA, 22 bp, Homo sapiens
agggcctgtctgtagaactgaa

SEQ ID NO: 9326752 - DNA, 22 bp, Homo sapiens
cctaagtaagttgactttcaga

SEQ ID NO: 9326753 - DNA, 22 bp, Homo sapiens
cctacagttatattcttgattg

SEQ ID NO: 9326754 - DNA, 22 bp, Homo sapiens
cctacaggaaattgtatcaaaa

SEQ ID NO: 9326755 - DNA, 22 bp, Homo sapiens
cctaaggtctcatgcagctttt

SEQ ID NO: 9326756 - DNA, 20 bp, Homo sapiens
agggcctgttgcaagcgttt

SEQ ID NO: 9326757 - DNA, 20 bp, Homo sapiens
agggcctgttgcaagcgttt

SEQ ID NO: 9326758 - DNA, 20 bp, Homo sapiens
agggcctgttgcaagcgttt

SEQ ID NO: 9326759 - DNA, 22 bp, Homo sapiens
agggcctgtgctgagtagacga

SEQ ID NO: 9326760 - DNA, 22 bp, Homo sapiens
agggcctgtgcttcctgagata

SEQ ID NO: 9326761 - DNA, 22 bp, Homo sapiens
agggcctgtgcttcctgagata

SEQ ID NO: 9326762 - DNA, 22 bp, Homo sapiens
agggcctgtgctgagtagacga

SEQ ID NO: 9326763 - DNA, 22 bp, Homo sapiens
agggcctgtgctgagtagacga

SEQ ID NO: 9326764 - DNA, 22 bp, Homo sapiens
ccctggcaagtgctgtgtagct

SEQ ID NO: 9326765 - DNA, 22 bp, Homo sapiens
ccctggcacatgcgctgtgtgg

SEQ ID NO: 9326766 - DNA, 22 bp, Homo sapiens
ccctggcactagcgacggccat

SEQ ID NO: 9326767 - DNA, 22 bp, Homo sapiens
ccctggcactagcgacggccat

SEQ ID NO: 9326768 - DNA, 22 bp, Homo sapiens
ccctggcagaaggtgtagaagc

SEQ ID NO: 9326769 - DNA, 22 bp, Homo sapiens
agggcccatgtgggagcacttg

SEQ ID NO: 9326770 - DNA, 17 bp, Homo sapiens
ccctggcaaagaatggc

SEQ ID NO: 9326771 - DNA, 22 bp, Homo sapiens
agggccccatagtcactgcccg

SEQ ID NO: 9326772 - DNA, 22 bp, Homo sapiens
agggcccagtggagagctgagc

SEQ ID NO: 9326773 - DNA, 22 bp, Homo sapiens
agggcccatagatcgtcagctt

SEQ ID NO: 9326774 - DNA, 22 bp, Homo sapiens
agggcccatgtgggagcacttg

SEQ ID NO: 9326775 - DNA, 22 bp, Homo sapiens
ccctggcagcaatcactggtgt

SEQ ID NO: 9326776 - DNA, 22 bp, Homo sapiens
ccctggcagagggggcaggtgc

SEQ ID NO: 9326777 - DNA, 22 bp, Homo sapiens
ccctggcagagggggcaggtgc

SEQ ID NO: 9326778 - DNA, 22 bp, Homo sapiens
ccctggcagaatgtctctgggc

SEQ ID NO: 9326779 - DNA, 22 bp, Homo sapiens
ccctggcagtgctcctttagac

SEQ ID NO: 9326780 - DNA, 22 bp, Homo sapiens
ccctggcataaaacttctccag

SEQ ID NO: 9326781 - DNA, 22 bp, Homo sapiens
ccctggcagtgctcctttagac

SEQ ID NO: 9326782 - DNA, 19 bp, Homo sapiens
ccctggcaggcaagcctgg

SEQ ID NO: 9326783 - DNA, 19 bp, Homo sapiens
ccctggcaggcaagcctgg

SEQ ID NO: 9326784 - DNA, 22 bp, Homo sapiens
ccctggcagcaatcactggtgt

SEQ ID NO: 9326785 - DNA, 22 bp, Homo sapiens
ccctggcatgcatgtccctggc

SEQ ID NO: 9326786 - DNA, 22 bp, Homo sapiens
ccctggcatgcatgtccctggc

SEQ ID NO: 9326787 - DNA, 22 bp, Homo sapiens
agggcctggcttcactttctca

SEQ ID NO: 9326788 - DNA, 22 bp, Homo sapiens
ccctggccagggcacagggagg

SEQ ID NO: 9326789 - DNA, 22 bp, Homo sapiens
ccctggccagctcatgtctgag

SEQ ID NO: 9326790 - DNA, 22 bp, Homo sapiens
ccctggccagggcacagggagg

SEQ ID NO: 9326791 - DNA, 22 bp, Homo sapiens
aggggaagattatacttttgaa

SEQ ID NO: 9326792 - DNA, 22 bp, Homo sapiens
aggggaaggccagcctgtagag

SEQ ID NO: 9326793 - DNA, 22 bp, Homo sapiens
aggggaagattatacttttgaa

SEQ ID NO: 9326794 - DNA, 22 bp, Homo sapiens
aggggaaatgccttggtggtac

SEQ ID NO: 9326795 - DNA, 21 bp, Homo sapiens
aggggaagtagagttttgatt

SEQ ID NO: 9326796 - DNA, 22 bp, Homo sapiens
aggggaatgggtagactgttga

SEQ ID NO: 9326797 - DNA, 22 bp, Homo sapiens
aggggaatgggtagactgttga

SEQ ID NO: 9326798 - DNA, 22 bp, Homo sapiens
cctcctggtgacaaggcaaagc

SEQ ID NO: 9326799 - DNA, 22 bp, Homo sapiens
cctcctggtgacaaggcaaagc

SEQ ID NO: 9326800 - DNA, 18 bp, Homo sapiens
aggggcagcttgtgtgga

SEQ ID NO: 9326801 - DNA, 22 bp, Homo sapiens
cctcgacctccccaggctcagg

SEQ ID NO: 9326802 - DNA, 22 bp, Homo sapiens
cctccttctggggccttctgct

SEQ ID NO: 9326803 - DNA, 22 bp, Homo sapiens
cctccttcctgggacagagctg

SEQ ID NO: 9326804 - DNA, 22 bp, Homo sapiens
cctcctgttgtcctgctggggc

SEQ ID NO: 9326805 - DNA, 22 bp, Homo sapiens
cctcctggtgggcgcttctggc

SEQ ID NO: 9326806 - DNA, 22 bp, Homo sapiens
cctcctggtgggcgcttctggc

SEQ ID NO: 9326807 - DNA, 22 bp, Homo sapiens
cctcctggtgggcgcttctggc

SEQ ID NO: 9326808 - DNA, 22 bp, Homo sapiens
cctcctggtgggcgcttctggc

SEQ ID NO: 9326809 - DNA, 22 bp, Homo sapiens
cctcctggtgggcgcttctggc

SEQ ID NO: 9326810 - DNA, 22 bp, Homo sapiens
cctcctgttgtcaccaggcgtg

SEQ ID NO: 9326811 - DNA, 22 bp, Homo sapiens
cctcctggttgcaatgaaatgg

SEQ ID NO: 9326812 - DNA, 19 bp, Homo sapiens
cctcctgtggcgggtgggg

SEQ ID NO: 9326813 - DNA, 22 bp, Homo sapiens
cctcctggttgcaatgaaatgg

SEQ ID NO: 9326814 - DNA, 22 bp, Homo sapiens
cctcctgtctccttcctatatt

SEQ ID NO: 9326815 - DNA, 22 bp, Homo sapiens
aggggcctggttggcctctgtt

SEQ ID NO: 9326816 - DNA, 22 bp, Homo sapiens
aggggctcagttactttggcag

SEQ ID NO: 9326817 - DNA, 22 bp, Homo sapiens
cctctgtgggccgggcctgctg

SEQ ID NO: 9326818 - DNA, 22 bp, Homo sapiens
aggggctgcctggcttggcact

SEQ ID NO: 9326819 - DNA, 22 bp, Homo sapiens
aggggctctgagtgggccagga

SEQ ID NO: 9326820 - DNA, 22 bp, Homo sapiens
aggggctctaaagatcatggaa

SEQ ID NO: 9326821 - DNA, 22 bp, Homo sapiens
aggggctcctttgtgctgcgtc

SEQ ID NO: 9326822 - DNA, 22 bp, Homo sapiens
aggggctcctggcctggagagc

SEQ ID NO: 9326823 - DNA, 22 bp, Homo sapiens
aggggctcctggcctggagagc

SEQ ID NO: 9326824 - DNA, 22 bp, Homo sapiens
agggggctggagacacctcctc

SEQ ID NO: 9326825 - DNA, 22 bp, Homo sapiens
agggggtgaatgtctgtctaca

SEQ ID NO: 9326826 - DNA, 22 bp, Homo sapiens
agggggtgaatgtctgtctaca

SEQ ID NO: 9326827 - DNA, 22 bp, Homo sapiens
cctcttcagcaaagttcggccc

SEQ ID NO: 9326828 - DNA, 22 bp, Homo sapiens
cctcttcacctcgggcacactg

SEQ ID NO: 9326829 - DNA, 22 bp, Homo sapiens
agggggagcttggctactcctg

SEQ ID NO: 9326830 - DNA, 22 bp, Homo sapiens
agggggagcttggctactcctg

SEQ ID NO: 9326831 - DNA, 22 bp, Homo sapiens
agggggctccttggtgtgcaga

SEQ ID NO: 9326832 - DNA, 22 bp, Homo sapiens
cctctgtgtctccaagaggcct

SEQ ID NO: 9326833 - DNA, 22 bp, Homo sapiens
cctctgtgtgatgcgcaaagta

SEQ ID NO: 9326834 - DNA, 22 bp, Homo sapiens
cctctgtgtgtgcatgcatgcg

SEQ ID NO: 9326835 - DNA, 22 bp, Homo sapiens
cctctgttgaaaattacaaaca

SEQ ID NO: 9326836 - DNA, 20 bp, Homo sapiens
cctctgtttacaacacaccc

SEQ ID NO: 9326837 - DNA, 22 bp, Homo sapiens
cctctgtggtctgtctaatgca

SEQ ID NO: 9326838 - DNA, 22 bp, Homo sapiens
cctctgtgtcctggtcattgaa

SEQ ID NO: 9326839 - DNA, 22 bp, Homo sapiens
cctctgtgtcagggaagagact

SEQ ID NO: 9326840 - DNA, 22 bp, Homo sapiens
cctctgtgtcctggtcattgaa

SEQ ID NO: 9326841 - DNA, 20 bp, Homo sapiens
cctctgtgtcctgtgtcata

SEQ ID NO: 9326842 - DNA, 20 bp, Homo sapiens
cctctgtgtcctgtgtcata

SEQ ID NO: 9326843 - DNA, 22 bp, Homo sapiens
aggggtctatcctgagatggtc

SEQ ID NO: 9326844 - DNA, 20 bp, Homo sapiens
aggggtctagcagcagtgct

SEQ ID NO: 9326845 - DNA, 22 bp, Homo sapiens
aggggtcagtgaccattgagga

SEQ ID NO: 9326846 - DNA, 22 bp, Homo sapiens
aggggtcagtgaccattgagga

SEQ ID NO: 9326847 - DNA, 22 bp, Homo sapiens
aggggtcttgggagtcctggct

SEQ ID NO: 9326848 - DNA, 22 bp, Homo sapiens
agggggtgtctctgattgggtt

SEQ ID NO: 9326849 - DNA, 22 bp, Homo sapiens
agggggtgtctctgattgggtt

SEQ ID NO: 9326850 - DNA, 22 bp, Homo sapiens
agggggtgtctctgattgggtt

SEQ ID NO: 9326851 - DNA, 22 bp, Homo sapiens
agggggtgatcaaggtgcggcg

SEQ ID NO: 9326852 - DNA, 22 bp, Homo sapiens
agggggtgatcaaggtgcggcg

SEQ ID NO: 9326853 - DNA, 22 bp, Homo sapiens
agggggtgcatttgtgaatgaa

SEQ ID NO: 9326854 - DNA, 22 bp, Homo sapiens
agggggtgcatttgtgaatgaa

SEQ ID NO: 9326855 - DNA, 22 bp, Homo sapiens
agggggtgcatttgtgaatgaa

SEQ ID NO: 9326856 - DNA, 22 bp, Homo sapiens
agggggtgcccagatgaaggat

SEQ ID NO: 9326857 - DNA, 22 bp, Homo sapiens
ccctgaggatagggcaggaccc

SEQ ID NO: 9326858 - DNA, 19 bp, Homo sapiens
agggccacggggaggtatt

SEQ ID NO: 9326859 - DNA, 22 bp, Homo sapiens
agggccacctctctgggttccc

SEQ ID NO: 9326860 - DNA, 22 bp, Homo sapiens
agggccaccagggagtctcagg

SEQ ID NO: 9326861 - DNA, 22 bp, Homo sapiens
agggccacagtggggcctgaga

SEQ ID NO: 9326862 - DNA, 22 bp, Homo sapiens
agggccaccagagcagggcagt

SEQ ID NO: 9326863 - DNA, 22 bp, Homo sapiens
agggccaccagagcagggcagt

SEQ ID NO: 9326864 - DNA, 22 bp, Homo sapiens
agggccaccagagcagggcagt

SEQ ID NO: 9326865 - DNA, 22 bp, Homo sapiens
agggccaccagggagtctcagg

SEQ ID NO: 9326866 - DNA, 22 bp, Homo sapiens
cccctgggtccaggcttctctg

SEQ ID NO: 9326867 - DNA, 22 bp, Homo sapiens
cccctgggtccaggcttctctg

SEQ ID NO: 9326868 - DNA, 22 bp, Homo sapiens
cccctggggatcagctggaatt

SEQ ID NO: 9326869 - DNA, 22 bp, Homo sapiens
cccctggggatcagctggaatt

SEQ ID NO: 9326870 - DNA, 22 bp, Homo sapiens
agggcagctgtgagccactgtg

SEQ ID NO: 9326871 - DNA, 22 bp, Homo sapiens
agggcatgctggaggagagaca

SEQ ID NO: 9326872 - DNA, 22 bp, Homo sapiens
agggcatgtgggagaggagcct

SEQ ID NO: 9326873 - DNA, 22 bp, Homo sapiens
agggcatgtgggagaggagcct

SEQ ID NO: 9326874 - DNA, 22 bp, Homo sapiens
agggcatgtgggagaggagcct

SEQ ID NO: 9326875 - DNA, 22 bp, Homo sapiens
agggcatgtgggagaggagcct

SEQ ID NO: 9326876 - DNA, 22 bp, Homo sapiens
agggcatggggttaacctggga

SEQ ID NO: 9326877 - DNA, 22 bp, Homo sapiens
agggccagggaagctgtatttt

SEQ ID NO: 9326878 - DNA, 23 bp, Homo sapiens
agggccaggtgcggaaacagctc

SEQ ID NO: 9326879 - DNA, 22 bp, Homo sapiens
agggcccacagttcctatggcc

SEQ ID NO: 9326880 - DNA, 23 bp, Homo sapiens
agggcccaagcctggacagcagg

SEQ ID NO: 9326881 - DNA, 22 bp, Homo sapiens
agggcccaggacagcatcaggg

SEQ ID NO: 9326882 - DNA, 22 bp, Homo sapiens
ccctgagtcatcattgcggaag

SEQ ID NO: 9326883 - DNA, 22 bp, Homo sapiens
ccctgaggggagtggtgaggtg

SEQ ID NO: 9326884 - DNA, 21 bp, Homo sapiens
cccctgggagccctgtcagta

SEQ ID NO: 9326885 - DNA, 21 bp, Homo sapiens
cccctgggagccctgtcagta

SEQ ID NO: 9326886 - DNA, 21 bp, Homo sapiens
cccctgggagccctgtcagta

SEQ ID NO: 9326887 - DNA, 21 bp, Homo sapiens
cccctgggagccctgtcagta

SEQ ID NO: 9326888 - DNA, 21 bp, Homo sapiens
cccctgggagccctgtcagta

SEQ ID NO: 9326889 - DNA, 22 bp, Homo sapiens
cccctgctggtcgaaacaattt

SEQ ID NO: 9326890 - DNA, 22 bp, Homo sapiens
cccctgctggcctgctggtttc

SEQ ID NO: 9326891 - DNA, 22 bp, Homo sapiens
cccctgccagctatccctgaac

SEQ ID NO: 9326892 - DNA, 22 bp, Homo sapiens
agggcagagaaatgtagttgag

SEQ ID NO: 9326893 - DNA, 22 bp, Homo sapiens
agggcagagaaatgtagttgag

SEQ ID NO: 9326894 - DNA, 22 bp, Homo sapiens
agggcagaagtacagacactta

SEQ ID NO: 9326895 - DNA, 22 bp, Homo sapiens
agggcagaccacgtgcaaggat

SEQ ID NO: 9326896 - DNA, 22 bp, Homo sapiens
agggcagactaggatggaagtg

SEQ ID NO: 9326897 - DNA, 20 bp, Homo sapiens
cccaggtgtctgaagctctg

SEQ ID NO: 9326898 - DNA, 20 bp, Homo sapiens
cccaggtgtctgaagctctg

SEQ ID NO: 9326899 - DNA, 19 bp, Homo sapiens
cccaggtgtttgaggctgc

SEQ ID NO: 9326900 - DNA, 19 bp, Homo sapiens
cccaggtgtttgaggctgc

SEQ ID NO: 9326901 - DNA, 23 bp, Homo sapiens
cccaggtgtggaggcggtggcag

SEQ ID NO: 9326902 - DNA, 22 bp, Homo sapiens
cccagtaagaagctggcaccag

SEQ ID NO: 9326903 - DNA, 18 bp, Homo sapiens
cccaggttggcctacaga

SEQ ID NO: 9326904 - DNA, 18 bp, Homo sapiens
cccaggttggcctacaga

SEQ ID NO: 9326905 - DNA, 19 bp, Homo sapiens
cccaggtgtttgaggctgc

SEQ ID NO: 9326906 - DNA, 22 bp, Homo sapiens
cccaggtgtttgtggcagaggt

SEQ ID NO: 9326907 - DNA, 22 bp, Homo sapiens
agggcagaaatattgatactgt

SEQ ID NO: 9326908 - DNA, 22 bp, Homo sapiens
cccaggtgggttggcctctgtc

SEQ ID NO: 9326909 - DNA, 22 bp, Homo sapiens
cccaggtgggcacctcgaggaa

SEQ ID NO: 9326910 - DNA, 22 bp, Homo sapiens
cccaggtgggttggcctctgtc

SEQ ID NO: 9326911 - DNA, 22 bp, Homo sapiens
cccaggtgggcacctcgaggaa

SEQ ID NO: 9326912 - DNA, 22 bp, Homo sapiens
cccaggtgggcacctcgaggaa

SEQ ID NO: 9326913 - DNA, 22 bp, Homo sapiens
cccaggtgctgcgtgaagcctc

SEQ ID NO: 9326914 - DNA, 22 bp, Homo sapiens
cccaggtggcagaagctgcagt

SEQ ID NO: 9326915 - DNA, 22 bp, Homo sapiens
cccaggtggcagaagctgcagt

SEQ ID NO: 9326916 - DNA, 22 bp, Homo sapiens
cccaggtggcagaagctgcagt

SEQ ID NO: 9326917 - DNA, 21 bp, Homo sapiens
cccaggtgggatggttgcctc

SEQ ID NO: 9326918 - DNA, 22 bp, Homo sapiens
agggagctttaccccagatcac

SEQ ID NO: 9326919 - DNA, 22 bp, Homo sapiens
agggagctttaccccagatcac

SEQ ID NO: 9326920 - DNA, 22 bp, Homo sapiens
agggagcttgtgtttcttttag

SEQ ID NO: 9326921 - DNA, 21 bp, Homo sapiens
agggagctttaggtagaagtt

SEQ ID NO: 9326922 - DNA, 22 bp, Homo sapiens
agggagctttcaggtagcttaa

SEQ ID NO: 9326923 - DNA, 22 bp, Homo sapiens
cccaggtgctgaaggaggccgc

SEQ ID NO: 9326924 - DNA, 22 bp, Homo sapiens
cccaggtgctgaaggaggccgc

SEQ ID NO: 9326925 - DNA, 22 bp, Homo sapiens
cccaggtgctgcgtgaagcctc

SEQ ID NO: 9326926 - DNA, 22 bp, Homo sapiens
cccaggaagggatgccaaggaa

SEQ ID NO: 9326927 - DNA, 22 bp, Homo sapiens
cccaggaagggatgccaaggaa

SEQ ID NO: 9326928 - DNA, 22 bp, Homo sapiens
cccaggaagttgatgcagagga

SEQ ID NO: 9326929 - DNA, 22 bp, Homo sapiens
cccaggaagttgagactgcagt

SEQ ID NO: 9326930 - DNA, 19 bp, Homo sapiens
cccaggaagcggaggttgc

SEQ ID NO: 9326931 - DNA, 22 bp, Homo sapiens
cccaggaacagggctcagaccc

SEQ ID NO: 9326932 - DNA, 22 bp, Homo sapiens
agggaaagtaagcatttcatta

SEQ ID NO: 9326933 - DNA, 23 bp, Homo sapiens
agggaaagtagtaatggcctttg

SEQ ID NO: 9326934 - DNA, 22 bp, Homo sapiens
agggaaaggtagtgaggtcaca

SEQ ID NO: 9326935 - DNA, 21 bp, Homo sapiens
agggaaagaaaatgagctaat

SEQ ID NO: 9326936 - DNA, 22 bp, Homo sapiens
agggaaaggctgatgctgtggg

SEQ ID NO: 9326937 - DNA, 22 bp, Homo sapiens
aggctttcctgtcactcatgct

SEQ ID NO: 9326938 - DNA, 22 bp, Homo sapiens
cccagagtggagggtgcagaat

SEQ ID NO: 9326939 - DNA, 22 bp, Homo sapiens
cccagagttcaaaccctgcgtc

SEQ ID NO: 9326940 - DNA, 22 bp, Homo sapiens
agggagctgtggtcagctcagt

SEQ ID NO: 9326941 - DNA, 22 bp, Homo sapiens
agggagcttccgaactacagct

SEQ ID NO: 9326942 - DNA, 22 bp, Homo sapiens
agggagcttccgaactacagct

SEQ ID NO: 9326943 - DNA, 22 bp, Homo sapiens
agggagctgtggtcagctcagt

SEQ ID NO: 9326944 - DNA, 22 bp, Homo sapiens
agggagctgtggtcagctcagt

SEQ ID NO: 9326945 - DNA, 22 bp, Homo sapiens
agggagcttccgaactacagct

SEQ ID NO: 9326946 - DNA, 22 bp, Homo sapiens
agggagcttctacttcaaggca

SEQ ID NO: 9326947 - DNA, 22 bp, Homo sapiens
agggagcttctggcctcagcct

SEQ ID NO: 9326948 - DNA, 22 bp, Homo sapiens
agggagcttctggcctcagcct

SEQ ID NO: 9326949 - DNA, 22 bp, Homo sapiens
agggagcttctggcctcagcct

SEQ ID NO: 9326950 - DNA, 22 bp, Homo sapiens
agggagctgagctgtgagcagc

SEQ ID NO: 9326951 - DNA, 21 bp, Homo sapiens
agggagctgcgtcttgaaaga

SEQ ID NO: 9326952 - DNA, 21 bp, Homo sapiens
agggagctggccacacagcct

SEQ ID NO: 9326953 - DNA, 22 bp, Homo sapiens
agggagctgctctgcttccgtg

SEQ ID NO: 9326954 - DNA, 21 bp, Homo sapiens
agggagctggccacacagcct

SEQ ID NO: 9326955 - DNA, 22 bp, Homo sapiens
agggagctggtatttataatga

SEQ ID NO: 9326956 - DNA, 22 bp, Homo sapiens
agggagctgggccacactgatc

SEQ ID NO: 9326957 - DNA, 22 bp, Homo sapiens
cccaggcctggtctgggccagt

SEQ ID NO: 9326958 - DNA, 22 bp, Homo sapiens
cccaggcctggtctgggccagt

SEQ ID NO: 9326959 - DNA, 22 bp, Homo sapiens
cccaggcctggtctgggccagt

SEQ ID NO: 9326960 - DNA, 22 bp, Homo sapiens
agggagccttcctggctgtggt

SEQ ID NO: 9326961 - DNA, 22 bp, Homo sapiens
agggagctgagagctactattt

SEQ ID NO: 9326962 - DNA, 22 bp, Homo sapiens
agggagctgagctgtgagcagc

SEQ ID NO: 9326963 - DNA, 22 bp, Homo sapiens
cccaggccctggcagagcttgt

SEQ ID NO: 9326964 - DNA, 22 bp, Homo sapiens
cccaggccctggcagagcttgt

SEQ ID NO: 9326965 - DNA, 22 bp, Homo sapiens
cccaggccccagggcttgtcag

SEQ ID NO: 9326966 - DNA, 22 bp, Homo sapiens
cccaggccctggcagagcttgt

SEQ ID NO: 9326967 - DNA, 22 bp, Homo sapiens
cccaggccctggcagagcttgt

SEQ ID NO: 9326968 - DNA, 17 bp, Homo sapiens
cccaggccgccgggagc

SEQ ID NO: 9326969 - DNA, 17 bp, Homo sapiens
cccaggccgccgggagc

SEQ ID NO: 9326970 - DNA, 17 bp, Homo sapiens
cccaggccgccgggagc

SEQ ID NO: 9326971 - DNA, 22 bp, Homo sapiens
cccaggccccagggcttgtcag

SEQ ID NO: 9326972 - DNA, 22 bp, Homo sapiens
cccaggccccagggcttgtcag

SEQ ID NO: 9326973 - DNA, 22 bp, Homo sapiens
cccaggccccagggcttgtcag

SEQ ID NO: 9326974 - DNA, 22 bp, Homo sapiens
cccaggccagaacttggttgct

SEQ ID NO: 9326975 - DNA, 22 bp, Homo sapiens
agggactccctgggccgacacg

SEQ ID NO: 9326976 - DNA, 22 bp, Homo sapiens
agggactccgtgcacagtggtt

SEQ ID NO: 9326977 - DNA, 22 bp, Homo sapiens
cccaggccagaacttggttgct

SEQ ID NO: 9326978 - DNA, 22 bp, Homo sapiens
cccaggccagaacttggttgct

SEQ ID NO: 9326979 - DNA, 22 bp, Homo sapiens
cccaggccagaacttggttgct

SEQ ID NO: 9326980 - DNA, 22 bp, Homo sapiens
cccaggcattttcaactttagt

SEQ ID NO: 9326981 - DNA, 22 bp, Homo sapiens
agggacccatagagagaccagt

SEQ ID NO: 9326982 - DNA, 22 bp, Homo sapiens
agggacagttacatcatcagac

SEQ ID NO: 9326983 - DNA, 22 bp, Homo sapiens
agggacagttacatcatcagac

SEQ ID NO: 9326984 - DNA, 22 bp, Homo sapiens
agggacagttacatcatcagac

SEQ ID NO: 9326985 - DNA, 22 bp, Homo sapiens
agggaccacatcccctctgtgg

SEQ ID NO: 9326986 - DNA, 22 bp, Homo sapiens
agggacatgaggatgatctaga

SEQ ID NO: 9326987 - DNA, 22 bp, Homo sapiens
agggacagtctactgttcactg

SEQ ID NO: 9326988 - DNA, 22 bp, Homo sapiens
agggaatggatgatggcaggtt

SEQ ID NO: 9326989 - DNA, 22 bp, Homo sapiens
agggaatggatgatggcaggtt

SEQ ID NO: 9326990 - DNA, 22 bp, Homo sapiens
agggaatggatgatggcaggtt

SEQ ID NO: 9326991 - DNA, 22 bp, Homo sapiens
agggaatggatgatggcaggtt

SEQ ID NO: 9326992 - DNA, 22 bp, Homo sapiens
agggacagtctactgttcactg

SEQ ID NO: 9326993 - DNA, 22 bp, Homo sapiens
agggacagtctactgttcactg

SEQ ID NO: 9326994 - DNA, 22 bp, Homo sapiens
agggacagttacatcatcagac

SEQ ID NO: 9326995 - DNA, 22 bp, Homo sapiens
agtacaagtagaatgctacaag

SEQ ID NO: 9326996 - DNA, 22 bp, Homo sapiens
agtacaagtagaatgctacaag

SEQ ID NO: 9326997 - DNA, 22 bp, Homo sapiens
agtacaaattatagcgcttgga

SEQ ID NO: 9326998 - DNA, 22 bp, Homo sapiens
agtacaaattatagcgcttgga

SEQ ID NO: 9326999 - DNA, 21 bp, Homo sapiens
cgggctggccgggccctcacc

SEQ ID NO: 9327000 - DNA, 22 bp, Homo sapiens
cgggcgcactccgggcagctgt

SEQ ID NO: 9327001 - DNA, 22 bp, Homo sapiens
cgggcaaggcgagactaggccc

SEQ ID NO: 9327002 - DNA, 22 bp, Homo sapiens
cgggcagtgtggctccagagtc

SEQ ID NO: 9327003 - DNA, 22 bp, Homo sapiens
cgggcagcggcgtggccatggt

SEQ ID NO: 9327004 - DNA, 22 bp, Homo sapiens
cgggcagtgtggctccagagtc

SEQ ID NO: 9327005 - DNA, 17 bp, Homo sapiens
cgggcatggagggcagg

SEQ ID NO: 9327006 - DNA, 22 bp, Homo sapiens
cgggccctttaaggatgtgtcg

SEQ ID NO: 9327007 - DNA, 22 bp, Homo sapiens
agtacacaagacacatttaaaa

SEQ ID NO: 9327008 - DNA, 22 bp, Homo sapiens
agtacagggagtttgttgtgtt

SEQ ID NO: 9327009 - DNA, 21 bp, Homo sapiens
ctaagcaaggagcaggggtag

SEQ ID NO: 9327010 - DNA, 20 bp, Homo sapiens
ctaagaggtccttccacatc

SEQ ID NO: 9327011 - DNA, 18 bp, Homo sapiens
ctaagaggtcgtttctca

SEQ ID NO: 9327012 - DNA, 22 bp, Homo sapiens
ctaagaggaagtactctgttat

SEQ ID NO: 9327013 - DNA, 20 bp, Homo sapiens
ctaagaggaggactaggttt

SEQ ID NO: 9327014 - DNA, 22 bp, Homo sapiens
ctaaacttcttggcaattttat

SEQ ID NO: 9327015 - DNA, 22 bp, Homo sapiens
ctaaactttgtttatactctga

SEQ ID NO: 9327016 - DNA, 18 bp, Homo sapiens
cctgtgtgtgttgcaggc

SEQ ID NO: 9327017 - DNA, 17 bp, Homo sapiens
cctgtgtttgctccttc

SEQ ID NO: 9327018 - DNA, 22 bp, Homo sapiens
cctgttccattcatatcctatt

SEQ ID NO: 9327019 - DNA, 22 bp, Homo sapiens
cgcaggctccggggtgccctgg

SEQ ID NO: 9327020 - DNA, 22 bp, Homo sapiens
cgcaggcacagagtggacagcg

SEQ ID NO: 9327021 - DNA, 22 bp, Homo sapiens
cgcaggcaagagagtacagtta

SEQ ID NO: 9327022 - DNA, 19 bp, Homo sapiens
cgcaggagccgaggtgacc

SEQ ID NO: 9327023 - DNA, 19 bp, Homo sapiens
cgcaggagccgaggtgacc

SEQ ID NO: 9327024 - DNA, 22 bp, Homo sapiens
cgcaggaagacaagggtggaaa

SEQ ID NO: 9327025 - DNA, 22 bp, Homo sapiens
cctgttctaatcttggggcaga

SEQ ID NO: 9327026 - DNA, 22 bp, Homo sapiens
cctgttgctctgcatgagttta

SEQ ID NO: 9327027 - DNA, 22 bp, Homo sapiens
cgcagctgtccatgtgtggggg

SEQ ID NO: 9327028 - DNA, 22 bp, Homo sapiens
cgaggcctcaagacagtgtttg

SEQ ID NO: 9327029 - DNA, 22 bp, Homo sapiens
cgaggccatgcatgctgaggac

SEQ ID NO: 9327030 - DNA, 22 bp, Homo sapiens
cgaggccatgcatgctgaggac

SEQ ID NO: 9327031 - DNA, 22 bp, Homo sapiens
cgcagggccgcgagcgggacca

SEQ ID NO: 9327032 - DNA, 22 bp, Homo sapiens
cgcaggtgaaagaggctgggca

SEQ ID NO: 9327033 - DNA, 22 bp, Homo sapiens
cgcaggtgaaagaggctgggca

SEQ ID NO: 9327034 - DNA, 22 bp, Homo sapiens
cgcaggtgaaagaggctgggca

SEQ ID NO: 9327035 - DNA, 22 bp, Homo sapiens
cgcaggtgaactgttctgcagt

SEQ ID NO: 9327036 - DNA, 22 bp, Homo sapiens
cgcaggtgaactgttctgcagt

SEQ ID NO: 9327037 - DNA, 22 bp, Homo sapiens
cgcaggctggcgcggagtggca

SEQ ID NO: 9327038 - DNA, 22 bp, Homo sapiens
cgcaggctgcagccaagaagag

SEQ ID NO: 9327039 - DNA, 22 bp, Homo sapiens
cgcaggctcggttcacagagca

SEQ ID NO: 9327040 - DNA, 19 bp, Homo sapiens
cgcaggcttcgggtcgctc

SEQ ID NO: 9327041 - DNA, 22 bp, Homo sapiens
cgcagggccgcgagcgggacca

SEQ ID NO: 9327042 - DNA, 22 bp, Homo sapiens
agtaaaaagttcagaatggttg

SEQ ID NO: 9327043 - DNA, 22 bp, Homo sapiens
agtaaaaatatgcttgtggcta

SEQ ID NO: 9327044 - DNA, 22 bp, Homo sapiens
cggctcagctagcttggcccca

SEQ ID NO: 9327045 - DNA, 20 bp, Homo sapiens
cggctcagcctctccctccc

SEQ ID NO: 9327046 - DNA, 22 bp, Homo sapiens
ctacatttgttctatagctttt

SEQ ID NO: 9327047 - DNA, 22 bp, Homo sapiens
ctacattttaataagctgctta

SEQ ID NO: 9327048 - DNA, 22 bp, Homo sapiens
ctacatttggagagtataggaa

SEQ ID NO: 9327049 - DNA, 22 bp, Homo sapiens
ctagaaatctctgtttacatca

SEQ ID NO: 9327050 - DNA, 22 bp, Homo sapiens
ctaccagcttctttgtctggga

SEQ ID NO: 9327051 - DNA, 22 bp, Homo sapiens
ctacatttttcaccgagcctct

SEQ ID NO: 9327052 - DNA, 22 bp, Homo sapiens
agtatttagcatagtggttagt

SEQ ID NO: 9327053 - DNA, 22 bp, Homo sapiens
agtatttagctgactcgctaca

SEQ ID NO: 9327054 - DNA, 22 bp, Homo sapiens
agtatttagagacacaagatgg

SEQ ID NO: 9327055 - DNA, 23 bp, Homo sapiens
agtattcaaaaggcaagctatat

SEQ ID NO: 9327056 - DNA, 22 bp, Homo sapiens
agtattgtgactcaagtattct

SEQ ID NO: 9327057 - DNA, 22 bp, Homo sapiens
agtatttagagacacaagacgg

SEQ ID NO: 9327058 - DNA, 22 bp, Homo sapiens
agtatttagagacacaagacgg

SEQ ID NO: 9327059 - DNA, 22 bp, Homo sapiens
agtatttagagacacaagacgg

SEQ ID NO: 9327060 - DNA, 22 bp, Homo sapiens
ctaaggaaaggaaatacagtaa

SEQ ID NO: 9327061 - DNA, 22 bp, Homo sapiens
ctaagcacactgccttgctgtg

SEQ ID NO: 9327062 - DNA, 22 bp, Homo sapiens
ctaaggaagtgacagtgggatt

SEQ ID NO: 9327063 - DNA, 22 bp, Homo sapiens
ctaaggaagtgacagtgggatt

SEQ ID NO: 9327064 - DNA, 22 bp, Homo sapiens
ctaaggaaatatgtcacttgct

SEQ ID NO: 9327065 - DNA, 22 bp, Homo sapiens
agtatgcatatttcaaagtaag

SEQ ID NO: 9327066 - DNA, 23 bp, Homo sapiens
agtatgggggatcacgtggccct

SEQ ID NO: 9327067 - DNA, 22 bp, Homo sapiens
ctaaggaattggagcatgtgtt

SEQ ID NO: 9327068 - DNA, 22 bp, Homo sapiens
agtatgtggcacagaatttctt

SEQ ID NO: 9327069 - DNA, 22 bp, Homo sapiens
agtatgtaattttcaatgtgtt

SEQ ID NO: 9327070 - DNA, 22 bp, Homo sapiens
agtatgtaattttcaatgtgtt

SEQ ID NO: 9327071 - DNA, 22 bp, Homo sapiens
agtatgtagtgcaatcagtcag

SEQ ID NO: 9327072 - DNA, 22 bp, Homo sapiens
ctagaacagaaagtacaggaaa

SEQ ID NO: 9327073 - DNA, 22 bp, Homo sapiens
ctagaagcaactagatctgttt

SEQ ID NO: 9327074 - DNA, 22 bp, Homo sapiens
ctagaatactcgtattattccc

SEQ ID NO: 9327075 - DNA, 22 bp, Homo sapiens
ctagaatatcatatgaagagac

SEQ ID NO: 9327076 - DNA, 22 bp, Homo sapiens
agtccaaggttcatggcacaga

SEQ ID NO: 9327077 - DNA, 22 bp, Homo sapiens
agtccaaggttcatggcacaga

SEQ ID NO: 9327078 - DNA, 22 bp, Homo sapiens
agtccaggctcttcctgaagaa

SEQ ID NO: 9327079 - DNA, 22 bp, Homo sapiens
agtccagggagcccaggctttg

SEQ ID NO: 9327080 - DNA, 22 bp, Homo sapiens
agtccagggctctctgtgggat

SEQ ID NO: 9327081 - DNA, 22 bp, Homo sapiens
agtccaggtctctgagtcacaa

SEQ ID NO: 9327082 - DNA, 22 bp, Homo sapiens
agtccagggcttagtcagcggg

SEQ ID NO: 9327083 - DNA, 22 bp, Homo sapiens
agtccataacttcagagtgtca

SEQ ID NO: 9327084 - DNA, 22 bp, Homo sapiens
agtccaggtggaccttggccag

SEQ ID NO: 9327085 - DNA, 22 bp, Homo sapiens
agtccaggtggaccttggccag

SEQ ID NO: 9327086 - DNA, 22 bp, Homo sapiens
ctagtattacatttttgtgtgt

SEQ ID NO: 9327087 - DNA, 22 bp, Homo sapiens
ctaggtggtggtgggttgacat

SEQ ID NO: 9327088 - DNA, 22 bp, Homo sapiens
ctaggttaaagcggttttatgt

SEQ ID NO: 9327089 - DNA, 22 bp, Homo sapiens
ctagtaaagctatgattctgcc

SEQ ID NO: 9327090 - DNA, 22 bp, Homo sapiens
agtcccagctactcaagaggct

SEQ ID NO: 9327091 - DNA, 22 bp, Homo sapiens
agtcccagctactcaagaggct

SEQ ID NO: 9327092 - DNA, 22 bp, Homo sapiens
ctagggtcaggggcctgcgtcg

SEQ ID NO: 9327093 - DNA, 22 bp, Homo sapiens
ctagggtcaggggcctgcgtcg

SEQ ID NO: 9327094 - DNA, 22 bp, Homo sapiens
ctagggtgtgcagattttgcct

SEQ ID NO: 9327095 - DNA, 22 bp, Homo sapiens
ctagggtgtgcagattttgcct

SEQ ID NO: 9327096 - DNA, 22 bp, Homo sapiens
agtccatgctgtctacagaatc

SEQ ID NO: 9327097 - DNA, 22 bp, Homo sapiens
agtccatggttgtagttctctc

SEQ ID NO: 9327098 - DNA, 22 bp, Homo sapiens
agtccatggttctgactcatct

SEQ ID NO: 9327099 - DNA, 19 bp, Homo sapiens
agtccatgaatggaggatg

SEQ ID NO: 9327100 - DNA, 18 bp, Homo sapiens
agtccatgcatggctata

SEQ ID NO: 9327101 - DNA, 22 bp, Homo sapiens
cctgccagatcccctgagctga

SEQ ID NO: 9327102 - DNA, 22 bp, Homo sapiens
cctgccagatcccctgagctga

SEQ ID NO: 9327103 - DNA, 23 bp, Homo sapiens
cctgcagctgctggggctccacc

SEQ ID NO: 9327104 - DNA, 22 bp, Homo sapiens
cctgccagagcagcttgtcctc

SEQ ID NO: 9327105 - DNA, 23 bp, Homo sapiens
cctgcagctgctggggctccacc

SEQ ID NO: 9327106 - DNA, 22 bp, Homo sapiens
cctgcagcctcttctgaaaatc

SEQ ID NO: 9327107 - DNA, 23 bp, Homo sapiens
cctgcagctgccacgccctgctc

SEQ ID NO: 9327108 - DNA, 23 bp, Homo sapiens
cctgcagctgctggggctccacc

SEQ ID NO: 9327109 - DNA, 23 bp, Homo sapiens
cctgcagctgccacgccctgctc

SEQ ID NO: 9327110 - DNA, 22 bp, Homo sapiens
cctgccagccagatcactcgcc

SEQ ID NO: 9327111 - DNA, 22 bp, Homo sapiens
cctgccagcatcttcagcccct

SEQ ID NO: 9327112 - DNA, 22 bp, Homo sapiens
cctgccagcatcttcagcccct

SEQ ID NO: 9327113 - DNA, 22 bp, Homo sapiens
cctgccagatcccctgagctga

SEQ ID NO: 9327114 - DNA, 22 bp, Homo sapiens
cctgccagcccgcgttcatgcc

SEQ ID NO: 9327115 - DNA, 22 bp, Homo sapiens
cctgccagccagatcactcgcc

SEQ ID NO: 9327116 - DNA, 22 bp, Homo sapiens
cctgccagcccccatagagaca

SEQ ID NO: 9327117 - DNA, 22 bp, Homo sapiens
cctgccagcccccatagagaca

SEQ ID NO: 9327118 - DNA, 22 bp, Homo sapiens
cctgcagagcaggagaggcatc

SEQ ID NO: 9327119 - DNA, 22 bp, Homo sapiens
cctgcagagcaggagaggcatc

SEQ ID NO: 9327120 - DNA, 22 bp, Homo sapiens
cctgcagagcaggagaggcatc

SEQ ID NO: 9327121 - DNA, 22 bp, Homo sapiens
cctgcagagccacgtgccagcg

SEQ ID NO: 9327122 - DNA, 22 bp, Homo sapiens
cctgcagagggactggcaggaa

SEQ ID NO: 9327123 - DNA, 22 bp, Homo sapiens
cctgcagatgtgggacagctgt

SEQ ID NO: 9327124 - DNA, 22 bp, Homo sapiens
cctgcagatgtgggacagctgt

SEQ ID NO: 9327125 - DNA, 21 bp, Homo sapiens
cctgccaggaaactgagtgtc

SEQ ID NO: 9327126 - DNA, 21 bp, Homo sapiens
cctgccaggaaactgagtgtc

SEQ ID NO: 9327127 - DNA, 21 bp, Homo sapiens
cctgccaggaaactgagtgtc

SEQ ID NO: 9327128 - DNA, 22 bp, Homo sapiens
cctgccagctgtgggccagcct

SEQ ID NO: 9327129 - DNA, 22 bp, Homo sapiens
cctgccagctgtgggccagcct

SEQ ID NO: 9327130 - DNA, 22 bp, Homo sapiens
cctgccagcgcttatctctcgg

SEQ ID NO: 9327131 - DNA, 22 bp, Homo sapiens
cctgccagcgcttatctctcgg

SEQ ID NO: 9327132 - DNA, 22 bp, Homo sapiens
cctgccagctgtgggccagcct

SEQ ID NO: 9327133 - DNA, 22 bp, Homo sapiens
cctgccagctgtgggccagcct

SEQ ID NO: 9327134 - DNA, 22 bp, Homo sapiens
aggtacagcaatataagaggtc

SEQ ID NO: 9327135 - DNA, 22 bp, Homo sapiens
aggtagggaagaaggcatgaaa

SEQ ID NO: 9327136 - DNA, 22 bp, Homo sapiens
aggtagggaagaaggcatgaaa

SEQ ID NO: 9327137 - DNA, 22 bp, Homo sapiens
aggtaggcctgaaagtgacagc

SEQ ID NO: 9327138 - DNA, 22 bp, Homo sapiens
aggtagggaagaaggcatgaaa

SEQ ID NO: 9327139 - DNA, 19 bp, Homo sapiens
aggtaggcagtggcatgga

SEQ ID NO: 9327140 - DNA, 23 bp, Homo sapiens
aggtaggttattgctgctacctg

SEQ ID NO: 9327141 - DNA, 22 bp, Homo sapiens
aggtagggttaatggagatata

SEQ ID NO: 9327142 - DNA, 22 bp, Homo sapiens
aggtagggttaatggagatata

SEQ ID NO: 9327143 - DNA, 22 bp, Homo sapiens
aggtagggggtttgggaactgc

SEQ ID NO: 9327144 - DNA, 22 bp, Homo sapiens
aggtagggggtttgggaactgc

SEQ ID NO: 9327145 - DNA, 22 bp, Homo sapiens
aggtagggctaggctgcgtctg

SEQ ID NO: 9327146 - DNA, 22 bp, Homo sapiens
cctggctctgaggtatgcctgg

SEQ ID NO: 9327147 - DNA, 22 bp, Homo sapiens
cctggctctgcagccactccag

SEQ ID NO: 9327148 - DNA, 22 bp, Homo sapiens
aggtcctctgtgcctgctggcg

SEQ ID NO: 9327149 - DNA, 21 bp, Homo sapiens
aggtcctctatccaagttaag

SEQ ID NO: 9327150 - DNA, 22 bp, Homo sapiens
aggtcctgagggttcgtctgca

SEQ ID NO: 9327151 - DNA, 22 bp, Homo sapiens
aggtcctgagggttcgtctgca

SEQ ID NO: 9327152 - DNA, 22 bp, Homo sapiens
aggtccagttttctgacaaggg

SEQ ID NO: 9327153 - DNA, 22 bp, Homo sapiens
aggtcccaggcatagctggtct

SEQ ID NO: 9327154 - DNA, 22 bp, Homo sapiens
aggtccagttttcagttctcat

SEQ ID NO: 9327155 - DNA, 22 bp, Homo sapiens
aggtcatgatccattggtgagt

SEQ ID NO: 9327156 - DNA, 22 bp, Homo sapiens
cctggcaacatttcaaggtctt

SEQ ID NO: 9327157 - DNA, 22 bp, Homo sapiens
cctggcacaagagcagcattgg

SEQ ID NO: 9327158 - DNA, 23 bp, Homo sapiens
cctggcacacagttgacatggaa

SEQ ID NO: 9327159 - DNA, 22 bp, Homo sapiens
cctggaggtggaggttgcagtg

SEQ ID NO: 9327160 - DNA, 23 bp, Homo sapiens
aggtaggttattgctgctacctg

SEQ ID NO: 9327161 - DNA, 22 bp, Homo sapiens
aggtagtattcatgattaaatt

SEQ ID NO: 9327162 - DNA, 19 bp, Homo sapiens
cctggagtcgcgctgcctc

SEQ ID NO: 9327163 - DNA, 22 bp, Homo sapiens
cctggagtctgtgactttcctc

SEQ ID NO: 9327164 - DNA, 22 bp, Homo sapiens
cctggagtgacaggtgtagcct

SEQ ID NO: 9327165 - DNA, 23 bp, Homo sapiens
cctggagtactaaggggatggaa

SEQ ID NO: 9327166 - DNA, 22 bp, Homo sapiens
cctggagtaccgtggccatcca

SEQ ID NO: 9327167 - DNA, 22 bp, Homo sapiens
cctggagttgaaggaaggtggg

SEQ ID NO: 9327168 - DNA, 22 bp, Homo sapiens
cctggagttgaaggaaggtggg

SEQ ID NO: 9327169 - DNA, 22 bp, Homo sapiens
cctggagtgacaggtgtagcct

SEQ ID NO: 9327170 - DNA, 22 bp, Homo sapiens
cctggagtgacaggtgtagcct

SEQ ID NO: 9327171 - DNA, 18 bp, Homo sapiens
cctggagtgtgttaggct

SEQ ID NO: 9327172 - DNA, 22 bp, Homo sapiens
cctggagtggggtccgtgcatg

SEQ ID NO: 9327173 - DNA, 22 bp, Homo sapiens
cctggatgatccatgtcatgga

SEQ ID NO: 9327174 - DNA, 22 bp, Homo sapiens
cctggagttttttggttgactc

SEQ ID NO: 9327175 - DNA, 22 bp, Homo sapiens
cctgggctcaagtgatggtccc

SEQ ID NO: 9327176 - DNA, 22 bp, Homo sapiens
cctgggctcaagtgatggtccc

SEQ ID NO: 9327177 - DNA, 22 bp, Homo sapiens
cctgggctcaagtgatggtccc

SEQ ID NO: 9327178 - DNA, 22 bp, Homo sapiens
cctgggctcacagccaaggctc

SEQ ID NO: 9327179 - DNA, 22 bp, Homo sapiens
cctgggctcacagccaaggctc

SEQ ID NO: 9327180 - DNA, 22 bp, Homo sapiens
cctgggctcacagccaaggctc

SEQ ID NO: 9327181 - DNA, 22 bp, Homo sapiens
cctgggctcaggcttgggcagc

SEQ ID NO: 9327182 - DNA, 22 bp, Homo sapiens
cctgggctcaccatgccttgga

SEQ ID NO: 9327183 - DNA, 22 bp, Homo sapiens
cctgggctcaggcttgggcagc

SEQ ID NO: 9327184 - DNA, 20 bp, Homo sapiens
cctgggctccaggagccccg

SEQ ID NO: 9327185 - DNA, 22 bp, Homo sapiens
cctgggctccactccaagagca

SEQ ID NO: 9327186 - DNA, 22 bp, Homo sapiens
cctggctctgggatcttcgctt

SEQ ID NO: 9327187 - DNA, 22 bp, Homo sapiens
cctggctctggtgaggagaagt

SEQ ID NO: 9327188 - DNA, 22 bp, Homo sapiens
cctggctctgcgtgcagctccg

SEQ ID NO: 9327189 - DNA, 22 bp, Homo sapiens
cctggctctgggatcttcgctt

SEQ ID NO: 9327190 - DNA, 22 bp, Homo sapiens
cctgggcataaatcactccaag

SEQ ID NO: 9327191 - DNA, 22 bp, Homo sapiens
cctgggcataaatcactccaag

SEQ ID NO: 9327192 - DNA, 22 bp, Homo sapiens
cctgggcataaatcactccaag

SEQ ID NO: 9327193 - DNA, 22 bp, Homo sapiens
cctgggctcaagtgatcctcct

SEQ ID NO: 9327194 - DNA, 22 bp, Homo sapiens
cctgggctcaagtgatggtccc

SEQ ID NO: 9327195 - DNA, 22 bp, Homo sapiens
cctgggctcaagtgatcctcct

SEQ ID NO: 9327196 - DNA, 22 bp, Homo sapiens
cctggctctggttccctcagct

SEQ ID NO: 9327197 - DNA, 22 bp, Homo sapiens
cctggctctggttccctcagct

SEQ ID NO: 9327198 - DNA, 22 bp, Homo sapiens
cctgggctttgagggcaggatg

SEQ ID NO: 9327199 - DNA, 22 bp, Homo sapiens
cctgggctttcggcggcttcct

SEQ ID NO: 9327200 - DNA, 22 bp, Homo sapiens
cctgggctttcaaaaccagcct

SEQ ID NO: 9327201 - DNA, 22 bp, Homo sapiens
cctggtgccggtagacgcgcag

SEQ ID NO: 9327202 - DNA, 22 bp, Homo sapiens
cctgtcagttgctgtcagggat

SEQ ID NO: 9327203 - DNA, 22 bp, Homo sapiens
cctgtcagggtttgcctcagaa

SEQ ID NO: 9327204 - DNA, 22 bp, Homo sapiens
cctgtcagttgctgtcagggat

SEQ ID NO: 9327205 - DNA, 22 bp, Homo sapiens
cctgggcttggttgttgagaac

SEQ ID NO: 9327206 - DNA, 22 bp, Homo sapiens
cctgggcttgcatctgtgctgg

SEQ ID NO: 9327207 - DNA, 22 bp, Homo sapiens
cctgggcttggttgttgagaac

SEQ ID NO: 9327208 - DNA, 22 bp, Homo sapiens
cctgggcttgcatctgtgctgg

SEQ ID NO: 9327209 - DNA, 22 bp, Homo sapiens
cctgggcttgcatctgtgctgg

SEQ ID NO: 9327210 - DNA, 22 bp, Homo sapiens
cctgggcttctgtctagatgtt

SEQ ID NO: 9327211 - DNA, 22 bp, Homo sapiens
cctgggcttctgtctagatgtt

SEQ ID NO: 9327212 - DNA, 20 bp, Homo sapiens
cctgggctccaggagccccg

SEQ ID NO: 9327213 - DNA, 20 bp, Homo sapiens
cctgggctccaggagccccg

SEQ ID NO: 9327214 - DNA, 20 bp, Homo sapiens
cctgggctccaggagccccg

SEQ ID NO: 9327215 - DNA, 20 bp, Homo sapiens
cctgggctccaggagccccg

SEQ ID NO: 9327216 - DNA, 22 bp, Homo sapiens
cctgggcttctgtctagatgtt

SEQ ID NO: 9327217 - DNA, 22 bp, Homo sapiens
cctgggcttctgtctagatgtt

SEQ ID NO: 9327218 - DNA, 22 bp, Homo sapiens
cctgtgcatccggtggtcattg

SEQ ID NO: 9327219 - DNA, 22 bp, Homo sapiens
cctgtgcaggctccataataga

SEQ ID NO: 9327220 - DNA, 22 bp, Homo sapiens
cctgtgcagcccttgccagttt

SEQ ID NO: 9327221 - DNA, 22 bp, Homo sapiens
cctgtgatccataggcatccag

SEQ ID NO: 9327222 - DNA, 22 bp, Homo sapiens
cctgtgatattgttcataatat

SEQ ID NO: 9327223 - DNA, 20 bp, Homo sapiens
cctgtctcctcttacctggc

SEQ ID NO: 9327224 - DNA, 19 bp, Homo sapiens
cctgtgactatctttgtaa

SEQ ID NO: 9327225 - DNA, 22 bp, Homo sapiens
cctgtgacttggcaaacctcca

SEQ ID NO: 9327226 - DNA, 22 bp, Homo sapiens
cctgtcccctcacaatgccact

SEQ ID NO: 9327227 - DNA, 22 bp, Homo sapiens
cctgtcctccaagagcacatct

SEQ ID NO: 9327228 - DNA, 22 bp, Homo sapiens
cctgtcccaagcagggctggcc

SEQ ID NO: 9327229 - DNA, 22 bp, Homo sapiens
cctgtcccccaggcctgtacca

SEQ ID NO: 9327230 - DNA, 22 bp, Homo sapiens
cctgtcataatgtccgatgtca

SEQ ID NO: 9327231 - DNA, 22 bp, Homo sapiens
cctgtctccctggcatggctca

SEQ ID NO: 9327232 - DNA, 20 bp, Homo sapiens
cctgtctcacgttccgcccc

SEQ ID NO: 9327233 - DNA, 20 bp, Homo sapiens
cctgtctcacgttccgcccc

SEQ ID NO: 9327234 - DNA, 22 bp, Homo sapiens
cctgtcctccggagcgggctgt

SEQ ID NO: 9327235 - DNA, 22 bp, Homo sapiens
aggtggggaggagtgtctcttt

SEQ ID NO: 9327236 - DNA, 22 bp, Homo sapiens
aggtgggcacagatggagaagt

SEQ ID NO: 9327237 - DNA, 22 bp, Homo sapiens
cctgtgccaaaaggctgcttat

SEQ ID NO: 9327238 - DNA, 22 bp, Homo sapiens
cctgtgcattgaccacactctc

SEQ ID NO: 9327239 - DNA, 22 bp, Homo sapiens
cctgtgcatgccagggtacacc

SEQ ID NO: 9327240 - DNA, 22 bp, Homo sapiens
cctgtgcatgccagggtacacc

SEQ ID NO: 9327241 - DNA, 22 bp, Homo sapiens
cctgtgcatgccagggtacacc

SEQ ID NO: 9327242 - DNA, 22 bp, Homo sapiens
cctgtgccagccccttctgctg

SEQ ID NO: 9327243 - DNA, 22 bp, Homo sapiens
aggtggggcccaccaatttgca

SEQ ID NO: 9327244 - DNA, 21 bp, Homo sapiens
aggtggggctgcacctctgct

SEQ ID NO: 9327245 - DNA, 21 bp, Homo sapiens
aggtggggctgcacctctgct

SEQ ID NO: 9327246 - DNA, 22 bp, Homo sapiens
aggtggggagtatatgtaattg

SEQ ID NO: 9327247 - DNA, 22 bp, Homo sapiens
aggtggggccaaatgctacagt

SEQ ID NO: 9327248 - DNA, 22 bp, Homo sapiens
aggtggggccaaatgctacagt

SEQ ID NO: 9327249 - DNA, 22 bp, Homo sapiens
ctgagaaaccaggtgctctgat

SEQ ID NO: 9327250 - DNA, 22 bp, Homo sapiens
ctgagaaacatatttccatcta

SEQ ID NO: 9327251 - DNA, 22 bp, Homo sapiens
agttagaaagtaaatcatttga

SEQ ID NO: 9327252 - DNA, 22 bp, Homo sapiens
agttactcactgagggtttatt

SEQ ID NO: 9327253 - DNA, 22 bp, Homo sapiens
agttagaatagtcagattgtag

SEQ ID NO: 9327254 - DNA, 22 bp, Homo sapiens
agttagaatagtcagattgtag

SEQ ID NO: 9327255 - DNA, 18 bp, Homo sapiens
agttagaaatgaaggcca

SEQ ID NO: 9327256 - DNA, 22 bp, Homo sapiens
agttataatctgctactgatat

SEQ ID NO: 9327257 - DNA, 22 bp, Homo sapiens
agttatataactatctagatgc

SEQ ID NO: 9327258 - DNA, 22 bp, Homo sapiens
agttagtggcaaagtggtttga

SEQ ID NO: 9327259 - DNA, 22 bp, Homo sapiens
agttagttttgtaattccaccc

SEQ ID NO: 9327260 - DNA, 22 bp, Homo sapiens
ctgagctgggactcagtagcaa

SEQ ID NO: 9327261 - DNA, 22 bp, Homo sapiens
ctgagcagccccaccagccatt

SEQ ID NO: 9327262 - DNA, 22 bp, Homo sapiens
ctgagcagcagggagactggtg

SEQ ID NO: 9327263 - DNA, 22 bp, Homo sapiens
ctgaggagaacaatgagatcaa

SEQ ID NO: 9327264 - DNA, 22 bp, Homo sapiens
ctgaggagagatcacgtggtgt

SEQ ID NO: 9327265 - DNA, 22 bp, Homo sapiens
ctgaggagaggtggcctgtgtt

SEQ ID NO: 9327266 - DNA, 22 bp, Homo sapiens
ctgagcagcaacccagagcctc

SEQ ID NO: 9327267 - DNA, 22 bp, Homo sapiens
ctgagcagcaattgctggccca

SEQ ID NO: 9327268 - DNA, 22 bp, Homo sapiens
ctgagcagcaattgctggccca

SEQ ID NO: 9327269 - DNA, 22 bp, Homo sapiens
ctgagcagcaattgctggccca

SEQ ID NO: 9327270 - DNA, 22 bp, Homo sapiens
ctgagcagcacagggcgccagg

SEQ ID NO: 9327271 - DNA, 22 bp, Homo sapiens
ctgagcagcaccttcaagaaac

SEQ ID NO: 9327272 - DNA, 22 bp, Homo sapiens
ctgagcagcagggagactggtg

SEQ ID NO: 9327273 - DNA, 22 bp, Homo sapiens
ctgagcagcacagggcgccagg

SEQ ID NO: 9327274 - DNA, 22 bp, Homo sapiens
ctgagcagcaacccagagcctc

SEQ ID NO: 9327275 - DNA, 22 bp, Homo sapiens
ctgagcagcaacccagagcctc

SEQ ID NO: 9327276 - DNA, 22 bp, Homo sapiens
ctgagcagatgttgcccagaag

SEQ ID NO: 9327277 - DNA, 22 bp, Homo sapiens
ctgagcagatgaccagccccag

SEQ ID NO: 9327278 - DNA, 22 bp, Homo sapiens
ctgagcagatgttgcccagaag

SEQ ID NO: 9327279 - DNA, 22 bp, Homo sapiens
ctgagcagcaacccagagcctc

SEQ ID NO: 9327280 - DNA, 22 bp, Homo sapiens
agttatataactatctagatgc

SEQ ID NO: 9327281 - DNA, 19 bp, Homo sapiens
ctgagcagagggaggaact

SEQ ID NO: 9327282 - DNA, 22 bp, Homo sapiens
ctgagcagatgaccagccccag

SEQ ID NO: 9327283 - DNA, 22 bp, Homo sapiens
ctgagcagatgaccagccccag

SEQ ID NO: 9327284 - DNA, 22 bp, Homo sapiens
ctgaatgagggattctgagggc

SEQ ID NO: 9327285 - DNA, 22 bp, Homo sapiens
ctgaatgagggattctgagggc

SEQ ID NO: 9327286 - DNA, 22 bp, Homo sapiens
ctgaatgaaatcaaggactgag

SEQ ID NO: 9327287 - DNA, 22 bp, Homo sapiens
ctgaatccacacaaggtgatgg

SEQ ID NO: 9327288 - DNA, 20 bp, Homo sapiens
agtgtctgggcctcaggccc

SEQ ID NO: 9327289 - DNA, 18 bp, Homo sapiens
agtgtctggatatttggg

SEQ ID NO: 9327290 - DNA, 22 bp, Homo sapiens
agtgtctgcttatcagttcttg

SEQ ID NO: 9327291 - DNA, 22 bp, Homo sapiens
agtgtctgctttgagtcaggtg

SEQ ID NO: 9327292 - DNA, 22 bp, Homo sapiens
agtgtctgctttgagtcaggtg

SEQ ID NO: 9327293 - DNA, 22 bp, Homo sapiens
agtgtctgctttgagtcaggtg

SEQ ID NO: 9327294 - DNA, 22 bp, Homo sapiens
agtgtctgctaggttcatcaac

SEQ ID NO: 9327295 - DNA, 22 bp, Homo sapiens
agtgtctgcgggcagaggagcg

SEQ ID NO: 9327296 - DNA, 22 bp, Homo sapiens
ctgaattaatacacagaatggc

SEQ ID NO: 9327297 - DNA, 20 bp, Homo sapiens
ctgacagaaaatatttcatc

SEQ ID NO: 9327298 - DNA, 22 bp, Homo sapiens
ctgagaaaagtatgagctctgg

SEQ ID NO: 9327299 - DNA, 22 bp, Homo sapiens
ctgagaaaagtatgagctctgg

SEQ ID NO: 9327300 - DNA, 22 bp, Homo sapiens
ctgagaaaatttcaggaagtgt

SEQ ID NO: 9327301 - DNA, 22 bp, Homo sapiens
ctgagaaaagctttcttataca

SEQ ID NO: 9327302 - DNA, 22 bp, Homo sapiens
ctgagaaaagctttcttataca

SEQ ID NO: 9327303 - DNA, 22 bp, Homo sapiens
ctctggggaaatggatatgtac

SEQ ID NO: 9327304 - DNA, 22 bp, Homo sapiens
ctctggggaagcagccagctgg

SEQ ID NO: 9327305 - DNA, 22 bp, Homo sapiens
ctctggggttaagcttccatgg

SEQ ID NO: 9327306 - DNA, 22 bp, Homo sapiens
ctctggggttaagcttccatgg

SEQ ID NO: 9327307 - DNA, 22 bp, Homo sapiens
ctctggggtggaggaggctgac

SEQ ID NO: 9327308 - DNA, 22 bp, Homo sapiens
ctctggggtggaggaggctgac

SEQ ID NO: 9327309 - DNA, 22 bp, Homo sapiens
ctgaaataaagttgctaaaatt

SEQ ID NO: 9327310 - DNA, 23 bp, Homo sapiens
ctgaaataccagaaaatcagtgt

SEQ ID NO: 9327311 - DNA, 22 bp, Homo sapiens
ctgaaagggttacatagtaagt

SEQ ID NO: 9327312 - DNA, 22 bp, Homo sapiens
ctgaaaggtataaataagactt

SEQ ID NO: 9327313 - DNA, 22 bp, Homo sapiens
ctgaaaggcagtgggtagtgtg

SEQ ID NO: 9327314 - DNA, 22 bp, Homo sapiens
ctgaaagggagaacaccaagag

SEQ ID NO: 9327315 - DNA, 17 bp, Homo sapiens
ctgaaatattatgataa

SEQ ID NO: 9327316 - DNA, 22 bp, Homo sapiens
ctgaaatagtttcatagaactt

SEQ ID NO: 9327317 - DNA, 21 bp, Homo sapiens
ctctgggacatttcttagcag

SEQ ID NO: 9327318 - DNA, 22 bp, Homo sapiens
ctctgggacatcccttggccta

SEQ ID NO: 9327319 - DNA, 22 bp, Homo sapiens
ctctgggaattctgagcaagca

SEQ ID NO: 9327320 - DNA, 22 bp, Homo sapiens
ctctgggacatcccttggccta

SEQ ID NO: 9327321 - DNA, 22 bp, Homo sapiens
ctctgggaccatggcaagtgcg

SEQ ID NO: 9327322 - DNA, 22 bp, Homo sapiens
ctctgggaccatggcaagtgcg

SEQ ID NO: 9327323 - DNA, 22 bp, Homo sapiens
ctctgggagaggacacttggag

SEQ ID NO: 9327324 - DNA, 22 bp, Homo sapiens
ctctgggaaagattgtgcaggc

SEQ ID NO: 9327325 - DNA, 22 bp, Homo sapiens
ctctgggaaagattgtgcaggc

SEQ ID NO: 9327326 - DNA, 22 bp, Homo sapiens
ctctgggaaagattgtgcaggc

SEQ ID NO: 9327327 - DNA, 22 bp, Homo sapiens
ctctgggaaagattgtgcaggc

SEQ ID NO: 9327328 - DNA, 22 bp, Homo sapiens
ctctgggaagggctgagcactg

SEQ ID NO: 9327329 - DNA, 22 bp, Homo sapiens
ctctgggaagtggagacttcag

SEQ ID NO: 9327330 - DNA, 22 bp, Homo sapiens
ctctggctttcccagggaggag

SEQ ID NO: 9327331 - DNA, 22 bp, Homo sapiens
ctctggctttaaggatgccaca

SEQ ID NO: 9327332 - DNA, 19 bp, Homo sapiens
ctctgcatatgtgaggata

SEQ ID NO: 9327333 - DNA, 22 bp, Homo sapiens
ctctgcagtgtaacagcgcttg

SEQ ID NO: 9327334 - DNA, 22 bp, Homo sapiens
ctctgcagtgtaacagcgcttg

SEQ ID NO: 9327335 - DNA, 22 bp, Homo sapiens
ctctgcatgccacatgagtgac

SEQ ID NO: 9327336 - DNA, 22 bp, Homo sapiens
ctctgcatgccttgctcagaca

SEQ ID NO: 9327337 - DNA, 22 bp, Homo sapiens
ctctgcctgtctcatcctgcaa

SEQ ID NO: 9327338 - DNA, 22 bp, Homo sapiens
ctctgcctgtctcatcctgcaa

SEQ ID NO: 9327339 - DNA, 22 bp, Homo sapiens
ctctgcctgcccaccgacccat

SEQ ID NO: 9327340 - DNA, 22 bp, Homo sapiens
ctctgcctgcccaccgacccat

SEQ ID NO: 9327341 - DNA, 22 bp, Homo sapiens
ctctgcctgcccaccgacccat

SEQ ID NO: 9327342 - DNA, 22 bp, Homo sapiens
ctctgcctgtgtcgccaccaca

SEQ ID NO: 9327343 - DNA, 22 bp, Homo sapiens
ctctgcctgtgtcgccaccaca

SEQ ID NO: 9327344 - DNA, 22 bp, Homo sapiens
ctctgcctgtgtcgccaccaca

SEQ ID NO: 9327345 - DNA, 22 bp, Homo sapiens
ctctgcctgtgtcgccaccaca

SEQ ID NO: 9327346 - DNA, 22 bp, Homo sapiens
ctctgctcaccagccatgtgat

SEQ ID NO: 9327347 - DNA, 22 bp, Homo sapiens
ctctgctagggctgaggtgttc

SEQ ID NO: 9327348 - DNA, 22 bp, Homo sapiens
ctctgctcaccagccatgtgat

SEQ ID NO: 9327349 - DNA, 22 bp, Homo sapiens
ctctgctagggctgaggtgttc

SEQ ID NO: 9327350 - DNA, 22 bp, Homo sapiens
ctctgcctgtgtcgccaccaca

SEQ ID NO: 9327351 - DNA, 22 bp, Homo sapiens
ctctggcttctaccttgcagtt

SEQ ID NO: 9327352 - DNA, 22 bp, Homo sapiens
ctctggatctgccctgacgcca

SEQ ID NO: 9327353 - DNA, 23 bp, Homo sapiens
ctctggatcctgtagctcctggc

SEQ ID NO: 9327354 - DNA, 22 bp, Homo sapiens
ctctggatctgccctgacgcca

SEQ ID NO: 9327355 - DNA, 22 bp, Homo sapiens
ctctggatgaggtcctgtctgt

SEQ ID NO: 9327356 - DNA, 22 bp, Homo sapiens
ctctggatatgcactgggtgag

SEQ ID NO: 9327357 - DNA, 19 bp, Homo sapiens
ctctcagcctgtctccttg

SEQ ID NO: 9327358 - DNA, 22 bp, Homo sapiens
ctctgagcccgctgcagcccca

SEQ ID NO: 9327359 - DNA, 22 bp, Homo sapiens
ctctgcaggcctgtgaagggtg

SEQ ID NO: 9327360 - DNA, 22 bp, Homo sapiens
ctctgcaggcctgtgaagggtg

SEQ ID NO: 9327361 - DNA, 22 bp, Homo sapiens
ctctgcaggcacccagggtggg

SEQ ID NO: 9327362 - DNA, 22 bp, Homo sapiens
ctctgcaggcacccagggtggg

SEQ ID NO: 9327363 - DNA, 23 bp, Homo sapiens
ctctgcaggagagtgggcagggc

SEQ ID NO: 9327364 - DNA, 23 bp, Homo sapiens
ctctgcaggagagtgggcagggc

SEQ ID NO: 9327365 - DNA, 23 bp, Homo sapiens
ctctgcaggagagtgggcagggc

SEQ ID NO: 9327366 - DNA, 21 bp, Homo sapiens
ctctgcagccctgcttccagg

SEQ ID NO: 9327367 - DNA, 21 bp, Homo sapiens
ctctgcagccctgcttccagg

SEQ ID NO: 9327368 - DNA, 17 bp, Homo sapiens
ctctgcagtgcatggct

SEQ ID NO: 9327369 - DNA, 22 bp, Homo sapiens
ctctgcagtgtaacagcgcttg

SEQ ID NO: 9327370 - DNA, 21 bp, Homo sapiens
ctctgcagtgcccaccttgcc

SEQ ID NO: 9327371 - DNA, 22 bp, Homo sapiens
ctctgcaggggaggcatgcact

SEQ ID NO: 9327372 - DNA, 17 bp, Homo sapiens
ctctgcagtgcatggct

SEQ ID NO: 9327373 - DNA, 17 bp, Homo sapiens
ctctgcagtgcatggct

SEQ ID NO: 9327374 - DNA, 22 bp, Homo sapiens
ctctgcaggggaggcatgcact

SEQ ID NO: 9327375 - DNA, 22 bp, Homo sapiens
ctctgcaggggaggcatgcact

SEQ ID NO: 9327376 - DNA, 22 bp, Homo sapiens
ctctgcaggccttgagtgtggt

SEQ ID NO: 9327377 - DNA, 22 bp, Homo sapiens
ctccctcagaggagcacctgtt

SEQ ID NO: 9327378 - DNA, 22 bp, Homo sapiens
ctccctcaccatgacccgctgt

SEQ ID NO: 9327379 - DNA, 22 bp, Homo sapiens
ctccctcacacccttgcccaga

SEQ ID NO: 9327380 - DNA, 18 bp, Homo sapiens
ctccagggaactcagtca

SEQ ID NO: 9327381 - DNA, 22 bp, Homo sapiens
ctcccaggttgattctttccct

SEQ ID NO: 9327382 - DNA, 22 bp, Homo sapiens
ctcccaggttgattctttccct

SEQ ID NO: 9327383 - DNA, 22 bp, Homo sapiens
ctccagggaaaggggcgtccgc

SEQ ID NO: 9327384 - DNA, 20 bp, Homo sapiens
ctccagggaacagactggag

SEQ ID NO: 9327385 - DNA, 18 bp, Homo sapiens
ctccagggaactcagtca

SEQ ID NO: 9327386 - DNA, 18 bp, Homo sapiens
ctccagggaactcagtca

SEQ ID NO: 9327387 - DNA, 20 bp, Homo sapiens
ctccagggaacagactggag

SEQ ID NO: 9327388 - DNA, 22 bp, Homo sapiens
ctccctccctacgtgagctcac

SEQ ID NO: 9327389 - DNA, 22 bp, Homo sapiens
ctccctcctcaaatatctttgt

SEQ ID NO: 9327390 - DNA, 22 bp, Homo sapiens
ctccctccctacgtgagctcac

SEQ ID NO: 9327391 - DNA, 22 bp, Homo sapiens
ctccctccctacgtgagctcac

SEQ ID NO: 9327392 - DNA, 22 bp, Homo sapiens
ctccctccctacgtgagctcac

SEQ ID NO: 9327393 - DNA, 22 bp, Homo sapiens
ctccctccctacgtgagctcac

SEQ ID NO: 9327394 - DNA, 22 bp, Homo sapiens
ctccctctcaccggagccctgg

SEQ ID NO: 9327395 - DNA, 22 bp, Homo sapiens
ctccctcgagaacgcccctctc

SEQ ID NO: 9327396 - DNA, 22 bp, Homo sapiens
ctccctccaaataagactcggg

SEQ ID NO: 9327397 - DNA, 22 bp, Homo sapiens
ctccctccctacgtgagctcac

SEQ ID NO: 9327398 - DNA, 22 bp, Homo sapiens
ctccctccaaataagactcggg

SEQ ID NO: 9327399 - DNA, 22 bp, Homo sapiens
ctccctcaggccttagccctgc

SEQ ID NO: 9327400 - DNA, 22 bp, Homo sapiens
ctccctcatatacccagcgaga

SEQ ID NO: 9327401 - DNA, 22 bp, Homo sapiens
ctccctcaggccttagccctgc

SEQ ID NO: 9327402 - DNA, 22 bp, Homo sapiens
ctccctcaggccttagccctgc

SEQ ID NO: 9327403 - DNA, 22 bp, Homo sapiens
ctcctaggacgccgctgctcct

SEQ ID NO: 9327404 - DNA, 22 bp, Homo sapiens
ctcctcaaggtctcaggaataa

SEQ ID NO: 9327405 - DNA, 22 bp, Homo sapiens
ctcctcagaacagccttggctg

SEQ ID NO: 9327406 - DNA, 22 bp, Homo sapiens
ctcctcactttccagactgggc

SEQ ID NO: 9327407 - DNA, 22 bp, Homo sapiens
ctccgtgctattttagtatcgc

SEQ ID NO: 9327408 - DNA, 22 bp, Homo sapiens
ctccctctgaggctttgagcct

SEQ ID NO: 9327409 - DNA, 22 bp, Homo sapiens
ctccctctctaaggcaaagaga

SEQ ID NO: 9327410 - DNA, 19 bp, Homo sapiens
ctccggccagcaactgcat

SEQ ID NO: 9327411 - DNA, 22 bp, Homo sapiens
ctccggagaggtcggaaaacag

SEQ ID NO: 9327412 - DNA, 22 bp, Homo sapiens
ctccctctgtccgaggccggct

SEQ ID NO: 9327413 - DNA, 22 bp, Homo sapiens
ctcctgccaccgcggtgtcctg

SEQ ID NO: 9327414 - DNA, 22 bp, Homo sapiens
ctcctgccaccgcggtgtcctg

SEQ ID NO: 9327415 - DNA, 22 bp, Homo sapiens
ctcctgcccacgtgctacttct

SEQ ID NO: 9327416 - DNA, 22 bp, Homo sapiens
ctcctcagactttccttgtccg

SEQ ID NO: 9327417 - DNA, 22 bp, Homo sapiens
ctcctcagactttccttgtccg

SEQ ID NO: 9327418 - DNA, 22 bp, Homo sapiens
ctcctcagaagagggtaacaca

SEQ ID NO: 9327419 - DNA, 22 bp, Homo sapiens
ctcctcagaagagggtaacaca

SEQ ID NO: 9327420 - DNA, 22 bp, Homo sapiens
ctcctcagaacagccttggctg

SEQ ID NO: 9327421 - DNA, 22 bp, Homo sapiens
ctcctggctctgccacttacta

SEQ ID NO: 9327422 - DNA, 22 bp, Homo sapiens
ctcctggctctctgtttagtgt

SEQ ID NO: 9327423 - DNA, 22 bp, Homo sapiens
ctcctggctctctgtttagtgt

SEQ ID NO: 9327424 - DNA, 22 bp, Homo sapiens
ctcctggctcgcccccagctga

SEQ ID NO: 9327425 - DNA, 22 bp, Homo sapiens
ctcctggctcgcccccagctga

SEQ ID NO: 9327426 - DNA, 18 bp, Homo sapiens
ctcctggctgatggtgag

SEQ ID NO: 9327427 - DNA, 18 bp, Homo sapiens
ctcctggctgatggtgag

SEQ ID NO: 9327428 - DNA, 19 bp, Homo sapiens
ctcctggctctgtcatttt

SEQ ID NO: 9327429 - DNA, 19 bp, Homo sapiens
ctcctggctctgtcatttt

SEQ ID NO: 9327430 - DNA, 22 bp, Homo sapiens
ctcctggctctgccacttacta

SEQ ID NO: 9327431 - DNA, 22 bp, Homo sapiens
ctcctggctctgccacttacta

SEQ ID NO: 9327432 - DNA, 22 bp, Homo sapiens
ctctcagaagtagcacgtgggc

SEQ ID NO: 9327433 - DNA, 22 bp, Homo sapiens
ctctcagaagtagcacgtgggc

SEQ ID NO: 9327434 - DNA, 19 bp, Homo sapiens
agtggcagatctggaagta

SEQ ID NO: 9327435 - DNA, 22 bp, Homo sapiens
ctctcagcaggaaagcatgcaa

SEQ ID NO: 9327436 - DNA, 22 bp, Homo sapiens
ctctcagcaggaaagcatgcaa

SEQ ID NO: 9327437 - DNA, 22 bp, Homo sapiens
ctctcagcaggaaagcatgcaa

SEQ ID NO: 9327438 - DNA, 22 bp, Homo sapiens
agtggcagatctctggtctgga

SEQ ID NO: 9327439 - DNA, 22 bp, Homo sapiens
agtggcagatctctggtctgga

SEQ ID NO: 9327440 - DNA, 22 bp, Homo sapiens
agtggcagatctctggtctgga

SEQ ID NO: 9327441 - DNA, 22 bp, Homo sapiens
agtggcagagtgcactcaggca

SEQ ID NO: 9327442 - DNA, 19 bp, Homo sapiens
agtggcagatctggaagta

SEQ ID NO: 9327443 - DNA, 19 bp, Homo sapiens
agtggcagatctggaagta

SEQ ID NO: 9327444 - DNA, 19 bp, Homo sapiens
agtggcagatctggaagta

SEQ ID NO: 9327445 - DNA, 22 bp, Homo sapiens
agtggcagatctctggtctgga

SEQ ID NO: 9327446 - DNA, 22 bp, Homo sapiens
agtggcagaagccaagtctgca

SEQ ID NO: 9327447 - DNA, 22 bp, Homo sapiens
agtggcagaagccaagtctgca

SEQ ID NO: 9327448 - DNA, 22 bp, Homo sapiens
agtggcagaagccaagtctgca

SEQ ID NO: 9327449 - DNA, 22 bp, Homo sapiens
agtggcagaagccaagtctgca

SEQ ID NO: 9327450 - DNA, 22 bp, Homo sapiens
agtggcagaggttgactgcagt

SEQ ID NO: 9327451 - DNA, 22 bp, Homo sapiens
ctcctgggtcattgccagcaaa

SEQ ID NO: 9327452 - DNA, 22 bp, Homo sapiens
ctcctgggtcattgccagcaaa

SEQ ID NO: 9327453 - DNA, 22 bp, Homo sapiens
agtggcagagtgcactcaggca

SEQ ID NO: 9327454 - DNA, 22 bp, Homo sapiens
agtggcagagtcagggtttgga

SEQ ID NO: 9327455 - DNA, 22 bp, Homo sapiens
agtggcagagtgcactcaggca

SEQ ID NO: 9327456 - DNA, 22 bp, Homo sapiens
agtggcagagtgcactcaggca

SEQ ID NO: 9327457 - DNA, 22 bp, Homo sapiens
agtggcagaggttgactgcagt

SEQ ID NO: 9327458 - DNA, 22 bp, Homo sapiens
agtggcagaggttgactgcagt

SEQ ID NO: 9327459 - DNA, 22 bp, Homo sapiens
ctcctgggtcattgccagcaaa

SEQ ID NO: 9327460 - DNA, 22 bp, Homo sapiens
ctcctgggtcattgccagcaaa

SEQ ID NO: 9327461 - DNA, 22 bp, Homo sapiens
ctcctgggggacagcggcaggg

SEQ ID NO: 9327462 - DNA, 22 bp, Homo sapiens
ctcctgggggacagcggcaggg

SEQ ID NO: 9327463 - DNA, 22 bp, Homo sapiens
ctcctgggggacagcggcaggg

SEQ ID NO: 9327464 - DNA, 22 bp, Homo sapiens
ctcctggggccatggaaggaac

SEQ ID NO: 9327465 - DNA, 22 bp, Homo sapiens
ctcctgggggacagcggcaggg

SEQ ID NO: 9327466 - DNA, 22 bp, Homo sapiens
ctcctggggcacttagaagcaa

SEQ ID NO: 9327467 - DNA, 22 bp, Homo sapiens
ctcctggggccatggaaggaac

SEQ ID NO: 9327468 - DNA, 22 bp, Homo sapiens
ctcctggggcacttagaagcaa

SEQ ID NO: 9327469 - DNA, 22 bp, Homo sapiens
ctcctgggagcagggatggatg

SEQ ID NO: 9327470 - DNA, 20 bp, Homo sapiens
ctcctgggactgctggttat

SEQ ID NO: 9327471 - DNA, 20 bp, Homo sapiens
ctcctgggactgctggttat

SEQ ID NO: 9327472 - DNA, 20 bp, Homo sapiens
ctcctgggactgctggttat

SEQ ID NO: 9327473 - DNA, 22 bp, Homo sapiens
ctcctgggaatttagttgtgag

SEQ ID NO: 9327474 - DNA, 22 bp, Homo sapiens
ctcctgggaaatgaaggggcag

SEQ ID NO: 9327475 - DNA, 22 bp, Homo sapiens
ctcctgggaaaggctggacaca

SEQ ID NO: 9327476 - DNA, 22 bp, Homo sapiens
ctcctgggaatttagttgtgag

SEQ ID NO: 9327477 - DNA, 22 bp, Homo sapiens
ctcctgggaaaggctggacaca

SEQ ID NO: 9327478 - DNA, 22 bp, Homo sapiens
ctcctggcttctgaaatcgtgg

SEQ ID NO: 9327479 - DNA, 22 bp, Homo sapiens
ctcctggctttcccagaccagg

SEQ ID NO: 9327480 - DNA, 22 bp, Homo sapiens
ctcctggctttcccagaccagg

SEQ ID NO: 9327481 - DNA, 22 bp, Homo sapiens
ctcctggctttcccagaccagg

SEQ ID NO: 9327482 - DNA, 22 bp, Homo sapiens
ctcctggcttctgaaatcgtgg

SEQ ID NO: 9327483 - DNA, 22 bp, Homo sapiens
agtcctggacttggagtcaggg

SEQ ID NO: 9327484 - DNA, 22 bp, Homo sapiens
agtcctggacttggagtcaggg

SEQ ID NO: 9327485 - DNA, 22 bp, Homo sapiens
agtcctgatgctctggcaggag

SEQ ID NO: 9327486 - DNA, 22 bp, Homo sapiens
agtcctagacttttctgccact

SEQ ID NO: 9327487 - DNA, 22 bp, Homo sapiens
agtcctcccttggggccacctt

SEQ ID NO: 9327488 - DNA, 18 bp, Homo sapiens
agtcctggagatcaccaa

SEQ ID NO: 9327489 - DNA, 22 bp, Homo sapiens
agtcctggcatataggtcctca

SEQ ID NO: 9327490 - DNA, 18 bp, Homo sapiens
agtcctggagatcaccaa

SEQ ID NO: 9327491 - DNA, 22 bp, Homo sapiens
agtcctggcatataggtcctca

SEQ ID NO: 9327492 - DNA, 22 bp, Homo sapiens
agtcctggccccaaggaaggat

SEQ ID NO: 9327493 - DNA, 22 bp, Homo sapiens
agtcctggccccaaggaaggat

SEQ ID NO: 9327494 - DNA, 22 bp, Homo sapiens
agtcctggcatggaattgtccc

SEQ ID NO: 9327495 - DNA, 22 bp, Homo sapiens
agtcctggcatggaattgtccc

SEQ ID NO: 9327496 - DNA, 22 bp, Homo sapiens
agtccgcctgctgccgtggcag

SEQ ID NO: 9327497 - DNA, 20 bp, Homo sapiens
agtccctttggtcaggtatt

SEQ ID NO: 9327498 - DNA, 22 bp, Homo sapiens
agtccctttagtctggagagct

SEQ ID NO: 9327499 - DNA, 22 bp, Homo sapiens
agtccgtcctgtcaagcagctg

SEQ ID NO: 9327500 - DNA, 22 bp, Homo sapiens
agtcccttctcaaagtgtgcgg

SEQ ID NO: 9327501 - DNA, 22 bp, Homo sapiens
agtccctgtactttccactgcc

SEQ ID NO: 9327502 - DNA, 22 bp, Homo sapiens
agtccctgtactttccactgcc

SEQ ID NO: 9327503 - DNA, 21 bp, Homo sapiens
agtcccctgtccttacttcta

SEQ ID NO: 9327504 - DNA, 22 bp, Homo sapiens
agtcccctggcaggagggacgt

SEQ ID NO: 9327505 - DNA, 21 bp, Homo sapiens
agtcccctgtccttacttcta

SEQ ID NO: 9327506 - DNA, 22 bp, Homo sapiens
agtccctgtactttccactgcc

SEQ ID NO: 9327507 - DNA, 22 bp, Homo sapiens
agtccctggattgtctctgtca

SEQ ID NO: 9327508 - DNA, 23 bp, Homo sapiens
agtcccctacatagttcctgggg

SEQ ID NO: 9327509 - DNA, 23 bp, Homo sapiens
agtcccctacatagttcctgggg

SEQ ID NO: 9327510 - DNA, 23 bp, Homo sapiens
agtcccctacatagttcctgggg

SEQ ID NO: 9327511 - DNA, 22 bp, Homo sapiens
agtcccctctaacccaacttta

SEQ ID NO: 9327512 - DNA, 22 bp, Homo sapiens
agtcccctggcaggagggacgt

SEQ ID NO: 9327513 - DNA, 22 bp, Homo sapiens
agtcccctctcgcttggctgag

SEQ ID NO: 9327514 - DNA, 22 bp, Homo sapiens
agtcccctctcgcttggctgag

SEQ ID NO: 9327515 - DNA, 22 bp, Homo sapiens
agtcccctctaacccaacttta

SEQ ID NO: 9327516 - DNA, 22 bp, Homo sapiens
agtcccctctaacccaacttta

SEQ ID NO: 9327517 - DNA, 22 bp, Homo sapiens
agtcccctctcgcttggctgag

SEQ ID NO: 9327518 - DNA, 22 bp, Homo sapiens
agtcctgggtccagcaggtcct

SEQ ID NO: 9327519 - DNA, 22 bp, Homo sapiens
ctcagtgttaaatataaggtat

SEQ ID NO: 9327520 - DNA, 22 bp, Homo sapiens
agtcctgggtccagcaggtcct

SEQ ID NO: 9327521 - DNA, 22 bp, Homo sapiens
ctcatgcccagagccactgttg

SEQ ID NO: 9327522 - DNA, 22 bp, Homo sapiens
agtcctggccccaaggaaggat

SEQ ID NO: 9327523 - DNA, 19 bp, Homo sapiens
agtcctggcctgggggacc

SEQ ID NO: 9327524 - DNA, 19 bp, Homo sapiens
agtcctggcctgggggacc

SEQ ID NO: 9327525 - DNA, 18 bp, Homo sapiens
agtcctggctctaccacc

SEQ ID NO: 9327526 - DNA, 18 bp, Homo sapiens
agtcctggctctaccacc

SEQ ID NO: 9327527 - DNA, 22 bp, Homo sapiens
agtcctggctctacgggcttca

SEQ ID NO: 9327528 - DNA, 22 bp, Homo sapiens
agtcctggctctacgggcttca

SEQ ID NO: 9327529 - DNA, 22 bp, Homo sapiens
ctcattgcccagatccccacag

SEQ ID NO: 9327530 - DNA, 22 bp, Homo sapiens
ctcattgcaacctccgcctccc

SEQ ID NO: 9327531 - DNA, 22 bp, Homo sapiens
ctcattgcaacctccgcctccc

SEQ ID NO: 9327532 - DNA, 22 bp, Homo sapiens
ctcatgtcaggggtgtcaatgt

SEQ ID NO: 9327533 - DNA, 22 bp, Homo sapiens
ctccagctttagctctccaggg

SEQ ID NO: 9327534 - DNA, 22 bp, Homo sapiens
ctccaggaaaatagggaatgag

SEQ ID NO: 9327535 - DNA, 22 bp, Homo sapiens
ctccagctttttcccagttggc

SEQ ID NO: 9327536 - DNA, 22 bp, Homo sapiens
ctccagctttttcccagttggc

SEQ ID NO: 9327537 - DNA, 22 bp, Homo sapiens
ctccaggaaagcctgaggcccg

SEQ ID NO: 9327538 - DNA, 22 bp, Homo sapiens
ctccaggaaaatagggaatgag

SEQ ID NO: 9327539 - DNA, 22 bp, Homo sapiens
ctccagcttctgcccagagact

SEQ ID NO: 9327540 - DNA, 22 bp, Homo sapiens
ctccagctgctggtctgagact

SEQ ID NO: 9327541 - DNA, 22 bp, Homo sapiens
ctccagctgctggtctgagact

SEQ ID NO: 9327542 - DNA, 22 bp, Homo sapiens
ctccaggctggatccaagtcaa

SEQ ID NO: 9327543 - DNA, 22 bp, Homo sapiens
ctccaggctggatccaagtcaa

SEQ ID NO: 9327544 - DNA, 22 bp, Homo sapiens
ctccaggctggggtgcaggttg

SEQ ID NO: 9327545 - DNA, 22 bp, Homo sapiens
ctccaggctggggtgcaggttg

SEQ ID NO: 9327546 - DNA, 22 bp, Homo sapiens
ctccaggcttcaagggccggcc

SEQ ID NO: 9327547 - DNA, 22 bp, Homo sapiens
ctccagggaaaggggcgtccgc

SEQ ID NO: 9327548 - DNA, 22 bp, Homo sapiens
ctccagggaaaggggcgtccgc

SEQ ID NO: 9327549 - DNA, 22 bp, Homo sapiens
ctccaggacactaacccaggct

SEQ ID NO: 9327550 - DNA, 22 bp, Homo sapiens
ctccaggctcgtccaagatcga

SEQ ID NO: 9327551 - DNA, 22 bp, Homo sapiens
ctccaggctggatccaagtcaa

SEQ ID NO: 9327552 - DNA, 22 bp, Homo sapiens
ctccagcctcatctcctggctg

SEQ ID NO: 9327553 - DNA, 22 bp, Homo sapiens
ctccagagagtccagctctggg

SEQ ID NO: 9327554 - DNA, 22 bp, Homo sapiens
ctccagctcgcgagctctgctc

SEQ ID NO: 9327555 - DNA, 22 bp, Homo sapiens
ctccagctcttaactgcggaag

SEQ ID NO: 9327556 - DNA, 22 bp, Homo sapiens
ctccagctgagtaagaacacta

SEQ ID NO: 9327557 - DNA, 22 bp, Homo sapiens
ctccagctcttaactgcggaag

SEQ ID NO: 9327558 - DNA, 22 bp, Homo sapiens
agtcttctcatttcacatgctt

SEQ ID NO: 9327559 - DNA, 22 bp, Homo sapiens
ctccagagagtccagctctggg

SEQ ID NO: 9327560 - DNA, 22 bp, Homo sapiens
agtcttctcatttcacatgctt

SEQ ID NO: 9327561 - DNA, 22 bp, Homo sapiens
agtcttcactcttcactactat

SEQ ID NO: 9327562 - DNA, 22 bp, Homo sapiens
agtcttatgtgatttatctttc

SEQ ID NO: 9327563 - DNA, 22 bp, Homo sapiens
agtcttcagcagggttaaaccc

SEQ ID NO: 9327564 - DNA, 22 bp, Homo sapiens
agtcttatatcactatgctctg

SEQ ID NO: 9327565 - DNA, 22 bp, Homo sapiens
agttatatgtgaaaacacgtat

SEQ ID NO: 9327566 - DNA, 22 bp, Homo sapiens
ctgaggagctgaaggccctcca

SEQ ID NO: 9327567 - DNA, 22 bp, Homo sapiens
ctgaggagccccctctcagcat

SEQ ID NO: 9327568 - DNA, 22 bp, Homo sapiens
ctgaggagcagctggcccgcta

SEQ ID NO: 9327569 - DNA, 22 bp, Homo sapiens
ctgaggagcagctggcccgcta

SEQ ID NO: 9327570 - DNA, 22 bp, Homo sapiens
ctgaggagatccccccagaagt

SEQ ID NO: 9327571 - DNA, 22 bp, Homo sapiens
agttatcaagacagtgtggtac

SEQ ID NO: 9327572 - DNA, 22 bp, Homo sapiens
agttatcaggtgttttcatgga

SEQ ID NO: 9327573 - DNA, 22 bp, Homo sapiens
agttatcatcccttacactttg

SEQ ID NO: 9327574 - DNA, 22 bp, Homo sapiens
agttatcatcccttacactttg

SEQ ID NO: 9327575 - DNA, 22 bp, Homo sapiens
agttattactctttaacatatt

SEQ ID NO: 9327576 - DNA, 22 bp, Homo sapiens
agttattgttcagtacaatgtc

SEQ ID NO: 9327577 - DNA, 22 bp, Homo sapiens
agttatttactcctttgtctct

SEQ ID NO: 9327578 - DNA, 22 bp, Homo sapiens
agttattgagtgcagagcaggg

SEQ ID NO: 9327579 - DNA, 19 bp, Homo sapiens
agttattgatctattcagg

SEQ ID NO: 9327580 - DNA, 22 bp, Homo sapiens
agttattgggttaaaattgcat

SEQ ID NO: 9327581 - DNA, 22 bp, Homo sapiens
ctgcaagggatcttcaggtagc

SEQ ID NO: 9327582 - DNA, 22 bp, Homo sapiens
ctgcaaggctggggtgagctgg

SEQ ID NO: 9327583 - DNA, 22 bp, Homo sapiens
ctgcaaggtcatgactctctgg

SEQ ID NO: 9327584 - DNA, 22 bp, Homo sapiens
ctgcaaggtcatgactctctgg

SEQ ID NO: 9327585 - DNA, 23 bp, Homo sapiens
ctgcaaggtacaagatgctggat

SEQ ID NO: 9327586 - DNA, 22 bp, Homo sapiens
ctgcaaggtatatgttatcata

SEQ ID NO: 9327587 - DNA, 22 bp, Homo sapiens
ctgcaaggtccacctgctacat

SEQ ID NO: 9327588 - DNA, 22 bp, Homo sapiens
ctgcaagtatctaccattctct

SEQ ID NO: 9327589 - DNA, 22 bp, Homo sapiens
ctgcaatgatgtatttgtcctg

SEQ ID NO: 9327590 - DNA, 22 bp, Homo sapiens
ctgcaatatgatgtctgagaaa

SEQ ID NO: 9327591 - DNA, 22 bp, Homo sapiens
ctgcaagattggaagatgcaat

SEQ ID NO: 9327592 - DNA, 22 bp, Homo sapiens
ctgcaagccagggagagatgcc

SEQ ID NO: 9327593 - DNA, 22 bp, Homo sapiens
ctgcaaggctgaattcagctga

SEQ ID NO: 9327594 - DNA, 22 bp, Homo sapiens
ctgcaaggagttgacattgtct

SEQ ID NO: 9327595 - DNA, 22 bp, Homo sapiens
ctgcaagctacccctagcatca

SEQ ID NO: 9327596 - DNA, 21 bp, Homo sapiens
ctgatcccaaacctctgccct

SEQ ID NO: 9327597 - DNA, 22 bp, Homo sapiens
ctgatcatgtgggaggatatgt

SEQ ID NO: 9327598 - DNA, 22 bp, Homo sapiens
ctgcaaataggggtgtgaataa

SEQ ID NO: 9327599 - DNA, 22 bp, Homo sapiens
ctgcaaatcaagttcttataat

SEQ ID NO: 9327600 - DNA, 20 bp, Homo sapiens
ctgcagggttagaggctcca

SEQ ID NO: 9327601 - DNA, 20 bp, Homo sapiens
ctgcagggttagaggctcca

SEQ ID NO: 9327602 - DNA, 20 bp, Homo sapiens
ctgcagggttagaggctcca

SEQ ID NO: 9327603 - DNA, 22 bp, Homo sapiens
ctgcagggtgacgttgcccacc

SEQ ID NO: 9327604 - DNA, 22 bp, Homo sapiens
ctgcagggtgacgttgcccacc

SEQ ID NO: 9327605 - DNA, 20 bp, Homo sapiens
ctgcagggtgagtgggcgat

SEQ ID NO: 9327606 - DNA, 22 bp, Homo sapiens
ctgcagggagaggggacagcct

SEQ ID NO: 9327607 - DNA, 22 bp, Homo sapiens
ctgcaggggtgtcctgtattgg

SEQ ID NO: 9327608 - DNA, 22 bp, Homo sapiens
ctgcagggagaggggacagcct

SEQ ID NO: 9327609 - DNA, 22 bp, Homo sapiens
ctgcagggagaggggacagcct

SEQ ID NO: 9327610 - DNA, 22 bp, Homo sapiens
ctgcagggagaggggacagcct

SEQ ID NO: 9327611 - DNA, 22 bp, Homo sapiens
ctgcagagcaagtaacatcctc

SEQ ID NO: 9327612 - DNA, 22 bp, Homo sapiens
ctgcagagatgaagaaggtggc

SEQ ID NO: 9327613 - DNA, 22 bp, Homo sapiens
ctgcagagatgaagaaggtggc

SEQ ID NO: 9327614 - DNA, 22 bp, Homo sapiens
ctgcagagagtgccgggcagcc

SEQ ID NO: 9327615 - DNA, 22 bp, Homo sapiens
ctgcagagagtaactgaaatat

SEQ ID NO: 9327616 - DNA, 22 bp, Homo sapiens
ctgcagagagtgccgggcagcc

SEQ ID NO: 9327617 - DNA, 22 bp, Homo sapiens
ctgcagagaattgtggggcttc

SEQ ID NO: 9327618 - DNA, 22 bp, Homo sapiens
ctgcagagaattgtggggcttc

SEQ ID NO: 9327619 - DNA, 22 bp, Homo sapiens
ctgcagagacctaggtcaggtt

SEQ ID NO: 9327620 - DNA, 23 bp, Homo sapiens
ctgcagagaactgagggacagcc

SEQ ID NO: 9327621 - DNA, 23 bp, Homo sapiens
ctgcagagaactgagggacagcc

SEQ ID NO: 9327622 - DNA, 22 bp, Homo sapiens
ctgcacacatatggcttctctc

SEQ ID NO: 9327623 - DNA, 22 bp, Homo sapiens
ctgcatggtagggataagatgg

SEQ ID NO: 9327624 - DNA, 22 bp, Homo sapiens
ctgcatctctgtgccagagggc

SEQ ID NO: 9327625 - DNA, 22 bp, Homo sapiens
ctgcatggttcaaatgagctaa

SEQ ID NO: 9327626 - DNA, 22 bp, Homo sapiens
ctgcattgatcaggcagaatct

SEQ ID NO: 9327627 - DNA, 22 bp, Homo sapiens
ctgcattaagttgcctgtaaga

SEQ ID NO: 9327628 - DNA, 22 bp, Homo sapiens
ctgcagggtttcgccagttgtg

SEQ ID NO: 9327629 - DNA, 22 bp, Homo sapiens
ctgcagggttcggagagttccc

SEQ ID NO: 9327630 - DNA, 22 bp, Homo sapiens
ctgcagggtttcgccagttgtg

SEQ ID NO: 9327631 - DNA, 20 bp, Homo sapiens
ctgcagggttagaggctcca

SEQ ID NO: 9327632 - DNA, 22 bp, Homo sapiens
ctgcagggttcggagagttccc

SEQ ID NO: 9327633 - DNA, 22 bp, Homo sapiens
ctgcagggttcggagagttccc

SEQ ID NO: 9327634 - DNA, 22 bp, Homo sapiens
ctgcatccatgttgctgcaaag

SEQ ID NO: 9327635 - DNA, 22 bp, Homo sapiens
ctgcagggttttaacaatggac

SEQ ID NO: 9327636 - DNA, 22 bp, Homo sapiens
ctgcagggttttaacaatggac

SEQ ID NO: 9327637 - DNA, 22 bp, Homo sapiens
ctgcagggtttttcaaggacaa

SEQ ID NO: 9327638 - DNA, 22 bp, Homo sapiens
ctgcagggtttttcaaggacaa

SEQ ID NO: 9327639 - DNA, 22 bp, Homo sapiens
ataacagctcttaaacaccata

SEQ ID NO: 9327640 - DNA, 22 bp, Homo sapiens
ataacagatgcttcagcataaa

SEQ ID NO: 9327641 - DNA, 22 bp, Homo sapiens
ataactctgtttttttcatgca

SEQ ID NO: 9327642 - DNA, 19 bp, Homo sapiens
ataactacattggctcagt

SEQ ID NO: 9327643 - DNA, 22 bp, Homo sapiens
ataactctgtttttttcatgca

SEQ ID NO: 9327644 - DNA, 22 bp, Homo sapiens
ataacccattggccaggcttca

SEQ ID NO: 9327645 - DNA, 22 bp, Homo sapiens
ataaccatgattaatctaagaa

SEQ ID NO: 9327646 - DNA, 23 bp, Homo sapiens
ataaattactatctccctagagc

SEQ ID NO: 9327647 - DNA, 22 bp, Homo sapiens
ataaattaggatctggggttcc

SEQ ID NO: 9327648 - DNA, 22 bp, Homo sapiens
ataacagagttgggaagtgaaa

SEQ ID NO: 9327649 - DNA, 22 bp, Homo sapiens
ataaatgtgaattagagctttg

SEQ ID NO: 9327650 - DNA, 22 bp, Homo sapiens
ataaatgtgaaatgagcagtta

SEQ ID NO: 9327651 - DNA, 22 bp, Homo sapiens
ataaatgtttgttgaatgaata

SEQ ID NO: 9327652 - DNA, 23 bp, Homo sapiens
ataaattactatctccctagagc

SEQ ID NO: 9327653 - DNA, 22 bp, Homo sapiens
ataaatctcttaagactcaaca

SEQ ID NO: 9327654 - DNA, 22 bp, Homo sapiens
ataaatgaacattcacagagct

SEQ ID NO: 9327655 - DNA, 22 bp, Homo sapiens
ctgcctctgcgtcccacagagt

SEQ ID NO: 9327656 - DNA, 22 bp, Homo sapiens
ctgcctctgcgtcccacagagt

SEQ ID NO: 9327657 - DNA, 22 bp, Homo sapiens
ataaatgattcagcaggaaata

SEQ ID NO: 9327658 - DNA, 22 bp, Homo sapiens
ataaatgaacattcacagagct

SEQ ID NO: 9327659 - DNA, 22 bp, Homo sapiens
ataaatgattcagcaggaaata

SEQ ID NO: 9327660 - DNA, 22 bp, Homo sapiens
ataaatgcctcagaatcatccc

SEQ ID NO: 9327661 - DNA, 22 bp, Homo sapiens
ctgcctctattcactgaggcag

SEQ ID NO: 9327662 - DNA, 23 bp, Homo sapiens
ctgcattgtctcctgggagcatg

SEQ ID NO: 9327663 - DNA, 22 bp, Homo sapiens
ctgcctctcagcctgaccgcca

SEQ ID NO: 9327664 - DNA, 22 bp, Homo sapiens
ctgcctctcaggtccctgagat

SEQ ID NO: 9327665 - DNA, 22 bp, Homo sapiens
ctgcctctcaggtccctgagat

SEQ ID NO: 9327666 - DNA, 22 bp, Homo sapiens
ctgcctctcaggtccctgagat

SEQ ID NO: 9327667 - DNA, 22 bp, Homo sapiens
ctgctgaggccttccctgtcct

SEQ ID NO: 9327668 - DNA, 22 bp, Homo sapiens
ctgctgagcctggtgcgggatg

SEQ ID NO: 9327669 - DNA, 22 bp, Homo sapiens
ctgctgaggtatactatgtgac

SEQ ID NO: 9327670 - DNA, 22 bp, Homo sapiens
ctgctgcaatctggcttccatg

SEQ ID NO: 9327671 - DNA, 22 bp, Homo sapiens
ctgctgaggtatactatgtgac

SEQ ID NO: 9327672 - DNA, 22 bp, Homo sapiens
atacaaatttatagatgcattt

SEQ ID NO: 9327673 - DNA, 22 bp, Homo sapiens
atacaaatttatagatgcattt

SEQ ID NO: 9327674 - DNA, 22 bp, Homo sapiens
atacaacagaaaatgattattc

SEQ ID NO: 9327675 - DNA, 22 bp, Homo sapiens
atacaacagaaaatgattattc

SEQ ID NO: 9327676 - DNA, 22 bp, Homo sapiens
atacaacagaaaatgattattc

SEQ ID NO: 9327677 - DNA, 22 bp, Homo sapiens
atacaaatttatagatgcattt

SEQ ID NO: 9327678 - DNA, 22 bp, Homo sapiens
atacaaatttatagatgcattt

SEQ ID NO: 9327679 - DNA, 22 bp, Homo sapiens
ataagcatgattaccgggagca

SEQ ID NO: 9327680 - DNA, 22 bp, Homo sapiens
ataagcacacaaatacatatat

SEQ ID NO: 9327681 - DNA, 21 bp, Homo sapiens
ataagcatgctgattacattt

SEQ ID NO: 9327682 - DNA, 22 bp, Homo sapiens
ataagaggaattacagaagagg

SEQ ID NO: 9327683 - DNA, 22 bp, Homo sapiens
ataagagctatggtgggagttg

SEQ ID NO: 9327684 - DNA, 22 bp, Homo sapiens
atacaaagctaaatatggtttc

SEQ ID NO: 9327685 - DNA, 22 bp, Homo sapiens
ataatttactaagctctacctt

SEQ ID NO: 9327686 - DNA, 22 bp, Homo sapiens
ataacttcagggctgtgacaga

SEQ ID NO: 9327687 - DNA, 22 bp, Homo sapiens
ataacttcagtttctgtgtcct

SEQ ID NO: 9327688 - DNA, 22 bp, Homo sapiens
ataacttagagtaggcaaaagt

SEQ ID NO: 9327689 - DNA, 22 bp, Homo sapiens
ataacttaatgggtcatgctct

SEQ ID NO: 9327690 - DNA, 22 bp, Homo sapiens
ataacttattagattggagctg

SEQ ID NO: 9327691 - DNA, 22 bp, Homo sapiens
ctggccccaggcagcctgctgg

SEQ ID NO: 9327692 - DNA, 22 bp, Homo sapiens
ctggcccatggtgagctctggg

SEQ ID NO: 9327693 - DNA, 22 bp, Homo sapiens
ctggcccccacacctgtcaggg

SEQ ID NO: 9327694 - DNA, 22 bp, Homo sapiens
ctggccccatctggagtctgag

SEQ ID NO: 9327695 - DNA, 22 bp, Homo sapiens
ctggcccccacacctgtcaggg

SEQ ID NO: 9327696 - DNA, 22 bp, Homo sapiens
ctggcccccacacctgtcaggg

SEQ ID NO: 9327697 - DNA, 22 bp, Homo sapiens
ctggccccaggcagcctgctgg

SEQ ID NO: 9327698 - DNA, 22 bp, Homo sapiens
ctggccccaggcagcctgctgg

SEQ ID NO: 9327699 - DNA, 22 bp, Homo sapiens
ctggccccatctggagtctgag

SEQ ID NO: 9327700 - DNA, 22 bp, Homo sapiens
ctggccccaggcagcctgctgg

SEQ ID NO: 9327701 - DNA, 22 bp, Homo sapiens
atagcaaaaggcaccagagtga

SEQ ID NO: 9327702 - DNA, 22 bp, Homo sapiens
atagcaaactggcagcttgtgg

SEQ ID NO: 9327703 - DNA, 22 bp, Homo sapiens
atagatttgaatttaagacttg

SEQ ID NO: 9327704 - DNA, 22 bp, Homo sapiens
atagattcattctatttctccg

SEQ ID NO: 9327705 - DNA, 22 bp, Homo sapiens
atagattatttgctcattactt

SEQ ID NO: 9327706 - DNA, 22 bp, Homo sapiens
atactatattaccttctcaact

SEQ ID NO: 9327707 - DNA, 22 bp, Homo sapiens
atactacactatgcatggatgt

SEQ ID NO: 9327708 - DNA, 22 bp, Homo sapiens
atactacatactatgtaaacat

SEQ ID NO: 9327709 - DNA, 22 bp, Homo sapiens
atactacacattgactatattt

SEQ ID NO: 9327710 - DNA, 22 bp, Homo sapiens
atactacacattgactatattt

SEQ ID NO: 9327711 - DNA, 22 bp, Homo sapiens
atactacactatgcatggatgt

SEQ ID NO: 9327712 - DNA, 22 bp, Homo sapiens
atactacatactatgtaaacat

SEQ ID NO: 9327713 - DNA, 22 bp, Homo sapiens
atactacatactatgtaaacat

SEQ ID NO: 9327714 - DNA, 22 bp, Homo sapiens
atactacaatcataattgtaca

SEQ ID NO: 9327715 - DNA, 22 bp, Homo sapiens
atactacaatcataattgtaca

SEQ ID NO: 9327716 - DNA, 22 bp, Homo sapiens
atactacaaggtatgtgctaaa

SEQ ID NO: 9327717 - DNA, 22 bp, Homo sapiens
ctggctccatctttgcttcctg

SEQ ID NO: 9327718 - DNA, 22 bp, Homo sapiens
ctggctccattactcagcatct

SEQ ID NO: 9327719 - DNA, 22 bp, Homo sapiens
ctggcccggctgcctggtcatt

SEQ ID NO: 9327720 - DNA, 22 bp, Homo sapiens
ctggctcccgaagccctcagtg

SEQ ID NO: 9327721 - DNA, 22 bp, Homo sapiens
ctggctcccgaagccctcagtg

SEQ ID NO: 9327722 - DNA, 22 bp, Homo sapiens
ctggctcccatgagctctcacg

SEQ ID NO: 9327723 - DNA, 22 bp, Homo sapiens
ctggctcccgaagccctcagtg

SEQ ID NO: 9327724 - DNA, 22 bp, Homo sapiens
ctggctccctcgctgaggtgct

SEQ ID NO: 9327725 - DNA, 22 bp, Homo sapiens
ctggctggagtgcaggtgagtg

SEQ ID NO: 9327726 - DNA, 22 bp, Homo sapiens
ctggctggcaagtagaacacaa

SEQ ID NO: 9327727 - DNA, 22 bp, Homo sapiens
ctggctgcagctccgaggaaga

SEQ ID NO: 9327728 - DNA, 22 bp, Homo sapiens
ctggctgcagctccgaggaaga

SEQ ID NO: 9327729 - DNA, 19 bp, Homo sapiens
atagcagctatacccagat

SEQ ID NO: 9327730 - DNA, 22 bp, Homo sapiens
atagcagggatgtcagcaagta

SEQ ID NO: 9327731 - DNA, 22 bp, Homo sapiens
ctggctggccatgcagcgccag

SEQ ID NO: 9327732 - DNA, 22 bp, Homo sapiens
ctggctggcagatgctcttgct

SEQ ID NO: 9327733 - DNA, 22 bp, Homo sapiens
ctggctggccatgcagcgccag

SEQ ID NO: 9327734 - DNA, 22 bp, Homo sapiens
ctggctggccatgcagcgccag

SEQ ID NO: 9327735 - DNA, 22 bp, Homo sapiens
ctggctggccatgtagagatga

SEQ ID NO: 9327736 - DNA, 22 bp, Homo sapiens
ctggctggccggagcgaggcgg

SEQ ID NO: 9327737 - DNA, 22 bp, Homo sapiens
atagcacttattgtatgctgag

SEQ ID NO: 9327738 - DNA, 22 bp, Homo sapiens
atagcacaatgacttgggtatc

SEQ ID NO: 9327739 - DNA, 22 bp, Homo sapiens
atagcacaatattacctttatg

SEQ ID NO: 9327740 - DNA, 22 bp, Homo sapiens
ctggagacctctcctgagagtg

SEQ ID NO: 9327741 - DNA, 22 bp, Homo sapiens
ctggagacctctcctgagagtg

SEQ ID NO: 9327742 - DNA, 22 bp, Homo sapiens
ctggagagaatgtggaatgatt

SEQ ID NO: 9327743 - DNA, 22 bp, Homo sapiens
ctggagagaatgtggaatgatt

SEQ ID NO: 9327744 - DNA, 22 bp, Homo sapiens
ctggagagaatgtggaatgatt

SEQ ID NO: 9327745 - DNA, 22 bp, Homo sapiens
ctggagagaaatgacaaagcta

SEQ ID NO: 9327746 - DNA, 22 bp, Homo sapiens
ctggagaagtactgagacattt

SEQ ID NO: 9327747 - DNA, 17 bp, Homo sapiens
ctggagaagcctgtgga

SEQ ID NO: 9327748 - DNA, 22 bp, Homo sapiens
ctggagaagtactgagacattt

SEQ ID NO: 9327749 - DNA, 17 bp, Homo sapiens
ctggagaagcctgtgga

SEQ ID NO: 9327750 - DNA, 20 bp, Homo sapiens
atacagatggttccagctgg

SEQ ID NO: 9327751 - DNA, 22 bp, Homo sapiens
atacagatgttaaagcaatttc

SEQ ID NO: 9327752 - DNA, 19 bp, Homo sapiens
atacagatgtatccatgat

SEQ ID NO: 9327753 - DNA, 22 bp, Homo sapiens
ctggagagaccgaaagaggctg

SEQ ID NO: 9327754 - DNA, 22 bp, Homo sapiens
ctggagagaatgttcattgcag

SEQ ID NO: 9327755 - DNA, 22 bp, Homo sapiens
ctggagagaatgttcattgcag

SEQ ID NO: 9327756 - DNA, 22 bp, Homo sapiens
ctggagagaatgttcattgcag

SEQ ID NO: 9327757 - DNA, 22 bp, Homo sapiens
ctggagagaatgtggaatgatt

SEQ ID NO: 9327758 - DNA, 22 bp, Homo sapiens
ctggaatggcaatgggaagtcc

SEQ ID NO: 9327759 - DNA, 22 bp, Homo sapiens
ctggaatgggccatttgaggcc

SEQ ID NO: 9327760 - DNA, 22 bp, Homo sapiens
ctggaatgtatgggaacccaaa

SEQ ID NO: 9327761 - DNA, 20 bp, Homo sapiens
ctggaatgggtgtgggttag

SEQ ID NO: 9327762 - DNA, 20 bp, Homo sapiens
ctggaatgggtgtgggttag

SEQ ID NO: 9327763 - DNA, 19 bp, Homo sapiens
ctggaatgagaacatgccc

SEQ ID NO: 9327764 - DNA, 22 bp, Homo sapiens
ctggaatgagcagggcttatgg

SEQ ID NO: 9327765 - DNA, 18 bp, Homo sapiens
ctgctgcaggcactcagg

SEQ ID NO: 9327766 - DNA, 22 bp, Homo sapiens
ctgctgccaagggtgccacagg

SEQ ID NO: 9327767 - DNA, 22 bp, Homo sapiens
ctgctgccaagggtgccacagg

SEQ ID NO: 9327768 - DNA, 22 bp, Homo sapiens
ctgctgcattactcttctcaag

SEQ ID NO: 9327769 - DNA, 22 bp, Homo sapiens
ctgctgcattcctctttatgag

SEQ ID NO: 9327770 - DNA, 22 bp, Homo sapiens
ctggaagagcatttgcataggg

SEQ ID NO: 9327771 - DNA, 22 bp, Homo sapiens
ctggaagtggggttggcttgaa

SEQ ID NO: 9327772 - DNA, 22 bp, Homo sapiens
ctggaagagcatttgcataggg

SEQ ID NO: 9327773 - DNA, 22 bp, Homo sapiens
ctgctgccattagggcacagac

SEQ ID NO: 9327774 - DNA, 22 bp, Homo sapiens
ctggaagtggggttggcttgaa

SEQ ID NO: 9327775 - DNA, 22 bp, Homo sapiens
ctggaagtttccttcctggtca

SEQ ID NO: 9327776 - DNA, 22 bp, Homo sapiens
ctggaataaacgatcttcagca

SEQ ID NO: 9327777 - DNA, 17 bp, Homo sapiens
atacagtttattttaca

SEQ ID NO: 9327778 - DNA, 22 bp, Homo sapiens
atacataattacttccgatgtt

SEQ ID NO: 9327779 - DNA, 22 bp, Homo sapiens
atacataattacttccgatgtt

SEQ ID NO: 9327780 - DNA, 22 bp, Homo sapiens
atacagttatagtcagggctaa

SEQ ID NO: 9327781 - DNA, 22 bp, Homo sapiens
atacatacatgtacacataaat

SEQ ID NO: 9327782 - DNA, 22 bp, Homo sapiens
atacatacatgtacacataaat

SEQ ID NO: 9327783 - DNA, 22 bp, Homo sapiens
atacatacatgtatgcacatac

SEQ ID NO: 9327784 - DNA, 22 bp, Homo sapiens
atacatacatgtatgcacatac

SEQ ID NO: 9327785 - DNA, 22 bp, Homo sapiens
atacatacgtacatacgtatgt

SEQ ID NO: 9327786 - DNA, 22 bp, Homo sapiens
atacatacatgtatgcacatac

SEQ ID NO: 9327787 - DNA, 22 bp, Homo sapiens
atacatacgtacatacgtatgt

SEQ ID NO: 9327788 - DNA, 22 bp, Homo sapiens
atacagtggctgtgagctgggc

SEQ ID NO: 9327789 - DNA, 22 bp, Homo sapiens
atacctgtgtatccacaagcgt

SEQ ID NO: 9327790 - DNA, 22 bp, Homo sapiens
atacctgatcaaggcaaaaatg

SEQ ID NO: 9327791 - DNA, 22 bp, Homo sapiens
atacctatgtgacagtattatt

SEQ ID NO: 9327792 - DNA, 22 bp, Homo sapiens
ataccatggcagtttattcacg

SEQ ID NO: 9327793 - DNA, 22 bp, Homo sapiens
ataccataggaaaggatcagcc

SEQ ID NO: 9327794 - DNA, 21 bp, Homo sapiens
atacattctattaagcattta

SEQ ID NO: 9327795 - DNA, 22 bp, Homo sapiens
ataccaaagcacatactgtttg

SEQ ID NO: 9327796 - DNA, 22 bp, Homo sapiens
atacattgagttttgatgttct

SEQ ID NO: 9327797 - DNA, 22 bp, Homo sapiens
atacatgtgtgtgcatacatgt

SEQ ID NO: 9327798 - DNA, 22 bp, Homo sapiens
atacatagttctgtgaaaagta

SEQ ID NO: 9327799 - DNA, 22 bp, Homo sapiens
atacatgtgtgtgcatacatgt

SEQ ID NO: 9327800 - DNA, 22 bp, Homo sapiens
atacatagctgaaaacttgtag

SEQ ID NO: 9327801 - DNA, 22 bp, Homo sapiens
atacataggagaataacttcag

SEQ ID NO: 9327802 - DNA, 22 bp, Homo sapiens
atcctgggcagtgtgtcactct

SEQ ID NO: 9327803 - DNA, 22 bp, Homo sapiens
atcctgggcagttttgagtgct

SEQ ID NO: 9327804 - DNA, 22 bp, Homo sapiens
atcctgggcagtgtgtcactct

SEQ ID NO: 9327805 - DNA, 18 bp, Homo sapiens
atcctgggccagtctttc

SEQ ID NO: 9327806 - DNA, 22 bp, Homo sapiens
atcctgaaaacttacgaagtgg

SEQ ID NO: 9327807 - DNA, 22 bp, Homo sapiens
atcctgggcaaagtatgctgtc

SEQ ID NO: 9327808 - DNA, 22 bp, Homo sapiens
atcctgggcaagtcaatgtccc

SEQ ID NO: 9327809 - DNA, 22 bp, Homo sapiens
atcctgggcaagtcaatgtccc

SEQ ID NO: 9327810 - DNA, 22 bp, Homo sapiens
atcctgggggcagctggaaaca

SEQ ID NO: 9327811 - DNA, 22 bp, Homo sapiens
atcctgggtaagttccttttaa

SEQ ID NO: 9327812 - DNA, 19 bp, Homo sapiens
atcctgggtcctccagctg

SEQ ID NO: 9327813 - DNA, 22 bp, Homo sapiens
atcctgggctgcaccctcagcc

SEQ ID NO: 9327814 - DNA, 22 bp, Homo sapiens
atcctgggcctcagaggtgtgt

SEQ ID NO: 9327815 - DNA, 22 bp, Homo sapiens
atcctgggtttgtgagtttatg

SEQ ID NO: 9327816 - DNA, 22 bp, Homo sapiens
atcctgtgaggataagcccttg

SEQ ID NO: 9327817 - DNA, 22 bp, Homo sapiens
atcctgaaaacttacgaagtgg

SEQ ID NO: 9327818 - DNA, 22 bp, Homo sapiens
ctgtgtgtcctcggacgagttt

SEQ ID NO: 9327819 - DNA, 22 bp, Homo sapiens
ctgtgtgtcatttgtcaatcct

SEQ ID NO: 9327820 - DNA, 22 bp, Homo sapiens
ctgtgtgtcatttgtcaatcct

SEQ ID NO: 9327821 - DNA, 22 bp, Homo sapiens
ctgtgtggactggttgaggccc

SEQ ID NO: 9327822 - DNA, 22 bp, Homo sapiens
atccagggtgtggagagagctc

SEQ ID NO: 9327823 - DNA, 22 bp, Homo sapiens
atccagtatgaggtagggcttg

SEQ ID NO: 9327824 - DNA, 22 bp, Homo sapiens
atccagtcaaaattagtaaggt

SEQ ID NO: 9327825 - DNA, 22 bp, Homo sapiens
atccagtgagtgcagctgttgt

SEQ ID NO: 9327826 - DNA, 22 bp, Homo sapiens
atccagtctggggtgctgcatg

SEQ ID NO: 9327827 - DNA, 22 bp, Homo sapiens
atccatataggcagatggcaca

SEQ ID NO: 9327828 - DNA, 22 bp, Homo sapiens
atccaggcttaatgggagccac

SEQ ID NO: 9327829 - DNA, 22 bp, Homo sapiens
atccagggataaaagtaaggtt

SEQ ID NO: 9327830 - DNA, 22 bp, Homo sapiens
atccagggataaaagtaaggtt

SEQ ID NO: 9327831 - DNA, 22 bp, Homo sapiens
ctgtgggagaggtgcctggatt

SEQ ID NO: 9327832 - DNA, 22 bp, Homo sapiens
atccactccctaacaccatgtt

SEQ ID NO: 9327833 - DNA, 22 bp, Homo sapiens
atccaggcgaatgcagaaggcc

SEQ ID NO: 9327834 - DNA, 22 bp, Homo sapiens
ctgtggctcaaaatcccatgat

SEQ ID NO: 9327835 - DNA, 22 bp, Homo sapiens
ctgtggctaggaagctgtggga

SEQ ID NO: 9327836 - DNA, 22 bp, Homo sapiens
ctgtggctttgtgtctattgta

SEQ ID NO: 9327837 - DNA, 21 bp, Homo sapiens
ctgtgggaccaagcactggga

SEQ ID NO: 9327838 - DNA, 21 bp, Homo sapiens
ctgtgggaccaagcactggga

SEQ ID NO: 9327839 - DNA, 22 bp, Homo sapiens
ctgtgggagaagttgctggagt

SEQ ID NO: 9327840 - DNA, 22 bp, Homo sapiens
ctgtgggagaagttgctggagt

SEQ ID NO: 9327841 - DNA, 22 bp, Homo sapiens
ctgtgggagaagctagcacagg

SEQ ID NO: 9327842 - DNA, 18 bp, Homo sapiens
ctgtgggaagagtttggg

SEQ ID NO: 9327843 - DNA, 22 bp, Homo sapiens
ctgtgggaacactgaggacttc

SEQ ID NO: 9327844 - DNA, 22 bp, Homo sapiens
ctgtgggaacactgaggacttc

SEQ ID NO: 9327845 - DNA, 22 bp, Homo sapiens
ctgtgggaaaggatgagattgc

SEQ ID NO: 9327846 - DNA, 23 bp, Homo sapiens
ctgtgggaagtcggggagcgcgc

SEQ ID NO: 9327847 - DNA, 22 bp, Homo sapiens
ctgtgggaatactgcgagtgta

SEQ ID NO: 9327848 - DNA, 22 bp, Homo sapiens
ctgtgggaatactgcgagtgta

SEQ ID NO: 9327849 - DNA, 22 bp, Homo sapiens
ctgtggagtgtagatgctgggt

SEQ ID NO: 9327850 - DNA, 23 bp, Homo sapiens
ctgtggccctgcttcatgcagcc

SEQ ID NO: 9327851 - DNA, 23 bp, Homo sapiens
ctgtggccctgcttcatgcagcc

SEQ ID NO: 9327852 - DNA, 23 bp, Homo sapiens
ctgtggccctgcttcatgcagcc

SEQ ID NO: 9327853 - DNA, 23 bp, Homo sapiens
ctgtggccctgcttcatgcagcc

SEQ ID NO: 9327854 - DNA, 22 bp, Homo sapiens
ctgtggcctgtgccagaactgg

SEQ ID NO: 9327855 - DNA, 21 bp, Homo sapiens
ctgtggcctggctagcaccgt

SEQ ID NO: 9327856 - DNA, 22 bp, Homo sapiens
ctgtggccttggaccagcatct

SEQ ID NO: 9327857 - DNA, 22 bp, Homo sapiens
atcagagcaatggataaaatca

SEQ ID NO: 9327858 - DNA, 22 bp, Homo sapiens
atcagagcactgagcaggacac

SEQ ID NO: 9327859 - DNA, 22 bp, Homo sapiens
ctgtggagtggggagtactggt

SEQ ID NO: 9327860 - DNA, 22 bp, Homo sapiens
atcagacactagtggactagaa

SEQ ID NO: 9327861 - DNA, 22 bp, Homo sapiens
cttcccactagtatcacagagc

SEQ ID NO: 9327862 - DNA, 22 bp, Homo sapiens
cttcccagaacaatgtaggctt

SEQ ID NO: 9327863 - DNA, 22 bp, Homo sapiens
cttcccagaacaatgtaggctt

SEQ ID NO: 9327864 - DNA, 22 bp, Homo sapiens
cttcctaaaagcttcaagagaa

SEQ ID NO: 9327865 - DNA, 22 bp, Homo sapiens
cttcctcccggcccatgctctg

SEQ ID NO: 9327866 - DNA, 18 bp, Homo sapiens
cttcctcatcgctctccc

SEQ ID NO: 9327867 - DNA, 22 bp, Homo sapiens
cttcctcccccacacactcact

SEQ ID NO: 9327868 - DNA, 17 bp, Homo sapiens
cttcccaccatctcctg

SEQ ID NO: 9327869 - DNA, 22 bp, Homo sapiens
cttcccaagtaaatttgtattt

SEQ ID NO: 9327870 - DNA, 22 bp, Homo sapiens
cttcccaagctttagttatttt

SEQ ID NO: 9327871 - DNA, 22 bp, Homo sapiens
cttcccaagactgtattgcaag

SEQ ID NO: 9327872 - DNA, 22 bp, Homo sapiens
cttccagtcttttcagtggagt

SEQ ID NO: 9327873 - DNA, 22 bp, Homo sapiens
cttccagtagtatcattctcat

SEQ ID NO: 9327874 - DNA, 22 bp, Homo sapiens
cttccaggttctggttgggaag

SEQ ID NO: 9327875 - DNA, 22 bp, Homo sapiens
cttagatgaagtcacagaaccc

SEQ ID NO: 9327876 - DNA, 22 bp, Homo sapiens
cttagagccttactcttcttgt

SEQ ID NO: 9327877 - DNA, 22 bp, Homo sapiens
cttagagatgggttttacttag

SEQ ID NO: 9327878 - DNA, 22 bp, Homo sapiens
cttagaagtgggctataattag

SEQ ID NO: 9327879 - DNA, 22 bp, Homo sapiens
cttagaagtaatttaccttctc

SEQ ID NO: 9327880 - DNA, 22 bp, Homo sapiens
cttagagatgggttttacttag

SEQ ID NO: 9327881 - DNA, 22 bp, Homo sapiens
atcctgtggccctgcctctgct

SEQ ID NO: 9327882 - DNA, 22 bp, Homo sapiens
atcctgtggctccagggagccg

SEQ ID NO: 9327883 - DNA, 22 bp, Homo sapiens
atcctgtggggcggctgcaggg

SEQ ID NO: 9327884 - DNA, 20 bp, Homo sapiens
cttagaagggacatcctggg

SEQ ID NO: 9327885 - DNA, 22 bp, Homo sapiens
cttagaaggatgtttgctgttt

SEQ ID NO: 9327886 - DNA, 22 bp, Homo sapiens
cttagaagaatgcctaggacag

SEQ ID NO: 9327887 - DNA, 22 bp, Homo sapiens
cttagaaggaacagtttagtgc

SEQ ID NO: 9327888 - DNA, 22 bp, Homo sapiens
atctgcaggaatgtgtgcagag

SEQ ID NO: 9327889 - DNA, 22 bp, Homo sapiens
atctgcagaggacaggcgagga

SEQ ID NO: 9327890 - DNA, 22 bp, Homo sapiens
atctgaggtatatgactggcta

SEQ ID NO: 9327891 - DNA, 22 bp, Homo sapiens
atctgagggtttgggcatcagc

SEQ ID NO: 9327892 - DNA, 20 bp, Homo sapiens
atctgaggctgtcgctggaa

SEQ ID NO: 9327893 - DNA, 22 bp, Homo sapiens
atctgacaagttgtgtgtatag

SEQ ID NO: 9327894 - DNA, 22 bp, Homo sapiens
atctgacatctactagaacaga

SEQ ID NO: 9327895 - DNA, 22 bp, Homo sapiens
cttcttggctgcaagtctctgt

SEQ ID NO: 9327896 - DNA, 22 bp, Homo sapiens
cttcttggctgcaagtctctgt

SEQ ID NO: 9327897 - DNA, 22 bp, Homo sapiens
atctgcagtttgttttctcttg

SEQ ID NO: 9327898 - DNA, 22 bp, Homo sapiens
atctgcaggatgttaggatgat

SEQ ID NO: 9327899 - DNA, 22 bp, Homo sapiens
atctgcagtttgttttctcttg

SEQ ID NO: 9327900 - DNA, 22 bp, Homo sapiens
cttcttggaagtcgtccttcca

SEQ ID NO: 9327901 - DNA, 22 bp, Homo sapiens
cttcttatctgaaagtaatatt

SEQ ID NO: 9327902 - DNA, 22 bp, Homo sapiens
atctgaataaatttcttttagt

SEQ ID NO: 9327903 - DNA, 22 bp, Homo sapiens
atctgaagggaagtggaaggca

SEQ ID NO: 9327904 - DNA, 22 bp, Homo sapiens
atctgaagaggtcatggctgac

SEQ ID NO: 9327905 - DNA, 19 bp, Homo sapiens
atctgaagtaggtgcagct

SEQ ID NO: 9327906 - DNA, 22 bp, Homo sapiens
atctgaaatagtcttatctgag

SEQ ID NO: 9327907 - DNA, 22 bp, Homo sapiens
atctgaaagctaggagttctca

SEQ ID NO: 9327908 - DNA, 22 bp, Homo sapiens
atctgaaactctgacattgtct

SEQ ID NO: 9327909 - DNA, 22 bp, Homo sapiens
atctgaaaagctttaatgagct

SEQ ID NO: 9327910 - DNA, 22 bp, Homo sapiens
cttcctccgaagaagttgctgg

SEQ ID NO: 9327911 - DNA, 22 bp, Homo sapiens
atctctgatttacagcatctct

SEQ ID NO: 9327912 - DNA, 22 bp, Homo sapiens
atcagaagcttgtagtctctct

SEQ ID NO: 9327913 - DNA, 22 bp, Homo sapiens
atcagaagaaatggatgtgact

SEQ ID NO: 9327914 - DNA, 22 bp, Homo sapiens
atcagaaaggtgggcaagcaga

SEQ ID NO: 9327915 - DNA, 22 bp, Homo sapiens
atcacattctttcaaagcagtc

SEQ ID NO: 9327916 - DNA, 22 bp, Homo sapiens
atcactttggtaccaattcagc

SEQ ID NO: 9327917 - DNA, 22 bp, Homo sapiens
atcaacatttgcatccttccac

SEQ ID NO: 9327918 - DNA, 22 bp, Homo sapiens
atcaacatagccactccttaga

SEQ ID NO: 9327919 - DNA, 22 bp, Homo sapiens
atcaacataaagaagtcctcag

SEQ ID NO: 9327920 - DNA, 22 bp, Homo sapiens
atcaacatgaatttctctgaag

SEQ ID NO: 9327921 - DNA, 22 bp, Homo sapiens
atcaacatgaatttctctgaag

SEQ ID NO: 9327922 - DNA, 22 bp, Homo sapiens
atcaaattatgtgctacaagaa

SEQ ID NO: 9327923 - DNA, 22 bp, Homo sapiens
atcaaatacaaagggcataagg

SEQ ID NO: 9327924 - DNA, 22 bp, Homo sapiens
atcaaatacaaagggcataagg

SEQ ID NO: 9327925 - DNA, 22 bp, Homo sapiens
atattgtactagggttacatgt

SEQ ID NO: 9327926 - DNA, 21 bp, Homo sapiens
atattggtatctttttaaatc

SEQ ID NO: 9327927 - DNA, 22 bp, Homo sapiens
atattggtgattagccaatgct

SEQ ID NO: 9327928 - DNA, 22 bp, Homo sapiens
atattggtgaaatgctagcaaa

SEQ ID NO: 9327929 - DNA, 22 bp, Homo sapiens
atattggtaaagtggattaaca

SEQ ID NO: 9327930 - DNA, 22 bp, Homo sapiens
atattgttagtaatatttcgaa

SEQ ID NO: 9327931 - DNA, 22 bp, Homo sapiens
atattgttgactataagagtaa

SEQ ID NO: 9327932 - DNA, 22 bp, Homo sapiens
atattgttgactataagagtaa

SEQ ID NO: 9327933 - DNA, 22 bp, Homo sapiens
atattgagatgaggatattaac

SEQ ID NO: 9327934 - DNA, 22 bp, Homo sapiens
atattgagataagaactgacat

SEQ ID NO: 9327935 - DNA, 22 bp, Homo sapiens
atattcttgtgattataaagta

SEQ ID NO: 9327936 - DNA, 22 bp, Homo sapiens
atattcttgtgattataaagta

SEQ ID NO: 9327937 - DNA, 22 bp, Homo sapiens
atattcttgaagggagattata

SEQ ID NO: 9327938 - DNA, 22 bp, Homo sapiens
atattcttgtgattataaagta

SEQ ID NO: 9327939 - DNA, 22 bp, Homo sapiens
atattcttgtgattataaagta

SEQ ID NO: 9327940 - DNA, 22 bp, Homo sapiens
atattgcagtgtgtttatgtga

SEQ ID NO: 9327941 - DNA, 22 bp, Homo sapiens
atattgcaatagatgcatcatt

SEQ ID NO: 9327942 - DNA, 22 bp, Homo sapiens
atattgatggaggtgttagaca

SEQ ID NO: 9327943 - DNA, 22 bp, Homo sapiens
atattttggcaaatgtctagat

SEQ ID NO: 9327944 - DNA, 22 bp, Homo sapiens
atatttaactggtcccaatata

SEQ ID NO: 9327945 - DNA, 22 bp, Homo sapiens
atatttaactggtcccaatata

SEQ ID NO: 9327946 - DNA, 22 bp, Homo sapiens
atatttaactggtcccaatata

SEQ ID NO: 9327947 - DNA, 22 bp, Homo sapiens
atatttaaacagggtaccaata

SEQ ID NO: 9327948 - DNA, 22 bp, Homo sapiens
atatttaaacagggtaccaata

SEQ ID NO: 9327949 - DNA, 22 bp, Homo sapiens
atcaaaatggaagaatttggct

SEQ ID NO: 9327950 - DNA, 22 bp, Homo sapiens
ctggcttccatgctgtagtggc

SEQ ID NO: 9327951 - DNA, 22 bp, Homo sapiens
ctggcttccaccatggcccctg

SEQ ID NO: 9327952 - DNA, 22 bp, Homo sapiens
ctggcttccctgtcttatggaa

SEQ ID NO: 9327953 - DNA, 22 bp, Homo sapiens
ctggcttccctgtcttatggaa

SEQ ID NO: 9327954 - DNA, 22 bp, Homo sapiens
ctggctgtgtcttggaggagct

SEQ ID NO: 9327955 - DNA, 19 bp, Homo sapiens
ctggcttcaagcagtcctc

SEQ ID NO: 9327956 - DNA, 19 bp, Homo sapiens
ctggcttcaagcagtcctc

SEQ ID NO: 9327957 - DNA, 22 bp, Homo sapiens
ctggctgtttctcctttgtcta

SEQ ID NO: 9327958 - DNA, 22 bp, Homo sapiens
ctggctgttttcaatgttgatg

SEQ ID NO: 9327959 - DNA, 22 bp, Homo sapiens
ctggctgggagcgagctgctca

SEQ ID NO: 9327960 - DNA, 22 bp, Homo sapiens
ctggctgggagcgagctgctca

SEQ ID NO: 9327961 - DNA, 22 bp, Homo sapiens
ctggctgggagcgagctgctca

SEQ ID NO: 9327962 - DNA, 22 bp, Homo sapiens
ctggctgtggtcacaggtaact

SEQ ID NO: 9327963 - DNA, 22 bp, Homo sapiens
ctggctggccggagcgaggcgg

SEQ ID NO: 9327964 - DNA, 22 bp, Homo sapiens
ctggctggccggagcgaggcgg

SEQ ID NO: 9327965 - DNA, 22 bp, Homo sapiens
ctggctggccggaggcatccct

SEQ ID NO: 9327966 - DNA, 22 bp, Homo sapiens
ctggctgggaagtagagtaggt

SEQ ID NO: 9327967 - DNA, 22 bp, Homo sapiens
ctggctgggaagtagagtaggt

SEQ ID NO: 9327968 - DNA, 22 bp, Homo sapiens
ctggctggctgtgcccctgccg

SEQ ID NO: 9327969 - DNA, 22 bp, Homo sapiens
ctggctggccggaggcatccct

SEQ ID NO: 9327970 - DNA, 22 bp, Homo sapiens
ctggctggctcatttttcattg

SEQ ID NO: 9327971 - DNA, 22 bp, Homo sapiens
ctggctggcgttttccaaaagc

SEQ ID NO: 9327972 - DNA, 20 bp, Homo sapiens
ctggcttcgggaactagttt

SEQ ID NO: 9327973 - DNA, 22 bp, Homo sapiens
ctggcttctgggccagggcaga

SEQ ID NO: 9327974 - DNA, 21 bp, Homo sapiens
ctgggctcaagcaatcctttc

SEQ ID NO: 9327975 - DNA, 20 bp, Homo sapiens
ctgggctcaagtgagcctcc

SEQ ID NO: 9327976 - DNA, 20 bp, Homo sapiens
ctgggctcaagtgagcctcc

SEQ ID NO: 9327977 - DNA, 20 bp, Homo sapiens
ctgggctcaagtgagcctcc

SEQ ID NO: 9327978 - DNA, 20 bp, Homo sapiens
ctgggctcaagtgagcctcc

SEQ ID NO: 9327979 - DNA, 21 bp, Homo sapiens
ctgggctcaagcaatcctttc

SEQ ID NO: 9327980 - DNA, 20 bp, Homo sapiens
ctgggctcaagtgatcctcc

SEQ ID NO: 9327981 - DNA, 22 bp, Homo sapiens
ctgggctcagatgagaggaagg

SEQ ID NO: 9327982 - DNA, 22 bp, Homo sapiens
ctgggctcagatgagaggaagg

SEQ ID NO: 9327983 - DNA, 22 bp, Homo sapiens
ctgggctcagaaccttgttaag

SEQ ID NO: 9327984 - DNA, 22 bp, Homo sapiens
ctgggctcagaaccttgttaag

SEQ ID NO: 9327985 - DNA, 22 bp, Homo sapiens
ctgggctcacctgtggctggca

SEQ ID NO: 9327986 - DNA, 22 bp, Homo sapiens
atatgcacatacatacataggt

SEQ ID NO: 9327987 - DNA, 22 bp, Homo sapiens
ctgggctctggggtcccggtgc

SEQ ID NO: 9327988 - DNA, 22 bp, Homo sapiens
ctgggctctgcggtgtcgctct

SEQ ID NO: 9327989 - DNA, 22 bp, Homo sapiens
atattataagttatttcaagtt

SEQ ID NO: 9327990 - DNA, 22 bp, Homo sapiens
atattatagacagagtcttctg

SEQ ID NO: 9327991 - DNA, 22 bp, Homo sapiens
atattatagacagagtcttctg

SEQ ID NO: 9327992 - DNA, 22 bp, Homo sapiens
ctgggctgaaggctccccacac

SEQ ID NO: 9327993 - DNA, 22 bp, Homo sapiens
ctgggctgaaagtgttccttga

SEQ ID NO: 9327994 - DNA, 22 bp, Homo sapiens
ctgggctgaaagtgttccttga

SEQ ID NO: 9327995 - DNA, 22 bp, Homo sapiens
ctgggctcttctcaccctgttt

SEQ ID NO: 9327996 - DNA, 22 bp, Homo sapiens
ctgggctctgcggtgtcgctct

SEQ ID NO: 9327997 - DNA, 22 bp, Homo sapiens
ctgggctctgtgtttcagtttc

SEQ ID NO: 9327998 - DNA, 22 bp, Homo sapiens
ctgggctctgtgtttcagtttc

SEQ ID NO: 9327999 - DNA, 19 bp, Homo sapiens
ctgggctgaggtctgcctt

SEQ ID NO: 9328000 - DNA, 19 bp, Homo sapiens
ctgggctgaggtctgcctt

SEQ ID NO: 9328001 - DNA, 22 bp, Homo sapiens
atattcttcttgttcagactat

SEQ ID NO: 9328002 - DNA, 22 bp, Homo sapiens
ctgggctgagctgtggaaactc

SEQ ID NO: 9328003 - DNA, 19 bp, Homo sapiens
ctgggctgaggtctgcctt

SEQ ID NO: 9328004 - DNA, 19 bp, Homo sapiens
ctgggctgaggtctgcctt

SEQ ID NO: 9328005 - DNA, 19 bp, Homo sapiens
ctgggctgaggtctgcctt

SEQ ID NO: 9328006 - DNA, 22 bp, Homo sapiens
ctgggctgaaggctccccacac

SEQ ID NO: 9328007 - DNA, 22 bp, Homo sapiens
ctgggctgagcctgggctgtgt

SEQ ID NO: 9328008 - DNA, 22 bp, Homo sapiens
ctgggctgagcctgggctgtgt

SEQ ID NO: 9328009 - DNA, 22 bp, Homo sapiens
atatgcattaacattgtaggag

SEQ ID NO: 9328010 - DNA, 22 bp, Homo sapiens
atatgcatgcatgcttgtgaga

SEQ ID NO: 9328011 - DNA, 22 bp, Homo sapiens
atatgcattaacattgtaggag

SEQ ID NO: 9328012 - DNA, 22 bp, Homo sapiens
atatgcatgcatgcttgtgaga

SEQ ID NO: 9328013 - DNA, 22 bp, Homo sapiens
atatgtttttggaaagaacaca

SEQ ID NO: 9328014 - DNA, 22 bp, Homo sapiens
atatgccattagctagaaataa

SEQ ID NO: 9328015 - DNA, 22 bp, Homo sapiens
atattataagttatttcaagtt

SEQ ID NO: 9328016 - DNA, 22 bp, Homo sapiens
atattataagttatttcaagtt

SEQ ID NO: 9328017 - DNA, 22 bp, Homo sapiens
atattacataaacatgagtgaa

SEQ ID NO: 9328018 - DNA, 22 bp, Homo sapiens
atattacataaacatgagtgaa

SEQ ID NO: 9328019 - DNA, 22 bp, Homo sapiens
atattacttcctggtataaaat

SEQ ID NO: 9328020 - DNA, 22 bp, Homo sapiens
atattactctgatttagtaaat

SEQ ID NO: 9328021 - DNA, 22 bp, Homo sapiens
atattactctgatttagtaaat

SEQ ID NO: 9328022 - DNA, 22 bp, Homo sapiens
atgtgtctgaccactgtattgg

SEQ ID NO: 9328023 - DNA, 20 bp, Homo sapiens
atgtgtctgcctctgtgttc

SEQ ID NO: 9328024 - DNA, 22 bp, Homo sapiens
atgtgtctggcatggaaagtgt

SEQ ID NO: 9328025 - DNA, 17 bp, Homo sapiens
atgtgtctgagtgtcct

SEQ ID NO: 9328026 - DNA, 22 bp, Homo sapiens
gaggtggcgcgccatccctgcc

SEQ ID NO: 9328027 - DNA, 22 bp, Homo sapiens
atgtgtccttataagaagaaga

SEQ ID NO: 9328028 - DNA, 22 bp, Homo sapiens
gaggtggcgcgccatccctgcc

SEQ ID NO: 9328029 - DNA, 22 bp, Homo sapiens
gaggtggcgcgccatccctgcc

SEQ ID NO: 9328030 - DNA, 22 bp, Homo sapiens
atgtgtccttgttcccattcca

SEQ ID NO: 9328031 - DNA, 22 bp, Homo sapiens
atgtgtctaattccaggagcac

SEQ ID NO: 9328032 - DNA, 22 bp, Homo sapiens
atgtgtctaattccaggagcac

SEQ ID NO: 9328033 - DNA, 22 bp, Homo sapiens
gaggtggccaagcgaggaaggg

SEQ ID NO: 9328034 - DNA, 22 bp, Homo sapiens
gaggtggccaagcgaggaaggg

SEQ ID NO: 9328035 - DNA, 22 bp, Homo sapiens
gaggtggccagagtcaagagcc

SEQ ID NO: 9328036 - DNA, 22 bp, Homo sapiens
gaggtggccagagtcaagagcc

SEQ ID NO: 9328037 - DNA, 22 bp, Homo sapiens
gaggtggcctcaagcagtcttc

SEQ ID NO: 9328038 - DNA, 22 bp, Homo sapiens
gaggtggcctcaagcagtcttc

SEQ ID NO: 9328039 - DNA, 22 bp, Homo sapiens
gaggtggcccttgctcagcctt

SEQ ID NO: 9328040 - DNA, 22 bp, Homo sapiens
gaggtggcccttgctcagcctt

SEQ ID NO: 9328041 - DNA, 22 bp, Homo sapiens
gaggtggcactgtgaggagcac

SEQ ID NO: 9328042 - DNA, 22 bp, Homo sapiens
gaggtggcagaggcctggacct

SEQ ID NO: 9328043 - DNA, 22 bp, Homo sapiens
gaggtggcattaagattctggt

SEQ ID NO: 9328044 - DNA, 22 bp, Homo sapiens
gaggtggcactgtgaggagcac

SEQ ID NO: 9328045 - DNA, 22 bp, Homo sapiens
gaggtggcactgtgaggagcac

SEQ ID NO: 9328046 - DNA, 22 bp, Homo sapiens
gaggtggcactgtgaggagcac

SEQ ID NO: 9328047 - DNA, 22 bp, Homo sapiens
gaggtggcaatttaatgcagtc

SEQ ID NO: 9328048 - DNA, 22 bp, Homo sapiens
atgttgaactaggatctcttga

SEQ ID NO: 9328049 - DNA, 22 bp, Homo sapiens
atgttctttgtgattctgagct

SEQ ID NO: 9328050 - DNA, 22 bp, Homo sapiens
atgttctttcagccagtgcatc

SEQ ID NO: 9328051 - DNA, 22 bp, Homo sapiens
atgttcttgttcaaatgtcagt

SEQ ID NO: 9328052 - DNA, 22 bp, Homo sapiens
atgttcttccaaatctgtaaca

SEQ ID NO: 9328053 - DNA, 22 bp, Homo sapiens
atgttcttagcaaagtacttgc

SEQ ID NO: 9328054 - DNA, 20 bp, Homo sapiens
atgtgtcttagagcatcagg

SEQ ID NO: 9328055 - DNA, 22 bp, Homo sapiens
atgtgtctggcatggctctatt

SEQ ID NO: 9328056 - DNA, 22 bp, Homo sapiens
atgtgtctggcatggctctatt

SEQ ID NO: 9328057 - DNA, 22 bp, Homo sapiens
gatatatttggaccagagcatt

SEQ ID NO: 9328058 - DNA, 22 bp, Homo sapiens
gatatattttccatggtctgca

SEQ ID NO: 9328059 - DNA, 22 bp, Homo sapiens
gatatattttccatggtctgca

SEQ ID NO: 9328060 - DNA, 22 bp, Homo sapiens
gatacacaaaagtctagtgagg

SEQ ID NO: 9328061 - DNA, 22 bp, Homo sapiens
gatacaaattcatgtctgaatt

SEQ ID NO: 9328062 - DNA, 22 bp, Homo sapiens
gatatcattgagcccaggagtt

SEQ ID NO: 9328063 - DNA, 22 bp, Homo sapiens
gatatgtaccacctcttaaaag

SEQ ID NO: 9328064 - DNA, 22 bp, Homo sapiens
gatatgtaccacctcttaaaag

SEQ ID NO: 9328065 - DNA, 18 bp, Homo sapiens
gatatggaaggccatgcc

SEQ ID NO: 9328066 - DNA, 18 bp, Homo sapiens
gatatggaaggccatgcc

SEQ ID NO: 9328067 - DNA, 22 bp, Homo sapiens
gatatgaagtggcattgtgaag

SEQ ID NO: 9328068 - DNA, 22 bp, Homo sapiens
gatatgcacattcaaaaattgc

SEQ ID NO: 9328069 - DNA, 18 bp, Homo sapiens
gatatggaaggccatgcc

SEQ ID NO: 9328070 - DNA, 22 bp, Homo sapiens
gatacaaattcatgtctgaatt

SEQ ID NO: 9328071 - DNA, 22 bp, Homo sapiens
gatacaaaatataaatggagag

SEQ ID NO: 9328072 - DNA, 22 bp, Homo sapiens
gatacaaaatataaatggagag

SEQ ID NO: 9328073 - DNA, 22 bp, Homo sapiens
gataattttagtctgaaaattg

SEQ ID NO: 9328074 - DNA, 22 bp, Homo sapiens
gataatttctccatctcaaggt

SEQ ID NO: 9328075 - DNA, 22 bp, Homo sapiens
gataatgtggatttattgtgat

SEQ ID NO: 9328076 - DNA, 22 bp, Homo sapiens
gataatgtgccgataatttcta

SEQ ID NO: 9328077 - DNA, 22 bp, Homo sapiens
gataatggggaatgataagtca

SEQ ID NO: 9328078 - DNA, 22 bp, Homo sapiens
atgtttaatcggctgcctttcc

SEQ ID NO: 9328079 - DNA, 22 bp, Homo sapiens
gataatgatgacaatgacaacc

SEQ ID NO: 9328080 - DNA, 22 bp, Homo sapiens
atgtttaagaaagtcttccata

SEQ ID NO: 9328081 - DNA, 22 bp, Homo sapiens
atgtttaaggaactggtttgct

SEQ ID NO: 9328082 - DNA, 22 bp, Homo sapiens
atgtttaaggaactggtttgct

SEQ ID NO: 9328083 - DNA, 22 bp, Homo sapiens
atgttgtattatgttattgtct

SEQ ID NO: 9328084 - DNA, 22 bp, Homo sapiens
atgttgtaggtctcatggtaca

SEQ ID NO: 9328085 - DNA, 22 bp, Homo sapiens
atgttgtgtttgactgttaccc

SEQ ID NO: 9328086 - DNA, 22 bp, Homo sapiens
atgttgttaaatgggtgtattt

SEQ ID NO: 9328087 - DNA, 22 bp, Homo sapiens
atgttgttccctctacacaggt

SEQ ID NO: 9328088 - DNA, 22 bp, Homo sapiens
atgttgttgaactctttgcatg

SEQ ID NO: 9328089 - DNA, 22 bp, Homo sapiens
atgttgttttttcataaagtat

SEQ ID NO: 9328090 - DNA, 22 bp, Homo sapiens
atgttgtttttgtcccagaagg

SEQ ID NO: 9328091 - DNA, 20 bp, Homo sapiens
atgttgtttactcatagcat

SEQ ID NO: 9328092 - DNA, 22 bp, Homo sapiens
atgttgttttttcataaagtat

SEQ ID NO: 9328093 - DNA, 22 bp, Homo sapiens
atgttgtagcatatgaaatata

SEQ ID NO: 9328094 - DNA, 22 bp, Homo sapiens
atgttggagtcgtaaggcatgg

SEQ ID NO: 9328095 - DNA, 21 bp, Homo sapiens
atgttggaatccaaaaacatt

SEQ ID NO: 9328096 - DNA, 22 bp, Homo sapiens
atgtccttttaaaatgtgagaa

SEQ ID NO: 9328097 - DNA, 22 bp, Homo sapiens
atgtctatggaatttccacaca

SEQ ID NO: 9328098 - DNA, 22 bp, Homo sapiens
atgtctatgttctttactgtgt

SEQ ID NO: 9328099 - DNA, 22 bp, Homo sapiens
atgtctatatagtcaataatca

SEQ ID NO: 9328100 - DNA, 22 bp, Homo sapiens
atgtctctcaggtttaacttta

SEQ ID NO: 9328101 - DNA, 22 bp, Homo sapiens
atgtctctcaggtttaacttta

SEQ ID NO: 9328102 - DNA, 22 bp, Homo sapiens
atgtctctgccccagagagctt

SEQ ID NO: 9328103 - DNA, 22 bp, Homo sapiens
atgtctctctctgagtgccaga

SEQ ID NO: 9328104 - DNA, 22 bp, Homo sapiens
atgtccttaatctgaatgttag

SEQ ID NO: 9328105 - DNA, 20 bp, Homo sapiens
atgtcctgcttctcctcacc

SEQ ID NO: 9328106 - DNA, 22 bp, Homo sapiens
atgtcctggagcagaggcaagg

SEQ ID NO: 9328107 - DNA, 21 bp, Homo sapiens
atgtcctggctaccagcgcag

SEQ ID NO: 9328108 - DNA, 22 bp, Homo sapiens
atgtcctggcccgaggatggag

SEQ ID NO: 9328109 - DNA, 22 bp, Homo sapiens
atgtcctgctgattcacattat

SEQ ID NO: 9328110 - DNA, 23 bp, Homo sapiens
atgtcctgcatagttgcttctgt

SEQ ID NO: 9328111 - DNA, 22 bp, Homo sapiens
atgtcctggtctagcttccggg

SEQ ID NO: 9328112 - DNA, 22 bp, Homo sapiens
atgtcctggtcctccaccatgg

SEQ ID NO: 9328113 - DNA, 22 bp, Homo sapiens
atgtcctgggctgggttatgtt

SEQ ID NO: 9328114 - DNA, 22 bp, Homo sapiens
atgtcctggggtcttctcttca

SEQ ID NO: 9328115 - DNA, 20 bp, Homo sapiens
atgtcctgttgctgccccag

SEQ ID NO: 9328116 - DNA, 23 bp, Homo sapiens
atgtcctgtgatgcttaatgacc

SEQ ID NO: 9328117 - DNA, 22 bp, Homo sapiens
atgtcctgttaaatagattgta

SEQ ID NO: 9328118 - DNA, 22 bp, Homo sapiens
atgtcctgttttggcttgctct

SEQ ID NO: 9328119 - DNA, 22 bp, Homo sapiens
atgtcctcggctctgtgctgct

SEQ ID NO: 9328120 - DNA, 22 bp, Homo sapiens
atgtcctcttctgcctcaggcc

SEQ ID NO: 9328121 - DNA, 22 bp, Homo sapiens
atgtcctcttctgcctcaggcc

SEQ ID NO: 9328122 - DNA, 20 bp, Homo sapiens
atgtcctcagccactgccct

SEQ ID NO: 9328123 - DNA, 22 bp, Homo sapiens
atgtcctcaaaactgattgcag

SEQ ID NO: 9328124 - DNA, 22 bp, Homo sapiens
atgtccctgagggtctctctga

SEQ ID NO: 9328125 - DNA, 22 bp, Homo sapiens
atgtagctgcagatgataatgc

SEQ ID NO: 9328126 - DNA, 20 bp, Homo sapiens
atgtagcagtgtgctgggaa

SEQ ID NO: 9328127 - DNA, 22 bp, Homo sapiens
atgtagaagtgggcattataga

SEQ ID NO: 9328128 - DNA, 22 bp, Homo sapiens
atgtagaagctgacagtgctgt

SEQ ID NO: 9328129 - DNA, 22 bp, Homo sapiens
atgtagaagctgacagtgctgt

SEQ ID NO: 9328130 - DNA, 22 bp, Homo sapiens
atgtagaagtgggcattataga

SEQ ID NO: 9328131 - DNA, 22 bp, Homo sapiens
atgtagagtagaatagtacaac

SEQ ID NO: 9328132 - DNA, 22 bp, Homo sapiens
atgtagagctccttgatcctcc

SEQ ID NO: 9328133 - DNA, 22 bp, Homo sapiens
atgtagaattccttctactttg

SEQ ID NO: 9328134 - DNA, 22 bp, Homo sapiens
atgtagaaattaggatgatagt

SEQ ID NO: 9328135 - DNA, 22 bp, Homo sapiens
atgtagaaagttattttactct

SEQ ID NO: 9328136 - DNA, 22 bp, Homo sapiens
atgtagaaataatttcagttcc

SEQ ID NO: 9328137 - DNA, 22 bp, Homo sapiens
atgtagaaagttcatagatgcg

SEQ ID NO: 9328138 - DNA, 22 bp, Homo sapiens
gaggcagcgggtcaggaccgtg

SEQ ID NO: 9328139 - DNA, 22 bp, Homo sapiens
gaggcagcgggtcaggaccgtg

SEQ ID NO: 9328140 - DNA, 22 bp, Homo sapiens
atgtgagggctcaggctgactg

SEQ ID NO: 9328141 - DNA, 22 bp, Homo sapiens
atgtgagggctcaggctgactg

SEQ ID NO: 9328142 - DNA, 22 bp, Homo sapiens
gaggtggatgttgcagtgagct

SEQ ID NO: 9328143 - DNA, 23 bp, Homo sapiens
gaggtggcaatgagggcagttgg

SEQ ID NO: 9328144 - DNA, 20 bp, Homo sapiens
gaggtagggcttaaggcaag

SEQ ID NO: 9328145 - DNA, 22 bp, Homo sapiens
atgtgagatgcacataattata

SEQ ID NO: 9328146 - DNA, 22 bp, Homo sapiens
atgtgacagtgtttgacagatg

SEQ ID NO: 9328147 - DNA, 22 bp, Homo sapiens
gagggctgaagattgtggcccc

SEQ ID NO: 9328148 - DNA, 22 bp, Homo sapiens
atgtgaaacgcaatgggatcat

SEQ ID NO: 9328149 - DNA, 21 bp, Homo sapiens
atgtgaaatatcatcagagca

SEQ ID NO: 9328150 - DNA, 22 bp, Homo sapiens
atgtgaatgcagttatctataa

SEQ ID NO: 9328151 - DNA, 22 bp, Homo sapiens
gagggcagaaaattatgcggtg

SEQ ID NO: 9328152 - DNA, 22 bp, Homo sapiens
gagggcagagacagtgattcac

SEQ ID NO: 9328153 - DNA, 22 bp, Homo sapiens
gagggcagagacagtgattcac

SEQ ID NO: 9328154 - DNA, 22 bp, Homo sapiens
gagggctcaactactactaggc

SEQ ID NO: 9328155 - DNA, 22 bp, Homo sapiens
atgtctgcaaatatctgccagt

SEQ ID NO: 9328156 - DNA, 22 bp, Homo sapiens
atgtctctttactcttagaacc

SEQ ID NO: 9328157 - DNA, 22 bp, Homo sapiens
atgtctctttactcttagaacc

SEQ ID NO: 9328158 - DNA, 19 bp, Homo sapiens
atgtctctgtagcacatac

SEQ ID NO: 9328159 - DNA, 19 bp, Homo sapiens
atgtctctgtagcacatac

SEQ ID NO: 9328160 - DNA, 19 bp, Homo sapiens
atgtctctgtagcacatac

SEQ ID NO: 9328161 - DNA, 22 bp, Homo sapiens
gagggctgaagattgtggcccc

SEQ ID NO: 9328162 - DNA, 22 bp, Homo sapiens
gagggctgaagattgtggcccc

SEQ ID NO: 9328163 - DNA, 23 bp, Homo sapiens
gagggctctgagtgcttgggcca

SEQ ID NO: 9328164 - DNA, 22 bp, Homo sapiens
gagggctcactgagaaagcagt

SEQ ID NO: 9328165 - DNA, 22 bp, Homo sapiens
gagggctccacacgggcccagc

SEQ ID NO: 9328166 - DNA, 22 bp, Homo sapiens
gagggctccattccccgtgccc

SEQ ID NO: 9328167 - DNA, 22 bp, Homo sapiens
gagatggggaataggagcaagc

SEQ ID NO: 9328168 - DNA, 22 bp, Homo sapiens
gagatggggaataggagcaagc

SEQ ID NO: 9328169 - DNA, 22 bp, Homo sapiens
gagatggggtcagctgggacat

SEQ ID NO: 9328170 - DNA, 22 bp, Homo sapiens
gagatggggtcagctgggacat

SEQ ID NO: 9328171 - DNA, 22 bp, Homo sapiens
gagatggggtcttgctatgttg

SEQ ID NO: 9328172 - DNA, 17 bp, Homo sapiens
gagatgggtggatcacc

SEQ ID NO: 9328173 - DNA, 17 bp, Homo sapiens
gagatgggtggatcacc

SEQ ID NO: 9328174 - DNA, 17 bp, Homo sapiens
gagatgggtggatcacc

SEQ ID NO: 9328175 - DNA, 22 bp, Homo sapiens
gagatggggtcttgctatgttg

SEQ ID NO: 9328176 - DNA, 22 bp, Homo sapiens
gagatggggtcttgctatgttg

SEQ ID NO: 9328177 - DNA, 17 bp, Homo sapiens
gagatgggtggatcacc

SEQ ID NO: 9328178 - DNA, 22 bp, Homo sapiens
atggcattcacatttccagaga

SEQ ID NO: 9328179 - DNA, 22 bp, Homo sapiens
atggcattgcaagggcaggagg

SEQ ID NO: 9328180 - DNA, 22 bp, Homo sapiens
gagatggtagcctcagaagagt

SEQ ID NO: 9328181 - DNA, 22 bp, Homo sapiens
atggccaagcatatacagattg

SEQ ID NO: 9328182 - DNA, 22 bp, Homo sapiens
atggccagagaaggcagggtca

SEQ ID NO: 9328183 - DNA, 22 bp, Homo sapiens
atggccagagaaggcagggtca

SEQ ID NO: 9328184 - DNA, 22 bp, Homo sapiens
atggccagagaaggcagggtca

SEQ ID NO: 9328185 - DNA, 22 bp, Homo sapiens
atggccagagagagcacacctg

SEQ ID NO: 9328186 - DNA, 22 bp, Homo sapiens
atggctggcatccaggtgggct

SEQ ID NO: 9328187 - DNA, 22 bp, Homo sapiens
atggctggcatccaggtgggct

SEQ ID NO: 9328188 - DNA, 22 bp, Homo sapiens
atggctgtgttgttcctctgaa

SEQ ID NO: 9328189 - DNA, 21 bp, Homo sapiens
atggccagatctattaggtgg

SEQ ID NO: 9328190 - DNA, 22 bp, Homo sapiens
atggctggcatccaggtgggct

SEQ ID NO: 9328191 - DNA, 22 bp, Homo sapiens
atggccagagagagcacacctg

SEQ ID NO: 9328192 - DNA, 22 bp, Homo sapiens
atggccagagaggccagcctgg

SEQ ID NO: 9328193 - DNA, 22 bp, Homo sapiens
atggcttcatcttttagtcctt

SEQ ID NO: 9328194 - DNA, 22 bp, Homo sapiens
atggcttccaaggccctccgtg

SEQ ID NO: 9328195 - DNA, 22 bp, Homo sapiens
atggcttctcgctggcacctgt

SEQ ID NO: 9328196 - DNA, 21 bp, Homo sapiens
atggcttctcaggtgcactga

SEQ ID NO: 9328197 - DNA, 22 bp, Homo sapiens
atggcttcgagtatatacatag

SEQ ID NO: 9328198 - DNA, 22 bp, Homo sapiens
atggctttctgtgtttccgtag

SEQ ID NO: 9328199 - DNA, 22 bp, Homo sapiens
atgggaaagaagccactgccca

SEQ ID NO: 9328200 - DNA, 22 bp, Homo sapiens
atggctttccggactttggcca

SEQ ID NO: 9328201 - DNA, 22 bp, Homo sapiens
atggcttgcagagaaaagaggt

SEQ ID NO: 9328202 - DNA, 22 bp, Homo sapiens
gagagagaagtgggtgtcacct

SEQ ID NO: 9328203 - DNA, 22 bp, Homo sapiens
gagagagaagtgggtgtcacct

SEQ ID NO: 9328204 - DNA, 22 bp, Homo sapiens
gagagagaggtgctgccaggca

SEQ ID NO: 9328205 - DNA, 22 bp, Homo sapiens
gactgggctccaagagggagag

SEQ ID NO: 9328206 - DNA, 22 bp, Homo sapiens
gactggggctctagccaggcct

SEQ ID NO: 9328207 - DNA, 22 bp, Homo sapiens
gactgggctccaagagggagag

SEQ ID NO: 9328208 - DNA, 22 bp, Homo sapiens
gactggggctctagccaggcct

SEQ ID NO: 9328209 - DNA, 22 bp, Homo sapiens
gagagaggcctccatgtactga

SEQ ID NO: 9328210 - DNA, 22 bp, Homo sapiens
gagagaggcctccatgtactga

SEQ ID NO: 9328211 - DNA, 22 bp, Homo sapiens
gagagaggcctccatgtactga

SEQ ID NO: 9328212 - DNA, 22 bp, Homo sapiens
gagagaggcctccatgtactga

SEQ ID NO: 9328213 - DNA, 22 bp, Homo sapiens
gagagagctctgtgcctgggat

SEQ ID NO: 9328214 - DNA, 22 bp, Homo sapiens
gagagagctctgtgcctgggat

SEQ ID NO: 9328215 - DNA, 23 bp, Homo sapiens
gagagagattgctaaaccactcc

SEQ ID NO: 9328216 - DNA, 22 bp, Homo sapiens
gagagatccagactgtgggtga

SEQ ID NO: 9328217 - DNA, 22 bp, Homo sapiens
gagagcaatggggacgggcagg

SEQ ID NO: 9328218 - DNA, 22 bp, Homo sapiens
gagagcagactctcaaagctgg

SEQ ID NO: 9328219 - DNA, 22 bp, Homo sapiens
gagagcagactctcaaagctgg

SEQ ID NO: 9328220 - DNA, 17 bp, Homo sapiens
atggaggcagacaggtc

SEQ ID NO: 9328221 - DNA, 17 bp, Homo sapiens
atggaggcagacaggtc

SEQ ID NO: 9328222 - DNA, 17 bp, Homo sapiens
atggaggcagacaggtc

SEQ ID NO: 9328223 - DNA, 22 bp, Homo sapiens
atggagggaaaagtggagagcc

SEQ ID NO: 9328224 - DNA, 22 bp, Homo sapiens
atggagggaaaagtggagagcc

SEQ ID NO: 9328225 - DNA, 18 bp, Homo sapiens
atggaggcagagagctga

SEQ ID NO: 9328226 - DNA, 18 bp, Homo sapiens
atggaggcagagagctga

SEQ ID NO: 9328227 - DNA, 18 bp, Homo sapiens
atggaggcagagagctga

SEQ ID NO: 9328228 - DNA, 21 bp, Homo sapiens
atggagggaccagggaagcag

SEQ ID NO: 9328229 - DNA, 22 bp, Homo sapiens
atggagggaaaagtggagagcc

SEQ ID NO: 9328230 - DNA, 22 bp, Homo sapiens
atggagggaaaagtggagagcc

SEQ ID NO: 9328231 - DNA, 22 bp, Homo sapiens
atggagggtggtaagacagaga

SEQ ID NO: 9328232 - DNA, 22 bp, Homo sapiens
atggagggtggtaagacagaga

SEQ ID NO: 9328233 - DNA, 21 bp, Homo sapiens
atggagggaccagggaagcag

SEQ ID NO: 9328234 - DNA, 21 bp, Homo sapiens
atggagggaccagggaagcag

SEQ ID NO: 9328235 - DNA, 22 bp, Homo sapiens
gagatggccagtgccaggacaa

SEQ ID NO: 9328236 - DNA, 17 bp, Homo sapiens
gagatggcattggcagc

SEQ ID NO: 9328237 - DNA, 22 bp, Homo sapiens
gagatggccagtgccaggacaa

SEQ ID NO: 9328238 - DNA, 22 bp, Homo sapiens
gagagtattacaaattttacaa

SEQ ID NO: 9328239 - DNA, 22 bp, Homo sapiens
gagaggttgaacaacatactct

SEQ ID NO: 9328240 - DNA, 22 bp, Homo sapiens
atggagggtggtaagacagaga

SEQ ID NO: 9328241 - DNA, 21 bp, Homo sapiens
gagatggcccagtagcgggcc

SEQ ID NO: 9328242 - DNA, 21 bp, Homo sapiens
gagatggcccagtagcgggcc

SEQ ID NO: 9328243 - DNA, 22 bp, Homo sapiens
gagatggccctggcatgtagct

SEQ ID NO: 9328244 - DNA, 22 bp, Homo sapiens
gagatggccctggcatgtagct

SEQ ID NO: 9328245 - DNA, 23 bp, Homo sapiens
gagatggctggttgtcctctgaa

SEQ ID NO: 9328246 - DNA, 23 bp, Homo sapiens
gagatggctggttgtcctctgaa

SEQ ID NO: 9328247 - DNA, 22 bp, Homo sapiens
gagatggccctggcatgtagct

SEQ ID NO: 9328248 - DNA, 20 bp, Homo sapiens
gagatggctaagtgctgaac

SEQ ID NO: 9328249 - DNA, 20 bp, Homo sapiens
gagatggctaagtgctgaac

SEQ ID NO: 9328250 - DNA, 22 bp, Homo sapiens
gagatgggcgagaaggtggact

SEQ ID NO: 9328251 - DNA, 22 bp, Homo sapiens
gagatgggcgagaaggtggact

SEQ ID NO: 9328252 - DNA, 22 bp, Homo sapiens
gagatgggcgagaaggtggact

SEQ ID NO: 9328253 - DNA, 22 bp, Homo sapiens
gaggagaagctaagaaacacag

SEQ ID NO: 9328254 - DNA, 22 bp, Homo sapiens
gaggagaagctaagaaacacag

SEQ ID NO: 9328255 - DNA, 22 bp, Homo sapiens
gaggagaagctaagaaacacag

SEQ ID NO: 9328256 - DNA, 22 bp, Homo sapiens
gaggagaagctattggaaggac

SEQ ID NO: 9328257 - DNA, 22 bp, Homo sapiens
gaggagaagctattggaaggac

SEQ ID NO: 9328258 - DNA, 22 bp, Homo sapiens
gaggagaagctattggaaggac

SEQ ID NO: 9328259 - DNA, 22 bp, Homo sapiens
atggggctagacaaccagtgcc

SEQ ID NO: 9328260 - DNA, 22 bp, Homo sapiens
gaggaaggctaaggggcttaga

SEQ ID NO: 9328261 - DNA, 22 bp, Homo sapiens
gaggaaggctaaggggcttaga

SEQ ID NO: 9328262 - DNA, 22 bp, Homo sapiens
gaggagaaattatccttggtgt

SEQ ID NO: 9328263 - DNA, 22 bp, Homo sapiens
gaggagaaattatccttggtgt

SEQ ID NO: 9328264 - DNA, 22 bp, Homo sapiens
gaggagaagctaagaaacacag

SEQ ID NO: 9328265 - DNA, 22 bp, Homo sapiens
gaggagaaatttggggacctga

SEQ ID NO: 9328266 - DNA, 22 bp, Homo sapiens
gaggagaagggcacggagaaaa

SEQ ID NO: 9328267 - DNA, 18 bp, Homo sapiens
atggtctcatactgggag

SEQ ID NO: 9328268 - DNA, 22 bp, Homo sapiens
atggtctgctgagtcatgaggc

SEQ ID NO: 9328269 - DNA, 22 bp, Homo sapiens
atggtctgttaggagctacttt

SEQ ID NO: 9328270 - DNA, 22 bp, Homo sapiens
atggtctgttaggagctacttt

SEQ ID NO: 9328271 - DNA, 18 bp, Homo sapiens
atggtctcatactgggag

SEQ ID NO: 9328272 - DNA, 18 bp, Homo sapiens
atggtctcatactgggag

SEQ ID NO: 9328273 - DNA, 21 bp, Homo sapiens
atggtctgaggatagcaaaaa

SEQ ID NO: 9328274 - DNA, 22 bp, Homo sapiens
atggtctgaatgtgtgctccaa

SEQ ID NO: 9328275 - DNA, 22 bp, Homo sapiens
atggtctgatgtcccatggctt

SEQ ID NO: 9328276 - DNA, 21 bp, Homo sapiens
atggtgagatactgggtgtgg

SEQ ID NO: 9328277 - DNA, 22 bp, Homo sapiens
atggtgaagcttcatgggtgtt

SEQ ID NO: 9328278 - DNA, 22 bp, Homo sapiens
atggtgtacagccagatgtaga

SEQ ID NO: 9328279 - DNA, 21 bp, Homo sapiens
atggtggcacaaatttgatct

SEQ ID NO: 9328280 - DNA, 22 bp, Homo sapiens
atggtggaggtgtattctggat

SEQ ID NO: 9328281 - DNA, 22 bp, Homo sapiens
gaggcacatatatacagagccc

SEQ ID NO: 9328282 - DNA, 22 bp, Homo sapiens
gaggcacatatatacagagccc

SEQ ID NO: 9328283 - DNA, 22 bp, Homo sapiens
atggttaaattggttatttatg

SEQ ID NO: 9328284 - DNA, 22 bp, Homo sapiens
gaggcagcctcagtggacctcg

SEQ ID NO: 9328285 - DNA, 22 bp, Homo sapiens
gaggcagcctcagtggacctcg

SEQ ID NO: 9328286 - DNA, 22 bp, Homo sapiens
gaggcagcctcagtggacctcg

SEQ ID NO: 9328287 - DNA, 22 bp, Homo sapiens
gaggcagcctcagtggacctcg

SEQ ID NO: 9328288 - DNA, 22 bp, Homo sapiens
gaggcagcatggtaccttggag

SEQ ID NO: 9328289 - DNA, 22 bp, Homo sapiens
gaggcagcatctatggtgggaa

SEQ ID NO: 9328290 - DNA, 22 bp, Homo sapiens
gaggcagcattcgcatagacag

SEQ ID NO: 9328291 - DNA, 22 bp, Homo sapiens
gaggcagcattcgcatagacag

SEQ ID NO: 9328292 - DNA, 23 bp, Homo sapiens
atgggcttagaaagcaagtggga

SEQ ID NO: 9328293 - DNA, 23 bp, Homo sapiens
atgggcttagaaagcaagtggga

SEQ ID NO: 9328294 - DNA, 23 bp, Homo sapiens
atgggcttagaaagcaagtggga

SEQ ID NO: 9328295 - DNA, 22 bp, Homo sapiens
atggggaagagccagtgagctg

SEQ ID NO: 9328296 - DNA, 22 bp, Homo sapiens
atgggcttggcgacaatttgaa

SEQ ID NO: 9328297 - DNA, 22 bp, Homo sapiens
atgggcttgaccctacagaaag

SEQ ID NO: 9328298 - DNA, 22 bp, Homo sapiens
atggggagagaagggctgagct

SEQ ID NO: 9328299 - DNA, 22 bp, Homo sapiens
atggggagagaagggctgagct

SEQ ID NO: 9328300 - DNA, 22 bp, Homo sapiens
atggggcagaggttaaaggtgg

SEQ ID NO: 9328301 - DNA, 22 bp, Homo sapiens
atgggctggggaagctcactcc

SEQ ID NO: 9328302 - DNA, 20 bp, Homo sapiens
atgggctggttaggaagtgt

SEQ ID NO: 9328303 - DNA, 22 bp, Homo sapiens
atgggctgtccattgctggctg

SEQ ID NO: 9328304 - DNA, 22 bp, Homo sapiens
atgggctgtcctagtccagccc

SEQ ID NO: 9328305 - DNA, 22 bp, Homo sapiens
atgggctgggatctgagtgtca

SEQ ID NO: 9328306 - DNA, 22 bp, Homo sapiens
atgggctggggaagctcactcc

SEQ ID NO: 9328307 - DNA, 22 bp, Homo sapiens
atgggctgggatctgagtgtca

SEQ ID NO: 9328308 - DNA, 22 bp, Homo sapiens
atgggctgggatctgagtgtca

SEQ ID NO: 9328309 - DNA, 22 bp, Homo sapiens
atgggctgcttctccagcacct

SEQ ID NO: 9328310 - DNA, 22 bp, Homo sapiens
atgggctgggaatacacagggg

SEQ ID NO: 9328311 - DNA, 22 bp, Homo sapiens
atgggagaaacatcatgaggca

SEQ ID NO: 9328312 - DNA, 22 bp, Homo sapiens
atgggacatagatccttgaggt

SEQ ID NO: 9328313 - DNA, 22 bp, Homo sapiens
atgggacaggtactagaaaggg

SEQ ID NO: 9328314 - DNA, 22 bp, Homo sapiens
atgggacagggctggctggtcc

SEQ ID NO: 9328315 - DNA, 22 bp, Homo sapiens
atgggacacagtccgccctcta

SEQ ID NO: 9328316 - DNA, 22 bp, Homo sapiens
atgggaagctgacctgcatgga

SEQ ID NO: 9328317 - DNA, 19 bp, Homo sapiens
atgggaagcggccagcgga

SEQ ID NO: 9328318 - DNA, 22 bp, Homo sapiens
atgggaaggttttgagagcggg

SEQ ID NO: 9328319 - DNA, 22 bp, Homo sapiens
atgggaagtgaagtcagggagg

SEQ ID NO: 9328320 - DNA, 22 bp, Homo sapiens
atgggctgaggaagctcctgag

SEQ ID NO: 9328321 - DNA, 22 bp, Homo sapiens
atgggctgaggtgggatagaag

SEQ ID NO: 9328322 - DNA, 22 bp, Homo sapiens
atgggctgacccagtcgtggca

SEQ ID NO: 9328323 - DNA, 22 bp, Homo sapiens
atgggctgaggaagctcctgag

SEQ ID NO: 9328324 - DNA, 22 bp, Homo sapiens
atgggctgacccagtcgtggca

SEQ ID NO: 9328325 - DNA, 22 bp, Homo sapiens
atgggctgacccagtcgtggca

SEQ ID NO: 9328326 - DNA, 22 bp, Homo sapiens
atgggagaaacatcatgaggca

SEQ ID NO: 9328327 - DNA, 22 bp, Homo sapiens
atgggagaaacatcatgaggca

SEQ ID NO: 9328328 - DNA, 22 bp, Homo sapiens
atgggagaaacatcatgaggca

SEQ ID NO: 9328329 - DNA, 22 bp, Homo sapiens
atgggctgacaagacatgcata

SEQ ID NO: 9328330 - DNA, 22 bp, Homo sapiens
atgggctgaaagagtaagctgt

SEQ ID NO: 9328331 - DNA, 22 bp, Homo sapiens
ctttccaggaatcctcacagcc

SEQ ID NO: 9328332 - DNA, 22 bp, Homo sapiens
ctttccaggaatcctcacagcc

SEQ ID NO: 9328333 - DNA, 19 bp, Homo sapiens
ctttccagctcgagcaatt

SEQ ID NO: 9328334 - DNA, 22 bp, Homo sapiens
ctttccagcatttccttgtgaa

SEQ ID NO: 9328335 - DNA, 19 bp, Homo sapiens
ctttccagctcgagcaatt

SEQ ID NO: 9328336 - DNA, 22 bp, Homo sapiens
ctttccaggacttgcatttctg

SEQ ID NO: 9328337 - DNA, 22 bp, Homo sapiens
ctttccaggaatcctcacagcc

SEQ ID NO: 9328338 - DNA, 19 bp, Homo sapiens
ctttccaggagatgctgag

SEQ ID NO: 9328339 - DNA, 19 bp, Homo sapiens
ctttccaggagatgctgag

SEQ ID NO: 9328340 - DNA, 22 bp, Homo sapiens
ctttccaggacttgcatttctg

SEQ ID NO: 9328341 - DNA, 22 bp, Homo sapiens
ctttccaggctgagtttgcttg

SEQ ID NO: 9328342 - DNA, 22 bp, Homo sapiens
ctttccaggctgagtttgcttg

SEQ ID NO: 9328343 - DNA, 22 bp, Homo sapiens
ctttccaggctgagtttgcttg

SEQ ID NO: 9328344 - DNA, 22 bp, Homo sapiens
ctttccaggtctaaaggcaggg

SEQ ID NO: 9328345 - DNA, 22 bp, Homo sapiens
ctttccaggtctaaaggcaggg

SEQ ID NO: 9328346 - DNA, 22 bp, Homo sapiens
ctttccagtaccaggaagcgga

SEQ ID NO: 9328347 - DNA, 22 bp, Homo sapiens
ctttccagtaccaggaagcgga

SEQ ID NO: 9328348 - DNA, 22 bp, Homo sapiens
ctttccagatttgtccagttat

SEQ ID NO: 9328349 - DNA, 22 bp, Homo sapiens
ctttccagcatttccttgtgaa

SEQ ID NO: 9328350 - DNA, 22 bp, Homo sapiens
ctttcaagctcgcccccgctct

SEQ ID NO: 9328351 - DNA, 22 bp, Homo sapiens
ctttcaaagaccttggcatggg

SEQ ID NO: 9328352 - DNA, 22 bp, Homo sapiens
atctggctcacctgggtaaata

SEQ ID NO: 9328353 - DNA, 22 bp, Homo sapiens
atctggctatttctggtcgggg

SEQ ID NO: 9328354 - DNA, 22 bp, Homo sapiens
ctttcctagaaatatatactta

SEQ ID NO: 9328355 - DNA, 22 bp, Homo sapiens
ctttcctagtagttacagaatg

SEQ ID NO: 9328356 - DNA, 22 bp, Homo sapiens
ctttcctagatggccatctttc

SEQ ID NO: 9328357 - DNA, 22 bp, Homo sapiens
ctttcctagatggccatctttc

SEQ ID NO: 9328358 - DNA, 22 bp, Homo sapiens
ctttccagtttctaagtacagt

SEQ ID NO: 9328359 - DNA, 22 bp, Homo sapiens
ctttccagtttctaagtacagt

SEQ ID NO: 9328360 - DNA, 22 bp, Homo sapiens
ctttcccttagccccattctat

SEQ ID NO: 9328361 - DNA, 22 bp, Homo sapiens
ctttcccttagccccattctat

SEQ ID NO: 9328362 - DNA, 22 bp, Homo sapiens
ctttcccttagccccattctat

SEQ ID NO: 9328363 - DNA, 22 bp, Homo sapiens
cttcttgttttagccctcatac

SEQ ID NO: 9328364 - DNA, 22 bp, Homo sapiens
cttctttaatgtatacaaaaga

SEQ ID NO: 9328365 - DNA, 22 bp, Homo sapiens
cttcttgtgctgggccagcttc

SEQ ID NO: 9328366 - DNA, 22 bp, Homo sapiens
atctggagatcagctggtggca

SEQ ID NO: 9328367 - DNA, 22 bp, Homo sapiens
atctggagcagggccacaaggc

SEQ ID NO: 9328368 - DNA, 22 bp, Homo sapiens
atctggagcaagattaagagat

SEQ ID NO: 9328369 - DNA, 22 bp, Homo sapiens
atctggaggattctgggacttg

SEQ ID NO: 9328370 - DNA, 22 bp, Homo sapiens
atctggagcttgttagatgttt

SEQ ID NO: 9328371 - DNA, 22 bp, Homo sapiens
atctggaggcaaaggggcgtga

SEQ ID NO: 9328372 - DNA, 23 bp, Homo sapiens
atgaacattagtttcagatattg

SEQ ID NO: 9328373 - DNA, 22 bp, Homo sapiens
atgaacatttggtttggcagca

SEQ ID NO: 9328374 - DNA, 22 bp, Homo sapiens
atgaactaagagtcattagtgt

SEQ ID NO: 9328375 - DNA, 22 bp, Homo sapiens
atgaacatgtgactcagacctg

SEQ ID NO: 9328376 - DNA, 22 bp, Homo sapiens
atgaacatctctgatccaagca

SEQ ID NO: 9328377 - DNA, 22 bp, Homo sapiens
atgaacatctctgatccaagca

SEQ ID NO: 9328378 - DNA, 22 bp, Homo sapiens
atgaacattaaaatggtagaat

SEQ ID NO: 9328379 - DNA, 20 bp, Homo sapiens
atgaagacaaatccgacttg

SEQ ID NO: 9328380 - DNA, 22 bp, Homo sapiens
atgaacttatttctgaactttt

SEQ ID NO: 9328381 - DNA, 22 bp, Homo sapiens
atgaactttctttacagttttg

SEQ ID NO: 9328382 - DNA, 22 bp, Homo sapiens
atgaactttctttacagttttg

SEQ ID NO: 9328383 - DNA, 22 bp, Homo sapiens
atgaactgcatgtattttagtg

SEQ ID NO: 9328384 - DNA, 22 bp, Homo sapiens
atgaactcttgctttatttcag

SEQ ID NO: 9328385 - DNA, 22 bp, Homo sapiens
atgaactcatttattttcctct

SEQ ID NO: 9328386 - DNA, 22 bp, Homo sapiens
atgaactcttctggttattttt

SEQ ID NO: 9328387 - DNA, 22 bp, Homo sapiens
atgaagacaggtctcatcacca

SEQ ID NO: 9328388 - DNA, 23 bp, Homo sapiens
atgaagacccgtggtgtccccac

SEQ ID NO: 9328389 - DNA, 22 bp, Homo sapiens
ctttctcttcgaaaacctgccc

SEQ ID NO: 9328390 - DNA, 22 bp, Homo sapiens
ctttctgattttaagctctaat

SEQ ID NO: 9328391 - DNA, 22 bp, Homo sapiens
ctttctggcacagccgcgggat

SEQ ID NO: 9328392 - DNA, 22 bp, Homo sapiens
ctttcttaatttttaaggacac

SEQ ID NO: 9328393 - DNA, 22 bp, Homo sapiens
atgaaacaacagacttggtcaa

SEQ ID NO: 9328394 - DNA, 22 bp, Homo sapiens
atgaaaatgtacatgtgtataa

SEQ ID NO: 9328395 - DNA, 22 bp, Homo sapiens
atgaaaatactgtggttgatag

SEQ ID NO: 9328396 - DNA, 22 bp, Homo sapiens
atgaaaatactgtggttgatag

SEQ ID NO: 9328397 - DNA, 22 bp, Homo sapiens
atgaaacagtgaattagtcaag

SEQ ID NO: 9328398 - DNA, 22 bp, Homo sapiens
atgaaattcatctgagaatgct

SEQ ID NO: 9328399 - DNA, 18 bp, Homo sapiens
atgaacactgagctgaat

SEQ ID NO: 9328400 - DNA, 22 bp, Homo sapiens
atgaacatcggaaatgagactg

SEQ ID NO: 9328401 - DNA, 22 bp, Homo sapiens
atgaacatcctaggaggcattt

SEQ ID NO: 9328402 - DNA, 22 bp, Homo sapiens
gaaacattgtgttctacagatt

SEQ ID NO: 9328403 - DNA, 20 bp, Homo sapiens
gaaacattggcagcaactga

SEQ ID NO: 9328404 - DNA, 22 bp, Homo sapiens
gaaacattcatatgagaaacct

SEQ ID NO: 9328405 - DNA, 22 bp, Homo sapiens
gaaacattcagtcaacagtgtt

SEQ ID NO: 9328406 - DNA, 22 bp, Homo sapiens
gaaacatattaatccagtgaaa

SEQ ID NO: 9328407 - DNA, 22 bp, Homo sapiens
ctttcttctccctcaatattac

SEQ ID NO: 9328408 - DNA, 22 bp, Homo sapiens
ctttcttccatagggcccagtc

SEQ ID NO: 9328409 - DNA, 22 bp, Homo sapiens
ctttcttcatctgtaatatgga

SEQ ID NO: 9328410 - DNA, 22 bp, Homo sapiens
ctttcttcatcaagtgccacgt

SEQ ID NO: 9328411 - DNA, 22 bp, Homo sapiens
ctttctttcgaagacgtgatta

SEQ ID NO: 9328412 - DNA, 22 bp, Homo sapiens
gaaaatgttagcttcatagtca

SEQ ID NO: 9328413 - DNA, 22 bp, Homo sapiens
atgacagatgctgtggggaggt

SEQ ID NO: 9328414 - DNA, 22 bp, Homo sapiens
atgacagctctagcacacagta

SEQ ID NO: 9328415 - DNA, 22 bp, Homo sapiens
atgacaggaggcagctgggcag

SEQ ID NO: 9328416 - DNA, 21 bp, Homo sapiens
atgacagatgctgcagatcgt

SEQ ID NO: 9328417 - DNA, 22 bp, Homo sapiens
atgacataaagctatgctaggt

SEQ ID NO: 9328418 - DNA, 22 bp, Homo sapiens
atgacatatgattctgaagaca

SEQ ID NO: 9328419 - DNA, 22 bp, Homo sapiens
atgacataagtgaaaaacatca

SEQ ID NO: 9328420 - DNA, 22 bp, Homo sapiens
atgacagttctacacttaatct

SEQ ID NO: 9328421 - DNA, 22 bp, Homo sapiens
gaaaggtttaagtaggatttgt

SEQ ID NO: 9328422 - DNA, 22 bp, Homo sapiens
gaaaggtttcatctacttttca

SEQ ID NO: 9328423 - DNA, 22 bp, Homo sapiens
gaaaggttgtaacaagactctt

SEQ ID NO: 9328424 - DNA, 22 bp, Homo sapiens
gaaagcataactaatatttatt

SEQ ID NO: 9328425 - DNA, 22 bp, Homo sapiens
gaaagcagtatttagttctgtt

SEQ ID NO: 9328426 - DNA, 22 bp, Homo sapiens
atgatggaccatcccaatgtga

SEQ ID NO: 9328427 - DNA, 22 bp, Homo sapiens
atgatcatacagagccctggta

SEQ ID NO: 9328428 - DNA, 22 bp, Homo sapiens
atgatgaaaactgaaggttagg

SEQ ID NO: 9328429 - DNA, 22 bp, Homo sapiens
atgatgaaatgataggtttgtt

SEQ ID NO: 9328430 - DNA, 22 bp, Homo sapiens
atgatatttgcaatgtgcttgc

SEQ ID NO: 9328431 - DNA, 22 bp, Homo sapiens
atgatatatgtgttgagcttgc

SEQ ID NO: 9328432 - DNA, 22 bp, Homo sapiens
gaaatagtacagcatagttctt

SEQ ID NO: 9328433 - DNA, 19 bp, Homo sapiens
atgatacaggtgaaaattg

SEQ ID NO: 9328434 - DNA, 19 bp, Homo sapiens
gaaagtcatagagcttgtc

SEQ ID NO: 9328435 - DNA, 22 bp, Homo sapiens
gaaagtcatggatgaacactac

SEQ ID NO: 9328436 - DNA, 23 bp, Homo sapiens
gaaagtcaatatggtagctttga

SEQ ID NO: 9328437 - DNA, 22 bp, Homo sapiens
gaaaggtttggcttttcagtag

SEQ ID NO: 9328438 - DNA, 22 bp, Homo sapiens
gaaagtaacatttcttgaatta

SEQ ID NO: 9328439 - DNA, 22 bp, Homo sapiens
gaaagtattagcctagaagtca

SEQ ID NO: 9328440 - DNA, 22 bp, Homo sapiens
gaaagtatgccatctacctctt

SEQ ID NO: 9328441 - DNA, 22 bp, Homo sapiens
gaaatacagttgggaggaggta

SEQ ID NO: 9328442 - DNA, 22 bp, Homo sapiens
gaaatacagttgggaggaggta

SEQ ID NO: 9328443 - DNA, 22 bp, Homo sapiens
gaaggctgtcagagaggagggc

SEQ ID NO: 9328444 - DNA, 22 bp, Homo sapiens
gaaggctgtcagagaggagggc

SEQ ID NO: 9328445 - DNA, 22 bp, Homo sapiens
gaaggctgtcagagaggagggc

SEQ ID NO: 9328446 - DNA, 22 bp, Homo sapiens
gaaggctgtttctggtagtgat

SEQ ID NO: 9328447 - DNA, 22 bp, Homo sapiens
atgcacaagttatatgtatgga

SEQ ID NO: 9328448 - DNA, 22 bp, Homo sapiens
atgcacaatgttttgatttgag

SEQ ID NO: 9328449 - DNA, 22 bp, Homo sapiens
atgcacaaggtagattattatt

SEQ ID NO: 9328450 - DNA, 19 bp, Homo sapiens
atgcacacattgaagagga

SEQ ID NO: 9328451 - DNA, 22 bp, Homo sapiens
atgcacacaagcttatgtatta

SEQ ID NO: 9328452 - DNA, 22 bp, Homo sapiens
atgcacaattaggatatagctt

SEQ ID NO: 9328453 - DNA, 22 bp, Homo sapiens
atgcacacacattatgtctgtg

SEQ ID NO: 9328454 - DNA, 22 bp, Homo sapiens
atgcacacaagcttatgtatta

SEQ ID NO: 9328455 - DNA, 22 bp, Homo sapiens
atgcacacgtaccctacaaggc

SEQ ID NO: 9328456 - DNA, 22 bp, Homo sapiens
atgcacactgaatgcttacttt

SEQ ID NO: 9328457 - DNA, 22 bp, Homo sapiens
atgcacactgggattcaactgg

SEQ ID NO: 9328458 - DNA, 22 bp, Homo sapiens
atgcacagctgaacactctaaa

SEQ ID NO: 9328459 - DNA, 22 bp, Homo sapiens
atgcacaggaagtgtccccatt

SEQ ID NO: 9328460 - DNA, 22 bp, Homo sapiens
gaacaaactgggtcccaatgat

SEQ ID NO: 9328461 - DNA, 22 bp, Homo sapiens
gaacaaattctcatcaacttgt

SEQ ID NO: 9328462 - DNA, 22 bp, Homo sapiens
gaacaaattctcatcaacttgt

SEQ ID NO: 9328463 - DNA, 22 bp, Homo sapiens
gaacaaattggagaaatcagga

SEQ ID NO: 9328464 - DNA, 22 bp, Homo sapiens
gaaggctggctttctgagagca

SEQ ID NO: 9328465 - DNA, 22 bp, Homo sapiens
gaaggctggaaggcaagtagga

SEQ ID NO: 9328466 - DNA, 22 bp, Homo sapiens
gaaggctggaaggcaagtagga

SEQ ID NO: 9328467 - DNA, 22 bp, Homo sapiens
gaaggctgctgggaagtgtggt

SEQ ID NO: 9328468 - DNA, 22 bp, Homo sapiens
gaaggctgctgggaagtgtggt

SEQ ID NO: 9328469 - DNA, 22 bp, Homo sapiens
gaaggcaacaccaggatgcact

SEQ ID NO: 9328470 - DNA, 22 bp, Homo sapiens
gaacaaggattcccaaagaaga

SEQ ID NO: 9328471 - DNA, 22 bp, Homo sapiens
gacaatggtggatacatgtcat

SEQ ID NO: 9328472 - DNA, 22 bp, Homo sapiens
gacaatatagttgaatgagcaa

SEQ ID NO: 9328473 - DNA, 22 bp, Homo sapiens
gacaataaagtgatacatggga

SEQ ID NO: 9328474 - DNA, 22 bp, Homo sapiens
gaatcagcctgagtttgcagct

SEQ ID NO: 9328475 - DNA, 22 bp, Homo sapiens
gaatcacactcgtaagtgagtt

SEQ ID NO: 9328476 - DNA, 22 bp, Homo sapiens
gaatcacagaggcaaattctga

SEQ ID NO: 9328477 - DNA, 22 bp, Homo sapiens
gaatatttttaaagggactaat

SEQ ID NO: 9328478 - DNA, 22 bp, Homo sapiens
gaatatttttaaagggactaat

SEQ ID NO: 9328479 - DNA, 22 bp, Homo sapiens
gaatatttttaaagggactaat

SEQ ID NO: 9328480 - DNA, 22 bp, Homo sapiens
gaatattttcagtacagatggt

SEQ ID NO: 9328481 - DNA, 22 bp, Homo sapiens
gaatattttcagtacagatggt

SEQ ID NO: 9328482 - DNA, 22 bp, Homo sapiens
gaataatcatgaaattcagtga

SEQ ID NO: 9328483 - DNA, 22 bp, Homo sapiens
gaataattttgatcagaaggga

SEQ ID NO: 9328484 - DNA, 22 bp, Homo sapiens
gaataattttgatcagaaggga

SEQ ID NO: 9328485 - DNA, 22 bp, Homo sapiens
gaatacaaagcagaactcatac

SEQ ID NO: 9328486 - DNA, 23 bp, Homo sapiens
gaatacaaagcagatggtccagc

SEQ ID NO: 9328487 - DNA, 22 bp, Homo sapiens
gaagtcttcattctctctgaga

SEQ ID NO: 9328488 - DNA, 22 bp, Homo sapiens
gaagtcttgaaacacaaactag

SEQ ID NO: 9328489 - DNA, 22 bp, Homo sapiens
gaagtcttcatctgatgctctg

SEQ ID NO: 9328490 - DNA, 22 bp, Homo sapiens
gaagtcttggctgaaaaccctc

SEQ ID NO: 9328491 - DNA, 22 bp, Homo sapiens
gaagtcttgaagagcactgtaa

SEQ ID NO: 9328492 - DNA, 22 bp, Homo sapiens
gaagtcttttcttccacccaaa

SEQ ID NO: 9328493 - DNA, 22 bp, Homo sapiens
gaagtcttttagcaaaacgaac

SEQ ID NO: 9328494 - DNA, 22 bp, Homo sapiens
atgcacaggtgctgatgcacgc

SEQ ID NO: 9328495 - DNA, 22 bp, Homo sapiens
gaataacattttttcctttaca

SEQ ID NO: 9328496 - DNA, 21 bp, Homo sapiens
gactggagagaggaagtctgg

SEQ ID NO: 9328497 - DNA, 22 bp, Homo sapiens
gactggagcccccaaggacacc

SEQ ID NO: 9328498 - DNA, 22 bp, Homo sapiens
gactggagtcaatgagcagcac

SEQ ID NO: 9328499 - DNA, 22 bp, Homo sapiens
gactggagtgcctccaggaaag

SEQ ID NO: 9328500 - DNA, 22 bp, Homo sapiens
gactgggagggttcagctgggt

SEQ ID NO: 9328501 - DNA, 22 bp, Homo sapiens
gactgggccaaggtcagcagct

SEQ ID NO: 9328502 - DNA, 22 bp, Homo sapiens
gactgggcagccggtagggaag

SEQ ID NO: 9328503 - DNA, 22 bp, Homo sapiens
gactggcctggagatgcagctg

SEQ ID NO: 9328504 - DNA, 22 bp, Homo sapiens
gactggcctggggctgggcaca

SEQ ID NO: 9328505 - DNA, 22 bp, Homo sapiens
gacggggcagccagctggtggc

SEQ ID NO: 9328506 - DNA, 22 bp, Homo sapiens
gacggagctggttgctgcggct

SEQ ID NO: 9328507 - DNA, 22 bp, Homo sapiens
gacctttttactgtgtacgctg

SEQ ID NO: 9328508 - DNA, 22 bp, Homo sapiens
gacgcatcaggaggcgaggagc

SEQ ID NO: 9328509 - DNA, 22 bp, Homo sapiens
gactggaaagcctgtcctcaga

SEQ ID NO: 9328510 - DNA, 22 bp, Homo sapiens
gactggaaagcctgtcctcaga

SEQ ID NO: 9328511 - DNA, 22 bp, Homo sapiens
gactggaaagcctgtcctcaga

SEQ ID NO: 9328512 - DNA, 22 bp, Homo sapiens
gactacagatagccaattaagt

SEQ ID NO: 9328513 - DNA, 22 bp, Homo sapiens
gactacaggccggcatcagaga

SEQ ID NO: 9328514 - DNA, 22 bp, Homo sapiens
gacgggtgtatgctcccagcca

SEQ ID NO: 9328515 - DNA, 22 bp, Homo sapiens
gacgggtgtccctatgtccatt

SEQ ID NO: 9328516 - DNA, 22 bp, Homo sapiens
gactaaattcctgttcgcgatg

SEQ ID NO: 9328517 - DNA, 22 bp, Homo sapiens
gactaaatcagacttttccaaa

SEQ ID NO: 9328518 - DNA, 22 bp, Homo sapiens
gactaaataaaagccaaacttc

SEQ ID NO: 9328519 - DNA, 22 bp, Homo sapiens
atgctcctcgagtgtctcacag

SEQ ID NO: 9328520 - DNA, 18 bp, Homo sapiens
atgctcctatctctgagc

SEQ ID NO: 9328521 - DNA, 22 bp, Homo sapiens
atgctcagtagctggctgaccc

SEQ ID NO: 9328522 - DNA, 22 bp, Homo sapiens
atgctccagtgtgatgcttcat

SEQ ID NO: 9328523 - DNA, 18 bp, Homo sapiens
atgctcctatctctgagc

SEQ ID NO: 9328524 - DNA, 22 bp, Homo sapiens
atgctatttaccacacatcatt

SEQ ID NO: 9328525 - DNA, 22 bp, Homo sapiens
atgctcaggttttgcccaagac

SEQ ID NO: 9328526 - DNA, 22 bp, Homo sapiens
atgctcacttcagagaagatga

SEQ ID NO: 9328527 - DNA, 22 bp, Homo sapiens
gaccttgtgatccgcccgcctt

SEQ ID NO: 9328528 - DNA, 22 bp, Homo sapiens
gaccttgtgatccccctgcctt

SEQ ID NO: 9328529 - DNA, 22 bp, Homo sapiens
gaccttgtgatccacctgcctt

SEQ ID NO: 9328530 - DNA, 22 bp, Homo sapiens
gacctttaatgtttctaccact

SEQ ID NO: 9328531 - DNA, 22 bp, Homo sapiens
gaccttgtgatctgcccacctt

SEQ ID NO: 9328532 - DNA, 22 bp, Homo sapiens
gaccttgtgatctgcctgcctt

SEQ ID NO: 9328533 - DNA, 22 bp, Homo sapiens
gaccctggagttagtcctgtgt

SEQ ID NO: 9328534 - DNA, 22 bp, Homo sapiens
gacatttatgaaggagatatgc

SEQ ID NO: 9328535 - DNA, 22 bp, Homo sapiens
gacatttatgaaggagatatgc

SEQ ID NO: 9328536 - DNA, 22 bp, Homo sapiens
gacactctcctccagtggatag

SEQ ID NO: 9328537 - DNA, 22 bp, Homo sapiens
gacactcagtaggacttcaagg

SEQ ID NO: 9328538 - DNA, 22 bp, Homo sapiens
gacataaatgaagtttgactat

SEQ ID NO: 9328539 - DNA, 22 bp, Homo sapiens
gacatttattagaaaactatca

SEQ ID NO: 9328540 - DNA, 22 bp, Homo sapiens
gacatttattagaaaactatca

SEQ ID NO: 9328541 - DNA, 22 bp, Homo sapiens
gacatttattagaaaactatca

SEQ ID NO: 9328542 - DNA, 22 bp, Homo sapiens
gacatttctagcccataaaact

SEQ ID NO: 9328543 - DNA, 22 bp, Homo sapiens
gacatttattggattttacgag

SEQ ID NO: 9328544 - DNA, 22 bp, Homo sapiens
gacatttattggattttacgag

SEQ ID NO: 9328545 - DNA, 22 bp, Homo sapiens
gacatttgtatcttaggggaaa

SEQ ID NO: 9328546 - DNA, 22 bp, Homo sapiens
gacatttgttcctctaagtgac

SEQ ID NO: 9328547 - DNA, 22 bp, Homo sapiens
gaccaagatacagcatcataga

SEQ ID NO: 9328548 - DNA, 22 bp, Homo sapiens
gaccaagatacagcatcataga

SEQ ID NO: 9328549 - DNA, 22 bp, Homo sapiens
gaccacagaggtgtgggagaga

SEQ ID NO: 9328550 - DNA, 22 bp, Homo sapiens
gaccacagactggaaagagggc

SEQ ID NO: 9328551 - DNA, 22 bp, Homo sapiens
gacacaaagtttgtcagaaatt

SEQ ID NO: 9328552 - DNA, 21 bp, Homo sapiens
gacacaaagggtagtaatggt

SEQ ID NO: 9328553 - DNA, 22 bp, Homo sapiens
gacacaaagtttgtcagaaatt

SEQ ID NO: 9328554 - DNA, 22 bp, Homo sapiens
gacaatttctcaatatagaaac

SEQ ID NO: 9328555 - DNA, 22 bp, Homo sapiens
gacaattgcttttgccgaataa

SEQ ID NO: 9328556 - DNA, 22 bp, Homo sapiens
gacaatttctcaatatagaaac

SEQ ID NO: 9328557 - DNA, 22 bp, Homo sapiens
gacaatttctcaatatagaaac

SEQ ID NO: 9328558 - DNA, 19 bp, Homo sapiens
gacaattagagatcactca

SEQ ID NO: 9328559 - DNA, 18 bp, Homo sapiens
gacacatccccaggcctc

SEQ ID NO: 9328560 - DNA, 22 bp, Homo sapiens
gacacatgaccataaatgctaa

SEQ ID NO: 9328561 - DNA, 16 bp, Homo sapiens
gacacatgggggaaaa

SEQ ID NO: 9328562 - DNA, 22 bp, Homo sapiens
gacacagtttttctcacggtgg

SEQ ID NO: 9328563 - DNA, 18 bp, Homo sapiens
gacaccagcctctgcccc

SEQ ID NO: 9328564 - DNA, 22 bp, Homo sapiens
gacaccagcaaggctgtgagga

SEQ ID NO: 9328565 - DNA, 22 bp, Homo sapiens
gacaccagcaaggctgtgagga

SEQ ID NO: 9328566 - DNA, 23 bp, Homo sapiens
gacacctttgccagatcaagatg

SEQ ID NO: 9328567 - DNA, 22 bp, Homo sapiens
gcctagtggtgggtatgcagag

SEQ ID NO: 9328568 - DNA, 22 bp, Homo sapiens
gcctagtgcactggcagggctc

SEQ ID NO: 9328569 - DNA, 22 bp, Homo sapiens
gcctagggttggcctgagaatc

SEQ ID NO: 9328570 - DNA, 22 bp, Homo sapiens
gcctagggtgctcagggacgag

SEQ ID NO: 9328571 - DNA, 22 bp, Homo sapiens
gcctcaagacatttttaattgc

SEQ ID NO: 9328572 - DNA, 19 bp, Homo sapiens
gcctcacaggtctcaggcc

SEQ ID NO: 9328573 - DNA, 22 bp, Homo sapiens
gcctcacatattcatggttact

SEQ ID NO: 9328574 - DNA, 19 bp, Homo sapiens
gcctcacaggtctcaggcc

SEQ ID NO: 9328575 - DNA, 21 bp, Homo sapiens
gcctagggagatgggactgcc

SEQ ID NO: 9328576 - DNA, 21 bp, Homo sapiens
gcctagggagatgggactgcc

SEQ ID NO: 9328577 - DNA, 20 bp, Homo sapiens
gcctaggggttgggaaagca

SEQ ID NO: 9328578 - DNA, 22 bp, Homo sapiens
gcctaggagtacagaatggttt

SEQ ID NO: 9328579 - DNA, 22 bp, Homo sapiens
atttggaacttataataagttt

SEQ ID NO: 9328580 - DNA, 22 bp, Homo sapiens
atttgccttttaaactcacaat

SEQ ID NO: 9328581 - DNA, 22 bp, Homo sapiens
gccccctctttggagccagcca

SEQ ID NO: 9328582 - DNA, 22 bp, Homo sapiens
atttggaaaagtttcttcaact

SEQ ID NO: 9328583 - DNA, 22 bp, Homo sapiens
atttggaaaatctggttataga

SEQ ID NO: 9328584 - DNA, 22 bp, Homo sapiens
gcccccgtagtagatgaggcgc

SEQ ID NO: 9328585 - DNA, 22 bp, Homo sapiens
gccccctaaaggtgtcctcatc

SEQ ID NO: 9328586 - DNA, 22 bp, Homo sapiens
gcccccaggcactacatgtgaa

SEQ ID NO: 9328587 - DNA, 22 bp, Homo sapiens
gcccccagctctcaagctcaaa

SEQ ID NO: 9328588 - DNA, 22 bp, Homo sapiens
gcctgagaaggacacagcaggt

SEQ ID NO: 9328589 - DNA, 22 bp, Homo sapiens
gcctgagaaggacacagcaggt

SEQ ID NO: 9328590 - DNA, 22 bp, Homo sapiens
gcctgagaaggacacagcaggt

SEQ ID NO: 9328591 - DNA, 22 bp, Homo sapiens
gcctgagaaggataggaagcga

SEQ ID NO: 9328592 - DNA, 22 bp, Homo sapiens
gcctgagaaggataggaagcga

SEQ ID NO: 9328593 - DNA, 22 bp, Homo sapiens
gcctgagagtctccagaccttg

SEQ ID NO: 9328594 - DNA, 22 bp, Homo sapiens
gcctgagagaactgaccaagag

SEQ ID NO: 9328595 - DNA, 22 bp, Homo sapiens
gcctgagacagtgtggtccaat

SEQ ID NO: 9328596 - DNA, 22 bp, Homo sapiens
gcctgagagttgaagttcagtg

SEQ ID NO: 9328597 - DNA, 22 bp, Homo sapiens
gcctgagatcaggagaaagcca

SEQ ID NO: 9328598 - DNA, 22 bp, Homo sapiens
gcctgagagttgaagttcagtg

SEQ ID NO: 9328599 - DNA, 22 bp, Homo sapiens
atttggaaggtttacaaagaga

SEQ ID NO: 9328600 - DNA, 22 bp, Homo sapiens
atttggaagcatttccaaagca

SEQ ID NO: 9328601 - DNA, 22 bp, Homo sapiens
gcctggcaatggcctcaggaag

SEQ ID NO: 9328602 - DNA, 22 bp, Homo sapiens
gcctggcaatggcctcaggaag

SEQ ID NO: 9328603 - DNA, 22 bp, Homo sapiens
gcctggcacaggaattaggagg

SEQ ID NO: 9328604 - DNA, 22 bp, Homo sapiens
gcctggcacaggaattaggagg

SEQ ID NO: 9328605 - DNA, 22 bp, Homo sapiens
gcctggcacagtagggacccaa

SEQ ID NO: 9328606 - DNA, 22 bp, Homo sapiens
gcctggcacagtagggacccaa

SEQ ID NO: 9328607 - DNA, 22 bp, Homo sapiens
gcctggcaaggccctgttgact

SEQ ID NO: 9328608 - DNA, 22 bp, Homo sapiens
gcctggcaatggcctcaggaag

SEQ ID NO: 9328609 - DNA, 22 bp, Homo sapiens
gcctggcaatggcctcaggaag

SEQ ID NO: 9328610 - DNA, 23 bp, Homo sapiens
gcctggcaaagcactaccgagag

SEQ ID NO: 9328611 - DNA, 23 bp, Homo sapiens
gcctggcaaagcactaccgagag

SEQ ID NO: 9328612 - DNA, 21 bp, Homo sapiens
gcctggcaaaaaccggccctg

SEQ ID NO: 9328613 - DNA, 22 bp, Homo sapiens
gcctggcaaggccctgttgact

SEQ ID NO: 9328614 - DNA, 22 bp, Homo sapiens
gcctggcaccacagcctttcag

SEQ ID NO: 9328615 - DNA, 22 bp, Homo sapiens
attttactactccaattaatga

SEQ ID NO: 9328616 - DNA, 22 bp, Homo sapiens
gcctggcacattgcagtggatt

SEQ ID NO: 9328617 - DNA, 22 bp, Homo sapiens
gcctggcacattgcagtggatt

SEQ ID NO: 9328618 - DNA, 22 bp, Homo sapiens
gcctggcacattgcagtggatt

SEQ ID NO: 9328619 - DNA, 22 bp, Homo sapiens
attttacttagtgtaatgtcca

SEQ ID NO: 9328620 - DNA, 22 bp, Homo sapiens
attttacttagtgtaatgtcca

SEQ ID NO: 9328621 - DNA, 22 bp, Homo sapiens
attttactactccaattaatga

SEQ ID NO: 9328622 - DNA, 22 bp, Homo sapiens
attttactactccaattaatga

SEQ ID NO: 9328623 - DNA, 21 bp, Homo sapiens
gcctggcaaaaaccggccctg

SEQ ID NO: 9328624 - DNA, 22 bp, Homo sapiens
gcctggagttgtggtgaagcca

SEQ ID NO: 9328625 - DNA, 22 bp, Homo sapiens
gcctggagttgtggtgaagcca

SEQ ID NO: 9328626 - DNA, 22 bp, Homo sapiens
gcctggagttgtggtgaagcca

SEQ ID NO: 9328627 - DNA, 22 bp, Homo sapiens
gcctggagttgtggtgaagcca

SEQ ID NO: 9328628 - DNA, 22 bp, Homo sapiens
gcctggagttgaaactattatt

SEQ ID NO: 9328629 - DNA, 22 bp, Homo sapiens
gcctggagttgaaactattatt

SEQ ID NO: 9328630 - DNA, 22 bp, Homo sapiens
gcctggagttcagccaagtccc

SEQ ID NO: 9328631 - DNA, 22 bp, Homo sapiens
gcctggaggaatgtagctgagg

SEQ ID NO: 9328632 - DNA, 20 bp, Homo sapiens
gcctggaggcaatgggaaga

SEQ ID NO: 9328633 - DNA, 22 bp, Homo sapiens
gcctggaggaatgtagctgagg

SEQ ID NO: 9328634 - DNA, 22 bp, Homo sapiens
atttggaatagctgtagaaata

SEQ ID NO: 9328635 - DNA, 22 bp, Homo sapiens
gccaggtgagaggactgaggct

SEQ ID NO: 9328636 - DNA, 22 bp, Homo sapiens
gccaggtgcacctgccctggcc

SEQ ID NO: 9328637 - DNA, 22 bp, Homo sapiens
gccaggtgcacctgccctggcc

SEQ ID NO: 9328638 - DNA, 22 bp, Homo sapiens
gccaggtgagaggactgaggct

SEQ ID NO: 9328639 - DNA, 22 bp, Homo sapiens
gccaggtgagaggactgaggct

SEQ ID NO: 9328640 - DNA, 19 bp, Homo sapiens
gccaggtcttgggtccagg

SEQ ID NO: 9328641 - DNA, 22 bp, Homo sapiens
gccaggtgcatattagaagcat

SEQ ID NO: 9328642 - DNA, 22 bp, Homo sapiens
gccaggtgcatattagaagcat

SEQ ID NO: 9328643 - DNA, 22 bp, Homo sapiens
gccaggtgcatattagaagcat

SEQ ID NO: 9328644 - DNA, 22 bp, Homo sapiens
gccaggtgcatattagaagcat

SEQ ID NO: 9328645 - DNA, 22 bp, Homo sapiens
gccaggtgcatggctgagtctc

SEQ ID NO: 9328646 - DNA, 22 bp, Homo sapiens
gccaggtgcatggctgagtctc

SEQ ID NO: 9328647 - DNA, 22 bp, Homo sapiens
gccaggtggaggttgcagtgag

SEQ ID NO: 9328648 - DNA, 22 bp, Homo sapiens
gccaggtggaggttgcagtgag

SEQ ID NO: 9328649 - DNA, 22 bp, Homo sapiens
gccaggtggaggttgcagtgag

SEQ ID NO: 9328650 - DNA, 22 bp, Homo sapiens
gccaggtgctatccctgcgctg

SEQ ID NO: 9328651 - DNA, 22 bp, Homo sapiens
gccaggtgctatccctgcgctg

SEQ ID NO: 9328652 - DNA, 22 bp, Homo sapiens
atttccaggagttgaggtctga

SEQ ID NO: 9328653 - DNA, 22 bp, Homo sapiens
atttccaggagttgaggtctga

SEQ ID NO: 9328654 - DNA, 22 bp, Homo sapiens
atttccaggctgttttgtgaat

SEQ ID NO: 9328655 - DNA, 22 bp, Homo sapiens
atttccaggctgttttgtgaat

SEQ ID NO: 9328656 - DNA, 22 bp, Homo sapiens
atttccaggtaacctgttgagt

SEQ ID NO: 9328657 - DNA, 22 bp, Homo sapiens
atttccaggtaacctgttgagt

SEQ ID NO: 9328658 - DNA, 22 bp, Homo sapiens
atttccagtacccagaacagag

SEQ ID NO: 9328659 - DNA, 22 bp, Homo sapiens
atttccagtacccagaacagag

SEQ ID NO: 9328660 - DNA, 22 bp, Homo sapiens
atttccagtacccagaacagag

SEQ ID NO: 9328661 - DNA, 22 bp, Homo sapiens
atttccagtcctaatgatctgg

SEQ ID NO: 9328662 - DNA, 22 bp, Homo sapiens
atttccagtatgcaaatgcctc

SEQ ID NO: 9328663 - DNA, 22 bp, Homo sapiens
atttccagtactattttctgct

SEQ ID NO: 9328664 - DNA, 22 bp, Homo sapiens
atttccagtatgcaaatgcctc

SEQ ID NO: 9328665 - DNA, 22 bp, Homo sapiens
atttccagtatgcaaatgcctc

SEQ ID NO: 9328666 - DNA, 22 bp, Homo sapiens
atttccagtactattttctgct

SEQ ID NO: 9328667 - DNA, 22 bp, Homo sapiens
atttccagtcctaatgatctgg

SEQ ID NO: 9328668 - DNA, 22 bp, Homo sapiens
atttccagtgactctcacaggt

SEQ ID NO: 9328669 - DNA, 22 bp, Homo sapiens
atttccagtgactctcacaggt

SEQ ID NO: 9328670 - DNA, 22 bp, Homo sapiens
atttccagtgcactgaatagaa

SEQ ID NO: 9328671 - DNA, 22 bp, Homo sapiens
atttccagtgcactgaatagaa

SEQ ID NO: 9328672 - DNA, 22 bp, Homo sapiens
atttccagtgactctcacaggt

SEQ ID NO: 9328673 - DNA, 22 bp, Homo sapiens
atttccagcataggcttattga

SEQ ID NO: 9328674 - DNA, 22 bp, Homo sapiens
atttccaggagaaaggatttta

SEQ ID NO: 9328675 - DNA, 22 bp, Homo sapiens
atttccagcataggcttattga

SEQ ID NO: 9328676 - DNA, 22 bp, Homo sapiens
atttccaggagaaaggatttta

SEQ ID NO: 9328677 - DNA, 22 bp, Homo sapiens
gccaggtggctgagcagctgca

SEQ ID NO: 9328678 - DNA, 22 bp, Homo sapiens
gccaggtggctgagcagctgca

SEQ ID NO: 9328679 - DNA, 22 bp, Homo sapiens
gccaggctggggggagatgtct

SEQ ID NO: 9328680 - DNA, 22 bp, Homo sapiens
gccaggctggggggagatgtct

SEQ ID NO: 9328681 - DNA, 22 bp, Homo sapiens
gccaggctggtgcaaggatatt

SEQ ID NO: 9328682 - DNA, 22 bp, Homo sapiens
gccaggctggtgcaaggatatt

SEQ ID NO: 9328683 - DNA, 22 bp, Homo sapiens
gccaggctggtcttgaactcct

SEQ ID NO: 9328684 - DNA, 22 bp, Homo sapiens
gccaggctggaaagaacagaca

SEQ ID NO: 9328685 - DNA, 22 bp, Homo sapiens
gccaggctggccagcaccttct

SEQ ID NO: 9328686 - DNA, 22 bp, Homo sapiens
gccaggctggcaaaaggaaacc

SEQ ID NO: 9328687 - DNA, 22 bp, Homo sapiens
gccaggctggccagcaccttct

SEQ ID NO: 9328688 - DNA, 19 bp, Homo sapiens
gccaggcctggacctgcag

SEQ ID NO: 9328689 - DNA, 22 bp, Homo sapiens
gccacaggtggaattaagaaat

SEQ ID NO: 9328690 - DNA, 22 bp, Homo sapiens
gccacaggtgggctctgggaaa

SEQ ID NO: 9328691 - DNA, 22 bp, Homo sapiens
gccacaggtactatgggagaga

SEQ ID NO: 9328692 - DNA, 22 bp, Homo sapiens
gccacaggtactatgggagaga

SEQ ID NO: 9328693 - DNA, 22 bp, Homo sapiens
gccacaggtactatgggagaga

SEQ ID NO: 9328694 - DNA, 22 bp, Homo sapiens
gccacaggtcggctagagggtc

SEQ ID NO: 9328695 - DNA, 22 bp, Homo sapiens
gccacaggtcggctagagggtc

SEQ ID NO: 9328696 - DNA, 22 bp, Homo sapiens
gccacaggtcggctagagggtc

SEQ ID NO: 9328697 - DNA, 22 bp, Homo sapiens
gccccaggttgcctgtcccagg

SEQ ID NO: 9328698 - DNA, 22 bp, Homo sapiens
atttctgttgcttataaattac

SEQ ID NO: 9328699 - DNA, 22 bp, Homo sapiens
atttctgttgcttataaattac

SEQ ID NO: 9328700 - DNA, 22 bp, Homo sapiens
atttctgttgcttataaattac

SEQ ID NO: 9328701 - DNA, 22 bp, Homo sapiens
atttctgtgcagtaaatggtga

SEQ ID NO: 9328702 - DNA, 22 bp, Homo sapiens
atttctgataaacgtaagctgc

SEQ ID NO: 9328703 - DNA, 17 bp, Homo sapiens
gcccacccttaggagct

SEQ ID NO: 9328704 - DNA, 22 bp, Homo sapiens
atttctgcatctctggagatct

SEQ ID NO: 9328705 - DNA, 22 bp, Homo sapiens
atttctgctactgcaccctagt

SEQ ID NO: 9328706 - DNA, 22 bp, Homo sapiens
atttctgctctgacctgaaagt

SEQ ID NO: 9328707 - DNA, 22 bp, Homo sapiens
atttctgctactgcaccctagt

SEQ ID NO: 9328708 - DNA, 22 bp, Homo sapiens
atttctgtaacttatgaaagtt

SEQ ID NO: 9328709 - DNA, 22 bp, Homo sapiens
atttctgtagtccacattcttt

SEQ ID NO: 9328710 - DNA, 23 bp, Homo sapiens
gcccaccctcagcgtcctcacgg

SEQ ID NO: 9328711 - DNA, 23 bp, Homo sapiens
gcccaccctcagcgtcctcacgg

SEQ ID NO: 9328712 - DNA, 22 bp, Homo sapiens
gcccacagtgtagcaggtactc

SEQ ID NO: 9328713 - DNA, 22 bp, Homo sapiens
gcccacagttaatgggggctct

SEQ ID NO: 9328714 - DNA, 22 bp, Homo sapiens
gcccacagttaatgggggctct

SEQ ID NO: 9328715 - DNA, 22 bp, Homo sapiens
gcccacagtgtagcaggtactc

SEQ ID NO: 9328716 - DNA, 22 bp, Homo sapiens
gcccacagtgtagcaggtactc

SEQ ID NO: 9328717 - DNA, 22 bp, Homo sapiens
gcccacagtctatcagtttgcg

SEQ ID NO: 9328718 - DNA, 21 bp, Homo sapiens
gcccacagtgaggaggatccc

SEQ ID NO: 9328719 - DNA, 22 bp, Homo sapiens
atttccattatcatgacaaatt

SEQ ID NO: 9328720 - DNA, 22 bp, Homo sapiens
atttccatgtccaaaaattagt

SEQ ID NO: 9328721 - DNA, 22 bp, Homo sapiens
atttccatgtcggtattttata

SEQ ID NO: 9328722 - DNA, 22 bp, Homo sapiens
atttccagtgcactgaatagaa

SEQ ID NO: 9328723 - DNA, 22 bp, Homo sapiens
caaatagaactcacagacaaga

SEQ ID NO: 9328724 - DNA, 22 bp, Homo sapiens
caaagctggaaaaggaggctgg

SEQ ID NO: 9328725 - DNA, 22 bp, Homo sapiens
caaaggaggtgataggccctct

SEQ ID NO: 9328726 - DNA, 22 bp, Homo sapiens
caaaggaggtgataggccctct

SEQ ID NO: 9328727 - DNA, 22 bp, Homo sapiens
caaataattactatcctcactt

SEQ ID NO: 9328728 - DNA, 22 bp, Homo sapiens
caaatacaaatacgggcagctt

SEQ ID NO: 9328729 - DNA, 22 bp, Homo sapiens
caaatactaaacataagatttt

SEQ ID NO: 9328730 - DNA, 22 bp, Homo sapiens
gctgacagcaaggggctgccct

SEQ ID NO: 9328731 - DNA, 22 bp, Homo sapiens
gctgacagcgtttccagtgatg

SEQ ID NO: 9328732 - DNA, 22 bp, Homo sapiens
gctgacagcgtttccagtgatg

SEQ ID NO: 9328733 - DNA, 22 bp, Homo sapiens
gctgacagttactgctgtaaca

SEQ ID NO: 9328734 - DNA, 22 bp, Homo sapiens
gctgacagttgtacctgcccct

SEQ ID NO: 9328735 - DNA, 22 bp, Homo sapiens
gctgacaggctctgtgtatgct

SEQ ID NO: 9328736 - DNA, 22 bp, Homo sapiens
gctgacagttgtacctgcccct

SEQ ID NO: 9328737 - DNA, 22 bp, Homo sapiens
gctgacccctacaggttgtgtt

SEQ ID NO: 9328738 - DNA, 20 bp, Homo sapiens
gctgaccataaatcacactg

SEQ ID NO: 9328739 - DNA, 20 bp, Homo sapiens
gctctttgtaagggaatttg

SEQ ID NO: 9328740 - DNA, 22 bp, Homo sapiens
gctctttgtattttggaatcaa

SEQ ID NO: 9328741 - DNA, 22 bp, Homo sapiens
gctgaaaaatagtgtcgtgttt

SEQ ID NO: 9328742 - DNA, 22 bp, Homo sapiens
gctgaaatcccagcattcccca

SEQ ID NO: 9328743 - DNA, 22 bp, Homo sapiens
gctgaaatgaaaacacaggtcg

SEQ ID NO: 9328744 - DNA, 22 bp, Homo sapiens
gctgaaatgaaaacacaggtcg

SEQ ID NO: 9328745 - DNA, 22 bp, Homo sapiens
gctgacagagtgcctggcctca

SEQ ID NO: 9328746 - DNA, 22 bp, Homo sapiens
gctgaaatgcagatccctcact

SEQ ID NO: 9328747 - DNA, 22 bp, Homo sapiens
gctgacagagtgcctggcctca

SEQ ID NO: 9328748 - DNA, 22 bp, Homo sapiens
gctcttgtcaaaaattagttga

SEQ ID NO: 9328749 - DNA, 22 bp, Homo sapiens
gctcttgtcaaaaattagttga

SEQ ID NO: 9328750 - DNA, 22 bp, Homo sapiens
gctcttgtcaaaaattagttga

SEQ ID NO: 9328751 - DNA, 22 bp, Homo sapiens
gctctttaattcattcatggat

SEQ ID NO: 9328752 - DNA, 22 bp, Homo sapiens
gctctttactgtgagggtggtc

SEQ ID NO: 9328753 - DNA, 22 bp, Homo sapiens
gctctttagacatagtctgaag

SEQ ID NO: 9328754 - DNA, 16 bp, Homo sapiens
gctctttagagggagg

SEQ ID NO: 9328755 - DNA, 22 bp, Homo sapiens
gctctttagcgggggccaggcc

SEQ ID NO: 9328756 - DNA, 22 bp, Homo sapiens
gctctttagtccaagccatgtc

SEQ ID NO: 9328757 - DNA, 22 bp, Homo sapiens
gctctttgcacagctctgccct

SEQ ID NO: 9328758 - DNA, 22 bp, Homo sapiens
gctctttggattcctttacaaa

SEQ ID NO: 9328759 - DNA, 22 bp, Homo sapiens
gctctttagttgatggcctgcc

SEQ ID NO: 9328760 - DNA, 22 bp, Homo sapiens
gctctggttccagcgcgcccga

SEQ ID NO: 9328761 - DNA, 22 bp, Homo sapiens
gctctggttccagttccgcacc

SEQ ID NO: 9328762 - DNA, 18 bp, Homo sapiens
gctctggttccttcaacc

SEQ ID NO: 9328763 - DNA, 22 bp, Homo sapiens
gctcttggaagacaggatgtgt

SEQ ID NO: 9328764 - DNA, 22 bp, Homo sapiens
gctcttggccaagtggaagggt

SEQ ID NO: 9328765 - DNA, 22 bp, Homo sapiens
gctcttgggggacagatggagt

SEQ ID NO: 9328766 - DNA, 22 bp, Homo sapiens
caaatgatacctattactaggc

SEQ ID NO: 9328767 - DNA, 22 bp, Homo sapiens
caaatgcatagtttataagaag

SEQ ID NO: 9328768 - DNA, 22 bp, Homo sapiens
gctgactgtccgctgctcccgg

SEQ ID NO: 9328769 - DNA, 22 bp, Homo sapiens
gctgactgtccgctgctcccgg

SEQ ID NO: 9328770 - DNA, 22 bp, Homo sapiens
gctgacctgctctcagcagaga

SEQ ID NO: 9328771 - DNA, 22 bp, Homo sapiens
gctgactgagctggcttttcgt

SEQ ID NO: 9328772 - DNA, 22 bp, Homo sapiens
gctgactgctcagggccagctg

SEQ ID NO: 9328773 - DNA, 22 bp, Homo sapiens
gctgactggttcaggtcccgct

SEQ ID NO: 9328774 - DNA, 22 bp, Homo sapiens
caaatggctggcatccttctac

SEQ ID NO: 9328775 - DNA, 22 bp, Homo sapiens
caaaatgatgtgattttattgt

SEQ ID NO: 9328776 - DNA, 22 bp, Homo sapiens
caaaatgcatctgagaccaggc

SEQ ID NO: 9328777 - DNA, 22 bp, Homo sapiens
caaaataccacgacttgtttta

SEQ ID NO: 9328778 - DNA, 22 bp, Homo sapiens
caaaataccacgacttgtttta

SEQ ID NO: 9328779 - DNA, 22 bp, Homo sapiens
caaaatagatgttaacctggaa

SEQ ID NO: 9328780 - DNA, 22 bp, Homo sapiens
caaaatgatgtgattttattgt

SEQ ID NO: 9328781 - DNA, 22 bp, Homo sapiens
caaaatgtgagtcccacctcaa

SEQ ID NO: 9328782 - DNA, 22 bp, Homo sapiens
caaaattgattgtggtgatggt

SEQ ID NO: 9328783 - DNA, 22 bp, Homo sapiens
caaaattgatgaatgtatgatt

SEQ ID NO: 9328784 - DNA, 22 bp, Homo sapiens
caaacattcaagtacaagtctt

SEQ ID NO: 9328785 - DNA, 22 bp, Homo sapiens
caaaattctgcatttctaataa

SEQ ID NO: 9328786 - DNA, 22 bp, Homo sapiens
caaaattctgcatttctaataa

SEQ ID NO: 9328787 - DNA, 22 bp, Homo sapiens
caaagcaggcttgtcaaattgc

SEQ ID NO: 9328788 - DNA, 22 bp, Homo sapiens
caaagcagtgatccttaaagga

SEQ ID NO: 9328789 - DNA, 20 bp, Homo sapiens
caaagcagtaggataaaaat

SEQ ID NO: 9328790 - DNA, 20 bp, Homo sapiens
caaagcagtaggataaaaat

SEQ ID NO: 9328791 - DNA, 21 bp, Homo sapiens
caaagccaggcaactctctcc

SEQ ID NO: 9328792 - DNA, 22 bp, Homo sapiens
caaagccaggctttctaatgta

SEQ ID NO: 9328793 - DNA, 21 bp, Homo sapiens
caaagccaggcaactctctcc

SEQ ID NO: 9328794 - DNA, 21 bp, Homo sapiens
caaagccaggcaactctctcc

SEQ ID NO: 9328795 - DNA, 22 bp, Homo sapiens
caaagccatagagtagataaga

SEQ ID NO: 9328796 - DNA, 22 bp, Homo sapiens
caaagccatagagtagataaga

SEQ ID NO: 9328797 - DNA, 22 bp, Homo sapiens
caaagccatagagtagataaga

SEQ ID NO: 9328798 - DNA, 22 bp, Homo sapiens
caaagccaggctttctaatgta

SEQ ID NO: 9328799 - DNA, 22 bp, Homo sapiens
caaagccaggctttctaatgta

SEQ ID NO: 9328800 - DNA, 22 bp, Homo sapiens
caaacattcaagtacaagtctt

SEQ ID NO: 9328801 - DNA, 22 bp, Homo sapiens
caaagcagacgcagtaagggta

SEQ ID NO: 9328802 - DNA, 22 bp, Homo sapiens
caaagcagagaactgtctcatt

SEQ ID NO: 9328803 - DNA, 22 bp, Homo sapiens
caaagcagcctgcagtgtggac

SEQ ID NO: 9328804 - DNA, 22 bp, Homo sapiens
caaagcagcggattgggatagt

SEQ ID NO: 9328805 - DNA, 22 bp, Homo sapiens
attttgctgtggtacattagga

SEQ ID NO: 9328806 - DNA, 22 bp, Homo sapiens
attttagagctccaagtacagc

SEQ ID NO: 9328807 - DNA, 22 bp, Homo sapiens
attttagagctccaagtacagc

SEQ ID NO: 9328808 - DNA, 22 bp, Homo sapiens
attttacttcatttgaaatgcc

SEQ ID NO: 9328809 - DNA, 22 bp, Homo sapiens
attttacttcatttgaaatgcc

SEQ ID NO: 9328810 - DNA, 22 bp, Homo sapiens
attttactttgtgaatattgac

SEQ ID NO: 9328811 - DNA, 22 bp, Homo sapiens
attttactttgtgaatattgac

SEQ ID NO: 9328812 - DNA, 22 bp, Homo sapiens
attttactttgtgaatattgac

SEQ ID NO: 9328813 - DNA, 22 bp, Homo sapiens
atttttccaattaggataaaga

SEQ ID NO: 9328814 - DNA, 22 bp, Homo sapiens
atttttcagcttcattgaggca

SEQ ID NO: 9328815 - DNA, 22 bp, Homo sapiens
atttttcagcttcattgaggca

SEQ ID NO: 9328816 - DNA, 22 bp, Homo sapiens
attttgtttcctttggagtaga

SEQ ID NO: 9328817 - DNA, 22 bp, Homo sapiens
atttttatgacaaaccatcctc

SEQ ID NO: 9328818 - DNA, 22 bp, Homo sapiens
atttttatgacaaaccatcctc

SEQ ID NO: 9328819 - DNA, 22 bp, Homo sapiens
atttttgccctgcagtacataa

SEQ ID NO: 9328820 - DNA, 22 bp, Homo sapiens
atttttgagctgtgaacatagc

SEQ ID NO: 9328821 - DNA, 22 bp, Homo sapiens
attttttagaacctggcctgat

SEQ ID NO: 9328822 - DNA, 22 bp, Homo sapiens
atttttctctttccactgagat

SEQ ID NO: 9328823 - DNA, 19 bp, Homo sapiens
atttttcttcctctgtgca

SEQ ID NO: 9328824 - DNA, 19 bp, Homo sapiens
atttttcttcctctgtgca

SEQ ID NO: 9328825 - DNA, 22 bp, Homo sapiens
atttttctctccactccattaa

SEQ ID NO: 9328826 - DNA, 22 bp, Homo sapiens
atttttctctccactccattaa

SEQ ID NO: 9328827 - DNA, 22 bp, Homo sapiens
atttttctctccactccattaa

SEQ ID NO: 9328828 - DNA, 22 bp, Homo sapiens
atttttctctccactccattaa

SEQ ID NO: 9328829 - DNA, 22 bp, Homo sapiens
atttttctctccactccattaa

SEQ ID NO: 9328830 - DNA, 22 bp, Homo sapiens
atttttctctcacacttaccag

SEQ ID NO: 9328831 - DNA, 22 bp, Homo sapiens
atttttctctcacacttaccag

SEQ ID NO: 9328832 - DNA, 22 bp, Homo sapiens
atttttcctgggtgctttagtt

SEQ ID NO: 9328833 - DNA, 23 bp, Homo sapiens
atttttcctggaacagtcaccca

SEQ ID NO: 9328834 - DNA, 22 bp, Homo sapiens
atttttcctgggtgctttagtt

SEQ ID NO: 9328835 - DNA, 23 bp, Homo sapiens
atttttcctggaacagtcaccca

SEQ ID NO: 9328836 - DNA, 22 bp, Homo sapiens
atttttccatgatacttatctg

SEQ ID NO: 9328837 - DNA, 22 bp, Homo sapiens
atttttccatgatacttatctg

SEQ ID NO: 9328838 - DNA, 22 bp, Homo sapiens
atttttccattctctgttagta

SEQ ID NO: 9328839 - DNA, 18 bp, Homo sapiens
atttttcccagatggata

SEQ ID NO: 9328840 - DNA, 22 bp, Homo sapiens
atttttcctgctggatctgctc

SEQ ID NO: 9328841 - DNA, 22 bp, Homo sapiens
atttttcctgctggatctgctc

SEQ ID NO: 9328842 - DNA, 18 bp, Homo sapiens
atttttcccagatggata

SEQ ID NO: 9328843 - DNA, 22 bp, Homo sapiens
attgtctttccactgagaagtt

SEQ ID NO: 9328844 - DNA, 20 bp, Homo sapiens
attgtgaatactgcatatgt

SEQ ID NO: 9328845 - DNA, 22 bp, Homo sapiens
attgtctttccactgagaagtt

SEQ ID NO: 9328846 - DNA, 22 bp, Homo sapiens
attgtcttggcattcaaattag

SEQ ID NO: 9328847 - DNA, 22 bp, Homo sapiens
attgtctgaatccaaagctctg

SEQ ID NO: 9328848 - DNA, 22 bp, Homo sapiens
gcattctgtgctacagccattc

SEQ ID NO: 9328849 - DNA, 22 bp, Homo sapiens
attgtgcaaaacctcaggcctc

SEQ ID NO: 9328850 - DNA, 22 bp, Homo sapiens
attgtgcaaatattatctgtag

SEQ ID NO: 9328851 - DNA, 22 bp, Homo sapiens
attgtgcaatgttttacaattt

SEQ ID NO: 9328852 - DNA, 22 bp, Homo sapiens
attgtgcaatgttttacaattt

SEQ ID NO: 9328853 - DNA, 22 bp, Homo sapiens
attgtgcaccaccttgtggcag

SEQ ID NO: 9328854 - DNA, 22 bp, Homo sapiens
attgtgaggcagggaaaggtgg

SEQ ID NO: 9328855 - DNA, 23 bp, Homo sapiens
attgtgagattactatcacactg

SEQ ID NO: 9328856 - DNA, 22 bp, Homo sapiens
attgtgaatagtgccgcagtaa

SEQ ID NO: 9328857 - DNA, 22 bp, Homo sapiens
attgtgaattgagagtacttct

SEQ ID NO: 9328858 - DNA, 22 bp, Homo sapiens
gccacagggcagatgcgcagag

SEQ ID NO: 9328859 - DNA, 22 bp, Homo sapiens
gccacagggcagatgcgcagag

SEQ ID NO: 9328860 - DNA, 22 bp, Homo sapiens
gccacagggcgagcggaggcca

SEQ ID NO: 9328861 - DNA, 22 bp, Homo sapiens
gccacagggcagatgcgcagag

SEQ ID NO: 9328862 - DNA, 22 bp, Homo sapiens
gccacagggcgagcggaggcca

SEQ ID NO: 9328863 - DNA, 22 bp, Homo sapiens
gccacagggcgagcggaggcca

SEQ ID NO: 9328864 - DNA, 22 bp, Homo sapiens
gccacagggcgagcggaggcca

SEQ ID NO: 9328865 - DNA, 20 bp, Homo sapiens
gccaacgcgctggggctgcc

SEQ ID NO: 9328866 - DNA, 22 bp, Homo sapiens
gccaaatactggaatcatagaa

SEQ ID NO: 9328867 - DNA, 22 bp, Homo sapiens
gccaacaggccttgctctgctc

SEQ ID NO: 9328868 - DNA, 22 bp, Homo sapiens
gccaaaggacctgtgggtgaca

SEQ ID NO: 9328869 - DNA, 22 bp, Homo sapiens
gccaaagcccaggagacagcca

SEQ ID NO: 9328870 - DNA, 23 bp, Homo sapiens
gccaaaggtctgttcagtggtga

SEQ ID NO: 9328871 - DNA, 22 bp, Homo sapiens
gccaaagtacctagccctctgc

SEQ ID NO: 9328872 - DNA, 22 bp, Homo sapiens
gccaaaggttggcctgtgagtt

SEQ ID NO: 9328873 - DNA, 22 bp, Homo sapiens
gccaaagtcctccagccatgca

SEQ ID NO: 9328874 - DNA, 22 bp, Homo sapiens
gcagtgcttgctcaggcttcat

SEQ ID NO: 9328875 - DNA, 22 bp, Homo sapiens
gcagtgtgacgctgttctccgt

SEQ ID NO: 9328876 - DNA, 22 bp, Homo sapiens
gcagtgtgatgcttccagccac

SEQ ID NO: 9328877 - DNA, 22 bp, Homo sapiens
gcagtgtgatgcttccagccac

SEQ ID NO: 9328878 - DNA, 22 bp, Homo sapiens
gcagtgctttagtctgtccttt

SEQ ID NO: 9328879 - DNA, 22 bp, Homo sapiens
gcagtgtgtctcttggcttcct

SEQ ID NO: 9328880 - DNA, 20 bp, Homo sapiens
gcagtgtgtatgaatagctg

SEQ ID NO: 9328881 - DNA, 22 bp, Homo sapiens
gcagtgtggcgtggggacctaa

SEQ ID NO: 9328882 - DNA, 22 bp, Homo sapiens
gcatacaaaggtttacaactga

SEQ ID NO: 9328883 - DNA, 22 bp, Homo sapiens
gcagtgtgtgtccccacactgg

SEQ ID NO: 9328884 - DNA, 22 bp, Homo sapiens
gcagtgtgtgtccccacactgg

SEQ ID NO: 9328885 - DNA, 22 bp, Homo sapiens
gcagtgtgtttctgagatatgg

SEQ ID NO: 9328886 - DNA, 22 bp, Homo sapiens
gcatagcctcgctgtttcacaa

SEQ ID NO: 9328887 - DNA, 22 bp, Homo sapiens
gcataggccactagtgccagga

SEQ ID NO: 9328888 - DNA, 22 bp, Homo sapiens
gcataggcactttcctcctcct

SEQ ID NO: 9328889 - DNA, 22 bp, Homo sapiens
gcatattttcacaagctcttgg

SEQ ID NO: 9328890 - DNA, 22 bp, Homo sapiens
gcatatgatcacgtgtgtcggt

SEQ ID NO: 9328891 - DNA, 17 bp, Homo sapiens
gcatcacagataacacg

SEQ ID NO: 9328892 - DNA, 17 bp, Homo sapiens
gcatcacagataacacg

SEQ ID NO: 9328893 - DNA, 22 bp, Homo sapiens
attgtataacagcatgtatttt

SEQ ID NO: 9328894 - DNA, 22 bp, Homo sapiens
attgtcatcgatgttagccagt

SEQ ID NO: 9328895 - DNA, 22 bp, Homo sapiens
attgtcagagtttgagaaagta

SEQ ID NO: 9328896 - DNA, 20 bp, Homo sapiens
attgtcagccttcagaggag

SEQ ID NO: 9328897 - DNA, 22 bp, Homo sapiens
attgtatttgtacaagacatgt

SEQ ID NO: 9328898 - DNA, 22 bp, Homo sapiens
attgtatttgtacaagacatgt

SEQ ID NO: 9328899 - DNA, 18 bp, Homo sapiens
attgtcagaagtcatgtg

SEQ ID NO: 9328900 - DNA, 22 bp, Homo sapiens
attgtcattccagtcattgtta

SEQ ID NO: 9328901 - DNA, 22 bp, Homo sapiens
attgtcgtcaatggacacatag

SEQ ID NO: 9328902 - DNA, 17 bp, Homo sapiens
attgtctcttcacttat

SEQ ID NO: 9328903 - DNA, 22 bp, Homo sapiens
attgtctatggctgctttcact

SEQ ID NO: 9328904 - DNA, 22 bp, Homo sapiens
gcaggcctgtcttgctcgccct

SEQ ID NO: 9328905 - DNA, 22 bp, Homo sapiens
gcaggccttggcaatgagcctg

SEQ ID NO: 9328906 - DNA, 22 bp, Homo sapiens
gcaggcctttatccctgcctca

SEQ ID NO: 9328907 - DNA, 22 bp, Homo sapiens
gcaggccttggcaatgagcctg

SEQ ID NO: 9328908 - DNA, 22 bp, Homo sapiens
gcaggcctgtaatgaagggaca

SEQ ID NO: 9328909 - DNA, 22 bp, Homo sapiens
gcaggcctgtaatgaagggaca

SEQ ID NO: 9328910 - DNA, 22 bp, Homo sapiens
gcaggcctgtcttgctcgccct

SEQ ID NO: 9328911 - DNA, 22 bp, Homo sapiens
gcaggcctggtttacatggtag

SEQ ID NO: 9328912 - DNA, 22 bp, Homo sapiens
gcaggcctgtaatgaagggaca

SEQ ID NO: 9328913 - DNA, 22 bp, Homo sapiens
gcaggcctgcccagcaggatgg

SEQ ID NO: 9328914 - DNA, 22 bp, Homo sapiens
gcaggcctgcaggtatggccgg

SEQ ID NO: 9328915 - DNA, 22 bp, Homo sapiens
gcaggcctgcaggtatggccgg

SEQ ID NO: 9328916 - DNA, 22 bp, Homo sapiens
gcaggcctgactgtagggggca

SEQ ID NO: 9328917 - DNA, 22 bp, Homo sapiens
gcaggcctgactgtagggggca

SEQ ID NO: 9328918 - DNA, 22 bp, Homo sapiens
gcaggcctgactgtagggggca

SEQ ID NO: 9328919 - DNA, 22 bp, Homo sapiens
gcaggcctgcccagcaggatgg

SEQ ID NO: 9328920 - DNA, 22 bp, Homo sapiens
gcaggcctggtttacatggtag

SEQ ID NO: 9328921 - DNA, 22 bp, Homo sapiens
gcaggcctgcccagcaggatgg

SEQ ID NO: 9328922 - DNA, 22 bp, Homo sapiens
attgatatattatttctaactg

SEQ ID NO: 9328923 - DNA, 22 bp, Homo sapiens
attgactagagtcacagttgca

SEQ ID NO: 9328924 - DNA, 22 bp, Homo sapiens
gcaggcctttatccctgcctca

SEQ ID NO: 9328925 - DNA, 22 bp, Homo sapiens
attgatatattatttctaactg

SEQ ID NO: 9328926 - DNA, 22 bp, Homo sapiens
attgatatcagtttgctgattg

SEQ ID NO: 9328927 - DNA, 22 bp, Homo sapiens
attgatgacacatgttagtttt

SEQ ID NO: 9328928 - DNA, 22 bp, Homo sapiens
attgatccacagtttcgcttaa

SEQ ID NO: 9328929 - DNA, 22 bp, Homo sapiens
attgatgtgtaatgaaggagtt

SEQ ID NO: 9328930 - DNA, 22 bp, Homo sapiens
attgatgttagaatctactcct

SEQ ID NO: 9328931 - DNA, 22 bp, Homo sapiens
gcagggctgcagagggcactgt

SEQ ID NO: 9328932 - DNA, 22 bp, Homo sapiens
gcagggctgcagagggcactgt

SEQ ID NO: 9328933 - DNA, 22 bp, Homo sapiens
gcagggctgcagagggcactgt

SEQ ID NO: 9328934 - DNA, 22 bp, Homo sapiens
gcagggctgctgaaacttgttt

SEQ ID NO: 9328935 - DNA, 22 bp, Homo sapiens
gcagggctgctgaaacttgttt

SEQ ID NO: 9328936 - DNA, 22 bp, Homo sapiens
gcagggctgggacttactggta

SEQ ID NO: 9328937 - DNA, 18 bp, Homo sapiens
gcagggctggacaagtca

SEQ ID NO: 9328938 - DNA, 22 bp, Homo sapiens
gcagggctgggacttactggta

SEQ ID NO: 9328939 - DNA, 22 bp, Homo sapiens
gcagggctgatgttattgacga

SEQ ID NO: 9328940 - DNA, 18 bp, Homo sapiens
gcagggctgcacacgcat

SEQ ID NO: 9328941 - DNA, 18 bp, Homo sapiens
gcagggctgcacacgcat

SEQ ID NO: 9328942 - DNA, 22 bp, Homo sapiens
gcagggctgatgttattgacga

SEQ ID NO: 9328943 - DNA, 22 bp, Homo sapiens
gcagggctgatgttattgacga

SEQ ID NO: 9328944 - DNA, 22 bp, Homo sapiens
gcagggctgatggcttccctca

SEQ ID NO: 9328945 - DNA, 22 bp, Homo sapiens
gcagggctgatggcttccctca

SEQ ID NO: 9328946 - DNA, 22 bp, Homo sapiens
gcagggctgagtcatgtgtgcc

SEQ ID NO: 9328947 - DNA, 22 bp, Homo sapiens
gcagggctgagtcatgtgtgcc

SEQ ID NO: 9328948 - DNA, 22 bp, Homo sapiens
gcagggctgagtcatgtgtgcc

SEQ ID NO: 9328949 - DNA, 22 bp, Homo sapiens
gcagggctgactcagccaccct

SEQ ID NO: 9328950 - DNA, 22 bp, Homo sapiens
gcagggctgactcagccaccct

SEQ ID NO: 9328951 - DNA, 22 bp, Homo sapiens
gcagggctgactcagccaccct

SEQ ID NO: 9328952 - DNA, 22 bp, Homo sapiens
gcagggctgactcagccaccct

SEQ ID NO: 9328953 - DNA, 22 bp, Homo sapiens
attgattttcagactatgcgag

SEQ ID NO: 9328954 - DNA, 22 bp, Homo sapiens
attgatttgaacaaagatatta

SEQ ID NO: 9328955 - DNA, 22 bp, Homo sapiens
attgatttgtagtgcctgcact

SEQ ID NO: 9328956 - DNA, 22 bp, Homo sapiens
attgatttctgcttactcactg

SEQ ID NO: 9328957 - DNA, 22 bp, Homo sapiens
attgatttctgcttactcactg

SEQ ID NO: 9328958 - DNA, 22 bp, Homo sapiens
attgatttgaacaaagatatta

SEQ ID NO: 9328959 - DNA, 22 bp, Homo sapiens
attgatttaggcttgttatgac

SEQ ID NO: 9328960 - DNA, 22 bp, Homo sapiens
attgatttaggcttgttatgac

SEQ ID NO: 9328961 - DNA, 22 bp, Homo sapiens
attgatttagctcaagacacat

SEQ ID NO: 9328962 - DNA, 18 bp, Homo sapiens
attgattgggagaggatt

SEQ ID NO: 9328963 - DNA, 22 bp, Homo sapiens
attgattgggtatgtgcatgca

SEQ ID NO: 9328964 - DNA, 22 bp, Homo sapiens
attgatttagctcaagacacat

SEQ ID NO: 9328965 - DNA, 22 bp, Homo sapiens
gcagctgctggaagttcctgcc

SEQ ID NO: 9328966 - DNA, 22 bp, Homo sapiens
gcagctgctggaagttcctgcc

SEQ ID NO: 9328967 - DNA, 22 bp, Homo sapiens
gcagctgctcccttttacagtg

SEQ ID NO: 9328968 - DNA, 22 bp, Homo sapiens
gcagctgctcacattctcacaa

SEQ ID NO: 9328969 - DNA, 22 bp, Homo sapiens
gcagctgcgctggtgtggggca

SEQ ID NO: 9328970 - DNA, 22 bp, Homo sapiens
gcagctgcgaagaagtctatct

SEQ ID NO: 9328971 - DNA, 22 bp, Homo sapiens
gcagctgcctattcagggcttg

SEQ ID NO: 9328972 - DNA, 22 bp, Homo sapiens
gcagcgaggtgatgaaatagct

SEQ ID NO: 9328973 - DNA, 22 bp, Homo sapiens
gcagcgaggtgatgaaatagct

SEQ ID NO: 9328974 - DNA, 22 bp, Homo sapiens
gcagctgccttcagctggatgg

SEQ ID NO: 9328975 - DNA, 22 bp, Homo sapiens
gcagctgccttcagctggatgg

SEQ ID NO: 9328976 - DNA, 22 bp, Homo sapiens
gcagctggaagtgacactctgt

SEQ ID NO: 9328977 - DNA, 22 bp, Homo sapiens
gcagctggaagtgacactctgt

SEQ ID NO: 9328978 - DNA, 22 bp, Homo sapiens
gcagctggaagtgacactctgt

SEQ ID NO: 9328979 - DNA, 22 bp, Homo sapiens
gcagctgctgtggcatcaagct

SEQ ID NO: 9328980 - DNA, 22 bp, Homo sapiens
gcagctgctgtggcatcaagct

SEQ ID NO: 9328981 - DNA, 22 bp, Homo sapiens
gcagctgctggagggaggcagg

SEQ ID NO: 9328982 - DNA, 22 bp, Homo sapiens
gcagctgctggagggaggcagg

SEQ ID NO: 9328983 - DNA, 22 bp, Homo sapiens
gcagctggacccacacggctta

SEQ ID NO: 9328984 - DNA, 22 bp, Homo sapiens
attccttctttgagaataagca

SEQ ID NO: 9328985 - DNA, 22 bp, Homo sapiens
attctttagttggcttcttgcc

SEQ ID NO: 9328986 - DNA, 22 bp, Homo sapiens
attctttcatataaaggctcag

SEQ ID NO: 9328987 - DNA, 22 bp, Homo sapiens
attctttcaaggaatagttatt

SEQ ID NO: 9328988 - DNA, 22 bp, Homo sapiens
attctttcaaggaatagttatt

SEQ ID NO: 9328989 - DNA, 22 bp, Homo sapiens
attcttgtttaatttgcatccc

SEQ ID NO: 9328990 - DNA, 19 bp, Homo sapiens
attcttgttaagtgtcatc

SEQ ID NO: 9328991 - DNA, 22 bp, Homo sapiens
attcttgtaaattttgtgtgaa

SEQ ID NO: 9328992 - DNA, 22 bp, Homo sapiens
attcttgtttaatttgcatccc

SEQ ID NO: 9328993 - DNA, 19 bp, Homo sapiens
attcttcagcagtgagacc

SEQ ID NO: 9328994 - DNA, 22 bp, Homo sapiens
attcttcttgagtcttggactc

SEQ ID NO: 9328995 - DNA, 22 bp, Homo sapiens
attagtgtacatctcacacgca

SEQ ID NO: 9328996 - DNA, 22 bp, Homo sapiens
attagtgtcatgttgaggactt

SEQ ID NO: 9328997 - DNA, 22 bp, Homo sapiens
attagtgtctgtgaataattct

SEQ ID NO: 9328998 - DNA, 22 bp, Homo sapiens
attagtgtggaccctaatttaa

SEQ ID NO: 9328999 - DNA, 22 bp, Homo sapiens
attagtgtgtaggctggaaaaa

SEQ ID NO: 9329000 - DNA, 22 bp, Homo sapiens
attagtgttgtggcttcatggc

SEQ ID NO: 9329001 - DNA, 22 bp, Homo sapiens
attagtgttgtggcttcatggc

SEQ ID NO: 9329002 - DNA, 22 bp, Homo sapiens
attagtgtctgtgaataattct

SEQ ID NO: 9329003 - DNA, 22 bp, Homo sapiens
attagtgttgtaagaagctgcc

SEQ ID NO: 9329004 - DNA, 22 bp, Homo sapiens
attagtgttcttatcttctagg

SEQ ID NO: 9329005 - DNA, 22 bp, Homo sapiens
attatttccttgctttgaggaa

SEQ ID NO: 9329006 - DNA, 22 bp, Homo sapiens
attatttccttgctttgaggaa

SEQ ID NO: 9329007 - DNA, 22 bp, Homo sapiens
attatttccttgctttgaggaa

SEQ ID NO: 9329008 - DNA, 22 bp, Homo sapiens
attcaaagtactagctattttt

SEQ ID NO: 9329009 - DNA, 22 bp, Homo sapiens
attcaaattaagttaattcagc

SEQ ID NO: 9329010 - DNA, 22 bp, Homo sapiens
attcaaattaagttaattcagc

SEQ ID NO: 9329011 - DNA, 22 bp, Homo sapiens
attcaagagcccatgtttcctg

SEQ ID NO: 9329012 - DNA, 22 bp, Homo sapiens
attcaacatattctgagtaaaa

SEQ ID NO: 9329013 - DNA, 22 bp, Homo sapiens
attaggtatgattctcatttca

SEQ ID NO: 9329014 - DNA, 22 bp, Homo sapiens
attaggtagtataatctttgtt

SEQ ID NO: 9329015 - DNA, 22 bp, Homo sapiens
attagatacacagatttccact

SEQ ID NO: 9329016 - DNA, 22 bp, Homo sapiens
attagctgttgtgaaaggggtg

SEQ ID NO: 9329017 - DNA, 20 bp, Homo sapiens
attagcttggagacagtggc

SEQ ID NO: 9329018 - DNA, 22 bp, Homo sapiens
attagcttatcccatttctgaa

SEQ ID NO: 9329019 - DNA, 22 bp, Homo sapiens
gatttctagtaagtcatgaagg

SEQ ID NO: 9329020 - DNA, 19 bp, Homo sapiens
gatttctacaaatgtcaga

SEQ ID NO: 9329021 - DNA, 22 bp, Homo sapiens
gatttctcatttgtggattgaa

SEQ ID NO: 9329022 - DNA, 22 bp, Homo sapiens
gatttctcactgtggatttcct

SEQ ID NO: 9329023 - DNA, 22 bp, Homo sapiens
gatttctctgcacccactcagg

SEQ ID NO: 9329024 - DNA, 22 bp, Homo sapiens
gatttcctaatgtggatctctg

SEQ ID NO: 9329025 - DNA, 22 bp, Homo sapiens
gatttccattttcaactcctgc

SEQ ID NO: 9329026 - DNA, 22 bp, Homo sapiens
gatttccattttcaactcctgc

SEQ ID NO: 9329027 - DNA, 22 bp, Homo sapiens
gatttccatgattgggccagaa

SEQ ID NO: 9329028 - DNA, 22 bp, Homo sapiens
gatttccaggtcattaataaag

SEQ ID NO: 9329029 - DNA, 22 bp, Homo sapiens
gatttccaggtcattaataaag

SEQ ID NO: 9329030 - DNA, 22 bp, Homo sapiens
gatttcctcactaacatccatc

SEQ ID NO: 9329031 - DNA, 17 bp, Homo sapiens
gatttcctgaagttctt

SEQ ID NO: 9329032 - DNA, 22 bp, Homo sapiens
gatttcctagacatggggcaga

SEQ ID NO: 9329033 - DNA, 22 bp, Homo sapiens
gatttccttgcatattggtaat

SEQ ID NO: 9329034 - DNA, 22 bp, Homo sapiens
attactttcagatgtgctgtaa

SEQ ID NO: 9329035 - DNA, 22 bp, Homo sapiens
attacttcaatttctcagtgaa

SEQ ID NO: 9329036 - DNA, 22 bp, Homo sapiens
gatttcactggctttaagcaca

SEQ ID NO: 9329037 - DNA, 22 bp, Homo sapiens
gatttcactggctttaagcaca

SEQ ID NO: 9329038 - DNA, 22 bp, Homo sapiens
gatttcagccccgctcccagct

SEQ ID NO: 9329039 - DNA, 22 bp, Homo sapiens
gatttcagtggctgtctcaaat

SEQ ID NO: 9329040 - DNA, 22 bp, Homo sapiens
gatttccaggacgggaggtggg

SEQ ID NO: 9329041 - DNA, 22 bp, Homo sapiens
gatttccaggtcattaataaag

SEQ ID NO: 9329042 - DNA, 23 bp, Homo sapiens
attacatgagcaaatatagctat

SEQ ID NO: 9329043 - DNA, 22 bp, Homo sapiens
attacctatttcattttctgtc

SEQ ID NO: 9329044 - DNA, 22 bp, Homo sapiens
attacatatgttggcaacattt

SEQ ID NO: 9329045 - DNA, 22 bp, Homo sapiens
attacagttctgcaggtagttt

SEQ ID NO: 9329046 - DNA, 22 bp, Homo sapiens
attacagttctacacatccttt

SEQ ID NO: 9329047 - DNA, 22 bp, Homo sapiens
attacagttctacacatccttt

SEQ ID NO: 9329048 - DNA, 22 bp, Homo sapiens
attacagttaatttaccttctt

SEQ ID NO: 9329049 - DNA, 22 bp, Homo sapiens
attacagttctgcaggtagttt

SEQ ID NO: 9329050 - DNA, 22 bp, Homo sapiens
attacagttctgcaggtagttt

SEQ ID NO: 9329051 - DNA, 22 bp, Homo sapiens
attacagttaatttaccttctt

SEQ ID NO: 9329052 - DNA, 23 bp, Homo sapiens
attacagttaattacaacatctt

SEQ ID NO: 9329053 - DNA, 23 bp, Homo sapiens
attacagttaattacaacatctt

SEQ ID NO: 9329054 - DNA, 22 bp, Homo sapiens
attacagtgggtaaacagaatt

SEQ ID NO: 9329055 - DNA, 22 bp, Homo sapiens
attacagtgggtaaacagaatt

SEQ ID NO: 9329056 - DNA, 22 bp, Homo sapiens
attacagtgggtaaacagaatt

SEQ ID NO: 9329057 - DNA, 22 bp, Homo sapiens
attacagtggacagctatgcac

SEQ ID NO: 9329058 - DNA, 22 bp, Homo sapiens
attacagtggacagctatgcac

SEQ ID NO: 9329059 - DNA, 22 bp, Homo sapiens
attacagtggacagctatgcac

SEQ ID NO: 9329060 - DNA, 22 bp, Homo sapiens
gatattgtgatgatgtctttgg

SEQ ID NO: 9329061 - DNA, 22 bp, Homo sapiens
gatattctacctgctgaccaag

SEQ ID NO: 9329062 - DNA, 22 bp, Homo sapiens
gatattcctgaaggacagggtt

SEQ ID NO: 9329063 - DNA, 22 bp, Homo sapiens
gatatgtattgaatgatcattt

SEQ ID NO: 9329064 - DNA, 22 bp, Homo sapiens
gatatgtatgaggagtatgtat

SEQ ID NO: 9329065 - DNA, 22 bp, Homo sapiens
gatatgtatgaggagtatgtat

SEQ ID NO: 9329066 - DNA, 22 bp, Homo sapiens
gatatgtattccactataaagg

SEQ ID NO: 9329067 - DNA, 22 bp, Homo sapiens
attcataacggcaaatgtcacc

SEQ ID NO: 9329068 - DNA, 22 bp, Homo sapiens
gcagcagagtttgggagatggt

SEQ ID NO: 9329069 - DNA, 22 bp, Homo sapiens
gcagcagagtagacagagccct

SEQ ID NO: 9329070 - DNA, 22 bp, Homo sapiens
gcagcagagtagacagagccct

SEQ ID NO: 9329071 - DNA, 22 bp, Homo sapiens
gcagcagagtttgggagatggt

SEQ ID NO: 9329072 - DNA, 22 bp, Homo sapiens
attcagaatggcaaacttctag

SEQ ID NO: 9329073 - DNA, 22 bp, Homo sapiens
gcagatggaaagtgcttgaggg

SEQ ID NO: 9329074 - DNA, 21 bp, Homo sapiens
gcagcagaggcttgacagaca

SEQ ID NO: 9329075 - DNA, 21 bp, Homo sapiens
gcagcagaggcttgacagaca

SEQ ID NO: 9329076 - DNA, 20 bp, Homo sapiens
gcagcagacagacaggggac

SEQ ID NO: 9329077 - DNA, 22 bp, Homo sapiens
gcagcagagaacacaatgatgg

SEQ ID NO: 9329078 - DNA, 22 bp, Homo sapiens
gcagcagagaacacaatgatgg

SEQ ID NO: 9329079 - DNA, 20 bp, Homo sapiens
gcagcagacagacaggggac

SEQ ID NO: 9329080 - DNA, 22 bp, Homo sapiens
gcagcagagaccccaggaagga

SEQ ID NO: 9329081 - DNA, 22 bp, Homo sapiens
attcagaaagatatgcctggtt

SEQ ID NO: 9329082 - DNA, 22 bp, Homo sapiens
attcactgtcagcttgcatggg

SEQ ID NO: 9329083 - DNA, 22 bp, Homo sapiens
attcagaaagggttgcctggtt

SEQ ID NO: 9329084 - DNA, 21 bp, Homo sapiens
attcagaaagggaataaactc

SEQ ID NO: 9329085 - DNA, 22 bp, Homo sapiens
attcacattgagcttcactgtg

SEQ ID NO: 9329086 - DNA, 22 bp, Homo sapiens
attcaccaagaatgatttcagt

SEQ ID NO: 9329087 - DNA, 22 bp, Homo sapiens
attcacattttatttcactgga

SEQ ID NO: 9329088 - DNA, 22 bp, Homo sapiens
gcacggcaagacggggcctcct

SEQ ID NO: 9329089 - DNA, 22 bp, Homo sapiens
gcacggctaatttttgtatttt

SEQ ID NO: 9329090 - DNA, 22 bp, Homo sapiens
gcaccttggctttcttggtggc

SEQ ID NO: 9329091 - DNA, 22 bp, Homo sapiens
gcacctggtttatataatcata

SEQ ID NO: 9329092 - DNA, 22 bp, Homo sapiens
gcacctggggtacacagctaca

SEQ ID NO: 9329093 - DNA, 18 bp, Homo sapiens
gcaccttaccaattctac

SEQ ID NO: 9329094 - DNA, 22 bp, Homo sapiens
gcacctggggtacacagctaca

SEQ ID NO: 9329095 - DNA, 22 bp, Homo sapiens
attcaaggtttattcagtttag

SEQ ID NO: 9329096 - DNA, 22 bp, Homo sapiens
attcaaggtatttaaaacataa

SEQ ID NO: 9329097 - DNA, 22 bp, Homo sapiens
gcactagaagtacgccttgtaa

SEQ ID NO: 9329098 - DNA, 22 bp, Homo sapiens
gcacggctaatttttgtatttt

SEQ ID NO: 9329099 - DNA, 22 bp, Homo sapiens
gcacggctaatttttgtatttt

SEQ ID NO: 9329100 - DNA, 22 bp, Homo sapiens
gcacgtggaatgctcatgagcc

SEQ ID NO: 9329101 - DNA, 22 bp, Homo sapiens
attcacaatgatacataagcga

SEQ ID NO: 9329102 - DNA, 22 bp, Homo sapiens
attcacagtttcctcatattct

SEQ ID NO: 9329103 - DNA, 22 bp, Homo sapiens
cagccttcaaggcttagctcag

SEQ ID NO: 9329104 - DNA, 22 bp, Homo sapiens
cagctacagaggccacatggct

SEQ ID NO: 9329105 - DNA, 22 bp, Homo sapiens
cagctactcctcccatgacttc

SEQ ID NO: 9329106 - DNA, 22 bp, Homo sapiens
cagctagcttccctgcagtgct

SEQ ID NO: 9329107 - DNA, 22 bp, Homo sapiens
cagctagctaagaaggccagag

SEQ ID NO: 9329108 - DNA, 22 bp, Homo sapiens
cagctagcggtgctggcggctc

SEQ ID NO: 9329109 - DNA, 22 bp, Homo sapiens
cagctagctaagaaggccagag

SEQ ID NO: 9329110 - DNA, 22 bp, Homo sapiens
cagctatagatggactgaagag

SEQ ID NO: 9329111 - DNA, 22 bp, Homo sapiens
cagctaggaaaccagagggcag

SEQ ID NO: 9329112 - DNA, 22 bp, Homo sapiens
cagctagggagtggcagagctt

SEQ ID NO: 9329113 - DNA, 22 bp, Homo sapiens
cagctagggagtggcagagctt

SEQ ID NO: 9329114 - DNA, 22 bp, Homo sapiens
gtgcccagtcctgccttgacag

SEQ ID NO: 9329115 - DNA, 22 bp, Homo sapiens
cagcctggtccccggctcaccc

SEQ ID NO: 9329116 - DNA, 22 bp, Homo sapiens
cagcctgggctccagagtccct

SEQ ID NO: 9329117 - DNA, 22 bp, Homo sapiens
cagcctggcctgggactgctga

SEQ ID NO: 9329118 - DNA, 22 bp, Homo sapiens
cagcctgggctccagagtccct

SEQ ID NO: 9329119 - DNA, 22 bp, Homo sapiens
cagcctggcctgggactgctga

SEQ ID NO: 9329120 - DNA, 22 bp, Homo sapiens
cagcctgtagaatacagtaaat

SEQ ID NO: 9329121 - DNA, 22 bp, Homo sapiens
cagcctggtccccggctcaccc

SEQ ID NO: 9329122 - DNA, 22 bp, Homo sapiens
cagcctgtcggctccttcattc

SEQ ID NO: 9329123 - DNA, 22 bp, Homo sapiens
cagcctgtctgggcagagtgga

SEQ ID NO: 9329124 - DNA, 21 bp, Homo sapiens
cagcctgctgctccagggcca

SEQ ID NO: 9329125 - DNA, 22 bp, Homo sapiens
cagcctggacagcgaccagagt

SEQ ID NO: 9329126 - DNA, 21 bp, Homo sapiens
cagcctgctgctccagggcca

SEQ ID NO: 9329127 - DNA, 22 bp, Homo sapiens
cagcctggacagcgaccagagt

SEQ ID NO: 9329128 - DNA, 22 bp, Homo sapiens
cagcctggattgcagaatgcta

SEQ ID NO: 9329129 - DNA, 22 bp, Homo sapiens
cagcctggattgcagaatgcta

SEQ ID NO: 9329130 - DNA, 22 bp, Homo sapiens
cagcctggattgcagaatgcta

SEQ ID NO: 9329131 - DNA, 22 bp, Homo sapiens
cagcctggattgcagaatgcta

SEQ ID NO: 9329132 - DNA, 22 bp, Homo sapiens
cagcctggagccacagcccagg

SEQ ID NO: 9329133 - DNA, 22 bp, Homo sapiens
cagcctggagccacagcccagg

SEQ ID NO: 9329134 - DNA, 22 bp, Homo sapiens
cagccctgcagctggatctcac

SEQ ID NO: 9329135 - DNA, 22 bp, Homo sapiens
cagccctgcagccatggcctgt

SEQ ID NO: 9329136 - DNA, 22 bp, Homo sapiens
cagccctgcagccatggcctgt

SEQ ID NO: 9329137 - DNA, 23 bp, Homo sapiens
cagccctgaaatcgaggtgacac

SEQ ID NO: 9329138 - DNA, 22 bp, Homo sapiens
cagccctgccatggagcctcct

SEQ ID NO: 9329139 - DNA, 22 bp, Homo sapiens
cagccctgccatggagcctcct

SEQ ID NO: 9329140 - DNA, 17 bp, Homo sapiens
cagccctgccgttccca

SEQ ID NO: 9329141 - DNA, 22 bp, Homo sapiens
cagccctgctcttagtgtctcc

SEQ ID NO: 9329142 - DNA, 22 bp, Homo sapiens
cagccctgctggttttgggcaa

SEQ ID NO: 9329143 - DNA, 22 bp, Homo sapiens
cagccctgctggttttgggcaa

SEQ ID NO: 9329144 - DNA, 22 bp, Homo sapiens
cagccctgcttccccgctagtt

SEQ ID NO: 9329145 - DNA, 22 bp, Homo sapiens
cagccctgcttccccgctagtt

SEQ ID NO: 9329146 - DNA, 22 bp, Homo sapiens
cagccctggcagctttcagggt

SEQ ID NO: 9329147 - DNA, 22 bp, Homo sapiens
cagccctggcccaggtgcctta

SEQ ID NO: 9329148 - DNA, 22 bp, Homo sapiens
cagccctggcccaggtgcctta

SEQ ID NO: 9329149 - DNA, 22 bp, Homo sapiens
cagccctggcccaggtgcctta

SEQ ID NO: 9329150 - DNA, 20 bp, Homo sapiens
cagcctccactcactcagct

SEQ ID NO: 9329151 - DNA, 22 bp, Homo sapiens
cagccctggaacagctgactca

SEQ ID NO: 9329152 - DNA, 22 bp, Homo sapiens
cagccctggaacagctgactca

SEQ ID NO: 9329153 - DNA, 23 bp, Homo sapiens
cagccctggagatgtgggaggca

SEQ ID NO: 9329154 - DNA, 22 bp, Homo sapiens
cagcctgctagggcaatgcctt

SEQ ID NO: 9329155 - DNA, 22 bp, Homo sapiens
cagcctgccgtcagccaggtag

SEQ ID NO: 9329156 - DNA, 22 bp, Homo sapiens
cagcctctttccacatcaggca

SEQ ID NO: 9329157 - DNA, 22 bp, Homo sapiens
cagcctctttccacatcaggca

SEQ ID NO: 9329158 - DNA, 22 bp, Homo sapiens
cagcctctttccacatcaggca

SEQ ID NO: 9329159 - DNA, 22 bp, Homo sapiens
cagcctgcagggctgcctgttg

SEQ ID NO: 9329160 - DNA, 22 bp, Homo sapiens
gtgctgtgtgatccatgctggc

SEQ ID NO: 9329161 - DNA, 22 bp, Homo sapiens
gtgctgtgtctatcaggaataa

SEQ ID NO: 9329162 - DNA, 18 bp, Homo sapiens
gtgctgtgggcagtggcc

SEQ ID NO: 9329163 - DNA, 22 bp, Homo sapiens
gtgctgtgcgctttttctgtat

SEQ ID NO: 9329164 - DNA, 22 bp, Homo sapiens
gtgccccagacacgcatgtggg

SEQ ID NO: 9329165 - DNA, 22 bp, Homo sapiens
gtgcccagttgaggccaggact

SEQ ID NO: 9329166 - DNA, 22 bp, Homo sapiens
gtgctgtgcgctttttctgtat

SEQ ID NO: 9329167 - DNA, 22 bp, Homo sapiens
gtgctgagtagaatgaatgcct

SEQ ID NO: 9329168 - DNA, 22 bp, Homo sapiens
gtgccctccgtgttcatagagc

SEQ ID NO: 9329169 - DNA, 22 bp, Homo sapiens
gtcccaggcaggccactggcag

SEQ ID NO: 9329170 - DNA, 22 bp, Homo sapiens
gtcccaggcaggccactggcag

SEQ ID NO: 9329171 - DNA, 22 bp, Homo sapiens
gtcccaggagttgctgggcctt

SEQ ID NO: 9329172 - DNA, 22 bp, Homo sapiens
gtcccaggcagagtcaggaggg

SEQ ID NO: 9329173 - DNA, 22 bp, Homo sapiens
gtcccagaggctttggccacag

SEQ ID NO: 9329174 - DNA, 22 bp, Homo sapiens
gtcccaggaacattctggctag

SEQ ID NO: 9329175 - DNA, 22 bp, Homo sapiens
gtcccagcttcccactagcagc

SEQ ID NO: 9329176 - DNA, 22 bp, Homo sapiens
gtcccaggaacattctggctag

SEQ ID NO: 9329177 - DNA, 22 bp, Homo sapiens
gtcccaggaacattctggctag

SEQ ID NO: 9329178 - DNA, 22 bp, Homo sapiens
cagcaggctgtggaaatcctgg

SEQ ID NO: 9329179 - DNA, 22 bp, Homo sapiens
gtccagccaccctggaggcacg

SEQ ID NO: 9329180 - DNA, 22 bp, Homo sapiens
cagcaggctgcgattgctcatt

SEQ ID NO: 9329181 - DNA, 22 bp, Homo sapiens
cagcaggctggacttcagtccc

SEQ ID NO: 9329182 - DNA, 22 bp, Homo sapiens
cagcaggctctgagtggctgcc

SEQ ID NO: 9329183 - DNA, 22 bp, Homo sapiens
cagcaggctctgagtggctgcc

SEQ ID NO: 9329184 - DNA, 22 bp, Homo sapiens
cagcaggctctgagtggctgcc

SEQ ID NO: 9329185 - DNA, 22 bp, Homo sapiens
cagcaggctctgagtggctgcc

SEQ ID NO: 9329186 - DNA, 22 bp, Homo sapiens
cagcaggctctgagtggctgcc

SEQ ID NO: 9329187 - DNA, 22 bp, Homo sapiens
cagcaggctgcgattgctcatt

SEQ ID NO: 9329188 - DNA, 20 bp, Homo sapiens
cagcaggctatggggcaccc

SEQ ID NO: 9329189 - DNA, 20 bp, Homo sapiens
cagcaggctatggggcaccc

SEQ ID NO: 9329190 - DNA, 20 bp, Homo sapiens
cagcaggctatggggcaccc

SEQ ID NO: 9329191 - DNA, 22 bp, Homo sapiens
cagcaggcgttgggagaaagac

SEQ ID NO: 9329192 - DNA, 22 bp, Homo sapiens
cagcaggcgttgggagaaagac

SEQ ID NO: 9329193 - DNA, 22 bp, Homo sapiens
cagcaggcgttgggagaaagac

SEQ ID NO: 9329194 - DNA, 22 bp, Homo sapiens
cagcaggcgttgggagaaagac

SEQ ID NO: 9329195 - DNA, 22 bp, Homo sapiens
cagcaggcggcccgcgggcccg

SEQ ID NO: 9329196 - DNA, 22 bp, Homo sapiens
gtcatgtcagcaaatatcatag

SEQ ID NO: 9329197 - DNA, 22 bp, Homo sapiens
gtcatgagaaatctttgaaggt

SEQ ID NO: 9329198 - DNA, 22 bp, Homo sapiens
gtcatatacactgcatgtaatc

SEQ ID NO: 9329199 - DNA, 22 bp, Homo sapiens
gtcatcatcaggcagatgctgc

SEQ ID NO: 9329200 - DNA, 23 bp, Homo sapiens
gtcatcattaaagtcacagagac

SEQ ID NO: 9329201 - DNA, 22 bp, Homo sapiens
gtcatctcaagtaagtgaacaa

SEQ ID NO: 9329202 - DNA, 22 bp, Homo sapiens
gtcatctctgtgaatgaggcag

SEQ ID NO: 9329203 - DNA, 22 bp, Homo sapiens
gtcatctctgggcccgcactgc

SEQ ID NO: 9329204 - DNA, 22 bp, Homo sapiens
gtcatctctgggcccgcactgc

SEQ ID NO: 9329205 - DNA, 22 bp, Homo sapiens
gtcatctcacagcagggctagt

SEQ ID NO: 9329206 - DNA, 23 bp, Homo sapiens
gtcatctctcctgggccagcgcc

SEQ ID NO: 9329207 - DNA, 22 bp, Homo sapiens
gtcatctcttatcactgacttc

SEQ ID NO: 9329208 - DNA, 22 bp, Homo sapiens
gtcatctctttacttttgctga

SEQ ID NO: 9329209 - DNA, 22 bp, Homo sapiens
gtcatcttaaggactgctatag

SEQ ID NO: 9329210 - DNA, 22 bp, Homo sapiens
gtcatcttaaggactgctatag

SEQ ID NO: 9329211 - DNA, 22 bp, Homo sapiens
cagcagctgcgtgcccaggccg

SEQ ID NO: 9329212 - DNA, 22 bp, Homo sapiens
cagcagctgggaaggaggctga

SEQ ID NO: 9329213 - DNA, 22 bp, Homo sapiens
cagcagctgcgtgcccaggccg

SEQ ID NO: 9329214 - DNA, 22 bp, Homo sapiens
cagcagctgggaaggaggctga

SEQ ID NO: 9329215 - DNA, 22 bp, Homo sapiens
cagcagctgggaaggaggctga

SEQ ID NO: 9329216 - DNA, 22 bp, Homo sapiens
cagcagctggtgagacacagcc

SEQ ID NO: 9329217 - DNA, 22 bp, Homo sapiens
cagcagctgggaaggaggctga

SEQ ID NO: 9329218 - DNA, 22 bp, Homo sapiens
cagcagctgcctcagctgggga

SEQ ID NO: 9329219 - DNA, 22 bp, Homo sapiens
cagcagctgcaaatggaaacag

SEQ ID NO: 9329220 - DNA, 22 bp, Homo sapiens
cagcagctgcgtgcccaggccg

SEQ ID NO: 9329221 - DNA, 22 bp, Homo sapiens
cagcagctgatggggaagtgat

SEQ ID NO: 9329222 - DNA, 22 bp, Homo sapiens
cagcagctgatggggaagtgat

SEQ ID NO: 9329223 - DNA, 22 bp, Homo sapiens
cagcagctgcaaatggaaacag

SEQ ID NO: 9329224 - DNA, 22 bp, Homo sapiens
cagcagctagaggaagggcaga

SEQ ID NO: 9329225 - DNA, 22 bp, Homo sapiens
cagcacctctgggtcttgtctt

SEQ ID NO: 9329226 - DNA, 22 bp, Homo sapiens
cagcacctctgggtcttgtctt

SEQ ID NO: 9329227 - DNA, 22 bp, Homo sapiens
cagcaccctcggaggctgccgt

SEQ ID NO: 9329228 - DNA, 22 bp, Homo sapiens
cagcaccattttcctggtcagc

SEQ ID NO: 9329229 - DNA, 22 bp, Homo sapiens
cagcacccctcctggctatgaa

SEQ ID NO: 9329230 - DNA, 22 bp, Homo sapiens
cagcaccattttcctggtcagc

SEQ ID NO: 9329231 - DNA, 22 bp, Homo sapiens
cagcagcttttgcattctcatt

SEQ ID NO: 9329232 - DNA, 22 bp, Homo sapiens
cagcagcttctgttgatcagaa

SEQ ID NO: 9329233 - DNA, 22 bp, Homo sapiens
cagcagcttctgttgatcagaa

SEQ ID NO: 9329234 - DNA, 22 bp, Homo sapiens
cagcagctggtgagacacagcc

SEQ ID NO: 9329235 - DNA, 22 bp, Homo sapiens
cagcagctggtgagacacagcc

SEQ ID NO: 9329236 - DNA, 22 bp, Homo sapiens
cagcagctggttatacctgtgg

SEQ ID NO: 9329237 - DNA, 22 bp, Homo sapiens
cagcagctggttatacctgtgg

SEQ ID NO: 9329238 - DNA, 22 bp, Homo sapiens
cagcagctggttatacctgtgg

SEQ ID NO: 9329239 - DNA, 22 bp, Homo sapiens
gtcataaagacagaaacattcc

SEQ ID NO: 9329240 - DNA, 22 bp, Homo sapiens
gtcagcattagcaatgactggt

SEQ ID NO: 9329241 - DNA, 22 bp, Homo sapiens
cagcaggaaagacatctgagca

SEQ ID NO: 9329242 - DNA, 18 bp, Homo sapiens
gtctgtgtggcttgggga

SEQ ID NO: 9329243 - DNA, 22 bp, Homo sapiens
gtctgtgtgcacagcgagtgcc

SEQ ID NO: 9329244 - DNA, 22 bp, Homo sapiens
gtctgtgggccaaatacagccc

SEQ ID NO: 9329245 - DNA, 22 bp, Homo sapiens
gtctgtggtagacaggaaggca

SEQ ID NO: 9329246 - DNA, 22 bp, Homo sapiens
gtctgtggtccctgctggggac

SEQ ID NO: 9329247 - DNA, 22 bp, Homo sapiens
gtctgtctcctgggtgcgcacc

SEQ ID NO: 9329248 - DNA, 22 bp, Homo sapiens
gtctgtccttttcatctcccaa

SEQ ID NO: 9329249 - DNA, 22 bp, Homo sapiens
cagccctcatcccgcctgcgtt

SEQ ID NO: 9329250 - DNA, 22 bp, Homo sapiens
cagccctcatcccgcctgcgtt

SEQ ID NO: 9329251 - DNA, 22 bp, Homo sapiens
cagccctcaggtcctcagcagc

SEQ ID NO: 9329252 - DNA, 22 bp, Homo sapiens
cagccctcaggtcctcagcagc

SEQ ID NO: 9329253 - DNA, 22 bp, Homo sapiens
cagccctcaggtcctcagcagc

SEQ ID NO: 9329254 - DNA, 22 bp, Homo sapiens
cagccccttcctggcatctgga

SEQ ID NO: 9329255 - DNA, 22 bp, Homo sapiens
cagccccttcctggcatctgga

SEQ ID NO: 9329256 - DNA, 22 bp, Homo sapiens
cagccccttgtccggtagccac

SEQ ID NO: 9329257 - DNA, 22 bp, Homo sapiens
cagccccttgtccggtagccac

SEQ ID NO: 9329258 - DNA, 22 bp, Homo sapiens
cagcccgccctgaactttcggg

SEQ ID NO: 9329259 - DNA, 22 bp, Homo sapiens
cagccctcaaaccacttccagg

SEQ ID NO: 9329260 - DNA, 22 bp, Homo sapiens
cagccctcaaaccacttccagg

SEQ ID NO: 9329261 - DNA, 22 bp, Homo sapiens
cagcccctccctcaggcaggtg

SEQ ID NO: 9329262 - DNA, 22 bp, Homo sapiens
cagcccctcacagagctgtcct

SEQ ID NO: 9329263 - DNA, 22 bp, Homo sapiens
cagccaggtatgggcgtgcggg

SEQ ID NO: 9329264 - DNA, 22 bp, Homo sapiens
cagccagggtcaggcagcttct

SEQ ID NO: 9329265 - DNA, 22 bp, Homo sapiens
cagccagggtcaggcagcttct

SEQ ID NO: 9329266 - DNA, 22 bp, Homo sapiens
cagccagggtcaggcagcttct

SEQ ID NO: 9329267 - DNA, 22 bp, Homo sapiens
cagccaggggctggcgtgttga

SEQ ID NO: 9329268 - DNA, 22 bp, Homo sapiens
cagccaggggctggcgtgttga

SEQ ID NO: 9329269 - DNA, 22 bp, Homo sapiens
cagccagggagggcaaatgaga

SEQ ID NO: 9329270 - DNA, 22 bp, Homo sapiens
cagccaggtatgggcgtgcggg

SEQ ID NO: 9329271 - DNA, 22 bp, Homo sapiens
cagccaggttagtgctaattgt

SEQ ID NO: 9329272 - DNA, 22 bp, Homo sapiens
cagccaggttcaagtccttata

SEQ ID NO: 9329273 - DNA, 22 bp, Homo sapiens
cagccagggagggcaaatgaga

SEQ ID NO: 9329274 - DNA, 22 bp, Homo sapiens
cagccagggagcaaagagttga

SEQ ID NO: 9329275 - DNA, 22 bp, Homo sapiens
cagccagggagcaaagagttga

SEQ ID NO: 9329276 - DNA, 22 bp, Homo sapiens
cagccaggcccccgagtcgttg

SEQ ID NO: 9329277 - DNA, 22 bp, Homo sapiens
cagccaggcctggtgaccaaag

SEQ ID NO: 9329278 - DNA, 22 bp, Homo sapiens
gtctggagccaccctaagcatt

SEQ ID NO: 9329279 - DNA, 22 bp, Homo sapiens
gtctggagccccagtcaatgag

SEQ ID NO: 9329280 - DNA, 22 bp, Homo sapiens
gtctggagcctgggtccctgct

SEQ ID NO: 9329281 - DNA, 22 bp, Homo sapiens
gtctggagccactgctgctgct

SEQ ID NO: 9329282 - DNA, 22 bp, Homo sapiens
gtctggagagctgagcagagtt

SEQ ID NO: 9329283 - DNA, 22 bp, Homo sapiens
gtctggaaggaggagatggagc

SEQ ID NO: 9329284 - DNA, 22 bp, Homo sapiens
gtctggaaggaggagatggagc

SEQ ID NO: 9329285 - DNA, 22 bp, Homo sapiens
gtctggaagagcaggaataaac

SEQ ID NO: 9329286 - DNA, 22 bp, Homo sapiens
gtctggaagctctaggggagaa

SEQ ID NO: 9329287 - DNA, 22 bp, Homo sapiens
gtctggaagaactagggatgtt

SEQ ID NO: 9329288 - DNA, 22 bp, Homo sapiens
gtctggaagaactagggatgtt

SEQ ID NO: 9329289 - DNA, 22 bp, Homo sapiens
gtctggaagtgtcttgttaagt

SEQ ID NO: 9329290 - DNA, 22 bp, Homo sapiens
gtctggaagggagtgcattttc

SEQ ID NO: 9329291 - DNA, 22 bp, Homo sapiens
gtctggaatatagcaagctctt

SEQ ID NO: 9329292 - DNA, 22 bp, Homo sapiens
gtctggaagaacctgtgccagt

SEQ ID NO: 9329293 - DNA, 22 bp, Homo sapiens
gtctggaaccaatatttgaggg

SEQ ID NO: 9329294 - DNA, 22 bp, Homo sapiens
gtctggaaccaagacgtgtagc

SEQ ID NO: 9329295 - DNA, 22 bp, Homo sapiens
gtctggaaatttaaggtatgag

SEQ ID NO: 9329296 - DNA, 22 bp, Homo sapiens
gtctggaaatttaaggtatgag

SEQ ID NO: 9329297 - DNA, 22 bp, Homo sapiens
gtctggaaattcaatttaatgc

SEQ ID NO: 9329298 - DNA, 22 bp, Homo sapiens
gtctggaaattaagaggaggtt

SEQ ID NO: 9329299 - DNA, 22 bp, Homo sapiens
gtctggaaatattgacttcaga

SEQ ID NO: 9329300 - DNA, 22 bp, Homo sapiens
gtctggaaaggggcttttatct

SEQ ID NO: 9329301 - DNA, 22 bp, Homo sapiens
gtctggaaaggtatttgtctca

SEQ ID NO: 9329302 - DNA, 22 bp, Homo sapiens
gtccctgggatgcccttctggg

SEQ ID NO: 9329303 - DNA, 19 bp, Homo sapiens
gtccctgggcagaggcacc

SEQ ID NO: 9329304 - DNA, 19 bp, Homo sapiens
gtccctgggcagaggcacc

SEQ ID NO: 9329305 - DNA, 22 bp, Homo sapiens
gtccctggcgctttcgagcctt

SEQ ID NO: 9329306 - DNA, 22 bp, Homo sapiens
gtccctgggaaaggagagggca

SEQ ID NO: 9329307 - DNA, 22 bp, Homo sapiens
gtccctggcgctttcgagcctt

SEQ ID NO: 9329308 - DNA, 22 bp, Homo sapiens
gtcccagggaagaaggcagcac

SEQ ID NO: 9329309 - DNA, 22 bp, Homo sapiens
gtcccagggaagaaggcagcac

SEQ ID NO: 9329310 - DNA, 22 bp, Homo sapiens
gtccctggatctgggacagctg

SEQ ID NO: 9329311 - DNA, 22 bp, Homo sapiens
gtctcttgttatcatttctgag

SEQ ID NO: 9329312 - DNA, 22 bp, Homo sapiens
gtctcttgtggatgttgggaag

SEQ ID NO: 9329313 - DNA, 22 bp, Homo sapiens
gtctcttctttgccggtcctgc

SEQ ID NO: 9329314 - DNA, 22 bp, Homo sapiens
gtctcttctttgccggtcctgc

SEQ ID NO: 9329315 - DNA, 22 bp, Homo sapiens
gtcccttggctcacaaacagct

SEQ ID NO: 9329316 - DNA, 22 bp, Homo sapiens
gtctcttgttatcatttctgag

SEQ ID NO: 9329317 - DNA, 22 bp, Homo sapiens
gtctcttttatggtgagttgat

SEQ ID NO: 9329318 - DNA, 22 bp, Homo sapiens
gtctggaaagagctgaggttca

SEQ ID NO: 9329319 - DNA, 22 bp, Homo sapiens
gtctcttctttgccggtcctgc

SEQ ID NO: 9329320 - DNA, 19 bp, Homo sapiens
gtcccttcactcctgctgg

SEQ ID NO: 9329321 - DNA, 22 bp, Homo sapiens
gtccctgggtctaaggcagtaa

SEQ ID NO: 9329322 - DNA, 22 bp, Homo sapiens
gtccctggtctaccgtggcttc

SEQ ID NO: 9329323 - DNA, 22 bp, Homo sapiens
gtccctgggtctaaggcagtaa

SEQ ID NO: 9329324 - DNA, 22 bp, Homo sapiens
gtccctgggtctaaggcagtaa

SEQ ID NO: 9329325 - DNA, 22 bp, Homo sapiens
gtccctgggggtttaggactca

SEQ ID NO: 9329326 - DNA, 22 bp, Homo sapiens
cagaggcaaaagaggtggaggt

SEQ ID NO: 9329327 - DNA, 22 bp, Homo sapiens
gggctgagtgggcctcttactt

SEQ ID NO: 9329328 - DNA, 22 bp, Homo sapiens
cagaggagaattgcgggatcat

SEQ ID NO: 9329329 - DNA, 22 bp, Homo sapiens
cagaggcacaagaaagcaaggc

SEQ ID NO: 9329330 - DNA, 22 bp, Homo sapiens
cagaggcaaaagaggtggaggt

SEQ ID NO: 9329331 - DNA, 20 bp, Homo sapiens
cagaggcaaggagacttgga

SEQ ID NO: 9329332 - DNA, 22 bp, Homo sapiens
cagaggcaaaagaggtggaggt

SEQ ID NO: 9329333 - DNA, 20 bp, Homo sapiens
cagaggcaaggagacttgga

SEQ ID NO: 9329334 - DNA, 22 bp, Homo sapiens
gggctgagtgacctcaggccaa

SEQ ID NO: 9329335 - DNA, 22 bp, Homo sapiens
gggctgagtgacctcaggccaa

SEQ ID NO: 9329336 - DNA, 22 bp, Homo sapiens
gggctgagtctgctgcctgtca

SEQ ID NO: 9329337 - DNA, 22 bp, Homo sapiens
gggctgagtctgctgcctgtca

SEQ ID NO: 9329338 - DNA, 22 bp, Homo sapiens
gggctgagtctgctgcctgtca

SEQ ID NO: 9329339 - DNA, 22 bp, Homo sapiens
gggctgagtctgctgcctgtca

SEQ ID NO: 9329340 - DNA, 22 bp, Homo sapiens
gggctgaggggtatctcatggg

SEQ ID NO: 9329341 - DNA, 22 bp, Homo sapiens
gggctgaggggtatctcatggg

SEQ ID NO: 9329342 - DNA, 22 bp, Homo sapiens
gggctgaggggtatctcatggg

SEQ ID NO: 9329343 - DNA, 22 bp, Homo sapiens
gggctgagtcatctggggcctc

SEQ ID NO: 9329344 - DNA, 22 bp, Homo sapiens
gggctgagtcatctggggcctc

SEQ ID NO: 9329345 - DNA, 23 bp, Homo sapiens
cagagctggcttcatgggtgtgc

SEQ ID NO: 9329346 - DNA, 22 bp, Homo sapiens
cagagctgggatcccatgggcg

SEQ ID NO: 9329347 - DNA, 23 bp, Homo sapiens
cagagctggcttcatgggtgtgc

SEQ ID NO: 9329348 - DNA, 22 bp, Homo sapiens
cagagctgggatcccatgggcg

SEQ ID NO: 9329349 - DNA, 20 bp, Homo sapiens
cagagctgggatttgaacac

SEQ ID NO: 9329350 - DNA, 22 bp, Homo sapiens
cagagctgggcatggtgaaagg

SEQ ID NO: 9329351 - DNA, 22 bp, Homo sapiens
cagagctgggcatggtgaaagg

SEQ ID NO: 9329352 - DNA, 22 bp, Homo sapiens
cagagctgggtttgggaaacct

SEQ ID NO: 9329353 - DNA, 22 bp, Homo sapiens
cagagctggggactgttggatg

SEQ ID NO: 9329354 - DNA, 22 bp, Homo sapiens
cagagctggggactgttggatg

SEQ ID NO: 9329355 - DNA, 23 bp, Homo sapiens
cagagctggctcagagctgcctg

SEQ ID NO: 9329356 - DNA, 22 bp, Homo sapiens
cagagcctctcagccccttggg

SEQ ID NO: 9329357 - DNA, 22 bp, Homo sapiens
cagagcctccctcctctgccat

SEQ ID NO: 9329358 - DNA, 22 bp, Homo sapiens
cagagcctctgccctgggcact

SEQ ID NO: 9329359 - DNA, 22 bp, Homo sapiens
cagagcctctcagccccttggg

SEQ ID NO: 9329360 - DNA, 22 bp, Homo sapiens
cagagcctctgccctgggcact

SEQ ID NO: 9329361 - DNA, 22 bp, Homo sapiens
cagagcctctgccctgggcact

SEQ ID NO: 9329362 - DNA, 19 bp, Homo sapiens
cagagcctcagagctagaa

SEQ ID NO: 9329363 - DNA, 22 bp, Homo sapiens
cagagcctccctcctctgccat

SEQ ID NO: 9329364 - DNA, 19 bp, Homo sapiens
cagagcctcagagctagaa

SEQ ID NO: 9329365 - DNA, 19 bp, Homo sapiens
cagagcctcagagctagaa

SEQ ID NO: 9329366 - DNA, 22 bp, Homo sapiens
cagagcctcagaatcctgtgga

SEQ ID NO: 9329367 - DNA, 22 bp, Homo sapiens
cagagcctcagaatcctgtgga

SEQ ID NO: 9329368 - DNA, 22 bp, Homo sapiens
cagagcctcagaatcctgtgga

SEQ ID NO: 9329369 - DNA, 22 bp, Homo sapiens
gggctgactcaaccttgcaaag

SEQ ID NO: 9329370 - DNA, 22 bp, Homo sapiens
gggctgacgaaggccatgtgtg

SEQ ID NO: 9329371 - DNA, 22 bp, Homo sapiens
cagagcctaaaacgactccact

SEQ ID NO: 9329372 - DNA, 22 bp, Homo sapiens
cagagcccttggctggagccca

SEQ ID NO: 9329373 - DNA, 22 bp, Homo sapiens
cagagcccttggctggagccca

SEQ ID NO: 9329374 - DNA, 22 bp, Homo sapiens
cagagcctaaaacgactccact

SEQ ID NO: 9329375 - DNA, 22 bp, Homo sapiens
gggctgaaaggccgcctcagat

SEQ ID NO: 9329376 - DNA, 22 bp, Homo sapiens
gggctgacaaccatctgacaag

SEQ ID NO: 9329377 - DNA, 22 bp, Homo sapiens
gggctctgtttagatcagagat

SEQ ID NO: 9329378 - DNA, 22 bp, Homo sapiens
gggctctgtttagatcagagat

SEQ ID NO: 9329379 - DNA, 22 bp, Homo sapiens
gggctctgtttagatcagagat

SEQ ID NO: 9329380 - DNA, 22 bp, Homo sapiens
gggctctgtttagaccagagat

SEQ ID NO: 9329381 - DNA, 22 bp, Homo sapiens
gggctctgtttagaccagagat

SEQ ID NO: 9329382 - DNA, 22 bp, Homo sapiens
gggctctgtttagaccagagat

SEQ ID NO: 9329383 - DNA, 22 bp, Homo sapiens
gggctgacaaccatctgacaag

SEQ ID NO: 9329384 - DNA, 22 bp, Homo sapiens
gggctgacaccacccaggcgca

SEQ ID NO: 9329385 - DNA, 22 bp, Homo sapiens
gggctgacaccacccaggcgca

SEQ ID NO: 9329386 - DNA, 22 bp, Homo sapiens
gggctgacagcacgccttctgt

SEQ ID NO: 9329387 - DNA, 22 bp, Homo sapiens
gggctgaccccacccctcactc

SEQ ID NO: 9329388 - DNA, 22 bp, Homo sapiens
gggctgacagtttcccctgaaa

SEQ ID NO: 9329389 - DNA, 22 bp, Homo sapiens
gggctgacagtttcccctgaaa

SEQ ID NO: 9329390 - DNA, 22 bp, Homo sapiens
gggctgacagtttcccctgaaa

SEQ ID NO: 9329391 - DNA, 17 bp, Homo sapiens
gggctgacagtggcctc

SEQ ID NO: 9329392 - DNA, 22 bp, Homo sapiens
gggccactgggtcctgctggcc

SEQ ID NO: 9329393 - DNA, 22 bp, Homo sapiens
gggccacttctagtgcctcaga

SEQ ID NO: 9329394 - DNA, 22 bp, Homo sapiens
gggccagacccttggcgatctg

SEQ ID NO: 9329395 - DNA, 22 bp, Homo sapiens
gggccagacccttggcgatctg

SEQ ID NO: 9329396 - DNA, 22 bp, Homo sapiens
gggcagtgtcggggcccaggga

SEQ ID NO: 9329397 - DNA, 20 bp, Homo sapiens
gggctctgcttggcagaagt

SEQ ID NO: 9329398 - DNA, 20 bp, Homo sapiens
gggctctgcttggcagaagt

SEQ ID NO: 9329399 - DNA, 20 bp, Homo sapiens
gggctctgcttggcagaagt

SEQ ID NO: 9329400 - DNA, 22 bp, Homo sapiens
gggctctgcgggcccggactcc

SEQ ID NO: 9329401 - DNA, 22 bp, Homo sapiens
gggctctgcgggcccggactcc

SEQ ID NO: 9329402 - DNA, 22 bp, Homo sapiens
gggccagcctactgctagaccc

SEQ ID NO: 9329403 - DNA, 22 bp, Homo sapiens
gggccagcctactgctagaccc

SEQ ID NO: 9329404 - DNA, 22 bp, Homo sapiens
gggccagcagtatcggaggcat

SEQ ID NO: 9329405 - DNA, 22 bp, Homo sapiens
gggccagagcttggcagctggg

SEQ ID NO: 9329406 - DNA, 22 bp, Homo sapiens
gggccagagcttggcagctggg

SEQ ID NO: 9329407 - DNA, 22 bp, Homo sapiens
gggccagagcttggcagctggg

SEQ ID NO: 9329408 - DNA, 22 bp, Homo sapiens
ggcttagattgacactgatctc

SEQ ID NO: 9329409 - DNA, 20 bp, Homo sapiens
ggcttagactgagttctcac

SEQ ID NO: 9329410 - DNA, 22 bp, Homo sapiens
ggcttcaccaggtgcatgcatg

SEQ ID NO: 9329411 - DNA, 22 bp, Homo sapiens
ggcttcagaggggaggtagtgc

SEQ ID NO: 9329412 - DNA, 22 bp, Homo sapiens
ggcttcagaagactggacaggt

SEQ ID NO: 9329413 - DNA, 22 bp, Homo sapiens
ggcttcagaagactggacaggt

SEQ ID NO: 9329414 - DNA, 22 bp, Homo sapiens
cagacagggtcctgtccgtcac

SEQ ID NO: 9329415 - DNA, 22 bp, Homo sapiens
cagacccttttctgagaggacc

SEQ ID NO: 9329416 - DNA, 21 bp, Homo sapiens
cagaccctctagaggccacct

SEQ ID NO: 9329417 - DNA, 23 bp, Homo sapiens
cagaccctcaatccacttgtttt

SEQ ID NO: 9329418 - DNA, 22 bp, Homo sapiens
cagaccagaaggaagccgacaa

SEQ ID NO: 9329419 - DNA, 21 bp, Homo sapiens
cagaccattgcatgagcaggt

SEQ ID NO: 9329420 - DNA, 22 bp, Homo sapiens
cagacctgaggagcactgagcc

SEQ ID NO: 9329421 - DNA, 22 bp, Homo sapiens
cagacctgaggagcactgagcc

SEQ ID NO: 9329422 - DNA, 20 bp, Homo sapiens
cagacctgcacccacttcga

SEQ ID NO: 9329423 - DNA, 20 bp, Homo sapiens
cagacctgcacccacttcga

SEQ ID NO: 9329424 - DNA, 22 bp, Homo sapiens
cagacctgaggttgagtaccag

SEQ ID NO: 9329425 - DNA, 22 bp, Homo sapiens
cagacctgggtccctggcctgt

SEQ ID NO: 9329426 - DNA, 19 bp, Homo sapiens
cagacctgtccagcctgtg

SEQ ID NO: 9329427 - DNA, 22 bp, Homo sapiens
cagacctgggtccctggcctgt

SEQ ID NO: 9329428 - DNA, 22 bp, Homo sapiens
cagacctggggcctgggagccc

SEQ ID NO: 9329429 - DNA, 23 bp, Homo sapiens
cagacctttctgtatcagttatc

SEQ ID NO: 9329430 - DNA, 19 bp, Homo sapiens
cagacctgtccagcctgtg

SEQ ID NO: 9329431 - DNA, 22 bp, Homo sapiens
gggcagcagagccctgccgagt

SEQ ID NO: 9329432 - DNA, 22 bp, Homo sapiens
gggcagcagagccctgccgagt

SEQ ID NO: 9329433 - DNA, 22 bp, Homo sapiens
gggcagagaaatggacagttgg

SEQ ID NO: 9329434 - DNA, 22 bp, Homo sapiens
gggcagagaaatggacagttgg

SEQ ID NO: 9329435 - DNA, 22 bp, Homo sapiens
gggcagagactcagaaacagaa

SEQ ID NO: 9329436 - DNA, 22 bp, Homo sapiens
cagactgggctggtggaaagct

SEQ ID NO: 9329437 - DNA, 22 bp, Homo sapiens
cagactgggctggtggaaagct

SEQ ID NO: 9329438 - DNA, 22 bp, Homo sapiens
cagactgtagagtttgagaagt

SEQ ID NO: 9329439 - DNA, 22 bp, Homo sapiens
cagactgggagtcaggaagaag

SEQ ID NO: 9329440 - DNA, 22 bp, Homo sapiens
cagactggccacatctgcactg

SEQ ID NO: 9329441 - DNA, 22 bp, Homo sapiens
cagactggccacatctgcactg

SEQ ID NO: 9329442 - DNA, 22 bp, Homo sapiens
cagactcttgagctgattgtat

SEQ ID NO: 9329443 - DNA, 22 bp, Homo sapiens
cagactctgatgcagccttgtg

SEQ ID NO: 9329444 - DNA, 22 bp, Homo sapiens
gggcagcagagccctgccgagt

SEQ ID NO: 9329445 - DNA, 22 bp, Homo sapiens
gggcagcagcaggaggtctctg

SEQ ID NO: 9329446 - DNA, 22 bp, Homo sapiens
gggcagcattctgtgggcaggt

SEQ ID NO: 9329447 - DNA, 22 bp, Homo sapiens
gggcagcattctgtgggcaggt

SEQ ID NO: 9329448 - DNA, 22 bp, Homo sapiens
cagagacaggaatcagctgcag

SEQ ID NO: 9329449 - DNA, 22 bp, Homo sapiens
cagagacaggaatcagctgcag

SEQ ID NO: 9329450 - DNA, 22 bp, Homo sapiens
gggcagtggttacacagctgag

SEQ ID NO: 9329451 - DNA, 20 bp, Homo sapiens
gggcagtggcgctatctcag

SEQ ID NO: 9329452 - DNA, 22 bp, Homo sapiens
gggcagtgggaccaggcaccag

SEQ ID NO: 9329453 - DNA, 22 bp, Homo sapiens
gggcagtgggaccaggcaccag

SEQ ID NO: 9329454 - DNA, 22 bp, Homo sapiens
gggcagtgggtggctgcagcct

SEQ ID NO: 9329455 - DNA, 22 bp, Homo sapiens
gggcagtgggtggctgcagcct

SEQ ID NO: 9329456 - DNA, 22 bp, Homo sapiens
gggcagtgggtggctgcagcct

SEQ ID NO: 9329457 - DNA, 22 bp, Homo sapiens
gggcagtgggtggctgcagcct

SEQ ID NO: 9329458 - DNA, 22 bp, Homo sapiens
gggcaggtaggtgaaataatga

SEQ ID NO: 9329459 - DNA, 22 bp, Homo sapiens
gggcaggtatttatcttctatt

SEQ ID NO: 9329460 - DNA, 22 bp, Homo sapiens
gggcaggtatttatcttctatt

SEQ ID NO: 9329461 - DNA, 22 bp, Homo sapiens
cagagacaggatctcgaagact

SEQ ID NO: 9329462 - DNA, 22 bp, Homo sapiens
cagagtcctgcaccagctccag

SEQ ID NO: 9329463 - DNA, 22 bp, Homo sapiens
cagagtcctggacacagagaca

SEQ ID NO: 9329464 - DNA, 22 bp, Homo sapiens
cagagtcctgcaccagctccag

SEQ ID NO: 9329465 - DNA, 22 bp, Homo sapiens
cagagtctctgggaggctgggt

SEQ ID NO: 9329466 - DNA, 22 bp, Homo sapiens
cagagtctctgggaggctgggt

SEQ ID NO: 9329467 - DNA, 22 bp, Homo sapiens
cagagtctgcgagcagaggggc

SEQ ID NO: 9329468 - DNA, 22 bp, Homo sapiens
cagagtctggactgcaggctcc

SEQ ID NO: 9329469 - DNA, 22 bp, Homo sapiens
cagagtctgcgagcagaggggc

SEQ ID NO: 9329470 - DNA, 18 bp, Homo sapiens
ggtcctgggcctggctca

SEQ ID NO: 9329471 - DNA, 22 bp, Homo sapiens
ggtcctgggaagatgctcatga

SEQ ID NO: 9329472 - DNA, 18 bp, Homo sapiens
ggtcctgggcctggctca

SEQ ID NO: 9329473 - DNA, 22 bp, Homo sapiens
ggtcctgggaagatgctcatga

SEQ ID NO: 9329474 - DNA, 22 bp, Homo sapiens
ggtcctgggaagatgctcatga

SEQ ID NO: 9329475 - DNA, 22 bp, Homo sapiens
ggtcatgagggagcagtgcagg

SEQ ID NO: 9329476 - DNA, 22 bp, Homo sapiens
ggtcatgaggagggagaaggtt

SEQ ID NO: 9329477 - DNA, 22 bp, Homo sapiens
ggtcatgtgtccaggaggtagc

SEQ ID NO: 9329478 - DNA, 22 bp, Homo sapiens
ggtcatgttttaaaaatattgt

SEQ ID NO: 9329479 - DNA, 22 bp, Homo sapiens
ggtcatggatagctggagcctt

SEQ ID NO: 9329480 - DNA, 22 bp, Homo sapiens
ggtcatggatagctggagcctt

SEQ ID NO: 9329481 - DNA, 22 bp, Homo sapiens
cagagtcatatcagagaatatg

SEQ ID NO: 9329482 - DNA, 23 bp, Homo sapiens
cagagtcagggggccccacctct

SEQ ID NO: 9329483 - DNA, 22 bp, Homo sapiens
cagagtcagtattgaattgaaa

SEQ ID NO: 9329484 - DNA, 22 bp, Homo sapiens
cagagtccaattgctcagagcg

SEQ ID NO: 9329485 - DNA, 22 bp, Homo sapiens
cagagtcatgggccgtcaggca

SEQ ID NO: 9329486 - DNA, 22 bp, Homo sapiens
cagagtcccagatgcccctcct

SEQ ID NO: 9329487 - DNA, 22 bp, Homo sapiens
cagagtcccagatgcccctcct

SEQ ID NO: 9329488 - DNA, 22 bp, Homo sapiens
ggtcagggttccaggtatcttc

SEQ ID NO: 9329489 - DNA, 22 bp, Homo sapiens
ggtcacagggaagggctctcaa

SEQ ID NO: 9329490 - DNA, 22 bp, Homo sapiens
ggtcacagggaagggctctcaa

SEQ ID NO: 9329491 - DNA, 22 bp, Homo sapiens
ggtcacaggggagaagagtgat

SEQ ID NO: 9329492 - DNA, 22 bp, Homo sapiens
ggtcaggtagctctgacaggcc

SEQ ID NO: 9329493 - DNA, 22 bp, Homo sapiens
ggtcaggtagctctgacaggcc

SEQ ID NO: 9329494 - DNA, 22 bp, Homo sapiens
ggtcaggtagctctgacaggcc

SEQ ID NO: 9329495 - DNA, 22 bp, Homo sapiens
ggtcaggtaggaagttaactat

SEQ ID NO: 9329496 - DNA, 22 bp, Homo sapiens
ggtcaggtagctctgacaggcc

SEQ ID NO: 9329497 - DNA, 22 bp, Homo sapiens
ggtcaggtggcttctgtcctct

SEQ ID NO: 9329498 - DNA, 22 bp, Homo sapiens
ggtcaggtaggaagttaactat

SEQ ID NO: 9329499 - DNA, 22 bp, Homo sapiens
cagagggttgatgtgaggctta

SEQ ID NO: 9329500 - DNA, 22 bp, Homo sapiens
cagagggttgatgtgaggctta

SEQ ID NO: 9329501 - DNA, 22 bp, Homo sapiens
ggtcagtctctcccgagtgttg

SEQ ID NO: 9329502 - DNA, 22 bp, Homo sapiens
ggtcaggtttttaggagtgacc

SEQ ID NO: 9329503 - DNA, 22 bp, Homo sapiens
ggtcaggtttttaggagtgacc

SEQ ID NO: 9329504 - DNA, 22 bp, Homo sapiens
ggtcaggtggcttctgtcctct

SEQ ID NO: 9329505 - DNA, 22 bp, Homo sapiens
ggtcagtgcctatcatgtgggc

SEQ ID NO: 9329506 - DNA, 22 bp, Homo sapiens
ggtcagtgagcaaacaaccacg

SEQ ID NO: 9329507 - DNA, 22 bp, Homo sapiens
ggtcagtgcgatttcccactcc

SEQ ID NO: 9329508 - DNA, 22 bp, Homo sapiens
ggtcagtgcctatcatgtgggc

SEQ ID NO: 9329509 - DNA, 22 bp, Homo sapiens
ggtcagtggcagggggtacttc

SEQ ID NO: 9329510 - DNA, 22 bp, Homo sapiens
ggtcagtgctgccagagtgacc

SEQ ID NO: 9329511 - DNA, 22 bp, Homo sapiens
ggtcagtggacaaaggagtttc

SEQ ID NO: 9329512 - DNA, 22 bp, Homo sapiens
ggtcagtggccaggaagcagtc

SEQ ID NO: 9329513 - DNA, 22 bp, Homo sapiens
ggtcatctgcctccaaagcact

SEQ ID NO: 9329514 - DNA, 22 bp, Homo sapiens
ggtcatatctttctgattgttc

SEQ ID NO: 9329515 - DNA, 21 bp, Homo sapiens
cagagggccggcatgtggtct

SEQ ID NO: 9329516 - DNA, 22 bp, Homo sapiens
cagagggctcagtcctgctgga

SEQ ID NO: 9329517 - DNA, 22 bp, Homo sapiens
cagagggctcttggctgcctgc

SEQ ID NO: 9329518 - DNA, 22 bp, Homo sapiens
cagagggctgccctgagttcgt

SEQ ID NO: 9329519 - DNA, 22 bp, Homo sapiens
cagagggctcttggctgcctgc

SEQ ID NO: 9329520 - DNA, 21 bp, Homo sapiens
cagagggcttttctctgttct

SEQ ID NO: 9329521 - DNA, 22 bp, Homo sapiens
cagagggtggaggccaggctct

SEQ ID NO: 9329522 - DNA, 22 bp, Homo sapiens
ggggagcaatagttgaggtgtg

SEQ ID NO: 9329523 - DNA, 22 bp, Homo sapiens
ggggagcagaagcagcaacaac

SEQ ID NO: 9329524 - DNA, 22 bp, Homo sapiens
cagaggctttgccctggaaacc

SEQ ID NO: 9329525 - DNA, 22 bp, Homo sapiens
ggggagcttggttattcatgca

SEQ ID NO: 9329526 - DNA, 22 bp, Homo sapiens
ggggagcttcaggtggcttaca

SEQ ID NO: 9329527 - DNA, 22 bp, Homo sapiens
ggggagctgggaggtgagttac

SEQ ID NO: 9329528 - DNA, 22 bp, Homo sapiens
cagaggcacagtgcgggccact

SEQ ID NO: 9329529 - DNA, 19 bp, Homo sapiens
cagaggcaccaggtataga

SEQ ID NO: 9329530 - DNA, 22 bp, Homo sapiens
cagaggcacagcttcttttaat

SEQ ID NO: 9329531 - DNA, 22 bp, Homo sapiens
cagaggcacagtgcgggccact

SEQ ID NO: 9329532 - DNA, 22 bp, Homo sapiens
cagaggcacaagaaagcaaggc

SEQ ID NO: 9329533 - DNA, 19 bp, Homo sapiens
cagaggcaccaggtataga

SEQ ID NO: 9329534 - DNA, 19 bp, Homo sapiens
cagaggcaccaggtataga

SEQ ID NO: 9329535 - DNA, 22 bp, Homo sapiens
ggggagagtcctttccagttcc

SEQ ID NO: 9329536 - DNA, 22 bp, Homo sapiens
ggggagagtcctttccagttcc

SEQ ID NO: 9329537 - DNA, 22 bp, Homo sapiens
ggggagagtcctttccagttcc

SEQ ID NO: 9329538 - DNA, 22 bp, Homo sapiens
ggggagagtcctttccagttcc

SEQ ID NO: 9329539 - DNA, 22 bp, Homo sapiens
ggggagagtattttattcaagt

SEQ ID NO: 9329540 - DNA, 22 bp, Homo sapiens
ggggagagtattttattcaagt

SEQ ID NO: 9329541 - DNA, 22 bp, Homo sapiens
cagcacagtttgcttggcagag

SEQ ID NO: 9329542 - DNA, 22 bp, Homo sapiens
cagcacatctgattatatgact

SEQ ID NO: 9329543 - DNA, 22 bp, Homo sapiens
cagcacatctgattatatgact

SEQ ID NO: 9329544 - DNA, 22 bp, Homo sapiens
cagcacatgctcatcagggaag

SEQ ID NO: 9329545 - DNA, 22 bp, Homo sapiens
cagcaccattttcctggtcagc

SEQ ID NO: 9329546 - DNA, 22 bp, Homo sapiens
cagcaccatttgcagcctcttt

SEQ ID NO: 9329547 - DNA, 22 bp, Homo sapiens
cagcacagtttcccccatgagc

SEQ ID NO: 9329548 - DNA, 20 bp, Homo sapiens
ggtgctgataagaaagaagt

SEQ ID NO: 9329549 - DNA, 22 bp, Homo sapiens
ggtgctgagtgagctagaggct

SEQ ID NO: 9329550 - DNA, 22 bp, Homo sapiens
ggtgctgatctaaatttaggac

SEQ ID NO: 9329551 - DNA, 22 bp, Homo sapiens
ggtgctgatattgttttggtga

SEQ ID NO: 9329552 - DNA, 22 bp, Homo sapiens
ggtgctgatagtaacaataata

SEQ ID NO: 9329553 - DNA, 22 bp, Homo sapiens
ggtgctgactgaggatggcttg

SEQ ID NO: 9329554 - DNA, 22 bp, Homo sapiens
ggtgctgacttcacagtcttac

SEQ ID NO: 9329555 - DNA, 22 bp, Homo sapiens
ggtgctgagagcctaggagggc

SEQ ID NO: 9329556 - DNA, 22 bp, Homo sapiens
ggtgctgaggccttggcaggga

SEQ ID NO: 9329557 - DNA, 22 bp, Homo sapiens
ggtgctgagagcctaggagggc

SEQ ID NO: 9329558 - DNA, 22 bp, Homo sapiens
cagcaaggactgggcatgtgaa

SEQ ID NO: 9329559 - DNA, 22 bp, Homo sapiens
cagcaaggactgggcatgtgaa

SEQ ID NO: 9329560 - DNA, 21 bp, Homo sapiens
cagcaaggaagtcgagtaggt

SEQ ID NO: 9329561 - DNA, 22 bp, Homo sapiens
ggtgctgaattctggaggaggc

SEQ ID NO: 9329562 - DNA, 22 bp, Homo sapiens
ggtgctgaataaatactagtta

SEQ ID NO: 9329563 - DNA, 19 bp, Homo sapiens
ggtgctgacatcatgcttt

SEQ ID NO: 9329564 - DNA, 22 bp, Homo sapiens
ggtgctgacattcagagtctgg

SEQ ID NO: 9329565 - DNA, 22 bp, Homo sapiens
ggtgctgactctgtcgtgagca

SEQ ID NO: 9329566 - DNA, 22 bp, Homo sapiens
cagcacaattttcaggagtcca

SEQ ID NO: 9329567 - DNA, 22 bp, Homo sapiens
ggtgctggttcagggtggctgt

SEQ ID NO: 9329568 - DNA, 22 bp, Homo sapiens
cagcacacagtgactcgcacct

SEQ ID NO: 9329569 - DNA, 22 bp, Homo sapiens
cagcacacagtgactcgcacct

SEQ ID NO: 9329570 - DNA, 22 bp, Homo sapiens
cagcacagtacaaggcacggat

SEQ ID NO: 9329571 - DNA, 22 bp, Homo sapiens
ggtgctgatttgttgctgagat

SEQ ID NO: 9329572 - DNA, 22 bp, Homo sapiens
ggtgctgattcactgacttctg

SEQ ID NO: 9329573 - DNA, 22 bp, Homo sapiens
ggtgctgattaagaactgtata

SEQ ID NO: 9329574 - DNA, 22 bp, Homo sapiens
ggtgctgatgttattgatgctg

SEQ ID NO: 9329575 - DNA, 22 bp, Homo sapiens
ggtgctgatgagttaggagagg

SEQ ID NO: 9329576 - DNA, 22 bp, Homo sapiens
ggtgctgatgaagatgtagcct

SEQ ID NO: 9329577 - DNA, 22 bp, Homo sapiens
ggtgaccagggtcagtagcttt

SEQ ID NO: 9329578 - DNA, 22 bp, Homo sapiens
ggtgacctcacctggtcccacc

SEQ ID NO: 9329579 - DNA, 19 bp, Homo sapiens
ggtgaccacctggtcagtg

SEQ ID NO: 9329580 - DNA, 22 bp, Homo sapiens
ggtctggaataaggtccaggaa

SEQ ID NO: 9329581 - DNA, 22 bp, Homo sapiens
ggtgacagtggttaaaatttgt

SEQ ID NO: 9329582 - DNA, 22 bp, Homo sapiens
ggtgacagtggttaaaatttgt

SEQ ID NO: 9329583 - DNA, 22 bp, Homo sapiens
ggtctggaagcgtcccaaaggt

SEQ ID NO: 9329584 - DNA, 22 bp, Homo sapiens
ggtctggaacgaggtctaagcc

SEQ ID NO: 9329585 - DNA, 22 bp, Homo sapiens
ggtctggaagcgcagtaggctg

SEQ ID NO: 9329586 - DNA, 22 bp, Homo sapiens
ggtctgaggtttgggattcact

SEQ ID NO: 9329587 - DNA, 22 bp, Homo sapiens
ggtctgagtagagggctggcga

SEQ ID NO: 9329588 - DNA, 22 bp, Homo sapiens
ggtctgaggtgggacccaggaa

SEQ ID NO: 9329589 - DNA, 22 bp, Homo sapiens
ggtctgagcttgagcccatgct

SEQ ID NO: 9329590 - DNA, 22 bp, Homo sapiens
ggtctgagatatttgttcagct

SEQ ID NO: 9329591 - DNA, 22 bp, Homo sapiens
ggtctgagtggtgctgactcag

SEQ ID NO: 9329592 - DNA, 22 bp, Homo sapiens
ggtctgcccactactctccatt

SEQ ID NO: 9329593 - DNA, 23 bp, Homo sapiens
ggtctgcttcctagtttgcagat

SEQ ID NO: 9329594 - DNA, 22 bp, Homo sapiens
ggtctggaacccctcaagtgac

SEQ ID NO: 9329595 - DNA, 22 bp, Homo sapiens
ggtctgcgatggcaagggtctt

SEQ ID NO: 9329596 - DNA, 21 bp, Homo sapiens
ggtctgctgtgtctagcctca

SEQ ID NO: 9329597 - DNA, 22 bp, Homo sapiens
ggtctgagtgggcaggggccgg

SEQ ID NO: 9329598 - DNA, 22 bp, Homo sapiens
ggtctgagtagagggctggcga

SEQ ID NO: 9329599 - DNA, 22 bp, Homo sapiens
cagcaaagtaagctgacatgta

SEQ ID NO: 9329600 - DNA, 22 bp, Homo sapiens
cagcaaagtaagctgacatgta

SEQ ID NO: 9329601 - DNA, 22 bp, Homo sapiens
ggtgacggggcccaggtttcct

SEQ ID NO: 9329602 - DNA, 22 bp, Homo sapiens
ggtgactcccagctgctctctt

SEQ ID NO: 9329603 - DNA, 21 bp, Homo sapiens
cagcaaggaagtcgagtaggt

SEQ ID NO: 9329604 - DNA, 22 bp, Homo sapiens
cagcaagacttcagggcttggt

SEQ ID NO: 9329605 - DNA, 22 bp, Homo sapiens
cagcaagagaggcagggcaaat

SEQ ID NO: 9329606 - DNA, 22 bp, Homo sapiens
caaatgtgtaaggaagtgttag

SEQ ID NO: 9329607 - DNA, 22 bp, Homo sapiens
caagattatcttcttcttgtta

SEQ ID NO: 9329608 - DNA, 22 bp, Homo sapiens
caaatgtattctcacttcaggg

SEQ ID NO: 9329609 - DNA, 22 bp, Homo sapiens
caagcaggatgaagcccaggga

SEQ ID NO: 9329610 - DNA, 22 bp, Homo sapiens
caagcagggagcatcaagggag

SEQ ID NO: 9329611 - DNA, 22 bp, Homo sapiens
caagcagggatactgcagggag

SEQ ID NO: 9329612 - DNA, 22 bp, Homo sapiens
caagcagccccaacatgaggat

SEQ ID NO: 9329613 - DNA, 22 bp, Homo sapiens
caagatttaagagtcagccttg

SEQ ID NO: 9329614 - DNA, 22 bp, Homo sapiens
caagcagccccaacatgaggat

SEQ ID NO: 9329615 - DNA, 22 bp, Homo sapiens
caagcagccccaacatgaggat

SEQ ID NO: 9329616 - DNA, 23 bp, Homo sapiens
caaatgtagtgtgtccacccctg

SEQ ID NO: 9329617 - DNA, 22 bp, Homo sapiens
caaatgtaattgcggtttttgc

SEQ ID NO: 9329618 - DNA, 22 bp, Homo sapiens
caaatgtatgttttcctatgta

SEQ ID NO: 9329619 - DNA, 22 bp, Homo sapiens
caaatgtatcagcccagggatt

SEQ ID NO: 9329620 - DNA, 22 bp, Homo sapiens
caaatgtataaatgtactttct

SEQ ID NO: 9329621 - DNA, 22 bp, Homo sapiens
caaatgtaaattcttttgaagc

SEQ ID NO: 9329622 - DNA, 22 bp, Homo sapiens
caaatgtaataaggagtttccc

SEQ ID NO: 9329623 - DNA, 22 bp, Homo sapiens
caaatgtaatggcaggttttgc

SEQ ID NO: 9329624 - DNA, 22 bp, Homo sapiens
caagccagtgacagccagggaa

SEQ ID NO: 9329625 - DNA, 22 bp, Homo sapiens
caagccaggtgaacataacaag

SEQ ID NO: 9329626 - DNA, 22 bp, Homo sapiens
caagccagctcctgccacagag

SEQ ID NO: 9329627 - DNA, 22 bp, Homo sapiens
caagccagcttgatgacctgtc

SEQ ID NO: 9329628 - DNA, 22 bp, Homo sapiens
caagccagctcctgccacagag

SEQ ID NO: 9329629 - DNA, 22 bp, Homo sapiens
caagcagggtttatgcatggag

SEQ ID NO: 9329630 - DNA, 22 bp, Homo sapiens
caagcagggtttatgcatggag

SEQ ID NO: 9329631 - DNA, 22 bp, Homo sapiens
caagcagggtttatgcatggag

SEQ ID NO: 9329632 - DNA, 22 bp, Homo sapiens
caagcagggatactgcagggag

SEQ ID NO: 9329633 - DNA, 22 bp, Homo sapiens
caagcagggagcatcaagggag

SEQ ID NO: 9329634 - DNA, 21 bp, Homo sapiens
caagccagaccaatagcagcc

SEQ ID NO: 9329635 - DNA, 22 bp, Homo sapiens
caagcatactgtgagagtttta

SEQ ID NO: 9329636 - DNA, 22 bp, Homo sapiens
gctggaggatggactggaagaa

SEQ ID NO: 9329637 - DNA, 22 bp, Homo sapiens
gctggaggatggactggaagaa

SEQ ID NO: 9329638 - DNA, 22 bp, Homo sapiens
gctggaggatggactggaagaa

SEQ ID NO: 9329639 - DNA, 22 bp, Homo sapiens
gctggaggatggactggaagaa

SEQ ID NO: 9329640 - DNA, 22 bp, Homo sapiens
gctggaggatggactggaagaa

SEQ ID NO: 9329641 - DNA, 22 bp, Homo sapiens
gctggaggatcacttgagccca

SEQ ID NO: 9329642 - DNA, 22 bp, Homo sapiens
gctggaggatggactggaagaa

SEQ ID NO: 9329643 - DNA, 22 bp, Homo sapiens
gctggaggaggaagtgtgaggg

SEQ ID NO: 9329644 - DNA, 22 bp, Homo sapiens
gctggaggaggaagtgtgaggg

SEQ ID NO: 9329645 - DNA, 22 bp, Homo sapiens
gctggaggatcacttgagccca

SEQ ID NO: 9329646 - DNA, 22 bp, Homo sapiens
caagccagtgacagccagggaa

SEQ ID NO: 9329647 - DNA, 22 bp, Homo sapiens
gctggagcttgagaggacaggg

SEQ ID NO: 9329648 - DNA, 22 bp, Homo sapiens
gctggctggctgtgcaaaggca

SEQ ID NO: 9329649 - DNA, 22 bp, Homo sapiens
caaggccttcgtctcctagctt

SEQ ID NO: 9329650 - DNA, 22 bp, Homo sapiens
gctggctggctgtgcaaaggca

SEQ ID NO: 9329651 - DNA, 22 bp, Homo sapiens
gctggctgggacagattccatt

SEQ ID NO: 9329652 - DNA, 22 bp, Homo sapiens
gctggctggctgtgcaaaggca

SEQ ID NO: 9329653 - DNA, 22 bp, Homo sapiens
gctggctgggtccctgagaggc

SEQ ID NO: 9329654 - DNA, 22 bp, Homo sapiens
gctggctgggacagattccatt

SEQ ID NO: 9329655 - DNA, 22 bp, Homo sapiens
gctggctgggtccctgagaggc

SEQ ID NO: 9329656 - DNA, 22 bp, Homo sapiens
gctggctgggtccctgagaggc

SEQ ID NO: 9329657 - DNA, 22 bp, Homo sapiens
gctggctggtccagcaggggct

SEQ ID NO: 9329658 - DNA, 22 bp, Homo sapiens
gctggctggtccagcaggggct

SEQ ID NO: 9329659 - DNA, 22 bp, Homo sapiens
gctggctgtatcacctggccag

SEQ ID NO: 9329660 - DNA, 22 bp, Homo sapiens
gctggctgtatcacctggccag

SEQ ID NO: 9329661 - DNA, 22 bp, Homo sapiens
gctggctgtatcacctggccag

SEQ ID NO: 9329662 - DNA, 22 bp, Homo sapiens
caagggtggtattgggagcata

SEQ ID NO: 9329663 - DNA, 22 bp, Homo sapiens
caaggccatgagcagcgagtgt

SEQ ID NO: 9329664 - DNA, 22 bp, Homo sapiens
caaggccatgagcagcgagtgt

SEQ ID NO: 9329665 - DNA, 22 bp, Homo sapiens
caaggccatattgcctgtatgt

SEQ ID NO: 9329666 - DNA, 22 bp, Homo sapiens
caaggccatattgcctgtatgt

SEQ ID NO: 9329667 - DNA, 22 bp, Homo sapiens
caaggcctaatcatactgctaa

SEQ ID NO: 9329668 - DNA, 22 bp, Homo sapiens
caaggcctatgcacacctagga

SEQ ID NO: 9329669 - DNA, 22 bp, Homo sapiens
caaggccagagccagcgataag

SEQ ID NO: 9329670 - DNA, 17 bp, Homo sapiens
caaggccagcatcttca

SEQ ID NO: 9329671 - DNA, 22 bp, Homo sapiens
caaggccagagccagcgataag

SEQ ID NO: 9329672 - DNA, 22 bp, Homo sapiens
caaggccagggaatttttctgg

SEQ ID NO: 9329673 - DNA, 22 bp, Homo sapiens
caaggccagtccattttggaag

SEQ ID NO: 9329674 - DNA, 22 bp, Homo sapiens
caaggccagtccattttggaag

SEQ ID NO: 9329675 - DNA, 22 bp, Homo sapiens
caaggccagggaatttttctgg

SEQ ID NO: 9329676 - DNA, 17 bp, Homo sapiens
caaggccagcatcttca

SEQ ID NO: 9329677 - DNA, 22 bp, Homo sapiens
caaggccagttcaccaagggca

SEQ ID NO: 9329678 - DNA, 22 bp, Homo sapiens
caaggccagttcaccaagggca

SEQ ID NO: 9329679 - DNA, 22 bp, Homo sapiens
caaggccagttcaccaagggca

SEQ ID NO: 9329680 - DNA, 22 bp, Homo sapiens
caaggccagttcaccaagggca

SEQ ID NO: 9329681 - DNA, 22 bp, Homo sapiens
caaggccagtttctcctagtca

SEQ ID NO: 9329682 - DNA, 22 bp, Homo sapiens
caaggccagtttctcctagtca

SEQ ID NO: 9329683 - DNA, 22 bp, Homo sapiens
caaggccataagagatacaaaa

SEQ ID NO: 9329684 - DNA, 22 bp, Homo sapiens
caaggccataagagatacaaaa

SEQ ID NO: 9329685 - DNA, 22 bp, Homo sapiens
caaggccataagagatacaaaa

SEQ ID NO: 9329686 - DNA, 22 bp, Homo sapiens
caaggccactgctcaggtttcc

SEQ ID NO: 9329687 - DNA, 22 bp, Homo sapiens
caaggccactgctcaggtttcc

SEQ ID NO: 9329688 - DNA, 22 bp, Homo sapiens
caaggccactccagagactggt

SEQ ID NO: 9329689 - DNA, 22 bp, Homo sapiens
caaggccactccagagactggt

SEQ ID NO: 9329690 - DNA, 22 bp, Homo sapiens
caaggccacgttctgcatgcgg

SEQ ID NO: 9329691 - DNA, 19 bp, Homo sapiens
caaggccaccatttctccg

SEQ ID NO: 9329692 - DNA, 22 bp, Homo sapiens
caaggccactccagagactggt

SEQ ID NO: 9329693 - DNA, 22 bp, Homo sapiens
caaggccacgttctgcatgcgg

SEQ ID NO: 9329694 - DNA, 22 bp, Homo sapiens
caaggccaagtctctgtgaaga

SEQ ID NO: 9329695 - DNA, 22 bp, Homo sapiens
caaggccaagtctctgtgaaga

SEQ ID NO: 9329696 - DNA, 22 bp, Homo sapiens
caaggccaagtctctgtgaaga

SEQ ID NO: 9329697 - DNA, 19 bp, Homo sapiens
caaggccaccatttctccg

SEQ ID NO: 9329698 - DNA, 22 bp, Homo sapiens
caaggccaaggttttgtgaact

SEQ ID NO: 9329699 - DNA, 22 bp, Homo sapiens
caaggccaaggttttgtgaact

SEQ ID NO: 9329700 - DNA, 22 bp, Homo sapiens
gctggaggctggagtgcagtgg

SEQ ID NO: 9329701 - DNA, 22 bp, Homo sapiens
gctggaggctggagtgcagtgg

SEQ ID NO: 9329702 - DNA, 22 bp, Homo sapiens
gctggaggcagttcagacacca

SEQ ID NO: 9329703 - DNA, 22 bp, Homo sapiens
gctggaggcagttcagacacca

SEQ ID NO: 9329704 - DNA, 22 bp, Homo sapiens
gctttgattcttggcttatcag

SEQ ID NO: 9329705 - DNA, 22 bp, Homo sapiens
gctttgaagtctgtgtcttttg

SEQ ID NO: 9329706 - DNA, 22 bp, Homo sapiens
gctttgaagtctgtgtcttttg

SEQ ID NO: 9329707 - DNA, 22 bp, Homo sapiens
gctttcttcatactcaagcatc

SEQ ID NO: 9329708 - DNA, 22 bp, Homo sapiens
gctttcttgctgcatggtggct

SEQ ID NO: 9329709 - DNA, 22 bp, Homo sapiens
gctttcttcatactcaagcatc

SEQ ID NO: 9329710 - DNA, 22 bp, Homo sapiens
gctttgaagacttttccagggt

SEQ ID NO: 9329711 - DNA, 22 bp, Homo sapiens
caatgtttactggggacccaga

SEQ ID NO: 9329712 - DNA, 22 bp, Homo sapiens
caatgtttcttgtaaccagtga

SEQ ID NO: 9329713 - DNA, 22 bp, Homo sapiens
caatgtttgagtaggagcataa

SEQ ID NO: 9329714 - DNA, 22 bp, Homo sapiens
caagttttgcatagttctgtat

SEQ ID NO: 9329715 - DNA, 22 bp, Homo sapiens
caataactagtaattattccgg

SEQ ID NO: 9329716 - DNA, 22 bp, Homo sapiens
caataactgctaaattccctgt

SEQ ID NO: 9329717 - DNA, 22 bp, Homo sapiens
caataactgctaaattccctgt

SEQ ID NO: 9329718 - DNA, 22 bp, Homo sapiens
caataactagtaattattccgg

SEQ ID NO: 9329719 - DNA, 22 bp, Homo sapiens
caagtttacaatgtgtatgtgt

SEQ ID NO: 9329720 - DNA, 22 bp, Homo sapiens
caagtttgtgttctatcattct

SEQ ID NO: 9329721 - DNA, 22 bp, Homo sapiens
gctttcttagtgtgttaattgg

SEQ ID NO: 9329722 - DNA, 21 bp, Homo sapiens
gctttctgtggactctgcacc

SEQ ID NO: 9329723 - DNA, 22 bp, Homo sapiens
caataactgctgaggagaagca

SEQ ID NO: 9329724 - DNA, 22 bp, Homo sapiens
caagtttaaggcactgataagt

SEQ ID NO: 9329725 - DNA, 22 bp, Homo sapiens
gctgttctttgcatctctggtg

SEQ ID NO: 9329726 - DNA, 21 bp, Homo sapiens
gctgttcggcggccctcgcgc

SEQ ID NO: 9329727 - DNA, 22 bp, Homo sapiens
gctgttctccgatgaccccgtg

SEQ ID NO: 9329728 - DNA, 22 bp, Homo sapiens
gctgttctgtccccatgggtaa

SEQ ID NO: 9329729 - DNA, 22 bp, Homo sapiens
gctgttctgcaccagacttcag

SEQ ID NO: 9329730 - DNA, 22 bp, Homo sapiens
gctgtgttttatgttaggttaa

SEQ ID NO: 9329731 - DNA, 22 bp, Homo sapiens
gctgttcaaaagccacagttac

SEQ ID NO: 9329732 - DNA, 21 bp, Homo sapiens
gctgttcccaatcctgggctg

SEQ ID NO: 9329733 - DNA, 22 bp, Homo sapiens
caagtcaagcatgcccttattt

SEQ ID NO: 9329734 - DNA, 22 bp, Homo sapiens
gctgtggcctggcgcagagctg

SEQ ID NO: 9329735 - DNA, 22 bp, Homo sapiens
gctgtggcggcagcagctggtg

SEQ ID NO: 9329736 - DNA, 22 bp, Homo sapiens
caagtcaactcaaattgttatc

SEQ ID NO: 9329737 - DNA, 22 bp, Homo sapiens
caagtatttgcggagttccacg

SEQ ID NO: 9329738 - DNA, 22 bp, Homo sapiens
caagtattttaaggactagtgg

SEQ ID NO: 9329739 - DNA, 20 bp, Homo sapiens
caagggtttgcattggcttt

SEQ ID NO: 9329740 - DNA, 22 bp, Homo sapiens
caaggtctggttcctctgggtg

SEQ ID NO: 9329741 - DNA, 22 bp, Homo sapiens
caaggtgatacttacattagtg

SEQ ID NO: 9329742 - DNA, 22 bp, Homo sapiens
caaggtgaacttgctgtacagc

SEQ ID NO: 9329743 - DNA, 22 bp, Homo sapiens
caaggtgaacttgctgtacagc

SEQ ID NO: 9329744 - DNA, 22 bp, Homo sapiens
caaggtgccatgctgggcgggg

SEQ ID NO: 9329745 - DNA, 22 bp, Homo sapiens
caaggtttgaaaacgccatggc

SEQ ID NO: 9329746 - DNA, 22 bp, Homo sapiens
caaggtttgaaaacgccatggc

SEQ ID NO: 9329747 - DNA, 22 bp, Homo sapiens
caaggtttcgagttcccaacca

SEQ ID NO: 9329748 - DNA, 22 bp, Homo sapiens
caaggtttctatgctcaaagga

SEQ ID NO: 9329749 - DNA, 22 bp, Homo sapiens
caaggttttgcttgtaagggaa

SEQ ID NO: 9329750 - DNA, 22 bp, Homo sapiens
caaggttttggaagattttcgt

SEQ ID NO: 9329751 - DNA, 22 bp, Homo sapiens
caaggtttcgagttcccaacca

SEQ ID NO: 9329752 - DNA, 22 bp, Homo sapiens
caaggtttctatgctcaaagga

SEQ ID NO: 9329753 - DNA, 22 bp, Homo sapiens
caaggtttactttatgatccag

SEQ ID NO: 9329754 - DNA, 22 bp, Homo sapiens
caaggtttactttatgatccag

SEQ ID NO: 9329755 - DNA, 22 bp, Homo sapiens
caaggtttacattgggctatca

SEQ ID NO: 9329756 - DNA, 22 bp, Homo sapiens
caaggtgccatgctgggcgggg

SEQ ID NO: 9329757 - DNA, 22 bp, Homo sapiens
caaggtttacattgggctatca

SEQ ID NO: 9329758 - DNA, 22 bp, Homo sapiens
caaggttattatgtgcatctgt

SEQ ID NO: 9329759 - DNA, 22 bp, Homo sapiens
caagtattctgtaaaaagtcaa

SEQ ID NO: 9329760 - DNA, 22 bp, Homo sapiens
caagtagagattacagtgtgca

SEQ ID NO: 9329761 - DNA, 22 bp, Homo sapiens
caaggttttggaagattttcgt

SEQ ID NO: 9329762 - DNA, 22 bp, Homo sapiens
caaggttttgcttgtaagggaa

SEQ ID NO: 9329763 - DNA, 22 bp, Homo sapiens
caagtaatggttttataatagt

SEQ ID NO: 9329764 - DNA, 22 bp, Homo sapiens
caagtaattctgcaagaaacca

SEQ ID NO: 9329765 - DNA, 22 bp, Homo sapiens
ggaaggggagctggaaagggta

SEQ ID NO: 9329766 - DNA, 22 bp, Homo sapiens
ggaaggggagctggaaagggta

SEQ ID NO: 9329767 - DNA, 22 bp, Homo sapiens
ggaaggggagctggaaagggta

SEQ ID NO: 9329768 - DNA, 20 bp, Homo sapiens
ggaaggggcaaagtgtgtga

SEQ ID NO: 9329769 - DNA, 20 bp, Homo sapiens
ggaaggggcaaagtgtgtga

SEQ ID NO: 9329770 - DNA, 20 bp, Homo sapiens
ggaaggggcaaagtgtgtga

SEQ ID NO: 9329771 - DNA, 21 bp, Homo sapiens
ggaagggctctgaggacggct

SEQ ID NO: 9329772 - DNA, 21 bp, Homo sapiens
ggaagggctctgaggacggct

SEQ ID NO: 9329773 - DNA, 22 bp, Homo sapiens
ggaaggggagctggaaagggta

SEQ ID NO: 9329774 - DNA, 22 bp, Homo sapiens
ggaaggggagctggaaagggta

SEQ ID NO: 9329775 - DNA, 22 bp, Homo sapiens
ggaaggggccttgagcaaactg

SEQ ID NO: 9329776 - DNA, 22 bp, Homo sapiens
cacagaagaatcatgctgtgtt

SEQ ID NO: 9329777 - DNA, 22 bp, Homo sapiens
cacagaagaatcatgctgtgtt

SEQ ID NO: 9329778 - DNA, 22 bp, Homo sapiens
cacagaataattcacatggctc

SEQ ID NO: 9329779 - DNA, 22 bp, Homo sapiens
cacagaagtttcatagtctcga

SEQ ID NO: 9329780 - DNA, 22 bp, Homo sapiens
cacagaatcatattgtcagttt

SEQ ID NO: 9329781 - DNA, 22 bp, Homo sapiens
cacacagctagtgacaggagaa

SEQ ID NO: 9329782 - DNA, 22 bp, Homo sapiens
ggaagggcctcgggcgtgggac

SEQ ID NO: 9329783 - DNA, 22 bp, Homo sapiens
ggaagggcctcgggcgtgggac

SEQ ID NO: 9329784 - DNA, 22 bp, Homo sapiens
cacacaggagagtgctggaggt

SEQ ID NO: 9329785 - DNA, 22 bp, Homo sapiens
cacacagacagctctctgaaga

SEQ ID NO: 9329786 - DNA, 22 bp, Homo sapiens
cacacagacagctctctgaaga

SEQ ID NO: 9329787 - DNA, 15 bp, Homo sapiens
cacacagacagcttg

SEQ ID NO: 9329788 - DNA, 22 bp, Homo sapiens
cacacagacagctctctgaaga

SEQ ID NO: 9329789 - DNA, 22 bp, Homo sapiens
cacacagacagctctctgaaga

SEQ ID NO: 9329790 - DNA, 22 bp, Homo sapiens
cacaattttaatacacagtcaa

SEQ ID NO: 9329791 - DNA, 22 bp, Homo sapiens
cacaattttaatacacagtcaa

SEQ ID NO: 9329792 - DNA, 22 bp, Homo sapiens
caatgttttcaactgacaagta

SEQ ID NO: 9329793 - DNA, 22 bp, Homo sapiens
cacaatttgttttatcagtatt

SEQ ID NO: 9329794 - DNA, 18 bp, Homo sapiens
caatgttttagatctcta

SEQ ID NO: 9329795 - DNA, 22 bp, Homo sapiens
caatgtttgtgatctactgact

SEQ ID NO: 9329796 - DNA, 22 bp, Homo sapiens
caatgtttgttagagctctaga

SEQ ID NO: 9329797 - DNA, 22 bp, Homo sapiens
ggactgggagaatggaggcaag

SEQ ID NO: 9329798 - DNA, 22 bp, Homo sapiens
ggactgggagaatggaggcaag

SEQ ID NO: 9329799 - DNA, 22 bp, Homo sapiens
ggactgggagaatggaggcaag

SEQ ID NO: 9329800 - DNA, 22 bp, Homo sapiens
ggactgggagaatggaggcaag

SEQ ID NO: 9329801 - DNA, 22 bp, Homo sapiens
ggactgggagaatggaggcaag

SEQ ID NO: 9329802 - DNA, 22 bp, Homo sapiens
ggactgggagaatggaggcaag

SEQ ID NO: 9329803 - DNA, 22 bp, Homo sapiens
cacagacagtgtccctttgttg

SEQ ID NO: 9329804 - DNA, 22 bp, Homo sapiens
ggactgggattctggatctgct

SEQ ID NO: 9329805 - DNA, 22 bp, Homo sapiens
ggactgggattctggatctgct

SEQ ID NO: 9329806 - DNA, 22 bp, Homo sapiens
ggactgggattctggatctgct

SEQ ID NO: 9329807 - DNA, 22 bp, Homo sapiens
ggactgggccaggggttggact

SEQ ID NO: 9329808 - DNA, 22 bp, Homo sapiens
ggactgggccaggggttggact

SEQ ID NO: 9329809 - DNA, 22 bp, Homo sapiens
ggactgggcatgggtgctctgc

SEQ ID NO: 9329810 - DNA, 22 bp, Homo sapiens
ggactgggcatgggtgctctgc

SEQ ID NO: 9329811 - DNA, 22 bp, Homo sapiens
ggactgggccaggggttggact

SEQ ID NO: 9329812 - DNA, 21 bp, Homo sapiens
cacagaggcgctgtatggctg

SEQ ID NO: 9329813 - DNA, 22 bp, Homo sapiens
cacagaggctcaaagccaggtg

SEQ ID NO: 9329814 - DNA, 22 bp, Homo sapiens
cacagaggaaatgactttctta

SEQ ID NO: 9329815 - DNA, 22 bp, Homo sapiens
cacagagctgaacctgggtcat

SEQ ID NO: 9329816 - DNA, 22 bp, Homo sapiens
cacaggaagtggtcagtgccag

SEQ ID NO: 9329817 - DNA, 22 bp, Homo sapiens
cacaggaagtggtcagtgccag

SEQ ID NO: 9329818 - DNA, 22 bp, Homo sapiens
cacaggaagtggtcagtgccag

SEQ ID NO: 9329819 - DNA, 22 bp, Homo sapiens
cacaggaataagtcaaacttca

SEQ ID NO: 9329820 - DNA, 22 bp, Homo sapiens
ggaggcagaatagagtgtgggt

SEQ ID NO: 9329821 - DNA, 22 bp, Homo sapiens
ggaggcaggaaagacaggttca

SEQ ID NO: 9329822 - DNA, 22 bp, Homo sapiens
cacaggagaaaggggaagctcg

SEQ ID NO: 9329823 - DNA, 22 bp, Homo sapiens
ggaggcagaatagagtgtgggt

SEQ ID NO: 9329824 - DNA, 22 bp, Homo sapiens
ggaggcagaatagagtgtgggt

SEQ ID NO: 9329825 - DNA, 22 bp, Homo sapiens
ggaggcagaatagagtgtgggt

SEQ ID NO: 9329826 - DNA, 22 bp, Homo sapiens
cacaggaatgaacagggaaaga

SEQ ID NO: 9329827 - DNA, 22 bp, Homo sapiens
cacaggaatgaacagggaaaga

SEQ ID NO: 9329828 - DNA, 22 bp, Homo sapiens
cacaggaattagcagcctaaaa

SEQ ID NO: 9329829 - DNA, 22 bp, Homo sapiens
cacaggaattagcagcctaaaa

SEQ ID NO: 9329830 - DNA, 22 bp, Homo sapiens
cacaggactcgactgcagacag

SEQ ID NO: 9329831 - DNA, 22 bp, Homo sapiens
cacaggcttttctgacataggc

SEQ ID NO: 9329832 - DNA, 22 bp, Homo sapiens
cacaggcttgtcagcatgaggc

SEQ ID NO: 9329833 - DNA, 22 bp, Homo sapiens
cacaggcttgtcagcatgaggc

SEQ ID NO: 9329834 - DNA, 22 bp, Homo sapiens
cacaggcttgtcagcatgaggc

SEQ ID NO: 9329835 - DNA, 23 bp, Homo sapiens
cacaggctgcgcataagcttctc

SEQ ID NO: 9329836 - DNA, 22 bp, Homo sapiens
cacaggcttgtcagcatgaggc

SEQ ID NO: 9329837 - DNA, 20 bp, Homo sapiens
cacaggcttacagtttagat

SEQ ID NO: 9329838 - DNA, 22 bp, Homo sapiens
cacaggcttccagtccccagct

SEQ ID NO: 9329839 - DNA, 22 bp, Homo sapiens
ggaggcatctctgtggctgtct

SEQ ID NO: 9329840 - DNA, 22 bp, Homo sapiens
ggaggccaaagtgtgggcggct

SEQ ID NO: 9329841 - DNA, 22 bp, Homo sapiens
ggaggccaaagtgtgggcggct

SEQ ID NO: 9329842 - DNA, 22 bp, Homo sapiens
ggaggccaaagtgtgggcggct

SEQ ID NO: 9329843 - DNA, 22 bp, Homo sapiens
ggaggccaaggaggagcttgcc

SEQ ID NO: 9329844 - DNA, 22 bp, Homo sapiens
ggaggccaaggaggagcttgcc

SEQ ID NO: 9329845 - DNA, 22 bp, Homo sapiens
ggaggccaaggaggagcttgcc

SEQ ID NO: 9329846 - DNA, 22 bp, Homo sapiens
ggaggccaaggagggcggatca

SEQ ID NO: 9329847 - DNA, 20 bp, Homo sapiens
cacaggctatatgagagcca

SEQ ID NO: 9329848 - DNA, 20 bp, Homo sapiens
cacaggctatatgagagcca

SEQ ID NO: 9329849 - DNA, 22 bp, Homo sapiens
ggaggccaaggcaggcggatca

SEQ ID NO: 9329850 - DNA, 22 bp, Homo sapiens
ggagcccttggcacctagtagg

SEQ ID NO: 9329851 - DNA, 19 bp, Homo sapiens
ggagccgccgcccttcatt

SEQ ID NO: 9329852 - DNA, 22 bp, Homo sapiens
ggagccggagggccactggcag

SEQ ID NO: 9329853 - DNA, 22 bp, Homo sapiens
ggagccctgctgacatgggtgt

SEQ ID NO: 9329854 - DNA, 22 bp, Homo sapiens
ggagccctgctgacatgggtgt

SEQ ID NO: 9329855 - DNA, 23 bp, Homo sapiens
ggagccctgagctgtccccatgc

SEQ ID NO: 9329856 - DNA, 22 bp, Homo sapiens
ggagcccttctattccatggag

SEQ ID NO: 9329857 - DNA, 22 bp, Homo sapiens
ggagcccttctattccatggag

SEQ ID NO: 9329858 - DNA, 22 bp, Homo sapiens
ggagccctgccctaggcagctc

SEQ ID NO: 9329859 - DNA, 22 bp, Homo sapiens
ggagccctgccctaggcagctc

SEQ ID NO: 9329860 - DNA, 22 bp, Homo sapiens
ggagccctccatcccttgcggc

SEQ ID NO: 9329861 - DNA, 22 bp, Homo sapiens
ggagcaggcagggccgtgtctg

SEQ ID NO: 9329862 - DNA, 22 bp, Homo sapiens
ggagcaggcagggccgtgtctg

SEQ ID NO: 9329863 - DNA, 22 bp, Homo sapiens
ggagcaggcagggccgtgtctg

SEQ ID NO: 9329864 - DNA, 22 bp, Homo sapiens
cacagatttctggtcttcaccc

SEQ ID NO: 9329865 - DNA, 22 bp, Homo sapiens
cacagattatgagacgagatac

SEQ ID NO: 9329866 - DNA, 22 bp, Homo sapiens
cacagaggtgatagtggtcaag

SEQ ID NO: 9329867 - DNA, 20 bp, Homo sapiens
cacagatgggacaggaaagg

SEQ ID NO: 9329868 - DNA, 19 bp, Homo sapiens
ggagcctggagcacgtgcc

SEQ ID NO: 9329869 - DNA, 22 bp, Homo sapiens
ggagcctgcgggagctcccatt

SEQ ID NO: 9329870 - DNA, 23 bp, Homo sapiens
ggagctgctgttgggggagctgc

SEQ ID NO: 9329871 - DNA, 23 bp, Homo sapiens
ggagctgctgttgggggagctgc

SEQ ID NO: 9329872 - DNA, 22 bp, Homo sapiens
ggagctgctccttcagccaagt

SEQ ID NO: 9329873 - DNA, 22 bp, Homo sapiens
ggagcctgagcggcccagggcc

SEQ ID NO: 9329874 - DNA, 22 bp, Homo sapiens
ggagcctgaaaagtctgcattt

SEQ ID NO: 9329875 - DNA, 22 bp, Homo sapiens
ggagcctgacagtgcccagcat

SEQ ID NO: 9329876 - DNA, 22 bp, Homo sapiens
ggagctggagagctagcctagg

SEQ ID NO: 9329877 - DNA, 23 bp, Homo sapiens
ggagctggacccttacacctttc

SEQ ID NO: 9329878 - DNA, 23 bp, Homo sapiens
ggagctgctgttgggggagctgc

SEQ ID NO: 9329879 - DNA, 23 bp, Homo sapiens
ggagctgctgttgggggagctgc

SEQ ID NO: 9329880 - DNA, 20 bp, Homo sapiens
ggagctggcatccagcctct

SEQ ID NO: 9329881 - DNA, 20 bp, Homo sapiens
ggagctggcatccagcctct

SEQ ID NO: 9329882 - DNA, 18 bp, Homo sapiens
cagaaagttatttactct

SEQ ID NO: 9329883 - DNA, 22 bp, Homo sapiens
cagaaagtgatttgctattcca

SEQ ID NO: 9329884 - DNA, 23 bp, Homo sapiens
cagaaagtttgagaagatacatc

SEQ ID NO: 9329885 - DNA, 18 bp, Homo sapiens
cagaaagttatttactct

SEQ ID NO: 9329886 - DNA, 22 bp, Homo sapiens
ggctgggaggatgacttgctac

SEQ ID NO: 9329887 - DNA, 22 bp, Homo sapiens
ggctgggaggatgacttgctac

SEQ ID NO: 9329888 - DNA, 22 bp, Homo sapiens
ggctgggaggatgacttgctac

SEQ ID NO: 9329889 - DNA, 22 bp, Homo sapiens
ggctgggaggatgacttgctac

SEQ ID NO: 9329890 - DNA, 22 bp, Homo sapiens
cagaaataaagtggacagagta

SEQ ID NO: 9329891 - DNA, 21 bp, Homo sapiens
ggctggtgtttagctgtgata

SEQ ID NO: 9329892 - DNA, 21 bp, Homo sapiens
ggctggtgtttagctgtgata

SEQ ID NO: 9329893 - DNA, 21 bp, Homo sapiens
ggctggtgtttagctgtgata

SEQ ID NO: 9329894 - DNA, 22 bp, Homo sapiens
ggctggtgttacagtcggcagc

SEQ ID NO: 9329895 - DNA, 22 bp, Homo sapiens
ggctggtgttacagtcggcagc

SEQ ID NO: 9329896 - DNA, 22 bp, Homo sapiens
ggctgtaggttggtgctggaca

SEQ ID NO: 9329897 - DNA, 22 bp, Homo sapiens
ggctgtagtcagtgacatggta

SEQ ID NO: 9329898 - DNA, 22 bp, Homo sapiens
ggctgttcctctgagagctgat

SEQ ID NO: 9329899 - DNA, 22 bp, Homo sapiens
ggctgtgaagtagcaggggcag

SEQ ID NO: 9329900 - DNA, 22 bp, Homo sapiens
ggctgtgaaccctggcagtgtg

SEQ ID NO: 9329901 - DNA, 22 bp, Homo sapiens
ggctgtgaaccctggcagtgtg

SEQ ID NO: 9329902 - DNA, 22 bp, Homo sapiens
ggctgtgaaccctggcagtgtg

SEQ ID NO: 9329903 - DNA, 22 bp, Homo sapiens
ggctgtctctgtgactgccacc

SEQ ID NO: 9329904 - DNA, 22 bp, Homo sapiens
ggctgtctctgtgactgccacc

SEQ ID NO: 9329905 - DNA, 22 bp, Homo sapiens
cactttgggtttatgtcaatca

SEQ ID NO: 9329906 - DNA, 22 bp, Homo sapiens
cactttggggtatgacaagttt

SEQ ID NO: 9329907 - DNA, 21 bp, Homo sapiens
cactttaatggatatttgttt

SEQ ID NO: 9329908 - DNA, 21 bp, Homo sapiens
cactttaatggatatttgttt

SEQ ID NO: 9329909 - DNA, 21 bp, Homo sapiens
cactttaatggatatttgttt

SEQ ID NO: 9329910 - DNA, 21 bp, Homo sapiens
cactttaatggatatttgttt

SEQ ID NO: 9329911 - DNA, 17 bp, Homo sapiens
cactttgttgctgtggg

SEQ ID NO: 9329912 - DNA, 22 bp, Homo sapiens
cacttttaaatgggtccgtgtt

SEQ ID NO: 9329913 - DNA, 22 bp, Homo sapiens
cacttttaacaggagaattccc

SEQ ID NO: 9329914 - DNA, 22 bp, Homo sapiens
cactttggtagctgttttggga

SEQ ID NO: 9329915 - DNA, 22 bp, Homo sapiens
cactttggttcacctgagtttc

SEQ ID NO: 9329916 - DNA, 22 bp, Homo sapiens
cactttgtgtgggatcaggggt

SEQ ID NO: 9329917 - DNA, 23 bp, Homo sapiens
cagaaaacccagagctcagtccc

SEQ ID NO: 9329918 - DNA, 22 bp, Homo sapiens
cagaaaacaaacctatcctgag

SEQ ID NO: 9329919 - DNA, 22 bp, Homo sapiens
cagaaaacaaacctatcctgag

SEQ ID NO: 9329920 - DNA, 22 bp, Homo sapiens
cagaaaataaagtttctacgca

SEQ ID NO: 9329921 - DNA, 22 bp, Homo sapiens
ggctgccataacagagtaccac

SEQ ID NO: 9329922 - DNA, 22 bp, Homo sapiens
ggctgccataactgataccata

SEQ ID NO: 9329923 - DNA, 20 bp, Homo sapiens
ggctgcccactccagagtac

SEQ ID NO: 9329924 - DNA, 20 bp, Homo sapiens
ggctgcccactccagagtac

SEQ ID NO: 9329925 - DNA, 22 bp, Homo sapiens
ggctgccccagtgctcatggct

SEQ ID NO: 9329926 - DNA, 22 bp, Homo sapiens
ggctgcctcaaagctcaagctc

SEQ ID NO: 9329927 - DNA, 22 bp, Homo sapiens
ggctgcctactttcccagagtt

SEQ ID NO: 9329928 - DNA, 22 bp, Homo sapiens
cagaaacatgtataaagttgta

SEQ ID NO: 9329929 - DNA, 22 bp, Homo sapiens
ggctgccctcgtctactgccca

SEQ ID NO: 9329930 - DNA, 22 bp, Homo sapiens
ggctgccctcggggtcgcaggc

SEQ ID NO: 9329931 - DNA, 22 bp, Homo sapiens
ggctgcctactttcccagagtt

SEQ ID NO: 9329932 - DNA, 22 bp, Homo sapiens
cagaaagcgggatgcagcatgt

SEQ ID NO: 9329933 - DNA, 22 bp, Homo sapiens
cagaaagcgggatgcagcatgt

SEQ ID NO: 9329934 - DNA, 22 bp, Homo sapiens
cagaaagccgacttacaatgga

SEQ ID NO: 9329935 - DNA, 22 bp, Homo sapiens
ggctctggtgccctggctccca

SEQ ID NO: 9329936 - DNA, 22 bp, Homo sapiens
ggctctggtgccctggctccca

SEQ ID NO: 9329937 - DNA, 22 bp, Homo sapiens
ggctctggtgccctggctccca

SEQ ID NO: 9329938 - DNA, 22 bp, Homo sapiens
ggctctggtgccctggctccca

SEQ ID NO: 9329939 - DNA, 22 bp, Homo sapiens
ggctctggtgagggtaggagat

SEQ ID NO: 9329940 - DNA, 22 bp, Homo sapiens
ggctctggtgagggtaggagat

SEQ ID NO: 9329941 - DNA, 22 bp, Homo sapiens
ggctctggtgagggtaggagat

SEQ ID NO: 9329942 - DNA, 22 bp, Homo sapiens
ggctctggtgagggtaggagat

SEQ ID NO: 9329943 - DNA, 22 bp, Homo sapiens
ggctctggtgggaaggttagat

SEQ ID NO: 9329944 - DNA, 22 bp, Homo sapiens
ggctctggtgggaaggttagat

SEQ ID NO: 9329945 - DNA, 22 bp, Homo sapiens
ggctctggtgggaaggttagat

SEQ ID NO: 9329946 - DNA, 22 bp, Homo sapiens
ggctctggtggcaattgactgg

SEQ ID NO: 9329947 - DNA, 22 bp, Homo sapiens
ggctgagccccctctgcgtagg

SEQ ID NO: 9329948 - DNA, 22 bp, Homo sapiens
ggctgagccccctctgcgtagg

SEQ ID NO: 9329949 - DNA, 22 bp, Homo sapiens
ggctgagccccctctgcgtagg

SEQ ID NO: 9329950 - DNA, 22 bp, Homo sapiens
ggctctggtgtgaagcagcctc

SEQ ID NO: 9329951 - DNA, 22 bp, Homo sapiens
ggctctggtgtgaagcagcctc

SEQ ID NO: 9329952 - DNA, 22 bp, Homo sapiens
ggctctggtgggaaggttagat

SEQ ID NO: 9329953 - DNA, 22 bp, Homo sapiens
ggctgaggcggcgatgcccttg

SEQ ID NO: 9329954 - DNA, 22 bp, Homo sapiens
ggctgagcttttcatgatggtt

SEQ ID NO: 9329955 - DNA, 22 bp, Homo sapiens
ggctgagctccaagtattccat

SEQ ID NO: 9329956 - DNA, 22 bp, Homo sapiens
ggctgagcttatatatgtgctg

SEQ ID NO: 9329957 - DNA, 22 bp, Homo sapiens
ggctgaggcggcgatgcccttg

SEQ ID NO: 9329958 - DNA, 22 bp, Homo sapiens
ggctgagctcaggggcagcagg

SEQ ID NO: 9329959 - DNA, 22 bp, Homo sapiens
ggctgagctcaggggcagcagg

SEQ ID NO: 9329960 - DNA, 19 bp, Homo sapiens
ggctgagcgccttggctgc

SEQ ID NO: 9329961 - DNA, 22 bp, Homo sapiens
ggctgagcgtggctgccgtggg

SEQ ID NO: 9329962 - DNA, 22 bp, Homo sapiens
ggctgagcgtggctgccgtggg

SEQ ID NO: 9329963 - DNA, 22 bp, Homo sapiens
ggctgagcggactggggtccct

SEQ ID NO: 9329964 - DNA, 19 bp, Homo sapiens
ggctgagcgccttggctgc

SEQ ID NO: 9329965 - DNA, 22 bp, Homo sapiens
ggctgagcctggagcatctggt

SEQ ID NO: 9329966 - DNA, 22 bp, Homo sapiens
ggctgagcctggagcatctggt

SEQ ID NO: 9329967 - DNA, 22 bp, Homo sapiens
ggctgagcctggagcatctggt

SEQ ID NO: 9329968 - DNA, 22 bp, Homo sapiens
ggctctggtcagtgaggggcct

SEQ ID NO: 9329969 - DNA, 22 bp, Homo sapiens
ggctctggtgagggtaggagat

SEQ ID NO: 9329970 - DNA, 22 bp, Homo sapiens
ggctctggtcagtgaggggcct

SEQ ID NO: 9329971 - DNA, 22 bp, Homo sapiens
ggctctgggttctgcaatgcgt

SEQ ID NO: 9329972 - DNA, 22 bp, Homo sapiens
ggctctggtcagtgaggggcct

SEQ ID NO: 9329973 - DNA, 22 bp, Homo sapiens
ggctctggaatgtgtagtcagg

SEQ ID NO: 9329974 - DNA, 22 bp, Homo sapiens
ggctctggaatgtgtagtcagg

SEQ ID NO: 9329975 - DNA, 22 bp, Homo sapiens
ggctccaggtgcatgccaggct

SEQ ID NO: 9329976 - DNA, 22 bp, Homo sapiens
ggctccaggtgcatgccaggct

SEQ ID NO: 9329977 - DNA, 22 bp, Homo sapiens
ggctccaggtgcatgccaggct

SEQ ID NO: 9329978 - DNA, 22 bp, Homo sapiens
ggctccagtttccccttggggc

SEQ ID NO: 9329979 - DNA, 20 bp, Homo sapiens
ggctctggaatctggtgggc

SEQ ID NO: 9329980 - DNA, 18 bp, Homo sapiens
ggctccagtcttcagtgg

SEQ ID NO: 9329981 - DNA, 18 bp, Homo sapiens
ggctccagtcttcagtgg

SEQ ID NO: 9329982 - DNA, 22 bp, Homo sapiens
ggctccagggtacccctggatg

SEQ ID NO: 9329983 - DNA, 22 bp, Homo sapiens
ggctccaggtacgtatgggagg

SEQ ID NO: 9329984 - DNA, 22 bp, Homo sapiens
ggctccaggtgcatgccaggct

SEQ ID NO: 9329985 - DNA, 22 bp, Homo sapiens
ggctccaggtgcatgccaggct

SEQ ID NO: 9329986 - DNA, 22 bp, Homo sapiens
ggctccagggtctctccttgtg

SEQ ID NO: 9329987 - DNA, 22 bp, Homo sapiens
ggctcaggttaccagtccctcc

SEQ ID NO: 9329988 - DNA, 22 bp, Homo sapiens
ggctcaggttgggtcacatgac

SEQ ID NO: 9329989 - DNA, 22 bp, Homo sapiens
ggctcaggttgggtcacatgac

SEQ ID NO: 9329990 - DNA, 22 bp, Homo sapiens
ggctcaggttaccagtccctcc

SEQ ID NO: 9329991 - DNA, 22 bp, Homo sapiens
ggctcaggttgggtcacatgac

SEQ ID NO: 9329992 - DNA, 22 bp, Homo sapiens
ggctcaggtttaaagtgcttta

SEQ ID NO: 9329993 - DNA, 22 bp, Homo sapiens
ggctccagggtacccctggatg

SEQ ID NO: 9329994 - DNA, 22 bp, Homo sapiens
ggcctctctccctggcttgcag

SEQ ID NO: 9329995 - DNA, 22 bp, Homo sapiens
ggcctctctccttggcttgcag

SEQ ID NO: 9329996 - DNA, 22 bp, Homo sapiens
ggcctgagcagacagcatgatg

SEQ ID NO: 9329997 - DNA, 20 bp, Homo sapiens
ggcctgagcatggctggcag

SEQ ID NO: 9329998 - DNA, 20 bp, Homo sapiens
ggcctgagcatggctggcag

SEQ ID NO: 9329999 - DNA, 22 bp, Homo sapiens
ggcctgagcttgggcagcgtat

SEQ ID NO: 9330000 - DNA, 19 bp, Homo sapiens
ggcctgaggccacagatcc

SEQ ID NO: 9330001 - DNA, 22 bp, Homo sapiens
ggcctgaggcaatagtcagaca

SEQ ID NO: 9330002 - DNA, 22 bp, Homo sapiens
ggcctgtgagaatcaaggaaaa

SEQ ID NO: 9330003 - DNA, 22 bp, Homo sapiens
ggcctgtccagcctgcctggct

SEQ ID NO: 9330004 - DNA, 22 bp, Homo sapiens
ggcctgtgcacatgtgcaggaa

SEQ ID NO: 9330005 - DNA, 22 bp, Homo sapiens
ggcctgtgcacatgtgcaggaa

SEQ ID NO: 9330006 - DNA, 22 bp, Homo sapiens
ggcctgtgagcccttgcatgta

SEQ ID NO: 9330007 - DNA, 22 bp, Homo sapiens
ggcctgaggcgtcccagctgtg

SEQ ID NO: 9330008 - DNA, 22 bp, Homo sapiens
ggcctgaggcgtcccagctgtg

SEQ ID NO: 9330009 - DNA, 22 bp, Homo sapiens
ggcctgggctccgggagttact

SEQ ID NO: 9330010 - DNA, 22 bp, Homo sapiens
ggcctgggctccgggagttact

SEQ ID NO: 9330011 - DNA, 22 bp, Homo sapiens
ggcctgaggccaccagcagccc

SEQ ID NO: 9330012 - DNA, 22 bp, Homo sapiens
ggcctgaggccaccagcagccc

SEQ ID NO: 9330013 - DNA, 18 bp, Homo sapiens
ggctcaggctatcctaac

SEQ ID NO: 9330014 - DNA, 22 bp, Homo sapiens
ggctcaggcctgtaatcctagc

SEQ ID NO: 9330015 - DNA, 18 bp, Homo sapiens
ggctcaggctatcctaac

SEQ ID NO: 9330016 - DNA, 22 bp, Homo sapiens
ggctcaggctggagtgcagtgg

SEQ ID NO: 9330017 - DNA, 22 bp, Homo sapiens
ggctcaggctggagtgcagtgg

SEQ ID NO: 9330018 - DNA, 22 bp, Homo sapiens
ggctcaggctggagtgcagtgg

SEQ ID NO: 9330019 - DNA, 22 bp, Homo sapiens
ggctcagggaatgaggaagaat

SEQ ID NO: 9330020 - DNA, 22 bp, Homo sapiens
ggctcaggggccaggcctgtcc

SEQ ID NO: 9330021 - DNA, 22 bp, Homo sapiens
ggctcaggggccaggcctgtcc

SEQ ID NO: 9330022 - DNA, 19 bp, Homo sapiens
ggctcagggcgctgccgcc

SEQ ID NO: 9330023 - DNA, 22 bp, Homo sapiens
ggctcagggaatgaggaagaat

SEQ ID NO: 9330024 - DNA, 19 bp, Homo sapiens
ggctcagggcgctgccgcc

SEQ ID NO: 9330025 - DNA, 19 bp, Homo sapiens
ggctcagggcgctgccgcc

SEQ ID NO: 9330026 - DNA, 22 bp, Homo sapiens
ggctcagggaatgaggaagaat

SEQ ID NO: 9330027 - DNA, 22 bp, Homo sapiens
ggctcagggaatgaggaagaat

SEQ ID NO: 9330028 - DNA, 19 bp, Homo sapiens
ggcctgtgcagagcccgtc

SEQ ID NO: 9330029 - DNA, 22 bp, Homo sapiens
ggcctgtgctgagaacctggct

SEQ ID NO: 9330030 - DNA, 22 bp, Homo sapiens
ggcctgtgctgtcagccctagt

SEQ ID NO: 9330031 - DNA, 22 bp, Homo sapiens
ggcctgtgtctgtgcctgtcct

SEQ ID NO: 9330032 - DNA, 22 bp, Homo sapiens
ggcctgtgtcctccttgccctg

SEQ ID NO: 9330033 - DNA, 17 bp, Homo sapiens
ggcctgtgtggctgcag

SEQ ID NO: 9330034 - DNA, 22 bp, Homo sapiens
ggctcaatgcaacttctgcctc

SEQ ID NO: 9330035 - DNA, 22 bp, Homo sapiens
cacctgggctttctctgggact

SEQ ID NO: 9330036 - DNA, 22 bp, Homo sapiens
cacctgtccacgcagtctgcct

SEQ ID NO: 9330037 - DNA, 21 bp, Homo sapiens
ggccgccgccttgtgctctgc

SEQ ID NO: 9330038 - DNA, 22 bp, Homo sapiens
ggccgctctccggtgtggatct

SEQ ID NO: 9330039 - DNA, 19 bp, Homo sapiens
cacgagttctcttagcaaa

SEQ ID NO: 9330040 - DNA, 22 bp, Homo sapiens
cacgaggccatctccttctgga

SEQ ID NO: 9330041 - DNA, 22 bp, Homo sapiens
cacgaatggaagggtcttggct

SEQ ID NO: 9330042 - DNA, 22 bp, Homo sapiens
cacgcatttattcacgtattcg

SEQ ID NO: 9330043 - DNA, 22 bp, Homo sapiens
ggcctctctccagtcagtgcag

SEQ ID NO: 9330044 - DNA, 22 bp, Homo sapiens
cacgcatttattcacgtattcg

SEQ ID NO: 9330045 - DNA, 22 bp, Homo sapiens
ggcctctctccagtcagtgcag

SEQ ID NO: 9330046 - DNA, 22 bp, Homo sapiens
ggcctctctccagtcagtgcag

SEQ ID NO: 9330047 - DNA, 22 bp, Homo sapiens
ggcctctctccctggcttgcag

SEQ ID NO: 9330048 - DNA, 22 bp, Homo sapiens
cacctttgaccttgcagcgcac

SEQ ID NO: 9330049 - DNA, 22 bp, Homo sapiens
cacctttgcaaaccaaatctga

SEQ ID NO: 9330050 - DNA, 22 bp, Homo sapiens
caccttccatctccttggctag

SEQ ID NO: 9330051 - DNA, 22 bp, Homo sapiens
caccttcagaatgctccaggca

SEQ ID NO: 9330052 - DNA, 22 bp, Homo sapiens
caccttactccctctggatgcc

SEQ ID NO: 9330053 - DNA, 22 bp, Homo sapiens
ggccactgcctccgccatggct

SEQ ID NO: 9330054 - DNA, 22 bp, Homo sapiens
ggccactgctctccagcctggg

SEQ ID NO: 9330055 - DNA, 22 bp, Homo sapiens
ggccactgctctccagcctggg

SEQ ID NO: 9330056 - DNA, 22 bp, Homo sapiens
ggccactgctgctctggtggag

SEQ ID NO: 9330057 - DNA, 22 bp, Homo sapiens
ggccactgctgctctggtggag

SEQ ID NO: 9330058 - DNA, 22 bp, Homo sapiens
ggccgccctttccacggtttct

SEQ ID NO: 9330059 - DNA, 22 bp, Homo sapiens
ggccgccctttccacggtttct

SEQ ID NO: 9330060 - DNA, 22 bp, Homo sapiens
ggcccttggagcctccacagtg

SEQ ID NO: 9330061 - DNA, 22 bp, Homo sapiens
ggcccttgcagcaggcgctggc

SEQ ID NO: 9330062 - DNA, 22 bp, Homo sapiens
ggccctgtgatggatgtattag

SEQ ID NO: 9330063 - DNA, 22 bp, Homo sapiens
ggccacgtgacctctggctcct

SEQ ID NO: 9330064 - DNA, 22 bp, Homo sapiens
ggccaaggatggtggctctggt

SEQ ID NO: 9330065 - DNA, 19 bp, Homo sapiens
ggccactcctggtgactgg

SEQ ID NO: 9330066 - DNA, 19 bp, Homo sapiens
ggccactcctggtgactgg

SEQ ID NO: 9330067 - DNA, 23 bp, Homo sapiens
ggccactgaattttctgcatctt

SEQ ID NO: 9330068 - DNA, 23 bp, Homo sapiens
ggccactgaattttctgcatctt

SEQ ID NO: 9330069 - DNA, 21 bp, Homo sapiens
ggcatttgccaaagtgatcct

SEQ ID NO: 9330070 - DNA, 22 bp, Homo sapiens
ggcattatctgagcacgtaata

SEQ ID NO: 9330071 - DNA, 22 bp, Homo sapiens
ggcattataattggcaggctgt

SEQ ID NO: 9330072 - DNA, 22 bp, Homo sapiens
ggcattatttaaaagcctcact

SEQ ID NO: 9330073 - DNA, 22 bp, Homo sapiens
ggcatcaggagcttcttcaggt

SEQ ID NO: 9330074 - DNA, 22 bp, Homo sapiens
ggcatcaggagcttcttcaggt

SEQ ID NO: 9330075 - DNA, 22 bp, Homo sapiens
ggcatttaggatctttagttga

SEQ ID NO: 9330076 - DNA, 22 bp, Homo sapiens
ggcatttaggcagataacagac

SEQ ID NO: 9330077 - DNA, 22 bp, Homo sapiens
ggcatttaggcagataacagac

SEQ ID NO: 9330078 - DNA, 22 bp, Homo sapiens
ggcatttagattgaatttctgt

SEQ ID NO: 9330079 - DNA, 22 bp, Homo sapiens
ggcatttagagggcttttctga

SEQ ID NO: 9330080 - DNA, 22 bp, Homo sapiens
ggcatttagattgaatttctgt

SEQ ID NO: 9330081 - DNA, 22 bp, Homo sapiens
ggcatttaggatctttagttga

SEQ ID NO: 9330082 - DNA, 22 bp, Homo sapiens
ggcatttactagagccacattt

SEQ ID NO: 9330083 - DNA, 22 bp, Homo sapiens
ggcatttagagggcttttctga

SEQ ID NO: 9330084 - DNA, 22 bp, Homo sapiens
ggcatttacgatactgcatagg

SEQ ID NO: 9330085 - DNA, 22 bp, Homo sapiens
ggcatttacgatactgcatagg

SEQ ID NO: 9330086 - DNA, 22 bp, Homo sapiens
ggcatttacataatcttattta

SEQ ID NO: 9330087 - DNA, 22 bp, Homo sapiens
ggcatttacataatcttattta

SEQ ID NO: 9330088 - DNA, 22 bp, Homo sapiens
ggcatttaatccatctgattga

SEQ ID NO: 9330089 - DNA, 22 bp, Homo sapiens
ggcatttatttgtctcattctt

SEQ ID NO: 9330090 - DNA, 22 bp, Homo sapiens
ggcatttgaaactattcggaga

SEQ ID NO: 9330091 - DNA, 22 bp, Homo sapiens
ggcatttgactcagtgactggg

SEQ ID NO: 9330092 - DNA, 22 bp, Homo sapiens
ggcatttatctaatatagttta

SEQ ID NO: 9330093 - DNA, 22 bp, Homo sapiens
ggcatttagttttcatattctg

SEQ ID NO: 9330094 - DNA, 20 bp, Homo sapiens
ggcatttatgaaccaagcct

SEQ ID NO: 9330095 - DNA, 22 bp, Homo sapiens
ggcatttatctaatatagttta

SEQ ID NO: 9330096 - DNA, 22 bp, Homo sapiens
ggcatttatctaatatagttta

SEQ ID NO: 9330097 - DNA, 22 bp, Homo sapiens
ggcatttagttttcatattctg

SEQ ID NO: 9330098 - DNA, 22 bp, Homo sapiens
ggcatttagttttcatattctg

SEQ ID NO: 9330099 - DNA, 22 bp, Homo sapiens
ggcaggtgatctagagtcaata

SEQ ID NO: 9330100 - DNA, 22 bp, Homo sapiens
ggcaggtgcacctgagccatct

SEQ ID NO: 9330101 - DNA, 22 bp, Homo sapiens
ggcaggtgatctagagtcaata

SEQ ID NO: 9330102 - DNA, 22 bp, Homo sapiens
ggcaggtgatctagagtcaata

SEQ ID NO: 9330103 - DNA, 22 bp, Homo sapiens
ggcaggtgatctagagtcaata

SEQ ID NO: 9330104 - DNA, 22 bp, Homo sapiens
ggcaggtgcacctgagccatct

SEQ ID NO: 9330105 - DNA, 22 bp, Homo sapiens
ggcaggtgcacctgagccatct

SEQ ID NO: 9330106 - DNA, 22 bp, Homo sapiens
ggcaggtgcacctgagccatct

SEQ ID NO: 9330107 - DNA, 22 bp, Homo sapiens
ggcaggtgccttctgtgctagc

SEQ ID NO: 9330108 - DNA, 22 bp, Homo sapiens
ggcaggtgcccagagagcacga

SEQ ID NO: 9330109 - DNA, 22 bp, Homo sapiens
ggcaggtgcccagagagcacga

SEQ ID NO: 9330110 - DNA, 22 bp, Homo sapiens
ggcaggtgcccagagagcacga

SEQ ID NO: 9330111 - DNA, 22 bp, Homo sapiens
ggcaggtgccagttggcttggg

SEQ ID NO: 9330112 - DNA, 22 bp, Homo sapiens
ggcaggtgccagttggcttggg

SEQ ID NO: 9330113 - DNA, 22 bp, Homo sapiens
ggcaggtgccagttggcttggg

SEQ ID NO: 9330114 - DNA, 22 bp, Homo sapiens
ggcaggtgccagttggcttggg

SEQ ID NO: 9330115 - DNA, 22 bp, Homo sapiens
ggcaggtgccagttggcttggg

SEQ ID NO: 9330116 - DNA, 22 bp, Homo sapiens
ggcaggtgcccagagagcacga

SEQ ID NO: 9330117 - DNA, 22 bp, Homo sapiens
ggcaggtgccagttggcttggg

SEQ ID NO: 9330118 - DNA, 22 bp, Homo sapiens
ggcagggcaggaaagtcaggaa

SEQ ID NO: 9330119 - DNA, 22 bp, Homo sapiens
ggcagggcaggaaagtcaggaa

SEQ ID NO: 9330120 - DNA, 22 bp, Homo sapiens
ggcagggcaggaaagtcaggaa

SEQ ID NO: 9330121 - DNA, 22 bp, Homo sapiens
ggcagggcaggaaagtcaggaa

SEQ ID NO: 9330122 - DNA, 22 bp, Homo sapiens
ggcagggcaggaaagtcaggaa

SEQ ID NO: 9330123 - DNA, 22 bp, Homo sapiens
ggcagggcaggaaagtcaggaa

SEQ ID NO: 9330124 - DNA, 22 bp, Homo sapiens
ggcagggcaggaaagtcaggaa

SEQ ID NO: 9330125 - DNA, 22 bp, Homo sapiens
ggcagggcaggaaagtcaggaa

SEQ ID NO: 9330126 - DNA, 22 bp, Homo sapiens
ggcagggcaggaaagtcaggaa

SEQ ID NO: 9330127 - DNA, 22 bp, Homo sapiens
ggcagggagtggagactcccta

SEQ ID NO: 9330128 - DNA, 20 bp, Homo sapiens
ggcagggagggatactgagg

SEQ ID NO: 9330129 - DNA, 22 bp, Homo sapiens
ggcagggagtggagactcccta

SEQ ID NO: 9330130 - DNA, 22 bp, Homo sapiens
ggcagggcagcgctgattaggg

SEQ ID NO: 9330131 - DNA, 22 bp, Homo sapiens
ggcagggcagcgctgattaggg

SEQ ID NO: 9330132 - DNA, 22 bp, Homo sapiens
ggcagggcagcgctgattaggg

SEQ ID NO: 9330133 - DNA, 22 bp, Homo sapiens
ggaggtggaggttgcagtgagc

SEQ ID NO: 9330134 - DNA, 22 bp, Homo sapiens
cacagtgtgggcatggtgcctg

SEQ ID NO: 9330135 - DNA, 22 bp, Homo sapiens
cacagtttggttttgctgtaat

SEQ ID NO: 9330136 - DNA, 22 bp, Homo sapiens
cacagttttatcttatactgat

SEQ ID NO: 9330137 - DNA, 22 bp, Homo sapiens
ggaggtggagctggaagttcca

SEQ ID NO: 9330138 - DNA, 22 bp, Homo sapiens
ggaggtggagctggaagttcca

SEQ ID NO: 9330139 - DNA, 22 bp, Homo sapiens
ggaggtgctggcggccagctct

SEQ ID NO: 9330140 - DNA, 22 bp, Homo sapiens
ggaggtggaggttgcaatgagc

SEQ ID NO: 9330141 - DNA, 22 bp, Homo sapiens
ggaggtggaggttgcaatgagc

SEQ ID NO: 9330142 - DNA, 22 bp, Homo sapiens
ggaggtggaggttgcaatgagc

SEQ ID NO: 9330143 - DNA, 22 bp, Homo sapiens
ggaggtggaggttgcaatgagc

SEQ ID NO: 9330144 - DNA, 22 bp, Homo sapiens
cacagggaaccaaggctgggcc

SEQ ID NO: 9330145 - DNA, 22 bp, Homo sapiens
ggaggtgacgaaaagaaattgt

SEQ ID NO: 9330146 - DNA, 22 bp, Homo sapiens
cacagggaaccaaggctgggcc

SEQ ID NO: 9330147 - DNA, 22 bp, Homo sapiens
ggaggtgatcagagttttgagg

SEQ ID NO: 9330148 - DNA, 22 bp, Homo sapiens
ggaggtgaggccgtagggtgtg

SEQ ID NO: 9330149 - DNA, 22 bp, Homo sapiens
ggaggtgactggatcatgggca

SEQ ID NO: 9330150 - DNA, 22 bp, Homo sapiens
ggaggtgctgatcccagtcaac

SEQ ID NO: 9330151 - DNA, 22 bp, Homo sapiens
ggaggtgctggcggccagctct

SEQ ID NO: 9330152 - DNA, 22 bp, Homo sapiens
ggaggtgctgatcccagtcaac

SEQ ID NO: 9330153 - DNA, 22 bp, Homo sapiens
ggaggtgcagagtagggttggt

SEQ ID NO: 9330154 - DNA, 22 bp, Homo sapiens
ggaggtgcagagtagggttggt

SEQ ID NO: 9330155 - DNA, 22 bp, Homo sapiens
cacataattgaacgtgatgagt

SEQ ID NO: 9330156 - DNA, 22 bp, Homo sapiens
cacatacaaggcacactggagg

SEQ ID NO: 9330157 - DNA, 22 bp, Homo sapiens
cacatacaaggcacactggagg

SEQ ID NO: 9330158 - DNA, 22 bp, Homo sapiens
cacagttttgtcttggtttcca

SEQ ID NO: 9330159 - DNA, 22 bp, Homo sapiens
cacagttttgcccagggcttct

SEQ ID NO: 9330160 - DNA, 22 bp, Homo sapiens
cacataaatggtgccatgtttt

SEQ ID NO: 9330161 - DNA, 22 bp, Homo sapiens
cacatacatacgtatgtataca

SEQ ID NO: 9330162 - DNA, 22 bp, Homo sapiens
cacatacatacgtatgtataca

SEQ ID NO: 9330163 - DNA, 22 bp, Homo sapiens
cacatacaatggtgttatttgg

SEQ ID NO: 9330164 - DNA, 19 bp, Homo sapiens
cacatacagaaaagagtaa

SEQ ID NO: 9330165 - DNA, 22 bp, Homo sapiens
cacatacatgcacacctaaata

SEQ ID NO: 9330166 - DNA, 22 bp, Homo sapiens
cacatacatgcacacctaaata

SEQ ID NO: 9330167 - DNA, 22 bp, Homo sapiens
cacatactgagaatcacaccca

SEQ ID NO: 9330168 - DNA, 22 bp, Homo sapiens
cacatacttgtgtgtacatatg

SEQ ID NO: 9330169 - DNA, 22 bp, Homo sapiens
cacatttaggaggtggggaagc

SEQ ID NO: 9330170 - DNA, 22 bp, Homo sapiens
cacatttagaggttagcatggt

SEQ ID NO: 9330171 - DNA, 22 bp, Homo sapiens
cacatttagaggttagcatggt

SEQ ID NO: 9330172 - DNA, 22 bp, Homo sapiens
cacatttagaggttagcatggt

SEQ ID NO: 9330173 - DNA, 22 bp, Homo sapiens
cacatttacttttatcccttgg

SEQ ID NO: 9330174 - DNA, 22 bp, Homo sapiens
cacatttaggaggtggggaagc

SEQ ID NO: 9330175 - DNA, 22 bp, Homo sapiens
cacatttaggttcctatagcca

SEQ ID NO: 9330176 - DNA, 22 bp, Homo sapiens
cacatttaggttcctatagcca

SEQ ID NO: 9330177 - DNA, 22 bp, Homo sapiens
cacatttaggttcctatagcca

SEQ ID NO: 9330178 - DNA, 22 bp, Homo sapiens
cacatttatctctctccggtga

SEQ ID NO: 9330179 - DNA, 22 bp, Homo sapiens
cacatttatttgaggctaattg

SEQ ID NO: 9330180 - DNA, 22 bp, Homo sapiens
cacatttatgggctgggaggca

SEQ ID NO: 9330181 - DNA, 22 bp, Homo sapiens
cacatttatctgttctttctag

SEQ ID NO: 9330182 - DNA, 22 bp, Homo sapiens
cacatttatctgttctttctag

SEQ ID NO: 9330183 - DNA, 22 bp, Homo sapiens
cacatatacctcttcttgagtt

SEQ ID NO: 9330184 - DNA, 22 bp, Homo sapiens
cacatataccagccgcggtacg

SEQ ID NO: 9330185 - DNA, 22 bp, Homo sapiens
cacatataacctagacaaggcc

SEQ ID NO: 9330186 - DNA, 22 bp, Homo sapiens
cacatatatgaaatgaggaatt

SEQ ID NO: 9330187 - DNA, 23 bp, Homo sapiens
cacatatagcagccactaaggtc

SEQ ID NO: 9330188 - DNA, 23 bp, Homo sapiens
cacatatagcagccactaaggtc

SEQ ID NO: 9330189 - DNA, 18 bp, Homo sapiens
cacatttacctggctccc

SEQ ID NO: 9330190 - DNA, 22 bp, Homo sapiens
cacatttaattggtttagggtg

SEQ ID NO: 9330191 - DNA, 22 bp, Homo sapiens
cacatttacatataaaactttc

SEQ ID NO: 9330192 - DNA, 22 bp, Homo sapiens
cacatttatttgaggctaattg

SEQ ID NO: 9330193 - DNA, 22 bp, Homo sapiens
ggcaggcaggagctctgtctcc

SEQ ID NO: 9330194 - DNA, 20 bp, Homo sapiens
ggcaggcaggaggtttccag

SEQ ID NO: 9330195 - DNA, 22 bp, Homo sapiens
ggcaggcaggtcttcatggccc

SEQ ID NO: 9330196 - DNA, 22 bp, Homo sapiens
ggcaggcaggtcttcatggccc

SEQ ID NO: 9330197 - DNA, 22 bp, Homo sapiens
ggcaggcaggtcttcatggccc

SEQ ID NO: 9330198 - DNA, 22 bp, Homo sapiens
ggcaggcaggtcttcatggccc

SEQ ID NO: 9330199 - DNA, 22 bp, Homo sapiens
ggcaggcagtgtggtgtgaaac

SEQ ID NO: 9330200 - DNA, 22 bp, Homo sapiens
ggcaggcatggggtctgccatt

SEQ ID NO: 9330201 - DNA, 22 bp, Homo sapiens
ggcaggcatggggtctgccatt

SEQ ID NO: 9330202 - DNA, 22 bp, Homo sapiens
ggcaggcatggccactccctag

SEQ ID NO: 9330203 - DNA, 22 bp, Homo sapiens
ggcaggcatggggtctgccatt

SEQ ID NO: 9330204 - DNA, 22 bp, Homo sapiens
ggcaggcatcatgtggtcatta

SEQ ID NO: 9330205 - DNA, 22 bp, Homo sapiens
ggcaggcatcatgtggtcatta

SEQ ID NO: 9330206 - DNA, 22 bp, Homo sapiens
ggcaggcatcatgtggtcatta

SEQ ID NO: 9330207 - DNA, 20 bp, Homo sapiens
ggcagggagggatactgagg

SEQ ID NO: 9330208 - DNA, 22 bp, Homo sapiens
ggcaggcatggggtctgccatt

SEQ ID NO: 9330209 - DNA, 22 bp, Homo sapiens
atagttatgctctagacaagaa

SEQ ID NO: 9330210 - DNA, 22 bp, Homo sapiens
atagtgttacccttcttaaagt

SEQ ID NO: 9330211 - DNA, 22 bp, Homo sapiens
atagtgtgttagtgacataggc

SEQ ID NO: 9330212 - DNA, 22 bp, Homo sapiens
atagtgtgtggtataggtagag

SEQ ID NO: 9330213 - DNA, 22 bp, Homo sapiens
ataggagactgttcttggcttc

SEQ ID NO: 9330214 - DNA, 22 bp, Homo sapiens
ataggacagcagacaattagta

SEQ ID NO: 9330215 - DNA, 22 bp, Homo sapiens
ataggaatgtgatttataaatg

SEQ ID NO: 9330216 - DNA, 22 bp, Homo sapiens
ataggaaatcgctattaaccta

SEQ ID NO: 9330217 - DNA, 22 bp, Homo sapiens
atagtgtctttcttcacaggca

SEQ ID NO: 9330218 - DNA, 22 bp, Homo sapiens
atagtgtgtaaagtgcagtgat

SEQ ID NO: 9330219 - DNA, 22 bp, Homo sapiens
atagtgtgactgaggagttgaa

SEQ ID NO: 9330220 - DNA, 22 bp, Homo sapiens
ataggaaagaatggagggtggg

SEQ ID NO: 9330221 - DNA, 22 bp, Homo sapiens
ataggaaagaaaattatgtagg

SEQ ID NO: 9330222 - DNA, 22 bp, Homo sapiens
atagctttttgtcatagagtct

SEQ ID NO: 9330223 - DNA, 22 bp, Homo sapiens
atagcttcagaattgagatatc

SEQ ID NO: 9330224 - DNA, 22 bp, Homo sapiens
atagccactctaattctcttgt

SEQ ID NO: 9330225 - DNA, 22 bp, Homo sapiens
agaaaaggattgatggatcaga

SEQ ID NO: 9330226 - DNA, 22 bp, Homo sapiens
agaaaaggcttgaagaggtttt

SEQ ID NO: 9330227 - DNA, 17 bp, Homo sapiens
agaaaagagaccagcag

SEQ ID NO: 9330228 - DNA, 17 bp, Homo sapiens
agaaaagagaccagcag

SEQ ID NO: 9330229 - DNA, 22 bp, Homo sapiens
agaaaagaggctttctaagcat

SEQ ID NO: 9330230 - DNA, 22 bp, Homo sapiens
agaaaagaggctttctaagcat

SEQ ID NO: 9330231 - DNA, 23 bp, Homo sapiens
atagttatgctgcatgcatgtac

SEQ ID NO: 9330232 - DNA, 22 bp, Homo sapiens
atagttatttctgtcactgtca

SEQ ID NO: 9330233 - DNA, 22 bp, Homo sapiens
atagttctggatgtacttatag

SEQ ID NO: 9330234 - DNA, 22 bp, Homo sapiens
atagttgagatcagattcaact

SEQ ID NO: 9330235 - DNA, 22 bp, Homo sapiens
agaaaacttgtcacagctctca

SEQ ID NO: 9330236 - DNA, 22 bp, Homo sapiens
agaaaacttgtcacagctctca

SEQ ID NO: 9330237 - DNA, 22 bp, Homo sapiens
atacttaactgtggagtcattg

SEQ ID NO: 9330238 - DNA, 22 bp, Homo sapiens
atagaactcgggctttggaatc

SEQ ID NO: 9330239 - DNA, 21 bp, Homo sapiens
atagaacaccaggcatatata

SEQ ID NO: 9330240 - DNA, 22 bp, Homo sapiens
atagccacagttatattgagac

SEQ ID NO: 9330241 - DNA, 22 bp, Homo sapiens
atagatgtacgtatgtaaatca

SEQ ID NO: 9330242 - DNA, 22 bp, Homo sapiens
atagatccagaaaatttattat

SEQ ID NO: 9330243 - DNA, 23 bp, Homo sapiens
actttagataaattatgtgcaca

SEQ ID NO: 9330244 - DNA, 22 bp, Homo sapiens
actttagatattcctctgtaca

SEQ ID NO: 9330245 - DNA, 22 bp, Homo sapiens
actttagagaaatgtagaagta

SEQ ID NO: 9330246 - DNA, 22 bp, Homo sapiens
actttagaccatcttccacagt

SEQ ID NO: 9330247 - DNA, 22 bp, Homo sapiens
actttagaaaaggaacagagga

SEQ ID NO: 9330248 - DNA, 22 bp, Homo sapiens
actttagaagtaaggatgagtt

SEQ ID NO: 9330249 - DNA, 22 bp, Homo sapiens
actttactccccaacataaatg

SEQ ID NO: 9330250 - DNA, 22 bp, Homo sapiens
actttactccccaacataaatg

SEQ ID NO: 9330251 - DNA, 22 bp, Homo sapiens
actttactccccaacataaatg

SEQ ID NO: 9330252 - DNA, 22 bp, Homo sapiens
actttactccccaacataaatg

SEQ ID NO: 9330253 - DNA, 22 bp, Homo sapiens
actttactcttcatatgtgaca

SEQ ID NO: 9330254 - DNA, 22 bp, Homo sapiens
actttagaaaagcatccataga

SEQ ID NO: 9330255 - DNA, 20 bp, Homo sapiens
actttacagagaagactgac

SEQ ID NO: 9330256 - DNA, 22 bp, Homo sapiens
atagaatagcatagaaaattga

SEQ ID NO: 9330257 - DNA, 22 bp, Homo sapiens
atagaataatggttgtcaggag

SEQ ID NO: 9330258 - DNA, 22 bp, Homo sapiens
actttacagatggtttcctgac

SEQ ID NO: 9330259 - DNA, 22 bp, Homo sapiens
actttacagatggtttcctgac

SEQ ID NO: 9330260 - DNA, 22 bp, Homo sapiens
actttacaggcacttcaagtat

SEQ ID NO: 9330261 - DNA, 22 bp, Homo sapiens
actttactcaacaaatatttat

SEQ ID NO: 9330262 - DNA, 22 bp, Homo sapiens
actttactccccaacataaatg

SEQ ID NO: 9330263 - DNA, 22 bp, Homo sapiens
actttacatttgatctctctaa

SEQ ID NO: 9330264 - DNA, 22 bp, Homo sapiens
actttacaggcacttcaagtat

SEQ ID NO: 9330265 - DNA, 22 bp, Homo sapiens
actttactacatccacagatgg

SEQ ID NO: 9330266 - DNA, 22 bp, Homo sapiens
ataaattttcttgctgtactta

SEQ ID NO: 9330267 - DNA, 22 bp, Homo sapiens
ataacaatagtggtagtgctgg

SEQ ID NO: 9330268 - DNA, 22 bp, Homo sapiens
ataaattctctgatgtatagta

SEQ ID NO: 9330269 - DNA, 21 bp, Homo sapiens
ataaattctgagaggctctgc

SEQ ID NO: 9330270 - DNA, 22 bp, Homo sapiens
ataaattctctgatgtatagta

SEQ ID NO: 9330271 - DNA, 22 bp, Homo sapiens
ataaattatgaatggccctttt

SEQ ID NO: 9330272 - DNA, 19 bp, Homo sapiens
ataaataaaaagtgggaga

SEQ ID NO: 9330273 - DNA, 22 bp, Homo sapiens
agttgcagccttcaggagaccc

SEQ ID NO: 9330274 - DNA, 22 bp, Homo sapiens
agttgcactttctagatactgt

SEQ ID NO: 9330275 - DNA, 22 bp, Homo sapiens
agttcttttgtgaacatatgct

SEQ ID NO: 9330276 - DNA, 22 bp, Homo sapiens
agttctttgtgagtaatacaga

SEQ ID NO: 9330277 - DNA, 22 bp, Homo sapiens
agttgaaagccttatttctctg

SEQ ID NO: 9330278 - DNA, 22 bp, Homo sapiens
agttgaaagccttatttctctg

SEQ ID NO: 9330279 - DNA, 22 bp, Homo sapiens
agttgaaattaagagagagttt

SEQ ID NO: 9330280 - DNA, 22 bp, Homo sapiens
agttgaaggttggctgatccat

SEQ ID NO: 9330281 - DNA, 22 bp, Homo sapiens
agttcactttctgtagtggaag

SEQ ID NO: 9330282 - DNA, 22 bp, Homo sapiens
agttcacagaatggccagaact

SEQ ID NO: 9330283 - DNA, 22 bp, Homo sapiens
ataagctgtactctataaatgt

SEQ ID NO: 9330284 - DNA, 22 bp, Homo sapiens
ataaggcagtcactggaatgtt

SEQ ID NO: 9330285 - DNA, 22 bp, Homo sapiens
atacaagttgtgataatgtaaa

SEQ ID NO: 9330286 - DNA, 22 bp, Homo sapiens
atacaattattctgcagatatt

SEQ ID NO: 9330287 - DNA, 22 bp, Homo sapiens
atacacacgtgcacgtgggaaa

SEQ ID NO: 9330288 - DNA, 22 bp, Homo sapiens
atacacacatatgtgagttttg

SEQ ID NO: 9330289 - DNA, 22 bp, Homo sapiens
atacacacaatcaggttttgta

SEQ ID NO: 9330290 - DNA, 22 bp, Homo sapiens
atacacactgctatcctttttt

SEQ ID NO: 9330291 - DNA, 22 bp, Homo sapiens
atacacagccattatgaattag

SEQ ID NO: 9330292 - DNA, 22 bp, Homo sapiens
atacacagcgatgagaggaggc

SEQ ID NO: 9330293 - DNA, 22 bp, Homo sapiens
atacacatttgctagagatggg

SEQ ID NO: 9330294 - DNA, 22 bp, Homo sapiens
atacactactaagcacagattg

SEQ ID NO: 9330295 - DNA, 19 bp, Homo sapiens
atacacgtgtatacataca

SEQ ID NO: 9330296 - DNA, 22 bp, Homo sapiens
atacacctgtggagtgtctctc

SEQ ID NO: 9330297 - DNA, 22 bp, Homo sapiens
atacaccaccttggatctttca

SEQ ID NO: 9330298 - DNA, 22 bp, Homo sapiens
agaaatgtttatggctgcctat

SEQ ID NO: 9330299 - DNA, 22 bp, Homo sapiens
agaagcactacgataggtggtc

SEQ ID NO: 9330300 - DNA, 22 bp, Homo sapiens
agaagcacggttttgtctagca

SEQ ID NO: 9330301 - DNA, 22 bp, Homo sapiens
agaagcagggcagggaaaagca

SEQ ID NO: 9330302 - DNA, 22 bp, Homo sapiens
agaagcaggcctcacagatctg

SEQ ID NO: 9330303 - DNA, 18 bp, Homo sapiens
agaagcaggtaaaattct

SEQ ID NO: 9330304 - DNA, 20 bp, Homo sapiens
agaagcattcaaagaaaact

SEQ ID NO: 9330305 - DNA, 22 bp, Homo sapiens
agaagccaaaggggccagatat

SEQ ID NO: 9330306 - DNA, 22 bp, Homo sapiens
agaagccaacagggcaggagag

SEQ ID NO: 9330307 - DNA, 22 bp, Homo sapiens
agaagccaaatgccagtgacct

SEQ ID NO: 9330308 - DNA, 22 bp, Homo sapiens
agaagccaaatgccagtgacct

SEQ ID NO: 9330309 - DNA, 22 bp, Homo sapiens
agaaatggtgagtgagagcccc

SEQ ID NO: 9330310 - DNA, 22 bp, Homo sapiens
agaaatgggccttgggacacaa

SEQ ID NO: 9330311 - DNA, 22 bp, Homo sapiens
agaaatgttgaatacacaaaat

SEQ ID NO: 9330312 - DNA, 22 bp, Homo sapiens
agaaatgttacagttgttattt

SEQ ID NO: 9330313 - DNA, 20 bp, Homo sapiens
agaaatgtgaaaggctgagt

SEQ ID NO: 9330314 - DNA, 22 bp, Homo sapiens
agaaatgtccagggctaggatc

SEQ ID NO: 9330315 - DNA, 22 bp, Homo sapiens
agaagccaccagctgaggaaga

SEQ ID NO: 9330316 - DNA, 22 bp, Homo sapiens
agaagccaccagctgaggaaga

SEQ ID NO: 9330317 - DNA, 22 bp, Homo sapiens
agaagccatagtctgggaggca

SEQ ID NO: 9330318 - DNA, 22 bp, Homo sapiens
agaagccatagtatctcagggt

SEQ ID NO: 9330319 - DNA, 22 bp, Homo sapiens
agaagccatagtatctcagggt

SEQ ID NO: 9330320 - DNA, 22 bp, Homo sapiens
atcctgggaagctgacattgaa

SEQ ID NO: 9330321 - DNA, 22 bp, Homo sapiens
atcctgggaagtggcctcctcc

SEQ ID NO: 9330322 - DNA, 22 bp, Homo sapiens
atcctgggaatgggagggtcat

SEQ ID NO: 9330323 - DNA, 22 bp, Homo sapiens
atcctgggaatgggagggtcat

SEQ ID NO: 9330324 - DNA, 22 bp, Homo sapiens
agaagccaccagctgaggaaga

SEQ ID NO: 9330325 - DNA, 22 bp, Homo sapiens
atcctgggaatgggagggtcat

SEQ ID NO: 9330326 - DNA, 22 bp, Homo sapiens
agaagccatggtatgcaactac

SEQ ID NO: 9330327 - DNA, 21 bp, Homo sapiens
agaagccatgtggtggagaac

SEQ ID NO: 9330328 - DNA, 22 bp, Homo sapiens
agaagccatggtatgcaactac

SEQ ID NO: 9330329 - DNA, 22 bp, Homo sapiens
agaagccatggtatgcaactac

SEQ ID NO: 9330330 - DNA, 22 bp, Homo sapiens
agaagccatatttagggaggag

SEQ ID NO: 9330331 - DNA, 22 bp, Homo sapiens
agaagccatagtatctcagggt

SEQ ID NO: 9330332 - DNA, 22 bp, Homo sapiens
agaagccatagtctgggaggca

SEQ ID NO: 9330333 - DNA, 22 bp, Homo sapiens
atcctgaggaaggtgcagagat

SEQ ID NO: 9330334 - DNA, 22 bp, Homo sapiens
atcctgaggaaggtgcagagat

SEQ ID NO: 9330335 - DNA, 23 bp, Homo sapiens
atcctgctgatggccctccagga

SEQ ID NO: 9330336 - DNA, 22 bp, Homo sapiens
atcctggcgccacacggctcta

SEQ ID NO: 9330337 - DNA, 22 bp, Homo sapiens
atcctggcgccacacggctcta

SEQ ID NO: 9330338 - DNA, 22 bp, Homo sapiens
atcctggcgggggaactgccca

SEQ ID NO: 9330339 - DNA, 22 bp, Homo sapiens
atcctggcgggggaactgccca

SEQ ID NO: 9330340 - DNA, 22 bp, Homo sapiens
atcctggctttaggtcagaggc

SEQ ID NO: 9330341 - DNA, 22 bp, Homo sapiens
atcctgggaagctgacattgaa

SEQ ID NO: 9330342 - DNA, 22 bp, Homo sapiens
atcctggcccaggtgtggaggg

SEQ ID NO: 9330343 - DNA, 22 bp, Homo sapiens
atcctggcccaggtgtggaggg

SEQ ID NO: 9330344 - DNA, 22 bp, Homo sapiens
atcctggccctcatgacccctt

SEQ ID NO: 9330345 - DNA, 22 bp, Homo sapiens
atcctgctgctgtggacttctc

SEQ ID NO: 9330346 - DNA, 20 bp, Homo sapiens
atcctggaatccaaatggag

SEQ ID NO: 9330347 - DNA, 22 bp, Homo sapiens
atcctggacagtttcccctatt

SEQ ID NO: 9330348 - DNA, 22 bp, Homo sapiens
atcctggaggctggaggcttgc

SEQ ID NO: 9330349 - DNA, 22 bp, Homo sapiens
atcctggcaagcagaggagaac

SEQ ID NO: 9330350 - DNA, 22 bp, Homo sapiens
atctggaaaacacagtgtagac

SEQ ID NO: 9330351 - DNA, 22 bp, Homo sapiens
agaagctgcctacatgaccagc

SEQ ID NO: 9330352 - DNA, 20 bp, Homo sapiens
agaagctgagactgggtttt

SEQ ID NO: 9330353 - DNA, 22 bp, Homo sapiens
agaagctcgggtaagctccatt

SEQ ID NO: 9330354 - DNA, 22 bp, Homo sapiens
agaagcgttccatttgatgggt

SEQ ID NO: 9330355 - DNA, 19 bp, Homo sapiens
agaagcccagatcccagcc

SEQ ID NO: 9330356 - DNA, 21 bp, Homo sapiens
agaagccatttgttaggactt

SEQ ID NO: 9330357 - DNA, 22 bp, Homo sapiens
agaagccattgaagcagacctc

SEQ ID NO: 9330358 - DNA, 21 bp, Homo sapiens
agaagccatttgttaggactt

SEQ ID NO: 9330359 - DNA, 21 bp, Homo sapiens
agaagcctgggtggaggtggg

SEQ ID NO: 9330360 - DNA, 22 bp, Homo sapiens
agaagcgtgagtggatttaggt

SEQ ID NO: 9330361 - DNA, 22 bp, Homo sapiens
agaagccattctcagttcctga

SEQ ID NO: 9330362 - DNA, 22 bp, Homo sapiens
agaagccattctcagttcctga

SEQ ID NO: 9330363 - DNA, 22 bp, Homo sapiens
agaagccattccctgtaggctc

SEQ ID NO: 9330364 - DNA, 22 bp, Homo sapiens
agaagccattccctgtaggctc

SEQ ID NO: 9330365 - DNA, 22 bp, Homo sapiens
agaagccatgtttagtaggatg

SEQ ID NO: 9330366 - DNA, 21 bp, Homo sapiens
agaagccatgtggtggagaac

SEQ ID NO: 9330367 - DNA, 22 bp, Homo sapiens
atatagtgaaagtgatgtgtgg

SEQ ID NO: 9330368 - DNA, 22 bp, Homo sapiens
atatagtcaaacatatatgtgt

SEQ ID NO: 9330369 - DNA, 22 bp, Homo sapiens
atatagtttaagaaagtacagt

SEQ ID NO: 9330370 - DNA, 22 bp, Homo sapiens
atatagttgggtttcattctac

SEQ ID NO: 9330371 - DNA, 22 bp, Homo sapiens
agaaactgcagctcagagaagt

SEQ ID NO: 9330372 - DNA, 17 bp, Homo sapiens
agaaactgaggctcagt

SEQ ID NO: 9330373 - DNA, 21 bp, Homo sapiens
agaaactgactcctagaggca

SEQ ID NO: 9330374 - DNA, 22 bp, Homo sapiens
agaaactgtgttactagaatgt

SEQ ID NO: 9330375 - DNA, 22 bp, Homo sapiens
agaaacttcagctattcttttg

SEQ ID NO: 9330376 - DNA, 22 bp, Homo sapiens
agaaagaacgcacttgtgctgc

SEQ ID NO: 9330377 - DNA, 22 bp, Homo sapiens
atatagcacttgttttgcatgt

SEQ ID NO: 9330378 - DNA, 19 bp, Homo sapiens
atatagcattattcaattt

SEQ ID NO: 9330379 - DNA, 22 bp, Homo sapiens
atatagtaagcagtctgtaaat

SEQ ID NO: 9330380 - DNA, 22 bp, Homo sapiens
atatagtatgtcctccagaatt

SEQ ID NO: 9330381 - DNA, 22 bp, Homo sapiens
atatagtaagcagtctgtaaat

SEQ ID NO: 9330382 - DNA, 22 bp, Homo sapiens
atatagaatacacagggaaagt

SEQ ID NO: 9330383 - DNA, 22 bp, Homo sapiens
agaaaagggcaggagggataca

SEQ ID NO: 9330384 - DNA, 22 bp, Homo sapiens
agaaaagggcaggagggataca

SEQ ID NO: 9330385 - DNA, 22 bp, Homo sapiens
agaaaagggcaggagggataca

SEQ ID NO: 9330386 - DNA, 22 bp, Homo sapiens
atattaatgggatttagtcagg

SEQ ID NO: 9330387 - DNA, 22 bp, Homo sapiens
atattaatgagcaagtaagtga

SEQ ID NO: 9330388 - DNA, 22 bp, Homo sapiens
atattaaaactatggttttcag

SEQ ID NO: 9330389 - DNA, 22 bp, Homo sapiens
atattaaatggattttgggagc

SEQ ID NO: 9330390 - DNA, 22 bp, Homo sapiens
atattaaaactatggttttcag

SEQ ID NO: 9330391 - DNA, 22 bp, Homo sapiens
atattaaaactatggttttcag

SEQ ID NO: 9330392 - DNA, 22 bp, Homo sapiens
agaaagacgtgatgaagaagta

SEQ ID NO: 9330393 - DNA, 22 bp, Homo sapiens
agaaagacaaaatgcagtggct

SEQ ID NO: 9330394 - DNA, 22 bp, Homo sapiens
agaaagaacgttggttatctta

SEQ ID NO: 9330395 - DNA, 22 bp, Homo sapiens
agaaagagatgaatgctttaag

SEQ ID NO: 9330396 - DNA, 17 bp, Homo sapiens
agaaagaggatccacag

SEQ ID NO: 9330397 - DNA, 22 bp, Homo sapiens
atcaagttctgtcacatttgtc

SEQ ID NO: 9330398 - DNA, 18 bp, Homo sapiens
atcaaggaggggaaggtc

SEQ ID NO: 9330399 - DNA, 22 bp, Homo sapiens
atcaatagtctggaaagttctg

SEQ ID NO: 9330400 - DNA, 22 bp, Homo sapiens
atcaattttgaggatacaagaa

SEQ ID NO: 9330401 - DNA, 22 bp, Homo sapiens
atcaattttgaggatacaagaa

SEQ ID NO: 9330402 - DNA, 22 bp, Homo sapiens
agaaatcttggagtctgtggta

SEQ ID NO: 9330403 - DNA, 22 bp, Homo sapiens
agaaagtttgtttttatccata

SEQ ID NO: 9330404 - DNA, 22 bp, Homo sapiens
agaaagttttgtgctatatatg

SEQ ID NO: 9330405 - DNA, 22 bp, Homo sapiens
atattaattatttacacatgag

SEQ ID NO: 9330406 - DNA, 22 bp, Homo sapiens
agaaatatgctgattagatgaa

SEQ ID NO: 9330407 - DNA, 19 bp, Homo sapiens
agaaatagccttccttgtc

SEQ ID NO: 9330408 - DNA, 22 bp, Homo sapiens
agaaatagtcacattggaggaa

SEQ ID NO: 9330409 - DNA, 20 bp, Homo sapiens
agaaatcagcatgtcctctg

SEQ ID NO: 9330410 - DNA, 20 bp, Homo sapiens
agaaatattgagttcagagg

SEQ ID NO: 9330411 - DNA, 22 bp, Homo sapiens
actggtttcccggaactacagt

SEQ ID NO: 9330412 - DNA, 22 bp, Homo sapiens
actggttgaagaaaagctagta

SEQ ID NO: 9330413 - DNA, 22 bp, Homo sapiens
agttacaaacactatcagttct

SEQ ID NO: 9330414 - DNA, 22 bp, Homo sapiens
agttacaaccatgacacaagca

SEQ ID NO: 9330415 - DNA, 22 bp, Homo sapiens
actggggtttaggcctgggcaa

SEQ ID NO: 9330416 - DNA, 22 bp, Homo sapiens
actgggtgtaaaggacttaagc

SEQ ID NO: 9330417 - DNA, 22 bp, Homo sapiens
actgggtgtattagtggtgttt

SEQ ID NO: 9330418 - DNA, 22 bp, Homo sapiens
actgggtggctgcctccttctc

SEQ ID NO: 9330419 - DNA, 22 bp, Homo sapiens
actggggtgaaattggagtgtc

SEQ ID NO: 9330420 - DNA, 22 bp, Homo sapiens
actggggctgatgcgttcgtgt

SEQ ID NO: 9330421 - DNA, 22 bp, Homo sapiens
actggggcctcctccatgctct

SEQ ID NO: 9330422 - DNA, 22 bp, Homo sapiens
actggggcaggaaagtatgctg

SEQ ID NO: 9330423 - DNA, 22 bp, Homo sapiens
actggggcagtgggcagtggtt

SEQ ID NO: 9330424 - DNA, 22 bp, Homo sapiens
actggggcaggaaagtatgctg

SEQ ID NO: 9330425 - DNA, 22 bp, Homo sapiens
actggggattagggactcagtg

SEQ ID NO: 9330426 - DNA, 22 bp, Homo sapiens
agttacacaacttatcacatct

SEQ ID NO: 9330427 - DNA, 21 bp, Homo sapiens
agttacaagtttattcagagg

SEQ ID NO: 9330428 - DNA, 22 bp, Homo sapiens
agttacaagtacaggctttgga

SEQ ID NO: 9330429 - DNA, 22 bp, Homo sapiens
agttacaaccatgacacaagca

SEQ ID NO: 9330430 - DNA, 22 bp, Homo sapiens
agttacaagctattttacttaa

SEQ ID NO: 9330431 - DNA, 22 bp, Homo sapiens
agttacaactgtttgaatgtca

SEQ ID NO: 9330432 - DNA, 22 bp, Homo sapiens
agttacaactgtttgaatgtca

SEQ ID NO: 9330433 - DNA, 22 bp, Homo sapiens
agttacagcactcaaagttttc

SEQ ID NO: 9330434 - DNA, 22 bp, Homo sapiens
agttacagaatgtacagaggtt

SEQ ID NO: 9330435 - DNA, 22 bp, Homo sapiens
agttacagtaagccagccagca

SEQ ID NO: 9330436 - DNA, 22 bp, Homo sapiens
agttaccatatatcaaacatgg

SEQ ID NO: 9330437 - DNA, 22 bp, Homo sapiens
agttattttggaaaatgagtca

SEQ ID NO: 9330438 - DNA, 22 bp, Homo sapiens
agttcaaactctataagaactt

SEQ ID NO: 9330439 - DNA, 22 bp, Homo sapiens
agtgtcttcatgatgtggcagc

SEQ ID NO: 9330440 - DNA, 22 bp, Homo sapiens
agtgtctttagcaagtttagtc

SEQ ID NO: 9330441 - DNA, 22 bp, Homo sapiens
agtgtgggtgagggaggccctc

SEQ ID NO: 9330442 - DNA, 22 bp, Homo sapiens
agtgtggggtcaccggcccagg

SEQ ID NO: 9330443 - DNA, 22 bp, Homo sapiens
agtgtgggttttatggagccct

SEQ ID NO: 9330444 - DNA, 22 bp, Homo sapiens
agtgtgggtgagggaggccctc

SEQ ID NO: 9330445 - DNA, 20 bp, Homo sapiens
agtgtggttttcaggaatat

SEQ ID NO: 9330446 - DNA, 22 bp, Homo sapiens
agtgtgtccaggaagcagatgg

SEQ ID NO: 9330447 - DNA, 22 bp, Homo sapiens
agtgtgtcgagggagggtccag

SEQ ID NO: 9330448 - DNA, 17 bp, Homo sapiens
agtgtgtgaaatggtgg

SEQ ID NO: 9330449 - DNA, 22 bp, Homo sapiens
agtgtgtcttatcctgggagaa

SEQ ID NO: 9330450 - DNA, 23 bp, Homo sapiens
actgggctgaaatttttcatggc

SEQ ID NO: 9330451 - DNA, 23 bp, Homo sapiens
actgggctgaaattaaaggtgtc

SEQ ID NO: 9330452 - DNA, 22 bp, Homo sapiens
actgggctcccaggcttgtcat

SEQ ID NO: 9330453 - DNA, 22 bp, Homo sapiens
agtgtctgaacctgcagtggga

SEQ ID NO: 9330454 - DNA, 20 bp, Homo sapiens
agtgtctggtgcagggcctc

SEQ ID NO: 9330455 - DNA, 22 bp, Homo sapiens
agtgtctgtgttttctattgct

SEQ ID NO: 9330456 - DNA, 22 bp, Homo sapiens
agtgtctgtgatgaggtcagga

SEQ ID NO: 9330457 - DNA, 22 bp, Homo sapiens
agtgtctgtgatgaggtcagga

SEQ ID NO: 9330458 - DNA, 22 bp, Homo sapiens
agtggggcggacaggaccagga

SEQ ID NO: 9330459 - DNA, 22 bp, Homo sapiens
agtggggccggtgaggccgagg

SEQ ID NO: 9330460 - DNA, 22 bp, Homo sapiens
agtggggtctcctccagccccc

SEQ ID NO: 9330461 - DNA, 22 bp, Homo sapiens
agtggggtcctcagtatggttc

SEQ ID NO: 9330462 - DNA, 22 bp, Homo sapiens
agtggggtcctcagtatggttc

SEQ ID NO: 9330463 - DNA, 22 bp, Homo sapiens
agtgggggctggctctgtctgt

SEQ ID NO: 9330464 - DNA, 22 bp, Homo sapiens
agtgggggccaacgagggcagc

SEQ ID NO: 9330465 - DNA, 22 bp, Homo sapiens
agtgaggctaataggcaatggt

SEQ ID NO: 9330466 - DNA, 20 bp, Homo sapiens
agtgaggcagttcagtgggc

SEQ ID NO: 9330467 - DNA, 22 bp, Homo sapiens
agtgaggcaaagtgagaggcag

SEQ ID NO: 9330468 - DNA, 22 bp, Homo sapiens
agtgagcaacagaagcgtgggt

SEQ ID NO: 9330469 - DNA, 23 bp, Homo sapiens
agtgagcagctgtagggcaagga

SEQ ID NO: 9330470 - DNA, 23 bp, Homo sapiens
agtgagcagctgtagggcaagga

SEQ ID NO: 9330471 - DNA, 23 bp, Homo sapiens
agtgagcagctgtagggcaagga

SEQ ID NO: 9330472 - DNA, 22 bp, Homo sapiens
agtgagcattcgtttggaaccc

SEQ ID NO: 9330473 - DNA, 19 bp, Homo sapiens
agtgagcatccagagaggt

SEQ ID NO: 9330474 - DNA, 23 bp, Homo sapiens
agtgaattcagtttaaaacagag

SEQ ID NO: 9330475 - DNA, 17 bp, Homo sapiens
agtgagaatgtcatgta

SEQ ID NO: 9330476 - DNA, 17 bp, Homo sapiens
agtgagaatgtcatgta

SEQ ID NO: 9330477 - DNA, 22 bp, Homo sapiens
agtgagatattagctaatgtgt

SEQ ID NO: 9330478 - DNA, 22 bp, Homo sapiens
agtgagagtattaatgtgaact

SEQ ID NO: 9330479 - DNA, 21 bp, Homo sapiens
agtccttgaaactctttcttg

SEQ ID NO: 9330480 - DNA, 22 bp, Homo sapiens
agtccttcttttagttgcttgg

SEQ ID NO: 9330481 - DNA, 18 bp, Homo sapiens
agtccttcttggttttac

SEQ ID NO: 9330482 - DNA, 22 bp, Homo sapiens
agtgaatgtccccgcgggtcag

SEQ ID NO: 9330483 - DNA, 22 bp, Homo sapiens
agtcctttgggaaaaatgacta

SEQ ID NO: 9330484 - DNA, 22 bp, Homo sapiens
agtgattttaacttccagcaat

SEQ ID NO: 9330485 - DNA, 22 bp, Homo sapiens
agtgattttaacttccagcaat

SEQ ID NO: 9330486 - DNA, 20 bp, Homo sapiens
agtgatttgttagtacattg

SEQ ID NO: 9330487 - DNA, 22 bp, Homo sapiens
agtgatttggtgggagcgcgta

SEQ ID NO: 9330488 - DNA, 22 bp, Homo sapiens
agtgatttggttcatacttcca

SEQ ID NO: 9330489 - DNA, 20 bp, Homo sapiens
agtgatttgttagtacattg

SEQ ID NO: 9330490 - DNA, 22 bp, Homo sapiens
agtgatttgggagagccagctg

SEQ ID NO: 9330491 - DNA, 22 bp, Homo sapiens
agtgatttggcggcagagttag

SEQ ID NO: 9330492 - DNA, 22 bp, Homo sapiens
agtgatttgggtgtcagaaagt

SEQ ID NO: 9330493 - DNA, 22 bp, Homo sapiens
agtgatttggggatgggaaagg

SEQ ID NO: 9330494 - DNA, 22 bp, Homo sapiens
agtgattttgtagctatgagat

SEQ ID NO: 9330495 - DNA, 22 bp, Homo sapiens
agtgattttgtagctatgagat

SEQ ID NO: 9330496 - DNA, 22 bp, Homo sapiens
agtgattttgctttgaagtgac

SEQ ID NO: 9330497 - DNA, 15 bp, Homo sapiens
agtgattttggactc

SEQ ID NO: 9330498 - DNA, 22 bp, Homo sapiens
agtgattttggccgtgccatta

SEQ ID NO: 9330499 - DNA, 22 bp, Homo sapiens
agtgattttggcctggcctttt

SEQ ID NO: 9330500 - DNA, 22 bp, Homo sapiens
agtgattttcaagtggagcaca

SEQ ID NO: 9330501 - DNA, 22 bp, Homo sapiens
agtgattttatcaatttactca

SEQ ID NO: 9330502 - DNA, 20 bp, Homo sapiens
agtgattttgatatggtctt

SEQ ID NO: 9330503 - DNA, 22 bp, Homo sapiens
agtgattttctccagctggcag

SEQ ID NO: 9330504 - DNA, 22 bp, Homo sapiens
agtgattttgctttgaagtgac

SEQ ID NO: 9330505 - DNA, 22 bp, Homo sapiens
agtgcaaaattcagaagcaatt

SEQ ID NO: 9330506 - DNA, 22 bp, Homo sapiens
agtgcaaaaaagtgttgtgaca

SEQ ID NO: 9330507 - DNA, 22 bp, Homo sapiens
agtgattttgtcagcttctgca

SEQ ID NO: 9330508 - DNA, 22 bp, Homo sapiens
agtgatttttgaagccagccat

SEQ ID NO: 9330509 - DNA, 22 bp, Homo sapiens
agtgcaaagccgaggtttcttg

SEQ ID NO: 9330510 - DNA, 23 bp, Homo sapiens
agtgctgaattgaaagctccagg

SEQ ID NO: 9330511 - DNA, 22 bp, Homo sapiens
agtgctgtcagttttatagata

SEQ ID NO: 9330512 - DNA, 23 bp, Homo sapiens
agtgctgaattgaaagctccagg

SEQ ID NO: 9330513 - DNA, 22 bp, Homo sapiens
agtgcaagctccataatcttca

SEQ ID NO: 9330514 - DNA, 22 bp, Homo sapiens
agtgctgtctccttcccccggg

SEQ ID NO: 9330515 - DNA, 20 bp, Homo sapiens
agtgctgtggctgaataaga

SEQ ID NO: 9330516 - DNA, 22 bp, Homo sapiens
agtgctgtctccttcccccggg

SEQ ID NO: 9330517 - DNA, 22 bp, Homo sapiens
agtgggaggcggctgacgggcg

SEQ ID NO: 9330518 - DNA, 22 bp, Homo sapiens
agtgggagggccatatggtgaa

SEQ ID NO: 9330519 - DNA, 22 bp, Homo sapiens
agtgggagccagcagcttgggg

SEQ ID NO: 9330520 - DNA, 22 bp, Homo sapiens
agtgggaggaagtggtgatatt

SEQ ID NO: 9330521 - DNA, 22 bp, Homo sapiens
agtggctggaattgcaggtgcg

SEQ ID NO: 9330522 - DNA, 22 bp, Homo sapiens
agtggctggaattgcaggtgcg

SEQ ID NO: 9330523 - DNA, 22 bp, Homo sapiens
agtggctggaattgcaggtgcg

SEQ ID NO: 9330524 - DNA, 22 bp, Homo sapiens
agtggctggaattgcaggtgcg

SEQ ID NO: 9330525 - DNA, 22 bp, Homo sapiens
agtggcagagccaagtagagcc

SEQ ID NO: 9330526 - DNA, 22 bp, Homo sapiens
agtggcagagccaagatatgat

SEQ ID NO: 9330527 - DNA, 22 bp, Homo sapiens
agtggcagagccaagtagagcc

SEQ ID NO: 9330528 - DNA, 22 bp, Homo sapiens
agtggcagagccaagatatgat

SEQ ID NO: 9330529 - DNA, 20 bp, Homo sapiens
agtgggagagggcagactgc

SEQ ID NO: 9330530 - DNA, 20 bp, Homo sapiens
agtgggagagggcagactgc

SEQ ID NO: 9330531 - DNA, 20 bp, Homo sapiens
agtgggagagggcagactgc

SEQ ID NO: 9330532 - DNA, 20 bp, Homo sapiens
agtgggagagggcagactgc

SEQ ID NO: 9330533 - DNA, 22 bp, Homo sapiens
agtgctttccttcttgtgacat

SEQ ID NO: 9330534 - DNA, 22 bp, Homo sapiens
agtgctttccttcttgtgacat

SEQ ID NO: 9330535 - DNA, 22 bp, Homo sapiens
agtgctttccctgaaaccttcc

SEQ ID NO: 9330536 - DNA, 22 bp, Homo sapiens
agtgctttccctgaaaccttcc

SEQ ID NO: 9330537 - DNA, 22 bp, Homo sapiens
agtgctttatgttgttgtgcaa

SEQ ID NO: 9330538 - DNA, 22 bp, Homo sapiens
agtgctttagcatccaactgtc

SEQ ID NO: 9330539 - DNA, 22 bp, Homo sapiens
agtgctttagagaaatggtgct

SEQ ID NO: 9330540 - DNA, 22 bp, Homo sapiens
agtgctttacctagataatgtt

SEQ ID NO: 9330541 - DNA, 22 bp, Homo sapiens
agtgctgttaggttaatatagt

SEQ ID NO: 9330542 - DNA, 22 bp, Homo sapiens
agtgctgttaggttaatatagt

SEQ ID NO: 9330543 - DNA, 22 bp, Homo sapiens
agtgctgttggataatgctgtc

SEQ ID NO: 9330544 - DNA, 22 bp, Homo sapiens
agtgctttgaacgaaaggctga

SEQ ID NO: 9330545 - DNA, 22 bp, Homo sapiens
agtgctttcttgctccatcagt

SEQ ID NO: 9330546 - DNA, 22 bp, Homo sapiens
agtgctttgagcgtttgaaaag

SEQ ID NO: 9330547 - DNA, 22 bp, Homo sapiens
agtgctttgagcgtttgaaaag

SEQ ID NO: 9330548 - DNA, 22 bp, Homo sapiens
agtgctttggtatagaactatt

SEQ ID NO: 9330549 - DNA, 22 bp, Homo sapiens
agtggcagaagtcactgggtag

SEQ ID NO: 9330550 - DNA, 22 bp, Homo sapiens
agtggcagacacaatgtgggca

SEQ ID NO: 9330551 - DNA, 22 bp, Homo sapiens
agtggcagagcaggtgctggaa

SEQ ID NO: 9330552 - DNA, 22 bp, Homo sapiens
agtggcagagcaggtgctggaa

SEQ ID NO: 9330553 - DNA, 22 bp, Homo sapiens
agtggcagagcaggtgctggaa

SEQ ID NO: 9330554 - DNA, 22 bp, Homo sapiens
agtggcagagcaggtgctggaa

SEQ ID NO: 9330555 - DNA, 22 bp, Homo sapiens
agtggcagacacaatgtgggca

SEQ ID NO: 9330556 - DNA, 22 bp, Homo sapiens
agtggcagagaccccagccagc

SEQ ID NO: 9330557 - DNA, 19 bp, Homo sapiens
aggtgcaggtcacagggga

SEQ ID NO: 9330558 - DNA, 19 bp, Homo sapiens
aggtgcaggtcacagggga

SEQ ID NO: 9330559 - DNA, 22 bp, Homo sapiens
aggtgcaggagctgtgcaggga

SEQ ID NO: 9330560 - DNA, 21 bp, Homo sapiens
aggtgcaggcctcaagcccca

SEQ ID NO: 9330561 - DNA, 22 bp, Homo sapiens
aggtgcaggagctgtgcaggga

SEQ ID NO: 9330562 - DNA, 22 bp, Homo sapiens
aggtgcaggagctgtgcaggga

SEQ ID NO: 9330563 - DNA, 22 bp, Homo sapiens
agggtgcagtcacaggaaatgt

SEQ ID NO: 9330564 - DNA, 22 bp, Homo sapiens
agggtgcctgctgcaggttcag

SEQ ID NO: 9330565 - DNA, 22 bp, Homo sapiens
agggtgcatgtttgcaagagtg

SEQ ID NO: 9330566 - DNA, 23 bp, Homo sapiens
agggtgcatttcacttacagacc

SEQ ID NO: 9330567 - DNA, 22 bp, Homo sapiens
aggtgccagatgcacagctgaa

SEQ ID NO: 9330568 - DNA, 22 bp, Homo sapiens
aggtggaaatggctttcctagg

SEQ ID NO: 9330569 - DNA, 22 bp, Homo sapiens
aggtgccaagatgtcacagaca

SEQ ID NO: 9330570 - DNA, 21 bp, Homo sapiens
aggtgccaaggagaagcaggc

SEQ ID NO: 9330571 - DNA, 23 bp, Homo sapiens
aggtgccaactgagagctgagag

SEQ ID NO: 9330572 - DNA, 22 bp, Homo sapiens
aggtgccaaagcctgcgggtgt

SEQ ID NO: 9330573 - DNA, 22 bp, Homo sapiens
aggtgcagtgaaggaaaaggaa

SEQ ID NO: 9330574 - DNA, 22 bp, Homo sapiens
aggtgcagtggctcatgcctgt

SEQ ID NO: 9330575 - DNA, 22 bp, Homo sapiens
aggtgcagtggctcatgcctgt

SEQ ID NO: 9330576 - DNA, 19 bp, Homo sapiens
agggtccaggccctgtgga

SEQ ID NO: 9330577 - DNA, 22 bp, Homo sapiens
agggtccacttggacattgatc

SEQ ID NO: 9330578 - DNA, 22 bp, Homo sapiens
agggtcagttctgtgaggtgtt

SEQ ID NO: 9330579 - DNA, 22 bp, Homo sapiens
agggtcagtgatgagggagccc

SEQ ID NO: 9330580 - DNA, 22 bp, Homo sapiens
agggtcagtgatgagggagccc

SEQ ID NO: 9330581 - DNA, 18 bp, Homo sapiens
agggtcagtgtcactggc

SEQ ID NO: 9330582 - DNA, 22 bp, Homo sapiens
agggtccatcaaggactgcaca

SEQ ID NO: 9330583 - DNA, 22 bp, Homo sapiens
agggtgcaggtgtggagtctag

SEQ ID NO: 9330584 - DNA, 22 bp, Homo sapiens
agggtgcaggggaagctgccct

SEQ ID NO: 9330585 - DNA, 22 bp, Homo sapiens
agggtgcaggggaagctgccct

SEQ ID NO: 9330586 - DNA, 22 bp, Homo sapiens
agggtgcaggtgtggagtctag

SEQ ID NO: 9330587 - DNA, 22 bp, Homo sapiens
agggtgcagaaggagcctagga

SEQ ID NO: 9330588 - DNA, 22 bp, Homo sapiens
agggtgcagggacaggtgtgca

SEQ ID NO: 9330589 - DNA, 22 bp, Homo sapiens
agggtgcagaaggagcctagga

SEQ ID NO: 9330590 - DNA, 23 bp, Homo sapiens
agggtgagcaagctatggagacc

SEQ ID NO: 9330591 - DNA, 21 bp, Homo sapiens
agggtcctacagggctcagga

SEQ ID NO: 9330592 - DNA, 22 bp, Homo sapiens
agggtcctaagcctcagataag

SEQ ID NO: 9330593 - DNA, 22 bp, Homo sapiens
agggtgcaaaagcaaggacagt

SEQ ID NO: 9330594 - DNA, 22 bp, Homo sapiens
agggtgcagaaggagcctagga

SEQ ID NO: 9330595 - DNA, 22 bp, Homo sapiens
agggtgcagaacaaattaagac

SEQ ID NO: 9330596 - DNA, 22 bp, Homo sapiens
aggtggggaggagtgtctcttt

SEQ ID NO: 9330597 - DNA, 22 bp, Homo sapiens
aggtggggaggagtgtctcttt

SEQ ID NO: 9330598 - DNA, 22 bp, Homo sapiens
aggtgggtatcatgagagatta

SEQ ID NO: 9330599 - DNA, 22 bp, Homo sapiens
aggtgggtgccgtctgtcctct

SEQ ID NO: 9330600 - DNA, 22 bp, Homo sapiens
aggtgggtgccgtctgtcctct

SEQ ID NO: 9330601 - DNA, 22 bp, Homo sapiens
aggtggtccctataatgtggga

SEQ ID NO: 9330602 - DNA, 22 bp, Homo sapiens
aggtggtcgaatgaaataattt

SEQ ID NO: 9330603 - DNA, 22 bp, Homo sapiens
aggtggtccagagtaggaagtg

SEQ ID NO: 9330604 - DNA, 15 bp, Homo sapiens
aggtggtcagtagca

SEQ ID NO: 9330605 - DNA, 22 bp, Homo sapiens
aggtggtcactaactgccaaga

SEQ ID NO: 9330606 - DNA, 17 bp, Homo sapiens
aggtgggtggatcacct

SEQ ID NO: 9330607 - DNA, 22 bp, Homo sapiens
aggtgggttcccgactctggct

SEQ ID NO: 9330608 - DNA, 21 bp, Homo sapiens
aggtggtctgcagcagctgaa

SEQ ID NO: 9330609 - DNA, 21 bp, Homo sapiens
aggtggtctgcagcagctgaa

SEQ ID NO: 9330610 - DNA, 19 bp, Homo sapiens
aggtggtctaggctggaga

SEQ ID NO: 9330611 - DNA, 19 bp, Homo sapiens
aggtggtctaggctggaga

SEQ ID NO: 9330612 - DNA, 22 bp, Homo sapiens
aggtggtctagcatcacggtga

SEQ ID NO: 9330613 - DNA, 22 bp, Homo sapiens
aggtggtcttaaactgctctgg

SEQ ID NO: 9330614 - DNA, 22 bp, Homo sapiens
aggtggtcttggcccacccagg

SEQ ID NO: 9330615 - DNA, 23 bp, Homo sapiens
aggtggtcttgtggatgctgcaa

SEQ ID NO: 9330616 - DNA, 22 bp, Homo sapiens
aggtggtcttaaactgctctgg

SEQ ID NO: 9330617 - DNA, 22 bp, Homo sapiens
aggtggagaagagatgggcagt

SEQ ID NO: 9330618 - DNA, 22 bp, Homo sapiens
aggtggagaagagatgggcagt

SEQ ID NO: 9330619 - DNA, 22 bp, Homo sapiens
aggtggagaagagatgggcagt

SEQ ID NO: 9330620 - DNA, 22 bp, Homo sapiens
aggtggagacccagagaaggcg

SEQ ID NO: 9330621 - DNA, 22 bp, Homo sapiens
aggtggagacccagagaaggcg

SEQ ID NO: 9330622 - DNA, 22 bp, Homo sapiens
aggtggagacccagagaaggcg

SEQ ID NO: 9330623 - DNA, 22 bp, Homo sapiens
aggtggagacccagagaaggcg

SEQ ID NO: 9330624 - DNA, 22 bp, Homo sapiens
aggtggagacccagagaaggcg

SEQ ID NO: 9330625 - DNA, 22 bp, Homo sapiens
actcagagcctcgagggactgc

SEQ ID NO: 9330626 - DNA, 22 bp, Homo sapiens
actcagagcctcgagggactgc

SEQ ID NO: 9330627 - DNA, 22 bp, Homo sapiens
actcacatttcatcaggccaag

SEQ ID NO: 9330628 - DNA, 22 bp, Homo sapiens
aggttcttggtgtccagatttc

SEQ ID NO: 9330629 - DNA, 22 bp, Homo sapiens
aggttctggcattgctcagtaa

SEQ ID NO: 9330630 - DNA, 23 bp, Homo sapiens
aggttctcttatcatctctgccc

SEQ ID NO: 9330631 - DNA, 18 bp, Homo sapiens
aggttctgacagtccaaa

SEQ ID NO: 9330632 - DNA, 22 bp, Homo sapiens
aggttctcacacgtctacaccc

SEQ ID NO: 9330633 - DNA, 22 bp, Homo sapiens
aggttctcacacgtctacaccc

SEQ ID NO: 9330634 - DNA, 21 bp, Homo sapiens
aggttccagcagccagagaat

SEQ ID NO: 9330635 - DNA, 20 bp, Homo sapiens
aggttccagccacaaccagc

SEQ ID NO: 9330636 - DNA, 23 bp, Homo sapiens
aggtggtcttgtggatgctgcaa

SEQ ID NO: 9330637 - DNA, 22 bp, Homo sapiens
aggtggtcttgtggatgccgca

SEQ ID NO: 9330638 - DNA, 22 bp, Homo sapiens
aggtggtgatgacagaagacag

SEQ ID NO: 9330639 - DNA, 22 bp, Homo sapiens
aggtggtgatgacagaagacag

SEQ ID NO: 9330640 - DNA, 22 bp, Homo sapiens
aggtgtccaatcctggttggat

SEQ ID NO: 9330641 - DNA, 22 bp, Homo sapiens
aggtgtccaggaagatgctggc

SEQ ID NO: 9330642 - DNA, 22 bp, Homo sapiens
aggtgtccaatcctggttggat

SEQ ID NO: 9330643 - DNA, 20 bp, Homo sapiens
aggtgtccacgtggcagggt

SEQ ID NO: 9330644 - DNA, 20 bp, Homo sapiens
aggtgtccacgtggcagggt

SEQ ID NO: 9330645 - DNA, 22 bp, Homo sapiens
aggtgtccaatcctggttggat

SEQ ID NO: 9330646 - DNA, 20 bp, Homo sapiens
aggtgtcctgtagcttgagt

SEQ ID NO: 9330647 - DNA, 22 bp, Homo sapiens
aggtgtcccggcctgcggggct

SEQ ID NO: 9330648 - DNA, 22 bp, Homo sapiens
aggtgtccaggaagatgctggc

SEQ ID NO: 9330649 - DNA, 22 bp, Homo sapiens
aggtgtccggctgcataatctt

SEQ ID NO: 9330650 - DNA, 22 bp, Homo sapiens
aggtgtctggacttgtgaagca

SEQ ID NO: 9330651 - DNA, 20 bp, Homo sapiens
aggtgtcctgtagcttgagt

SEQ ID NO: 9330652 - DNA, 21 bp, Homo sapiens
agtccaggcctgcccacttcc

SEQ ID NO: 9330653 - DNA, 22 bp, Homo sapiens
actctgctaaatgtgtaggctc

SEQ ID NO: 9330654 - DNA, 22 bp, Homo sapiens
actctgctcaaagtcctgaggc

SEQ ID NO: 9330655 - DNA, 22 bp, Homo sapiens
actctgctcaaagtcctgaggc

SEQ ID NO: 9330656 - DNA, 22 bp, Homo sapiens
actctgctccctaagccatgat

SEQ ID NO: 9330657 - DNA, 22 bp, Homo sapiens
agtccaggcctccctctcctgc

SEQ ID NO: 9330658 - DNA, 22 bp, Homo sapiens
agtccaggcctccctctcctgc

SEQ ID NO: 9330659 - DNA, 22 bp, Homo sapiens
agtccaggaaaataagctaggt

SEQ ID NO: 9330660 - DNA, 21 bp, Homo sapiens
agtccaggaggaggccaggtt

SEQ ID NO: 9330661 - DNA, 22 bp, Homo sapiens
agtccagccttcaatcttagtg

SEQ ID NO: 9330662 - DNA, 22 bp, Homo sapiens
agtccaggagttgggtgacatt

SEQ ID NO: 9330663 - DNA, 22 bp, Homo sapiens
agtccaggcattccagccattc

SEQ ID NO: 9330664 - DNA, 21 bp, Homo sapiens
agtccaggagtcacccaagcc

SEQ ID NO: 9330665 - DNA, 21 bp, Homo sapiens
agtccaggaggaggccaggtt

SEQ ID NO: 9330666 - DNA, 22 bp, Homo sapiens
agtcctggttctgattctgaca

SEQ ID NO: 9330667 - DNA, 22 bp, Homo sapiens
agtcctggttctgattctgaca

SEQ ID NO: 9330668 - DNA, 22 bp, Homo sapiens
agtcctgtctctcccagggcca

SEQ ID NO: 9330669 - DNA, 22 bp, Homo sapiens
agtcctggtgacactcctcttc

SEQ ID NO: 9330670 - DNA, 22 bp, Homo sapiens
agtcctgggtgtgcaaggcaga

SEQ ID NO: 9330671 - DNA, 22 bp, Homo sapiens
agtcctggtgacactcctcttc

SEQ ID NO: 9330672 - DNA, 22 bp, Homo sapiens
agtcctgggttctggtgttttg

SEQ ID NO: 9330673 - DNA, 22 bp, Homo sapiens
agtcctgggttctggtgttttg

SEQ ID NO: 9330674 - DNA, 22 bp, Homo sapiens
agtccttcacgtcctgcttatt

SEQ ID NO: 9330675 - DNA, 22 bp, Homo sapiens
agtccttcccatctgacaccct

SEQ ID NO: 9330676 - DNA, 22 bp, Homo sapiens
agtcctgtgcaaatgcatctga

SEQ ID NO: 9330677 - DNA, 22 bp, Homo sapiens
actctgggctttgatttgttac

SEQ ID NO: 9330678 - DNA, 22 bp, Homo sapiens
actctgggccccaggtggagct

SEQ ID NO: 9330679 - DNA, 22 bp, Homo sapiens
actctgggccccaggtggagct

SEQ ID NO: 9330680 - DNA, 22 bp, Homo sapiens
actctggtagacaaggagaggt

SEQ ID NO: 9330681 - DNA, 22 bp, Homo sapiens
actctggtctttctgaaagcaa

SEQ ID NO: 9330682 - DNA, 22 bp, Homo sapiens
agtcctgggtgtgcaaggcaga

SEQ ID NO: 9330683 - DNA, 22 bp, Homo sapiens
actctggggtgatgtctctgag

SEQ ID NO: 9330684 - DNA, 20 bp, Homo sapiens
actctggggctcattagggg

SEQ ID NO: 9330685 - DNA, 22 bp, Homo sapiens
actctggggtgatgtctctgag

SEQ ID NO: 9330686 - DNA, 22 bp, Homo sapiens
actcagagcttggctccttgct

SEQ ID NO: 9330687 - DNA, 22 bp, Homo sapiens
actcagaggaaaccctcctagg

SEQ ID NO: 9330688 - DNA, 22 bp, Homo sapiens
actcagaggaaagttgagattg

SEQ ID NO: 9330689 - DNA, 22 bp, Homo sapiens
actcagaggaccaaaaggaaag

SEQ ID NO: 9330690 - DNA, 22 bp, Homo sapiens
actcagaggctggaaatcaaag

SEQ ID NO: 9330691 - DNA, 22 bp, Homo sapiens
actcagaggcagctgctcaccc

SEQ ID NO: 9330692 - DNA, 22 bp, Homo sapiens
actcagaggcagctgctcaccc

SEQ ID NO: 9330693 - DNA, 22 bp, Homo sapiens
actcagagtctgagataaatct

SEQ ID NO: 9330694 - DNA, 22 bp, Homo sapiens
actcagagtcaatgttaatggc

SEQ ID NO: 9330695 - DNA, 22 bp, Homo sapiens
actcagaggggactggtgtggt

SEQ ID NO: 9330696 - DNA, 22 bp, Homo sapiens
actcagagtagaaaataggttc

SEQ ID NO: 9330697 - DNA, 22 bp, Homo sapiens
actcagagtgcatctcctattt

SEQ ID NO: 9330698 - DNA, 22 bp, Homo sapiens
actcagagtctgtttggtacct

SEQ ID NO: 9330699 - DNA, 22 bp, Homo sapiens
actcagagttcctgtgcatagt

SEQ ID NO: 9330700 - DNA, 22 bp, Homo sapiens
actcagagttcctgtgcatagt

SEQ ID NO: 9330701 - DNA, 22 bp, Homo sapiens
actcagagtttgcgttccatac

SEQ ID NO: 9330702 - DNA, 22 bp, Homo sapiens
actcagagttttacccagagac

SEQ ID NO: 9330703 - DNA, 22 bp, Homo sapiens
actcagcatatggggccgcttg

SEQ ID NO: 9330704 - DNA, 20 bp, Homo sapiens
actcagatgctcacaacagg

SEQ ID NO: 9330705 - DNA, 22 bp, Homo sapiens
actcagcacagcactgggaacc

SEQ ID NO: 9330706 - DNA, 22 bp, Homo sapiens
actcagctaaactcagtctatg

SEQ ID NO: 9330707 - DNA, 22 bp, Homo sapiens
actcagctcaggagctggctgg

SEQ ID NO: 9330708 - DNA, 22 bp, Homo sapiens
agtaagcaccgggatggtcaag

SEQ ID NO: 9330709 - DNA, 22 bp, Homo sapiens
agtaagattcttctgaaaaatt

SEQ ID NO: 9330710 - DNA, 22 bp, Homo sapiens
agtaacttaagcaattgtgtat

SEQ ID NO: 9330711 - DNA, 22 bp, Homo sapiens
actcagcttcctacagctagaa

SEQ ID NO: 9330712 - DNA, 22 bp, Homo sapiens
agtcaggtaccacattacattg

SEQ ID NO: 9330713 - DNA, 22 bp, Homo sapiens
agtcaggtaccacattacattg

SEQ ID NO: 9330714 - DNA, 22 bp, Homo sapiens
agtcacttgggaagcaaagcct

SEQ ID NO: 9330715 - DNA, 22 bp, Homo sapiens
agtcacttggattagcaattct

SEQ ID NO: 9330716 - DNA, 22 bp, Homo sapiens
agtcaggtactccgagggcatg

SEQ ID NO: 9330717 - DNA, 22 bp, Homo sapiens
agtcaggtactccgagggcatg

SEQ ID NO: 9330718 - DNA, 19 bp, Homo sapiens
agtcaggtggctggtgcca

SEQ ID NO: 9330719 - DNA, 22 bp, Homo sapiens
agtcaggtgaatgttatacaca

SEQ ID NO: 9330720 - DNA, 22 bp, Homo sapiens
agtcaggtgaatgttatacaca

SEQ ID NO: 9330721 - DNA, 22 bp, Homo sapiens
agtcaggtgggggctgcagtgg

SEQ ID NO: 9330722 - DNA, 22 bp, Homo sapiens
agtcaggtggttctgctccact

SEQ ID NO: 9330723 - DNA, 22 bp, Homo sapiens
agtcaggttctcacagctcttc

SEQ ID NO: 9330724 - DNA, 22 bp, Homo sapiens
agtaataatagctgtaaagtgc

SEQ ID NO: 9330725 - DNA, 22 bp, Homo sapiens
agtcacttctattctattaagt

SEQ ID NO: 9330726 - DNA, 22 bp, Homo sapiens
agtcagtggctccgagcctggt

SEQ ID NO: 9330727 - DNA, 22 bp, Homo sapiens
agtcagtgggagaagtgtgaag

SEQ ID NO: 9330728 - DNA, 23 bp, Homo sapiens
agtcagtgtaagtttggaatgca

SEQ ID NO: 9330729 - DNA, 22 bp, Homo sapiens
agtcagtgaaaactagaatgtt

SEQ ID NO: 9330730 - DNA, 22 bp, Homo sapiens
agtcaggttgcattttaagtaa

SEQ ID NO: 9330731 - DNA, 22 bp, Homo sapiens
agtcaggttgcattttaagtaa

SEQ ID NO: 9330732 - DNA, 22 bp, Homo sapiens
agtcagtcaaaatataaattgt

SEQ ID NO: 9330733 - DNA, 22 bp, Homo sapiens
aggctctcaatatgatccagtc

SEQ ID NO: 9330734 - DNA, 22 bp, Homo sapiens
aggctctcaatatgatccagtc

SEQ ID NO: 9330735 - DNA, 22 bp, Homo sapiens
aggctctataccgctgggagtt

SEQ ID NO: 9330736 - DNA, 22 bp, Homo sapiens
aggctctcaccctctgaccaga

SEQ ID NO: 9330737 - DNA, 22 bp, Homo sapiens
aggctctcaccctctgaccaga

SEQ ID NO: 9330738 - DNA, 22 bp, Homo sapiens
aggctctcactatcctcctagc

SEQ ID NO: 9330739 - DNA, 22 bp, Homo sapiens
aggctctccagagagctgcttt

SEQ ID NO: 9330740 - DNA, 22 bp, Homo sapiens
aggctctccagagagctgcttt

SEQ ID NO: 9330741 - DNA, 22 bp, Homo sapiens
aggctctcagatcagccacatt

SEQ ID NO: 9330742 - DNA, 22 bp, Homo sapiens
aggctctcagatcagccacatt

SEQ ID NO: 9330743 - DNA, 22 bp, Homo sapiens
aggctctcagatcagccacatt

SEQ ID NO: 9330744 - DNA, 22 bp, Homo sapiens
aggctctcctccccaggaccat

SEQ ID NO: 9330745 - DNA, 22 bp, Homo sapiens
aggctctcctccccaggaccat

SEQ ID NO: 9330746 - DNA, 22 bp, Homo sapiens
aggctctctctgccagccgtgc

SEQ ID NO: 9330747 - DNA, 22 bp, Homo sapiens
aggctctctctgcccctgggac

SEQ ID NO: 9330748 - DNA, 22 bp, Homo sapiens
aggctctgaagcaaccctttga

SEQ ID NO: 9330749 - DNA, 22 bp, Homo sapiens
aggctctgaaggagaacctgtt

SEQ ID NO: 9330750 - DNA, 22 bp, Homo sapiens
aggctctgacccatgggaccca

SEQ ID NO: 9330751 - DNA, 22 bp, Homo sapiens
aggctctgaaggagaacctgtt

SEQ ID NO: 9330752 - DNA, 22 bp, Homo sapiens
aggctctgaaggagaacctgtt

SEQ ID NO: 9330753 - DNA, 22 bp, Homo sapiens
aggctctgaaggagaacctgtt

SEQ ID NO: 9330754 - DNA, 22 bp, Homo sapiens
aggctctggacagtgaggagtt

SEQ ID NO: 9330755 - DNA, 22 bp, Homo sapiens
aggctctggagaagaatccgct

SEQ ID NO: 9330756 - DNA, 22 bp, Homo sapiens
aggctctggagtgtggtgctgg

SEQ ID NO: 9330757 - DNA, 22 bp, Homo sapiens
aggctctggagtgtggtgctgg

SEQ ID NO: 9330758 - DNA, 22 bp, Homo sapiens
aggctctggagtgtggtgctgg

SEQ ID NO: 9330759 - DNA, 22 bp, Homo sapiens
aggctctggagttagccaggca

SEQ ID NO: 9330760 - DNA, 22 bp, Homo sapiens
aggctctggagttagccaggca

SEQ ID NO: 9330761 - DNA, 22 bp, Homo sapiens
aggctctggagttagccaggca

SEQ ID NO: 9330762 - DNA, 22 bp, Homo sapiens
aggctctggagttagccaggca

SEQ ID NO: 9330763 - DNA, 22 bp, Homo sapiens
aggctctggagttagccaggca

SEQ ID NO: 9330764 - DNA, 22 bp, Homo sapiens
aggctctggagttagccaggca

SEQ ID NO: 9330765 - DNA, 22 bp, Homo sapiens
aggctctgacgtcacacgtggc

SEQ ID NO: 9330766 - DNA, 22 bp, Homo sapiens
aggctctgacccatgggaccca

SEQ ID NO: 9330767 - DNA, 22 bp, Homo sapiens
aggctctggacagtgaggagtt

SEQ ID NO: 9330768 - DNA, 22 bp, Homo sapiens
aggctctggacagtgaggagtt

SEQ ID NO: 9330769 - DNA, 22 bp, Homo sapiens
aggctctggacagtgaggagtt

SEQ ID NO: 9330770 - DNA, 22 bp, Homo sapiens
aggctctggacagtgaggagtt

SEQ ID NO: 9330771 - DNA, 22 bp, Homo sapiens
aggctctgcttttctggatata

SEQ ID NO: 9330772 - DNA, 19 bp, Homo sapiens
aggctctgagctcctggag

SEQ ID NO: 9330773 - DNA, 22 bp, Homo sapiens
aggctctggacagtgaggagtt

SEQ ID NO: 9330774 - DNA, 22 bp, Homo sapiens
acattaacaccataagtgtgtt

SEQ ID NO: 9330775 - DNA, 22 bp, Homo sapiens
aggctctagatcaaggtgggag

SEQ ID NO: 9330776 - DNA, 22 bp, Homo sapiens
aggctctaaggagggctgtcta

SEQ ID NO: 9330777 - DNA, 22 bp, Homo sapiens
aggctcgcatgccctgcaccac

SEQ ID NO: 9330778 - DNA, 22 bp, Homo sapiens
acattaaatttcatagtgatta

SEQ ID NO: 9330779 - DNA, 22 bp, Homo sapiens
acattaaatttcatagtgatta

SEQ ID NO: 9330780 - DNA, 22 bp, Homo sapiens
acattaaatttcatagtgatta

SEQ ID NO: 9330781 - DNA, 22 bp, Homo sapiens
acattaaacttgcttggctgta

SEQ ID NO: 9330782 - DNA, 22 bp, Homo sapiens
acattaaagagtaaggttagtt

SEQ ID NO: 9330783 - DNA, 22 bp, Homo sapiens
acattaaaatggagaattttga

SEQ ID NO: 9330784 - DNA, 22 bp, Homo sapiens
acattaaaattgggtggggtaa

SEQ ID NO: 9330785 - DNA, 22 bp, Homo sapiens
acattaaaatggagaattttga

SEQ ID NO: 9330786 - DNA, 22 bp, Homo sapiens
acattaaaaaatgttgcatgaa

SEQ ID NO: 9330787 - DNA, 19 bp, Homo sapiens
acatgttttgcagaacagc

SEQ ID NO: 9330788 - DNA, 22 bp, Homo sapiens
aggctcaggtctcaggtctggc

SEQ ID NO: 9330789 - DNA, 22 bp, Homo sapiens
aggctcaggtctcaggtctggc

SEQ ID NO: 9330790 - DNA, 20 bp, Homo sapiens
aggctcagggtgtttaggaa

SEQ ID NO: 9330791 - DNA, 20 bp, Homo sapiens
aggctcagggtgtttaggaa

SEQ ID NO: 9330792 - DNA, 22 bp, Homo sapiens
aggctcaggtctcaggtctggc

SEQ ID NO: 9330793 - DNA, 22 bp, Homo sapiens
aggctcaggaggagctgccgga

SEQ ID NO: 9330794 - DNA, 22 bp, Homo sapiens
aggctcagctggtggtgatcgc

SEQ ID NO: 9330795 - DNA, 22 bp, Homo sapiens
aggctcagctggtggtgatcgc

SEQ ID NO: 9330796 - DNA, 20 bp, Homo sapiens
aggctcagctgagctcttgg

SEQ ID NO: 9330797 - DNA, 20 bp, Homo sapiens
aggctcagctgagctcttgg

SEQ ID NO: 9330798 - DNA, 20 bp, Homo sapiens
aggctcagctgagctcttgg

SEQ ID NO: 9330799 - DNA, 22 bp, Homo sapiens
aggctcagggacggggcccctt

SEQ ID NO: 9330800 - DNA, 22 bp, Homo sapiens
aggctcagggacggggcccctt

SEQ ID NO: 9330801 - DNA, 22 bp, Homo sapiens
aggctcagggactccctccctc

SEQ ID NO: 9330802 - DNA, 22 bp, Homo sapiens
aggctcaggaggagctgccgga

SEQ ID NO: 9330803 - DNA, 22 bp, Homo sapiens
aggctcaggaggagctgccgga

SEQ ID NO: 9330804 - DNA, 22 bp, Homo sapiens
aggctcaggcaggaatggcgga

SEQ ID NO: 9330805 - DNA, 22 bp, Homo sapiens
aggctcaggcaggaatggcgga

SEQ ID NO: 9330806 - DNA, 22 bp, Homo sapiens
aggctatttccactcttctcat

SEQ ID NO: 9330807 - DNA, 22 bp, Homo sapiens
aggctcagacaggaaaagtaac

SEQ ID NO: 9330808 - DNA, 22 bp, Homo sapiens
acatgtgtaaaagtggataaaa

SEQ ID NO: 9330809 - DNA, 22 bp, Homo sapiens
acatgtgtaaaagtggataaaa

SEQ ID NO: 9330810 - DNA, 22 bp, Homo sapiens
acatgtggaggaggcgagggta

SEQ ID NO: 9330811 - DNA, 22 bp, Homo sapiens
acatgtgagtaaatttaatgtt

SEQ ID NO: 9330812 - DNA, 21 bp, Homo sapiens
acatgtctctaatctcagtga

SEQ ID NO: 9330813 - DNA, 22 bp, Homo sapiens
acatgtctcttgtggttttcaa

SEQ ID NO: 9330814 - DNA, 21 bp, Homo sapiens
acatgtctggtcatttttagc

SEQ ID NO: 9330815 - DNA, 22 bp, Homo sapiens
acatgtcttttaaagtctaata

SEQ ID NO: 9330816 - DNA, 22 bp, Homo sapiens
acatgtcttttaaagtctaata

SEQ ID NO: 9330817 - DNA, 22 bp, Homo sapiens
acatgtcttgtggctttgatct

SEQ ID NO: 9330818 - DNA, 22 bp, Homo sapiens
acatgtctgtaattattttagg

SEQ ID NO: 9330819 - DNA, 22 bp, Homo sapiens
acatgtcttgtggctttgatct

SEQ ID NO: 9330820 - DNA, 22 bp, Homo sapiens
acatgtattgacattatattct

SEQ ID NO: 9330821 - DNA, 22 bp, Homo sapiens
acatgtatgctttatgaagtag

SEQ ID NO: 9330822 - DNA, 22 bp, Homo sapiens
acatgtatgctttatgaagtag

SEQ ID NO: 9330823 - DNA, 22 bp, Homo sapiens
acatgtatgctttatgaagtag

SEQ ID NO: 9330824 - DNA, 22 bp, Homo sapiens
acatgtcaatttagtactctta

SEQ ID NO: 9330825 - DNA, 22 bp, Homo sapiens
acatgtctacacattctgcaat

SEQ ID NO: 9330826 - DNA, 22 bp, Homo sapiens
acatgtatacaatgtgtaatga

SEQ ID NO: 9330827 - DNA, 22 bp, Homo sapiens
acatgtatacaatgtgtaatga

SEQ ID NO: 9330828 - DNA, 22 bp, Homo sapiens
acatgtacatacacatatgtaa

SEQ ID NO: 9330829 - DNA, 20 bp, Homo sapiens
acatgtactaatgaatacag

SEQ ID NO: 9330830 - DNA, 22 bp, Homo sapiens
acatgtacatacacatatgtaa

SEQ ID NO: 9330831 - DNA, 22 bp, Homo sapiens
acatgtacatacacatatgtaa

SEQ ID NO: 9330832 - DNA, 22 bp, Homo sapiens
aggcagtgttcttctaagggca

SEQ ID NO: 9330833 - DNA, 22 bp, Homo sapiens
acatggctaaagcaagtctaga

SEQ ID NO: 9330834 - DNA, 20 bp, Homo sapiens
acatggcattcccacgtggt

SEQ ID NO: 9330835 - DNA, 22 bp, Homo sapiens
acatgtaaaagataaattaaca

SEQ ID NO: 9330836 - DNA, 22 bp, Homo sapiens
acatgtaagactagcttaaagt

SEQ ID NO: 9330837 - DNA, 22 bp, Homo sapiens
acatgtaacatatatgtagcat

SEQ ID NO: 9330838 - DNA, 21 bp, Homo sapiens
acatgtaagagagtttcaaga

SEQ ID NO: 9330839 - DNA, 22 bp, Homo sapiens
acatgtaagactagcttaaagt

SEQ ID NO: 9330840 - DNA, 22 bp, Homo sapiens
acatgtaaacatttacagtatt

SEQ ID NO: 9330841 - DNA, 22 bp, Homo sapiens
acatgtaaaaggaacatgcatg

SEQ ID NO: 9330842 - DNA, 22 bp, Homo sapiens
acatgtaaaaggaacatgcatg

SEQ ID NO: 9330843 - DNA, 22 bp, Homo sapiens
aggctgtgagaagtccttcagt

SEQ ID NO: 9330844 - DNA, 19 bp, Homo sapiens
aggctgtgagggaggactc

SEQ ID NO: 9330845 - DNA, 19 bp, Homo sapiens
aggctgtgagggaggactc

SEQ ID NO: 9330846 - DNA, 22 bp, Homo sapiens
aggctgtgagcaagaacaccta

SEQ ID NO: 9330847 - DNA, 22 bp, Homo sapiens
aggctgtgagcaagaacaccta

SEQ ID NO: 9330848 - DNA, 19 bp, Homo sapiens
aggctgtgagggaggactc

SEQ ID NO: 9330849 - DNA, 19 bp, Homo sapiens
aggctgtgaggggaaggaa

SEQ ID NO: 9330850 - DNA, 22 bp, Homo sapiens
aggctggctttggtagcatggt

SEQ ID NO: 9330851 - DNA, 22 bp, Homo sapiens
aggctggctttggtagcatggt

SEQ ID NO: 9330852 - DNA, 22 bp, Homo sapiens
aggctggctttggtagcatggt

SEQ ID NO: 9330853 - DNA, 22 bp, Homo sapiens
aggctggctttggtagcatggt

SEQ ID NO: 9330854 - DNA, 22 bp, Homo sapiens
aggctggcttggctctcctgtg

SEQ ID NO: 9330855 - DNA, 22 bp, Homo sapiens
aggctggctttggtagcatggt

SEQ ID NO: 9330856 - DNA, 22 bp, Homo sapiens
accagaaaggaataatagaatt

SEQ ID NO: 9330857 - DNA, 22 bp, Homo sapiens
accagaaaggaataatagaatt

SEQ ID NO: 9330858 - DNA, 22 bp, Homo sapiens
accacttatcatcactatctca

SEQ ID NO: 9330859 - DNA, 22 bp, Homo sapiens
accactggggcaagtcttcaaa

SEQ ID NO: 9330860 - DNA, 22 bp, Homo sapiens
accactgcccatggtgaaaact

SEQ ID NO: 9330861 - DNA, 22 bp, Homo sapiens
accacaggacccatgagtcagt

SEQ ID NO: 9330862 - DNA, 22 bp, Homo sapiens
accacaggacccatgagtcagt

SEQ ID NO: 9330863 - DNA, 22 bp, Homo sapiens
aggctgtgattccaccactctc

SEQ ID NO: 9330864 - DNA, 22 bp, Homo sapiens
accacaggaattgctctgtggt

SEQ ID NO: 9330865 - DNA, 22 bp, Homo sapiens
aggctgtgatgagcctcatgga

SEQ ID NO: 9330866 - DNA, 22 bp, Homo sapiens
aggctgtgatgagcctcatgga

SEQ ID NO: 9330867 - DNA, 22 bp, Homo sapiens
aggctgtgatgagcctcatgga

SEQ ID NO: 9330868 - DNA, 22 bp, Homo sapiens
aggctgtgatgagcctcatgga

SEQ ID NO: 9330869 - DNA, 23 bp, Homo sapiens
aggctggcttcaggagcctctcc

SEQ ID NO: 9330870 - DNA, 23 bp, Homo sapiens
aggctggcttcaggagcctctcc

SEQ ID NO: 9330871 - DNA, 23 bp, Homo sapiens
aggctggcttcaggagcctctcc

SEQ ID NO: 9330872 - DNA, 22 bp, Homo sapiens
aggctggcttggctctcctgtg

SEQ ID NO: 9330873 - DNA, 22 bp, Homo sapiens
aggctggcttggctctcctgtg

SEQ ID NO: 9330874 - DNA, 22 bp, Homo sapiens
aggctggcttggctctcctgtg

SEQ ID NO: 9330875 - DNA, 22 bp, Homo sapiens
aggctggcttcccaagcgtcct

SEQ ID NO: 9330876 - DNA, 22 bp, Homo sapiens
aggctggcttcccaagcgtcct

SEQ ID NO: 9330877 - DNA, 22 bp, Homo sapiens
aggctggcttcccaagcgtcct

SEQ ID NO: 9330878 - DNA, 22 bp, Homo sapiens
aggctggcttcccaagcgtcct

SEQ ID NO: 9330879 - DNA, 22 bp, Homo sapiens
aggctggccagtgctgcagtgg

SEQ ID NO: 9330880 - DNA, 22 bp, Homo sapiens
aggctggccagtgctgcagtgg

SEQ ID NO: 9330881 - DNA, 22 bp, Homo sapiens
aggctggccagtgctgcagtgg

SEQ ID NO: 9330882 - DNA, 23 bp, Homo sapiens
aggctggcttcaggagcctctcc

SEQ ID NO: 9330883 - DNA, 22 bp, Homo sapiens
aggctggctggggatgcgtctt

SEQ ID NO: 9330884 - DNA, 22 bp, Homo sapiens
aggctggcatacatttgttctt

SEQ ID NO: 9330885 - DNA, 22 bp, Homo sapiens
aggctggcatacatttgttctt

SEQ ID NO: 9330886 - DNA, 22 bp, Homo sapiens
acatttctccttgcaggagtca

SEQ ID NO: 9330887 - DNA, 18 bp, Homo sapiens
acatttctccttctgacc

SEQ ID NO: 9330888 - DNA, 18 bp, Homo sapiens
acatttctccttctgacc

SEQ ID NO: 9330889 - DNA, 18 bp, Homo sapiens
acatttctccttctgacc

SEQ ID NO: 9330890 - DNA, 18 bp, Homo sapiens
acatttctccttctgacc

SEQ ID NO: 9330891 - DNA, 22 bp, Homo sapiens
acatttctcctacttgttattt

SEQ ID NO: 9330892 - DNA, 22 bp, Homo sapiens
acatttctcctacttgttattt

SEQ ID NO: 9330893 - DNA, 22 bp, Homo sapiens
acatttctccctgcatgcctgc

SEQ ID NO: 9330894 - DNA, 22 bp, Homo sapiens
acatttctcaggtaagtcattt

SEQ ID NO: 9330895 - DNA, 22 bp, Homo sapiens
acatttctcaggtaagtcattt

SEQ ID NO: 9330896 - DNA, 22 bp, Homo sapiens
acatttctcaggtaagtcattt

SEQ ID NO: 9330897 - DNA, 22 bp, Homo sapiens
aggctgctgccttggagagtgt

SEQ ID NO: 9330898 - DNA, 22 bp, Homo sapiens
aggctgctgccttggagagtgt

SEQ ID NO: 9330899 - DNA, 22 bp, Homo sapiens
aggctgctgccttggagagtgt

SEQ ID NO: 9330900 - DNA, 22 bp, Homo sapiens
aggctgctggcaggcgtggacg

SEQ ID NO: 9330901 - DNA, 22 bp, Homo sapiens
aggctgctgctctacagttgct

SEQ ID NO: 9330902 - DNA, 22 bp, Homo sapiens
aggctgctggcaggcgtggacg

SEQ ID NO: 9330903 - DNA, 22 bp, Homo sapiens
aggctgctggcaggcgtggacg

SEQ ID NO: 9330904 - DNA, 22 bp, Homo sapiens
aggctgctggctaagaataaga

SEQ ID NO: 9330905 - DNA, 21 bp, Homo sapiens
aggctgctggctcagggtcct

SEQ ID NO: 9330906 - DNA, 21 bp, Homo sapiens
aggctgctggctcagggtcct

SEQ ID NO: 9330907 - DNA, 22 bp, Homo sapiens
aggctgcttcaatggataagat

SEQ ID NO: 9330908 - DNA, 22 bp, Homo sapiens
aggctgcttcagctgcagggag

SEQ ID NO: 9330909 - DNA, 17 bp, Homo sapiens
aggctgctgggccaggg

SEQ ID NO: 9330910 - DNA, 17 bp, Homo sapiens
aggctgctgggccaggg

SEQ ID NO: 9330911 - DNA, 22 bp, Homo sapiens
aggctgcttcaatggataagat

SEQ ID NO: 9330912 - DNA, 23 bp, Homo sapiens
aggctgcttactggtatcagagc

SEQ ID NO: 9330913 - DNA, 21 bp, Homo sapiens
aggctgctctttcttgtggta

SEQ ID NO: 9330914 - DNA, 21 bp, Homo sapiens
aggctgctctttcttgtggta

SEQ ID NO: 9330915 - DNA, 23 bp, Homo sapiens
aggctgctgagatgggtgtgtca

SEQ ID NO: 9330916 - DNA, 22 bp, Homo sapiens
aggctgctgccttggagagtgt

SEQ ID NO: 9330917 - DNA, 22 bp, Homo sapiens
aggctgctgaggccaccacgct

SEQ ID NO: 9330918 - DNA, 22 bp, Homo sapiens
aggctgctgaggccaccacgct

SEQ ID NO: 9330919 - DNA, 22 bp, Homo sapiens
aggctgctctgcgaagtcagct

SEQ ID NO: 9330920 - DNA, 23 bp, Homo sapiens
aggctgcagaagaatagggtcat

SEQ ID NO: 9330921 - DNA, 21 bp, Homo sapiens
aggctgctctttcttgtggta

SEQ ID NO: 9330922 - DNA, 21 bp, Homo sapiens
aggctgctctttcttgtggta

SEQ ID NO: 9330923 - DNA, 21 bp, Homo sapiens
aggctgctctttcttgtggta

SEQ ID NO: 9330924 - DNA, 22 bp, Homo sapiens
aggctctggctactacagagct

SEQ ID NO: 9330925 - DNA, 22 bp, Homo sapiens
aggctctggctactacagagct

SEQ ID NO: 9330926 - DNA, 22 bp, Homo sapiens
aggctctggagttagccaggca

SEQ ID NO: 9330927 - DNA, 22 bp, Homo sapiens
aggctctggcaacagctggtgt

SEQ ID NO: 9330928 - DNA, 22 bp, Homo sapiens
aggctctggcaacagctggtgt

SEQ ID NO: 9330929 - DNA, 22 bp, Homo sapiens
aggctctggcaacagctggtgt

SEQ ID NO: 9330930 - DNA, 22 bp, Homo sapiens
aggctctggcaacagctggtgt

SEQ ID NO: 9330931 - DNA, 22 bp, Homo sapiens
agggccagcactcctggcagga

SEQ ID NO: 9330932 - DNA, 22 bp, Homo sapiens
agggccagcactcctggcagga

SEQ ID NO: 9330933 - DNA, 22 bp, Homo sapiens
agggccagcactcctggcagga

SEQ ID NO: 9330934 - DNA, 22 bp, Homo sapiens
agggccagcactcctggcagga

SEQ ID NO: 9330935 - DNA, 22 bp, Homo sapiens
agggccagcactcctggcagga

SEQ ID NO: 9330936 - DNA, 22 bp, Homo sapiens
agggccagcccataatgccaaa

SEQ ID NO: 9330937 - DNA, 22 bp, Homo sapiens
agggccagccaggccctacaaa

SEQ ID NO: 9330938 - DNA, 22 bp, Homo sapiens
agggcatgctggaggagagaca

SEQ ID NO: 9330939 - DNA, 22 bp, Homo sapiens
agggccagatgaagccacaagc

SEQ ID NO: 9330940 - DNA, 22 bp, Homo sapiens
agggccagcactcctggcagga

SEQ ID NO: 9330941 - DNA, 22 bp, Homo sapiens
agggccagatgaagccacaagc

SEQ ID NO: 9330942 - DNA, 22 bp, Homo sapiens
agggccagatgaagccacaagc

SEQ ID NO: 9330943 - DNA, 22 bp, Homo sapiens
agggccagcactcctggcagga

SEQ ID NO: 9330944 - DNA, 22 bp, Homo sapiens
agggcatgctggaggagagaca

SEQ ID NO: 9330945 - DNA, 22 bp, Homo sapiens
agggccagttcagaggacatgg

SEQ ID NO: 9330946 - DNA, 22 bp, Homo sapiens
agggccagtgggttgaaaggca

SEQ ID NO: 9330947 - DNA, 22 bp, Homo sapiens
agggccagtcgtgtattactgt

SEQ ID NO: 9330948 - DNA, 22 bp, Homo sapiens
agggccagtgggttgaaaggca

SEQ ID NO: 9330949 - DNA, 22 bp, Homo sapiens
agggccagtaccaggtgggtgg

SEQ ID NO: 9330950 - DNA, 22 bp, Homo sapiens
agggccagtaccaggtgggtgg

SEQ ID NO: 9330951 - DNA, 22 bp, Homo sapiens
agggccagtattaaggtaatta

SEQ ID NO: 9330952 - DNA, 22 bp, Homo sapiens
agggccagtaccaggtgggtgg

SEQ ID NO: 9330953 - DNA, 22 bp, Homo sapiens
agggccagtaaatgtttcctca

SEQ ID NO: 9330954 - DNA, 22 bp, Homo sapiens
agggccagttcagaggacatgg

SEQ ID NO: 9330955 - DNA, 22 bp, Homo sapiens
agggccagttcagaggacatgg

SEQ ID NO: 9330956 - DNA, 22 bp, Homo sapiens
agggccagttctacctctgaat

SEQ ID NO: 9330957 - DNA, 22 bp, Homo sapiens
agggccagttctacctctgaat

SEQ ID NO: 9330958 - DNA, 22 bp, Homo sapiens
agggcctgtcagcggtgtcctg

SEQ ID NO: 9330959 - DNA, 22 bp, Homo sapiens
agggcctgtcagcggtgtcctg

SEQ ID NO: 9330960 - DNA, 22 bp, Homo sapiens
agggccagttctacctctgaat

SEQ ID NO: 9330961 - DNA, 22 bp, Homo sapiens
agggctcaccactgtgcactcc

SEQ ID NO: 9330962 - DNA, 22 bp, Homo sapiens
agggctcaccactgtgcactcc

SEQ ID NO: 9330963 - DNA, 22 bp, Homo sapiens
agggctcaagggcatgctacgt

SEQ ID NO: 9330964 - DNA, 22 bp, Homo sapiens
agggctcaatggtgggcatgta

SEQ ID NO: 9330965 - DNA, 22 bp, Homo sapiens
agggcacagcctaaagcctatg

SEQ ID NO: 9330966 - DNA, 21 bp, Homo sapiens
agggcacccccgctgcctacc

SEQ ID NO: 9330967 - DNA, 19 bp, Homo sapiens
agggcacagggacagaagg

SEQ ID NO: 9330968 - DNA, 22 bp, Homo sapiens
agggcacatctgctgggaatgg

SEQ ID NO: 9330969 - DNA, 22 bp, Homo sapiens
agggatgttgtcaaggatgtgg

SEQ ID NO: 9330970 - DNA, 22 bp, Homo sapiens
agggatgtgggaactgcaggtt

SEQ ID NO: 9330971 - DNA, 22 bp, Homo sapiens
agggatgttcattttgtggctg

SEQ ID NO: 9330972 - DNA, 22 bp, Homo sapiens
agggatgttagttgtgagctca

SEQ ID NO: 9330973 - DNA, 22 bp, Homo sapiens
agggaggcattagctactgcga

SEQ ID NO: 9330974 - DNA, 22 bp, Homo sapiens
agggaggcattagctactgcga

SEQ ID NO: 9330975 - DNA, 19 bp, Homo sapiens
agggaggtagcattggaaa

SEQ ID NO: 9330976 - DNA, 22 bp, Homo sapiens
agggaggtccatccctgcagag

SEQ ID NO: 9330977 - DNA, 22 bp, Homo sapiens
agggaggtaggagcttctagct

SEQ ID NO: 9330978 - DNA, 22 bp, Homo sapiens
agggaggtccatccctgcagag

SEQ ID NO: 9330979 - DNA, 22 bp, Homo sapiens
agggaggtggttccccagtgga

SEQ ID NO: 9330980 - DNA, 22 bp, Homo sapiens
agggatgtgacattacagaagc

SEQ ID NO: 9330981 - DNA, 18 bp, Homo sapiens
agggatgtatgctggtgg

SEQ ID NO: 9330982 - DNA, 20 bp, Homo sapiens
agggaggtgctgggcctgag

SEQ ID NO: 9330983 - DNA, 22 bp, Homo sapiens
agggaggtctggctgccctgag

SEQ ID NO: 9330984 - DNA, 22 bp, Homo sapiens
agggaggtctggctgccctgag

SEQ ID NO: 9330985 - DNA, 22 bp, Homo sapiens
agggaggtctggctgccctgag

SEQ ID NO: 9330986 - DNA, 22 bp, Homo sapiens
agggagctgactggctgccatt

SEQ ID NO: 9330987 - DNA, 22 bp, Homo sapiens
agggagctgactggctgccatt

SEQ ID NO: 9330988 - DNA, 22 bp, Homo sapiens
accagagctcttcagcacagga

SEQ ID NO: 9330989 - DNA, 20 bp, Homo sapiens
accagagctctcagtatgtg

SEQ ID NO: 9330990 - DNA, 22 bp, Homo sapiens
accagagcccatctgctcctag

SEQ ID NO: 9330991 - DNA, 22 bp, Homo sapiens
accagagcgctcaagccttccc

SEQ ID NO: 9330992 - DNA, 22 bp, Homo sapiens
agggaggatctgctccttgtct

SEQ ID NO: 9330993 - DNA, 22 bp, Homo sapiens
agggaggatctgctccttgtct

SEQ ID NO: 9330994 - DNA, 22 bp, Homo sapiens
agggaggatagtagtcagttta

SEQ ID NO: 9330995 - DNA, 22 bp, Homo sapiens
agggaggatagtagtcagttta

SEQ ID NO: 9330996 - DNA, 22 bp, Homo sapiens
agggagctgactggctgccatt

SEQ ID NO: 9330997 - DNA, 22 bp, Homo sapiens
accagagcagactactggaggt

SEQ ID NO: 9330998 - DNA, 22 bp, Homo sapiens
accagagcagactactggaggt

SEQ ID NO: 9330999 - DNA, 22 bp, Homo sapiens
aggggagccgaggggcatctgt

SEQ ID NO: 9331000 - DNA, 22 bp, Homo sapiens
aggggagcatctgtgatggtta

SEQ ID NO: 9331001 - DNA, 22 bp, Homo sapiens
aggggaggagcttttcttgcct

SEQ ID NO: 9331002 - DNA, 22 bp, Homo sapiens
aggggcaggtgctgcacttaga

SEQ ID NO: 9331003 - DNA, 22 bp, Homo sapiens
aggggcaggtgctgcacttaga

SEQ ID NO: 9331004 - DNA, 22 bp, Homo sapiens
aggggcagttccaagttttgtg

SEQ ID NO: 9331005 - DNA, 22 bp, Homo sapiens
aggggcagttccaagttttgtg

SEQ ID NO: 9331006 - DNA, 22 bp, Homo sapiens
aggggcagttccaagttttgtg

SEQ ID NO: 9331007 - DNA, 22 bp, Homo sapiens
agggctcagcctcctcctcagc

SEQ ID NO: 9331008 - DNA, 22 bp, Homo sapiens
agggctcagccagcctgtgtgc

SEQ ID NO: 9331009 - DNA, 22 bp, Homo sapiens
agggctcagggcacgtcatcca

SEQ ID NO: 9331010 - DNA, 22 bp, Homo sapiens
agggctcagcctcctcctcagc

SEQ ID NO: 9331011 - DNA, 22 bp, Homo sapiens
agggctcactgggaggctataa

SEQ ID NO: 9331012 - DNA, 22 bp, Homo sapiens
agggctcagaaagcaggttttc

SEQ ID NO: 9331013 - DNA, 22 bp, Homo sapiens
agggctcagaaatgtctacggg

SEQ ID NO: 9331014 - DNA, 22 bp, Homo sapiens
agggctgacagtgaggagtcaa

SEQ ID NO: 9331015 - DNA, 22 bp, Homo sapiens
agggctgacagtaaaagtatga

SEQ ID NO: 9331016 - DNA, 22 bp, Homo sapiens
agggctgacaaatggcagtgac

SEQ ID NO: 9331017 - DNA, 22 bp, Homo sapiens
agggctgacaaatggcagtgac

SEQ ID NO: 9331018 - DNA, 22 bp, Homo sapiens
agggctgacaaatggcagtgac

SEQ ID NO: 9331019 - DNA, 22 bp, Homo sapiens
agggctgacacaccttatcctc

SEQ ID NO: 9331020 - DNA, 23 bp, Homo sapiens
agggctgaatgcagagaagcaga

SEQ ID NO: 9331021 - DNA, 23 bp, Homo sapiens
agggctgaatgcagagaagcaga

SEQ ID NO: 9331022 - DNA, 23 bp, Homo sapiens
agggctgaatgcagagaagcaga

SEQ ID NO: 9331023 - DNA, 22 bp, Homo sapiens
agggctgaagttatggctgagc

SEQ ID NO: 9331024 - DNA, 22 bp, Homo sapiens
agggctgacaaatggcagtgac

SEQ ID NO: 9331025 - DNA, 22 bp, Homo sapiens
agggctgacaaatggcagtgac

SEQ ID NO: 9331026 - DNA, 22 bp, Homo sapiens
agggctcagttgcctggagccc

SEQ ID NO: 9331027 - DNA, 22 bp, Homo sapiens
agggctcagggtcaccatctgt

SEQ ID NO: 9331028 - DNA, 22 bp, Homo sapiens
agggctcaggggccccaagctg

SEQ ID NO: 9331029 - DNA, 22 bp, Homo sapiens
agggctgaagttatggctgagc

SEQ ID NO: 9331030 - DNA, 22 bp, Homo sapiens
agggctgaagttatggctgagc

SEQ ID NO: 9331031 - DNA, 22 bp, Homo sapiens
agggctgaagggaggtgctcat

SEQ ID NO: 9331032 - DNA, 22 bp, Homo sapiens
agggctgaagggaggtgctcat

SEQ ID NO: 9331033 - DNA, 22 bp, Homo sapiens
agggctgaaacataatccttct

SEQ ID NO: 9331034 - DNA, 23 bp, Homo sapiens
aggggtggtcagtacccgcagtg

SEQ ID NO: 9331035 - DNA, 22 bp, Homo sapiens
aggggtgtgcatcctggaggat

SEQ ID NO: 9331036 - DNA, 22 bp, Homo sapiens
aggggttggatttggcctagag

SEQ ID NO: 9331037 - DNA, 22 bp, Homo sapiens
aggggttggacataagacagaa

SEQ ID NO: 9331038 - DNA, 22 bp, Homo sapiens
agggtcagtgatgagggagccc

SEQ ID NO: 9331039 - DNA, 20 bp, Homo sapiens
agggtcagtagcacagagct

SEQ ID NO: 9331040 - DNA, 20 bp, Homo sapiens
agggtcagtagcacagagct

SEQ ID NO: 9331041 - DNA, 20 bp, Homo sapiens
agggtcagtagcacagagct

SEQ ID NO: 9331042 - DNA, 22 bp, Homo sapiens
aggggtggagagtgttgccagt

SEQ ID NO: 9331043 - DNA, 22 bp, Homo sapiens
aggggtggcctgccttactccc

SEQ ID NO: 9331044 - DNA, 22 bp, Homo sapiens
acctccatggctcagtttcaga

SEQ ID NO: 9331045 - DNA, 22 bp, Homo sapiens
aggggtgatttgggacaggaca

SEQ ID NO: 9331046 - DNA, 20 bp, Homo sapiens
aggggtgatcgggtgacact

SEQ ID NO: 9331047 - DNA, 22 bp, Homo sapiens
aggggcctggacatggacgcgc

SEQ ID NO: 9331048 - DNA, 20 bp, Homo sapiens
aggggcctggaacaggcctt

SEQ ID NO: 9331049 - DNA, 20 bp, Homo sapiens
aggggcctggaacaggcctt

SEQ ID NO: 9331050 - DNA, 22 bp, Homo sapiens
aggggccacctgtggcaccctg

SEQ ID NO: 9331051 - DNA, 22 bp, Homo sapiens
acctcaagtgatccactcacct

SEQ ID NO: 9331052 - DNA, 22 bp, Homo sapiens
acctcaaggaaaatctagacag

SEQ ID NO: 9331053 - DNA, 21 bp, Homo sapiens
acctcaagcaacaaccaaggt

SEQ ID NO: 9331054 - DNA, 22 bp, Homo sapiens
acctcaagaatgtataacacag

SEQ ID NO: 9331055 - DNA, 22 bp, Homo sapiens
acctcagaggaggctcctggct

SEQ ID NO: 9331056 - DNA, 22 bp, Homo sapiens
acctcagagatacaaaccatgg

SEQ ID NO: 9331057 - DNA, 22 bp, Homo sapiens
acctcagagacctctcaggtgc

SEQ ID NO: 9331058 - DNA, 22 bp, Homo sapiens
acctcagaacggcgttcttgaa

SEQ ID NO: 9331059 - DNA, 22 bp, Homo sapiens
acctcacaagtctctgtcagct

SEQ ID NO: 9331060 - DNA, 22 bp, Homo sapiens
acctcacaagtctctgtcagct

SEQ ID NO: 9331061 - DNA, 22 bp, Homo sapiens
acctccaggaagctcttggtac

SEQ ID NO: 9331062 - DNA, 22 bp, Homo sapiens
acctcagagggatgttacaggc

SEQ ID NO: 9331063 - DNA, 22 bp, Homo sapiens
acctcagaggccagggatctag

SEQ ID NO: 9331064 - DNA, 22 bp, Homo sapiens
acctcagattgtggctccgctg

SEQ ID NO: 9331065 - DNA, 22 bp, Homo sapiens
acagtgagatccaagggcaggc

SEQ ID NO: 9331066 - DNA, 22 bp, Homo sapiens
acagtgagcccactccaggaga

SEQ ID NO: 9331067 - DNA, 22 bp, Homo sapiens
acagtgagcccactccaggaga

SEQ ID NO: 9331068 - DNA, 22 bp, Homo sapiens
acagtgaggaagcagctgtgct

SEQ ID NO: 9331069 - DNA, 22 bp, Homo sapiens
acagtgaggaagcagctgtgct

SEQ ID NO: 9331070 - DNA, 22 bp, Homo sapiens
aggaggcaggaagtctatggga

SEQ ID NO: 9331071 - DNA, 22 bp, Homo sapiens
aggaggcagtctgtcccttagc

SEQ ID NO: 9331072 - DNA, 22 bp, Homo sapiens
acagtgagatccaagggcaggc

SEQ ID NO: 9331073 - DNA, 22 bp, Homo sapiens
acagtgacgtttatttgagacg

SEQ ID NO: 9331074 - DNA, 22 bp, Homo sapiens
acagtgacactcaggtgggatg

SEQ ID NO: 9331075 - DNA, 22 bp, Homo sapiens
aggacttagaacattatgtact

SEQ ID NO: 9331076 - DNA, 22 bp, Homo sapiens
acagtctggcaggtgttgaaag

SEQ ID NO: 9331077 - DNA, 22 bp, Homo sapiens
acagtctggaggctgcttcatt

SEQ ID NO: 9331078 - DNA, 23 bp, Homo sapiens
acagtgaaacacgcagtaagagt

SEQ ID NO: 9331079 - DNA, 21 bp, Homo sapiens
aggaggccagtactgctgaac

SEQ ID NO: 9331080 - DNA, 20 bp, Homo sapiens
aggaggccaaagtaatgggg

SEQ ID NO: 9331081 - DNA, 22 bp, Homo sapiens
aggaggcagtctgtcccttagc

SEQ ID NO: 9331082 - DNA, 20 bp, Homo sapiens
aggaggcatagtctggaaag

SEQ ID NO: 9331083 - DNA, 20 bp, Homo sapiens
aggaggcatgaggggattta

SEQ ID NO: 9331084 - DNA, 20 bp, Homo sapiens
aggaggcatgaggggattta

SEQ ID NO: 9331085 - DNA, 22 bp, Homo sapiens
aggaggccatgtactaggttcc

SEQ ID NO: 9331086 - DNA, 22 bp, Homo sapiens
aggaggccattctctcagtagc

SEQ ID NO: 9331087 - DNA, 22 bp, Homo sapiens
aggaggccattctctcagtagc

SEQ ID NO: 9331088 - DNA, 22 bp, Homo sapiens
aggaggcccctcctgggttgct

SEQ ID NO: 9331089 - DNA, 22 bp, Homo sapiens
aggaggccctagagctctagag

SEQ ID NO: 9331090 - DNA, 22 bp, Homo sapiens
acagtgcttagcacagagtaga

SEQ ID NO: 9331091 - DNA, 22 bp, Homo sapiens
acagtgctgtgcagtctgccct

SEQ ID NO: 9331092 - DNA, 22 bp, Homo sapiens
acagtgcttttgttcctctcct

SEQ ID NO: 9331093 - DNA, 22 bp, Homo sapiens
acagtggaaagaaacgaattag

SEQ ID NO: 9331094 - DNA, 22 bp, Homo sapiens
acagtggaaagaacatggattt

SEQ ID NO: 9331095 - DNA, 22 bp, Homo sapiens
aggcacctcagctgagcctggg

SEQ ID NO: 9331096 - DNA, 22 bp, Homo sapiens
aggcacctcagctgagcctggg

SEQ ID NO: 9331097 - DNA, 22 bp, Homo sapiens
aggcaccgctcctcagtccaga

SEQ ID NO: 9331098 - DNA, 19 bp, Homo sapiens
aggcaccgagggccactct

SEQ ID NO: 9331099 - DNA, 17 bp, Homo sapiens
aggcacctcttcctgct

SEQ ID NO: 9331100 - DNA, 17 bp, Homo sapiens
aggcacctcttcctgct

SEQ ID NO: 9331101 - DNA, 17 bp, Homo sapiens
aggcacctcttcctgct

SEQ ID NO: 9331102 - DNA, 22 bp, Homo sapiens
aggcacctcatagccagccccc

SEQ ID NO: 9331103 - DNA, 22 bp, Homo sapiens
aggcacctcttaggctgctact

SEQ ID NO: 9331104 - DNA, 22 bp, Homo sapiens
aggcacagcacacctggccccc

SEQ ID NO: 9331105 - DNA, 22 bp, Homo sapiens
acagtggagaagcaaatgcagt

SEQ ID NO: 9331106 - DNA, 22 bp, Homo sapiens
acagtggagaaggcatgaggct

SEQ ID NO: 9331107 - DNA, 22 bp, Homo sapiens
acagtggaatggtgggcctgca

SEQ ID NO: 9331108 - DNA, 22 bp, Homo sapiens
acagtggaatttgtagatgtgt

SEQ ID NO: 9331109 - DNA, 22 bp, Homo sapiens
acagtggaaatgtgggagggga

SEQ ID NO: 9331110 - DNA, 22 bp, Homo sapiens
acagtggaaatgtgggagggga

SEQ ID NO: 9331111 - DNA, 20 bp, Homo sapiens
acagtggaaattgatgtctg

SEQ ID NO: 9331112 - DNA, 20 bp, Homo sapiens
acagtggaaattgatgtctg

SEQ ID NO: 9331113 - DNA, 22 bp, Homo sapiens
acagtggaagaagcactgaact

SEQ ID NO: 9331114 - DNA, 20 bp, Homo sapiens
acagtggaaattgatgtctg

SEQ ID NO: 9331115 - DNA, 22 bp, Homo sapiens
acagtggaagcatgatgctatc

SEQ ID NO: 9331116 - DNA, 22 bp, Homo sapiens
acagtggaggccatatggtcct

SEQ ID NO: 9331117 - DNA, 22 bp, Homo sapiens
acagtggagctcagatgaaaat

SEQ ID NO: 9331118 - DNA, 22 bp, Homo sapiens
acagtggagttggggtagccct

SEQ ID NO: 9331119 - DNA, 22 bp, Homo sapiens
acagtggaggccatatggtcct

SEQ ID NO: 9331120 - DNA, 22 bp, Homo sapiens
acagtggatatattaaatgaga

SEQ ID NO: 9331121 - DNA, 22 bp, Homo sapiens
acagtggagctcagatgaaaat

SEQ ID NO: 9331122 - DNA, 22 bp, Homo sapiens
acagtggatgtgatgtccaggt

SEQ ID NO: 9331123 - DNA, 22 bp, Homo sapiens
acagtggatgtgatgtccaggt

SEQ ID NO: 9331124 - DNA, 22 bp, Homo sapiens
acagtggatgacatccttttgc

SEQ ID NO: 9331125 - DNA, 22 bp, Homo sapiens
acagtggatgtgatgtccaggt

SEQ ID NO: 9331126 - DNA, 22 bp, Homo sapiens
aggcaccttgcggtccagtgaa

SEQ ID NO: 9331127 - DNA, 22 bp, Homo sapiens
aggcaccttgcggtccagtgaa

SEQ ID NO: 9331128 - DNA, 22 bp, Homo sapiens
aggcaccttgagagcaggagct

SEQ ID NO: 9331129 - DNA, 20 bp, Homo sapiens
aggcacctgtcacaggtgag

SEQ ID NO: 9331130 - DNA, 22 bp, Homo sapiens
aggcacctgaggtggccagcct

SEQ ID NO: 9331131 - DNA, 22 bp, Homo sapiens
aggcacctgaggtggccagcct

SEQ ID NO: 9331132 - DNA, 22 bp, Homo sapiens
aggcacctgaggtggccagcct

SEQ ID NO: 9331133 - DNA, 20 bp, Homo sapiens
acagtgttaggtttttcctt

SEQ ID NO: 9331134 - DNA, 22 bp, Homo sapiens
acagtgttacttgatagtgtat

SEQ ID NO: 9331135 - DNA, 22 bp, Homo sapiens
aggcactgaaaggtggccagag

SEQ ID NO: 9331136 - DNA, 22 bp, Homo sapiens
aggcacgagcaatggccgagga

SEQ ID NO: 9331137 - DNA, 22 bp, Homo sapiens
aggcaccttgcggtccagtgaa

SEQ ID NO: 9331138 - DNA, 22 bp, Homo sapiens
acagtgttcactaaggttagct

SEQ ID NO: 9331139 - DNA, 22 bp, Homo sapiens
acagtgttcctttgttgtgact

SEQ ID NO: 9331140 - DNA, 22 bp, Homo sapiens
aggcactggtccattttctgca

SEQ ID NO: 9331141 - DNA, 22 bp, Homo sapiens
aggcactttgaaatttggagct

SEQ ID NO: 9331142 - DNA, 22 bp, Homo sapiens
aggcactttttgcattttagaa

SEQ ID NO: 9331143 - DNA, 21 bp, Homo sapiens
aggcagaaagagcccaggctg

SEQ ID NO: 9331144 - DNA, 22 bp, Homo sapiens
aggcagtgtgtagctggaagag

SEQ ID NO: 9331145 - DNA, 22 bp, Homo sapiens
aggcagtgtggagggctgttgc

SEQ ID NO: 9331146 - DNA, 22 bp, Homo sapiens
aggcagtgtggagggctgttgc

SEQ ID NO: 9331147 - DNA, 22 bp, Homo sapiens
aggcagtgtgggccaagcttcc

SEQ ID NO: 9331148 - DNA, 22 bp, Homo sapiens
aggcagtgtattgctagcggct

SEQ ID NO: 9331149 - DNA, 22 bp, Homo sapiens
aggcagtgtattgctagcggct

SEQ ID NO: 9331150 - DNA, 22 bp, Homo sapiens
aggcagtgtattgctagcggct

SEQ ID NO: 9331151 - DNA, 23 bp, Homo sapiens
aggcagtgtctcttatcctgtcc

SEQ ID NO: 9331152 - DNA, 20 bp, Homo sapiens
aggcagtgtagagatgagta

SEQ ID NO: 9331153 - DNA, 22 bp, Homo sapiens
aggcagtgtattgctagcggct

SEQ ID NO: 9331154 - DNA, 20 bp, Homo sapiens
aggcagtgtagagatgagta

SEQ ID NO: 9331155 - DNA, 20 bp, Homo sapiens
aggcagtgtagagatgagta

SEQ ID NO: 9331156 - DNA, 22 bp, Homo sapiens
acatcttcccacacttgcaaaa

SEQ ID NO: 9331157 - DNA, 20 bp, Homo sapiens
aggcagtgtagagatgagta

SEQ ID NO: 9331158 - DNA, 22 bp, Homo sapiens
aggcagtggtgtttgctggtgg

SEQ ID NO: 9331159 - DNA, 22 bp, Homo sapiens
aggcagtggtgtttgctggtgg

SEQ ID NO: 9331160 - DNA, 22 bp, Homo sapiens
aggcagtggtgtttgctggtgg

SEQ ID NO: 9331161 - DNA, 22 bp, Homo sapiens
acatctgttcaaatatgcattt

SEQ ID NO: 9331162 - DNA, 22 bp, Homo sapiens
acatctgtttgagaaaaagaag

SEQ ID NO: 9331163 - DNA, 22 bp, Homo sapiens
acatatatgtaaagtactttgt

SEQ ID NO: 9331164 - DNA, 22 bp, Homo sapiens
acatatatgtaaagtactttgt

SEQ ID NO: 9331165 - DNA, 22 bp, Homo sapiens
acatatatgtaaagtactttgt

SEQ ID NO: 9331166 - DNA, 22 bp, Homo sapiens
acatatatgtgcacatgtgcag

SEQ ID NO: 9331167 - DNA, 22 bp, Homo sapiens
acatatatgtaaagtactttgt

SEQ ID NO: 9331168 - DNA, 22 bp, Homo sapiens
acatatattactagtaaagaca

SEQ ID NO: 9331169 - DNA, 22 bp, Homo sapiens
acatatattactagtaaagaca

SEQ ID NO: 9331170 - DNA, 22 bp, Homo sapiens
acatatatgtgcacatgtgcag

SEQ ID NO: 9331171 - DNA, 22 bp, Homo sapiens
acatatattactagtaaagaca

SEQ ID NO: 9331172 - DNA, 22 bp, Homo sapiens
acatatattactagtaaagaca

SEQ ID NO: 9331173 - DNA, 22 bp, Homo sapiens
acatatatgtgcacatgtgcag

SEQ ID NO: 9331174 - DNA, 22 bp, Homo sapiens
acatatatgcgtgggctcatgg

SEQ ID NO: 9331175 - DNA, 22 bp, Homo sapiens
acatatatgcgtgggctcatgg

SEQ ID NO: 9331176 - DNA, 22 bp, Homo sapiens
acatatatgcgtgggctcatgg

SEQ ID NO: 9331177 - DNA, 22 bp, Homo sapiens
acatatatgtaaagtactttgt

SEQ ID NO: 9331178 - DNA, 22 bp, Homo sapiens
acatatatgctgggactgtgac

SEQ ID NO: 9331179 - DNA, 22 bp, Homo sapiens
acatatatgctgggactgtgac

SEQ ID NO: 9331180 - DNA, 22 bp, Homo sapiens
acatatatgcgtgggctcatgg

SEQ ID NO: 9331181 - DNA, 22 bp, Homo sapiens
acatatatgctgggactgtgac

SEQ ID NO: 9331182 - DNA, 22 bp, Homo sapiens
acatctcttcttaaggctccag

SEQ ID NO: 9331183 - DNA, 22 bp, Homo sapiens
acatctcttataaactctctga

SEQ ID NO: 9331184 - DNA, 22 bp, Homo sapiens
acatctctgggtcctccatgca

SEQ ID NO: 9331185 - DNA, 22 bp, Homo sapiens
acatatattactagtaaagaca

SEQ ID NO: 9331186 - DNA, 23 bp, Homo sapiens
acatccatgaatcatctgctttc

SEQ ID NO: 9331187 - DNA, 22 bp, Homo sapiens
acatccatcttctgcctgtgaa

SEQ ID NO: 9331188 - DNA, 22 bp, Homo sapiens
acatccatgcatgtctgtgcac

SEQ ID NO: 9331189 - DNA, 22 bp, Homo sapiens
acatccatgttgtaatgttcct

SEQ ID NO: 9331190 - DNA, 22 bp, Homo sapiens
acatctgaaagggattgcagaa

SEQ ID NO: 9331191 - DNA, 22 bp, Homo sapiens
acatctgacatgatcttcagta

SEQ ID NO: 9331192 - DNA, 22 bp, Homo sapiens
acatctgagcaacagaacacta

SEQ ID NO: 9331193 - DNA, 22 bp, Homo sapiens
aggcaggttggggaaaagcact

SEQ ID NO: 9331194 - DNA, 22 bp, Homo sapiens
aggcaggttggtgagaagactg

SEQ ID NO: 9331195 - DNA, 22 bp, Homo sapiens
aggcaggttggggaaaagcact

SEQ ID NO: 9331196 - DNA, 22 bp, Homo sapiens
aggcaggttacaaaaactttat

SEQ ID NO: 9331197 - DNA, 22 bp, Homo sapiens
aggcaggttacaaaaactttat

SEQ ID NO: 9331198 - DNA, 22 bp, Homo sapiens
aggcaggtgttgggagacacca

SEQ ID NO: 9331199 - DNA, 22 bp, Homo sapiens
aggcaggtgttacctctggttt

SEQ ID NO: 9331200 - DNA, 22 bp, Homo sapiens
aggcaggtgttacctctggttt

SEQ ID NO: 9331201 - DNA, 22 bp, Homo sapiens
aggcaggtgttacctctggttt

SEQ ID NO: 9331202 - DNA, 22 bp, Homo sapiens
aggcaggtgttgggagacacca

SEQ ID NO: 9331203 - DNA, 22 bp, Homo sapiens
aggcaggtgttgggagacacca

SEQ ID NO: 9331204 - DNA, 22 bp, Homo sapiens
aggcaggtgggtcacttgagtc

SEQ ID NO: 9331205 - DNA, 22 bp, Homo sapiens
aggcaggtgggagtgattcctt

SEQ ID NO: 9331206 - DNA, 22 bp, Homo sapiens
aggcaggtgggtcacttgagtc

SEQ ID NO: 9331207 - DNA, 22 bp, Homo sapiens
aggcaggtgttaaccctctgag

SEQ ID NO: 9331208 - DNA, 22 bp, Homo sapiens
aggcaggtgttaaccctctgag

SEQ ID NO: 9331209 - DNA, 22 bp, Homo sapiens
aggcaggtgttaaccctctgag

SEQ ID NO: 9331210 - DNA, 22 bp, Homo sapiens
aggcaggtgggtcacttgagtc

SEQ ID NO: 9331211 - DNA, 22 bp, Homo sapiens
aggcaggtgggagtgattcctt

SEQ ID NO: 9331212 - DNA, 22 bp, Homo sapiens
aggcaggtgcttatgacttgct

SEQ ID NO: 9331213 - DNA, 18 bp, Homo sapiens
aggcaggtgctggaagtc

SEQ ID NO: 9331214 - DNA, 22 bp, Homo sapiens
aggcaggtgcttatgacttgct

SEQ ID NO: 9331215 - DNA, 22 bp, Homo sapiens
aggcaggggagctggaagggta

SEQ ID NO: 9331216 - DNA, 18 bp, Homo sapiens
aggcaggtgctggaagtc

SEQ ID NO: 9331217 - DNA, 22 bp, Homo sapiens
aggcagattttctttactcagt

SEQ ID NO: 9331218 - DNA, 22 bp, Homo sapiens
aggcagcaaagaaatgatgctg

SEQ ID NO: 9331219 - DNA, 22 bp, Homo sapiens
aggcagcaagattatttaatcc

SEQ ID NO: 9331220 - DNA, 22 bp, Homo sapiens
aggcagatggtaactgtgatat

SEQ ID NO: 9331221 - DNA, 22 bp, Homo sapiens
aggcagatgggagctggaagtt

SEQ ID NO: 9331222 - DNA, 22 bp, Homo sapiens
aggcagatgaacctgggttgag

SEQ ID NO: 9331223 - DNA, 22 bp, Homo sapiens
aggcagagaaaaaccagatatg

SEQ ID NO: 9331224 - DNA, 22 bp, Homo sapiens
aggcagaaccagctgggacttt

SEQ ID NO: 9331225 - DNA, 21 bp, Homo sapiens
aggcagaaagagcccaggctg

SEQ ID NO: 9331226 - DNA, 22 bp, Homo sapiens
aggcagaagccagccagggtcc

SEQ ID NO: 9331227 - DNA, 22 bp, Homo sapiens
aggcagagaaaaaccagatatg

SEQ ID NO: 9331228 - DNA, 22 bp, Homo sapiens
aggcagagaaaaaccagatatg

SEQ ID NO: 9331229 - DNA, 22 bp, Homo sapiens
acagccaaggaattaggaaggg

SEQ ID NO: 9331230 - DNA, 22 bp, Homo sapiens
acagccagaagtcagggtggga

SEQ ID NO: 9331231 - DNA, 22 bp, Homo sapiens
acagccagaggagccaggctgg

SEQ ID NO: 9331232 - DNA, 22 bp, Homo sapiens
acagccagaggagccaggctgg

SEQ ID NO: 9331233 - DNA, 20 bp, Homo sapiens
acagccagaggaggcagaca

SEQ ID NO: 9331234 - DNA, 22 bp, Homo sapiens
acagcattcaataaataataac

SEQ ID NO: 9331235 - DNA, 22 bp, Homo sapiens
acagcagttaacgatcagactc

SEQ ID NO: 9331236 - DNA, 22 bp, Homo sapiens
acagcatggataacaaggcact

SEQ ID NO: 9331237 - DNA, 22 bp, Homo sapiens
acagcatggataacaaggcact

SEQ ID NO: 9331238 - DNA, 22 bp, Homo sapiens
acagcatgagagatgaacattc

SEQ ID NO: 9331239 - DNA, 22 bp, Homo sapiens
acagcttcgaggatctcatccc

SEQ ID NO: 9331240 - DNA, 20 bp, Homo sapiens
acagccagaggaggcagaca

SEQ ID NO: 9331241 - DNA, 22 bp, Homo sapiens
acagcttctatttctctgtact

SEQ ID NO: 9331242 - DNA, 22 bp, Homo sapiens
acaggaagaaagtgcagtagat

SEQ ID NO: 9331243 - DNA, 22 bp, Homo sapiens
acaggaagaaagtgcagtagat

SEQ ID NO: 9331244 - DNA, 22 bp, Homo sapiens
acaggaagtgctggcacttaca

SEQ ID NO: 9331245 - DNA, 22 bp, Homo sapiens
acaggaagtgctggcacttaca

SEQ ID NO: 9331246 - DNA, 22 bp, Homo sapiens
acaggaagtgctggcacttaca

SEQ ID NO: 9331247 - DNA, 22 bp, Homo sapiens
acaggaagtgggaagaaacagg

SEQ ID NO: 9331248 - DNA, 22 bp, Homo sapiens
acaggaagtgggaagaaacagg

SEQ ID NO: 9331249 - DNA, 22 bp, Homo sapiens
acaggaagtgggaagaaacagg

SEQ ID NO: 9331250 - DNA, 22 bp, Homo sapiens
acaggaagctggagacccttga

SEQ ID NO: 9331251 - DNA, 22 bp, Homo sapiens
acaggaagctggagacccttga

SEQ ID NO: 9331252 - DNA, 22 bp, Homo sapiens
acaggaagctggagacccttga

SEQ ID NO: 9331253 - DNA, 22 bp, Homo sapiens
acaggaagaaagtgcagtagat

SEQ ID NO: 9331254 - DNA, 22 bp, Homo sapiens
acaggaagaaagtgcagtagat

SEQ ID NO: 9331255 - DNA, 22 bp, Homo sapiens
acaggaagtttggaaagcctca

SEQ ID NO: 9331256 - DNA, 22 bp, Homo sapiens
acaggaagtgggaagaaacagg

SEQ ID NO: 9331257 - DNA, 22 bp, Homo sapiens
acaggaagtgggaagaaacagg

SEQ ID NO: 9331258 - DNA, 22 bp, Homo sapiens
acaggaagtttggaaagcctca

SEQ ID NO: 9331259 - DNA, 22 bp, Homo sapiens
acaggaagtttggaaagcctca

SEQ ID NO: 9331260 - DNA, 22 bp, Homo sapiens
acaggacaactcagcagccagc

SEQ ID NO: 9331261 - DNA, 22 bp, Homo sapiens
acaggacaactcagcagccagc

SEQ ID NO: 9331262 - DNA, 22 bp, Homo sapiens
acaggacaactcagcagccagc

SEQ ID NO: 9331263 - DNA, 22 bp, Homo sapiens
acaggacaactcagcagccagc

SEQ ID NO: 9331264 - DNA, 22 bp, Homo sapiens
acaggacaaggggaagaagata

SEQ ID NO: 9331265 - DNA, 22 bp, Homo sapiens
agcttctttgtgggctccagaa

SEQ ID NO: 9331266 - DNA, 22 bp, Homo sapiens
agcttcttgtatgaagttagag

SEQ ID NO: 9331267 - DNA, 22 bp, Homo sapiens
agcttcttgtagaactcaaaag

SEQ ID NO: 9331268 - DNA, 22 bp, Homo sapiens
agcttctttaattcagcatgat

SEQ ID NO: 9331269 - DNA, 19 bp, Homo sapiens
agcttctttggaaacattt

SEQ ID NO: 9331270 - DNA, 22 bp, Homo sapiens
acaggatgggcgcacagagcta

SEQ ID NO: 9331271 - DNA, 22 bp, Homo sapiens
acaggatggccagctgatattg

SEQ ID NO: 9331272 - DNA, 22 bp, Homo sapiens
acaggatggccagctgatattg

SEQ ID NO: 9331273 - DNA, 22 bp, Homo sapiens
acaggatgataaaggatggcca

SEQ ID NO: 9331274 - DNA, 22 bp, Homo sapiens
acaggcaaggccagtgagaaat

SEQ ID NO: 9331275 - DNA, 22 bp, Homo sapiens
aggaaaggggtaggtgtggacg

SEQ ID NO: 9331276 - DNA, 21 bp, Homo sapiens
acaggcaatttcatatggttc

SEQ ID NO: 9331277 - DNA, 22 bp, Homo sapiens
acaggacagtctagtaacagta

SEQ ID NO: 9331278 - DNA, 22 bp, Homo sapiens
acaggacatgtaccaggtggtc

SEQ ID NO: 9331279 - DNA, 22 bp, Homo sapiens
acaggacatgtaccaggtggtc

SEQ ID NO: 9331280 - DNA, 22 bp, Homo sapiens
agcttcttcttggtctttccca

SEQ ID NO: 9331281 - DNA, 22 bp, Homo sapiens
agcttcttgaccaagcctgtaa

SEQ ID NO: 9331282 - DNA, 20 bp, Homo sapiens
agcttcttctgtctaatttt

SEQ ID NO: 9331283 - DNA, 22 bp, Homo sapiens
agcttcttctgatttgtcagtc

SEQ ID NO: 9331284 - DNA, 22 bp, Homo sapiens
agcttcttgacggatgttctgg

SEQ ID NO: 9331285 - DNA, 22 bp, Homo sapiens
agcttcttgggctttacacaaa

SEQ ID NO: 9331286 - DNA, 22 bp, Homo sapiens
agcttcttggctcagcacttgg

SEQ ID NO: 9331287 - DNA, 22 bp, Homo sapiens
agcttcttctattttggggcca

SEQ ID NO: 9331288 - DNA, 22 bp, Homo sapiens
agcttcttcccagcctcacccg

SEQ ID NO: 9331289 - DNA, 22 bp, Homo sapiens
agcttcttcaaagcaggaggcc

SEQ ID NO: 9331290 - DNA, 22 bp, Homo sapiens
agcttcttccaggcagtgactc

SEQ ID NO: 9331291 - DNA, 22 bp, Homo sapiens
agcttcttagttcacttttaat

SEQ ID NO: 9331292 - DNA, 22 bp, Homo sapiens
agcttccatactaagacaaaag

SEQ ID NO: 9331293 - DNA, 22 bp, Homo sapiens
agcttccacatctgtcttcagt

SEQ ID NO: 9331294 - DNA, 22 bp, Homo sapiens
acaggccttggtcctgacctaa

SEQ ID NO: 9331295 - DNA, 22 bp, Homo sapiens
acaggccttggtcctgacctaa

SEQ ID NO: 9331296 - DNA, 22 bp, Homo sapiens
acaggccttggtcctgacctaa

SEQ ID NO: 9331297 - DNA, 21 bp, Homo sapiens
acaggctacatgcaggagctg

SEQ ID NO: 9331298 - DNA, 22 bp, Homo sapiens
acaggccttaggagagatgggg

SEQ ID NO: 9331299 - DNA, 22 bp, Homo sapiens
acaggccttaggagagatgggg

SEQ ID NO: 9331300 - DNA, 22 bp, Homo sapiens
acaggccttggcaggcatgtga

SEQ ID NO: 9331301 - DNA, 22 bp, Homo sapiens
acaggcctggtgctgctgacag

SEQ ID NO: 9331302 - DNA, 22 bp, Homo sapiens
acaggcctggtgctgctgacag

SEQ ID NO: 9331303 - DNA, 22 bp, Homo sapiens
aggaaataggaccagacaaagc

SEQ ID NO: 9331304 - DNA, 22 bp, Homo sapiens
aggaaaggtgagagcggccgcg

SEQ ID NO: 9331305 - DNA, 22 bp, Homo sapiens
aggaaaggtagcgtgccagcag

SEQ ID NO: 9331306 - DNA, 22 bp, Homo sapiens
aggaaaggtagcgtgccagcag

SEQ ID NO: 9331307 - DNA, 22 bp, Homo sapiens
aggaaaggtagcgtgccagcag

SEQ ID NO: 9331308 - DNA, 22 bp, Homo sapiens
aggaaaggggtaggtgtggacg

SEQ ID NO: 9331309 - DNA, 19 bp, Homo sapiens
aggaaaggtggccttagca

SEQ ID NO: 9331310 - DNA, 19 bp, Homo sapiens
aggaaaggtggccttagca

SEQ ID NO: 9331311 - DNA, 22 bp, Homo sapiens
aggaaaggttcagtgattgaaa

SEQ ID NO: 9331312 - DNA, 17 bp, Homo sapiens
aggaaagtctgctgtcc

SEQ ID NO: 9331313 - DNA, 23 bp, Homo sapiens
acagggcattgctggcctcgagg

SEQ ID NO: 9331314 - DNA, 22 bp, Homo sapiens
acagggcatttcctctatgtgt

SEQ ID NO: 9331315 - DNA, 22 bp, Homo sapiens
acagggcatttcctctatgtgt

SEQ ID NO: 9331316 - DNA, 23 bp, Homo sapiens
acagggcattgctggcctcgagg

SEQ ID NO: 9331317 - DNA, 22 bp, Homo sapiens
acagggcatttcctctatgtgt

SEQ ID NO: 9331318 - DNA, 22 bp, Homo sapiens
acagggcatgtgcaagagacat

SEQ ID NO: 9331319 - DNA, 22 bp, Homo sapiens
acagggcatgtgcaagagacat

SEQ ID NO: 9331320 - DNA, 21 bp, Homo sapiens
acagggcatgcagctggctgt

SEQ ID NO: 9331321 - DNA, 21 bp, Homo sapiens
acagggcatgcagctggctgt

SEQ ID NO: 9331322 - DNA, 21 bp, Homo sapiens
acagggcatgcagctggctgt

SEQ ID NO: 9331323 - DNA, 21 bp, Homo sapiens
acagggcatgcagctggctgt

SEQ ID NO: 9331324 - DNA, 22 bp, Homo sapiens
acagggcagtgtcttgaaaaat

SEQ ID NO: 9331325 - DNA, 21 bp, Homo sapiens
acagggcatgcagctggctgt

SEQ ID NO: 9331326 - DNA, 21 bp, Homo sapiens
acagggcatgcagctggctgt

SEQ ID NO: 9331327 - DNA, 21 bp, Homo sapiens
acaggctctggggatgctggg

SEQ ID NO: 9331328 - DNA, 22 bp, Homo sapiens
acaggctctctattgagtgcag

SEQ ID NO: 9331329 - DNA, 22 bp, Homo sapiens
acaggctctcagccagttggca

SEQ ID NO: 9331330 - DNA, 22 bp, Homo sapiens
acaggctctctattgagtgcag

SEQ ID NO: 9331331 - DNA, 21 bp, Homo sapiens
acaggctcacgatccatttct

SEQ ID NO: 9331332 - DNA, 22 bp, Homo sapiens
acaggctcacagtcatttcatt

SEQ ID NO: 9331333 - DNA, 22 bp, Homo sapiens
acaggctcagttcactggattt

SEQ ID NO: 9331334 - DNA, 22 bp, Homo sapiens
acaggctcgtgcgcgcacgtgt

SEQ ID NO: 9331335 - DNA, 22 bp, Homo sapiens
acaggctcagttcactggattt

SEQ ID NO: 9331336 - DNA, 22 bp, Homo sapiens
acagggcacctgaggtaggaag

SEQ ID NO: 9331337 - DNA, 22 bp, Homo sapiens
acagggcacctgaggtaggaag

SEQ ID NO: 9331338 - DNA, 19 bp, Homo sapiens
acagggcagcaataggata

SEQ ID NO: 9331339 - DNA, 22 bp, Homo sapiens
acagggcagtgtcttgaaaaat

SEQ ID NO: 9331340 - DNA, 22 bp, Homo sapiens
acagggcaggtggctactggtc

SEQ ID NO: 9331341 - DNA, 22 bp, Homo sapiens
acagggcaggtggctactggtc

SEQ ID NO: 9331342 - DNA, 22 bp, Homo sapiens
aggactggtgccagacaaggta

SEQ ID NO: 9331343 - DNA, 22 bp, Homo sapiens
aggactggtgtgtgatcagcat

SEQ ID NO: 9331344 - DNA, 22 bp, Homo sapiens
aggactggtgtgtgatcagcat

SEQ ID NO: 9331345 - DNA, 22 bp, Homo sapiens
aggactggtgccagacaaggta

SEQ ID NO: 9331346 - DNA, 22 bp, Homo sapiens
aggactggcggtcggtggggat

SEQ ID NO: 9331347 - DNA, 22 bp, Homo sapiens
aggactgggtgcagagggcatc

SEQ ID NO: 9331348 - DNA, 22 bp, Homo sapiens
aggactgggtgcagagggcatc

SEQ ID NO: 9331349 - DNA, 22 bp, Homo sapiens
aggactgggtgcagagggcatc

SEQ ID NO: 9331350 - DNA, 22 bp, Homo sapiens
aggactgggtgcagagggcatc

SEQ ID NO: 9331351 - DNA, 22 bp, Homo sapiens
aggactggccctgaggggaggc

SEQ ID NO: 9331352 - DNA, 22 bp, Homo sapiens
aggactggccctgaggggaggc

SEQ ID NO: 9331353 - DNA, 22 bp, Homo sapiens
aggacatgtaaatggagaggga

SEQ ID NO: 9331354 - DNA, 22 bp, Homo sapiens
aggactgatgatggtgctgaca

SEQ ID NO: 9331355 - DNA, 22 bp, Homo sapiens
aggactggcagtgtgaggggtc

SEQ ID NO: 9331356 - DNA, 22 bp, Homo sapiens
aggactggcagtgtgaggggtc

SEQ ID NO: 9331357 - DNA, 22 bp, Homo sapiens
aggacatgaagaaagggcaagg

SEQ ID NO: 9331358 - DNA, 22 bp, Homo sapiens
aggacagttagttaggaagttt

SEQ ID NO: 9331359 - DNA, 22 bp, Homo sapiens
aggacagtggtgttctggagtg

SEQ ID NO: 9331360 - DNA, 22 bp, Homo sapiens
aggacagtggacactagtccct

SEQ ID NO: 9331361 - DNA, 22 bp, Homo sapiens
aggacagtccggggtcctccac

SEQ ID NO: 9331362 - DNA, 22 bp, Homo sapiens
aggacaggtgtagtgggctctg

SEQ ID NO: 9331363 - DNA, 22 bp, Homo sapiens
aggacaggtgtagtgggctctg

SEQ ID NO: 9331364 - DNA, 22 bp, Homo sapiens
acagggctatattcctcagagc

SEQ ID NO: 9331365 - DNA, 23 bp, Homo sapiens
acagggctagctgacagtggtat

SEQ ID NO: 9331366 - DNA, 22 bp, Homo sapiens
aggacaggtgtagtgggctctg

SEQ ID NO: 9331367 - DNA, 22 bp, Homo sapiens
aggacagggattcaaactccca

SEQ ID NO: 9331368 - DNA, 22 bp, Homo sapiens
aggacagggattcaaactccca

SEQ ID NO: 9331369 - DNA, 22 bp, Homo sapiens
acagggccctgtgggccccact

SEQ ID NO: 9331370 - DNA, 22 bp, Homo sapiens
agcaatgtggaccagctcaggg

SEQ ID NO: 9331371 - DNA, 22 bp, Homo sapiens
agcaatgttggggttagaggac

SEQ ID NO: 9331372 - DNA, 22 bp, Homo sapiens
agcaatgtaaaccctgaagttg

SEQ ID NO: 9331373 - DNA, 22 bp, Homo sapiens
agcaatgtctttttggccatct

SEQ ID NO: 9331374 - DNA, 22 bp, Homo sapiens
agcaatgtgacccctgacagca

SEQ ID NO: 9331375 - DNA, 22 bp, Homo sapiens
caaagtttggctctcatgacat

SEQ ID NO: 9331376 - DNA, 22 bp, Homo sapiens
caaagttgcagttatgtgatta

SEQ ID NO: 9331377 - DNA, 22 bp, Homo sapiens
caaagtggctggccgggagatc

SEQ ID NO: 9331378 - DNA, 22 bp, Homo sapiens
caaagtggaggctctggggcca

SEQ ID NO: 9331379 - DNA, 22 bp, Homo sapiens
caaacattgcactttctgctat

SEQ ID NO: 9331380 - DNA, 22 bp, Homo sapiens
caaacattgctaccagaggttt

SEQ ID NO: 9331381 - DNA, 22 bp, Homo sapiens
caaacatttgacttctctcagg

SEQ ID NO: 9331382 - DNA, 22 bp, Homo sapiens
caaacattgggggcttcaacac

SEQ ID NO: 9331383 - DNA, 22 bp, Homo sapiens
caaacattgctaccagaggttt

SEQ ID NO: 9331384 - DNA, 22 bp, Homo sapiens
caaacattttctacttccagga

SEQ ID NO: 9331385 - DNA, 22 bp, Homo sapiens
caaacattttaaataagggata

SEQ ID NO: 9331386 - DNA, 22 bp, Homo sapiens
caaacattttgagtggtttctg

SEQ ID NO: 9331387 - DNA, 22 bp, Homo sapiens
caaacattttctacttccagga

SEQ ID NO: 9331388 - DNA, 22 bp, Homo sapiens
caaaggtagtatatatattgtt

SEQ ID NO: 9331389 - DNA, 22 bp, Homo sapiens
caaaggtaaagatctgctgtgg

SEQ ID NO: 9331390 - DNA, 22 bp, Homo sapiens
caaaggtataagttaatataca

SEQ ID NO: 9331391 - DNA, 22 bp, Homo sapiens
caaaggtattctcattttggaa

SEQ ID NO: 9331392 - DNA, 22 bp, Homo sapiens
caaaggtataagttaatataca

SEQ ID NO: 9331393 - DNA, 23 bp, Homo sapiens
attttttgtctttgtaactagat

SEQ ID NO: 9331394 - DNA, 22 bp, Homo sapiens
attttttctgtaaactggcctt

SEQ ID NO: 9331395 - DNA, 22 bp, Homo sapiens
attttttcccagttagccagga

SEQ ID NO: 9331396 - DNA, 22 bp, Homo sapiens
agcaaggctcttaatgcccaaa

SEQ ID NO: 9331397 - DNA, 22 bp, Homo sapiens
agcaaggctcggtcagggtgat

SEQ ID NO: 9331398 - DNA, 20 bp, Homo sapiens
agcaaggctaaatcatgatt

SEQ ID NO: 9331399 - DNA, 22 bp, Homo sapiens
attttttgttaactcaggatag

SEQ ID NO: 9331400 - DNA, 20 bp, Homo sapiens
agcaagagtgtacctggcca

SEQ ID NO: 9331401 - DNA, 22 bp, Homo sapiens
agcaagtggaatcatggaaaag

SEQ ID NO: 9331402 - DNA, 22 bp, Homo sapiens
agcaagtgtaagaatgcagaat

SEQ ID NO: 9331403 - DNA, 22 bp, Homo sapiens
agcaaggtctccctgcacctgg

SEQ ID NO: 9331404 - DNA, 22 bp, Homo sapiens
agcaaggtgacatcatgctgag

SEQ ID NO: 9331405 - DNA, 22 bp, Homo sapiens
agcaaggtggagaaggatgggt

SEQ ID NO: 9331406 - DNA, 22 bp, Homo sapiens
agcaaggtgacatcatgctgag

SEQ ID NO: 9331407 - DNA, 19 bp, Homo sapiens
agcaaggtgcctcctcccc

SEQ ID NO: 9331408 - DNA, 19 bp, Homo sapiens
agcaaggtgcctcctcccc

SEQ ID NO: 9331409 - DNA, 22 bp, Homo sapiens
agcaaggctcttaatgcccaaa

SEQ ID NO: 9331410 - DNA, 22 bp, Homo sapiens
agcaaggcttcagagctgtctg

SEQ ID NO: 9331411 - DNA, 22 bp, Homo sapiens
attttgtatcttacggggacta

SEQ ID NO: 9331412 - DNA, 22 bp, Homo sapiens
attttgttataggagctgaaat

SEQ ID NO: 9331413 - DNA, 22 bp, Homo sapiens
attttgttatagaactctgtga

SEQ ID NO: 9331414 - DNA, 22 bp, Homo sapiens
attttgttataggagctgaaat

SEQ ID NO: 9331415 - DNA, 22 bp, Homo sapiens
attttgttataggagctgaaat

SEQ ID NO: 9331416 - DNA, 22 bp, Homo sapiens
attttgttgaggtaattgtcaa

SEQ ID NO: 9331417 - DNA, 22 bp, Homo sapiens
attttgttgatggtggagtagc

SEQ ID NO: 9331418 - DNA, 22 bp, Homo sapiens
attttttagccaagactctgca

SEQ ID NO: 9331419 - DNA, 22 bp, Homo sapiens
attttttagccaagactctgca

SEQ ID NO: 9331420 - DNA, 22 bp, Homo sapiens
attttttatataccaaggtggg

SEQ ID NO: 9331421 - DNA, 22 bp, Homo sapiens
attttttatataccaaggtggg

SEQ ID NO: 9331422 - DNA, 22 bp, Homo sapiens
attttttagccaagactctgca

SEQ ID NO: 9331423 - DNA, 22 bp, Homo sapiens
attttttcagattgagtgttaa

SEQ ID NO: 9331424 - DNA, 22 bp, Homo sapiens
attttttcagattgagtgttaa

SEQ ID NO: 9331425 - DNA, 22 bp, Homo sapiens
attttttcagattgagtgttaa

SEQ ID NO: 9331426 - DNA, 22 bp, Homo sapiens
attttttatataccaaggtggg

SEQ ID NO: 9331427 - DNA, 22 bp, Homo sapiens
agattgcaattccttacatgca

SEQ ID NO: 9331428 - DNA, 22 bp, Homo sapiens
agattggttccttgctttgaaa

SEQ ID NO: 9331429 - DNA, 22 bp, Homo sapiens
agattggttgaactgatttgca

SEQ ID NO: 9331430 - DNA, 19 bp, Homo sapiens
agattggttccttttgagg

SEQ ID NO: 9331431 - DNA, 22 bp, Homo sapiens
agattccttatctgtccaatgg

SEQ ID NO: 9331432 - DNA, 22 bp, Homo sapiens
agattcctgttgtatggagggg

SEQ ID NO: 9331433 - DNA, 22 bp, Homo sapiens
agattcctcagtcatgaagcct

SEQ ID NO: 9331434 - DNA, 22 bp, Homo sapiens
agattctaaacttgattctgct

SEQ ID NO: 9331435 - DNA, 22 bp, Homo sapiens
agatgatggccatgtcctctcc

SEQ ID NO: 9331436 - DNA, 22 bp, Homo sapiens
agatgatgaccatgggaatgga

SEQ ID NO: 9331437 - DNA, 22 bp, Homo sapiens
agattcattatcttctttgtac

SEQ ID NO: 9331438 - DNA, 22 bp, Homo sapiens
agattcattgctttaggcattg

SEQ ID NO: 9331439 - DNA, 21 bp, Homo sapiens
agattcataatctgtaaaatg

SEQ ID NO: 9331440 - DNA, 22 bp, Homo sapiens
agattgtcattgacgatgagca

SEQ ID NO: 9331441 - DNA, 22 bp, Homo sapiens
agattgtcattgacgatgagca

SEQ ID NO: 9331442 - DNA, 18 bp, Homo sapiens
agattgtgtctacaaatc

SEQ ID NO: 9331443 - DNA, 22 bp, Homo sapiens
agatttaaatttgctacaattc

SEQ ID NO: 9331444 - DNA, 22 bp, Homo sapiens
agatttaaatttgctacaattc

SEQ ID NO: 9331445 - DNA, 22 bp, Homo sapiens
agatttactgagaactgattac

SEQ ID NO: 9331446 - DNA, 22 bp, Homo sapiens
agatttactgagaactgattac

SEQ ID NO: 9331447 - DNA, 22 bp, Homo sapiens
agatttactggagtctttggtg

SEQ ID NO: 9331448 - DNA, 22 bp, Homo sapiens
agatttactccctgcttccgcc

SEQ ID NO: 9331449 - DNA, 22 bp, Homo sapiens
agatttactcagctcctggaaa

SEQ ID NO: 9331450 - DNA, 22 bp, Homo sapiens
agatttacaaaggatttgcttt

SEQ ID NO: 9331451 - DNA, 22 bp, Homo sapiens
agatttacaaaggatttgcttt

SEQ ID NO: 9331452 - DNA, 19 bp, Homo sapiens
agatttacctcatatagtt

SEQ ID NO: 9331453 - DNA, 20 bp, Homo sapiens
agatttacctttgagccttc

SEQ ID NO: 9331454 - DNA, 22 bp, Homo sapiens
attttctgtaactatttctata

SEQ ID NO: 9331455 - DNA, 22 bp, Homo sapiens
agatttcaatgtgagcattagt

SEQ ID NO: 9331456 - DNA, 21 bp, Homo sapiens
attttctgtgatagctgtctc

SEQ ID NO: 9331457 - DNA, 21 bp, Homo sapiens
attttgtacatagaatttgtc

SEQ ID NO: 9331458 - DNA, 22 bp, Homo sapiens
agatttatgtggtcacactcag

SEQ ID NO: 9331459 - DNA, 22 bp, Homo sapiens
agatttatgtggtcacactcag

SEQ ID NO: 9331460 - DNA, 22 bp, Homo sapiens
agatttatgtggtcacactcag

SEQ ID NO: 9331461 - DNA, 22 bp, Homo sapiens
agatttatgtggtcacactcag

SEQ ID NO: 9331462 - DNA, 22 bp, Homo sapiens
agatttatgtggtcacactcag

SEQ ID NO: 9331463 - DNA, 21 bp, Homo sapiens
agatgaggatactgaggccta

SEQ ID NO: 9331464 - DNA, 22 bp, Homo sapiens
agatgagtaaatggagtcttcc

SEQ ID NO: 9331465 - DNA, 22 bp, Homo sapiens
agatgacagccaaggagatgaa

SEQ ID NO: 9331466 - DNA, 22 bp, Homo sapiens
agatgagaatttttagagtgct

SEQ ID NO: 9331467 - DNA, 22 bp, Homo sapiens
agatgacatgggagcaagcact

SEQ ID NO: 9331468 - DNA, 22 bp, Homo sapiens
agatgacaatgaaggaaaatgt

SEQ ID NO: 9331469 - DNA, 22 bp, Homo sapiens
agatgacaatgaaggaaaatgt

SEQ ID NO: 9331470 - DNA, 22 bp, Homo sapiens
atttgaagaaagttttctagat

SEQ ID NO: 9331471 - DNA, 22 bp, Homo sapiens
atttgaagtcttcatgatttct

SEQ ID NO: 9331472 - DNA, 22 bp, Homo sapiens
atttgaaatcccttctactgta

SEQ ID NO: 9331473 - DNA, 19 bp, Homo sapiens
atttgaaagctgtgcttgc

SEQ ID NO: 9331474 - DNA, 22 bp, Homo sapiens
atttgaaatcccttctactgta

SEQ ID NO: 9331475 - DNA, 22 bp, Homo sapiens
atttctcttagcaagacattac

SEQ ID NO: 9331476 - DNA, 22 bp, Homo sapiens
atttctcttagcaagacattac

SEQ ID NO: 9331477 - DNA, 22 bp, Homo sapiens
atttacaggtagaattttaagt

SEQ ID NO: 9331478 - DNA, 22 bp, Homo sapiens
atttacaggtagaattttaagt

SEQ ID NO: 9331479 - DNA, 22 bp, Homo sapiens
atttcttgtgggaaatgcagca

SEQ ID NO: 9331480 - DNA, 22 bp, Homo sapiens
atttctttctggccacggtttt

SEQ ID NO: 9331481 - DNA, 22 bp, Homo sapiens
atttcttttcaagagggtgctt

SEQ ID NO: 9331482 - DNA, 22 bp, Homo sapiens
atttctttctggccacggtttt

SEQ ID NO: 9331483 - DNA, 22 bp, Homo sapiens
atttcttttcaagagggtgctt

SEQ ID NO: 9331484 - DNA, 23 bp, Homo sapiens
atttgaaactttcttgtttccag

SEQ ID NO: 9331485 - DNA, 22 bp, Homo sapiens
atttacagccttgaaaacagca

SEQ ID NO: 9331486 - DNA, 22 bp, Homo sapiens
atttacagccttgaaaacagca

SEQ ID NO: 9331487 - DNA, 22 bp, Homo sapiens
atttacagccttgccatctata

SEQ ID NO: 9331488 - DNA, 22 bp, Homo sapiens
atttacagccttgccatctata

SEQ ID NO: 9331489 - DNA, 22 bp, Homo sapiens
atttacagatgatgctatttga

SEQ ID NO: 9331490 - DNA, 22 bp, Homo sapiens
atttacagatgatgctatttga

SEQ ID NO: 9331491 - DNA, 22 bp, Homo sapiens
atttacagccttgaaaacagca

SEQ ID NO: 9331492 - DNA, 22 bp, Homo sapiens
atttacaggacagcttggcatt

SEQ ID NO: 9331493 - DNA, 22 bp, Homo sapiens
atttacaggtagaattttaagt

SEQ ID NO: 9331494 - DNA, 22 bp, Homo sapiens
atttacaggtagaattttaagt

SEQ ID NO: 9331495 - DNA, 22 bp, Homo sapiens
atttacaggacagcttggcatt

SEQ ID NO: 9331496 - DNA, 23 bp, Homo sapiens
atttacagctgtgtgagcaagtt

SEQ ID NO: 9331497 - DNA, 22 bp, Homo sapiens
atttacaggacagcttggcatt

SEQ ID NO: 9331498 - DNA, 23 bp, Homo sapiens
atttacagctgtgtgagcaagtt

SEQ ID NO: 9331499 - DNA, 23 bp, Homo sapiens
atttacagctgtgtgagcaagtt

SEQ ID NO: 9331500 - DNA, 22 bp, Homo sapiens
attgagaattgtgagtttggag

SEQ ID NO: 9331501 - DNA, 22 bp, Homo sapiens
attgagaatccatttgagatga

SEQ ID NO: 9331502 - DNA, 22 bp, Homo sapiens
attgagaatatgatttagtata

SEQ ID NO: 9331503 - DNA, 22 bp, Homo sapiens
attgagaatatgatttagtata

SEQ ID NO: 9331504 - DNA, 23 bp, Homo sapiens
attgagaaggatacattgttctc

SEQ ID NO: 9331505 - DNA, 22 bp, Homo sapiens
attgaggagcagagatggggta

SEQ ID NO: 9331506 - DNA, 22 bp, Homo sapiens
attggtgcaattatgagggtgt

SEQ ID NO: 9331507 - DNA, 22 bp, Homo sapiens
attgagcacctacagtattacc

SEQ ID NO: 9331508 - DNA, 22 bp, Homo sapiens
attgtataagtctatttacaat

SEQ ID NO: 9331509 - DNA, 22 bp, Homo sapiens
attgtataatcagttactggaa

SEQ ID NO: 9331510 - DNA, 22 bp, Homo sapiens
attgtataagtctatttacaat

SEQ ID NO: 9331511 - DNA, 22 bp, Homo sapiens
attgtatacaagcttaattgtt

SEQ ID NO: 9331512 - DNA, 22 bp, Homo sapiens
attgtataattgtattgccaaa

SEQ ID NO: 9331513 - DNA, 22 bp, Homo sapiens
attgtatgcagcattaagcaat

SEQ ID NO: 9331514 - DNA, 22 bp, Homo sapiens
attgtataacagcatgtatttt

SEQ ID NO: 9331515 - DNA, 22 bp, Homo sapiens
attgtataacagcatgtatttt

SEQ ID NO: 9331516 - DNA, 22 bp, Homo sapiens
attgtataagtctatttacaat

SEQ ID NO: 9331517 - DNA, 22 bp, Homo sapiens
attgtataagtctatttacaat

SEQ ID NO: 9331518 - DNA, 22 bp, Homo sapiens
attgtataacagcatgtatttt

SEQ ID NO: 9331519 - DNA, 22 bp, Homo sapiens
attggtggtgaggacatgccag

SEQ ID NO: 9331520 - DNA, 22 bp, Homo sapiens
attggtggtgaggacatgccag

SEQ ID NO: 9331521 - DNA, 22 bp, Homo sapiens
attgagaaaattcgagcaagtt

SEQ ID NO: 9331522 - DNA, 22 bp, Homo sapiens
attgagaaaggcttatgtttgc

SEQ ID NO: 9331523 - DNA, 22 bp, Homo sapiens
attgagaagcttgcagattttt

SEQ ID NO: 9331524 - DNA, 22 bp, Homo sapiens
attgaaaggttttgagcagata

SEQ ID NO: 9331525 - DNA, 22 bp, Homo sapiens
attgaaaatataattctaggag

SEQ ID NO: 9331526 - DNA, 22 bp, Homo sapiens
attgaaaatgacatttgtgccc

SEQ ID NO: 9331527 - DNA, 22 bp, Homo sapiens
attgaaagataggctactgtgg

SEQ ID NO: 9331528 - DNA, 22 bp, Homo sapiens
attgaaaaattcacaattctgg

SEQ ID NO: 9331529 - DNA, 22 bp, Homo sapiens
attgaaaataaggccagaaaca

SEQ ID NO: 9331530 - DNA, 22 bp, Homo sapiens
attgtgcatctactgtgtgcag

SEQ ID NO: 9331531 - DNA, 14 bp, Homo sapiens
attgtgcatgccat

SEQ ID NO: 9331532 - DNA, 22 bp, Homo sapiens
attgtatttaggagaaaagggt

SEQ ID NO: 9331533 - DNA, 22 bp, Homo sapiens
attgtattataattaggccaaa

SEQ ID NO: 9331534 - DNA, 22 bp, Homo sapiens
attgtgtcctcattgaccttca

SEQ ID NO: 9331535 - DNA, 19 bp, Homo sapiens
attgtgtcaatggtgttca

SEQ ID NO: 9331536 - DNA, 22 bp, Homo sapiens
attgttaaactgaagcattact

SEQ ID NO: 9331537 - DNA, 22 bp, Homo sapiens
attgttaaaaaggtggaaatgc

SEQ ID NO: 9331538 - DNA, 22 bp, Homo sapiens
attgttaaagtaataaccatgg

SEQ ID NO: 9331539 - DNA, 22 bp, Homo sapiens
attgttaataactattacattg

SEQ ID NO: 9331540 - DNA, 22 bp, Homo sapiens
agatacaactcagaagtgtggt

SEQ ID NO: 9331541 - DNA, 22 bp, Homo sapiens
agatacaaaaagggagaagatt

SEQ ID NO: 9331542 - DNA, 22 bp, Homo sapiens
agatacacagccctgccatcac

SEQ ID NO: 9331543 - DNA, 22 bp, Homo sapiens
agatacagacctcttattaagg

SEQ ID NO: 9331544 - DNA, 22 bp, Homo sapiens
atttacagacgtggattagtgc

SEQ ID NO: 9331545 - DNA, 22 bp, Homo sapiens
atttacagacgtggattagtgc

SEQ ID NO: 9331546 - DNA, 22 bp, Homo sapiens
atttacagatgatgctatttga

SEQ ID NO: 9331547 - DNA, 22 bp, Homo sapiens
atttacagatgatgctatttga

SEQ ID NO: 9331548 - DNA, 22 bp, Homo sapiens
atttacagacgtggattagtgc

SEQ ID NO: 9331549 - DNA, 22 bp, Homo sapiens
agatacaagttaagagaaagga

SEQ ID NO: 9331550 - DNA, 22 bp, Homo sapiens
agatacaactgtttaaacatta

SEQ ID NO: 9331551 - DNA, 22 bp, Homo sapiens
agaggaaatggataaagggtga

SEQ ID NO: 9331552 - DNA, 22 bp, Homo sapiens
agaggaaaatgagttccagaat

SEQ ID NO: 9331553 - DNA, 22 bp, Homo sapiens
agaggaaacataggtttttaaa

SEQ ID NO: 9331554 - DNA, 22 bp, Homo sapiens
attaataaaataccactttgtt

SEQ ID NO: 9331555 - DNA, 22 bp, Homo sapiens
attaatacattatagggattgt

SEQ ID NO: 9331556 - DNA, 22 bp, Homo sapiens
attaatacattatagggattgt

SEQ ID NO: 9331557 - DNA, 22 bp, Homo sapiens
agagctttgggacatttgctag

SEQ ID NO: 9331558 - DNA, 22 bp, Homo sapiens
attattttatgtgcggcctgat

SEQ ID NO: 9331559 - DNA, 22 bp, Homo sapiens
attattttatgtgcggcctgat

SEQ ID NO: 9331560 - DNA, 22 bp, Homo sapiens
agaggcctctagggcccctcag

SEQ ID NO: 9331561 - DNA, 22 bp, Homo sapiens
agaggcctccgaaaggtgggct

SEQ ID NO: 9331562 - DNA, 22 bp, Homo sapiens
agaggcctctttgcaagtaggt

SEQ ID NO: 9331563 - DNA, 22 bp, Homo sapiens
agaggcctctttgcaagtaggt

SEQ ID NO: 9331564 - DNA, 22 bp, Homo sapiens
agaggcctctgttgttcagacg

SEQ ID NO: 9331565 - DNA, 22 bp, Homo sapiens
attatttctcactcacataata

SEQ ID NO: 9331566 - DNA, 22 bp, Homo sapiens
attatttctcactcacataata

SEQ ID NO: 9331567 - DNA, 22 bp, Homo sapiens
agaggcctctttgcaagtaggt

SEQ ID NO: 9331568 - DNA, 22 bp, Homo sapiens
attatttctcactcacataata

SEQ ID NO: 9331569 - DNA, 22 bp, Homo sapiens
agaggccggccgagcccatggg

SEQ ID NO: 9331570 - DNA, 22 bp, Homo sapiens
agaggccgggtgcctgctcaga

SEQ ID NO: 9331571 - DNA, 19 bp, Homo sapiens
agaggcctcagcagctggc

SEQ ID NO: 9331572 - DNA, 19 bp, Homo sapiens
agaggcctcagcagctggc

SEQ ID NO: 9331573 - DNA, 22 bp, Homo sapiens
agaggcctccctcccagctggt

SEQ ID NO: 9331574 - DNA, 22 bp, Homo sapiens
agaggcctccctcccagctggt

SEQ ID NO: 9331575 - DNA, 22 bp, Homo sapiens
agaggcctcaaaccagacctga

SEQ ID NO: 9331576 - DNA, 22 bp, Homo sapiens
agaggcctcaaaccagacctga

SEQ ID NO: 9331577 - DNA, 22 bp, Homo sapiens
agaggcctaattgctacccttt

SEQ ID NO: 9331578 - DNA, 22 bp, Homo sapiens
attctctctagaagctgagatg

SEQ ID NO: 9331579 - DNA, 22 bp, Homo sapiens
attctctcatttatctgtccta

SEQ ID NO: 9331580 - DNA, 22 bp, Homo sapiens
attctctagtctcttccataaa

SEQ ID NO: 9331581 - DNA, 22 bp, Homo sapiens
attctccctgttcctcgacacc

SEQ ID NO: 9331582 - DNA, 20 bp, Homo sapiens
attctccctatactcacttt

SEQ ID NO: 9331583 - DNA, 19 bp, Homo sapiens
attctccctagaattttga

SEQ ID NO: 9331584 - DNA, 20 bp, Homo sapiens
attctacaagaataagcatg

SEQ ID NO: 9331585 - DNA, 22 bp, Homo sapiens
attctacaatcatgtagatcct

SEQ ID NO: 9331586 - DNA, 20 bp, Homo sapiens
attctacaagaataagcatg

SEQ ID NO: 9331587 - DNA, 22 bp, Homo sapiens
attctacaacccaataataatt

SEQ ID NO: 9331588 - DNA, 22 bp, Homo sapiens
attctacaacccaataataatt

SEQ ID NO: 9331589 - DNA, 20 bp, Homo sapiens
attctacaagaataagcatg

SEQ ID NO: 9331590 - DNA, 19 bp, Homo sapiens
attctccctagaattttga

SEQ ID NO: 9331591 - DNA, 22 bp, Homo sapiens
attctccagctcactgtccata

SEQ ID NO: 9331592 - DNA, 22 bp, Homo sapiens
attctccactgtaaggttatta

SEQ ID NO: 9331593 - DNA, 22 bp, Homo sapiens
attctctgtgcagatttaagac

SEQ ID NO: 9331594 - DNA, 21 bp, Homo sapiens
attctctgtgatgggattagg

SEQ ID NO: 9331595 - DNA, 22 bp, Homo sapiens
attctctgaagtctttcagggc

SEQ ID NO: 9331596 - DNA, 22 bp, Homo sapiens
attctacaaaagaactggatct

SEQ ID NO: 9331597 - DNA, 22 bp, Homo sapiens
attctacaacccaataataatt

SEQ ID NO: 9331598 - DNA, 22 bp, Homo sapiens
attctaattagttctacatgtt

SEQ ID NO: 9331599 - DNA, 22 bp, Homo sapiens
attctacaaaagaactggatct

SEQ ID NO: 9331600 - DNA, 22 bp, Homo sapiens
attcaaacctcatttattgttc

SEQ ID NO: 9331601 - DNA, 22 bp, Homo sapiens
attcaaacctcatttattgttc

SEQ ID NO: 9331602 - DNA, 22 bp, Homo sapiens
attcctttggactcctccttgc

SEQ ID NO: 9331603 - DNA, 22 bp, Homo sapiens
attcccaggtaaaagtagagct

SEQ ID NO: 9331604 - DNA, 22 bp, Homo sapiens
attcccaggtaaaagtagagct

SEQ ID NO: 9331605 - DNA, 22 bp, Homo sapiens
attcaaaagaccatgcagactc

SEQ ID NO: 9331606 - DNA, 18 bp, Homo sapiens
agagatggtgtagagttt

SEQ ID NO: 9331607 - DNA, 18 bp, Homo sapiens
agagatggtgtagagttt

SEQ ID NO: 9331608 - DNA, 18 bp, Homo sapiens
agagatggtgtagagttt

SEQ ID NO: 9331609 - DNA, 18 bp, Homo sapiens
agagatggtgtagagttt

SEQ ID NO: 9331610 - DNA, 22 bp, Homo sapiens
agagatggtagaacagtcataa

SEQ ID NO: 9331611 - DNA, 22 bp, Homo sapiens
atgtcttgatattttactgttt

SEQ ID NO: 9331612 - DNA, 22 bp, Homo sapiens
atgtgagtgtatacttacgtgt

SEQ ID NO: 9331613 - DNA, 22 bp, Homo sapiens
atgtgatactccttctagtgga

SEQ ID NO: 9331614 - DNA, 21 bp, Homo sapiens
atgtgattatatgacttttac

SEQ ID NO: 9331615 - DNA, 22 bp, Homo sapiens
atgtgatcaagaatgtgggaga

SEQ ID NO: 9331616 - DNA, 22 bp, Homo sapiens
atgtgcaaatccaatgtgaatg

SEQ ID NO: 9331617 - DNA, 23 bp, Homo sapiens
atgtgcaaagtgctacagtatag

SEQ ID NO: 9331618 - DNA, 22 bp, Homo sapiens
atgtgattcccactgaatcact

SEQ ID NO: 9331619 - DNA, 22 bp, Homo sapiens
atgtgcaaggagtggctgttgt

SEQ ID NO: 9331620 - DNA, 22 bp, Homo sapiens
atgtgcaacttttctgtctttt

SEQ ID NO: 9331621 - DNA, 18 bp, Homo sapiens
atgtgcaattttgtattt

SEQ ID NO: 9331622 - DNA, 22 bp, Homo sapiens
atgtgcaggatccaggctccta

SEQ ID NO: 9331623 - DNA, 22 bp, Homo sapiens
atgtgcaggatccaggctccta

SEQ ID NO: 9331624 - DNA, 22 bp, Homo sapiens
atgtgcatgcacctggactgtg

SEQ ID NO: 9331625 - DNA, 22 bp, Homo sapiens
atgtgcatgcacttacatgtgt

SEQ ID NO: 9331626 - DNA, 22 bp, Homo sapiens
atgtgcagttggtggccaggag

SEQ ID NO: 9331627 - DNA, 22 bp, Homo sapiens
atgtgcagacctgggttagaac

SEQ ID NO: 9331628 - DNA, 22 bp, Homo sapiens
agagccaggaagtggcgtgggg

SEQ ID NO: 9331629 - DNA, 22 bp, Homo sapiens
agagccaggaagtggcgtgggg

SEQ ID NO: 9331630 - DNA, 22 bp, Homo sapiens
agagccaggactgtgtctcact

SEQ ID NO: 9331631 - DNA, 22 bp, Homo sapiens
agagccaggactgtgtctcact

SEQ ID NO: 9331632 - DNA, 22 bp, Homo sapiens
agagccaggactgtgtctcact

SEQ ID NO: 9331633 - DNA, 22 bp, Homo sapiens
agagccaggactgtgtctcact

SEQ ID NO: 9331634 - DNA, 22 bp, Homo sapiens
agagccaggatgtcttctgggg

SEQ ID NO: 9331635 - DNA, 22 bp, Homo sapiens
atgttattttggaaaatacaaa

SEQ ID NO: 9331636 - DNA, 22 bp, Homo sapiens
atgttattttggaaaatacaaa

SEQ ID NO: 9331637 - DNA, 22 bp, Homo sapiens
atgttattttggaaaatacaaa

SEQ ID NO: 9331638 - DNA, 22 bp, Homo sapiens
agagccaggatgtcttctgggg

SEQ ID NO: 9331639 - DNA, 22 bp, Homo sapiens
agagccaggatgtcttctgggg

SEQ ID NO: 9331640 - DNA, 22 bp, Homo sapiens
agagccagcatttgggccctgc

SEQ ID NO: 9331641 - DNA, 22 bp, Homo sapiens
agagccagcatttgggccctgc

SEQ ID NO: 9331642 - DNA, 22 bp, Homo sapiens
agagccaggaagtggcgtgggg

SEQ ID NO: 9331643 - DNA, 22 bp, Homo sapiens
agagccaggaagtggcgtgggg

SEQ ID NO: 9331644 - DNA, 22 bp, Homo sapiens
agagccagccttctcagcttac

SEQ ID NO: 9331645 - DNA, 22 bp, Homo sapiens
agagccagccttctcagcttac

SEQ ID NO: 9331646 - DNA, 19 bp, Homo sapiens
atgtgcatttgtgtgaggt

SEQ ID NO: 9331647 - DNA, 19 bp, Homo sapiens
atgtgcatttgtgtgaggt

SEQ ID NO: 9331648 - DNA, 22 bp, Homo sapiens
atgtgcattaaatgtcaatgtt

SEQ ID NO: 9331649 - DNA, 19 bp, Homo sapiens
atgtgcatttgtgtgaggt

SEQ ID NO: 9331650 - DNA, 22 bp, Homo sapiens
atgtgcatgcacttacatgtgt

SEQ ID NO: 9331651 - DNA, 22 bp, Homo sapiens
atgtgcatgtgcacacatgcgt

SEQ ID NO: 9331652 - DNA, 22 bp, Homo sapiens
atgtgcatgtgcacacatgcgt

SEQ ID NO: 9331653 - DNA, 22 bp, Homo sapiens
agagccagcatttgacactggc

SEQ ID NO: 9331654 - DNA, 22 bp, Homo sapiens
atgttcatctacaaggcattgt

SEQ ID NO: 9331655 - DNA, 22 bp, Homo sapiens
agagctaagaaacagaattgct

SEQ ID NO: 9331656 - DNA, 22 bp, Homo sapiens
agagctaagaaacagaattgct

SEQ ID NO: 9331657 - DNA, 22 bp, Homo sapiens
agagccttgcctggggccctgt

SEQ ID NO: 9331658 - DNA, 22 bp, Homo sapiens
atgttctatatcattattgtga

SEQ ID NO: 9331659 - DNA, 19 bp, Homo sapiens
atgttctatcctccaagtt

SEQ ID NO: 9331660 - DNA, 22 bp, Homo sapiens
atgttctatatcattattgtga

SEQ ID NO: 9331661 - DNA, 22 bp, Homo sapiens
atgttctacagatggaaagggg

SEQ ID NO: 9331662 - DNA, 22 bp, Homo sapiens
atgttctacagatggaaagggg

SEQ ID NO: 9331663 - DNA, 22 bp, Homo sapiens
agagctctcttcataacggcct

SEQ ID NO: 9331664 - DNA, 22 bp, Homo sapiens
agagctctgtgtctctttgggt

SEQ ID NO: 9331665 - DNA, 22 bp, Homo sapiens
agagctctgtgtctctttgggt

SEQ ID NO: 9331666 - DNA, 22 bp, Homo sapiens
attaaggaagcctattctctcc

SEQ ID NO: 9331667 - DNA, 22 bp, Homo sapiens
attaagctggtccagacaagtt

SEQ ID NO: 9331668 - DNA, 22 bp, Homo sapiens
agagctctcaatggtcaatgct

SEQ ID NO: 9331669 - DNA, 22 bp, Homo sapiens
agagctcaagacgctcacagta

SEQ ID NO: 9331670 - DNA, 22 bp, Homo sapiens
agagctcagtgtgttatggtta

SEQ ID NO: 9331671 - DNA, 22 bp, Homo sapiens
atgtataagtacacagtcggaa

SEQ ID NO: 9331672 - DNA, 22 bp, Homo sapiens
atgtagtactgggtatgtttct

SEQ ID NO: 9331673 - DNA, 22 bp, Homo sapiens
atgtagtagttcacattctgtt

SEQ ID NO: 9331674 - DNA, 22 bp, Homo sapiens
atgtagtactgggtatgtttct

SEQ ID NO: 9331675 - DNA, 22 bp, Homo sapiens
atgtagtatctatatttcatgg

SEQ ID NO: 9331676 - DNA, 22 bp, Homo sapiens
atgtagtgccctttgtcatcta

SEQ ID NO: 9331677 - DNA, 22 bp, Homo sapiens
atgtagtatttggaaatgtaaa

SEQ ID NO: 9331678 - DNA, 22 bp, Homo sapiens
atgtatatgaagctagtatttt

SEQ ID NO: 9331679 - DNA, 22 bp, Homo sapiens
atgtatatgaagctagtatttt

SEQ ID NO: 9331680 - DNA, 22 bp, Homo sapiens
atgtatatacttacatgtgtgg

SEQ ID NO: 9331681 - DNA, 22 bp, Homo sapiens
atgtatatacttacatgtgtgg

SEQ ID NO: 9331682 - DNA, 22 bp, Homo sapiens
atgtataatgctaattagctag

SEQ ID NO: 9331683 - DNA, 22 bp, Homo sapiens
atgtataatgctaattagctag

SEQ ID NO: 9331684 - DNA, 22 bp, Homo sapiens
atgtataatgctaattagctag

SEQ ID NO: 9331685 - DNA, 22 bp, Homo sapiens
atgtataatgctaattagctag

SEQ ID NO: 9331686 - DNA, 22 bp, Homo sapiens
atgtatagtggtgatgattaca

SEQ ID NO: 9331687 - DNA, 22 bp, Homo sapiens
agagatggcgtctcagagcctg

SEQ ID NO: 9331688 - DNA, 22 bp, Homo sapiens
agagatggcgtctcagagcctg

SEQ ID NO: 9331689 - DNA, 22 bp, Homo sapiens
agagatggcgtctcagagcctg

SEQ ID NO: 9331690 - DNA, 20 bp, Homo sapiens
atgtatattactggctgtga

SEQ ID NO: 9331691 - DNA, 20 bp, Homo sapiens
atgtatattactggctgtga

SEQ ID NO: 9331692 - DNA, 17 bp, Homo sapiens
atgtatattaactctga

SEQ ID NO: 9331693 - DNA, 22 bp, Homo sapiens
atgtatatgcatgcattcaaag

SEQ ID NO: 9331694 - DNA, 22 bp, Homo sapiens
atgtatatgtgaaagatgttta

SEQ ID NO: 9331695 - DNA, 22 bp, Homo sapiens
atgtatatgtgtgcacgcacag

SEQ ID NO: 9331696 - DNA, 22 bp, Homo sapiens
atgtatatgtgaaagatgttta

SEQ ID NO: 9331697 - DNA, 22 bp, Homo sapiens
atgtatatgcatgcattcaaag

SEQ ID NO: 9331698 - DNA, 17 bp, Homo sapiens
atgtatattaactctga

SEQ ID NO: 9331699 - DNA, 18 bp, Homo sapiens
agagatgggagttggaaa

SEQ ID NO: 9331700 - DNA, 18 bp, Homo sapiens
agagatgggagttggaaa

SEQ ID NO: 9331701 - DNA, 22 bp, Homo sapiens
agagatgggaaggcagacttca

SEQ ID NO: 9331702 - DNA, 22 bp, Homo sapiens
agagatgggaaggcagacttca

SEQ ID NO: 9331703 - DNA, 22 bp, Homo sapiens
agagatgggaaggcagacttca

SEQ ID NO: 9331704 - DNA, 22 bp, Homo sapiens
agagatggtagaacagtcataa

SEQ ID NO: 9331705 - DNA, 20 bp, Homo sapiens
agagatggggtatcaccgta

SEQ ID NO: 9331706 - DNA, 22 bp, Homo sapiens
agagatgggcgggggcttctgc

SEQ ID NO: 9331707 - DNA, 22 bp, Homo sapiens
agagatgggcgggggcttctgc

SEQ ID NO: 9331708 - DNA, 21 bp, Homo sapiens
atgtagggtttgccttctcta

SEQ ID NO: 9331709 - DNA, 21 bp, Homo sapiens
atgtagggtttgccttctcta

SEQ ID NO: 9331710 - DNA, 22 bp, Homo sapiens
atgtacatagcatcatctagga

SEQ ID NO: 9331711 - DNA, 22 bp, Homo sapiens
atgtacatactgcattttcaaa

SEQ ID NO: 9331712 - DNA, 22 bp, Homo sapiens
atgtacatactgcattttcaaa

SEQ ID NO: 9331713 - DNA, 22 bp, Homo sapiens
atgtacatagcatcatctagga

SEQ ID NO: 9331714 - DNA, 22 bp, Homo sapiens
atgtacatagcatcatctagga

SEQ ID NO: 9331715 - DNA, 22 bp, Homo sapiens
agagactgtgtccatcgtgcct

SEQ ID NO: 9331716 - DNA, 22 bp, Homo sapiens
atgggctcggcgctgctgggat

SEQ ID NO: 9331717 - DNA, 22 bp, Homo sapiens
atgggctcggcgctgctgggat

SEQ ID NO: 9331718 - DNA, 22 bp, Homo sapiens
agagactgtacgtggcaagtat

SEQ ID NO: 9331719 - DNA, 22 bp, Homo sapiens
agagactggcttctaaaatggc

SEQ ID NO: 9331720 - DNA, 22 bp, Homo sapiens
atggacagcaactggaagcttc

SEQ ID NO: 9331721 - DNA, 22 bp, Homo sapiens
atggaatttggagattaggcat

SEQ ID NO: 9331722 - DNA, 22 bp, Homo sapiens
atggaattgagcatcagttgtt

SEQ ID NO: 9331723 - DNA, 22 bp, Homo sapiens
atggaattaataggggaatact

SEQ ID NO: 9331724 - DNA, 22 bp, Homo sapiens
atggaattaaaagtcaagtaat

SEQ ID NO: 9331725 - DNA, 22 bp, Homo sapiens
agagaagacttacagccacagt

SEQ ID NO: 9331726 - DNA, 22 bp, Homo sapiens
agagaactgtttctggggtctt

SEQ ID NO: 9331727 - DNA, 22 bp, Homo sapiens
agagaacatgacgtaatagtgg

SEQ ID NO: 9331728 - DNA, 22 bp, Homo sapiens
agagaacattagcaaaaacagc

SEQ ID NO: 9331729 - DNA, 22 bp, Homo sapiens
agagaacattagcaaaaacagc

SEQ ID NO: 9331730 - DNA, 22 bp, Homo sapiens
agagaacatgacgtaatagtgg

SEQ ID NO: 9331731 - DNA, 22 bp, Homo sapiens
agagaacagtgttttgaaggag

SEQ ID NO: 9331732 - DNA, 22 bp, Homo sapiens
agagaacatattttgtatgatt

SEQ ID NO: 9331733 - DNA, 22 bp, Homo sapiens
atgggcagtgtattggaaggaa

SEQ ID NO: 9331734 - DNA, 22 bp, Homo sapiens
atgggcagttaggaggccagga

SEQ ID NO: 9331735 - DNA, 22 bp, Homo sapiens
atgggcagttaggaggccagga

SEQ ID NO: 9331736 - DNA, 16 bp, Homo sapiens
atgggcagtgaggaag

SEQ ID NO: 9331737 - DNA, 22 bp, Homo sapiens
atgggcagttaggaggccagga

SEQ ID NO: 9331738 - DNA, 22 bp, Homo sapiens
atggacaggtactgcagtgggt

SEQ ID NO: 9331739 - DNA, 22 bp, Homo sapiens
atggacaggtactgcagtgggt

SEQ ID NO: 9331740 - DNA, 22 bp, Homo sapiens
atggacaggtggataggtggat

SEQ ID NO: 9331741 - DNA, 22 bp, Homo sapiens
atggacaggtggataggtggat

SEQ ID NO: 9331742 - DNA, 22 bp, Homo sapiens
atgggcagtaacagtggcagtc

SEQ ID NO: 9331743 - DNA, 18 bp, Homo sapiens
atgggaggggccaagaga

SEQ ID NO: 9331744 - DNA, 18 bp, Homo sapiens
atgggaggggccaagaga

SEQ ID NO: 9331745 - DNA, 22 bp, Homo sapiens
atgccactgcactccagcctag

SEQ ID NO: 9331746 - DNA, 22 bp, Homo sapiens
atgccacttcattccagcctcg

SEQ ID NO: 9331747 - DNA, 22 bp, Homo sapiens
atgccagaaaatgatggctgca

SEQ ID NO: 9331748 - DNA, 22 bp, Homo sapiens
atgccagaaggcagaatttatc

SEQ ID NO: 9331749 - DNA, 22 bp, Homo sapiens
atgccagaaggcagaatttatc

SEQ ID NO: 9331750 - DNA, 22 bp, Homo sapiens
atgccaggctgtttggcctcag

SEQ ID NO: 9331751 - DNA, 22 bp, Homo sapiens
atgccaggaacaaacagtggtg

SEQ ID NO: 9331752 - DNA, 22 bp, Homo sapiens
atgccaggagatggagcagagt

SEQ ID NO: 9331753 - DNA, 22 bp, Homo sapiens
atgccaggaacaaacagtggtg

SEQ ID NO: 9331754 - DNA, 22 bp, Homo sapiens
agacagtgctatcccatctgtg

SEQ ID NO: 9331755 - DNA, 22 bp, Homo sapiens
agacagtggatcgggatgcact

SEQ ID NO: 9331756 - DNA, 22 bp, Homo sapiens
atgccaggtacaggggtagggt

SEQ ID NO: 9331757 - DNA, 22 bp, Homo sapiens
atgccaggctgtttggcctcag

SEQ ID NO: 9331758 - DNA, 23 bp, Homo sapiens
atgccaggctgcctggccagcct

SEQ ID NO: 9331759 - DNA, 22 bp, Homo sapiens
atgccagggtcatcccctgggt

SEQ ID NO: 9331760 - DNA, 22 bp, Homo sapiens
atgccagggtcccttcagagat

SEQ ID NO: 9331761 - DNA, 22 bp, Homo sapiens
atgccagggtcatcccctgggt

SEQ ID NO: 9331762 - DNA, 22 bp, Homo sapiens
agacataagtgctatgacattg

SEQ ID NO: 9331763 - DNA, 22 bp, Homo sapiens
agacataagccagtcactcact

SEQ ID NO: 9331764 - DNA, 22 bp, Homo sapiens
agacatagataggcactgattg

SEQ ID NO: 9331765 - DNA, 22 bp, Homo sapiens
agacatagactttctactgtgt

SEQ ID NO: 9331766 - DNA, 22 bp, Homo sapiens
agacatagactttctactgtgt

SEQ ID NO: 9331767 - DNA, 22 bp, Homo sapiens
agacagtgtgtgtatatatggt

SEQ ID NO: 9331768 - DNA, 22 bp, Homo sapiens
atgcttccactgttctgctctc

SEQ ID NO: 9331769 - DNA, 22 bp, Homo sapiens
atgcttccctttgctccacatg

SEQ ID NO: 9331770 - DNA, 22 bp, Homo sapiens
agagaacaaattaaaggtggtt

SEQ ID NO: 9331771 - DNA, 22 bp, Homo sapiens
agagaacagacagatgcaatga

SEQ ID NO: 9331772 - DNA, 22 bp, Homo sapiens
atgctgaattgatgcgagggag

SEQ ID NO: 9331773 - DNA, 22 bp, Homo sapiens
atgctgaagagtgcacaggcta

SEQ ID NO: 9331774 - DNA, 22 bp, Homo sapiens
atgctgagactggagcagctgg

SEQ ID NO: 9331775 - DNA, 22 bp, Homo sapiens
atgctgagatcctcaggccaga

SEQ ID NO: 9331776 - DNA, 22 bp, Homo sapiens
atgctgaggtgtgtttaattta

SEQ ID NO: 9331777 - DNA, 19 bp, Homo sapiens
atgctgcatatggttttct

SEQ ID NO: 9331778 - DNA, 19 bp, Homo sapiens
atgctgcatatggttttct

SEQ ID NO: 9331779 - DNA, 22 bp, Homo sapiens
atcttagaagtttgataaaatc

SEQ ID NO: 9331780 - DNA, 22 bp, Homo sapiens
atgacaatacttcaataagctg

SEQ ID NO: 9331781 - DNA, 22 bp, Homo sapiens
atcttagagagtcgtgttttgt

SEQ ID NO: 9331782 - DNA, 22 bp, Homo sapiens
atcttaatcgagtccatgaaaa

SEQ ID NO: 9331783 - DNA, 22 bp, Homo sapiens
atcttacaattacaagacactc

SEQ ID NO: 9331784 - DNA, 22 bp, Homo sapiens
atcttacacgataactgttagt

SEQ ID NO: 9331785 - DNA, 19 bp, Homo sapiens
atcttacagagcagagtac

SEQ ID NO: 9331786 - DNA, 22 bp, Homo sapiens
atgactcagaagatattttcca

SEQ ID NO: 9331787 - DNA, 22 bp, Homo sapiens
atgaccagccgagataaacaga

SEQ ID NO: 9331788 - DNA, 22 bp, Homo sapiens
atgaccagtgttgctggccccg

SEQ ID NO: 9331789 - DNA, 22 bp, Homo sapiens
atctggggccccggaagttcct

SEQ ID NO: 9331790 - DNA, 22 bp, Homo sapiens
atctggggcctgggctagccat

SEQ ID NO: 9331791 - DNA, 21 bp, Homo sapiens
atcttaaaaggtcttaacttt

SEQ ID NO: 9331792 - DNA, 22 bp, Homo sapiens
atctgggttcaccatgctcctg

SEQ ID NO: 9331793 - DNA, 23 bp, Homo sapiens
atctgttgtgcctcttatatgta

SEQ ID NO: 9331794 - DNA, 22 bp, Homo sapiens
atctgggagtcttggctctgct

SEQ ID NO: 9331795 - DNA, 22 bp, Homo sapiens
atctgggagacccttgcgggaa

SEQ ID NO: 9331796 - DNA, 22 bp, Homo sapiens
atctgggagacccttgcgggaa

SEQ ID NO: 9331797 - DNA, 22 bp, Homo sapiens
atctgggagcggaggttgcagt

SEQ ID NO: 9331798 - DNA, 22 bp, Homo sapiens
atctgggcgtataggtgcaagt

SEQ ID NO: 9331799 - DNA, 22 bp, Homo sapiens
atctggcttgggtgtgggtagc

SEQ ID NO: 9331800 - DNA, 22 bp, Homo sapiens
atctggcttttaccccacggcc

SEQ ID NO: 9331801 - DNA, 22 bp, Homo sapiens
atgcaaattaacatatagtaga

SEQ ID NO: 9331802 - DNA, 22 bp, Homo sapiens
atgattgaccatctgctgggct

SEQ ID NO: 9331803 - DNA, 22 bp, Homo sapiens
atgatttaaagtcattgtgaac

SEQ ID NO: 9331804 - DNA, 22 bp, Homo sapiens
atgatttaaagtcattgtgaac

SEQ ID NO: 9331805 - DNA, 22 bp, Homo sapiens
atgattgaaaatgacattgcca

SEQ ID NO: 9331806 - DNA, 22 bp, Homo sapiens
atgattgaaaatgacattgcca

SEQ ID NO: 9331807 - DNA, 20 bp, Homo sapiens
atgattctgggctacactgg

SEQ ID NO: 9331808 - DNA, 22 bp, Homo sapiens
atgatatatgtgttgagcttgc

SEQ ID NO: 9331809 - DNA, 22 bp, Homo sapiens
atgattcagcccaatttttcta

SEQ ID NO: 9331810 - DNA, 22 bp, Homo sapiens
atgattcagggagttttcagga

SEQ ID NO: 9331811 - DNA, 22 bp, Homo sapiens
atgattctcattttataaactt

SEQ ID NO: 9331812 - DNA, 22 bp, Homo sapiens
atgaggagaccaaggcctgatg

SEQ ID NO: 9331813 - DNA, 22 bp, Homo sapiens
atgagaaagagttgtatctaga

SEQ ID NO: 9331814 - DNA, 22 bp, Homo sapiens
atgactttcctggcaaaagttg

SEQ ID NO: 9331815 - DNA, 22 bp, Homo sapiens
atgagaaaattcattccatcca

SEQ ID NO: 9331816 - DNA, 22 bp, Homo sapiens
atgaggcaaggctggccgtgtt

SEQ ID NO: 9331817 - DNA, 22 bp, Homo sapiens
atgaggcaaaggtggaggtggg

SEQ ID NO: 9331818 - DNA, 22 bp, Homo sapiens
atgaggcacagagatgttaatg

SEQ ID NO: 9331819 - DNA, 22 bp, Homo sapiens
atgaggcaatcatggtccagtt

SEQ ID NO: 9331820 - DNA, 22 bp, Homo sapiens
atgaggcacatcacagccaatg

SEQ ID NO: 9331821 - DNA, 22 bp, Homo sapiens
atgaggcacgtgttactggcct

SEQ ID NO: 9331822 - DNA, 22 bp, Homo sapiens
atgatatatgtgttgagcttgc

SEQ ID NO: 9331823 - DNA, 22 bp, Homo sapiens
atgatatagagagtagattaaa

SEQ ID NO: 9331824 - DNA, 22 bp, Homo sapiens
atgatatagagagtagattaaa

SEQ ID NO: 9331825 - DNA, 18 bp, Homo sapiens
cacaggctcccagtgagg

SEQ ID NO: 9331826 - DNA, 18 bp, Homo sapiens
cacaggctcccagtgagg

SEQ ID NO: 9331827 - DNA, 20 bp, Homo sapiens
cacaggctatatgagagcca

SEQ ID NO: 9331828 - DNA, 18 bp, Homo sapiens
cacaggctcccagtgagg

SEQ ID NO: 9331829 - DNA, 20 bp, Homo sapiens
cacaggctatatgagagcca

SEQ ID NO: 9331830 - DNA, 22 bp, Homo sapiens
cacaggctccggccttgcagcc

SEQ ID NO: 9331831 - DNA, 22 bp, Homo sapiens
cacaggctccggccttgcagcc

SEQ ID NO: 9331832 - DNA, 22 bp, Homo sapiens
cacaggctccggccttgcagcc

SEQ ID NO: 9331833 - DNA, 19 bp, Homo sapiens
agcaggctaggctgcctct

SEQ ID NO: 9331834 - DNA, 19 bp, Homo sapiens
agcaggctaggctgcctct

SEQ ID NO: 9331835 - DNA, 20 bp, Homo sapiens
cacaggctatatgagagcca

SEQ ID NO: 9331836 - DNA, 20 bp, Homo sapiens
cacaggctatatgagagcca

SEQ ID NO: 9331837 - DNA, 22 bp, Homo sapiens
agcaggctactcctgtgttcgt

SEQ ID NO: 9331838 - DNA, 22 bp, Homo sapiens
agcaggctaggaacctcactgc

SEQ ID NO: 9331839 - DNA, 22 bp, Homo sapiens
agcaggctaggaacctcactgc

SEQ ID NO: 9331840 - DNA, 22 bp, Homo sapiens
agcaggctaggaacctcactgc

SEQ ID NO: 9331841 - DNA, 19 bp, Homo sapiens
agcaggctaggctgcctct

SEQ ID NO: 9331842 - DNA, 20 bp, Homo sapiens
agcaggccttggggagagga

SEQ ID NO: 9331843 - DNA, 22 bp, Homo sapiens
agcaggcctgccacctcggggt

SEQ ID NO: 9331844 - DNA, 22 bp, Homo sapiens
agcaggctaagggacctgttta

SEQ ID NO: 9331845 - DNA, 22 bp, Homo sapiens
agcaggctactcctgtgttcgt

SEQ ID NO: 9331846 - DNA, 22 bp, Homo sapiens
agcaggcctgccacctcggggt

SEQ ID NO: 9331847 - DNA, 21 bp, Homo sapiens
agcaggcccaatggagggggc

SEQ ID NO: 9331848 - DNA, 19 bp, Homo sapiens
agcaggccaggcaggtggc

SEQ ID NO: 9331849 - DNA, 19 bp, Homo sapiens
agcaggccaggcaggtggc

SEQ ID NO: 9331850 - DNA, 19 bp, Homo sapiens
agcaggccaggcaggtggc

SEQ ID NO: 9331851 - DNA, 21 bp, Homo sapiens
agcaggcccaatggagggggc

SEQ ID NO: 9331852 - DNA, 22 bp, Homo sapiens
agcaggcccaagctggggggaa

SEQ ID NO: 9331853 - DNA, 22 bp, Homo sapiens
agcaggcccaagctggggggaa

SEQ ID NO: 9331854 - DNA, 22 bp, Homo sapiens
cacatgtagtaagcaggcaatg

SEQ ID NO: 9331855 - DNA, 22 bp, Homo sapiens
cacatgggtgtgcctggaggaa

SEQ ID NO: 9331856 - DNA, 22 bp, Homo sapiens
cacatgggtgtgcctggaggaa

SEQ ID NO: 9331857 - DNA, 22 bp, Homo sapiens
cacatgggtgtgcctggaggaa

SEQ ID NO: 9331858 - DNA, 22 bp, Homo sapiens
cacatgtacagaagcaggctgg

SEQ ID NO: 9331859 - DNA, 22 bp, Homo sapiens
cacatggcctgtgtggccagac

SEQ ID NO: 9331860 - DNA, 22 bp, Homo sapiens
cacatggcctgtgtggccagac

SEQ ID NO: 9331861 - DNA, 22 bp, Homo sapiens
cacatggcctgtgtggccagac

SEQ ID NO: 9331862 - DNA, 22 bp, Homo sapiens
cacatgggcgtaatgtccatgg

SEQ ID NO: 9331863 - DNA, 22 bp, Homo sapiens
cacatgggcacagagaacttgg

SEQ ID NO: 9331864 - DNA, 22 bp, Homo sapiens
cacatgggcgtaatgtccatgg

SEQ ID NO: 9331865 - DNA, 22 bp, Homo sapiens
cacatgggtggatggatgcatg

SEQ ID NO: 9331866 - DNA, 22 bp, Homo sapiens
cacatggggcgctgcattggcc

SEQ ID NO: 9331867 - DNA, 22 bp, Homo sapiens
cacatgggcttagcaggcaggg

SEQ ID NO: 9331868 - DNA, 22 bp, Homo sapiens
cacatgggcttagcaggcaggg

SEQ ID NO: 9331869 - DNA, 22 bp, Homo sapiens
cacatggaagagatacagtgag

SEQ ID NO: 9331870 - DNA, 22 bp, Homo sapiens
cacatgcttagatttcagtgga

SEQ ID NO: 9331871 - DNA, 22 bp, Homo sapiens
cacatgaagagagtctagtaat

SEQ ID NO: 9331872 - DNA, 22 bp, Homo sapiens
cacatggaagagatacagtgag

SEQ ID NO: 9331873 - DNA, 22 bp, Homo sapiens
cacatggcagaatcatgcatct

SEQ ID NO: 9331874 - DNA, 22 bp, Homo sapiens
cacatggcagaatcatgcatct

SEQ ID NO: 9331875 - DNA, 22 bp, Homo sapiens
cacaggctcttctcacttgatt

SEQ ID NO: 9331876 - DNA, 22 bp, Homo sapiens
cacaggctgcccgcagctggga

SEQ ID NO: 9331877 - DNA, 22 bp, Homo sapiens
cacaggctgcccgcagctggga

SEQ ID NO: 9331878 - DNA, 22 bp, Homo sapiens
cacatgaacatgctggaaaagc

SEQ ID NO: 9331879 - DNA, 22 bp, Homo sapiens
cacattgattcagtcctgtgtg

SEQ ID NO: 9331880 - DNA, 22 bp, Homo sapiens
cacattgataattaaggcctcc

SEQ ID NO: 9331881 - DNA, 22 bp, Homo sapiens
cacatttaaaaaatccacgatc

SEQ ID NO: 9331882 - DNA, 22 bp, Homo sapiens
cacatttaaaaaatccacgatc

SEQ ID NO: 9331883 - DNA, 22 bp, Homo sapiens
cacatttaaaggttgaagctga

SEQ ID NO: 9331884 - DNA, 22 bp, Homo sapiens
cacatttaagcagatgtggacc

SEQ ID NO: 9331885 - DNA, 22 bp, Homo sapiens
cacatttaagcagatgtggacc

SEQ ID NO: 9331886 - DNA, 22 bp, Homo sapiens
cacatttaaaggttgaagctga

SEQ ID NO: 9331887 - DNA, 22 bp, Homo sapiens
cactaaatgtttcaatgtggga

SEQ ID NO: 9331888 - DNA, 22 bp, Homo sapiens
cacgggcagtgagcacagcctg

SEQ ID NO: 9331889 - DNA, 22 bp, Homo sapiens
cacggtggcccacaggtgcaag

SEQ ID NO: 9331890 - DNA, 22 bp, Homo sapiens
cacatttaatcctttataagta

SEQ ID NO: 9331891 - DNA, 22 bp, Homo sapiens
cacctgagtgtcagtattctca

SEQ ID NO: 9331892 - DNA, 22 bp, Homo sapiens
cacggcctgtaaggacccagga

SEQ ID NO: 9331893 - DNA, 22 bp, Homo sapiens
cacgggagacgtgatcttggac

SEQ ID NO: 9331894 - DNA, 22 bp, Homo sapiens
cacatttaagtgcttgttcaga

SEQ ID NO: 9331895 - DNA, 22 bp, Homo sapiens
cacatttaagcagatgtggacc

SEQ ID NO: 9331896 - DNA, 22 bp, Homo sapiens
cacatttaagtgcttgttcaga

SEQ ID NO: 9331897 - DNA, 22 bp, Homo sapiens
cacatttaagtgcttgttcaga

SEQ ID NO: 9331898 - DNA, 22 bp, Homo sapiens
agcaggtggatttagacgggag

SEQ ID NO: 9331899 - DNA, 22 bp, Homo sapiens
agcaggtggacagaggaagaaa

SEQ ID NO: 9331900 - DNA, 22 bp, Homo sapiens
cactagagaaacgcccaggctc

SEQ ID NO: 9331901 - DNA, 22 bp, Homo sapiens
cactagagaaacgcccaggctc

SEQ ID NO: 9331902 - DNA, 22 bp, Homo sapiens
cactacagaatcaaatacgggc

SEQ ID NO: 9331903 - DNA, 22 bp, Homo sapiens
cactacaggggtccacagctga

SEQ ID NO: 9331904 - DNA, 22 bp, Homo sapiens
cactacaggggtccacagctga

SEQ ID NO: 9331905 - DNA, 19 bp, Homo sapiens
cactaagatgagatatagc

SEQ ID NO: 9331906 - DNA, 22 bp, Homo sapiens
cactaagtcaacagcctctctt

SEQ ID NO: 9331907 - DNA, 22 bp, Homo sapiens
cactaattaacacgtcgtctct

SEQ ID NO: 9331908 - DNA, 22 bp, Homo sapiens
cactgaaatcgaaaaatgtagg

SEQ ID NO: 9331909 - DNA, 22 bp, Homo sapiens
agcaggtgggcatgaaagctga

SEQ ID NO: 9331910 - DNA, 22 bp, Homo sapiens
agcaggtgggatcaagctggca

SEQ ID NO: 9331911 - DNA, 22 bp, Homo sapiens
agcaggtgggatcaagctggca

SEQ ID NO: 9331912 - DNA, 22 bp, Homo sapiens
agcaggtgggatcaagctggca

SEQ ID NO: 9331913 - DNA, 18 bp, Homo sapiens
agcaggtggcgtctgcag

SEQ ID NO: 9331914 - DNA, 18 bp, Homo sapiens
agcaggtggcgtctgcag

SEQ ID NO: 9331915 - DNA, 18 bp, Homo sapiens
agcaggtggcgtctgcag

SEQ ID NO: 9331916 - DNA, 22 bp, Homo sapiens
agcaggtggcctcctgtctgtc

SEQ ID NO: 9331917 - DNA, 22 bp, Homo sapiens
agcaggtggccacgaggaggag

SEQ ID NO: 9331918 - DNA, 22 bp, Homo sapiens
agcaggtggcctcctgtctgtc

SEQ ID NO: 9331919 - DNA, 22 bp, Homo sapiens
agcaggtggcctcctgtctgtc

SEQ ID NO: 9331920 - DNA, 22 bp, Homo sapiens
agcaggtggcctcctgtctgtc

SEQ ID NO: 9331921 - DNA, 22 bp, Homo sapiens
agcaggtggatttagacgggag

SEQ ID NO: 9331922 - DNA, 22 bp, Homo sapiens
agcaggtggatttagacgggag

SEQ ID NO: 9331923 - DNA, 18 bp, Homo sapiens
agcaggtggatttattgg

SEQ ID NO: 9331924 - DNA, 22 bp, Homo sapiens
agcaggtggccacgaggaggag

SEQ ID NO: 9331925 - DNA, 18 bp, Homo sapiens
agcaggtggatttattgg

SEQ ID NO: 9331926 - DNA, 22 bp, Homo sapiens
cactgggcgtgtcctgggtgag

SEQ ID NO: 9331927 - DNA, 22 bp, Homo sapiens
cactgggctttgtagttagcat

SEQ ID NO: 9331928 - DNA, 22 bp, Homo sapiens
cactggggaaaacaggcttctt

SEQ ID NO: 9331929 - DNA, 22 bp, Homo sapiens
cactgggctgataccaggcttc

SEQ ID NO: 9331930 - DNA, 22 bp, Homo sapiens
agcattttctgagagtatagat

SEQ ID NO: 9331931 - DNA, 22 bp, Homo sapiens
cactgggcaattctgagcctaa

SEQ ID NO: 9331932 - DNA, 23 bp, Homo sapiens
cactgggggctgctacagagagg

SEQ ID NO: 9331933 - DNA, 23 bp, Homo sapiens
cactgggggctgctacagagagg

SEQ ID NO: 9331934 - DNA, 23 bp, Homo sapiens
cactgggggctgctacagagagg

SEQ ID NO: 9331935 - DNA, 22 bp, Homo sapiens
cactggggtgggcctggtagag

SEQ ID NO: 9331936 - DNA, 22 bp, Homo sapiens
cactggggtgggcctggtagag

SEQ ID NO: 9331937 - DNA, 22 bp, Homo sapiens
cactggggtgggcctggtagag

SEQ ID NO: 9331938 - DNA, 22 bp, Homo sapiens
cactggggtgggcctggtagag

SEQ ID NO: 9331939 - DNA, 22 bp, Homo sapiens
cactgggtaaatttgaggctga

SEQ ID NO: 9331940 - DNA, 22 bp, Homo sapiens
cactgggtaaatttgaggctga

SEQ ID NO: 9331941 - DNA, 20 bp, Homo sapiens
cactttggacctgatgtatc

SEQ ID NO: 9331942 - DNA, 22 bp, Homo sapiens
cactttgatttgtgatgtgaga

SEQ ID NO: 9331943 - DNA, 22 bp, Homo sapiens
cactttgaagagctttttgaca

SEQ ID NO: 9331944 - DNA, 19 bp, Homo sapiens
cactggtcttctatttagg

SEQ ID NO: 9331945 - DNA, 20 bp, Homo sapiens
cagaaagaaggtagattttt

SEQ ID NO: 9331946 - DNA, 20 bp, Homo sapiens
cagaaagaaggtagattttt

SEQ ID NO: 9331947 - DNA, 22 bp, Homo sapiens
cagaaagacctgggctcaagag

SEQ ID NO: 9331948 - DNA, 22 bp, Homo sapiens
cagaaagacctgggctcaagag

SEQ ID NO: 9331949 - DNA, 22 bp, Homo sapiens
agccaaagagaccccatatcca

SEQ ID NO: 9331950 - DNA, 22 bp, Homo sapiens
agccaaagatcagtgtgcaagt

SEQ ID NO: 9331951 - DNA, 20 bp, Homo sapiens
agccaaaggagaacagtgct

SEQ ID NO: 9331952 - DNA, 20 bp, Homo sapiens
agccaaaggagaacagtgct

SEQ ID NO: 9331953 - DNA, 22 bp, Homo sapiens
agccaaaggcaccagagacact

SEQ ID NO: 9331954 - DNA, 22 bp, Homo sapiens
cactgcaacctccacctcctgg

SEQ ID NO: 9331955 - DNA, 22 bp, Homo sapiens
cactgcaacctccagctctcag

SEQ ID NO: 9331956 - DNA, 22 bp, Homo sapiens
cactgcaacctccatcttctgg

SEQ ID NO: 9331957 - DNA, 22 bp, Homo sapiens
cactgcaacctccacctcctgg

SEQ ID NO: 9331958 - DNA, 22 bp, Homo sapiens
cactgcaacctccacctcctgg

SEQ ID NO: 9331959 - DNA, 22 bp, Homo sapiens
cactgcactccagcccgggcaa

SEQ ID NO: 9331960 - DNA, 22 bp, Homo sapiens
cactgcactccagcccgggcaa

SEQ ID NO: 9331961 - DNA, 22 bp, Homo sapiens
cactgcactccagcactccagc

SEQ ID NO: 9331962 - DNA, 22 bp, Homo sapiens
cactgcacaggtgagatgtggg

SEQ ID NO: 9331963 - DNA, 22 bp, Homo sapiens
cactgcactccagcactccagc

SEQ ID NO: 9331964 - DNA, 22 bp, Homo sapiens
cactgcactccagcccgggcaa

SEQ ID NO: 9331965 - DNA, 22 bp, Homo sapiens
cactgcactccagcctcggtga

SEQ ID NO: 9331966 - DNA, 22 bp, Homo sapiens
cactgcactccatcctgggaaa

SEQ ID NO: 9331967 - DNA, 22 bp, Homo sapiens
cactgcactccatcctgggaaa

SEQ ID NO: 9331968 - DNA, 22 bp, Homo sapiens
cactgcactccatcctgggaaa

SEQ ID NO: 9331969 - DNA, 22 bp, Homo sapiens
agcatttagttagtaaatgttt

SEQ ID NO: 9331970 - DNA, 22 bp, Homo sapiens
agcatttagttagtaaatgttt

SEQ ID NO: 9331971 - DNA, 22 bp, Homo sapiens
agcatttagtctttattgcagc

SEQ ID NO: 9331972 - DNA, 22 bp, Homo sapiens
agcatttagtctttattgcagc

SEQ ID NO: 9331973 - DNA, 22 bp, Homo sapiens
agcatttatgactaatgtaaaa

SEQ ID NO: 9331974 - DNA, 22 bp, Homo sapiens
agcatttatcttttgtttgagt

SEQ ID NO: 9331975 - DNA, 22 bp, Homo sapiens
agcatttatcttttgtttgagt

SEQ ID NO: 9331976 - DNA, 22 bp, Homo sapiens
agcatttatagcccctatcatc

SEQ ID NO: 9331977 - DNA, 22 bp, Homo sapiens
agcatttatagataccctatgg

SEQ ID NO: 9331978 - DNA, 22 bp, Homo sapiens
agcatttatttcttagaaattg

SEQ ID NO: 9331979 - DNA, 22 bp, Homo sapiens
agcatttattgacctgctgctg

SEQ ID NO: 9331980 - DNA, 22 bp, Homo sapiens
agcatttattgacctgctgctg

SEQ ID NO: 9331981 - DNA, 22 bp, Homo sapiens
agcatttattgagtgccctggg

SEQ ID NO: 9331982 - DNA, 22 bp, Homo sapiens
agcatttatgactaatgtaaaa

SEQ ID NO: 9331983 - DNA, 22 bp, Homo sapiens
agcatttatttcttagaaattg

SEQ ID NO: 9331984 - DNA, 22 bp, Homo sapiens
agcatttattgagtgccctggg

SEQ ID NO: 9331985 - DNA, 22 bp, Homo sapiens
agcattatggtatagtcccata

SEQ ID NO: 9331986 - DNA, 22 bp, Homo sapiens
cactgcacttcagcctgggtga

SEQ ID NO: 9331987 - DNA, 22 bp, Homo sapiens
cactgcacttcagcctgggtga

SEQ ID NO: 9331988 - DNA, 22 bp, Homo sapiens
agcatttaggagaatttgagaa

SEQ ID NO: 9331989 - DNA, 20 bp, Homo sapiens
agcatttagcctttatccac

SEQ ID NO: 9331990 - DNA, 22 bp, Homo sapiens
agcatttaggagaatttgagaa

SEQ ID NO: 9331991 - DNA, 20 bp, Homo sapiens
agcatttagcctttatccac

SEQ ID NO: 9331992 - DNA, 20 bp, Homo sapiens
agcatttagcctttatccac

SEQ ID NO: 9331993 - DNA, 22 bp, Homo sapiens
agcattatgtccatgctaaatt

SEQ ID NO: 9331994 - DNA, 22 bp, Homo sapiens
cactgcacttcagcctgggtga

SEQ ID NO: 9331995 - DNA, 22 bp, Homo sapiens
cactgcacttcagcctgggtga

SEQ ID NO: 9331996 - DNA, 22 bp, Homo sapiens
cacagctgccatggctgcactt

SEQ ID NO: 9331997 - DNA, 22 bp, Homo sapiens
cacagctgccatggctgcactt

SEQ ID NO: 9331998 - DNA, 22 bp, Homo sapiens
cacagctgcacagaggaggtgc

SEQ ID NO: 9331999 - DNA, 22 bp, Homo sapiens
cacagctgccccctctctaact

SEQ ID NO: 9332000 - DNA, 22 bp, Homo sapiens
cacagctgccctactccatgtg

SEQ ID NO: 9332001 - DNA, 22 bp, Homo sapiens
cacagaaatattgtgtcccttg

SEQ ID NO: 9332002 - DNA, 22 bp, Homo sapiens
cacagaaatattgtgtcccttg

SEQ ID NO: 9332003 - DNA, 22 bp, Homo sapiens
cacagaaatattgtgtcccttg

SEQ ID NO: 9332004 - DNA, 20 bp, Homo sapiens
cacagaacaaattgcaggac

SEQ ID NO: 9332005 - DNA, 22 bp, Homo sapiens
cacagaaattattaggatgctt

SEQ ID NO: 9332006 - DNA, 22 bp, Homo sapiens
cacagaaatattgtgtcccttg

SEQ ID NO: 9332007 - DNA, 22 bp, Homo sapiens
cacagctgaccaccctgctccc

SEQ ID NO: 9332008 - DNA, 22 bp, Homo sapiens
cacagcagcgttcctccgtgtg

SEQ ID NO: 9332009 - DNA, 22 bp, Homo sapiens
cacaggaaatattaggagggat

SEQ ID NO: 9332010 - DNA, 22 bp, Homo sapiens
cacaggaaatgattctgcagca

SEQ ID NO: 9332011 - DNA, 22 bp, Homo sapiens
cacaggaaatgattctgcagca

SEQ ID NO: 9332012 - DNA, 22 bp, Homo sapiens
cacaggaaatgattctgcagca

SEQ ID NO: 9332013 - DNA, 22 bp, Homo sapiens
cacaggaacaaagaagacaatt

SEQ ID NO: 9332014 - DNA, 22 bp, Homo sapiens
cacaggaacaaagaagacaatt

SEQ ID NO: 9332015 - DNA, 22 bp, Homo sapiens
cacaggaacaaagaagacaatt

SEQ ID NO: 9332016 - DNA, 22 bp, Homo sapiens
cacaggaacttactggccactt

SEQ ID NO: 9332017 - DNA, 22 bp, Homo sapiens
cacaggaagatctcccagaggt

SEQ ID NO: 9332018 - DNA, 22 bp, Homo sapiens
cacaggaagaggtatacaattc

SEQ ID NO: 9332019 - DNA, 22 bp, Homo sapiens
cacaggaagatctcccagaggt

SEQ ID NO: 9332020 - DNA, 22 bp, Homo sapiens
agcaggcaggcccagcggctgg

SEQ ID NO: 9332021 - DNA, 22 bp, Homo sapiens
agcaggccactgcagctggagc

SEQ ID NO: 9332022 - DNA, 22 bp, Homo sapiens
agcaggcaggcccagcggctgg

SEQ ID NO: 9332023 - DNA, 20 bp, Homo sapiens
cacaggaaagctactcagtt

SEQ ID NO: 9332024 - DNA, 22 bp, Homo sapiens
cacaggaaagtcagccagaaga

SEQ ID NO: 9332025 - DNA, 22 bp, Homo sapiens
cacaggaaaataaaagatctaa

SEQ ID NO: 9332026 - DNA, 20 bp, Homo sapiens
cacaggaaagctactcagtt

SEQ ID NO: 9332027 - DNA, 22 bp, Homo sapiens
cacaggaaaataaaagatctaa

SEQ ID NO: 9332028 - DNA, 22 bp, Homo sapiens
cacaggaaaaatgggtccttta

SEQ ID NO: 9332029 - DNA, 22 bp, Homo sapiens
cacaggaaaaatgggtccttta

SEQ ID NO: 9332030 - DNA, 22 bp, Homo sapiens
cacaggaaaaatgggtccttta

SEQ ID NO: 9332031 - DNA, 22 bp, Homo sapiens
cacagctggggaagctgaggcc

SEQ ID NO: 9332032 - DNA, 19 bp, Homo sapiens
cacagctggcgctgaccgc

SEQ ID NO: 9332033 - DNA, 19 bp, Homo sapiens
cacagctggcgctgaccgc

SEQ ID NO: 9332034 - DNA, 22 bp, Homo sapiens
cacagctggaatggggtacctg

SEQ ID NO: 9332035 - DNA, 22 bp, Homo sapiens
cacacttttctggctcaggctc

SEQ ID NO: 9332036 - DNA, 22 bp, Homo sapiens
cacactttgtgctaatctattt

SEQ ID NO: 9332037 - DNA, 22 bp, Homo sapiens
cacagaaaaaggcttgaaaatc

SEQ ID NO: 9332038 - DNA, 22 bp, Homo sapiens
cacagaaaaaggcttgaaaatc

SEQ ID NO: 9332039 - DNA, 22 bp, Homo sapiens
cacactttcaggtcctctttgc

SEQ ID NO: 9332040 - DNA, 22 bp, Homo sapiens
cacacatgtgagcagagaggcg

SEQ ID NO: 9332041 - DNA, 22 bp, Homo sapiens
cacacatgtgggatccgcaggg

SEQ ID NO: 9332042 - DNA, 22 bp, Homo sapiens
cacacatgtgtgcagcttagaa

SEQ ID NO: 9332043 - DNA, 22 bp, Homo sapiens
cacacatgtctctccatgctct

SEQ ID NO: 9332044 - DNA, 22 bp, Homo sapiens
cacacatgtctctccatgctct

SEQ ID NO: 9332045 - DNA, 22 bp, Homo sapiens
cacacatggttccgcaggatgc

SEQ ID NO: 9332046 - DNA, 22 bp, Homo sapiens
cacacatggtagcaggtacaag

SEQ ID NO: 9332047 - DNA, 22 bp, Homo sapiens
cacacatggtagcaggtacaag

SEQ ID NO: 9332048 - DNA, 22 bp, Homo sapiens
cacacatggtagcaggtacaag

SEQ ID NO: 9332049 - DNA, 22 bp, Homo sapiens
cacacatggtagcaggtacaag

SEQ ID NO: 9332050 - DNA, 22 bp, Homo sapiens
cacacatggtagcaggtacaag

SEQ ID NO: 9332051 - DNA, 22 bp, Homo sapiens
cacacatgacccacttttaccg

SEQ ID NO: 9332052 - DNA, 22 bp, Homo sapiens
cacacatgagtctccccattgg

SEQ ID NO: 9332053 - DNA, 22 bp, Homo sapiens
cacacatggctgccagggaggt

SEQ ID NO: 9332054 - DNA, 22 bp, Homo sapiens
cacacatgcatgtaagacctct

SEQ ID NO: 9332055 - DNA, 22 bp, Homo sapiens
cacacatgaatccctagtacct

SEQ ID NO: 9332056 - DNA, 22 bp, Homo sapiens
cacacatcttatcccagttatt

SEQ ID NO: 9332057 - DNA, 22 bp, Homo sapiens
cacacatgaagttgctgagcta

SEQ ID NO: 9332058 - DNA, 22 bp, Homo sapiens
cacacatgaatccctagtacct

SEQ ID NO: 9332059 - DNA, 22 bp, Homo sapiens
cacacatcttatcccagttatt

SEQ ID NO: 9332060 - DNA, 22 bp, Homo sapiens
caatttctggaactaattctga

SEQ ID NO: 9332061 - DNA, 22 bp, Homo sapiens
caattcaaatgcatagttcaca

SEQ ID NO: 9332062 - DNA, 22 bp, Homo sapiens
caatttgacttttgaggttgta

SEQ ID NO: 9332063 - DNA, 22 bp, Homo sapiens
caatttctggaactaattctga

SEQ ID NO: 9332064 - DNA, 22 bp, Homo sapiens
caatttctgggcctcacacaag

SEQ ID NO: 9332065 - DNA, 22 bp, Homo sapiens
caatttcttgttaattctcagg

SEQ ID NO: 9332066 - DNA, 22 bp, Homo sapiens
caaggaaaaagcgagctcgggg

SEQ ID NO: 9332067 - DNA, 22 bp, Homo sapiens
caagcttgtttctcctgggggt

SEQ ID NO: 9332068 - DNA, 22 bp, Homo sapiens
caaggaaacatgaaatgcattg

SEQ ID NO: 9332069 - DNA, 22 bp, Homo sapiens
caagctggagttcctcagagtg

SEQ ID NO: 9332070 - DNA, 22 bp, Homo sapiens
caagctggctgggagaggcacg

SEQ ID NO: 9332071 - DNA, 22 bp, Homo sapiens
caagctgggtgcgggcagtata

SEQ ID NO: 9332072 - DNA, 22 bp, Homo sapiens
caagctgggtgcgggcagtata

SEQ ID NO: 9332073 - DNA, 22 bp, Homo sapiens
caagcagaggtttatgtattag

SEQ ID NO: 9332074 - DNA, 22 bp, Homo sapiens
agcaattttcccttagtctttg

SEQ ID NO: 9332075 - DNA, 22 bp, Homo sapiens
agcaattttcccttagtctttg

SEQ ID NO: 9332076 - DNA, 22 bp, Homo sapiens
agcaatttcccatctcttctgc

SEQ ID NO: 9332077 - DNA, 22 bp, Homo sapiens
agcaatttcccatctcttctgc

SEQ ID NO: 9332078 - DNA, 21 bp, Homo sapiens
agcaatttcatttggtttaac

SEQ ID NO: 9332079 - DNA, 22 bp, Homo sapiens
caaggccaaagggccactgtca

SEQ ID NO: 9332080 - DNA, 22 bp, Homo sapiens
caaggccaaagggccactgtca

SEQ ID NO: 9332081 - DNA, 22 bp, Homo sapiens
caaggccaaagggccactgtca

SEQ ID NO: 9332082 - DNA, 22 bp, Homo sapiens
caagggaaggctaagggcaaca

SEQ ID NO: 9332083 - DNA, 22 bp, Homo sapiens
agcagacatggcttggatgtgg

SEQ ID NO: 9332084 - DNA, 22 bp, Homo sapiens
agcagaccaggagtgcacaggt

SEQ ID NO: 9332085 - DNA, 22 bp, Homo sapiens
agcagagacatgaaatatgctt

SEQ ID NO: 9332086 - DNA, 22 bp, Homo sapiens
agcagagaagacacaggcttca

SEQ ID NO: 9332087 - DNA, 22 bp, Homo sapiens
agcagacatatctcatgtcaca

SEQ ID NO: 9332088 - DNA, 22 bp, Homo sapiens
agcagacaggtaggaggataaa

SEQ ID NO: 9332089 - DNA, 21 bp, Homo sapiens
agcagacagcccaagaaaatc

SEQ ID NO: 9332090 - DNA, 22 bp, Homo sapiens
caaggaaggagagatgatgggt

SEQ ID NO: 9332091 - DNA, 22 bp, Homo sapiens
caaggaagacccacgcagatat

SEQ ID NO: 9332092 - DNA, 22 bp, Homo sapiens
caaggaaggagagatgatgggt

SEQ ID NO: 9332093 - DNA, 22 bp, Homo sapiens
caatgtttttccttccttaata

SEQ ID NO: 9332094 - DNA, 21 bp, Homo sapiens
caattactatgaaccagttga

SEQ ID NO: 9332095 - DNA, 22 bp, Homo sapiens
caattatatttagaatgataca

SEQ ID NO: 9332096 - DNA, 22 bp, Homo sapiens
caattatatttagaatgataca

SEQ ID NO: 9332097 - DNA, 22 bp, Homo sapiens
caattatatttagaatgataca

SEQ ID NO: 9332098 - DNA, 22 bp, Homo sapiens
caattattcagtgacttaagag

SEQ ID NO: 9332099 - DNA, 22 bp, Homo sapiens
caattattcagtgacttaagag

SEQ ID NO: 9332100 - DNA, 22 bp, Homo sapiens
caagtgaagatatacagaaaat

SEQ ID NO: 9332101 - DNA, 22 bp, Homo sapiens
caatgatagattttacaaatta

SEQ ID NO: 9332102 - DNA, 22 bp, Homo sapiens
caatgttttgttgaatgaatag

SEQ ID NO: 9332103 - DNA, 22 bp, Homo sapiens
caagggaaggctaagggcaaca

SEQ ID NO: 9332104 - DNA, 22 bp, Homo sapiens
caagggcagaggcagggccccg

SEQ ID NO: 9332105 - DNA, 22 bp, Homo sapiens
caagggagttgctgcatgcagg

SEQ ID NO: 9332106 - DNA, 22 bp, Homo sapiens
caagggcctccaccttgctcgt

SEQ ID NO: 9332107 - DNA, 22 bp, Homo sapiens
caagggccctcggatgatgatg

SEQ ID NO: 9332108 - DNA, 22 bp, Homo sapiens
caagggccatctgagggcactg

SEQ ID NO: 9332109 - DNA, 22 bp, Homo sapiens
caagggccatctgagggcactg

SEQ ID NO: 9332110 - DNA, 22 bp, Homo sapiens
caagggccatctgagggcactg

SEQ ID NO: 9332111 - DNA, 21 bp, Homo sapiens
caagggccagtgagatgggat

SEQ ID NO: 9332112 - DNA, 22 bp, Homo sapiens
caagggcaggagaggatggatg

SEQ ID NO: 9332113 - DNA, 22 bp, Homo sapiens
caagggcagatagctggtccaa

SEQ ID NO: 9332114 - DNA, 22 bp, Homo sapiens
caagtcattgtttagtcatgtt

SEQ ID NO: 9332115 - DNA, 22 bp, Homo sapiens
caagtcccccaagaacagaacc

SEQ ID NO: 9332116 - DNA, 20 bp, Homo sapiens
caaggggagtagtatgggcc

SEQ ID NO: 9332117 - DNA, 22 bp, Homo sapiens
caagtcacttatgtgcagatat

SEQ ID NO: 9332118 - DNA, 22 bp, Homo sapiens
caagggctgctatcagctactg

SEQ ID NO: 9332119 - DNA, 22 bp, Homo sapiens
caagggcttcaagtggccaaga

SEQ ID NO: 9332120 - DNA, 22 bp, Homo sapiens
agcctggaggtaatgaggaaac

SEQ ID NO: 9332121 - DNA, 22 bp, Homo sapiens
cagcactgcttcgcagccaggg

SEQ ID NO: 9332122 - DNA, 18 bp, Homo sapiens
agcctggagggttgaagt

SEQ ID NO: 9332123 - DNA, 18 bp, Homo sapiens
agcctggagggttgaagt

SEQ ID NO: 9332124 - DNA, 19 bp, Homo sapiens
agcctggagggctggtcac

SEQ ID NO: 9332125 - DNA, 19 bp, Homo sapiens
agcctggagggctggtcac

SEQ ID NO: 9332126 - DNA, 22 bp, Homo sapiens
agcctggaggccaggagacagt

SEQ ID NO: 9332127 - DNA, 22 bp, Homo sapiens
agcctggaggccaggagacagt

SEQ ID NO: 9332128 - DNA, 22 bp, Homo sapiens
agcctggagcttgagttatgag

SEQ ID NO: 9332129 - DNA, 22 bp, Homo sapiens
agcctggaggaggagttgagca

SEQ ID NO: 9332130 - DNA, 22 bp, Homo sapiens
agcctggaggaggagttgagca

SEQ ID NO: 9332131 - DNA, 22 bp, Homo sapiens
agcctggagaggcgccatacac

SEQ ID NO: 9332132 - DNA, 22 bp, Homo sapiens
agcctggaattaaggaaatgca

SEQ ID NO: 9332133 - DNA, 22 bp, Homo sapiens
agcctggaattaaggaaatgca

SEQ ID NO: 9332134 - DNA, 22 bp, Homo sapiens
agcctggacagctacggagaac

SEQ ID NO: 9332135 - DNA, 22 bp, Homo sapiens
agcctggaccaggggcctcaga

SEQ ID NO: 9332136 - DNA, 22 bp, Homo sapiens
agcctggaccaggggcctcaga

SEQ ID NO: 9332137 - DNA, 22 bp, Homo sapiens
agcctgcttggcagccctccca

SEQ ID NO: 9332138 - DNA, 22 bp, Homo sapiens
agcctggaagaacctgaagtct

SEQ ID NO: 9332139 - DNA, 22 bp, Homo sapiens
agcctggaagaacctgaagtct

SEQ ID NO: 9332140 - DNA, 22 bp, Homo sapiens
agcctggaattaaggaaatgca

SEQ ID NO: 9332141 - DNA, 22 bp, Homo sapiens
cagatgaactgtgactgaaaat

SEQ ID NO: 9332142 - DNA, 22 bp, Homo sapiens
agcctgagtgcttaggactgtt

SEQ ID NO: 9332143 - DNA, 22 bp, Homo sapiens
agcctgagtgcttaggactgtt

SEQ ID NO: 9332144 - DNA, 22 bp, Homo sapiens
cagatccacccttgtagtgaca

SEQ ID NO: 9332145 - DNA, 22 bp, Homo sapiens
cagatcatgggactgtctcagc

SEQ ID NO: 9332146 - DNA, 23 bp, Homo sapiens
cagatcatatatccagctgtaag

SEQ ID NO: 9332147 - DNA, 22 bp, Homo sapiens
cagatcataacagatacataga

SEQ ID NO: 9332148 - DNA, 22 bp, Homo sapiens
cagatcctgccaggctgagttg

SEQ ID NO: 9332149 - DNA, 22 bp, Homo sapiens
agccggccatgtggtcttgtgc

SEQ ID NO: 9332150 - DNA, 22 bp, Homo sapiens
agccggccatgtggtcttgtgc

SEQ ID NO: 9332151 - DNA, 22 bp, Homo sapiens
agcctagggggtcctgggccac

SEQ ID NO: 9332152 - DNA, 22 bp, Homo sapiens
agcccttcaagagctctgtcct

SEQ ID NO: 9332153 - DNA, 22 bp, Homo sapiens
agcccttcaagagctctgtcct

SEQ ID NO: 9332154 - DNA, 22 bp, Homo sapiens
agcccttcaacctgcctactcc

SEQ ID NO: 9332155 - DNA, 22 bp, Homo sapiens
agcccttagtacatttctcaag

SEQ ID NO: 9332156 - DNA, 22 bp, Homo sapiens
agcccttagtacatttctcaag

SEQ ID NO: 9332157 - DNA, 22 bp, Homo sapiens
agccgagctctgagcagggcct

SEQ ID NO: 9332158 - DNA, 22 bp, Homo sapiens
agccgcgccccatctgagtggg

SEQ ID NO: 9332159 - DNA, 17 bp, Homo sapiens
agccgcctgggtcctgt

SEQ ID NO: 9332160 - DNA, 22 bp, Homo sapiens
agcccttgcagactgtcagcat

SEQ ID NO: 9332161 - DNA, 22 bp, Homo sapiens
agcccttcaagagctctgtcct

SEQ ID NO: 9332162 - DNA, 22 bp, Homo sapiens
cagaggagaattgcgggatcat

SEQ ID NO: 9332163 - DNA, 17 bp, Homo sapiens
cagaggagctttggggg

SEQ ID NO: 9332164 - DNA, 18 bp, Homo sapiens
cagaggagagacattcag

SEQ ID NO: 9332165 - DNA, 18 bp, Homo sapiens
cagaggagagacattcag

SEQ ID NO: 9332166 - DNA, 22 bp, Homo sapiens
cagaggaggcggtatacactgc

SEQ ID NO: 9332167 - DNA, 22 bp, Homo sapiens
cagaggaggcggtatacactgc

SEQ ID NO: 9332168 - DNA, 22 bp, Homo sapiens
cagaggaggcggtatacactgc

SEQ ID NO: 9332169 - DNA, 22 bp, Homo sapiens
cagagtgatggcacctgctggg

SEQ ID NO: 9332170 - DNA, 22 bp, Homo sapiens
cagagtgataaatatagaaatt

SEQ ID NO: 9332171 - DNA, 22 bp, Homo sapiens
cagagtggagaaagcatttagt

SEQ ID NO: 9332172 - DNA, 22 bp, Homo sapiens
cagagtgacattttcccttctc

SEQ ID NO: 9332173 - DNA, 22 bp, Homo sapiens
cagagtgaaataggggatcaag

SEQ ID NO: 9332174 - DNA, 22 bp, Homo sapiens
cagagtgaacagtgggatgtgc

SEQ ID NO: 9332175 - DNA, 22 bp, Homo sapiens
cagagtgaaataggggatcaag

SEQ ID NO: 9332176 - DNA, 22 bp, Homo sapiens
cagaggagtgggccgttatggt

SEQ ID NO: 9332177 - DNA, 22 bp, Homo sapiens
cagaggtgctggagtgagtcct

SEQ ID NO: 9332178 - DNA, 22 bp, Homo sapiens
cagagtgaaataggggatcaag

SEQ ID NO: 9332179 - DNA, 22 bp, Homo sapiens
cagaggtgctggagtgagtcct

SEQ ID NO: 9332180 - DNA, 22 bp, Homo sapiens
agccctgggctgtagataagca

SEQ ID NO: 9332181 - DNA, 22 bp, Homo sapiens
agccctcttccagccagcacag

SEQ ID NO: 9332182 - DNA, 22 bp, Homo sapiens
agccctctctatggccctcttg

SEQ ID NO: 9332183 - DNA, 22 bp, Homo sapiens
agccctctccctttcttcttag

SEQ ID NO: 9332184 - DNA, 21 bp, Homo sapiens
agccctctccaattccctttt

SEQ ID NO: 9332185 - DNA, 22 bp, Homo sapiens
agccctctctatggccctcttg

SEQ ID NO: 9332186 - DNA, 22 bp, Homo sapiens
agccctctctttagagatctga

SEQ ID NO: 9332187 - DNA, 22 bp, Homo sapiens
agccctctgctgttctagtctc

SEQ ID NO: 9332188 - DNA, 22 bp, Homo sapiens
agccctctgctgttctagtctc

SEQ ID NO: 9332189 - DNA, 22 bp, Homo sapiens
agccctctgagctagtcaccat

SEQ ID NO: 9332190 - DNA, 22 bp, Homo sapiens
agccctcctttgttcatgctgc

SEQ ID NO: 9332191 - DNA, 22 bp, Homo sapiens
agccctcctttgttcatgctgc

SEQ ID NO: 9332192 - DNA, 22 bp, Homo sapiens
agccctcctttgttcatgctgc

SEQ ID NO: 9332193 - DNA, 22 bp, Homo sapiens
agccctcctttgttcatgctgc

SEQ ID NO: 9332194 - DNA, 22 bp, Homo sapiens
agccctcctggggccacgctgg

SEQ ID NO: 9332195 - DNA, 22 bp, Homo sapiens
cagagtggcgaccccctcagct

SEQ ID NO: 9332196 - DNA, 22 bp, Homo sapiens
cagagtggcagtcccaggccca

SEQ ID NO: 9332197 - DNA, 22 bp, Homo sapiens
cagagtggcactctgctggatg

SEQ ID NO: 9332198 - DNA, 22 bp, Homo sapiens
cagagtggcagtcccaggccca

SEQ ID NO: 9332199 - DNA, 22 bp, Homo sapiens
cagagtggagatgtgtgtggaa

SEQ ID NO: 9332200 - DNA, 22 bp, Homo sapiens
cagagtggcactctgctggatg

SEQ ID NO: 9332201 - DNA, 22 bp, Homo sapiens
cagagtggcactctgctggatg

SEQ ID NO: 9332202 - DNA, 22 bp, Homo sapiens
cagagtggcactctgctggatg

SEQ ID NO: 9332203 - DNA, 22 bp, Homo sapiens
cagagctgttgcggggcttggc

SEQ ID NO: 9332204 - DNA, 22 bp, Homo sapiens
cagagcttaaaactccatggaa

SEQ ID NO: 9332205 - DNA, 22 bp, Homo sapiens
cagagctgttgcggggcttggc

SEQ ID NO: 9332206 - DNA, 22 bp, Homo sapiens
cagagctgttactattcatgaa

SEQ ID NO: 9332207 - DNA, 20 bp, Homo sapiens
cagagctgttatggatgatg

SEQ ID NO: 9332208 - DNA, 22 bp, Homo sapiens
cagagctgtccaaaccctgaca

SEQ ID NO: 9332209 - DNA, 21 bp, Homo sapiens
cagagctgtccaaaccctgac

SEQ ID NO: 9332210 - DNA, 23 bp, Homo sapiens
cagagctggctcagagctgcctg

SEQ ID NO: 9332211 - DNA, 22 bp, Homo sapiens
cagagccatccaggtgcctgtt

SEQ ID NO: 9332212 - DNA, 22 bp, Homo sapiens
cagagccatcatgatatggagt

SEQ ID NO: 9332213 - DNA, 22 bp, Homo sapiens
cagagccatcccagcctgtggt

SEQ ID NO: 9332214 - DNA, 22 bp, Homo sapiens
cagagcagtagaaaacagcctt

SEQ ID NO: 9332215 - DNA, 18 bp, Homo sapiens
cagagcagtatgaatgtt

SEQ ID NO: 9332216 - DNA, 22 bp, Homo sapiens
cagagcagtccttgtcaatcag

SEQ ID NO: 9332217 - DNA, 22 bp, Homo sapiens
cagagcagtccttgtcaatcag

SEQ ID NO: 9332218 - DNA, 22 bp, Homo sapiens
cagagcagtaaatctggggcac

SEQ ID NO: 9332219 - DNA, 22 bp, Homo sapiens
cagagcagtaaatctggggcac

SEQ ID NO: 9332220 - DNA, 22 bp, Homo sapiens
cagagcagtaaatctggggcac

SEQ ID NO: 9332221 - DNA, 22 bp, Homo sapiens
cagagcagtagaaaacagcctt

SEQ ID NO: 9332222 - DNA, 22 bp, Homo sapiens
cagagcagtagaaaacagcctt

SEQ ID NO: 9332223 - DNA, 22 bp, Homo sapiens
cagagcagtagaaaacagcctt

SEQ ID NO: 9332224 - DNA, 22 bp, Homo sapiens
cagagcagtaaatctggggcac

SEQ ID NO: 9332225 - DNA, 22 bp, Homo sapiens
cagagcaggtatctttggtgaa

SEQ ID NO: 9332226 - DNA, 22 bp, Homo sapiens
cagagcagtaaatctggggcac

SEQ ID NO: 9332227 - DNA, 22 bp, Homo sapiens
cagagccaggtctaggagtctc

SEQ ID NO: 9332228 - DNA, 22 bp, Homo sapiens
cagagccaggtcttgaactcag

SEQ ID NO: 9332229 - DNA, 22 bp, Homo sapiens
cagagccaggcctgccctcttt

SEQ ID NO: 9332230 - DNA, 22 bp, Homo sapiens
cagagcagtctggagatccagc

SEQ ID NO: 9332231 - DNA, 22 bp, Homo sapiens
cagagcagtctggagatccagc

SEQ ID NO: 9332232 - DNA, 22 bp, Homo sapiens
cagagccagggttgcacccctg

SEQ ID NO: 9332233 - DNA, 23 bp, Homo sapiens
agccagggcactggtggagattg

SEQ ID NO: 9332234 - DNA, 22 bp, Homo sapiens
agccagggatggcagtgcccag

SEQ ID NO: 9332235 - DNA, 22 bp, Homo sapiens
agccagggaggtggaggttgca

SEQ ID NO: 9332236 - DNA, 22 bp, Homo sapiens
agccagggatgcagcacagtga

SEQ ID NO: 9332237 - DNA, 22 bp, Homo sapiens
agccagggatgcagcacagtga

SEQ ID NO: 9332238 - DNA, 22 bp, Homo sapiens
cagagcagggtgcaccttgggc

SEQ ID NO: 9332239 - DNA, 22 bp, Homo sapiens
cagagcaggtatctttggtgaa

SEQ ID NO: 9332240 - DNA, 22 bp, Homo sapiens
cagagcagggtgcaccttgggc

SEQ ID NO: 9332241 - DNA, 22 bp, Homo sapiens
agccagggctgcgagcagacag

SEQ ID NO: 9332242 - DNA, 22 bp, Homo sapiens
agccagggctgcaggttccttg

SEQ ID NO: 9332243 - DNA, 22 bp, Homo sapiens
agccagggctgcgagcagacag

SEQ ID NO: 9332244 - DNA, 22 bp, Homo sapiens
agccagggctgcgagcagacag

SEQ ID NO: 9332245 - DNA, 22 bp, Homo sapiens
agccaggggagtcagctgctgg

SEQ ID NO: 9332246 - DNA, 22 bp, Homo sapiens
agccaggctgcagttggctggc

SEQ ID NO: 9332247 - DNA, 22 bp, Homo sapiens
agccaggctgcagttggctggc

SEQ ID NO: 9332248 - DNA, 22 bp, Homo sapiens
agccaggctgcagttggctggc

SEQ ID NO: 9332249 - DNA, 16 bp, Homo sapiens
agccaggctgcctcgg

SEQ ID NO: 9332250 - DNA, 16 bp, Homo sapiens
agccaggctgcctcgg

SEQ ID NO: 9332251 - DNA, 16 bp, Homo sapiens
agccaggctgcctcgg

SEQ ID NO: 9332252 - DNA, 22 bp, Homo sapiens
agccagggaaggataacaagaa

SEQ ID NO: 9332253 - DNA, 22 bp, Homo sapiens
agccagggacgctgcaggctac

SEQ ID NO: 9332254 - DNA, 22 bp, Homo sapiens
agccagggaaggataacaagaa

SEQ ID NO: 9332255 - DNA, 22 bp, Homo sapiens
agccagggaaggataacaagaa

SEQ ID NO: 9332256 - DNA, 22 bp, Homo sapiens
agccagggacgctgcaggctac

SEQ ID NO: 9332257 - DNA, 22 bp, Homo sapiens
agccaggccttttctcaaggtt

SEQ ID NO: 9332258 - DNA, 22 bp, Homo sapiens
agccaggctcaaggcctgctcc

SEQ ID NO: 9332259 - DNA, 22 bp, Homo sapiens
agccaagcactcaactcctgga

SEQ ID NO: 9332260 - DNA, 22 bp, Homo sapiens
agccaactccagcccctgcagc

SEQ ID NO: 9332261 - DNA, 22 bp, Homo sapiens
agccaactccagcccctgcagc

SEQ ID NO: 9332262 - DNA, 20 bp, Homo sapiens
agccaagaacaggcagaacc

SEQ ID NO: 9332263 - DNA, 22 bp, Homo sapiens
agccaagagatgaggctgcagg

SEQ ID NO: 9332264 - DNA, 22 bp, Homo sapiens
agccaagagatgaggctgcagg

SEQ ID NO: 9332265 - DNA, 22 bp, Homo sapiens
agccaagagacagatgcccacc

SEQ ID NO: 9332266 - DNA, 22 bp, Homo sapiens
cagcctctgtggctgccacacc

SEQ ID NO: 9332267 - DNA, 22 bp, Homo sapiens
cagcctctgacaccacagtcgt

SEQ ID NO: 9332268 - DNA, 22 bp, Homo sapiens
cagcctctctgtatctcaggat

SEQ ID NO: 9332269 - DNA, 22 bp, Homo sapiens
cagcctctgacaccacagtcgt

SEQ ID NO: 9332270 - DNA, 22 bp, Homo sapiens
cagcctctgacaccacagtcgt

SEQ ID NO: 9332271 - DNA, 22 bp, Homo sapiens
cagcctctgagccttggcagat

SEQ ID NO: 9332272 - DNA, 22 bp, Homo sapiens
cagcctctgtggctgccacacc

SEQ ID NO: 9332273 - DNA, 22 bp, Homo sapiens
cagcgtctcgttgtgggcctcg

SEQ ID NO: 9332274 - DNA, 22 bp, Homo sapiens
cagcggccggtgaggaagggga

SEQ ID NO: 9332275 - DNA, 22 bp, Homo sapiens
cagcggaggacagatgggagct

SEQ ID NO: 9332276 - DNA, 22 bp, Homo sapiens
cagcgctgtgggaacagggcta

SEQ ID NO: 9332277 - DNA, 22 bp, Homo sapiens
cagcgcctcctggacctcctct

SEQ ID NO: 9332278 - DNA, 22 bp, Homo sapiens
cagcgcagtgtaggtggggggc

SEQ ID NO: 9332279 - DNA, 22 bp, Homo sapiens
cagcgctggggtaggagcacct

SEQ ID NO: 9332280 - DNA, 22 bp, Homo sapiens
cagcgcaggcgtgtgaaggcgc

SEQ ID NO: 9332281 - DNA, 22 bp, Homo sapiens
cagctgccatgacatgtcctgc

SEQ ID NO: 9332282 - DNA, 22 bp, Homo sapiens
cagctgccagcttctctccatc

SEQ ID NO: 9332283 - DNA, 22 bp, Homo sapiens
cagctgccagcttctctccatc

SEQ ID NO: 9332284 - DNA, 22 bp, Homo sapiens
cagctgccatgacatgtcctgc

SEQ ID NO: 9332285 - DNA, 22 bp, Homo sapiens
cagctgcccaggccacctggag

SEQ ID NO: 9332286 - DNA, 22 bp, Homo sapiens
cagctgcccaagccccagatgt

SEQ ID NO: 9332287 - DNA, 22 bp, Homo sapiens
cagctgagcatcactagtctgg

SEQ ID NO: 9332288 - DNA, 18 bp, Homo sapiens
cagctgccagctcatgga

SEQ ID NO: 9332289 - DNA, 22 bp, Homo sapiens
cagctgccacttgctctcggct

SEQ ID NO: 9332290 - DNA, 18 bp, Homo sapiens
cagctgccagctcatgga

SEQ ID NO: 9332291 - DNA, 22 bp, Homo sapiens
cagctgccagcttctctccatc

SEQ ID NO: 9332292 - DNA, 18 bp, Homo sapiens
cagctgccagctcatgga

SEQ ID NO: 9332293 - DNA, 18 bp, Homo sapiens
cagctgccagctcatgga

SEQ ID NO: 9332294 - DNA, 18 bp, Homo sapiens
cagctgccagctcatgga

SEQ ID NO: 9332295 - DNA, 18 bp, Homo sapiens
cagctgccagctcatgga

SEQ ID NO: 9332296 - DNA, 22 bp, Homo sapiens
cagctgccccgctggctgacca

SEQ ID NO: 9332297 - DNA, 22 bp, Homo sapiens
cagctgccccataaatcacagt

SEQ ID NO: 9332298 - DNA, 22 bp, Homo sapiens
cagctgcccctccagggctggg

SEQ ID NO: 9332299 - DNA, 22 bp, Homo sapiens
agctctggaagccctggtagtt

SEQ ID NO: 9332300 - DNA, 22 bp, Homo sapiens
agctctggaagccctggtagtt

SEQ ID NO: 9332301 - DNA, 22 bp, Homo sapiens
cagctgcccaggccacctggag

SEQ ID NO: 9332302 - DNA, 22 bp, Homo sapiens
cagctgccccgctggctgacca

SEQ ID NO: 9332303 - DNA, 22 bp, Homo sapiens
agctctggaataatgatgtgat

SEQ ID NO: 9332304 - DNA, 22 bp, Homo sapiens
agctctggacctgacatctggt

SEQ ID NO: 9332305 - DNA, 21 bp, Homo sapiens
agctctggagcagcaatcaag

SEQ ID NO: 9332306 - DNA, 22 bp, Homo sapiens
agctctggacctgacatctggt

SEQ ID NO: 9332307 - DNA, 22 bp, Homo sapiens
agctctggagccggaggatttc

SEQ ID NO: 9332308 - DNA, 22 bp, Homo sapiens
agctctggagccggaggatttc

SEQ ID NO: 9332309 - DNA, 22 bp, Homo sapiens
agctctggagccggaggatttc

SEQ ID NO: 9332310 - DNA, 22 bp, Homo sapiens
agctctggagccggaggatttc

SEQ ID NO: 9332311 - DNA, 22 bp, Homo sapiens
agctctggagccggaggatttc

SEQ ID NO: 9332312 - DNA, 21 bp, Homo sapiens
agctctggagcagcaatcaag

SEQ ID NO: 9332313 - DNA, 20 bp, Homo sapiens
agctgaggcacctgaggtta

SEQ ID NO: 9332314 - DNA, 22 bp, Homo sapiens
cagctgctttcagcaggaggga

SEQ ID NO: 9332315 - DNA, 22 bp, Homo sapiens
cagctgctttcagcaggaggga

SEQ ID NO: 9332316 - DNA, 22 bp, Homo sapiens
cagctgctttcagcaggaggga

SEQ ID NO: 9332317 - DNA, 22 bp, Homo sapiens
cagctgctttagttttccatcc

SEQ ID NO: 9332318 - DNA, 22 bp, Homo sapiens
cagctggacttttgatagaagt

SEQ ID NO: 9332319 - DNA, 22 bp, Homo sapiens
cagctggatccctgcagaactt

SEQ ID NO: 9332320 - DNA, 22 bp, Homo sapiens
cagctggatgggagaccatgtt

SEQ ID NO: 9332321 - DNA, 22 bp, Homo sapiens
cagctggcaagtggagcagggt

SEQ ID NO: 9332322 - DNA, 22 bp, Homo sapiens
cagctggcaagtggagcagggt

SEQ ID NO: 9332323 - DNA, 22 bp, Homo sapiens
cagctggcaagtggagcagggt

SEQ ID NO: 9332324 - DNA, 22 bp, Homo sapiens
cagctggcagaacctgcatcca

SEQ ID NO: 9332325 - DNA, 22 bp, Homo sapiens
cagctggcagaacctgcatcca

SEQ ID NO: 9332326 - DNA, 22 bp, Homo sapiens
cagctggcagccctggccctgc

SEQ ID NO: 9332327 - DNA, 22 bp, Homo sapiens
cagctggcatacctgggcccgg

SEQ ID NO: 9332328 - DNA, 22 bp, Homo sapiens
cagctggcagccctggccctgc

SEQ ID NO: 9332329 - DNA, 22 bp, Homo sapiens
cagctggcatacctgggcccgg

SEQ ID NO: 9332330 - DNA, 22 bp, Homo sapiens
cagctgggtggctcttctgctc

SEQ ID NO: 9332331 - DNA, 22 bp, Homo sapiens
cagctgggtggctcttctgctc

SEQ ID NO: 9332332 - DNA, 22 bp, Homo sapiens
cagctggcatacctgggcccgg

SEQ ID NO: 9332333 - DNA, 22 bp, Homo sapiens
agctgaggaggaatgatgggta

SEQ ID NO: 9332334 - DNA, 22 bp, Homo sapiens
agctgaggaggaatgatgggta

SEQ ID NO: 9332335 - DNA, 22 bp, Homo sapiens
agctgaggacgtgaagggcggc

SEQ ID NO: 9332336 - DNA, 17 bp, Homo sapiens
agctgagctggccaggg

SEQ ID NO: 9332337 - DNA, 17 bp, Homo sapiens
agctgagctggccaggg

SEQ ID NO: 9332338 - DNA, 20 bp, Homo sapiens
agctgaagatctggatgggg

SEQ ID NO: 9332339 - DNA, 20 bp, Homo sapiens
agctgaagatctggatgggg

SEQ ID NO: 9332340 - DNA, 22 bp, Homo sapiens
agctctgggattctcaggccac

SEQ ID NO: 9332341 - DNA, 22 bp, Homo sapiens
agctctgggagtagttccacct

SEQ ID NO: 9332342 - DNA, 22 bp, Homo sapiens
agctctgggattctcaggccac

SEQ ID NO: 9332343 - DNA, 22 bp, Homo sapiens
agctctggcactggcgcgggat

SEQ ID NO: 9332344 - DNA, 22 bp, Homo sapiens
agctctggcactggcgcgggat

SEQ ID NO: 9332345 - DNA, 22 bp, Homo sapiens
agctctggcactggcgcgggat

SEQ ID NO: 9332346 - DNA, 19 bp, Homo sapiens
agctctggattaaatttct

SEQ ID NO: 9332347 - DNA, 22 bp, Homo sapiens
agctctggcactggcgcgggat

SEQ ID NO: 9332348 - DNA, 22 bp, Homo sapiens
agctctggcactggcgcgggat

SEQ ID NO: 9332349 - DNA, 23 bp, Homo sapiens
agctctggcgttggggaggtagt

SEQ ID NO: 9332350 - DNA, 23 bp, Homo sapiens
agctctggcgttggggaggtagt

SEQ ID NO: 9332351 - DNA, 23 bp, Homo sapiens
agctctggcgttggggaggtagt

SEQ ID NO: 9332352 - DNA, 22 bp, Homo sapiens
agctctgggagtagttccacct

SEQ ID NO: 9332353 - DNA, 23 bp, Homo sapiens
agctctggcgttggggaggtagt

SEQ ID NO: 9332354 - DNA, 22 bp, Homo sapiens
cagcactgtgataactgagcca

SEQ ID NO: 9332355 - DNA, 22 bp, Homo sapiens
cagcactgggaccactagaaca

SEQ ID NO: 9332356 - DNA, 22 bp, Homo sapiens
cagcactgggaccactagaaca

SEQ ID NO: 9332357 - DNA, 22 bp, Homo sapiens
cagcactggggccactggagtt

SEQ ID NO: 9332358 - DNA, 22 bp, Homo sapiens
cagcactttgagggctcttaat

SEQ ID NO: 9332359 - DNA, 22 bp, Homo sapiens
cagcacttcagcattcagattt

SEQ ID NO: 9332360 - DNA, 22 bp, Homo sapiens
cagcacttgagctttcatgtaa

SEQ ID NO: 9332361 - DNA, 22 bp, Homo sapiens
cagcactgttcccagaccactg

SEQ ID NO: 9332362 - DNA, 22 bp, Homo sapiens
cagcatggacaggggtggcgtt

SEQ ID NO: 9332363 - DNA, 22 bp, Homo sapiens
cagcagaaaatgtgggtgattt

SEQ ID NO: 9332364 - DNA, 22 bp, Homo sapiens
cagcatggagacaaagtgggca

SEQ ID NO: 9332365 - DNA, 22 bp, Homo sapiens
agcgaggttttgcagatacagc

SEQ ID NO: 9332366 - DNA, 22 bp, Homo sapiens
agcgagggaggtctgaggacag

SEQ ID NO: 9332367 - DNA, 22 bp, Homo sapiens
agcgcaggaacacgtctgcctt

SEQ ID NO: 9332368 - DNA, 22 bp, Homo sapiens
agcgccactgcactccagcctg

SEQ ID NO: 9332369 - DNA, 22 bp, Homo sapiens
agcgcctgcggtgtgagcctgc

SEQ ID NO: 9332370 - DNA, 22 bp, Homo sapiens
agcgcctgcaccactctgcggc

SEQ ID NO: 9332371 - DNA, 22 bp, Homo sapiens
agcgcctgcggtgtgagcctgc

SEQ ID NO: 9332372 - DNA, 22 bp, Homo sapiens
agcgctggctggcgctccttcc

SEQ ID NO: 9332373 - DNA, 22 bp, Homo sapiens
agcgctggtgatctctattttg

SEQ ID NO: 9332374 - DNA, 22 bp, Homo sapiens
agcgccgcccctgctggtgttg

SEQ ID NO: 9332375 - DNA, 22 bp, Homo sapiens
cagcatgggggcaattcaggtg

SEQ ID NO: 9332376 - DNA, 22 bp, Homo sapiens
cagcatgggttccgggggcctg

SEQ ID NO: 9332377 - DNA, 22 bp, Homo sapiens
cagcatggggatcactgtaggc

SEQ ID NO: 9332378 - DNA, 22 bp, Homo sapiens
cagcatggggcttggagtcagc

SEQ ID NO: 9332379 - DNA, 22 bp, Homo sapiens
cagcatggggcttggagtcagc

SEQ ID NO: 9332380 - DNA, 22 bp, Homo sapiens
cagcatggtggagctgctcttt

SEQ ID NO: 9332381 - DNA, 22 bp, Homo sapiens
cagcatggtgccagtgagtcca

SEQ ID NO: 9332382 - DNA, 22 bp, Homo sapiens
cagcatgtaagccactgccctg

SEQ ID NO: 9332383 - DNA, 22 bp, Homo sapiens
cagcatgtggattcctcccact

SEQ ID NO: 9332384 - DNA, 22 bp, Homo sapiens
agcgagggaggtctgaggacag

SEQ ID NO: 9332385 - DNA, 22 bp, Homo sapiens
cagccctggtgaggttggctat

SEQ ID NO: 9332386 - DNA, 22 bp, Homo sapiens
cagccctggtgaggttggctat

SEQ ID NO: 9332387 - DNA, 22 bp, Homo sapiens
cagccctggtgaggttggctat

SEQ ID NO: 9332388 - DNA, 22 bp, Homo sapiens
cagcccatttctgggacctgag

SEQ ID NO: 9332389 - DNA, 22 bp, Homo sapiens
cagcccattcctgccatgccgc

SEQ ID NO: 9332390 - DNA, 22 bp, Homo sapiens
cagccccacacggtctagctct

SEQ ID NO: 9332391 - DNA, 22 bp, Homo sapiens
cagcctcctgggacactcaccg

SEQ ID NO: 9332392 - DNA, 22 bp, Homo sapiens
cagcctctaagcacagcctctc

SEQ ID NO: 9332393 - DNA, 22 bp, Homo sapiens
cagcccagtgcacgcccgtttc

SEQ ID NO: 9332394 - DNA, 22 bp, Homo sapiens
cagcccagtaccaagcagttgg

SEQ ID NO: 9332395 - DNA, 22 bp, Homo sapiens
cagcccagtgcacgcccgtttc

SEQ ID NO: 9332396 - DNA, 22 bp, Homo sapiens
cagcccatccaaggcttggcat

SEQ ID NO: 9332397 - DNA, 22 bp, Homo sapiens
cagcccatggtttgtggccagt

SEQ ID NO: 9332398 - DNA, 22 bp, Homo sapiens
cagcccaggtctctcttccagt

SEQ ID NO: 9332399 - DNA, 22 bp, Homo sapiens
cagcccacgtcagggccactca

SEQ ID NO: 9332400 - DNA, 22 bp, Homo sapiens
cagcccaaagccccaggctaga

SEQ ID NO: 9332401 - DNA, 22 bp, Homo sapiens
cagccatgagtctaagcagttt

SEQ ID NO: 9332402 - DNA, 22 bp, Homo sapiens
agcgctgtgggcgtgcgaggag

SEQ ID NO: 9332403 - DNA, 22 bp, Homo sapiens
agcgctgtgggcgtgcgaggag

SEQ ID NO: 9332404 - DNA, 22 bp, Homo sapiens
agcggaaggcctggctgatccg

SEQ ID NO: 9332405 - DNA, 22 bp, Homo sapiens
cagccatactgacatcaacaaa

SEQ ID NO: 9332406 - DNA, 22 bp, Homo sapiens
cagccagtgtgaccgaggagga

SEQ ID NO: 9332407 - DNA, 22 bp, Homo sapiens
cagccagtggttgaagatgcag

SEQ ID NO: 9332408 - DNA, 22 bp, Homo sapiens
cagccagctggcactgtgagta

SEQ ID NO: 9332409 - DNA, 22 bp, Homo sapiens
cagcccagagaaggggcccgtg

SEQ ID NO: 9332410 - DNA, 22 bp, Homo sapiens
cagcccacttcccagcacctac

SEQ ID NO: 9332411 - DNA, 21 bp, Homo sapiens
cagcccagagcagtggggcca

SEQ ID NO: 9332412 - DNA, 22 bp, Homo sapiens
cagcccagagaaggggcccgtg

SEQ ID NO: 9332413 - DNA, 22 bp, Homo sapiens
acaaatatttactgaatccact

SEQ ID NO: 9332414 - DNA, 22 bp, Homo sapiens
acaaatatttactgaatccact

SEQ ID NO: 9332415 - DNA, 22 bp, Homo sapiens
aagaatcattgtaaagttctgt

SEQ ID NO: 9332416 - DNA, 22 bp, Homo sapiens
acaaatgaacatataagcttga

SEQ ID NO: 9332417 - DNA, 22 bp, Homo sapiens
acaaatctgttttatagacttt

SEQ ID NO: 9332418 - DNA, 20 bp, Homo sapiens
acaaattggcagaatgacaa

SEQ ID NO: 9332419 - DNA, 22 bp, Homo sapiens
acaaattgggtatgagctaaga

SEQ ID NO: 9332420 - DNA, 19 bp, Homo sapiens
acaaattgtcctcatcaag

SEQ ID NO: 9332421 - DNA, 22 bp, Homo sapiens
acaaatgaatcatacataatgt

SEQ ID NO: 9332422 - DNA, 22 bp, Homo sapiens
acaaatgaatcatacataatgt

SEQ ID NO: 9332423 - DNA, 22 bp, Homo sapiens
acaaaacagtgttcctgcccct

SEQ ID NO: 9332424 - DNA, 22 bp, Homo sapiens
acaaaagaataagatgagtcat

SEQ ID NO: 9332425 - DNA, 22 bp, Homo sapiens
acaaaagtgagtgtgtctcaga

SEQ ID NO: 9332426 - DNA, 22 bp, Homo sapiens
acaaaagtgtaggaattcctta

SEQ ID NO: 9332427 - DNA, 22 bp, Homo sapiens
acaaaagtgtaggaattcctta

SEQ ID NO: 9332428 - DNA, 22 bp, Homo sapiens
acaaaagtgtaggaattcctta

SEQ ID NO: 9332429 - DNA, 22 bp, Homo sapiens
acaaaagtgtaggaattcctta

SEQ ID NO: 9332430 - DNA, 22 bp, Homo sapiens
aagaatatctgttttatttagg

SEQ ID NO: 9332431 - DNA, 22 bp, Homo sapiens
aagaatatctgttttatttagg

SEQ ID NO: 9332432 - DNA, 22 bp, Homo sapiens
aagaatatagattttttgaagt

SEQ ID NO: 9332433 - DNA, 22 bp, Homo sapiens
aagaatatagattttttgaagt

SEQ ID NO: 9332434 - DNA, 22 bp, Homo sapiens
acaaaatagagttctcccctgg

SEQ ID NO: 9332435 - DNA, 17 bp, Homo sapiens
aagaatcattagagaag

SEQ ID NO: 9332436 - DNA, 22 bp, Homo sapiens
aagaatcatctgaactttgagg

SEQ ID NO: 9332437 - DNA, 22 bp, Homo sapiens
aattttatctctaagcaggctt

SEQ ID NO: 9332438 - DNA, 19 bp, Homo sapiens
aagaagcaataagctgtga

SEQ ID NO: 9332439 - DNA, 22 bp, Homo sapiens
aattttatctctaagcaggctt

SEQ ID NO: 9332440 - DNA, 22 bp, Homo sapiens
acaaaaagggagatgaggtaga

SEQ ID NO: 9332441 - DNA, 22 bp, Homo sapiens
acaaaaattagctgggcatggt

SEQ ID NO: 9332442 - DNA, 22 bp, Homo sapiens
acaaaaattagctgggcatggt

SEQ ID NO: 9332443 - DNA, 22 bp, Homo sapiens
acaaaaattagctgggcatggt

SEQ ID NO: 9332444 - DNA, 22 bp, Homo sapiens
aagaagagaaatgtgctgctgg

SEQ ID NO: 9332445 - DNA, 22 bp, Homo sapiens
aagaagaagtgttatttttaga

SEQ ID NO: 9332446 - DNA, 22 bp, Homo sapiens
aagaagaattattccctaatca

SEQ ID NO: 9332447 - DNA, 22 bp, Homo sapiens
aagaacattgatattgtctatg

SEQ ID NO: 9332448 - DNA, 22 bp, Homo sapiens
aagaacattttgtagaatgaca

SEQ ID NO: 9332449 - DNA, 22 bp, Homo sapiens
aagaacattttgtagaatgaca

SEQ ID NO: 9332450 - DNA, 22 bp, Homo sapiens
aagaacatgttaaaagattcac

SEQ ID NO: 9332451 - DNA, 22 bp, Homo sapiens
aagaacattcgaactattttct

SEQ ID NO: 9332452 - DNA, 22 bp, Homo sapiens
aagaacattcgaactattttct

SEQ ID NO: 9332453 - DNA, 22 bp, Homo sapiens
aagaacattgatattgtctatg

SEQ ID NO: 9332454 - DNA, 22 bp, Homo sapiens
aatgtacaagggttccagtttt

SEQ ID NO: 9332455 - DNA, 22 bp, Homo sapiens
aagaacaggttctagaaccatt

SEQ ID NO: 9332456 - DNA, 22 bp, Homo sapiens
acacacatgcctttcctaagta

SEQ ID NO: 9332457 - DNA, 22 bp, Homo sapiens
acacacatgcctttcctaagta

SEQ ID NO: 9332458 - DNA, 22 bp, Homo sapiens
acacacatgcctttcctaagta

SEQ ID NO: 9332459 - DNA, 22 bp, Homo sapiens
acaatgttctacatatacataa

SEQ ID NO: 9332460 - DNA, 17 bp, Homo sapiens
acacagacaggcagaca

SEQ ID NO: 9332461 - DNA, 22 bp, Homo sapiens
acacagagcaaatcatgacaga

SEQ ID NO: 9332462 - DNA, 22 bp, Homo sapiens
acacagcaacttgcagtatgga

SEQ ID NO: 9332463 - DNA, 22 bp, Homo sapiens
acacagcaacttgcagtatgga

SEQ ID NO: 9332464 - DNA, 22 bp, Homo sapiens
aagataacaggaggagtttgta

SEQ ID NO: 9332465 - DNA, 22 bp, Homo sapiens
aagatacaaatgtcaatattgg

SEQ ID NO: 9332466 - DNA, 22 bp, Homo sapiens
aagatacacggtcaactctcaa

SEQ ID NO: 9332467 - DNA, 22 bp, Homo sapiens
aagatacaaatgtcaatattgg

SEQ ID NO: 9332468 - DNA, 22 bp, Homo sapiens
acacagccgtgaatctgcttct

SEQ ID NO: 9332469 - DNA, 22 bp, Homo sapiens
acacagccccacggtgagcaaa

SEQ ID NO: 9332470 - DNA, 22 bp, Homo sapiens
acacagctttcagtcattatct

SEQ ID NO: 9332471 - DNA, 22 bp, Homo sapiens
acacagctagtgagtggcagag

SEQ ID NO: 9332472 - DNA, 22 bp, Homo sapiens
acacagctatggggtaggaaac

SEQ ID NO: 9332473 - DNA, 20 bp, Homo sapiens
acaatagatttgagcaaagt

SEQ ID NO: 9332474 - DNA, 22 bp, Homo sapiens
acaatagagttctcataggaca

SEQ ID NO: 9332475 - DNA, 22 bp, Homo sapiens
acaatagacccatgacacatac

SEQ ID NO: 9332476 - DNA, 22 bp, Homo sapiens
acaatagacccatgacacatac

SEQ ID NO: 9332477 - DNA, 22 bp, Homo sapiens
acaatatacacatcctaatggg

SEQ ID NO: 9332478 - DNA, 22 bp, Homo sapiens
acaaggcttcatattcttttta

SEQ ID NO: 9332479 - DNA, 22 bp, Homo sapiens
acaacaaaatcactagtcttcc

SEQ ID NO: 9332480 - DNA, 22 bp, Homo sapiens
acaacaaaatcactagtcttcc

SEQ ID NO: 9332481 - DNA, 21 bp, Homo sapiens
acaaattgtttatataggaag

SEQ ID NO: 9332482 - DNA, 21 bp, Homo sapiens
acaaattgtttatataggaag

SEQ ID NO: 9332483 - DNA, 22 bp, Homo sapiens
acaaattgttgcttcatgaatg

SEQ ID NO: 9332484 - DNA, 22 bp, Homo sapiens
acaaatttcataggcaaatttt

SEQ ID NO: 9332485 - DNA, 22 bp, Homo sapiens
acaaatttggtgagagtaaata

SEQ ID NO: 9332486 - DNA, 22 bp, Homo sapiens
acaatgtagagtaaaatatgtt

SEQ ID NO: 9332487 - DNA, 22 bp, Homo sapiens
acaatgtagagtaaaatatgtt

SEQ ID NO: 9332488 - DNA, 22 bp, Homo sapiens
acaatatagtccatgagcatgc

SEQ ID NO: 9332489 - DNA, 22 bp, Homo sapiens
acaatatagtccatgagcatgc

SEQ ID NO: 9332490 - DNA, 22 bp, Homo sapiens
acaatatacacatcctaatggg

SEQ ID NO: 9332491 - DNA, 22 bp, Homo sapiens
acaatatagtccatgagcatgc

SEQ ID NO: 9332492 - DNA, 22 bp, Homo sapiens
acaatatagtccatgagcatgc

SEQ ID NO: 9332493 - DNA, 22 bp, Homo sapiens
acaatgtgacctgacagtgtta

SEQ ID NO: 9332494 - DNA, 22 bp, Homo sapiens
acaatgtgataatttaaagata

SEQ ID NO: 9332495 - DNA, 22 bp, Homo sapiens
acaatgtgtttttatacatttg

SEQ ID NO: 9332496 - DNA, 22 bp, Homo sapiens
acaatgtgggcatgagaaacca

SEQ ID NO: 9332497 - DNA, 22 bp, Homo sapiens
acaatgtagttgtcatgagaca

SEQ ID NO: 9332498 - DNA, 22 bp, Homo sapiens
acaatgtaggctgaaaaagctt

SEQ ID NO: 9332499 - DNA, 22 bp, Homo sapiens
acaatgtaggatatgtacttgt

SEQ ID NO: 9332500 - DNA, 22 bp, Homo sapiens
acaatgtagagtaaaatatgtt

SEQ ID NO: 9332501 - DNA, 22 bp, Homo sapiens
acacttcatagcaaggttggag

SEQ ID NO: 9332502 - DNA, 22 bp, Homo sapiens
acactggttgttaatagtaaca

SEQ ID NO: 9332503 - DNA, 18 bp, Homo sapiens
acacttcctggtggtgtg

SEQ ID NO: 9332504 - DNA, 18 bp, Homo sapiens
acacttcctggtggtgtg

SEQ ID NO: 9332505 - DNA, 22 bp, Homo sapiens
acacttggagcaacacttatgg

SEQ ID NO: 9332506 - DNA, 22 bp, Homo sapiens
acacttggagcaacacttatgg

SEQ ID NO: 9332507 - DNA, 22 bp, Homo sapiens
acagaaagatgatttgaaatgg

SEQ ID NO: 9332508 - DNA, 23 bp, Homo sapiens
acagaaagttctgctggacagag

SEQ ID NO: 9332509 - DNA, 20 bp, Homo sapiens
acagaaagctgccttgtccc

SEQ ID NO: 9332510 - DNA, 20 bp, Homo sapiens
acagaaagctgccttgtccc

SEQ ID NO: 9332511 - DNA, 22 bp, Homo sapiens
aagatacatatttgttctagtg

SEQ ID NO: 9332512 - DNA, 22 bp, Homo sapiens
aagatacatatttgttctagtg

SEQ ID NO: 9332513 - DNA, 22 bp, Homo sapiens
aagatacacgttgtattgaata

SEQ ID NO: 9332514 - DNA, 22 bp, Homo sapiens
aagatacacgttgtattgaata

SEQ ID NO: 9332515 - DNA, 22 bp, Homo sapiens
aagatacacgttgtattgaata

SEQ ID NO: 9332516 - DNA, 20 bp, Homo sapiens
acacatatagcagcataaac

SEQ ID NO: 9332517 - DNA, 22 bp, Homo sapiens
acacatatatacatatttgtgc

SEQ ID NO: 9332518 - DNA, 22 bp, Homo sapiens
acactggtgtagttttctgcag

SEQ ID NO: 9332519 - DNA, 22 bp, Homo sapiens
acacatataccactgtaaatga

SEQ ID NO: 9332520 - DNA, 20 bp, Homo sapiens
acacatatagcagcataaac

SEQ ID NO: 9332521 - DNA, 20 bp, Homo sapiens
acacatatagcagcataaac

SEQ ID NO: 9332522 - DNA, 17 bp, Homo sapiens
acacatacatgggccat

SEQ ID NO: 9332523 - DNA, 22 bp, Homo sapiens
acacatacatggggaagatgag

SEQ ID NO: 9332524 - DNA, 22 bp, Homo sapiens
acacatataccactgtaaatga

SEQ ID NO: 9332525 - DNA, 22 bp, Homo sapiens
acacatataccactgtaaatga

SEQ ID NO: 9332526 - DNA, 22 bp, Homo sapiens
acacatagaaaataaatagtta

SEQ ID NO: 9332527 - DNA, 22 bp, Homo sapiens
acagactaaaattgcacagtgg

SEQ ID NO: 9332528 - DNA, 22 bp, Homo sapiens
acagacctgattcaagtcttga

SEQ ID NO: 9332529 - DNA, 22 bp, Homo sapiens
acagactgattcattgctcagg

SEQ ID NO: 9332530 - DNA, 22 bp, Homo sapiens
acagactggcctgtctcgcacc

SEQ ID NO: 9332531 - DNA, 22 bp, Homo sapiens
acagagatgaataatacaggtg

SEQ ID NO: 9332532 - DNA, 20 bp, Homo sapiens
acagagatcctctctttatc

SEQ ID NO: 9332533 - DNA, 22 bp, Homo sapiens
acagagcaataacagggagagg

SEQ ID NO: 9332534 - DNA, 22 bp, Homo sapiens
acagagcaatgcgtgttctcta

SEQ ID NO: 9332535 - DNA, 22 bp, Homo sapiens
acagagcaatgcgtgttctcta

SEQ ID NO: 9332536 - DNA, 22 bp, Homo sapiens
acagagcaactttatttcatgg

SEQ ID NO: 9332537 - DNA, 22 bp, Homo sapiens
acagagcaacttgagtatcctc

SEQ ID NO: 9332538 - DNA, 22 bp, Homo sapiens
acagacatttaataaatgctga

SEQ ID NO: 9332539 - DNA, 22 bp, Homo sapiens
acagacatttaataaatgctga

SEQ ID NO: 9332540 - DNA, 19 bp, Homo sapiens
acagacatttgcaattagc

SEQ ID NO: 9332541 - DNA, 22 bp, Homo sapiens
acagacattttaagacacttta

SEQ ID NO: 9332542 - DNA, 22 bp, Homo sapiens
acagacattttaagacacttta

SEQ ID NO: 9332543 - DNA, 22 bp, Homo sapiens
acagacattttaagacacttta

SEQ ID NO: 9332544 - DNA, 23 bp, Homo sapiens
acagacaacactgatgagagaaa

SEQ ID NO: 9332545 - DNA, 23 bp, Homo sapiens
acagacaacactgatgagagaaa

SEQ ID NO: 9332546 - DNA, 23 bp, Homo sapiens
acagacattccataatgtacacc

SEQ ID NO: 9332547 - DNA, 23 bp, Homo sapiens
acagacattccataatgtacacc

SEQ ID NO: 9332548 - DNA, 23 bp, Homo sapiens
acagacattccataatgtacacc

SEQ ID NO: 9332549 - DNA, 22 bp, Homo sapiens
acagaaataactttttatgttt

SEQ ID NO: 9332550 - DNA, 18 bp, Homo sapiens
acagaaatagctgtgcct

SEQ ID NO: 9332551 - DNA, 18 bp, Homo sapiens
acagaaatagctgtgcct

SEQ ID NO: 9332552 - DNA, 22 bp, Homo sapiens
acagaaatattcgtggtgcttg

SEQ ID NO: 9332553 - DNA, 23 bp, Homo sapiens
acagacaacactgatgagagaaa

SEQ ID NO: 9332554 - DNA, 22 bp, Homo sapiens
acagaaatgatgtttggcaata

SEQ ID NO: 9332555 - DNA, 22 bp, Homo sapiens
aagccaggttccatggaggagc

SEQ ID NO: 9332556 - DNA, 22 bp, Homo sapiens
acagccagggacatacaatggt

SEQ ID NO: 9332557 - DNA, 22 bp, Homo sapiens
acagccagggacatacaatggt

SEQ ID NO: 9332558 - DNA, 22 bp, Homo sapiens
aagccaggttccatggaggagc

SEQ ID NO: 9332559 - DNA, 22 bp, Homo sapiens
aagcccagcatccctgcaccag

SEQ ID NO: 9332560 - DNA, 23 bp, Homo sapiens
acagccaggatgggagcagaagc

SEQ ID NO: 9332561 - DNA, 22 bp, Homo sapiens
acagccaggcccagcacgcagg

SEQ ID NO: 9332562 - DNA, 22 bp, Homo sapiens
acagccaggaggaactcagtga

SEQ ID NO: 9332563 - DNA, 22 bp, Homo sapiens
acagcaggttacagtggcacag

SEQ ID NO: 9332564 - DNA, 22 bp, Homo sapiens
acagcaggttacagtggcacag

SEQ ID NO: 9332565 - DNA, 19 bp, Homo sapiens
acagcaggtgtggggataa

SEQ ID NO: 9332566 - DNA, 19 bp, Homo sapiens
acagcaggtgtggggataa

SEQ ID NO: 9332567 - DNA, 22 bp, Homo sapiens
acagccagatctgagagatctt

SEQ ID NO: 9332568 - DNA, 22 bp, Homo sapiens
acagccagatctgagagatctt

SEQ ID NO: 9332569 - DNA, 22 bp, Homo sapiens
acagccagatctgagagatctt

SEQ ID NO: 9332570 - DNA, 22 bp, Homo sapiens
acagcaggttacagtggcacag

SEQ ID NO: 9332571 - DNA, 22 bp, Homo sapiens
acagccaggacttggccctctt

SEQ ID NO: 9332572 - DNA, 22 bp, Homo sapiens
acagccaggagccatgggcagg

SEQ ID NO: 9332573 - DNA, 22 bp, Homo sapiens
acagccaggaattctggagaag

SEQ ID NO: 9332574 - DNA, 22 bp, Homo sapiens
acagccagcagagctgtttcct

SEQ ID NO: 9332575 - DNA, 22 bp, Homo sapiens
acagccagcttgatgggatccg

SEQ ID NO: 9332576 - DNA, 21 bp, Homo sapiens
acagccaggaacatgaggggc

SEQ ID NO: 9332577 - DNA, 21 bp, Homo sapiens
acagctggaaattacttgccc

SEQ ID NO: 9332578 - DNA, 22 bp, Homo sapiens
acagctggacaggggagagttt

SEQ ID NO: 9332579 - DNA, 21 bp, Homo sapiens
acagctggaaattacttgccc

SEQ ID NO: 9332580 - DNA, 22 bp, Homo sapiens
acagctgctctatatctcagcc

SEQ ID NO: 9332581 - DNA, 22 bp, Homo sapiens
acagctgctgcttctcactggg

SEQ ID NO: 9332582 - DNA, 19 bp, Homo sapiens
aagcccggctgctgagagg

SEQ ID NO: 9332583 - DNA, 22 bp, Homo sapiens
aagccctcatccccatgggcgt

SEQ ID NO: 9332584 - DNA, 22 bp, Homo sapiens
aagcccagggaatggtcgggag

SEQ ID NO: 9332585 - DNA, 22 bp, Homo sapiens
aagcccagcatccctgcaccag

SEQ ID NO: 9332586 - DNA, 22 bp, Homo sapiens
aagcccagcatccctgcaccag

SEQ ID NO: 9332587 - DNA, 22 bp, Homo sapiens
aagcccagctctgcctgctctg

SEQ ID NO: 9332588 - DNA, 22 bp, Homo sapiens
aagcccagctgaaagcattttt

SEQ ID NO: 9332589 - DNA, 22 bp, Homo sapiens
aagcccagctctgcctgctctg

SEQ ID NO: 9332590 - DNA, 22 bp, Homo sapiens
aagcccagtaccttcagtgagg

SEQ ID NO: 9332591 - DNA, 22 bp, Homo sapiens
aagcccagtaccttcagtgagg

SEQ ID NO: 9332592 - DNA, 22 bp, Homo sapiens
aagcccagtttcacactgagac

SEQ ID NO: 9332593 - DNA, 21 bp, Homo sapiens
aagcagggactgcccaggtcc

SEQ ID NO: 9332594 - DNA, 22 bp, Homo sapiens
aagcaggcttggtgtggccgct

SEQ ID NO: 9332595 - DNA, 22 bp, Homo sapiens
aagcaggcttggtgtggccgct

SEQ ID NO: 9332596 - DNA, 22 bp, Homo sapiens
aagcaggcttggtgtggccgct

SEQ ID NO: 9332597 - DNA, 21 bp, Homo sapiens
aagcaggctgtaatcatgtgg

SEQ ID NO: 9332598 - DNA, 21 bp, Homo sapiens
aagcaggctgtaatcatgtgg

SEQ ID NO: 9332599 - DNA, 22 bp, Homo sapiens
aagcaggctcacgccaggcagt

SEQ ID NO: 9332600 - DNA, 22 bp, Homo sapiens
aagcagggagaaatttttcttc

SEQ ID NO: 9332601 - DNA, 23 bp, Homo sapiens
aagcagggagattcttagctgag

SEQ ID NO: 9332602 - DNA, 23 bp, Homo sapiens
aagcagggagattcttagctgag

SEQ ID NO: 9332603 - DNA, 22 bp, Homo sapiens
aagcaggcgagggcctggagca

SEQ ID NO: 9332604 - DNA, 22 bp, Homo sapiens
aagcaggctagattgaagggct

SEQ ID NO: 9332605 - DNA, 22 bp, Homo sapiens
aagcaggctcacgccaggcagt

SEQ ID NO: 9332606 - DNA, 22 bp, Homo sapiens
aagcagggtttttccaccgcag

SEQ ID NO: 9332607 - DNA, 22 bp, Homo sapiens
aagcagggtcttcctcagttgg

SEQ ID NO: 9332608 - DNA, 22 bp, Homo sapiens
aagcagggtgtcttgacccatg

SEQ ID NO: 9332609 - DNA, 22 bp, Homo sapiens
aagcagggtgtcttgacccatg

SEQ ID NO: 9332610 - DNA, 22 bp, Homo sapiens
aagcagggtgtcttgacccatg

SEQ ID NO: 9332611 - DNA, 22 bp, Homo sapiens
aagcagggctccctggggactc

SEQ ID NO: 9332612 - DNA, 22 bp, Homo sapiens
aagcagggctccctggggactc

SEQ ID NO: 9332613 - DNA, 22 bp, Homo sapiens
aagcagggctagaccaagaaga

SEQ ID NO: 9332614 - DNA, 22 bp, Homo sapiens
aagcagggctccctggggactc

SEQ ID NO: 9332615 - DNA, 22 bp, Homo sapiens
aagcagggctccctggggactc

SEQ ID NO: 9332616 - DNA, 22 bp, Homo sapiens
aagcagggctccctggggactc

SEQ ID NO: 9332617 - DNA, 18 bp, Homo sapiens
aagcagggtccattgtgc

SEQ ID NO: 9332618 - DNA, 18 bp, Homo sapiens
aagcagggtccattgtgc

SEQ ID NO: 9332619 - DNA, 22 bp, Homo sapiens
aagcagggctttaagcggtttt

SEQ ID NO: 9332620 - DNA, 22 bp, Homo sapiens
aagcagggtcttcctcagttgg

SEQ ID NO: 9332621 - DNA, 18 bp, Homo sapiens
aagcagggtccattgtgc

SEQ ID NO: 9332622 - DNA, 22 bp, Homo sapiens
acagcagggggagctgttggac

SEQ ID NO: 9332623 - DNA, 22 bp, Homo sapiens
acagcagggggagctgttggac

SEQ ID NO: 9332624 - DNA, 22 bp, Homo sapiens
acagcagggggagctgttggac

SEQ ID NO: 9332625 - DNA, 21 bp, Homo sapiens
acagcagggctggcatgacag

SEQ ID NO: 9332626 - DNA, 21 bp, Homo sapiens
acagcagggctggcatgacag

SEQ ID NO: 9332627 - DNA, 22 bp, Homo sapiens
acagcagggggagctgttggac

SEQ ID NO: 9332628 - DNA, 22 bp, Homo sapiens
acagcagggggagctgttggac

SEQ ID NO: 9332629 - DNA, 22 bp, Homo sapiens
acagcaggggtggaataaacgt

SEQ ID NO: 9332630 - DNA, 22 bp, Homo sapiens
acagcaggggtggaataaacgt

SEQ ID NO: 9332631 - DNA, 22 bp, Homo sapiens
acagcagggtcacattccctct

SEQ ID NO: 9332632 - DNA, 22 bp, Homo sapiens
acagcagggtcacattccctct

SEQ ID NO: 9332633 - DNA, 22 bp, Homo sapiens
acagcagggtcacattccctct

SEQ ID NO: 9332634 - DNA, 22 bp, Homo sapiens
acagcaggtagctttgtgcctc

SEQ ID NO: 9332635 - DNA, 22 bp, Homo sapiens
acagcaggtagctttgtgcctc

SEQ ID NO: 9332636 - DNA, 19 bp, Homo sapiens
acagcaggtgtggggataa

SEQ ID NO: 9332637 - DNA, 19 bp, Homo sapiens
acagcaggtgtggggataa

SEQ ID NO: 9332638 - DNA, 19 bp, Homo sapiens
acagcaggtgtggggataa

SEQ ID NO: 9332639 - DNA, 22 bp, Homo sapiens
acagcaggaagctggagggaaa

SEQ ID NO: 9332640 - DNA, 22 bp, Homo sapiens
acagcaggaagctggagggaaa

SEQ ID NO: 9332641 - DNA, 22 bp, Homo sapiens
acagcaggaagctggagggaaa

SEQ ID NO: 9332642 - DNA, 22 bp, Homo sapiens
aagcataacttgctgcacatag

SEQ ID NO: 9332643 - DNA, 22 bp, Homo sapiens
aagcagtgttcccagctggccc

SEQ ID NO: 9332644 - DNA, 22 bp, Homo sapiens
aagcagtgttcccagctggccc

SEQ ID NO: 9332645 - DNA, 22 bp, Homo sapiens
aagttacacagagttggaggct

SEQ ID NO: 9332646 - DNA, 22 bp, Homo sapiens
aagttacagtcagaggttaaca

SEQ ID NO: 9332647 - DNA, 22 bp, Homo sapiens
aagttacagtcagaggttaaca

SEQ ID NO: 9332648 - DNA, 22 bp, Homo sapiens
aagttacagttacagaatggag

SEQ ID NO: 9332649 - DNA, 22 bp, Homo sapiens
aagttacatattcttgggctat

SEQ ID NO: 9332650 - DNA, 22 bp, Homo sapiens
aataagaacttgtctctggcag

SEQ ID NO: 9332651 - DNA, 22 bp, Homo sapiens
aagttacagttggaactgtgaa

SEQ ID NO: 9332652 - DNA, 22 bp, Homo sapiens
aataatgtctgctattttaaaa

SEQ ID NO: 9332653 - DNA, 22 bp, Homo sapiens
aataatgtaggatgataaatga

SEQ ID NO: 9332654 - DNA, 22 bp, Homo sapiens
aatacagaggggtcacaattca

SEQ ID NO: 9332655 - DNA, 22 bp, Homo sapiens
aatacagaggggtcacaattca

SEQ ID NO: 9332656 - DNA, 22 bp, Homo sapiens
aatacagatggcatgtgaagat

SEQ ID NO: 9332657 - DNA, 22 bp, Homo sapiens
aatacagatggcatgtgaagat

SEQ ID NO: 9332658 - DNA, 22 bp, Homo sapiens
aatacagatgagcttctgcctc

SEQ ID NO: 9332659 - DNA, 18 bp, Homo sapiens
aataatgctgctgtgaac

SEQ ID NO: 9332660 - DNA, 18 bp, Homo sapiens
aataatgctgctgtgaac

SEQ ID NO: 9332661 - DNA, 22 bp, Homo sapiens
aataatgagcttgtctaattgt

SEQ ID NO: 9332662 - DNA, 22 bp, Homo sapiens
aataatgagacagcttatttaa

SEQ ID NO: 9332663 - DNA, 22 bp, Homo sapiens
aataatatttgaagcttcaaag

SEQ ID NO: 9332664 - DNA, 22 bp, Homo sapiens
aataatatttgaagcttcaaag

SEQ ID NO: 9332665 - DNA, 22 bp, Homo sapiens
aataatatttgaagcttcaaag

SEQ ID NO: 9332666 - DNA, 22 bp, Homo sapiens
aatacatatggaattccatgtt

SEQ ID NO: 9332667 - DNA, 20 bp, Homo sapiens
aatataattctctgaattta

SEQ ID NO: 9332668 - DNA, 20 bp, Homo sapiens
aatataattctctgaattta

SEQ ID NO: 9332669 - DNA, 19 bp, Homo sapiens
aatacagtgttatagaatt

SEQ ID NO: 9332670 - DNA, 22 bp, Homo sapiens
aatacataataagttttgtctg

SEQ ID NO: 9332671 - DNA, 22 bp, Homo sapiens
aatacataataagttttgtctg

SEQ ID NO: 9332672 - DNA, 22 bp, Homo sapiens
aatacagtaattttgatgagtt

SEQ ID NO: 9332673 - DNA, 22 bp, Homo sapiens
aatacagtaggtaatagttcat

SEQ ID NO: 9332674 - DNA, 22 bp, Homo sapiens
aatatttctgcagaatggtttt

SEQ ID NO: 9332675 - DNA, 22 bp, Homo sapiens
aatatttctccttcgttatagc

SEQ ID NO: 9332676 - DNA, 22 bp, Homo sapiens
aatatttctgcagaatggtttt

SEQ ID NO: 9332677 - DNA, 22 bp, Homo sapiens
aatatttctccttcgttatagc

SEQ ID NO: 9332678 - DNA, 22 bp, Homo sapiens
aatctcaagctgtaaatacctc

SEQ ID NO: 9332679 - DNA, 22 bp, Homo sapiens
aatattgtttcaagatcacaga

SEQ ID NO: 9332680 - DNA, 22 bp, Homo sapiens
aatattgagaaccagcatgttt

SEQ ID NO: 9332681 - DNA, 22 bp, Homo sapiens
aatatctgtggccatacaattt

SEQ ID NO: 9332682 - DNA, 22 bp, Homo sapiens
aatatctgtggccatacaattt

SEQ ID NO: 9332683 - DNA, 22 bp, Homo sapiens
aatatctgtggccatacaattt

SEQ ID NO: 9332684 - DNA, 22 bp, Homo sapiens
aatatctgttgttctaagccac

SEQ ID NO: 9332685 - DNA, 22 bp, Homo sapiens
aatatctgtctctaatgcatat

SEQ ID NO: 9332686 - DNA, 22 bp, Homo sapiens
aatatctgtggccatacaattt

SEQ ID NO: 9332687 - DNA, 22 bp, Homo sapiens
aatatctggagatgctttttgt

SEQ ID NO: 9332688 - DNA, 22 bp, Homo sapiens
aatatctgtctctaatgcatat

SEQ ID NO: 9332689 - DNA, 22 bp, Homo sapiens
aacttcatttataatgtcatta

SEQ ID NO: 9332690 - DNA, 22 bp, Homo sapiens
aatgcagtgagccattaaatgg

SEQ ID NO: 9332691 - DNA, 22 bp, Homo sapiens
aatgctgtcttagcatgaaagc

SEQ ID NO: 9332692 - DNA, 22 bp, Homo sapiens
aatgtaaagttgggcacaaatg

SEQ ID NO: 9332693 - DNA, 22 bp, Homo sapiens
aatgtaaacagcaagagaaggg

SEQ ID NO: 9332694 - DNA, 22 bp, Homo sapiens
aactttacttgaaagaacatgt

SEQ ID NO: 9332695 - DNA, 22 bp, Homo sapiens
aactttacttgaaagaacatgt

SEQ ID NO: 9332696 - DNA, 22 bp, Homo sapiens
aatgtacaaaccttctttgtag

SEQ ID NO: 9332697 - DNA, 22 bp, Homo sapiens
aatgtaaagttgggcacaaatg

SEQ ID NO: 9332698 - DNA, 22 bp, Homo sapiens
aatgtacaaaagtcagccaact

SEQ ID NO: 9332699 - DNA, 22 bp, Homo sapiens
aactttaaggctataaattatg

SEQ ID NO: 9332700 - DNA, 22 bp, Homo sapiens
aactttaaagaggaggcttggg

SEQ ID NO: 9332701 - DNA, 23 bp, Homo sapiens
aactttactattttgaataatgc

SEQ ID NO: 9332702 - DNA, 23 bp, Homo sapiens
aactttactattttgaataatgc

SEQ ID NO: 9332703 - DNA, 22 bp, Homo sapiens
aactttaaaaaatatgtctgtt

SEQ ID NO: 9332704 - DNA, 22 bp, Homo sapiens
aatctcttcccagtaaaaatgg

SEQ ID NO: 9332705 - DNA, 22 bp, Homo sapiens
aatctctctggggttcagtcct

SEQ ID NO: 9332706 - DNA, 22 bp, Homo sapiens
aatctgacttataggctttgtg

SEQ ID NO: 9332707 - DNA, 22 bp, Homo sapiens
aatctctttggctcaaggatcc

SEQ ID NO: 9332708 - DNA, 22 bp, Homo sapiens
aatctggacacagttctcatgc

SEQ ID NO: 9332709 - DNA, 22 bp, Homo sapiens
aatctggctcagaagaagatga

SEQ ID NO: 9332710 - DNA, 22 bp, Homo sapiens
aatgaaatagttggctgtagag

SEQ ID NO: 9332711 - DNA, 22 bp, Homo sapiens
aatgcagagtaaatatttaatt

SEQ ID NO: 9332712 - DNA, 18 bp, Homo sapiens
aatgaaatgtacaccttt

SEQ ID NO: 9332713 - DNA, 23 bp, Homo sapiens
aaggtgtttgatgggttgaggaa

SEQ ID NO: 9332714 - DNA, 23 bp, Homo sapiens
aaggtgtttgatgggttgaggaa

SEQ ID NO: 9332715 - DNA, 23 bp, Homo sapiens
aaggtgttctgtatttaactcag

SEQ ID NO: 9332716 - DNA, 22 bp, Homo sapiens
aagtaacatctgaacatgatgt

SEQ ID NO: 9332717 - DNA, 22 bp, Homo sapiens
aagtctgagtgtcagtgcaagt

SEQ ID NO: 9332718 - DNA, 22 bp, Homo sapiens
aagtctgatcatttcttctata

SEQ ID NO: 9332719 - DNA, 22 bp, Homo sapiens
aagtctgagagaaactctctca

SEQ ID NO: 9332720 - DNA, 22 bp, Homo sapiens
aagtacaacgcatacagagaaa

SEQ ID NO: 9332721 - DNA, 22 bp, Homo sapiens
aagtaatggttaaataattcta

SEQ ID NO: 9332722 - DNA, 22 bp, Homo sapiens
aagggctggaatatctcttaga

SEQ ID NO: 9332723 - DNA, 22 bp, Homo sapiens
aagggctgctgtagaagcagag

SEQ ID NO: 9332724 - DNA, 22 bp, Homo sapiens
aagggctgctgtagaagcagag

SEQ ID NO: 9332725 - DNA, 22 bp, Homo sapiens
aagggctgctgtagaagcagag

SEQ ID NO: 9332726 - DNA, 22 bp, Homo sapiens
aagggctgccagggggtgccag

SEQ ID NO: 9332727 - DNA, 22 bp, Homo sapiens
aagggctgccagggggtgccag

SEQ ID NO: 9332728 - DNA, 22 bp, Homo sapiens
aagggctgccagggggtgccag

SEQ ID NO: 9332729 - DNA, 22 bp, Homo sapiens
aagggctgccagggggtgccag

SEQ ID NO: 9332730 - DNA, 22 bp, Homo sapiens
aagggcagggagtttgtgtcta

SEQ ID NO: 9332731 - DNA, 22 bp, Homo sapiens
aagggcaggtgggcatttctgg

SEQ ID NO: 9332732 - DNA, 22 bp, Homo sapiens
aagggctgcatttgatgtgtca

SEQ ID NO: 9332733 - DNA, 22 bp, Homo sapiens
aagggctgcatttgatgtgtca

SEQ ID NO: 9332734 - DNA, 22 bp, Homo sapiens
aagggctgcatttgatgtgtca

SEQ ID NO: 9332735 - DNA, 22 bp, Homo sapiens
aagggctgcaatccaaaacact

SEQ ID NO: 9332736 - DNA, 22 bp, Homo sapiens
aagggctgcaatccaaaacact

SEQ ID NO: 9332737 - DNA, 22 bp, Homo sapiens
aagggctggaatatctcttaga

SEQ ID NO: 9332738 - DNA, 22 bp, Homo sapiens
aagggctggaatatctcttaga

SEQ ID NO: 9332739 - DNA, 23 bp, Homo sapiens
aaggtgtcattgatgggattcta

SEQ ID NO: 9332740 - DNA, 22 bp, Homo sapiens
aaggtgtcatccaggatggtgg

SEQ ID NO: 9332741 - DNA, 22 bp, Homo sapiens
aaggtgtcaggcttgggaaagt

SEQ ID NO: 9332742 - DNA, 22 bp, Homo sapiens
aaggtgtcactgtttctggcct

SEQ ID NO: 9332743 - DNA, 22 bp, Homo sapiens
aaggtgtcattgtttatggaga

SEQ ID NO: 9332744 - DNA, 23 bp, Homo sapiens
aaggtgtcattgatgggattcta

SEQ ID NO: 9332745 - DNA, 22 bp, Homo sapiens
aaggtgtcaggcttgggaaagt

SEQ ID NO: 9332746 - DNA, 22 bp, Homo sapiens
aaggtgtcatccaggatggtgg

SEQ ID NO: 9332747 - DNA, 22 bp, Homo sapiens
aaggtgtcactgtttctggcct

SEQ ID NO: 9332748 - DNA, 22 bp, Homo sapiens
aaggtctgtattagagtttcat

SEQ ID NO: 9332749 - DNA, 22 bp, Homo sapiens
aaggtgtcgggttagctcagcc

SEQ ID NO: 9332750 - DNA, 19 bp, Homo sapiens
aaggtgtcccaactgcgtt

SEQ ID NO: 9332751 - DNA, 22 bp, Homo sapiens
aaggtgtcattgtttatggaga

SEQ ID NO: 9332752 - DNA, 22 bp, Homo sapiens
aaggtgtcggcagagccgcttc

SEQ ID NO: 9332753 - DNA, 22 bp, Homo sapiens
aaggtgtctctctgcttcttgg

SEQ ID NO: 9332754 - DNA, 22 bp, Homo sapiens
aaggtgtctctctgcttcttgg

SEQ ID NO: 9332755 - DNA, 22 bp, Homo sapiens
aaggtgtcgggttagctcagcc

SEQ ID NO: 9332756 - DNA, 19 bp, Homo sapiens
aaggtgtcccaactgcgtt

SEQ ID NO: 9332757 - DNA, 22 bp, Homo sapiens
aaggtgtcggcagagccgcttc

SEQ ID NO: 9332758 - DNA, 22 bp, Homo sapiens
aaggtgtcggcagagccgcttc

SEQ ID NO: 9332759 - DNA, 22 bp, Homo sapiens
aaggtgtcgggttagctcagcc

SEQ ID NO: 9332760 - DNA, 22 bp, Homo sapiens
aaggtgttcaggttttcccatt

SEQ ID NO: 9332761 - DNA, 22 bp, Homo sapiens
aaggtgttattggaggcatcag

SEQ ID NO: 9332762 - DNA, 22 bp, Homo sapiens
aaggtgttattggaggcatcag

SEQ ID NO: 9332763 - DNA, 22 bp, Homo sapiens
aaggtgttatagctgaggaata

SEQ ID NO: 9332764 - DNA, 22 bp, Homo sapiens
aaggtgtgaagagatgggaaga

SEQ ID NO: 9332765 - DNA, 22 bp, Homo sapiens
aaggtgtgaactgattcattgg

SEQ ID NO: 9332766 - DNA, 22 bp, Homo sapiens
aagtgcttcaactagtgtggtc

SEQ ID NO: 9332767 - DNA, 22 bp, Homo sapiens
aagtgcttaggtcaaaggacat

SEQ ID NO: 9332768 - DNA, 22 bp, Homo sapiens
aagtgctgtttctgatgaatgc

SEQ ID NO: 9332769 - DNA, 23 bp, Homo sapiens
aagtgctcagtggacagcattgc

SEQ ID NO: 9332770 - DNA, 22 bp, Homo sapiens
aacagtgttctagggtgtggct

SEQ ID NO: 9332771 - DNA, 22 bp, Homo sapiens
aacagtggggaaaagagttggt

SEQ ID NO: 9332772 - DNA, 22 bp, Homo sapiens
aacagtgttttgctctttgccc

SEQ ID NO: 9332773 - DNA, 22 bp, Homo sapiens
aagtcttaggcattttatttct

SEQ ID NO: 9332774 - DNA, 22 bp, Homo sapiens
aagtcttaggaaatagcaaaga

SEQ ID NO: 9332775 - DNA, 18 bp, Homo sapiens
aagtcttggaatttccac

SEQ ID NO: 9332776 - DNA, 18 bp, Homo sapiens
aagtctggcagctttccc

SEQ ID NO: 9332777 - DNA, 22 bp, Homo sapiens
aagtctgggcctccttcccaga

SEQ ID NO: 9332778 - DNA, 21 bp, Homo sapiens
aagtctggttgattcctttgc

SEQ ID NO: 9332779 - DNA, 22 bp, Homo sapiens
aagtctggtgctgtcctcaccc

SEQ ID NO: 9332780 - DNA, 22 bp, Homo sapiens
aagtcttaaccaaataaatgtt

SEQ ID NO: 9332781 - DNA, 22 bp, Homo sapiens
aagtgcatatttttgttgtaga

SEQ ID NO: 9332782 - DNA, 22 bp, Homo sapiens
aagtctttttgaatctataact

SEQ ID NO: 9332783 - DNA, 22 bp, Homo sapiens
aagtgccatcatagcatggctg

SEQ ID NO: 9332784 - DNA, 22 bp, Homo sapiens
aagtgcattagatagaatgatg

SEQ ID NO: 9332785 - DNA, 22 bp, Homo sapiens
aagtgcctgacctagcctggag

SEQ ID NO: 9332786 - DNA, 22 bp, Homo sapiens
aagtgcctgggcaacatagcaa

SEQ ID NO: 9332787 - DNA, 23 bp, Homo sapiens
aagtgctatgtttataagagctg

SEQ ID NO: 9332788 - DNA, 18 bp, Homo sapiens
aaatggcagaatggatag

SEQ ID NO: 9332789 - DNA, 22 bp, Homo sapiens
aaatggcaatcagcagaagcta

SEQ ID NO: 9332790 - DNA, 22 bp, Homo sapiens
aaggagggttcccaggtcctgg

SEQ ID NO: 9332791 - DNA, 22 bp, Homo sapiens
aaggagggttcccaggtcctgg

SEQ ID NO: 9332792 - DNA, 16 bp, Homo sapiens
aaggagggaagagaat

SEQ ID NO: 9332793 - DNA, 22 bp, Homo sapiens
aaggagggaaagcagtgcttct

SEQ ID NO: 9332794 - DNA, 22 bp, Homo sapiens
aaggagggaaagcagtgcttct

SEQ ID NO: 9332795 - DNA, 22 bp, Homo sapiens
aaatggaagaagtgcaatactg

SEQ ID NO: 9332796 - DNA, 22 bp, Homo sapiens
aaatggatctgtggaatacatt

SEQ ID NO: 9332797 - DNA, 22 bp, Homo sapiens
aaggagtctgggccattcagag

SEQ ID NO: 9332798 - DNA, 22 bp, Homo sapiens
aaggagtctgggccattcagag

SEQ ID NO: 9332799 - DNA, 22 bp, Homo sapiens
aaggagtctgggccattcagag

SEQ ID NO: 9332800 - DNA, 22 bp, Homo sapiens
aaggagtctgggccattcagag

SEQ ID NO: 9332801 - DNA, 22 bp, Homo sapiens
aaggagggttcccaggtcctgg

SEQ ID NO: 9332802 - DNA, 22 bp, Homo sapiens
aaggagtctgggccattcagag

SEQ ID NO: 9332803 - DNA, 22 bp, Homo sapiens
aaggagtctcagctgggcctga

SEQ ID NO: 9332804 - DNA, 22 bp, Homo sapiens
aaggaggttatcccagtggact

SEQ ID NO: 9332805 - DNA, 22 bp, Homo sapiens
aaggatatgggtagtatgatgt

SEQ ID NO: 9332806 - DNA, 22 bp, Homo sapiens
aaggataagaatggaaggaaca

SEQ ID NO: 9332807 - DNA, 22 bp, Homo sapiens
aaggagtgatatatgggtgcta

SEQ ID NO: 9332808 - DNA, 22 bp, Homo sapiens
aaggagtgcatgactcagagta

SEQ ID NO: 9332809 - DNA, 17 bp, Homo sapiens
aaggatattatagttct

SEQ ID NO: 9332810 - DNA, 22 bp, Homo sapiens
aaggcactgactgtgcagggga

SEQ ID NO: 9332811 - DNA, 22 bp, Homo sapiens
aaggcactgaacttaaattctg

SEQ ID NO: 9332812 - DNA, 22 bp, Homo sapiens
aaggcccaggggctctagggca

SEQ ID NO: 9332813 - DNA, 22 bp, Homo sapiens
aaggcccagcgtgacctcagtg

SEQ ID NO: 9332814 - DNA, 22 bp, Homo sapiens
aaggcccagcgtgacctcagtg

SEQ ID NO: 9332815 - DNA, 22 bp, Homo sapiens
aaggcccagcctggagcttgtt

SEQ ID NO: 9332816 - DNA, 22 bp, Homo sapiens
aaggcccaggctgccctgggca

SEQ ID NO: 9332817 - DNA, 22 bp, Homo sapiens
aaggcccaggctgccctgggca

SEQ ID NO: 9332818 - DNA, 22 bp, Homo sapiens
aaggcccagggattggaggtca

SEQ ID NO: 9332819 - DNA, 22 bp, Homo sapiens
aaggcccagggattggaggtca

SEQ ID NO: 9332820 - DNA, 22 bp, Homo sapiens
aaggctgaattcaagggtaggc

SEQ ID NO: 9332821 - DNA, 22 bp, Homo sapiens
aaggccatgaccacttgctgtg

SEQ ID NO: 9332822 - DNA, 22 bp, Homo sapiens
aaggccagtggataaaacctct

SEQ ID NO: 9332823 - DNA, 22 bp, Homo sapiens
aaggcccacagaactgtctcca

SEQ ID NO: 9332824 - DNA, 22 bp, Homo sapiens
aaggcccacagaactgtctcca

SEQ ID NO: 9332825 - DNA, 22 bp, Homo sapiens
aaggcccagccaatgggggcag

SEQ ID NO: 9332826 - DNA, 22 bp, Homo sapiens
aaggcccagcctggagcttgtt

SEQ ID NO: 9332827 - DNA, 23 bp, Homo sapiens
aaggccagagagaggctagtgtc

SEQ ID NO: 9332828 - DNA, 23 bp, Homo sapiens
aaggccagagagaggctagtgtc

SEQ ID NO: 9332829 - DNA, 22 bp, Homo sapiens
aaggccaggtccctgcagtgca

SEQ ID NO: 9332830 - DNA, 22 bp, Homo sapiens
aaggccaggtccctgcagtgca

SEQ ID NO: 9332831 - DNA, 22 bp, Homo sapiens
aaggccaggtccctgcagtgca

SEQ ID NO: 9332832 - DNA, 22 bp, Homo sapiens
aaggccaggtccctgcagtgca

SEQ ID NO: 9332833 - DNA, 22 bp, Homo sapiens
aagggcaggagaagacggatat

SEQ ID NO: 9332834 - DNA, 22 bp, Homo sapiens
aagggcaggagaagacggatat

SEQ ID NO: 9332835 - DNA, 22 bp, Homo sapiens
aagggcaggagaagacggatat

SEQ ID NO: 9332836 - DNA, 22 bp, Homo sapiens
aagggcaggaaaagatggatgt

SEQ ID NO: 9332837 - DNA, 22 bp, Homo sapiens
aagggcaggcagagatcatata

SEQ ID NO: 9332838 - DNA, 22 bp, Homo sapiens
aagggcagggagtttgtgtcta

SEQ ID NO: 9332839 - DNA, 22 bp, Homo sapiens
aagggcaggcacccaccctcac

SEQ ID NO: 9332840 - DNA, 22 bp, Homo sapiens
aagggcaggcacccaccctcac

SEQ ID NO: 9332841 - DNA, 22 bp, Homo sapiens
aagggcaggcacccaccctcac

SEQ ID NO: 9332842 - DNA, 22 bp, Homo sapiens
aagggaggccagaggttttgca

SEQ ID NO: 9332843 - DNA, 22 bp, Homo sapiens
aaggctgagacagcacaggtcc

SEQ ID NO: 9332844 - DNA, 22 bp, Homo sapiens
aaggctgaccagtttacacttt

SEQ ID NO: 9332845 - DNA, 22 bp, Homo sapiens
aaggctgacgtttgtgtttatt

SEQ ID NO: 9332846 - DNA, 22 bp, Homo sapiens
aaaggacatgtcaatatcaggc

SEQ ID NO: 9332847 - DNA, 22 bp, Homo sapiens
aaagctcatcattaggaggcta

SEQ ID NO: 9332848 - DNA, 22 bp, Homo sapiens
aaaggagaaaacatacaggact

SEQ ID NO: 9332849 - DNA, 22 bp, Homo sapiens
aaaggagaaaacatacaggact

SEQ ID NO: 9332850 - DNA, 22 bp, Homo sapiens
aaaggagaaaacatacaggact

SEQ ID NO: 9332851 - DNA, 22 bp, Homo sapiens
aaaggagaaaacatacaggact

SEQ ID NO: 9332852 - DNA, 22 bp, Homo sapiens
aaaggagacagtcttacctgga

SEQ ID NO: 9332853 - DNA, 22 bp, Homo sapiens
aaaggagacttcagatctcctt

SEQ ID NO: 9332854 - DNA, 22 bp, Homo sapiens
aaaggagagtgagtcagatgcc

SEQ ID NO: 9332855 - DNA, 22 bp, Homo sapiens
aaaggagagtaggttactccat

SEQ ID NO: 9332856 - DNA, 22 bp, Homo sapiens
aaaggagataaagggcccttca

SEQ ID NO: 9332857 - DNA, 22 bp, Homo sapiens
aaaggagagtgagtcagatgcc

SEQ ID NO: 9332858 - DNA, 22 bp, Homo sapiens
aaaggaggaatggagagatgct

SEQ ID NO: 9332859 - DNA, 22 bp, Homo sapiens
aaaatttccaccatctttgtgt

SEQ ID NO: 9332860 - DNA, 22 bp, Homo sapiens
aaaattgtaggaactgaatcaa

SEQ ID NO: 9332861 - DNA, 22 bp, Homo sapiens
aaaattgtcagaagttgatctt

SEQ ID NO: 9332862 - DNA, 22 bp, Homo sapiens
aaaattgtcgaacagtagtaac

SEQ ID NO: 9332863 - DNA, 22 bp, Homo sapiens
aaaattgtgaaggtttctgaaa

SEQ ID NO: 9332864 - DNA, 22 bp, Homo sapiens
aaaatttccaccatctttgtgt

SEQ ID NO: 9332865 - DNA, 22 bp, Homo sapiens
aaaatttccaccatctttgtgt

SEQ ID NO: 9332866 - DNA, 22 bp, Homo sapiens
aaagctatttattacagagaat

SEQ ID NO: 9332867 - DNA, 22 bp, Homo sapiens
aaagctattcaacacgaacatg

SEQ ID NO: 9332868 - DNA, 22 bp, Homo sapiens
aaagctatgaggcatgcatttc

SEQ ID NO: 9332869 - DNA, 22 bp, Homo sapiens
aaagctatttattacagagaat

SEQ ID NO: 9332870 - DNA, 22 bp, Homo sapiens
aaagctatttgttatgagagaa

SEQ ID NO: 9332871 - DNA, 22 bp, Homo sapiens
aaagctatttgtgagttataga

SEQ ID NO: 9332872 - DNA, 22 bp, Homo sapiens
aaagctagtaatattttaatcc

SEQ ID NO: 9332873 - DNA, 22 bp, Homo sapiens
aaagctatagggtcaagcattt

SEQ ID NO: 9332874 - DNA, 22 bp, Homo sapiens
aaagctagtaatattttaatcc

SEQ ID NO: 9332875 - DNA, 22 bp, Homo sapiens
aaagccagggacagtgtgcatg

SEQ ID NO: 9332876 - DNA, 22 bp, Homo sapiens
aaagccagggacagtgtgcatg

SEQ ID NO: 9332877 - DNA, 22 bp, Homo sapiens
aaaattttgccctatccttcat

SEQ ID NO: 9332878 - DNA, 22 bp, Homo sapiens
aaagctagaaggaaattttatg

SEQ ID NO: 9332879 - DNA, 22 bp, Homo sapiens
aaagctagaaggaaattttatg

SEQ ID NO: 9332880 - DNA, 22 bp, Homo sapiens
aaagtacaatattgagattgat

SEQ ID NO: 9332881 - DNA, 22 bp, Homo sapiens
aaagtacaaggaaaggatctga

SEQ ID NO: 9332882 - DNA, 22 bp, Homo sapiens
aaagtacaaggaaaggatctga

SEQ ID NO: 9332883 - DNA, 22 bp, Homo sapiens
aaagtacagatggtgaggttgg

SEQ ID NO: 9332884 - DNA, 22 bp, Homo sapiens
aaagtcagttggccagatcact

SEQ ID NO: 9332885 - DNA, 22 bp, Homo sapiens
aaagtcaggctgtgtacctaac

SEQ ID NO: 9332886 - DNA, 22 bp, Homo sapiens
aaagttttattcaagcattagt

SEQ ID NO: 9332887 - DNA, 22 bp, Homo sapiens
aaagtcatccaaatttttatgt

SEQ ID NO: 9332888 - DNA, 22 bp, Homo sapiens
aaagtcatctgtcctaggctct

SEQ ID NO: 9332889 - DNA, 22 bp, Homo sapiens
aaagacacacagccagcaagtg

SEQ ID NO: 9332890 - DNA, 22 bp, Homo sapiens
aaatgtctttcaatagagaaat

SEQ ID NO: 9332891 - DNA, 22 bp, Homo sapiens
aaagacagatggcaaggatgat

SEQ ID NO: 9332892 - DNA, 22 bp, Homo sapiens
aaagacagagctgtaggggaaa

SEQ ID NO: 9332893 - DNA, 22 bp, Homo sapiens
aaagacagatggcaaggatgat

SEQ ID NO: 9332894 - DNA, 22 bp, Homo sapiens
aaagacagatggcaaggatgat

SEQ ID NO: 9332895 - DNA, 22 bp, Homo sapiens
aaatgtctgttagtcatatcat

SEQ ID NO: 9332896 - DNA, 22 bp, Homo sapiens
aaatgtctgtctcatgaggaaa

SEQ ID NO: 9332897 - DNA, 22 bp, Homo sapiens
aaatgtctgtatgagaaagaga

SEQ ID NO: 9332898 - DNA, 22 bp, Homo sapiens
aaatgtctgtatgagaaagaga

SEQ ID NO: 9332899 - DNA, 22 bp, Homo sapiens
aaatggtgtttctaatgctaga

SEQ ID NO: 9332900 - DNA, 22 bp, Homo sapiens
aaatggtggctcttttaaattg

SEQ ID NO: 9332901 - DNA, 22 bp, Homo sapiens
aaatggtgctactaggagtcag

SEQ ID NO: 9332902 - DNA, 22 bp, Homo sapiens
aaatggtgctactaggagtcag

SEQ ID NO: 9332903 - DNA, 23 bp, Homo sapiens
aaacttcagtagtgtcatcagcc

SEQ ID NO: 9332904 - DNA, 22 bp, Homo sapiens
aaacttagtagagttcatatta

SEQ ID NO: 9332905 - DNA, 22 bp, Homo sapiens
aaacttagttaagcatattatt

SEQ ID NO: 9332906 - DNA, 22 bp, Homo sapiens
aaatacagagttgcttaaaagc

SEQ ID NO: 9332907 - DNA, 22 bp, Homo sapiens
aaatacagagttgcttaaaagc

SEQ ID NO: 9332908 - DNA, 22 bp, Homo sapiens
aaatacagagttgcttaaaagc

SEQ ID NO: 9332909 - DNA, 22 bp, Homo sapiens
aaataaaggtccactttagggc

SEQ ID NO: 9332910 - DNA, 22 bp, Homo sapiens
aaataacagtcagggacaacat

SEQ ID NO: 9332911 - DNA, 22 bp, Homo sapiens
aaataaaggtccactttagggc

SEQ ID NO: 9332912 - DNA, 22 bp, Homo sapiens
aaataaaggtccactttagggc

SEQ ID NO: 9332913 - DNA, 22 bp, Homo sapiens
aaatacacgtacatgtgtaaaa

SEQ ID NO: 9332914 - DNA, 22 bp, Homo sapiens
aaatacaatttcaggctgtaat

SEQ ID NO: 9332915 - DNA, 22 bp, Homo sapiens
aaataacagtcagggacaacat

SEQ ID NO: 9332916 - DNA, 22 bp, Homo sapiens
aaatgacagagtaagctgttta

SEQ ID NO: 9332917 - DNA, 22 bp, Homo sapiens
aaatgacagagtaagctgttta

SEQ ID NO: 9332918 - DNA, 22 bp, Homo sapiens
aaactgtttccctccataacct

SEQ ID NO: 9332919 - DNA, 22 bp, Homo sapiens
aaatgacaataaaagtccatgc

SEQ ID NO: 9332920 - DNA, 21 bp, Homo sapiens
aaatgaatgtggtagtgcaag

SEQ ID NO: 9332921 - DNA, 22 bp, Homo sapiens
aaagcagggtccaaggagatgt

SEQ ID NO: 9332922 - DNA, 22 bp, Homo sapiens
aaagcagggatgaggctagagg

SEQ ID NO: 9332923 - DNA, 22 bp, Homo sapiens
aaagcaggcagcaggctggatt

SEQ ID NO: 9332924 - DNA, 22 bp, Homo sapiens
aaagcagggaaatctatttgca

SEQ ID NO: 9332925 - DNA, 22 bp, Homo sapiens
aaagcagggatgaggctagagg

SEQ ID NO: 9332926 - DNA, 22 bp, Homo sapiens
aaagcagggcgatgtcctcctc

SEQ ID NO: 9332927 - DNA, 22 bp, Homo sapiens
aaagcagggtccaaggagatgt

SEQ ID NO: 9332928 - DNA, 22 bp, Homo sapiens
aaagcagctgatagtctcatct

SEQ ID NO: 9332929 - DNA, 22 bp, Homo sapiens
aaagcagcggtgtctttactgc

SEQ ID NO: 9332930 - DNA, 22 bp, Homo sapiens
aaagcaggcagcaggctggatt

SEQ ID NO: 9332931 - DNA, 22 bp, Homo sapiens
aaagcagctgtttgactttcca

SEQ ID NO: 9332932 - DNA, 21 bp, Homo sapiens
aaaatgtagacttttccctga

SEQ ID NO: 9332933 - DNA, 22 bp, Homo sapiens
aaaatgtctgctgttggtttat

SEQ ID NO: 9332934 - DNA, 22 bp, Homo sapiens
aaaatgtatgatggaggtgcta

SEQ ID NO: 9332935 - DNA, 22 bp, Homo sapiens
aaagcagcagcacgtggaagag

SEQ ID NO: 9332936 - DNA, 22 bp, Homo sapiens
aaagcagcagcacctgcatttc

SEQ ID NO: 9332937 - DNA, 22 bp, Homo sapiens
aaagcagccactctctctgcct

SEQ ID NO: 9332938 - DNA, 22 bp, Homo sapiens
aaaatgatgctgtaatttggca

SEQ ID NO: 9332939 - DNA, 22 bp, Homo sapiens
aaaatgtaaagcttgagtgtag

SEQ ID NO: 9332940 - DNA, 18 bp, Homo sapiens
aaaatgcaggcgacatgg

SEQ ID NO: 9332941 - DNA, 18 bp, Homo sapiens
aaaatgcaggcgacatgg

SEQ ID NO: 9332942 - DNA, 18 bp, Homo sapiens
aaaatgcaggcgacatgg

SEQ ID NO: 9332943 - DNA, 22 bp, Homo sapiens
aaaatgcatgagaatgtgctcg

SEQ ID NO: 9332944 - DNA, 22 bp, Homo sapiens
aaaagtttaagactcattctag

SEQ ID NO: 9332945 - DNA, 22 bp, Homo sapiens
aaaagctagtcaatgatgtatt

SEQ ID NO: 9332946 - DNA, 19 bp, Homo sapiens
aaaaggaatattctttggg

SEQ ID NO: 9332947 - DNA, 22 bp, Homo sapiens
aaaataacttctactatttgca

SEQ ID NO: 9332948 - DNA, 22 bp, Homo sapiens
aaaataacttctactatttgca

SEQ ID NO: 9332949 - DNA, 22 bp, Homo sapiens
aaaatacacatactaggggaaa

SEQ ID NO: 9332950 - DNA, 22 bp, Homo sapiens
aaaatacacatactaggggaaa

SEQ ID NO: 9332951 - DNA, 22 bp, Homo sapiens
aaaatacacatactaggggaaa

SEQ ID NO: 9332952 - DNA, 22 bp, Homo sapiens
aaaacattgaattgcacactat

SEQ ID NO: 9332953 - DNA, 22 bp, Homo sapiens
aaaacatgtccatacagaaact

SEQ ID NO: 9332954 - DNA, 22 bp, Homo sapiens
aaaaccaagttttccttagtct

SEQ ID NO: 9332955 - DNA, 22 bp, Homo sapiens
aaaagaggttaaccaggtgtgt

SEQ ID NO: 9332956 - DNA, 22 bp, Homo sapiens
aaaaccagacactgtttctggg

SEQ ID NO: 9332957 - DNA, 22 bp, Homo sapiens
aaaaattgctgagaacggaatt

SEQ ID NO: 9332958 - DNA, 22 bp, Homo sapiens
aaaaatttatggttcttctctg

SEQ ID NO: 9332959 - DNA, 20 bp, Homo sapiens
aaaaattgatatcgcttcct

SEQ ID NO: 9332960 - DNA, 22 bp, Homo sapiens
aaaacacaagaagcagggtaca

SEQ ID NO: 9332961 - DNA, 22 bp, Homo sapiens
aaaagcaagttgcctaggttga

SEQ ID NO: 9332962 - DNA, 22 bp, Homo sapiens
aaaagcaaggcagtctgtctga

SEQ ID NO: 9332963 - DNA, 22 bp, Homo sapiens
aaaagcaagaggctggattaaa

SEQ ID NO: 9332964 - DNA, 22 bp, Homo sapiens
aaaacacaagaagcagggtaca

SEQ ID NO: 9332965 - DNA, 22 bp, Homo sapiens
aaaacacactggaccaatttaa

SEQ ID NO: 9332966 - DNA, 22 bp, Homo sapiens
aaaacagttataaacagagtca

SEQ ID NO: 9332967 - DNA, 22 bp, Homo sapiens
aaaacagttataaacagagtca

SEQ ID NO: 9332968 - DNA, 22 bp, Homo sapiens
aaaacaggagttttggtaggct

SEQ ID NO: 9332969 - DNA, 22 bp, Homo sapiens
aaaacagttataaacagagtca

SEQ ID NO: 9332970 - DNA, 22 bp, Homo sapiens
aaaagcagagactctggagcta

SEQ ID NO: 9332971 - DNA, 22 bp, Homo sapiens
aaaagcagaccacgctttgtgg

SEQ ID NO: 9332972 - DNA, 22 bp, Homo sapiens
aaaagcagagactctggagcta

SEQ ID NO: 9332973 - DNA, 22 bp, Homo sapiens
aaaagcagatctccaaagtcta

SEQ ID NO: 9332974 - DNA, 20 bp, Homo sapiens
aaaagcagccagagatggta

SEQ ID NO: 9332975 - DNA, 22 bp, Homo sapiens
aaaagcaattgcgggttttgcc

SEQ ID NO: 9332976 - DNA, 22 bp, Homo sapiens
aaaagcaggtactcagcttggg

SEQ ID NO: 9332977 - DNA, 22 bp, Homo sapiens
aaaagcaggtactcagcttggg

SEQ ID NO: 9332978 - DNA, 22 bp, Homo sapiens
aaaagcaggtactcagcttggg

SEQ ID NO: 9332979 - DNA, 22 bp, Homo sapiens
aaaagcagtaaatgtatgacct

SEQ ID NO: 9332980 - DNA, 22 bp, Homo sapiens
aaaagcagttatctgggaggaa

SEQ ID NO: 9332981 - DNA, 22 bp, Homo sapiens
aaaagcatctcaaaggagcttc

SEQ ID NO: 9332982 - DNA, 22 bp, Homo sapiens
aaaagcagtttatagtcagttg

SEQ ID NO: 9332983 - DNA, 22 bp, Homo sapiens
aaaagccatgcatacctaagag

SEQ ID NO: 9332984 - DNA, 22 bp, Homo sapiens
aaaagccatgcatacctaagag

SEQ ID NO: 9332985 - DNA, 22 bp, Homo sapiens
aaaggaggccacatggctagga

SEQ ID NO: 9332986 - DNA, 22 bp, Homo sapiens
aaaggaggccacatggctagga

SEQ ID NO: 9332987 - DNA, 22 bp, Homo sapiens
aaaggataaggttatcaatttt

SEQ ID NO: 9332988 - DNA, 22 bp, Homo sapiens
aaaggattaaataaatgtgctg

SEQ ID NO: 9332989 - DNA, 22 bp, Homo sapiens
aaaggagttactcataaagctt

SEQ ID NO: 9332990 - DNA, 22 bp, Homo sapiens
aaaggagttactcataaagctt

SEQ ID NO: 9332991 - DNA, 22 bp, Homo sapiens
aaaggataaggttatcaatttt

SEQ ID NO: 9332992 - DNA, 22 bp, Homo sapiens
aaaggcacagaagggaaaccaa

SEQ ID NO: 9332993 - DNA, 22 bp, Homo sapiens
aaaggcacacactccttgttat

SEQ ID NO: 9332994 - DNA, 22 bp, Homo sapiens
aaaggattagagataccatgcc

SEQ ID NO: 9332995 - DNA, 22 bp, Homo sapiens
aaaggcactgatcttatccagt

SEQ ID NO: 9332996 - DNA, 20 bp, Homo sapiens
aaaggcacagcaacagagct

SEQ ID NO: 9332997 - DNA, 20 bp, Homo sapiens
aaaggcacagcaacagagct

SEQ ID NO: 9332998 - DNA, 22 bp, Homo sapiens
aacatgaaagttgctaagtgca

SEQ ID NO: 9332999 - DNA, 22 bp, Homo sapiens
aacatgaagttttctatagtga

SEQ ID NO: 9333000 - DNA, 22 bp, Homo sapiens
aacatgaaggtaggatggtttt

SEQ ID NO: 9333001 - DNA, 22 bp, Homo sapiens
aaagccaaatgaaagatggttc

SEQ ID NO: 9333002 - DNA, 22 bp, Homo sapiens
aaagccaaatgaaagatggttc

SEQ ID NO: 9333003 - DNA, 22 bp, Homo sapiens
aaagccaaatgaaagatggttc

SEQ ID NO: 9333004 - DNA, 22 bp, Homo sapiens
aaagccaagctgggaaggcagg

SEQ ID NO: 9333005 - DNA, 22 bp, Homo sapiens
aaagccaaatgaaagatggttc

SEQ ID NO: 9333006 - DNA, 23 bp, Homo sapiens
aaagccaagtcagtctactggaa

SEQ ID NO: 9333007 - DNA, 23 bp, Homo sapiens
aaagccaagtcagtctactggaa

SEQ ID NO: 9333008 - DNA, 20 bp, Homo sapiens
aaagcatttacttgtgattg

SEQ ID NO: 9333009 - DNA, 22 bp, Homo sapiens
aaagcattattctgtggaaaaa

SEQ ID NO: 9333010 - DNA, 22 bp, Homo sapiens
aaagcatttcatgtctagaaag

SEQ ID NO: 9333011 - DNA, 22 bp, Homo sapiens
aaagcatttcatgtctagaaag

SEQ ID NO: 9333012 - DNA, 22 bp, Homo sapiens
aaagcatgctactttatatagg

SEQ ID NO: 9333013 - DNA, 22 bp, Homo sapiens
aaattgctatatgtgaatgtga

SEQ ID NO: 9333014 - DNA, 22 bp, Homo sapiens
aaattgctctttaaaagtactg

SEQ ID NO: 9333015 - DNA, 22 bp, Homo sapiens
aaattgctgacacttgaccatt

SEQ ID NO: 9333016 - DNA, 22 bp, Homo sapiens
aaattgctggcagcctttattc

SEQ ID NO: 9333017 - DNA, 22 bp, Homo sapiens
aaattgctgaccaagtatattc

SEQ ID NO: 9333018 - DNA, 22 bp, Homo sapiens
aaattgctgaccaagtatattc

SEQ ID NO: 9333019 - DNA, 22 bp, Homo sapiens
aaattgctgaccaagtatattc

SEQ ID NO: 9333020 - DNA, 22 bp, Homo sapiens
aaattgctgacacttgaccatt

SEQ ID NO: 9333021 - DNA, 22 bp, Homo sapiens
aaattccagaaactcagtatat

SEQ ID NO: 9333022 - DNA, 22 bp, Homo sapiens
aaattcagttttaataatcact

SEQ ID NO: 9333023 - DNA, 22 bp, Homo sapiens
aaattcatatgttgaaatgcta

SEQ ID NO: 9333024 - DNA, 22 bp, Homo sapiens
aaattccaccagaatcagtaat

SEQ ID NO: 9333025 - DNA, 22 bp, Homo sapiens
aaattcatttttcttagtgtgc

SEQ ID NO: 9333026 - DNA, 22 bp, Homo sapiens
aaattagaccagttcaggtcca

SEQ ID NO: 9333027 - DNA, 23 bp, Homo sapiens
aaattcagtccttcaactctgag

SEQ ID NO: 9333028 - DNA, 22 bp, Homo sapiens
aaattcagatggctttcttttc

SEQ ID NO: 9333029 - DNA, 22 bp, Homo sapiens
aaattcagcagtgaaatgcccc

SEQ ID NO: 9333030 - DNA, 22 bp, Homo sapiens
aaagcaggttatgaccatggcc

SEQ ID NO: 9333031 - DNA, 22 bp, Homo sapiens
aaagcaggttgcaattacagtg

SEQ ID NO: 9333032 - DNA, 22 bp, Homo sapiens
aaattgcttataaagatgaatg

SEQ ID NO: 9333033 - DNA, 22 bp, Homo sapiens
aaattgcttgagattagtctcc

SEQ ID NO: 9333034 - DNA, 22 bp, Homo sapiens
aaattggagtctgaggagtaag

SEQ ID NO: 9333035 - DNA, 22 bp, Homo sapiens
aaattggatgcacatttagaaa

SEQ ID NO: 9333036 - DNA, 22 bp, Homo sapiens
aaattggattgggagaatgtga

SEQ ID NO: 9333037 - DNA, 22 bp, Homo sapiens
aaattggattttaaactgttgg

SEQ ID NO: 9333038 - DNA, 22 bp, Homo sapiens
aaattggattttaaactgttgg

SEQ ID NO: 9333039 - DNA, 22 bp, Homo sapiens
aaattgtaatgacttcacttga

SEQ ID NO: 9333040 - DNA, 22 bp, Homo sapiens
aaattgtaatgacttcacttga

SEQ ID NO: 9333041 - DNA, 22 bp, Homo sapiens
aaattgtatattccatttgtat

SEQ ID NO: 9333042 - DNA, 22 bp, Homo sapiens
aaagcagcacatggatatcagt

SEQ ID NO: 9333043 - DNA, 22 bp, Homo sapiens
aaaggctgccaggtaaaatatt

SEQ ID NO: 9333044 - DNA, 21 bp, Homo sapiens
aacatgatatgtgtatggatt

SEQ ID NO: 9333045 - DNA, 22 bp, Homo sapiens
aaaggcatgattaattctgtgt

SEQ ID NO: 9333046 - DNA, 22 bp, Homo sapiens
aaaggcatgcctccatttctat

SEQ ID NO: 9333047 - DNA, 22 bp, Homo sapiens
aacatgattggaaaatgctgtc

SEQ ID NO: 9333048 - DNA, 22 bp, Homo sapiens
aacatgatttagtataatgcag

SEQ ID NO: 9333049 - DNA, 22 bp, Homo sapiens
aaaggcttcagtgagtgggtat

SEQ ID NO: 9333050 - DNA, 22 bp, Homo sapiens
aaagggaatgtgtaggacatgt

SEQ ID NO: 9333051 - DNA, 22 bp, Homo sapiens
aaagggagcatggctgcaggga

SEQ ID NO: 9333052 - DNA, 22 bp, Homo sapiens
aaagggagcatggctgcaggga

SEQ ID NO: 9333053 - DNA, 22 bp, Homo sapiens
aaagggagcatggctgcaggga

SEQ ID NO: 9333054 - DNA, 22 bp, Homo sapiens
aaagggagcatggctgcaggga

SEQ ID NO: 9333055 - DNA, 22 bp, Homo sapiens
aaagggaggggcgataagccgg

SEQ ID NO: 9333056 - DNA, 22 bp, Homo sapiens
aaagggaggggcgataagccgg

SEQ ID NO: 9333057 - DNA, 22 bp, Homo sapiens
aaagtctttctcattggccatg

SEQ ID NO: 9333058 - DNA, 22 bp, Homo sapiens
aaagtctttctcatagtcacgc

SEQ ID NO: 9333059 - DNA, 22 bp, Homo sapiens
aaagtcttgttacgttccattg

SEQ ID NO: 9333060 - DNA, 22 bp, Homo sapiens
aaagtctttattttgtatcttt

SEQ ID NO: 9333061 - DNA, 22 bp, Homo sapiens
aacttccaggccttgaattatt

SEQ ID NO: 9333062 - DNA, 22 bp, Homo sapiens
aacttccttctagttcatatgt

SEQ ID NO: 9333063 - DNA, 22 bp, Homo sapiens
aacttccttctagttcatatgt

SEQ ID NO: 9333064 - DNA, 20 bp, Homo sapiens
aaagtcttatggttaatttt

SEQ ID NO: 9333065 - DNA, 22 bp, Homo sapiens
aaagtcttgcattgatcttgaa

SEQ ID NO: 9333066 - DNA, 22 bp, Homo sapiens
aaagtcttcacggcactagtgt

SEQ ID NO: 9333067 - DNA, 22 bp, Homo sapiens
aaagtcttaatgtaagtttagt

SEQ ID NO: 9333068 - DNA, 22 bp, Homo sapiens
aaagtccagagggcacactgaa

SEQ ID NO: 9333069 - DNA, 22 bp, Homo sapiens
aaagtcctgttaactgttaaca

SEQ ID NO: 9333070 - DNA, 22 bp, Homo sapiens
aaagtcctgttaactgttaaca

SEQ ID NO: 9333071 - DNA, 22 bp, Homo sapiens
aacttctttgagctccagtttt

SEQ ID NO: 9333072 - DNA, 22 bp, Homo sapiens
aacttgaaaacctcatgaattg

SEQ ID NO: 9333073 - DNA, 22 bp, Homo sapiens
aaagttctgggggagaagaacg

SEQ ID NO: 9333074 - DNA, 22 bp, Homo sapiens
aaagttctgggggagaagaacg

SEQ ID NO: 9333075 - DNA, 22 bp, Homo sapiens
aaagttacacatctagtaagtg

SEQ ID NO: 9333076 - DNA, 22 bp, Homo sapiens
aaagttctctatggtgtaaaaa

SEQ ID NO: 9333077 - DNA, 22 bp, Homo sapiens
aaatcagagtctgattttaagg

SEQ ID NO: 9333078 - DNA, 22 bp, Homo sapiens
aaatcagacacagtgaaagtta

SEQ ID NO: 9333079 - DNA, 22 bp, Homo sapiens
aaatcagacttgaattttcatc

SEQ ID NO: 9333080 - DNA, 22 bp, Homo sapiens
aaatcagaggtcagctgtacca

SEQ ID NO: 9333081 - DNA, 22 bp, Homo sapiens
aaatgatagtatggaactagga

SEQ ID NO: 9333082 - DNA, 22 bp, Homo sapiens
aaatgagtagcgatgcacatta

SEQ ID NO: 9333083 - DNA, 22 bp, Homo sapiens
aaatgacattaggatcctgcat

SEQ ID NO: 9333084 - DNA, 23 bp, Homo sapiens
aaatgacatatggtttctgaagg

SEQ ID NO: 9333085 - DNA, 22 bp, Homo sapiens
aaatatttgtctgaggcggttg

SEQ ID NO: 9333086 - DNA, 22 bp, Homo sapiens
aaatcaaaagacatgtgtttta

SEQ ID NO: 9333087 - DNA, 22 bp, Homo sapiens
aaatcaaaagacatgtgtttta

SEQ ID NO: 9333088 - DNA, 22 bp, Homo sapiens
aaatattggtaggatgcttgtt

SEQ ID NO: 9333089 - DNA, 22 bp, Homo sapiens
aaatattgttttggtaagcttc

SEQ ID NO: 9333090 - DNA, 22 bp, Homo sapiens
aaatattgttttggtaagcttc

SEQ ID NO: 9333091 - DNA, 23 bp, Homo sapiens
aaatattcttttttagtaagtgc

SEQ ID NO: 9333092 - DNA, 22 bp, Homo sapiens
aaatcaaggagggattatattt

SEQ ID NO: 9333093 - DNA, 22 bp, Homo sapiens
aaatcacagggtctctaagtat

SEQ ID NO: 9333094 - DNA, 22 bp, Homo sapiens
aaatcaaggagggattatattt

SEQ ID NO: 9333095 - DNA, 22 bp, Homo sapiens
aaatcagaaaatatggagagga

SEQ ID NO: 9333096 - DNA, 19 bp, Homo sapiens
aaatcagaatctgcatttt

SEQ ID NO: 9333097 - DNA, 22 bp, Homo sapiens
aaatcactgattaaagttagaa

SEQ ID NO: 9333098 - DNA, 22 bp, Homo sapiens
aaatgattgtcaaagttctgtt

SEQ ID NO: 9333099 - DNA, 22 bp, Homo sapiens
aaatgattgtcaaagttctgtt

SEQ ID NO: 9333100 - DNA, 22 bp, Homo sapiens
aaatgcaaggccatgtgaagga

SEQ ID NO: 9333101 - DNA, 22 bp, Homo sapiens
aaatgatggtactcatgtttag

SEQ ID NO: 9333102 - DNA, 22 bp, Homo sapiens
aaatgatgttataagaccagga

SEQ ID NO: 9333103 - DNA, 22 bp, Homo sapiens
aaatgatgctacagttttccca

SEQ ID NO: 9333104 - DNA, 22 bp, Homo sapiens
aaatgcaattgtatgtactcca

SEQ ID NO: 9333105 - DNA, 18 bp, Homo sapiens
aaatgctgctcaaattcc

SEQ ID NO: 9333106 - DNA, 22 bp, Homo sapiens
aaatgctgtaactgatattctg

SEQ ID NO: 9333107 - DNA, 22 bp, Homo sapiens
aaatgctgtgttttaacataga

SEQ ID NO: 9333108 - DNA, 20 bp, Homo sapiens
aaatgctgtgctgttgccat

SEQ ID NO: 9333109 - DNA, 22 bp, Homo sapiens
aaatgctgtcagtgttattgga

SEQ ID NO: 9333110 - DNA, 22 bp, Homo sapiens
aaatgctgtgttttaacataga

SEQ ID NO: 9333111 - DNA, 22 bp, Homo sapiens
aaatggaactgggctactaggt

SEQ ID NO: 9333112 - DNA, 22 bp, Homo sapiens
aaatgcttgctcttgattattt

SEQ ID NO: 9333113 - DNA, 22 bp, Homo sapiens
aaatataccagttgcctgcatc

SEQ ID NO: 9333114 - DNA, 22 bp, Homo sapiens
aaatatacggtccctaacagtc

SEQ ID NO: 9333115 - DNA, 22 bp, Homo sapiens
aaatataccagttgcctgcatc

SEQ ID NO: 9333116 - DNA, 22 bp, Homo sapiens
aaatataatttctgcctcaata

SEQ ID NO: 9333117 - DNA, 22 bp, Homo sapiens
aaatataatttctgcctcaata

SEQ ID NO: 9333118 - DNA, 22 bp, Homo sapiens
aaatatagcaattatgcctact

SEQ ID NO: 9333119 - DNA, 22 bp, Homo sapiens
aaatatacggtccctaacagtc

SEQ ID NO: 9333120 - DNA, 22 bp, Homo sapiens
aaatatactagatgatgaccca

SEQ ID NO: 9333121 - DNA, 22 bp, Homo sapiens
aagagagaccatgggggacagg

SEQ ID NO: 9333122 - DNA, 22 bp, Homo sapiens
aagagagagtgcgctcacagaa

SEQ ID NO: 9333123 - DNA, 22 bp, Homo sapiens
aagagagagtgcgctcacagaa

SEQ ID NO: 9333124 - DNA, 22 bp, Homo sapiens
aagagagagtgcgctcacagaa

SEQ ID NO: 9333125 - DNA, 22 bp, Homo sapiens
aagagagaccatgggggacagg

SEQ ID NO: 9333126 - DNA, 22 bp, Homo sapiens
aagagagacaataggtagcatt

SEQ ID NO: 9333127 - DNA, 22 bp, Homo sapiens
aagagagaagtctctctggttc

SEQ ID NO: 9333128 - DNA, 22 bp, Homo sapiens
aagagagacaataggtagcatt

SEQ ID NO: 9333129 - DNA, 22 bp, Homo sapiens
aaatatgagagtaggagtttgg

SEQ ID NO: 9333130 - DNA, 22 bp, Homo sapiens
aaatatagtgacacttatagtc

SEQ ID NO: 9333131 - DNA, 22 bp, Homo sapiens
aagagtttctttattaaccttt

SEQ ID NO: 9333132 - DNA, 22 bp, Homo sapiens
aagaagcaggtcacagacaggg

SEQ ID NO: 9333133 - DNA, 22 bp, Homo sapiens
aagaaggcggaccagaagggag

SEQ ID NO: 9333134 - DNA, 22 bp, Homo sapiens
aagaaggtgtggaaagatgctc

SEQ ID NO: 9333135 - DNA, 22 bp, Homo sapiens
aaatacaaaaattagccaggca

SEQ ID NO: 9333136 - DNA, 22 bp, Homo sapiens
aaatacaaaaattagccaggca

SEQ ID NO: 9333137 - DNA, 22 bp, Homo sapiens
aaatacataaaggttgtaccag

SEQ ID NO: 9333138 - DNA, 22 bp, Homo sapiens
aaatacataaaggttgtaccag

SEQ ID NO: 9333139 - DNA, 22 bp, Homo sapiens
aaatacagtggcagcagataat

SEQ ID NO: 9333140 - DNA, 22 bp, Homo sapiens
aaatacagtgtgtgttctttga

SEQ ID NO: 9333141 - DNA, 22 bp, Homo sapiens
aagagagaactcccttcgccag

SEQ ID NO: 9333142 - DNA, 22 bp, Homo sapiens
aaatacatacactgtacgtggc

SEQ ID NO: 9333143 - DNA, 22 bp, Homo sapiens
aaatacatacactgtacgtggc

SEQ ID NO: 9333144 - DNA, 22 bp, Homo sapiens
acacagttcatgcatgaggtct

SEQ ID NO: 9333145 - DNA, 22 bp, Homo sapiens
acacagttcgttgttttctact

SEQ ID NO: 9333146 - DNA, 22 bp, Homo sapiens
acacagttcgtgcttttctatt

SEQ ID NO: 9333147 - DNA, 22 bp, Homo sapiens
acacagttctttcactgttggt

SEQ ID NO: 9333148 - DNA, 22 bp, Homo sapiens
acacagtttatggtattctgtt

SEQ ID NO: 9333149 - DNA, 22 bp, Homo sapiens
agcagggaagcctccagaacct

SEQ ID NO: 9333150 - DNA, 21 bp, Homo sapiens
agcaggctttggagtggggct

SEQ ID NO: 9333151 - DNA, 22 bp, Homo sapiens
agcaggctttccacagaaggag

SEQ ID NO: 9333152 - DNA, 22 bp, Homo sapiens
agcaggctttccacagaaggag

SEQ ID NO: 9333153 - DNA, 22 bp, Homo sapiens
agcaggcttggtccccagcctc

SEQ ID NO: 9333154 - DNA, 22 bp, Homo sapiens
agcaggcttgttatgtctgaga

SEQ ID NO: 9333155 - DNA, 19 bp, Homo sapiens
agcaggccacagggccagc

SEQ ID NO: 9333156 - DNA, 22 bp, Homo sapiens
acacagtttttcagacagagat

SEQ ID NO: 9333157 - DNA, 19 bp, Homo sapiens
agcagggacatggaacttt

SEQ ID NO: 9333158 - DNA, 22 bp, Homo sapiens
agcagggacatggcatctctcc

SEQ ID NO: 9333159 - DNA, 22 bp, Homo sapiens
agcagggactacgtgaaagtga

SEQ ID NO: 9333160 - DNA, 22 bp, Homo sapiens
agcagggacatggcatctctcc

SEQ ID NO: 9333161 - DNA, 19 bp, Homo sapiens
agcagggacatggaacttt

SEQ ID NO: 9333162 - DNA, 22 bp, Homo sapiens
agcagggaatagcggaaagaat

SEQ ID NO: 9333163 - DNA, 22 bp, Homo sapiens
agcagggactacgtgaaagtga

SEQ ID NO: 9333164 - DNA, 22 bp, Homo sapiens
agcagggactgagccagtggga

SEQ ID NO: 9333165 - DNA, 22 bp, Homo sapiens
agcagggactacgtgaaagtga

SEQ ID NO: 9333166 - DNA, 22 bp, Homo sapiens
agcagggagaccatctcttcct

SEQ ID NO: 9333167 - DNA, 22 bp, Homo sapiens
acacatatgtcattgaaaaatc

SEQ ID NO: 9333168 - DNA, 22 bp, Homo sapiens
acacatatgtcattgaaaaatc

SEQ ID NO: 9333169 - DNA, 22 bp, Homo sapiens
acacatatgtcattgaaaaatc

SEQ ID NO: 9333170 - DNA, 22 bp, Homo sapiens
acacatctatattgcatctgca

SEQ ID NO: 9333171 - DNA, 22 bp, Homo sapiens
acacatctatattgcatctgca

SEQ ID NO: 9333172 - DNA, 22 bp, Homo sapiens
acacatctccagaagtgggctg

SEQ ID NO: 9333173 - DNA, 22 bp, Homo sapiens
acacatctatctctacacaagg

SEQ ID NO: 9333174 - DNA, 22 bp, Homo sapiens
acacatctatctctacacaagg

SEQ ID NO: 9333175 - DNA, 22 bp, Homo sapiens
acacatctatctctacacaagg

SEQ ID NO: 9333176 - DNA, 22 bp, Homo sapiens
acacatcagaaatatgaatgag

SEQ ID NO: 9333177 - DNA, 22 bp, Homo sapiens
acacatcagaaatatgaatgag

SEQ ID NO: 9333178 - DNA, 22 bp, Homo sapiens
acacatatgtggcaactgtaga

SEQ ID NO: 9333179 - DNA, 22 bp, Homo sapiens
acacatatgtggcaactgtaga

SEQ ID NO: 9333180 - DNA, 22 bp, Homo sapiens
acacatatgtggcaactgtaga

SEQ ID NO: 9333181 - DNA, 22 bp, Homo sapiens
acacatattcatatgtacttac

SEQ ID NO: 9333182 - DNA, 22 bp, Homo sapiens
acacatattcatatgtacttac

SEQ ID NO: 9333183 - DNA, 22 bp, Homo sapiens
acacatatgtggcaactgtaga

SEQ ID NO: 9333184 - DNA, 22 bp, Homo sapiens
acacacacaagcaggttgtgga

SEQ ID NO: 9333185 - DNA, 22 bp, Homo sapiens
acacaatgtcatcataatgtca

SEQ ID NO: 9333186 - DNA, 19 bp, Homo sapiens
acacaatgacacatatata

SEQ ID NO: 9333187 - DNA, 22 bp, Homo sapiens
acacaagattgtgtattgaatt

SEQ ID NO: 9333188 - DNA, 22 bp, Homo sapiens
acacaagattgtgtattgaatt

SEQ ID NO: 9333189 - DNA, 23 bp, Homo sapiens
acacaatagagtactattcagcc

SEQ ID NO: 9333190 - DNA, 23 bp, Homo sapiens
acacaatagagtactattcagcc

SEQ ID NO: 9333191 - DNA, 22 bp, Homo sapiens
acacagtggtgtttacaaaatt

SEQ ID NO: 9333192 - DNA, 22 bp, Homo sapiens
acacagtgtcagggcaggggcc

SEQ ID NO: 9333193 - DNA, 22 bp, Homo sapiens
acacagtgtgtgcagtcggacg

SEQ ID NO: 9333194 - DNA, 22 bp, Homo sapiens
acacagtgtccttctacttgcc

SEQ ID NO: 9333195 - DNA, 22 bp, Homo sapiens
acacagtgtcttaggtagtgtc

SEQ ID NO: 9333196 - DNA, 22 bp, Homo sapiens
acacagtgccaaattgcagtta

SEQ ID NO: 9333197 - DNA, 22 bp, Homo sapiens
acacacacaagcaggttgtgga

SEQ ID NO: 9333198 - DNA, 22 bp, Homo sapiens
acacacacaagcaggttgtgga

SEQ ID NO: 9333199 - DNA, 22 bp, Homo sapiens
acacagggcggaaagcatgaga

SEQ ID NO: 9333200 - DNA, 19 bp, Homo sapiens
acacagggctagagttaca

SEQ ID NO: 9333201 - DNA, 18 bp, Homo sapiens
acacacacacctgtgtat

SEQ ID NO: 9333202 - DNA, 18 bp, Homo sapiens
acacacacacctgtgtat

SEQ ID NO: 9333203 - DNA, 18 bp, Homo sapiens
acacacacacctgtgtat

SEQ ID NO: 9333204 - DNA, 22 bp, Homo sapiens
acacagtatgaaaagtctagtt

SEQ ID NO: 9333205 - DNA, 19 bp, Homo sapiens
acacagggctagagttaca

SEQ ID NO: 9333206 - DNA, 22 bp, Homo sapiens
acacagtatgcatctagaaatt

SEQ ID NO: 9333207 - DNA, 22 bp, Homo sapiens
acacagtatgacattggcagag

SEQ ID NO: 9333208 - DNA, 22 bp, Homo sapiens
acaccatgatgagtgatgtagc

SEQ ID NO: 9333209 - DNA, 22 bp, Homo sapiens
acaccatactcatgttggttcc

SEQ ID NO: 9333210 - DNA, 22 bp, Homo sapiens
acaccaggtcccgtctgtacct

SEQ ID NO: 9333211 - DNA, 22 bp, Homo sapiens
acaccagggcctagccagggcg

SEQ ID NO: 9333212 - DNA, 22 bp, Homo sapiens
agcaggtgtcactttcactcca

SEQ ID NO: 9333213 - DNA, 22 bp, Homo sapiens
agcaggtgtcactttcactcca

SEQ ID NO: 9333214 - DNA, 22 bp, Homo sapiens
agcaggtgtatcggtcacctac

SEQ ID NO: 9333215 - DNA, 22 bp, Homo sapiens
acaccagggcctagccagggcg

SEQ ID NO: 9333216 - DNA, 22 bp, Homo sapiens
acaccagggatatgaggaagga

SEQ ID NO: 9333217 - DNA, 22 bp, Homo sapiens
acaccatggttcccaaactgtg

SEQ ID NO: 9333218 - DNA, 22 bp, Homo sapiens
acacccagagcgccagtgccga

SEQ ID NO: 9333219 - DNA, 22 bp, Homo sapiens
acacccagagcgccagtgccga

SEQ ID NO: 9333220 - DNA, 22 bp, Homo sapiens
agcaggtgagcacagccaggct

SEQ ID NO: 9333221 - DNA, 22 bp, Homo sapiens
agcaggtgatcgcgtgtgctcc

SEQ ID NO: 9333222 - DNA, 22 bp, Homo sapiens
agcaggtggtaggcagtcagca

SEQ ID NO: 9333223 - DNA, 22 bp, Homo sapiens
agcaggtggtaggcagtcagca

SEQ ID NO: 9333224 - DNA, 22 bp, Homo sapiens
agcaggtggtaggcagtcagca

SEQ ID NO: 9333225 - DNA, 19 bp, Homo sapiens
agcaggtgggtaagaaaat

SEQ ID NO: 9333226 - DNA, 22 bp, Homo sapiens
agcaggtggtaggcagtcagca

SEQ ID NO: 9333227 - DNA, 22 bp, Homo sapiens
agcaggtggtgggccagatttg

SEQ ID NO: 9333228 - DNA, 22 bp, Homo sapiens
agcaggtggtctgttgctgctg

SEQ ID NO: 9333229 - DNA, 21 bp, Homo sapiens
agcaggtgtaaaggaggaaat

SEQ ID NO: 9333230 - DNA, 22 bp, Homo sapiens
agcaggtggtgggccagatttg

SEQ ID NO: 9333231 - DNA, 22 bp, Homo sapiens
agcaggtggtctgttgctgctg

SEQ ID NO: 9333232 - DNA, 22 bp, Homo sapiens
agcaggtggtaggcagtcagca

SEQ ID NO: 9333233 - DNA, 21 bp, Homo sapiens
agcaggtgtaaaggaggaaat

SEQ ID NO: 9333234 - DNA, 21 bp, Homo sapiens
agcaggtgtaaaggaggaaat

SEQ ID NO: 9333235 - DNA, 16 bp, Homo sapiens
agcaggtgtatagtgt

SEQ ID NO: 9333236 - DNA, 22 bp, Homo sapiens
agcaggtgtagggctctttgta

SEQ ID NO: 9333237 - DNA, 22 bp, Homo sapiens
agcaggtgtagggctctttgta

SEQ ID NO: 9333238 - DNA, 22 bp, Homo sapiens
agcaggtgtagggctctttgta

SEQ ID NO: 9333239 - DNA, 22 bp, Homo sapiens
agcaggtgtatataaggctgag

SEQ ID NO: 9333240 - DNA, 22 bp, Homo sapiens
agcaggtgtatataaggctgag

SEQ ID NO: 9333241 - DNA, 22 bp, Homo sapiens
agcaggtgtatataaggctgag

SEQ ID NO: 9333242 - DNA, 16 bp, Homo sapiens
agcaggtgtatagtgt

SEQ ID NO: 9333243 - DNA, 22 bp, Homo sapiens
agcaggtgtatcggtcacctac

SEQ ID NO: 9333244 - DNA, 22 bp, Homo sapiens
agcaggtgtatcggtcacctac

SEQ ID NO: 9333245 - DNA, 22 bp, Homo sapiens
agccaaggcagctagagctctg

SEQ ID NO: 9333246 - DNA, 22 bp, Homo sapiens
agccaagggtcagctgcacaga

SEQ ID NO: 9333247 - DNA, 22 bp, Homo sapiens
agccaatctacaacaaaggata

SEQ ID NO: 9333248 - DNA, 22 bp, Homo sapiens
agccaatcatcctcagactctc

SEQ ID NO: 9333249 - DNA, 22 bp, Homo sapiens
agccaaggtcgccccagggcaa

SEQ ID NO: 9333250 - DNA, 22 bp, Homo sapiens
agccaaggagtgcaggtggctt

SEQ ID NO: 9333251 - DNA, 22 bp, Homo sapiens
agccaaggcagctagagctctg

SEQ ID NO: 9333252 - DNA, 22 bp, Homo sapiens
agcatttacctcaatgcatctg

SEQ ID NO: 9333253 - DNA, 22 bp, Homo sapiens
agccaaggacacggagcctcct

SEQ ID NO: 9333254 - DNA, 22 bp, Homo sapiens
agcatttaattacagtttaatt

SEQ ID NO: 9333255 - DNA, 22 bp, Homo sapiens
agcatttacctcaatgcatctg

SEQ ID NO: 9333256 - DNA, 20 bp, Homo sapiens
agcatttacatcccttggtg

SEQ ID NO: 9333257 - DNA, 22 bp, Homo sapiens
acacccagcttttgaatgccct

SEQ ID NO: 9333258 - DNA, 22 bp, Homo sapiens
acacttaagcatgaagtataaa

SEQ ID NO: 9333259 - DNA, 22 bp, Homo sapiens
acacttatttttgtccacttcc

SEQ ID NO: 9333260 - DNA, 22 bp, Homo sapiens
acacttagctgagggtgcagat

SEQ ID NO: 9333261 - DNA, 22 bp, Homo sapiens
acacttatacaaagaatgtctg

SEQ ID NO: 9333262 - DNA, 22 bp, Homo sapiens
acacttatttcttgtctaacca

SEQ ID NO: 9333263 - DNA, 22 bp, Homo sapiens
acactgttccacactaagaagg

SEQ ID NO: 9333264 - DNA, 22 bp, Homo sapiens
acactgtgtggtctctctcgga

SEQ ID NO: 9333265 - DNA, 22 bp, Homo sapiens
acactgtgtttacatagagaat

SEQ ID NO: 9333266 - DNA, 22 bp, Homo sapiens
acactgttcctgaaattgttat

SEQ ID NO: 9333267 - DNA, 22 bp, Homo sapiens
agccacagtctgtagccagctt

SEQ ID NO: 9333268 - DNA, 23 bp, Homo sapiens
acacttcacccattgtgatagga

SEQ ID NO: 9333269 - DNA, 22 bp, Homo sapiens
agccagagatccatccctagga

SEQ ID NO: 9333270 - DNA, 22 bp, Homo sapiens
agccagagattgagatgcaggc

SEQ ID NO: 9333271 - DNA, 22 bp, Homo sapiens
agccagagattgagatgcaggc

SEQ ID NO: 9333272 - DNA, 22 bp, Homo sapiens
agccagagattgagatgcaggc

SEQ ID NO: 9333273 - DNA, 22 bp, Homo sapiens
agccagaggaagcctggccctc

SEQ ID NO: 9333274 - DNA, 22 bp, Homo sapiens
agccagaggaagcctggccctc

SEQ ID NO: 9333275 - DNA, 22 bp, Homo sapiens
agccagagctgatgtcattctc

SEQ ID NO: 9333276 - DNA, 22 bp, Homo sapiens
agccagagctgatgtcattctc

SEQ ID NO: 9333277 - DNA, 22 bp, Homo sapiens
agccagctgtactgcctgctca

SEQ ID NO: 9333278 - DNA, 22 bp, Homo sapiens
agccagctgtactgcctgctca

SEQ ID NO: 9333279 - DNA, 22 bp, Homo sapiens
agccagctggtgggtcagctgg

SEQ ID NO: 9333280 - DNA, 22 bp, Homo sapiens
agccagctgtgggctcaggcgg

SEQ ID NO: 9333281 - DNA, 22 bp, Homo sapiens
agccaggaagagaggcctcacc

SEQ ID NO: 9333282 - DNA, 22 bp, Homo sapiens
agccaggaagagaggcctcacc

SEQ ID NO: 9333283 - DNA, 22 bp, Homo sapiens
agccaggaagaaggtcacacca

SEQ ID NO: 9333284 - DNA, 22 bp, Homo sapiens
agccagctgttctggggcagca

SEQ ID NO: 9333285 - DNA, 22 bp, Homo sapiens
agccagcttctttacggtggca

SEQ ID NO: 9333286 - DNA, 22 bp, Homo sapiens
agccaggaaccagctacagtct

SEQ ID NO: 9333287 - DNA, 22 bp, Homo sapiens
agccagagggatctttctaaga

SEQ ID NO: 9333288 - DNA, 22 bp, Homo sapiens
agccagaggtcatgagcacagg

SEQ ID NO: 9333289 - DNA, 22 bp, Homo sapiens
agccagaggtcatgagcacagg

SEQ ID NO: 9333290 - DNA, 22 bp, Homo sapiens
agccagaggccagcctgcctca

SEQ ID NO: 9333291 - DNA, 22 bp, Homo sapiens
agccagagggatctttctaaga

SEQ ID NO: 9333292 - DNA, 22 bp, Homo sapiens
agccagaggccagcctgcctca

SEQ ID NO: 9333293 - DNA, 22 bp, Homo sapiens
agccagaggccagcctgcctca

SEQ ID NO: 9333294 - DNA, 22 bp, Homo sapiens
agccagctgctcgggggaaaca

SEQ ID NO: 9333295 - DNA, 22 bp, Homo sapiens
agccagctgcctttcacatctg

SEQ ID NO: 9333296 - DNA, 19 bp, Homo sapiens
agccagagtggcccagggg

SEQ ID NO: 9333297 - DNA, 19 bp, Homo sapiens
agccagagtggcccagggg

SEQ ID NO: 9333298 - DNA, 22 bp, Homo sapiens
agccagaggtcatgagcacagg

SEQ ID NO: 9333299 - DNA, 22 bp, Homo sapiens
acagcagggaatatgggaattg

SEQ ID NO: 9333300 - DNA, 22 bp, Homo sapiens
acagcagggaatatgggaattg

SEQ ID NO: 9333301 - DNA, 22 bp, Homo sapiens
acagcagggaatatgggaattg

SEQ ID NO: 9333302 - DNA, 19 bp, Homo sapiens
acagcagggatttttggag

SEQ ID NO: 9333303 - DNA, 17 bp, Homo sapiens
acagcagggaagtgttg

SEQ ID NO: 9333304 - DNA, 17 bp, Homo sapiens
acagcagggaagtgttg

SEQ ID NO: 9333305 - DNA, 22 bp, Homo sapiens
acagcagggaatatgggaattg

SEQ ID NO: 9333306 - DNA, 17 bp, Homo sapiens
acagcagggaagtgttg

SEQ ID NO: 9333307 - DNA, 22 bp, Homo sapiens
acagcaggcccatactggaagg

SEQ ID NO: 9333308 - DNA, 22 bp, Homo sapiens
acagcaggcccatactggaagg

SEQ ID NO: 9333309 - DNA, 22 bp, Homo sapiens
acagcaggcccatactggaagg

SEQ ID NO: 9333310 - DNA, 22 bp, Homo sapiens
acagcaggcccatactggaagg

SEQ ID NO: 9333311 - DNA, 17 bp, Homo sapiens
acagcaggcccggaggg

SEQ ID NO: 9333312 - DNA, 17 bp, Homo sapiens
acagcaggcccggaggg

SEQ ID NO: 9333313 - DNA, 17 bp, Homo sapiens
acagcaggcccggaggg

SEQ ID NO: 9333314 - DNA, 17 bp, Homo sapiens
acagcaggcccggaggg

SEQ ID NO: 9333315 - DNA, 17 bp, Homo sapiens
acagcaggcccggaggg

SEQ ID NO: 9333316 - DNA, 18 bp, Homo sapiens
acagcaggtttcattctt

SEQ ID NO: 9333317 - DNA, 18 bp, Homo sapiens
acagcaggtttcattctt

SEQ ID NO: 9333318 - DNA, 22 bp, Homo sapiens
acagcaggttattgttatggca

SEQ ID NO: 9333319 - DNA, 22 bp, Homo sapiens
acagcaggttattgttatggca

SEQ ID NO: 9333320 - DNA, 21 bp, Homo sapiens
acagcagggctggcatgacag

SEQ ID NO: 9333321 - DNA, 22 bp, Homo sapiens
acagcaggttacagtggcacag

SEQ ID NO: 9333322 - DNA, 21 bp, Homo sapiens
acagcagggctggcatgacag

SEQ ID NO: 9333323 - DNA, 21 bp, Homo sapiens
acagcagggctggcatgacag

SEQ ID NO: 9333324 - DNA, 21 bp, Homo sapiens
acagcagggctggcatgacag

SEQ ID NO: 9333325 - DNA, 19 bp, Homo sapiens
acagcagggatttttggag

SEQ ID NO: 9333326 - DNA, 22 bp, Homo sapiens
acagcaggttttaactttgaag

SEQ ID NO: 9333327 - DNA, 18 bp, Homo sapiens
acagcaggtttcattctt

SEQ ID NO: 9333328 - DNA, 22 bp, Homo sapiens
acagcaggttttaactttgaag

SEQ ID NO: 9333329 - DNA, 22 bp, Homo sapiens
acagcaggttttaactttgaag

SEQ ID NO: 9333330 - DNA, 22 bp, Homo sapiens
acagcaggttttaactttgaag

SEQ ID NO: 9333331 - DNA, 22 bp, Homo sapiens
acagcaggttttaactttgaag

SEQ ID NO: 9333332 - DNA, 22 bp, Homo sapiens
acagcagtgcacagagaaccct

SEQ ID NO: 9333333 - DNA, 22 bp, Homo sapiens
acagcagtggattagaggatgg

SEQ ID NO: 9333334 - DNA, 22 bp, Homo sapiens
acagcagtgcacagagaaccct

SEQ ID NO: 9333335 - DNA, 22 bp, Homo sapiens
agctgagaggtggcaagctgta

SEQ ID NO: 9333336 - DNA, 21 bp, Homo sapiens
agctgaggtaaggcaagagag

SEQ ID NO: 9333337 - DNA, 22 bp, Homo sapiens
agctgagggttcggtgtccaca

SEQ ID NO: 9333338 - DNA, 22 bp, Homo sapiens
agctgagggttcggtgtccaca

SEQ ID NO: 9333339 - DNA, 22 bp, Homo sapiens
agctgagggcaggatggggtga

SEQ ID NO: 9333340 - DNA, 18 bp, Homo sapiens
agctgaggggactgaaga

SEQ ID NO: 9333341 - DNA, 21 bp, Homo sapiens
agctgaggtaaggcaagagag

SEQ ID NO: 9333342 - DNA, 21 bp, Homo sapiens
agctgaggtaaggcaagagag

SEQ ID NO: 9333343 - DNA, 22 bp, Homo sapiens
agctgaggttgaagagtgaacg

SEQ ID NO: 9333344 - DNA, 22 bp, Homo sapiens
acagcaggcatgaatgacactg

SEQ ID NO: 9333345 - DNA, 22 bp, Homo sapiens
agctgatgtgtccggagcagct

SEQ ID NO: 9333346 - DNA, 22 bp, Homo sapiens
agctgatgtgtccggagcagct

SEQ ID NO: 9333347 - DNA, 22 bp, Homo sapiens
agctgatgccatgtggaacagt

SEQ ID NO: 9333348 - DNA, 22 bp, Homo sapiens
agctgataggtgtaggatacac

SEQ ID NO: 9333349 - DNA, 22 bp, Homo sapiens
acagcagccagccactgtgagc

SEQ ID NO: 9333350 - DNA, 22 bp, Homo sapiens
acagcagcctgcagccctgtgt

SEQ ID NO: 9333351 - DNA, 20 bp, Homo sapiens
acagcagccttgctagaaac

SEQ ID NO: 9333352 - DNA, 22 bp, Homo sapiens
acagcagccttgttggtttcga

SEQ ID NO: 9333353 - DNA, 22 bp, Homo sapiens
acagcagcagaccagcatatgt

SEQ ID NO: 9333354 - DNA, 22 bp, Homo sapiens
acagcagcatcctatttcactc

SEQ ID NO: 9333355 - DNA, 22 bp, Homo sapiens
acagcagccagccactgtgagc

SEQ ID NO: 9333356 - DNA, 22 bp, Homo sapiens
acagcagatttccctgggctcc

SEQ ID NO: 9333357 - DNA, 22 bp, Homo sapiens
acagcagcaatagcagtgacat

SEQ ID NO: 9333358 - DNA, 22 bp, Homo sapiens
acagcagatttccctgggctcc

SEQ ID NO: 9333359 - DNA, 21 bp, Homo sapiens
acagcagcaatctgtctttcc

SEQ ID NO: 9333360 - DNA, 22 bp, Homo sapiens
acagcagcactattgacatttt

SEQ ID NO: 9333361 - DNA, 22 bp, Homo sapiens
acagcagatctggctacaggtt

SEQ ID NO: 9333362 - DNA, 22 bp, Homo sapiens
acagcagatctggctacaggtt

SEQ ID NO: 9333363 - DNA, 22 bp, Homo sapiens
acagatataaactatagtagtg

SEQ ID NO: 9333364 - DNA, 22 bp, Homo sapiens
acagatagtatgtaaattaagc

SEQ ID NO: 9333365 - DNA, 22 bp, Homo sapiens
acagatataaactatagtagtg

SEQ ID NO: 9333366 - DNA, 22 bp, Homo sapiens
acagatatatgattgtgtaaat

SEQ ID NO: 9333367 - DNA, 22 bp, Homo sapiens
acagatactataatgtaaagtg

SEQ ID NO: 9333368 - DNA, 19 bp, Homo sapiens
acagatagactccaaagca

SEQ ID NO: 9333369 - DNA, 22 bp, Homo sapiens
acagatagatgataatggcttt

SEQ ID NO: 9333370 - DNA, 22 bp, Homo sapiens
acagatagcactaagggatctg

SEQ ID NO: 9333371 - DNA, 22 bp, Homo sapiens
acagatagatttgagggaggct

SEQ ID NO: 9333372 - DNA, 23 bp, Homo sapiens
acagatagggaaggcagagtttc

SEQ ID NO: 9333373 - DNA, 17 bp, Homo sapiens
acagataggagccccat

SEQ ID NO: 9333374 - DNA, 22 bp, Homo sapiens
acagcagagtgtgagatagcca

SEQ ID NO: 9333375 - DNA, 22 bp, Homo sapiens
acagcagagtgtgagatagcca

SEQ ID NO: 9333376 - DNA, 22 bp, Homo sapiens
acagcagatctggctacaggtt

SEQ ID NO: 9333377 - DNA, 22 bp, Homo sapiens
acagcagatctggctacaggtt

SEQ ID NO: 9333378 - DNA, 20 bp, Homo sapiens
acagcagataccacaactat

SEQ ID NO: 9333379 - DNA, 20 bp, Homo sapiens
acagcagataccacaactat

SEQ ID NO: 9333380 - DNA, 22 bp, Homo sapiens
acagcagagtggagatgagcac

SEQ ID NO: 9333381 - DNA, 22 bp, Homo sapiens
acagcagagtgtgagatagcca

SEQ ID NO: 9333382 - DNA, 22 bp, Homo sapiens
acagcagaccactactagtagg

SEQ ID NO: 9333383 - DNA, 22 bp, Homo sapiens
acagcagaccactactagtagg

SEQ ID NO: 9333384 - DNA, 22 bp, Homo sapiens
acagagctgtacatgtgccatg

SEQ ID NO: 9333385 - DNA, 22 bp, Homo sapiens
acagaggcagtgtgagatactg

SEQ ID NO: 9333386 - DNA, 22 bp, Homo sapiens
acagaggccatgagctgccacc

SEQ ID NO: 9333387 - DNA, 22 bp, Homo sapiens
acagaatattgtaagtgccact

SEQ ID NO: 9333388 - DNA, 22 bp, Homo sapiens
acagaatactcataagaagggg

SEQ ID NO: 9333389 - DNA, 19 bp, Homo sapiens
acagaagcatagaaaagga

SEQ ID NO: 9333390 - DNA, 19 bp, Homo sapiens
acagaagcatagaaaagga

SEQ ID NO: 9333391 - DNA, 22 bp, Homo sapiens
acagaagcctttggccatttga

SEQ ID NO: 9333392 - DNA, 23 bp, Homo sapiens
acagaagccaggagccgctgggc

SEQ ID NO: 9333393 - DNA, 21 bp, Homo sapiens
acagaagcggcgagtggcccc

SEQ ID NO: 9333394 - DNA, 22 bp, Homo sapiens
acagaagcctttggccatttga

SEQ ID NO: 9333395 - DNA, 22 bp, Homo sapiens
acagaagctcaagagagcagtg

SEQ ID NO: 9333396 - DNA, 22 bp, Homo sapiens
acagaagctcaagagagcagtg

SEQ ID NO: 9333397 - DNA, 22 bp, Homo sapiens
acagagggtgtggaggaagacg

SEQ ID NO: 9333398 - DNA, 19 bp, Homo sapiens
acagagggcaactgagaaa

SEQ ID NO: 9333399 - DNA, 22 bp, Homo sapiens
acagagggggccttggagtgca

SEQ ID NO: 9333400 - DNA, 22 bp, Homo sapiens
acagagggtctgggcacaggac

SEQ ID NO: 9333401 - DNA, 22 bp, Homo sapiens
acagaggccgcctctctcacgg

SEQ ID NO: 9333402 - DNA, 23 bp, Homo sapiens
acagaggcttaaatgagtggcag

SEQ ID NO: 9333403 - DNA, 22 bp, Homo sapiens
agcgtggactgctgggcaaggt

SEQ ID NO: 9333404 - DNA, 22 bp, Homo sapiens
agcgtgtgtgcgggtcttcttt

SEQ ID NO: 9333405 - DNA, 22 bp, Homo sapiens
acagataatacattgtgctaca

SEQ ID NO: 9333406 - DNA, 22 bp, Homo sapiens
acagataattagcataaatgct

SEQ ID NO: 9333407 - DNA, 22 bp, Homo sapiens
acagataattagcataaatgct

SEQ ID NO: 9333408 - DNA, 22 bp, Homo sapiens
agctaaatcctacttttgtatt

SEQ ID NO: 9333409 - DNA, 22 bp, Homo sapiens
agctaaatgttgcttaaaattt

SEQ ID NO: 9333410 - DNA, 22 bp, Homo sapiens
agcggctgctccgcaggctggc

SEQ ID NO: 9333411 - DNA, 22 bp, Homo sapiens
agcggctgctccgcaggctggc

SEQ ID NO: 9333412 - DNA, 22 bp, Homo sapiens
agcggcgccggagggaggtgcg

SEQ ID NO: 9333413 - DNA, 22 bp, Homo sapiens
agcggcgccgagcttggccagg

SEQ ID NO: 9333414 - DNA, 20 bp, Homo sapiens
agcggctggcggaggacacg

SEQ ID NO: 9333415 - DNA, 20 bp, Homo sapiens
agcggctggcggaggacacg

SEQ ID NO: 9333416 - DNA, 22 bp, Homo sapiens
agcggctgtcggccagccggag

SEQ ID NO: 9333417 - DNA, 19 bp, Homo sapiens
agcggttctcaaagtcagg

SEQ ID NO: 9333418 - DNA, 22 bp, Homo sapiens
agcggtggtgtcggcagcggct

SEQ ID NO: 9333419 - DNA, 22 bp, Homo sapiens
aatgtgtctatgtggttcacag

SEQ ID NO: 9333420 - DNA, 22 bp, Homo sapiens
aatgtgtgaattgagagaagag

SEQ ID NO: 9333421 - DNA, 22 bp, Homo sapiens
aatgtgtgaacttcagagcatc

SEQ ID NO: 9333422 - DNA, 22 bp, Homo sapiens
aatgtgtgtatttctaggcgag

SEQ ID NO: 9333423 - DNA, 22 bp, Homo sapiens
aatgtgtgttcggggcccagag

SEQ ID NO: 9333424 - DNA, 22 bp, Homo sapiens
aatgtgtcccttatttcacagg

SEQ ID NO: 9333425 - DNA, 22 bp, Homo sapiens
aatgtgtcccttatttcacagg

SEQ ID NO: 9333426 - DNA, 22 bp, Homo sapiens
aatgtgtcatttcccacaggtg

SEQ ID NO: 9333427 - DNA, 22 bp, Homo sapiens
aatgtgtcatttcccacaggtg

SEQ ID NO: 9333428 - DNA, 22 bp, Homo sapiens
aatgtgtcagcttgtcgatctt

SEQ ID NO: 9333429 - DNA, 22 bp, Homo sapiens
aatgtgtcagcttgtcgatctt

SEQ ID NO: 9333430 - DNA, 22 bp, Homo sapiens
aatgtgtagtcattgatcaaga

SEQ ID NO: 9333431 - DNA, 22 bp, Homo sapiens
aatgtgtataagggagagctaa

SEQ ID NO: 9333432 - DNA, 22 bp, Homo sapiens
aatgtgtataagggagagctaa

SEQ ID NO: 9333433 - DNA, 22 bp, Homo sapiens
aatgtgtatactggcaattaag

SEQ ID NO: 9333434 - DNA, 22 bp, Homo sapiens
aatgtgtatatgaacatacagg

SEQ ID NO: 9333435 - DNA, 22 bp, Homo sapiens
aatgtgtatatgaacatacagg

SEQ ID NO: 9333436 - DNA, 22 bp, Homo sapiens
agagcaacgaggtgatactaga

SEQ ID NO: 9333437 - DNA, 22 bp, Homo sapiens
agagcaaatagagaagccagct

SEQ ID NO: 9333438 - DNA, 22 bp, Homo sapiens
agagatttctactgcactcttt

SEQ ID NO: 9333439 - DNA, 22 bp, Homo sapiens
agagatttgtcaatgatttcca

SEQ ID NO: 9333440 - DNA, 22 bp, Homo sapiens
agagatttgtcaatgatttcca

SEQ ID NO: 9333441 - DNA, 22 bp, Homo sapiens
agagcaagtgacagaaacaggg

SEQ ID NO: 9333442 - DNA, 21 bp, Homo sapiens
agagcaagttaaggcattaat

SEQ ID NO: 9333443 - DNA, 22 bp, Homo sapiens
agagcacaaattagttggtctt

SEQ ID NO: 9333444 - DNA, 22 bp, Homo sapiens
agagaaggggtaaagagtcctg

SEQ ID NO: 9333445 - DNA, 22 bp, Homo sapiens
agagaagggggaaagatctcac

SEQ ID NO: 9333446 - DNA, 22 bp, Homo sapiens
agagaagggggaaagatctcac

SEQ ID NO: 9333447 - DNA, 22 bp, Homo sapiens
agagaagggcctgtatgtaatc

SEQ ID NO: 9333448 - DNA, 22 bp, Homo sapiens
aatgtgtagatgttgcattcct

SEQ ID NO: 9333449 - DNA, 22 bp, Homo sapiens
aatgtgtagcatttaatgcagt

SEQ ID NO: 9333450 - DNA, 22 bp, Homo sapiens
agagaaggggtaaagagtcctg

SEQ ID NO: 9333451 - DNA, 22 bp, Homo sapiens
aatgtgtactttttcatgctca

SEQ ID NO: 9333452 - DNA, 22 bp, Homo sapiens
agagaagggcctgtatgtaatc

SEQ ID NO: 9333453 - DNA, 21 bp, Homo sapiens
agagaagggattccaggccct

SEQ ID NO: 9333454 - DNA, 22 bp, Homo sapiens
agagaaatgattcctgggcaga

SEQ ID NO: 9333455 - DNA, 22 bp, Homo sapiens
aatgctaaaatggcactaaagt

SEQ ID NO: 9333456 - DNA, 22 bp, Homo sapiens
aatgccttggagagcctagagg

SEQ ID NO: 9333457 - DNA, 22 bp, Homo sapiens
aatgccttggagagcctagagg

SEQ ID NO: 9333458 - DNA, 22 bp, Homo sapiens
aatgccttggagagcctagagg

SEQ ID NO: 9333459 - DNA, 22 bp, Homo sapiens
aatgccttggagagcctagagg

SEQ ID NO: 9333460 - DNA, 22 bp, Homo sapiens
aatgctattcattaagcctact

SEQ ID NO: 9333461 - DNA, 22 bp, Homo sapiens
agacaggtaaatagagatgctg

SEQ ID NO: 9333462 - DNA, 22 bp, Homo sapiens
agacaggtagcaggacagatat

SEQ ID NO: 9333463 - DNA, 20 bp, Homo sapiens
aatgctgcttctttttgcat

SEQ ID NO: 9333464 - DNA, 19 bp, Homo sapiens
aatgctgcttctttttgca

SEQ ID NO: 9333465 - DNA, 22 bp, Homo sapiens
agacatttatgtttctctagga

SEQ ID NO: 9333466 - DNA, 22 bp, Homo sapiens
agacatttagacccctgtagtt

SEQ ID NO: 9333467 - DNA, 22 bp, Homo sapiens
aatgtataatatttaatgcttt

SEQ ID NO: 9333468 - DNA, 22 bp, Homo sapiens
aatgtataatatttaatgcttt

SEQ ID NO: 9333469 - DNA, 22 bp, Homo sapiens
aatgtataatatttaatgcttt

SEQ ID NO: 9333470 - DNA, 22 bp, Homo sapiens
agacatttattcacacatttat

SEQ ID NO: 9333471 - DNA, 22 bp, Homo sapiens
agacatgtccacaaagcattca

SEQ ID NO: 9333472 - DNA, 21 bp, Homo sapiens
agacatgtgaactaaaggtga

SEQ ID NO: 9333473 - DNA, 22 bp, Homo sapiens
agacatgtggtataatcagggg

SEQ ID NO: 9333474 - DNA, 22 bp, Homo sapiens
agacatgtcaccaattcttact

SEQ ID NO: 9333475 - DNA, 22 bp, Homo sapiens
agacatggagaaggagccagtg

SEQ ID NO: 9333476 - DNA, 22 bp, Homo sapiens
aatgtattatacataatttgtg

SEQ ID NO: 9333477 - DNA, 21 bp, Homo sapiens
aatgtatgtttatctcacagt

SEQ ID NO: 9333478 - DNA, 22 bp, Homo sapiens
aatgtatgtgcatcatttacat

SEQ ID NO: 9333479 - DNA, 22 bp, Homo sapiens
aatgtatgtgattattcctcta

SEQ ID NO: 9333480 - DNA, 22 bp, Homo sapiens
aatgtatgtgtatatcaaatca

SEQ ID NO: 9333481 - DNA, 22 bp, Homo sapiens
aatgtatgtgcatcatttacat

SEQ ID NO: 9333482 - DNA, 22 bp, Homo sapiens
aatgtatgtgtatatcaaatca

SEQ ID NO: 9333483 - DNA, 23 bp, Homo sapiens
aatgtatgttagtatcttagaga

SEQ ID NO: 9333484 - DNA, 22 bp, Homo sapiens
aatgtatggattcatgtctgtg

SEQ ID NO: 9333485 - DNA, 22 bp, Homo sapiens
aatgtatggattcatgtctgtg

SEQ ID NO: 9333486 - DNA, 22 bp, Homo sapiens
aatgtatgctgtggtatcttct

SEQ ID NO: 9333487 - DNA, 22 bp, Homo sapiens
aatgtatgaaggttccagtttc

SEQ ID NO: 9333488 - DNA, 22 bp, Homo sapiens
aatgtatgacagttctagtggt

SEQ ID NO: 9333489 - DNA, 20 bp, Homo sapiens
aatgtatatgtgaccccaaa

SEQ ID NO: 9333490 - DNA, 22 bp, Homo sapiens
aatgtataatatttaatgcttt

SEQ ID NO: 9333491 - DNA, 22 bp, Homo sapiens
aatgtatgaaggttccagtttc

SEQ ID NO: 9333492 - DNA, 22 bp, Homo sapiens
agagctgggtggtggtgactca

SEQ ID NO: 9333493 - DNA, 22 bp, Homo sapiens
aattccagctgattgactttcc

SEQ ID NO: 9333494 - DNA, 22 bp, Homo sapiens
aattccaggatgcaggaggtgc

SEQ ID NO: 9333495 - DNA, 22 bp, Homo sapiens
agaggaagtaatcaggacctgc

SEQ ID NO: 9333496 - DNA, 22 bp, Homo sapiens
agaggaaggatgcatatccaaa

SEQ ID NO: 9333497 - DNA, 21 bp, Homo sapiens
agagctggtaggtaggtaggt

SEQ ID NO: 9333498 - DNA, 22 bp, Homo sapiens
agaggaagtaatcaggacctgc

SEQ ID NO: 9333499 - DNA, 22 bp, Homo sapiens
agaggaagtaatcaggacctgc

SEQ ID NO: 9333500 - DNA, 22 bp, Homo sapiens
agaggaagtaatcaggacctgc

SEQ ID NO: 9333501 - DNA, 22 bp, Homo sapiens
agaggaagtaatcaggacctgc

SEQ ID NO: 9333502 - DNA, 22 bp, Homo sapiens
agaggaagtaatcaggacctgc

SEQ ID NO: 9333503 - DNA, 22 bp, Homo sapiens
agaggaagtaatcaggacctgc

SEQ ID NO: 9333504 - DNA, 22 bp, Homo sapiens
agaggaagtaatcaggacctgc

SEQ ID NO: 9333505 - DNA, 22 bp, Homo sapiens
agaggaatatgggtgcactaga

SEQ ID NO: 9333506 - DNA, 21 bp, Homo sapiens
agaggaagtgattggtctggc

SEQ ID NO: 9333507 - DNA, 22 bp, Homo sapiens
agaggaatgtatttccctgcaa

SEQ ID NO: 9333508 - DNA, 22 bp, Homo sapiens
agaggaatctgtctagacacaa

SEQ ID NO: 9333509 - DNA, 22 bp, Homo sapiens
agaggaatttctggaaggaggc

SEQ ID NO: 9333510 - DNA, 22 bp, Homo sapiens
agaggaggtggtgatgctttaa

SEQ ID NO: 9333511 - DNA, 22 bp, Homo sapiens
agaggaggtggtgatgctttaa

SEQ ID NO: 9333512 - DNA, 22 bp, Homo sapiens
agaggaggtggtgatgctttaa

SEQ ID NO: 9333513 - DNA, 22 bp, Homo sapiens
agaggaggtggtgatgctttaa

SEQ ID NO: 9333514 - DNA, 22 bp, Homo sapiens
agaggaggtccttttctgatgt

SEQ ID NO: 9333515 - DNA, 22 bp, Homo sapiens
agaggaggtccttttctgatgt

SEQ ID NO: 9333516 - DNA, 22 bp, Homo sapiens
agaggacaaaatgagaagtgct

SEQ ID NO: 9333517 - DNA, 22 bp, Homo sapiens
agaggatgattttaaggacact

SEQ ID NO: 9333518 - DNA, 22 bp, Homo sapiens
agaggatgattttaaggacact

SEQ ID NO: 9333519 - DNA, 22 bp, Homo sapiens
agaggatcatctagtttgactc

SEQ ID NO: 9333520 - DNA, 22 bp, Homo sapiens
agaggagtgggaagcagtgcaa

SEQ ID NO: 9333521 - DNA, 22 bp, Homo sapiens
aatttcacagctggtctatggg

SEQ ID NO: 9333522 - DNA, 22 bp, Homo sapiens
aatttcacagtgaactttgagg

SEQ ID NO: 9333523 - DNA, 22 bp, Homo sapiens
aatttccagatcagatgactca

SEQ ID NO: 9333524 - DNA, 22 bp, Homo sapiens
aatttcctgggataaaaagcca

SEQ ID NO: 9333525 - DNA, 18 bp, Homo sapiens
aatttccatatgaattgc

SEQ ID NO: 9333526 - DNA, 18 bp, Homo sapiens
aatttccatatgaattgc

SEQ ID NO: 9333527 - DNA, 22 bp, Homo sapiens
aatttcggttcaaggcccagtt

SEQ ID NO: 9333528 - DNA, 22 bp, Homo sapiens
agaggcaaaaatctatggcaac

SEQ ID NO: 9333529 - DNA, 22 bp, Homo sapiens
agagcacagcagatctctgatg

SEQ ID NO: 9333530 - DNA, 22 bp, Homo sapiens
aattaatggaaagtaaggaagg

SEQ ID NO: 9333531 - DNA, 21 bp, Homo sapiens
aattacagatggaattacaga

SEQ ID NO: 9333532 - DNA, 22 bp, Homo sapiens
aattaattttgttcattcagtc

SEQ ID NO: 9333533 - DNA, 22 bp, Homo sapiens
agagcctggcaaaaggtcctgc

SEQ ID NO: 9333534 - DNA, 22 bp, Homo sapiens
aattacagtcggagcagcactg

SEQ ID NO: 9333535 - DNA, 22 bp, Homo sapiens
agagcctggctcccagctaccg

SEQ ID NO: 9333536 - DNA, 22 bp, Homo sapiens
agagctgaggatccagctgagc

SEQ ID NO: 9333537 - DNA, 22 bp, Homo sapiens
agagctgagcaccaagcatggt

SEQ ID NO: 9333538 - DNA, 22 bp, Homo sapiens
agagctgaatttgggtggtgga

SEQ ID NO: 9333539 - DNA, 22 bp, Homo sapiens
aattcattgccagaatctatga

SEQ ID NO: 9333540 - DNA, 22 bp, Homo sapiens
aattcatcattttatagctagt

SEQ ID NO: 9333541 - DNA, 22 bp, Homo sapiens
aattcatatggatatgctagta

SEQ ID NO: 9333542 - DNA, 22 bp, Homo sapiens
aattcattaagaaagagctaaa

SEQ ID NO: 9333543 - DNA, 22 bp, Homo sapiens
aattcatgagtagaatctatat

SEQ ID NO: 9333544 - DNA, 22 bp, Homo sapiens
aattcatgagtagaatctatat

SEQ ID NO: 9333545 - DNA, 22 bp, Homo sapiens
aattcatactctatattgcttt

SEQ ID NO: 9333546 - DNA, 22 bp, Homo sapiens
agagctggaatcagacctcagg

SEQ ID NO: 9333547 - DNA, 22 bp, Homo sapiens
agagctgctcagatgtcactgc

SEQ ID NO: 9333548 - DNA, 22 bp, Homo sapiens
acaagtttcattgtttagaacc

SEQ ID NO: 9333549 - DNA, 22 bp, Homo sapiens
acaagtttcattgtttagaacc

SEQ ID NO: 9333550 - DNA, 19 bp, Homo sapiens
acaataactcattgattgc

SEQ ID NO: 9333551 - DNA, 22 bp, Homo sapiens
acaagttttggaagtcttaagg

SEQ ID NO: 9333552 - DNA, 22 bp, Homo sapiens
acaatagaaataattaagcaca

SEQ ID NO: 9333553 - DNA, 22 bp, Homo sapiens
acaatagaaggaaactgacata

SEQ ID NO: 9333554 - DNA, 22 bp, Homo sapiens
acaataatgtattgccaaaagt

SEQ ID NO: 9333555 - DNA, 22 bp, Homo sapiens
agattttggctggctggagaga

SEQ ID NO: 9333556 - DNA, 22 bp, Homo sapiens
acaacattcttaaatacactga

SEQ ID NO: 9333557 - DNA, 22 bp, Homo sapiens
acaacatcagctgagaccttca

SEQ ID NO: 9333558 - DNA, 22 bp, Homo sapiens
agcaaataaagacaattatgtc

SEQ ID NO: 9333559 - DNA, 22 bp, Homo sapiens
agcaaagtatgtgctgggagct

SEQ ID NO: 9333560 - DNA, 22 bp, Homo sapiens
agcacacaggacttgattcatg

SEQ ID NO: 9333561 - DNA, 22 bp, Homo sapiens
agcacacaggacttgattcatg

SEQ ID NO: 9333562 - DNA, 22 bp, Homo sapiens
agcacacaggccacctccactt

SEQ ID NO: 9333563 - DNA, 22 bp, Homo sapiens
agcaaggccgagaggatgctat

SEQ ID NO: 9333564 - DNA, 22 bp, Homo sapiens
agcaaggcagtcagctggctgg

SEQ ID NO: 9333565 - DNA, 22 bp, Homo sapiens
agcacaaatataaaaatgtctg

SEQ ID NO: 9333566 - DNA, 22 bp, Homo sapiens
agcacaagtttctggcagacag

SEQ ID NO: 9333567 - DNA, 22 bp, Homo sapiens
agcacagaatggcttggaagcc

SEQ ID NO: 9333568 - DNA, 19 bp, Homo sapiens
agcacagacaagaccagca

SEQ ID NO: 9333569 - DNA, 19 bp, Homo sapiens
agcacagacaagaccagca

SEQ ID NO: 9333570 - DNA, 22 bp, Homo sapiens
agcacaggaccaaggaagctgt

SEQ ID NO: 9333571 - DNA, 22 bp, Homo sapiens
agcacacatcacttctgctcat

SEQ ID NO: 9333572 - DNA, 23 bp, Homo sapiens
agcacacttgtacaatgccctag

SEQ ID NO: 9333573 - DNA, 22 bp, Homo sapiens
agcacagaatgaggtggaagtg

SEQ ID NO: 9333574 - DNA, 22 bp, Homo sapiens
acacaagaagttaatgggcaaa

SEQ ID NO: 9333575 - DNA, 22 bp, Homo sapiens
acaatttttcaaagaagcttat

SEQ ID NO: 9333576 - DNA, 22 bp, Homo sapiens
agcacaggacgtagagcttgga

SEQ ID NO: 9333577 - DNA, 22 bp, Homo sapiens
agcacaggctttggtgtgaggg

SEQ ID NO: 9333578 - DNA, 22 bp, Homo sapiens
agcacagggacaatgccaggtg

SEQ ID NO: 9333579 - DNA, 22 bp, Homo sapiens
agcacagggcccagcctaggcc

SEQ ID NO: 9333580 - DNA, 22 bp, Homo sapiens
agatgcagaaaaactaagtgat

SEQ ID NO: 9333581 - DNA, 22 bp, Homo sapiens
acaaatagagattcaaataaag

SEQ ID NO: 9333582 - DNA, 22 bp, Homo sapiens
acaaagtgctgacattacaggc

SEQ ID NO: 9333583 - DNA, 19 bp, Homo sapiens
acaaagtgcgtgctctttt

SEQ ID NO: 9333584 - DNA, 22 bp, Homo sapiens
acaaagtgcacaagatgagaac

SEQ ID NO: 9333585 - DNA, 22 bp, Homo sapiens
acaaagtgctgacattacaggc

SEQ ID NO: 9333586 - DNA, 22 bp, Homo sapiens
agagttcagctactgcaaatgt

SEQ ID NO: 9333587 - DNA, 22 bp, Homo sapiens
acaaagtcacaataattaacct

SEQ ID NO: 9333588 - DNA, 22 bp, Homo sapiens
agatgcagacttggttcaggca

SEQ ID NO: 9333589 - DNA, 21 bp, Homo sapiens
agatgcagtgacccactgggg

SEQ ID NO: 9333590 - DNA, 21 bp, Homo sapiens
agatgcagttatgagatgcag

SEQ ID NO: 9333591 - DNA, 21 bp, Homo sapiens
agatgcagtttgcaggtgggt

SEQ ID NO: 9333592 - DNA, 22 bp, Homo sapiens
agatgcatgcttaattagcaca

SEQ ID NO: 9333593 - DNA, 22 bp, Homo sapiens
agatgcatggaaatctcattac

SEQ ID NO: 9333594 - DNA, 21 bp, Homo sapiens
agatgcagtttgcaggtgggt

SEQ ID NO: 9333595 - DNA, 21 bp, Homo sapiens
agatgcagttatgagatgcag

SEQ ID NO: 9333596 - DNA, 22 bp, Homo sapiens
agatgcctaaatctgggcaagg

SEQ ID NO: 9333597 - DNA, 22 bp, Homo sapiens
agatgcatgtttatgtctttcc

SEQ ID NO: 9333598 - DNA, 22 bp, Homo sapiens
agatgctgaattattgtgcttt

SEQ ID NO: 9333599 - DNA, 22 bp, Homo sapiens
agatgctgcctctcctcacaag

SEQ ID NO: 9333600 - DNA, 22 bp, Homo sapiens
acaacagggtaaggcaggccat

SEQ ID NO: 9333601 - DNA, 22 bp, Homo sapiens
acaacagggtaaggcaggccat

SEQ ID NO: 9333602 - DNA, 23 bp, Homo sapiens
acaacaggaaatcagacctgaac

SEQ ID NO: 9333603 - DNA, 20 bp, Homo sapiens
agagtgggtgtcacaggctg

SEQ ID NO: 9333604 - DNA, 20 bp, Homo sapiens
agagtgggtgtcacaggctg

SEQ ID NO: 9333605 - DNA, 20 bp, Homo sapiens
agagtgggtgtcacaggctg

SEQ ID NO: 9333606 - DNA, 22 bp, Homo sapiens
agagtggtcatttgtccaggat

SEQ ID NO: 9333607 - DNA, 22 bp, Homo sapiens
agagtgggttataggcagactt

SEQ ID NO: 9333608 - DNA, 22 bp, Homo sapiens
agagtgggttataggcagactt

SEQ ID NO: 9333609 - DNA, 22 bp, Homo sapiens
agagtgggttataggcagactt

SEQ ID NO: 9333610 - DNA, 22 bp, Homo sapiens
aatttgggcgaggagggaggca

SEQ ID NO: 9333611 - DNA, 22 bp, Homo sapiens
aatttggggaggttcagactct

SEQ ID NO: 9333612 - DNA, 22 bp, Homo sapiens
agagtgaaggttgacacttcac

SEQ ID NO: 9333613 - DNA, 22 bp, Homo sapiens
agagtgtaccaaatatcctaca

SEQ ID NO: 9333614 - DNA, 22 bp, Homo sapiens
agagtgtggaacttgaggagct

SEQ ID NO: 9333615 - DNA, 22 bp, Homo sapiens
agagtgtggaacttgaggagct

SEQ ID NO: 9333616 - DNA, 22 bp, Homo sapiens
aatttggcagtgtcttgaagta

SEQ ID NO: 9333617 - DNA, 22 bp, Homo sapiens
aatttgattccctgcacctgtt

SEQ ID NO: 9333618 - DNA, 22 bp, Homo sapiens
aatttgccttaccttcttccaa

SEQ ID NO: 9333619 - DNA, 22 bp, Homo sapiens
aatttgattcagcaaatgttca

SEQ ID NO: 9333620 - DNA, 22 bp, Homo sapiens
aatttgatgagtttgtaagtct

SEQ ID NO: 9333621 - DNA, 22 bp, Homo sapiens
aatttgacagcaatagaagatt

SEQ ID NO: 9333622 - DNA, 18 bp, Homo sapiens
aatttctttgacaactta

SEQ ID NO: 9333623 - DNA, 22 bp, Homo sapiens
aatttctccaagaatgcttaga

SEQ ID NO: 9333624 - DNA, 22 bp, Homo sapiens
aatttctcggttttgatattgt

SEQ ID NO: 9333625 - DNA, 22 bp, Homo sapiens
aatttctcggttttgatattgt

SEQ ID NO: 9333626 - DNA, 22 bp, Homo sapiens
aatttctcaattgttacaggtg

SEQ ID NO: 9333627 - DNA, 22 bp, Homo sapiens
aatttctccaagaatgcttaga

SEQ ID NO: 9333628 - DNA, 22 bp, Homo sapiens
aatttcttcagctctaaaatgg

SEQ ID NO: 9333629 - DNA, 16 bp, Homo sapiens
aaggaatgtcattctg

SEQ ID NO: 9333630 - DNA, 22 bp, Homo sapiens
aaggacaaagcagagctggatg

SEQ ID NO: 9333631 - DNA, 22 bp, Homo sapiens
aaggaatgctctaggagggcag

SEQ ID NO: 9333632 - DNA, 22 bp, Homo sapiens
aaggaatgctctaggagggcag

SEQ ID NO: 9333633 - DNA, 21 bp, Homo sapiens
aaggaatgaatggatggatga

SEQ ID NO: 9333634 - DNA, 19 bp, Homo sapiens
aaggaatggctttaagtag

SEQ ID NO: 9333635 - DNA, 19 bp, Homo sapiens
aaggaatggctttaagtag

SEQ ID NO: 9333636 - DNA, 17 bp, Homo sapiens
aaggaatgtcagaagtt

SEQ ID NO: 9333637 - DNA, 22 bp, Homo sapiens
aaggaagttttcttggttccta

SEQ ID NO: 9333638 - DNA, 22 bp, Homo sapiens
aaggaagttaagtcttagaatg

SEQ ID NO: 9333639 - DNA, 22 bp, Homo sapiens
aaggaagtgattttcatgtcaa

SEQ ID NO: 9333640 - DNA, 21 bp, Homo sapiens
aaggaagtgactttagtggtt

SEQ ID NO: 9333641 - DNA, 22 bp, Homo sapiens
aaggaaggttcatagtcaaaga

SEQ ID NO: 9333642 - DNA, 22 bp, Homo sapiens
aaggaaggtactcagtgattct

SEQ ID NO: 9333643 - DNA, 22 bp, Homo sapiens
aaggaagatgctggcctgggga

SEQ ID NO: 9333644 - DNA, 22 bp, Homo sapiens
aaggaagatgaggtgctgctta

SEQ ID NO: 9333645 - DNA, 22 bp, Homo sapiens
aaggaagggaaatagtgatgtc

SEQ ID NO: 9333646 - DNA, 22 bp, Homo sapiens
aaggaagggaaatagtgatgtc

SEQ ID NO: 9333647 - DNA, 22 bp, Homo sapiens
aaggaagggaaatagtgatgtc

SEQ ID NO: 9333648 - DNA, 22 bp, Homo sapiens
aaggaaggaattgatcatgcgc

SEQ ID NO: 9333649 - DNA, 22 bp, Homo sapiens
aaggatgtgactcagtcagcta

SEQ ID NO: 9333650 - DNA, 22 bp, Homo sapiens
aaggattgtctggctatttatg

SEQ ID NO: 9333651 - DNA, 22 bp, Homo sapiens
aaggattccagttttacttgcc

SEQ ID NO: 9333652 - DNA, 22 bp, Homo sapiens
aaggattcaagaaatggtgtag

SEQ ID NO: 9333653 - DNA, 22 bp, Homo sapiens
aaggatttttgctaggaagaca

SEQ ID NO: 9333654 - DNA, 22 bp, Homo sapiens
aaggcaaatgtgttcttttagt

SEQ ID NO: 9333655 - DNA, 22 bp, Homo sapiens
aaggatcatagtaaacattgat

SEQ ID NO: 9333656 - DNA, 22 bp, Homo sapiens
aaggagggaaagcagtgcttct

SEQ ID NO: 9333657 - DNA, 22 bp, Homo sapiens
aaggatgattggtaatgacact

SEQ ID NO: 9333658 - DNA, 22 bp, Homo sapiens
aaggatgaacattaatacatca

SEQ ID NO: 9333659 - DNA, 22 bp, Homo sapiens
aaggacaagtagtatttgcatc

SEQ ID NO: 9333660 - DNA, 22 bp, Homo sapiens
aagctgtgtattacagaatatt

SEQ ID NO: 9333661 - DNA, 22 bp, Homo sapiens
aagctgtgaagagcaagtgagg

SEQ ID NO: 9333662 - DNA, 22 bp, Homo sapiens
aagctgtgaaatctctagtgca

SEQ ID NO: 9333663 - DNA, 22 bp, Homo sapiens
aagctgtgaagagcaagtgagg

SEQ ID NO: 9333664 - DNA, 22 bp, Homo sapiens
aagctgtggcttggaggaaaca

SEQ ID NO: 9333665 - DNA, 22 bp, Homo sapiens
acagctggacaggggagagttt

SEQ ID NO: 9333666 - DNA, 22 bp, Homo sapiens
acagctggaggccccattgtcc

SEQ ID NO: 9333667 - DNA, 22 bp, Homo sapiens
acagctggagccctatggctgg

SEQ ID NO: 9333668 - DNA, 22 bp, Homo sapiens
acagctggagccctatggctgg

SEQ ID NO: 9333669 - DNA, 22 bp, Homo sapiens
acagctggaggggctgcagagg

SEQ ID NO: 9333670 - DNA, 22 bp, Homo sapiens
acagctggaggggctgcagagg

SEQ ID NO: 9333671 - DNA, 22 bp, Homo sapiens
acagctggagtgaggatggagt

SEQ ID NO: 9333672 - DNA, 22 bp, Homo sapiens
acagctggaggtctgtgagcac

SEQ ID NO: 9333673 - DNA, 22 bp, Homo sapiens
acagctggagtgaggatggagt

SEQ ID NO: 9333674 - DNA, 22 bp, Homo sapiens
aagcttaatcagtctggttgca

SEQ ID NO: 9333675 - DNA, 22 bp, Homo sapiens
aagctgttggcagatagctctg

SEQ ID NO: 9333676 - DNA, 20 bp, Homo sapiens
aagcttccttgggcgcccgg

SEQ ID NO: 9333677 - DNA, 22 bp, Homo sapiens
aaggaagaagggaagttactta

SEQ ID NO: 9333678 - DNA, 22 bp, Homo sapiens
aagcttgtagagtttgacttcc

SEQ ID NO: 9333679 - DNA, 22 bp, Homo sapiens
aagcttgtagagtttgacttcc

SEQ ID NO: 9333680 - DNA, 22 bp, Homo sapiens
aagcttgcagggcataatttgc

SEQ ID NO: 9333681 - DNA, 22 bp, Homo sapiens
aaggcaaggttcaccgtgctat

SEQ ID NO: 9333682 - DNA, 22 bp, Homo sapiens
aaggcaactgtaaaacatgcac

SEQ ID NO: 9333683 - DNA, 17 bp, Homo sapiens
aaggcacagggcactgg

SEQ ID NO: 9333684 - DNA, 22 bp, Homo sapiens
aaggcacatattgcagatcttg

SEQ ID NO: 9333685 - DNA, 18 bp, Homo sapiens
aaggcacaggagaacatt

SEQ ID NO: 9333686 - DNA, 18 bp, Homo sapiens
aaggcacaggagaacatt

SEQ ID NO: 9333687 - DNA, 22 bp, Homo sapiens
aaggcacagccacttgatcatc

SEQ ID NO: 9333688 - DNA, 22 bp, Homo sapiens
aaggcacagaggcagggcactt

SEQ ID NO: 9333689 - DNA, 22 bp, Homo sapiens
aaggcacagaggcagggcactt

SEQ ID NO: 9333690 - DNA, 22 bp, Homo sapiens
aaggcacacagttagatagagc

SEQ ID NO: 9333691 - DNA, 22 bp, Homo sapiens
aaggcatgtgtcctcagagaga

SEQ ID NO: 9333692 - DNA, 22 bp, Homo sapiens
aaggccagagcagactggagtt

SEQ ID NO: 9333693 - DNA, 22 bp, Homo sapiens
aaggccagagcagactggagtt

SEQ ID NO: 9333694 - DNA, 22 bp, Homo sapiens
aaggccagagcagactggagtt

SEQ ID NO: 9333695 - DNA, 22 bp, Homo sapiens
aaggccagagcgtgtcctgcct

SEQ ID NO: 9333696 - DNA, 22 bp, Homo sapiens
aaggccagagtactagaggctg

SEQ ID NO: 9333697 - DNA, 22 bp, Homo sapiens
aaggccagagtactagaggctg

SEQ ID NO: 9333698 - DNA, 22 bp, Homo sapiens
aaggccagagtactagaggctg

SEQ ID NO: 9333699 - DNA, 22 bp, Homo sapiens
aaggccagagcagactggagtt

SEQ ID NO: 9333700 - DNA, 22 bp, Homo sapiens
aaggccagagcagactggagtt

SEQ ID NO: 9333701 - DNA, 22 bp, Homo sapiens
aaggccagagcgtgtcctgcct

SEQ ID NO: 9333702 - DNA, 22 bp, Homo sapiens
aaggccagagcgtgtcctgcct

SEQ ID NO: 9333703 - DNA, 22 bp, Homo sapiens
aaggccagcctgagagctaaca

SEQ ID NO: 9333704 - DNA, 22 bp, Homo sapiens
aaggccagcctgagagctaaca

SEQ ID NO: 9333705 - DNA, 22 bp, Homo sapiens
aaggccagccctaatgatgctc

SEQ ID NO: 9333706 - DNA, 22 bp, Homo sapiens
aaggccagccctaatgatgctc

SEQ ID NO: 9333707 - DNA, 22 bp, Homo sapiens
acatccatttgtcagctcttga

SEQ ID NO: 9333708 - DNA, 22 bp, Homo sapiens
acatccattttgttcaaaagca

SEQ ID NO: 9333709 - DNA, 22 bp, Homo sapiens
aaggccagccttggaaccctga

SEQ ID NO: 9333710 - DNA, 22 bp, Homo sapiens
acatccatttgctttatttgct

SEQ ID NO: 9333711 - DNA, 22 bp, Homo sapiens
aaggccagccttggaaccctga

SEQ ID NO: 9333712 - DNA, 22 bp, Homo sapiens
aaggccagattcactttacaat

SEQ ID NO: 9333713 - DNA, 22 bp, Homo sapiens
aaggccagagttgaactgctcc

SEQ ID NO: 9333714 - DNA, 22 bp, Homo sapiens
aaggccagagttgaactgctcc

SEQ ID NO: 9333715 - DNA, 22 bp, Homo sapiens
aaggccagagttgaactgctcc

SEQ ID NO: 9333716 - DNA, 22 bp, Homo sapiens
aaggccagattctctctagggg

SEQ ID NO: 9333717 - DNA, 22 bp, Homo sapiens
aaggccagattctctctagggg

SEQ ID NO: 9333718 - DNA, 22 bp, Homo sapiens
aaggccagcagtttgagaccag

SEQ ID NO: 9333719 - DNA, 22 bp, Homo sapiens
aaggccagcagtttgagaccag

SEQ ID NO: 9333720 - DNA, 22 bp, Homo sapiens
acatccttgattatgtaaggat

SEQ ID NO: 9333721 - DNA, 22 bp, Homo sapiens
acatcgatggtcagccgaggag

SEQ ID NO: 9333722 - DNA, 22 bp, Homo sapiens
acatcgatggatagagcttgct

SEQ ID NO: 9333723 - DNA, 22 bp, Homo sapiens
acatctcacttctttgaaggct

SEQ ID NO: 9333724 - DNA, 22 bp, Homo sapiens
acatctcaaattccaggctcca

SEQ ID NO: 9333725 - DNA, 22 bp, Homo sapiens
acatctatgaacatttaagtag

SEQ ID NO: 9333726 - DNA, 22 bp, Homo sapiens
acatcctcccgatctactggct

SEQ ID NO: 9333727 - DNA, 22 bp, Homo sapiens
acatcctcccgatctactggct

SEQ ID NO: 9333728 - DNA, 22 bp, Homo sapiens
acatccctcagtcagactgtaa

SEQ ID NO: 9333729 - DNA, 22 bp, Homo sapiens
acatctcagaactgagtaaccg

SEQ ID NO: 9333730 - DNA, 22 bp, Homo sapiens
acatgaatatatgaagttcaac

SEQ ID NO: 9333731 - DNA, 22 bp, Homo sapiens
acatgaagtggtcagatcaaac

SEQ ID NO: 9333732 - DNA, 22 bp, Homo sapiens
acatgaatatatgaagttcaac

SEQ ID NO: 9333733 - DNA, 22 bp, Homo sapiens
acatgaatgaagactttacaat

SEQ ID NO: 9333734 - DNA, 22 bp, Homo sapiens
acatgaatgcagccataacact

SEQ ID NO: 9333735 - DNA, 22 bp, Homo sapiens
acatgacacctctggctgggtg

SEQ ID NO: 9333736 - DNA, 22 bp, Homo sapiens
acatgcatacacgtacatacct

SEQ ID NO: 9333737 - DNA, 22 bp, Homo sapiens
acatgcatacgtgtgtttaaaa

SEQ ID NO: 9333738 - DNA, 22 bp, Homo sapiens
acatgacagtgcttagcaaact

SEQ ID NO: 9333739 - DNA, 22 bp, Homo sapiens
acatgcatatacttaaatatgt

SEQ ID NO: 9333740 - DNA, 22 bp, Homo sapiens
acatgcatactgctgccaacgc

SEQ ID NO: 9333741 - DNA, 19 bp, Homo sapiens
acatgcatatggacagttg

SEQ ID NO: 9333742 - DNA, 22 bp, Homo sapiens
acatgcatctctgggacacatg

SEQ ID NO: 9333743 - DNA, 22 bp, Homo sapiens
acatgcatggacatgtatatat

SEQ ID NO: 9333744 - DNA, 22 bp, Homo sapiens
acatgcatgctttggtgggtgt

SEQ ID NO: 9333745 - DNA, 22 bp, Homo sapiens
acatgcatggctgcttaaatta

SEQ ID NO: 9333746 - DNA, 22 bp, Homo sapiens
acatgcatggtgttgggttgga

SEQ ID NO: 9333747 - DNA, 22 bp, Homo sapiens
acatgcatgtctatgggcaggt

SEQ ID NO: 9333748 - DNA, 22 bp, Homo sapiens
acatgcatgtctatgggcaggt

SEQ ID NO: 9333749 - DNA, 22 bp, Homo sapiens
accagaggaggaattaccttcc

SEQ ID NO: 9333750 - DNA, 22 bp, Homo sapiens
accagagtaatgtgtggaaatt

SEQ ID NO: 9333751 - DNA, 22 bp, Homo sapiens
accagagttggaataattttga

SEQ ID NO: 9333752 - DNA, 22 bp, Homo sapiens
accagagggagacttcctcttc

SEQ ID NO: 9333753 - DNA, 22 bp, Homo sapiens
accagagctggctctgagcacc

SEQ ID NO: 9333754 - DNA, 22 bp, Homo sapiens
accagagcttacatgctagaaa

SEQ ID NO: 9333755 - DNA, 22 bp, Homo sapiens
accagagctggctctgagcacc

SEQ ID NO: 9333756 - DNA, 22 bp, Homo sapiens
accagagcttacatgctagaaa

SEQ ID NO: 9333757 - DNA, 22 bp, Homo sapiens
aaggggaaaaagtgttaggagt

SEQ ID NO: 9333758 - DNA, 22 bp, Homo sapiens
accagcacctgataggcagtaa

SEQ ID NO: 9333759 - DNA, 22 bp, Homo sapiens
aaggggaagagaccgcagagtc

SEQ ID NO: 9333760 - DNA, 19 bp, Homo sapiens
aaggggtgagggaagcaga

SEQ ID NO: 9333761 - DNA, 22 bp, Homo sapiens
aaggggggcacctgcatgcccg

SEQ ID NO: 9333762 - DNA, 22 bp, Homo sapiens
aagggtgggccctggcagccat

SEQ ID NO: 9333763 - DNA, 22 bp, Homo sapiens
aagggtggtgtaggagatcaaa

SEQ ID NO: 9333764 - DNA, 22 bp, Homo sapiens
aagggtgggcaccgccaggtca

SEQ ID NO: 9333765 - DNA, 22 bp, Homo sapiens
aagggtgggccctggcagccat

SEQ ID NO: 9333766 - DNA, 22 bp, Homo sapiens
aagggtggatttctgagctcta

SEQ ID NO: 9333767 - DNA, 22 bp, Homo sapiens
aagggtgggcaccgccaggtca

SEQ ID NO: 9333768 - DNA, 22 bp, Homo sapiens
aaggggtgggcattagagcagt

SEQ ID NO: 9333769 - DNA, 22 bp, Homo sapiens
aaggggtgctgttggaaaccca

SEQ ID NO: 9333770 - DNA, 22 bp, Homo sapiens
aaggggtgggcattagagcagt

SEQ ID NO: 9333771 - DNA, 22 bp, Homo sapiens
aagggtgaagggtggtggccta

SEQ ID NO: 9333772 - DNA, 22 bp, Homo sapiens
aagggtgctgctatcaggaagc

SEQ ID NO: 9333773 - DNA, 22 bp, Homo sapiens
aagggtgcgacctaggagtgag

SEQ ID NO: 9333774 - DNA, 22 bp, Homo sapiens
aagggtgcattgcgcggggctg

SEQ ID NO: 9333775 - DNA, 22 bp, Homo sapiens
acccaggcagcaggagctaaag

SEQ ID NO: 9333776 - DNA, 22 bp, Homo sapiens
aaggtacagttttaagaataag

SEQ ID NO: 9333777 - DNA, 22 bp, Homo sapiens
aaggtacagaaattaacaagga

SEQ ID NO: 9333778 - DNA, 22 bp, Homo sapiens
aagggttgcaaggtcagaggaa

SEQ ID NO: 9333779 - DNA, 22 bp, Homo sapiens
aagggttgaagataaataaggt

SEQ ID NO: 9333780 - DNA, 22 bp, Homo sapiens
aagggctgggtctggttaaccc

SEQ ID NO: 9333781 - DNA, 19 bp, Homo sapiens
aagggctgggcacctcact

SEQ ID NO: 9333782 - DNA, 19 bp, Homo sapiens
aagggctgggcacctcact

SEQ ID NO: 9333783 - DNA, 18 bp, Homo sapiens
aagggctggcctttggag

SEQ ID NO: 9333784 - DNA, 18 bp, Homo sapiens
aagggctggcctttggag

SEQ ID NO: 9333785 - DNA, 22 bp, Homo sapiens
aagggctggccctgggaagagt

SEQ ID NO: 9333786 - DNA, 22 bp, Homo sapiens
aagggctggccctgggaagagt

SEQ ID NO: 9333787 - DNA, 22 bp, Homo sapiens
aagggctggccctgggaagagt

SEQ ID NO: 9333788 - DNA, 22 bp, Homo sapiens
aagggctggccacattctgggt

SEQ ID NO: 9333789 - DNA, 22 bp, Homo sapiens
aagggctggccacattctgggt

SEQ ID NO: 9333790 - DNA, 22 bp, Homo sapiens
aagggctggccacattctgggt

SEQ ID NO: 9333791 - DNA, 22 bp, Homo sapiens
aagggctggagaggaaaggttg

SEQ ID NO: 9333792 - DNA, 22 bp, Homo sapiens
aagggctggatctctctgagca

SEQ ID NO: 9333793 - DNA, 22 bp, Homo sapiens
aagggctggatctctctgagca

SEQ ID NO: 9333794 - DNA, 22 bp, Homo sapiens
aagggctggatctctctgagca

SEQ ID NO: 9333795 - DNA, 22 bp, Homo sapiens
aagggctggatctctctgagca

SEQ ID NO: 9333796 - DNA, 22 bp, Homo sapiens
aagggctggagaggaaaggttg

SEQ ID NO: 9333797 - DNA, 22 bp, Homo sapiens
aagggctggagaggaaaggttg

SEQ ID NO: 9333798 - DNA, 22 bp, Homo sapiens
aagggctgcaatccaaaacact

SEQ ID NO: 9333799 - DNA, 22 bp, Homo sapiens
aagggctggagactgggtcttc

SEQ ID NO: 9333800 - DNA, 22 bp, Homo sapiens
aagggctggagactgggtcttc

SEQ ID NO: 9333801 - DNA, 22 bp, Homo sapiens
acatttcagtgagctattgaag

SEQ ID NO: 9333802 - DNA, 22 bp, Homo sapiens
acatttcagcgtgcatgacatg

SEQ ID NO: 9333803 - DNA, 22 bp, Homo sapiens
acatttcagattcatgaagtga

SEQ ID NO: 9333804 - DNA, 22 bp, Homo sapiens
acatttcagcgtgcatgacatg

SEQ ID NO: 9333805 - DNA, 22 bp, Homo sapiens
acatttcagcgtgcatgacatg

SEQ ID NO: 9333806 - DNA, 20 bp, Homo sapiens
aagggcagagggaacagact

SEQ ID NO: 9333807 - DNA, 20 bp, Homo sapiens
aagggcagagggaacagact

SEQ ID NO: 9333808 - DNA, 20 bp, Homo sapiens
aagggcagagggaacagact

SEQ ID NO: 9333809 - DNA, 22 bp, Homo sapiens
aagggcagaatagagaagatgg

SEQ ID NO: 9333810 - DNA, 22 bp, Homo sapiens
aagggcagagggaatcccacat

SEQ ID NO: 9333811 - DNA, 22 bp, Homo sapiens
aagggcagagggaatcccacat

SEQ ID NO: 9333812 - DNA, 20 bp, Homo sapiens
aagggcagagggaacagact

SEQ ID NO: 9333813 - DNA, 22 bp, Homo sapiens
acatttcagattcatgaagtga

SEQ ID NO: 9333814 - DNA, 22 bp, Homo sapiens
acatttcagatgtaatgtgatg

SEQ ID NO: 9333815 - DNA, 22 bp, Homo sapiens
acatgcatgtgaatatggacac

SEQ ID NO: 9333816 - DNA, 22 bp, Homo sapiens
acatgcatgtgaatatggacac

SEQ ID NO: 9333817 - DNA, 22 bp, Homo sapiens
acatgcatgttgtgtagggggg

SEQ ID NO: 9333818 - DNA, 22 bp, Homo sapiens
aagggcagaatagagaagatgg

SEQ ID NO: 9333819 - DNA, 22 bp, Homo sapiens
aagggcagaatagagaagatgg

SEQ ID NO: 9333820 - DNA, 22 bp, Homo sapiens
aagggcagaatagagaagatgg

SEQ ID NO: 9333821 - DNA, 22 bp, Homo sapiens
aagggcagaaagggacgctttg

SEQ ID NO: 9333822 - DNA, 22 bp, Homo sapiens
aagtcatcactcctctgaactt

SEQ ID NO: 9333823 - DNA, 22 bp, Homo sapiens
aagtatctcaaaaacagtaatc

SEQ ID NO: 9333824 - DNA, 20 bp, Homo sapiens
aagtatatgtccgtgtactt

SEQ ID NO: 9333825 - DNA, 22 bp, Homo sapiens
aagtatatttagctgagcttgt

SEQ ID NO: 9333826 - DNA, 22 bp, Homo sapiens
aagtataatcaaagcagggcta

SEQ ID NO: 9333827 - DNA, 22 bp, Homo sapiens
aagtataagctattcttcatga

SEQ ID NO: 9333828 - DNA, 22 bp, Homo sapiens
aagtaggaatccgaatgagtag

SEQ ID NO: 9333829 - DNA, 22 bp, Homo sapiens
aagtaggaatccgaatgagtag

SEQ ID NO: 9333830 - DNA, 22 bp, Homo sapiens
acctctggccaagactcgtgtt

SEQ ID NO: 9333831 - DNA, 22 bp, Homo sapiens
aagtagatagtgctacggagtt

SEQ ID NO: 9333832 - DNA, 23 bp, Homo sapiens
aagtagataacactgttctgaga

SEQ ID NO: 9333833 - DNA, 23 bp, Homo sapiens
aagtagataacactgttctgaga

SEQ ID NO: 9333834 - DNA, 22 bp, Homo sapiens
aagtcctgccacctataagcct

SEQ ID NO: 9333835 - DNA, 22 bp, Homo sapiens
aagtcctgaaacttctttctga

SEQ ID NO: 9333836 - DNA, 22 bp, Homo sapiens
acctgcctatcagctgcctgct

SEQ ID NO: 9333837 - DNA, 22 bp, Homo sapiens
acctgcctatcagctgcctgct

SEQ ID NO: 9333838 - DNA, 22 bp, Homo sapiens
acctgcctatcagctgcctgct

SEQ ID NO: 9333839 - DNA, 22 bp, Homo sapiens
acccaggggcagccttgctgtg

SEQ ID NO: 9333840 - DNA, 22 bp, Homo sapiens
acccagggcttaaggcggtgca

SEQ ID NO: 9333841 - DNA, 22 bp, Homo sapiens
acccagggagtgctcctgttct

SEQ ID NO: 9333842 - DNA, 22 bp, Homo sapiens
acccagggagtgctcctgttct

SEQ ID NO: 9333843 - DNA, 22 bp, Homo sapiens
acccaggccattggcaagagtc

SEQ ID NO: 9333844 - DNA, 22 bp, Homo sapiens
acccagggctcaagcgtaggca

SEQ ID NO: 9333845 - DNA, 22 bp, Homo sapiens
aaggtggtgcttctgctcctct

SEQ ID NO: 9333846 - DNA, 22 bp, Homo sapiens
aaggtggtgcttctgctcctct

SEQ ID NO: 9333847 - DNA, 22 bp, Homo sapiens
aaggtggtgatcatcttgaagg

SEQ ID NO: 9333848 - DNA, 22 bp, Homo sapiens
aaggtggttcgctggtacccag

SEQ ID NO: 9333849 - DNA, 22 bp, Homo sapiens
aaggtggttgcaattaccataa

SEQ ID NO: 9333850 - DNA, 22 bp, Homo sapiens
aaggtggtgagtacagttaggt

SEQ ID NO: 9333851 - DNA, 22 bp, Homo sapiens
aaggtggtgatcatcttgaagg

SEQ ID NO: 9333852 - DNA, 22 bp, Homo sapiens
aaggtggtgagtacagttaggt

SEQ ID NO: 9333853 - DNA, 22 bp, Homo sapiens
aaggtggtttgcagacagaata

SEQ ID NO: 9333854 - DNA, 22 bp, Homo sapiens
aaggtggtttgctaatcccaac

SEQ ID NO: 9333855 - DNA, 22 bp, Homo sapiens
aaggtggtttgattatcccact

SEQ ID NO: 9333856 - DNA, 22 bp, Homo sapiens
aaggtggtttgattatcccact

SEQ ID NO: 9333857 - DNA, 22 bp, Homo sapiens
aaggtggttgtaggctggtctg

SEQ ID NO: 9333858 - DNA, 22 bp, Homo sapiens
aaggtggttgtaggctggtctg

SEQ ID NO: 9333859 - DNA, 22 bp, Homo sapiens
aaggtggttgtaggctggtctg

SEQ ID NO: 9333860 - DNA, 22 bp, Homo sapiens
aaggtggttgcaattaccataa

SEQ ID NO: 9333861 - DNA, 22 bp, Homo sapiens
aaggtggttcgctggtacccag

SEQ ID NO: 9333862 - DNA, 22 bp, Homo sapiens
aaggtggtcttactgatggtat

SEQ ID NO: 9333863 - DNA, 22 bp, Homo sapiens
aaggtggtcttactgatggtat

SEQ ID NO: 9333864 - DNA, 22 bp, Homo sapiens
acccagggtagaacctcagagc

SEQ ID NO: 9333865 - DNA, 19 bp, Homo sapiens
acccaggggtttatgtgtg

SEQ ID NO: 9333866 - DNA, 22 bp, Homo sapiens
acccaggggcgaagctggccac

SEQ ID NO: 9333867 - DNA, 22 bp, Homo sapiens
acccaggggcagccttgctgtg

SEQ ID NO: 9333868 - DNA, 22 bp, Homo sapiens
acctcctggtgcccaagtgttt

SEQ ID NO: 9333869 - DNA, 22 bp, Homo sapiens
acctcctggtgcccaagtgttt

SEQ ID NO: 9333870 - DNA, 22 bp, Homo sapiens
acctcctggctgctcatggaac

SEQ ID NO: 9333871 - DNA, 22 bp, Homo sapiens
acctcctggcttatcatggaca

SEQ ID NO: 9333872 - DNA, 22 bp, Homo sapiens
acctcctggcttatcatggaca

SEQ ID NO: 9333873 - DNA, 22 bp, Homo sapiens
acctcctggcctcaagcaatcc

SEQ ID NO: 9333874 - DNA, 22 bp, Homo sapiens
acctcctggcctcaagcaatcc

SEQ ID NO: 9333875 - DNA, 22 bp, Homo sapiens
acctcctggcctcaagcaatcc

SEQ ID NO: 9333876 - DNA, 20 bp, Homo sapiens
acctcctggcgggcatcctc

SEQ ID NO: 9333877 - DNA, 20 bp, Homo sapiens
acctcctggcgggcatcctc

SEQ ID NO: 9333878 - DNA, 22 bp, Homo sapiens
acctcctggctgctcatggaac

SEQ ID NO: 9333879 - DNA, 22 bp, Homo sapiens
aaggtgtcaccagattggcagg

SEQ ID NO: 9333880 - DNA, 22 bp, Homo sapiens
aaggtgtcaaactagaagatgt

SEQ ID NO: 9333881 - DNA, 22 bp, Homo sapiens
aaggtgtcaccagattggcagg

SEQ ID NO: 9333882 - DNA, 19 bp, Homo sapiens
aaggtggtttgtctctgta

SEQ ID NO: 9333883 - DNA, 22 bp, Homo sapiens
aaggtggtttgcagacagaata

SEQ ID NO: 9333884 - DNA, 19 bp, Homo sapiens
aaggtggtttgtctctgta

SEQ ID NO: 9333885 - DNA, 22 bp, Homo sapiens
aaggtggtttgctaatcccaac

SEQ ID NO: 9333886 - DNA, 22 bp, Homo sapiens
aaggtgtcaaactagaagatgt

SEQ ID NO: 9333887 - DNA, 22 bp, Homo sapiens
aaggtgtcaccagattggcagg

SEQ ID NO: 9333888 - DNA, 20 bp, Homo sapiens
acctcctggaagcaggtgcc

SEQ ID NO: 9333889 - DNA, 21 bp, Homo sapiens
acctcctggcatcctgttccc

SEQ ID NO: 9333890 - DNA, 20 bp, Homo sapiens
acctcctggaagcaggtgcc

SEQ ID NO: 9333891 - DNA, 20 bp, Homo sapiens
acctcctggaagcaggtgcc

SEQ ID NO: 9333892 - DNA, 22 bp, Homo sapiens
acctctctgggcctgcttcctg

SEQ ID NO: 9333893 - DNA, 22 bp, Homo sapiens
acctctcttgtagctgctggtg

SEQ ID NO: 9333894 - DNA, 22 bp, Homo sapiens
acctctgcaatgcaatgtcatg

SEQ ID NO: 9333895 - DNA, 22 bp, Homo sapiens
acctctggacactgcatccttc

SEQ ID NO: 9333896 - DNA, 22 bp, Homo sapiens
acctctggcaccccctggcttg

SEQ ID NO: 9333897 - DNA, 22 bp, Homo sapiens
acctctggcaccccctggcttg

SEQ ID NO: 9333898 - DNA, 22 bp, Homo sapiens
acctctggacactgcatccttc

SEQ ID NO: 9333899 - DNA, 22 bp, Homo sapiens
acctctgccactttctaactct

SEQ ID NO: 9333900 - DNA, 22 bp, Homo sapiens
acctctgccaagatgtgctccc

SEQ ID NO: 9333901 - DNA, 22 bp, Homo sapiens
acctctgcaatgcaatgtcatg

SEQ ID NO: 9333902 - DNA, 19 bp, Homo sapiens
acctctgcagagatgttta

SEQ ID NO: 9333903 - DNA, 22 bp, Homo sapiens
acctctgcagtagggctgtgcc

SEQ ID NO: 9333904 - DNA, 18 bp, Homo sapiens
actgcaggagaggtgagg

SEQ ID NO: 9333905 - DNA, 18 bp, Homo sapiens
actgcaggagaggtgagg

SEQ ID NO: 9333906 - DNA, 22 bp, Homo sapiens
actgcaggccttggtgccagca

SEQ ID NO: 9333907 - DNA, 22 bp, Homo sapiens
actgcaggccttggtgccagca

SEQ ID NO: 9333908 - DNA, 22 bp, Homo sapiens
actgcaggatgtgctcctattg

SEQ ID NO: 9333909 - DNA, 22 bp, Homo sapiens
actgcaggagacacagctgctg

SEQ ID NO: 9333910 - DNA, 22 bp, Homo sapiens
actgcaggagacacagctgctg

SEQ ID NO: 9333911 - DNA, 22 bp, Homo sapiens
actgcaggagacacagctgctg

SEQ ID NO: 9333912 - DNA, 22 bp, Homo sapiens
actgcactccagcctgggtgac

SEQ ID NO: 9333913 - DNA, 22 bp, Homo sapiens
aagttctaacatctacgtggaa

SEQ ID NO: 9333914 - DNA, 22 bp, Homo sapiens
actgcatgtaaggcaatatgtt

SEQ ID NO: 9333915 - DNA, 22 bp, Homo sapiens
actgcatgataataatagcaga

SEQ ID NO: 9333916 - DNA, 22 bp, Homo sapiens
actgcaggtggatggcacttta

SEQ ID NO: 9333917 - DNA, 22 bp, Homo sapiens
actgcaggccttggtgccagca

SEQ ID NO: 9333918 - DNA, 22 bp, Homo sapiens
actgcaggccttggtgccagca

SEQ ID NO: 9333919 - DNA, 19 bp, Homo sapiens
actgcagggaggaggtgtg

SEQ ID NO: 9333920 - DNA, 22 bp, Homo sapiens
actgcagggcatcctggccaag

SEQ ID NO: 9333921 - DNA, 18 bp, Homo sapiens
aagttccacaagagatct

SEQ ID NO: 9333922 - DNA, 22 bp, Homo sapiens
aagttcatcaaagagtaaatat

SEQ ID NO: 9333923 - DNA, 22 bp, Homo sapiens
aagttcaatggaaaagctttag

SEQ ID NO: 9333924 - DNA, 22 bp, Homo sapiens
aagttcaatcagatgaaaaagc

SEQ ID NO: 9333925 - DNA, 22 bp, Homo sapiens
aagttcaagtgtaatctttatt

SEQ ID NO: 9333926 - DNA, 22 bp, Homo sapiens
aagttcaagtctgcatcttttt

SEQ ID NO: 9333927 - DNA, 22 bp, Homo sapiens
actctttagaggtacatctctt

SEQ ID NO: 9333928 - DNA, 22 bp, Homo sapiens
actgaaaaagacatcttggtaa

SEQ ID NO: 9333929 - DNA, 22 bp, Homo sapiens
actgaaaatgaattagaaacag

SEQ ID NO: 9333930 - DNA, 22 bp, Homo sapiens
actgaaaaagtatgattcactg

SEQ ID NO: 9333931 - DNA, 22 bp, Homo sapiens
aagttcaaggctctagagttcc

SEQ ID NO: 9333932 - DNA, 22 bp, Homo sapiens
aagtgtggtttaggcatctttt

SEQ ID NO: 9333933 - DNA, 22 bp, Homo sapiens
aagtgtgtattgtttatgctgc

SEQ ID NO: 9333934 - DNA, 22 bp, Homo sapiens
aagtgtgtatttttcttcagtg

SEQ ID NO: 9333935 - DNA, 22 bp, Homo sapiens
aagtgtgtctggcggcccagtg

SEQ ID NO: 9333936 - DNA, 22 bp, Homo sapiens
aagtgtgtcttgggaagggagg

SEQ ID NO: 9333937 - DNA, 19 bp, Homo sapiens
aagtgtgttgagccaggat

SEQ ID NO: 9333938 - DNA, 22 bp, Homo sapiens
aagtgtgtgagcctgtcaggct

SEQ ID NO: 9333939 - DNA, 22 bp, Homo sapiens
aagtgtgtgggcaggcagtggt

SEQ ID NO: 9333940 - DNA, 22 bp, Homo sapiens
aagtgtcttttagccactttta

SEQ ID NO: 9333941 - DNA, 22 bp, Homo sapiens
aagtgtctttatatttgagaaa

SEQ ID NO: 9333942 - DNA, 22 bp, Homo sapiens
aagtgtcttttagccactttta

SEQ ID NO: 9333943 - DNA, 22 bp, Homo sapiens
aagtgtgagacacacaaaatta

SEQ ID NO: 9333944 - DNA, 22 bp, Homo sapiens
aagtgtgggaagtaggtggcga

SEQ ID NO: 9333945 - DNA, 22 bp, Homo sapiens
aagtgtgggcagggcatttctg

SEQ ID NO: 9333946 - DNA, 22 bp, Homo sapiens
aagtgtgggactagggctccag

SEQ ID NO: 9333947 - DNA, 22 bp, Homo sapiens
aagtgtcttctgatggggtgtg

SEQ ID NO: 9333948 - DNA, 22 bp, Homo sapiens
aagtgtcttaactccttttggg

SEQ ID NO: 9333949 - DNA, 22 bp, Homo sapiens
aagtgtctgctggctctaccct

SEQ ID NO: 9333950 - DNA, 22 bp, Homo sapiens
aagtgtctgctggctctaccct

SEQ ID NO: 9333951 - DNA, 22 bp, Homo sapiens
aagtgtctgcaaaatgacagag

SEQ ID NO: 9333952 - DNA, 22 bp, Homo sapiens
aagtgtctgatggagcgaaatg

SEQ ID NO: 9333953 - DNA, 22 bp, Homo sapiens
aagtgggttcatgtggcattat

SEQ ID NO: 9333954 - DNA, 22 bp, Homo sapiens
aagtgggtgcactcaactttat

SEQ ID NO: 9333955 - DNA, 22 bp, Homo sapiens
aagtgggtcataaaaaattgca

SEQ ID NO: 9333956 - DNA, 22 bp, Homo sapiens
aagtgggtcagggacagatctt

SEQ ID NO: 9333957 - DNA, 22 bp, Homo sapiens
aagtgtctgacacaaaatatgt

SEQ ID NO: 9333958 - DNA, 22 bp, Homo sapiens
aagtgggttggacaaatgaccc

SEQ ID NO: 9333959 - DNA, 19 bp, Homo sapiens
aagtgggtagcacattcac

SEQ ID NO: 9333960 - DNA, 22 bp, Homo sapiens
aagtgggtacatgatgcacttt

SEQ ID NO: 9333961 - DNA, 22 bp, Homo sapiens
acctgcctcagtgcagctggat

SEQ ID NO: 9333962 - DNA, 22 bp, Homo sapiens
acctgcctatggagccacatgg

SEQ ID NO: 9333963 - DNA, 22 bp, Homo sapiens
aagtgtttaggtttgcagtcga

SEQ ID NO: 9333964 - DNA, 22 bp, Homo sapiens
aagtgtttacttaaagtcatgg

SEQ ID NO: 9333965 - DNA, 22 bp, Homo sapiens
actctttaacagactttgatct

SEQ ID NO: 9333966 - DNA, 22 bp, Homo sapiens
actcttgtttgtagagcccacc

SEQ ID NO: 9333967 - DNA, 22 bp, Homo sapiens
actcttgattgatttagtcttt

SEQ ID NO: 9333968 - DNA, 22 bp, Homo sapiens
actcttcttgctgctcattaat

SEQ ID NO: 9333969 - DNA, 22 bp, Homo sapiens
actcttcttgctgctcattaat

SEQ ID NO: 9333970 - DNA, 22 bp, Homo sapiens
actgtacacattcgtcaagact

SEQ ID NO: 9333971 - DNA, 22 bp, Homo sapiens
actgtacacagtggtgtactgt

SEQ ID NO: 9333972 - DNA, 22 bp, Homo sapiens
actgtacacagtggtgtactgt

SEQ ID NO: 9333973 - DNA, 22 bp, Homo sapiens
actgtacacgtgtcatttacag

SEQ ID NO: 9333974 - DNA, 22 bp, Homo sapiens
actgtcatgatcgaagatgtca

SEQ ID NO: 9333975 - DNA, 22 bp, Homo sapiens
actgtccaagcatgcctggctt

SEQ ID NO: 9333976 - DNA, 22 bp, Homo sapiens
actgtcccatttatgtagacat

SEQ ID NO: 9333977 - DNA, 22 bp, Homo sapiens
actgtccataatattggtgaac

SEQ ID NO: 9333978 - DNA, 22 bp, Homo sapiens
actgtacacacttctctgtctt

SEQ ID NO: 9333979 - DNA, 22 bp, Homo sapiens
actgtacacacttctctgtctt

SEQ ID NO: 9333980 - DNA, 22 bp, Homo sapiens
actgtacaaatattgcaaaata

SEQ ID NO: 9333981 - DNA, 23 bp, Homo sapiens
actgtctgatatgttttccatca

SEQ ID NO: 9333982 - DNA, 22 bp, Homo sapiens
aatagaatgtaatctaatacat

SEQ ID NO: 9333983 - DNA, 22 bp, Homo sapiens
actgtctagttctcttttctaa

SEQ ID NO: 9333984 - DNA, 22 bp, Homo sapiens
actgtctaatcagattcacttg

SEQ ID NO: 9333985 - DNA, 22 bp, Homo sapiens
actgtcgattatgatgagtcag

SEQ ID NO: 9333986 - DNA, 22 bp, Homo sapiens
aatagcatagagttaaaatgca

SEQ ID NO: 9333987 - DNA, 22 bp, Homo sapiens
aatagcataagatgtcaaatag

SEQ ID NO: 9333988 - DNA, 22 bp, Homo sapiens
aatagcacttcctgaacacatt

SEQ ID NO: 9333989 - DNA, 22 bp, Homo sapiens
aatagcatcctaaaacatactt

SEQ ID NO: 9333990 - DNA, 22 bp, Homo sapiens
aatagcatagagttaaaatgca

SEQ ID NO: 9333991 - DNA, 22 bp, Homo sapiens
aatagcatcttccctggtaacc

SEQ ID NO: 9333992 - DNA, 22 bp, Homo sapiens
aatagcatcttctgagacaaag

SEQ ID NO: 9333993 - DNA, 22 bp, Homo sapiens
aatagcatcctgtatctcttcc

SEQ ID NO: 9333994 - DNA, 22 bp, Homo sapiens
aatagcaaagttatcaaattaa

SEQ ID NO: 9333995 - DNA, 22 bp, Homo sapiens
aatagcaattacatttgcacca

SEQ ID NO: 9333996 - DNA, 22 bp, Homo sapiens
aataaaatgaactggtagagtt

SEQ ID NO: 9333997 - DNA, 21 bp, Homo sapiens
aataaaacagttggtgtcaat

SEQ ID NO: 9333998 - DNA, 20 bp, Homo sapiens
aataaaagaagccttcaccc

SEQ ID NO: 9333999 - DNA, 22 bp, Homo sapiens
aataaaatgaactggtagagtt

SEQ ID NO: 9334000 - DNA, 21 bp, Homo sapiens
aataaaacagttggtgtcaat

SEQ ID NO: 9334001 - DNA, 22 bp, Homo sapiens
aagtttttggtagagaaaagta

SEQ ID NO: 9334002 - DNA, 22 bp, Homo sapiens
aagtttttcacattgctgttgt

SEQ ID NO: 9334003 - DNA, 22 bp, Homo sapiens
aagtttttgattctaagagaga

SEQ ID NO: 9334004 - DNA, 22 bp, Homo sapiens
actggctgagttgcttcagcaa

SEQ ID NO: 9334005 - DNA, 22 bp, Homo sapiens
aataaaatggtcagttttctca

SEQ ID NO: 9334006 - DNA, 22 bp, Homo sapiens
actgggaggcaaagagcaagga

SEQ ID NO: 9334007 - DNA, 22 bp, Homo sapiens
actggctgagtttatgttcaca

SEQ ID NO: 9334008 - DNA, 22 bp, Homo sapiens
actgggaggcatctggagctga

SEQ ID NO: 9334009 - DNA, 22 bp, Homo sapiens
actgggaggcaaagagcaagga

SEQ ID NO: 9334010 - DNA, 22 bp, Homo sapiens
actgggaggcaaagagcaagga

SEQ ID NO: 9334011 - DNA, 22 bp, Homo sapiens
actgggaggcaaagagcaagga

SEQ ID NO: 9334012 - DNA, 22 bp, Homo sapiens
actgggagggtcttgaagaggg

SEQ ID NO: 9334013 - DNA, 22 bp, Homo sapiens
actgggagtcatgaggaaggag

SEQ ID NO: 9334014 - DNA, 22 bp, Homo sapiens
actgggagggtcttgaagaggg

SEQ ID NO: 9334015 - DNA, 22 bp, Homo sapiens
actgggagggtcttgaagaggg

SEQ ID NO: 9334016 - DNA, 22 bp, Homo sapiens
actgggagtcatgaggaaggag

SEQ ID NO: 9334017 - DNA, 22 bp, Homo sapiens
actgggagtcatgaggaaggag

SEQ ID NO: 9334018 - DNA, 22 bp, Homo sapiens
actgggagtcatgaggaaggag

SEQ ID NO: 9334019 - DNA, 22 bp, Homo sapiens
aataagcaagcctgtgtgcaag

SEQ ID NO: 9334020 - DNA, 22 bp, Homo sapiens
aataaggtgtgggtgctaatat

SEQ ID NO: 9334021 - DNA, 22 bp, Homo sapiens
actgggattacaggtgggagtc

SEQ ID NO: 9334022 - DNA, 22 bp, Homo sapiens
actgggagttctccatgtccct

SEQ ID NO: 9334023 - DNA, 22 bp, Homo sapiens
actgggcaaggatatgatgggt

SEQ ID NO: 9334024 - DNA, 22 bp, Homo sapiens
actgggattacaggtgggagtc

SEQ ID NO: 9334025 - DNA, 22 bp, Homo sapiens
actgggcaaggatatgatgggt

SEQ ID NO: 9334026 - DNA, 22 bp, Homo sapiens
actgggcaataaattcagagaa

SEQ ID NO: 9334027 - DNA, 22 bp, Homo sapiens
actgggcaaggatatgatgggt

SEQ ID NO: 9334028 - DNA, 22 bp, Homo sapiens
actgggcaccatcatgagatag

SEQ ID NO: 9334029 - DNA, 22 bp, Homo sapiens
actgggcaccatcatgagatgg

SEQ ID NO: 9334030 - DNA, 22 bp, Homo sapiens
aataagcaagcctgtgtgcaag

SEQ ID NO: 9334031 - DNA, 22 bp, Homo sapiens
actggggagagtcatgccagca

SEQ ID NO: 9334032 - DNA, 19 bp, Homo sapiens
actgggcttgtcctcgtgg

SEQ ID NO: 9334033 - DNA, 22 bp, Homo sapiens
aataatagcagagtttacaatc

SEQ ID NO: 9334034 - DNA, 22 bp, Homo sapiens
aataatacatgagattaatgtt

SEQ ID NO: 9334035 - DNA, 22 bp, Homo sapiens
aataataagatactaagggagt

SEQ ID NO: 9334036 - DNA, 22 bp, Homo sapiens
aataatactgcatgtaaggtgc

SEQ ID NO: 9334037 - DNA, 22 bp, Homo sapiens
aatagcttttgtatgatgaaat

SEQ ID NO: 9334038 - DNA, 22 bp, Homo sapiens
aataggcagttggatatgcaag

SEQ ID NO: 9334039 - DNA, 22 bp, Homo sapiens
aatagtaaaagatacagctaat

SEQ ID NO: 9334040 - DNA, 23 bp, Homo sapiens
aatagctggtaatgatagcacaa

SEQ ID NO: 9334041 - DNA, 22 bp, Homo sapiens
aatagcttatgggatagatgtt

SEQ ID NO: 9334042 - DNA, 22 bp, Homo sapiens
aatagctcactgatttctcttt

SEQ ID NO: 9334043 - DNA, 22 bp, Homo sapiens
aatagcatgtaagtttaaaaga

SEQ ID NO: 9334044 - DNA, 22 bp, Homo sapiens
aatagcatgtaagtttaaaaga

SEQ ID NO: 9334045 - DNA, 22 bp, Homo sapiens
aatagcatcttctgagacaaag

SEQ ID NO: 9334046 - DNA, 22 bp, Homo sapiens
aatagcatgttcatgataaaat

SEQ ID NO: 9334047 - DNA, 22 bp, Homo sapiens
actttgatctaagtttctttga

SEQ ID NO: 9334048 - DNA, 22 bp, Homo sapiens
actttgttctaatagtatctct

SEQ ID NO: 9334049 - DNA, 22 bp, Homo sapiens
actttgacagcattttaattat

SEQ ID NO: 9334050 - DNA, 22 bp, Homo sapiens
acttttaaatgagtttcagttg

SEQ ID NO: 9334051 - DNA, 22 bp, Homo sapiens
acttttaaatgagtttcagttg

SEQ ID NO: 9334052 - DNA, 22 bp, Homo sapiens
actttgttgttccttgtctaaa

SEQ ID NO: 9334053 - DNA, 22 bp, Homo sapiens
actttgttgttccttgtctaaa

SEQ ID NO: 9334054 - DNA, 22 bp, Homo sapiens
actttgttttatagcacataag

SEQ ID NO: 9334055 - DNA, 22 bp, Homo sapiens
aatcaagagttgtgtaatattt

SEQ ID NO: 9334056 - DNA, 22 bp, Homo sapiens
acttttatgataatcaatgttc

SEQ ID NO: 9334057 - DNA, 22 bp, Homo sapiens
acttttatgataatcaatgttc

SEQ ID NO: 9334058 - DNA, 22 bp, Homo sapiens
acttttatcaaggaagtgatct

SEQ ID NO: 9334059 - DNA, 22 bp, Homo sapiens
acttttatcaaggaagtgatct

SEQ ID NO: 9334060 - DNA, 22 bp, Homo sapiens
acttttatgataatcaatgttc

SEQ ID NO: 9334061 - DNA, 22 bp, Homo sapiens
aatcctggcatgtgccttggga

SEQ ID NO: 9334062 - DNA, 22 bp, Homo sapiens
agaaagggatgaggtagctgct

SEQ ID NO: 9334063 - DNA, 22 bp, Homo sapiens
aatcgcaattacttttgcacca

SEQ ID NO: 9334064 - DNA, 22 bp, Homo sapiens
aatcctgtgtgactctggggag

SEQ ID NO: 9334065 - DNA, 22 bp, Homo sapiens
agaaagggagcgtggatcaatt

SEQ ID NO: 9334066 - DNA, 22 bp, Homo sapiens
agaaagggagcgtggatcaatt

SEQ ID NO: 9334067 - DNA, 22 bp, Homo sapiens
aatctagtttaatatgtttaaa

SEQ ID NO: 9334068 - DNA, 22 bp, Homo sapiens
aatctagtttaatatgtttaaa

SEQ ID NO: 9334069 - DNA, 23 bp, Homo sapiens
aatctatacttaggctggtaata

SEQ ID NO: 9334070 - DNA, 22 bp, Homo sapiens
aatctagtttcagactttgagt

SEQ ID NO: 9334071 - DNA, 22 bp, Homo sapiens
aatctagagtgctaggtctgtg

SEQ ID NO: 9334072 - DNA, 22 bp, Homo sapiens
agaaactgacaggaaatgaatt

SEQ ID NO: 9334073 - DNA, 22 bp, Homo sapiens
agaaagctggagtcaagcagag

SEQ ID NO: 9334074 - DNA, 22 bp, Homo sapiens
agaaagcttatgaatgggcaag

SEQ ID NO: 9334075 - DNA, 22 bp, Homo sapiens
agaaagcttatgaatgggcaag

SEQ ID NO: 9334076 - DNA, 22 bp, Homo sapiens
agaaaggacatctccctttaag

SEQ ID NO: 9334077 - DNA, 22 bp, Homo sapiens
aatcacagtgggtactagattg

SEQ ID NO: 9334078 - DNA, 22 bp, Homo sapiens
aatcacagccagcttccgctat

SEQ ID NO: 9334079 - DNA, 22 bp, Homo sapiens
aatcacatcactgagaatgagg

SEQ ID NO: 9334080 - DNA, 22 bp, Homo sapiens
aatcacagagtccagcagatga

SEQ ID NO: 9334081 - DNA, 22 bp, Homo sapiens
aatcacaattacttttgcacca

SEQ ID NO: 9334082 - DNA, 22 bp, Homo sapiens
agaaggaagccaggagggtgca

SEQ ID NO: 9334083 - DNA, 22 bp, Homo sapiens
agaaggaagccaggagggtgca

SEQ ID NO: 9334084 - DNA, 22 bp, Homo sapiens
agaaggaagccaggagggtgca

SEQ ID NO: 9334085 - DNA, 22 bp, Homo sapiens
agaaggaaggaagcattctgtt

SEQ ID NO: 9334086 - DNA, 22 bp, Homo sapiens
agaaggaaggaagcattctgtt

SEQ ID NO: 9334087 - DNA, 22 bp, Homo sapiens
agaaggaaggataactgcatta

SEQ ID NO: 9334088 - DNA, 22 bp, Homo sapiens
agaaggaaggctgagtgctgat

SEQ ID NO: 9334089 - DNA, 18 bp, Homo sapiens
aatgcaatgtatttgcag

SEQ ID NO: 9334090 - DNA, 22 bp, Homo sapiens
agaagcttgaaggagcagtgac

SEQ ID NO: 9334091 - DNA, 22 bp, Homo sapiens
agaagcttgaaggagcagtgac

SEQ ID NO: 9334092 - DNA, 22 bp, Homo sapiens
agaagctgttgcattcctggcg

SEQ ID NO: 9334093 - DNA, 22 bp, Homo sapiens
agaagccagcttcagctgcccg

SEQ ID NO: 9334094 - DNA, 22 bp, Homo sapiens
agaagccagcttcagctgcccg

SEQ ID NO: 9334095 - DNA, 22 bp, Homo sapiens
agaagccagccttgcctccttt

SEQ ID NO: 9334096 - DNA, 22 bp, Homo sapiens
agaagccagtcgctctcccgca

SEQ ID NO: 9334097 - DNA, 22 bp, Homo sapiens
agaagccagcttcagctgcccg

SEQ ID NO: 9334098 - DNA, 22 bp, Homo sapiens
agaagccagcttcagctgcccg

SEQ ID NO: 9334099 - DNA, 22 bp, Homo sapiens
agaagccagattgtagtgggac

SEQ ID NO: 9334100 - DNA, 22 bp, Homo sapiens
agaagccagaggcagtgggtac

SEQ ID NO: 9334101 - DNA, 22 bp, Homo sapiens
agaagccagattgtagtgggac

SEQ ID NO: 9334102 - DNA, 22 bp, Homo sapiens
agaagccagccttgcctccttt

SEQ ID NO: 9334103 - DNA, 22 bp, Homo sapiens
agaagccagattgtagtgggac

SEQ ID NO: 9334104 - DNA, 22 bp, Homo sapiens
aatgcatgtattcattgtggaa

SEQ ID NO: 9334105 - DNA, 19 bp, Homo sapiens
aatgcatggaagttggaga

SEQ ID NO: 9334106 - DNA, 22 bp, Homo sapiens
aatgcatatgtaggcaagcagt

SEQ ID NO: 9334107 - DNA, 22 bp, Homo sapiens
aatgcatgtttcctctcagcag

SEQ ID NO: 9334108 - DNA, 22 bp, Homo sapiens
aatgcattaaagttagagactt

SEQ ID NO: 9334109 - DNA, 23 bp, Homo sapiens
aatgcattaatttgggagagtac

SEQ ID NO: 9334110 - DNA, 21 bp, Homo sapiens
aatgcattaacataaagctga

SEQ ID NO: 9334111 - DNA, 22 bp, Homo sapiens
aatgcattctcggtttgtgtgt

SEQ ID NO: 9334112 - DNA, 22 bp, Homo sapiens
aatgcattgattgctggaaata

SEQ ID NO: 9334113 - DNA, 22 bp, Homo sapiens
aatgcctcgccttatttatttt

SEQ ID NO: 9334114 - DNA, 22 bp, Homo sapiens
aatgcattttattatatgtgac

SEQ ID NO: 9334115 - DNA, 18 bp, Homo sapiens
aatgcatttatggagatg

SEQ ID NO: 9334116 - DNA, 22 bp, Homo sapiens
agaagaaagattgaaggttcct

SEQ ID NO: 9334117 - DNA, 22 bp, Homo sapiens
agaagaaagattgaaggttcct

SEQ ID NO: 9334118 - DNA, 22 bp, Homo sapiens
agaagaaactgtcggggatatt

SEQ ID NO: 9334119 - DNA, 22 bp, Homo sapiens
agaagaaagattgaaggttcct

SEQ ID NO: 9334120 - DNA, 22 bp, Homo sapiens
agaagaaactgtcggggatatt

SEQ ID NO: 9334121 - DNA, 22 bp, Homo sapiens
agaagaaactgtcggggatatt

SEQ ID NO: 9334122 - DNA, 22 bp, Homo sapiens
agaacttttggagacttttagt

SEQ ID NO: 9334123 - DNA, 19 bp, Homo sapiens
agaactcagtatcttttct

SEQ ID NO: 9334124 - DNA, 22 bp, Homo sapiens
aatctagtttcagactttgagt

SEQ ID NO: 9334125 - DNA, 17 bp, Homo sapiens
agaactgtagtagctcc

SEQ ID NO: 9334126 - DNA, 19 bp, Homo sapiens
agaactgggtccatggctt

SEQ ID NO: 9334127 - DNA, 22 bp, Homo sapiens
aatgaagttctattcattttct

SEQ ID NO: 9334128 - DNA, 22 bp, Homo sapiens
aatgaataacaatcctctggag

SEQ ID NO: 9334129 - DNA, 21 bp, Homo sapiens
aatgaagtggctattttgagg

SEQ ID NO: 9334130 - DNA, 22 bp, Homo sapiens
aatgaagtgttatttagtttca

SEQ ID NO: 9334131 - DNA, 21 bp, Homo sapiens
aatgaagtggctattttgagg

SEQ ID NO: 9334132 - DNA, 20 bp, Homo sapiens
aatgaagttattaatgatgt

SEQ ID NO: 9334133 - DNA, 22 bp, Homo sapiens
agaagccagaatattcatggat

SEQ ID NO: 9334134 - DNA, 18 bp, Homo sapiens
agaagccacgaggagtcc

SEQ ID NO: 9334135 - DNA, 22 bp, Homo sapiens
agaagccactgctcccagtgag

SEQ ID NO: 9334136 - DNA, 22 bp, Homo sapiens
agaagccagaggcagtgggtac

SEQ ID NO: 9334137 - DNA, 22 bp, Homo sapiens
agaagccagaatattcatggat

SEQ ID NO: 9334138 - DNA, 22 bp, Homo sapiens
agaagccactggaggttgagat

SEQ ID NO: 9334139 - DNA, 18 bp, Homo sapiens
agaagccacgaggagtcc

SEQ ID NO: 9334140 - DNA, 22 bp, Homo sapiens
agaagccactggaggttgagat

SEQ ID NO: 9334141 - DNA, 22 bp, Homo sapiens
agaagccactgctcccagtgag

SEQ ID NO: 9334142 - DNA, 22 bp, Homo sapiens
aatgaatgaaccacatataaca

SEQ ID NO: 9334143 - DNA, 22 bp, Homo sapiens
agaagcagctttcaaggtgatt

SEQ ID NO: 9334144 - DNA, 22 bp, Homo sapiens
tatccatcagtcacactataga

SEQ ID NO: 9334145 - DNA, 22 bp, Homo sapiens
tatccataccactacttccctt

SEQ ID NO: 9334146 - DNA, 22 bp, Homo sapiens
tatccatagtttatagatcaag

SEQ ID NO: 9334147 - DNA, 22 bp, Homo sapiens
tatccatattaagatgcctctg

SEQ ID NO: 9334148 - DNA, 22 bp, Homo sapiens
tatccatattcagactgtgaat

SEQ ID NO: 9334149 - DNA, 22 bp, Homo sapiens
tatccatctatgtgtgtctgtg

SEQ ID NO: 9334150 - DNA, 20 bp, Homo sapiens
tatatgacatcatgatctta

SEQ ID NO: 9334151 - DNA, 22 bp, Homo sapiens
tatccaattcaccattgatggg

SEQ ID NO: 9334152 - DNA, 22 bp, Homo sapiens
tatatctaagtgtatgtaagag

SEQ ID NO: 9334153 - DNA, 22 bp, Homo sapiens
tatatctaagtgtatgtaagag

SEQ ID NO: 9334154 - DNA, 22 bp, Homo sapiens
tatatctaggaaccctgagatt

SEQ ID NO: 9334155 - DNA, 22 bp, Homo sapiens
tatatcttatatgtgcaggtac

SEQ ID NO: 9334156 - DNA, 22 bp, Homo sapiens
tatatgacagtatcattttaaa

SEQ ID NO: 9334157 - DNA, 22 bp, Homo sapiens
tatatcatggagattaacattc

SEQ ID NO: 9334158 - DNA, 22 bp, Homo sapiens
tatatatgggggaagctggatg

SEQ ID NO: 9334159 - DNA, 22 bp, Homo sapiens
tatatattcttaagtagtgtag

SEQ ID NO: 9334160 - DNA, 22 bp, Homo sapiens
tatatattcttaagtagtgtag

SEQ ID NO: 9334161 - DNA, 19 bp, Homo sapiens
tatatattttggggttgtg

SEQ ID NO: 9334162 - DNA, 19 bp, Homo sapiens
tatatattttggggttgtg

SEQ ID NO: 9334163 - DNA, 22 bp, Homo sapiens
tatagcacacagtttataaaag

SEQ ID NO: 9334164 - DNA, 22 bp, Homo sapiens
tatagcaattcagaatacatgt

SEQ ID NO: 9334165 - DNA, 22 bp, Homo sapiens
tatagccatttccagtggcatc

SEQ ID NO: 9334166 - DNA, 22 bp, Homo sapiens
tatagctaaggtcagactgttt

SEQ ID NO: 9334167 - DNA, 22 bp, Homo sapiens
tataggaaggcagattttagct

SEQ ID NO: 9334168 - DNA, 22 bp, Homo sapiens
tatagtaaaattttcatttatg

SEQ ID NO: 9334169 - DNA, 22 bp, Homo sapiens
tatagtacacttaggtacttca

SEQ ID NO: 9334170 - DNA, 22 bp, Homo sapiens
tataggactgatcacattttca

SEQ ID NO: 9334171 - DNA, 22 bp, Homo sapiens
tataggaccgacttgtttatag

SEQ ID NO: 9334172 - DNA, 21 bp, Homo sapiens
tatagtgtggatatgctgatg

SEQ ID NO: 9334173 - DNA, 22 bp, Homo sapiens
tatatatgagcatgtgaggaca

SEQ ID NO: 9334174 - DNA, 22 bp, Homo sapiens
tatagtacatggaatcttcata

SEQ ID NO: 9334175 - DNA, 22 bp, Homo sapiens
tatagtacacttaggtacttca

SEQ ID NO: 9334176 - DNA, 22 bp, Homo sapiens
tatagtacatggaatcttcata

SEQ ID NO: 9334177 - DNA, 22 bp, Homo sapiens
tatgagaaaataaatatctgtt

SEQ ID NO: 9334178 - DNA, 22 bp, Homo sapiens
tatgactatagggcttagtgtt

SEQ ID NO: 9334179 - DNA, 22 bp, Homo sapiens
tatgacagtttcgtaggggttg

SEQ ID NO: 9334180 - DNA, 19 bp, Homo sapiens
tatgacagctggagggctc

SEQ ID NO: 9334181 - DNA, 22 bp, Homo sapiens
tatctacattcttgtatcttct

SEQ ID NO: 9334182 - DNA, 22 bp, Homo sapiens
tatctacatgtaggtatgtatg

SEQ ID NO: 9334183 - DNA, 22 bp, Homo sapiens
tatctacatgtaggtatgtatg

SEQ ID NO: 9334184 - DNA, 22 bp, Homo sapiens
tatctagaaacagagttttact

SEQ ID NO: 9334185 - DNA, 22 bp, Homo sapiens
tatctacagttaatatgtcatc

SEQ ID NO: 9334186 - DNA, 19 bp, Homo sapiens
tatgacaagtactagttct

SEQ ID NO: 9334187 - DNA, 22 bp, Homo sapiens
tatctagataccaagaagcaca

SEQ ID NO: 9334188 - DNA, 22 bp, Homo sapiens
tatcctggagaatctgatagga

SEQ ID NO: 9334189 - DNA, 23 bp, Homo sapiens
tatcctaaaggcaacaggaagtc

SEQ ID NO: 9334190 - DNA, 22 bp, Homo sapiens
tatccccacctctgttaaggac

SEQ ID NO: 9334191 - DNA, 22 bp, Homo sapiens
tatcctggagaatctgatagga

SEQ ID NO: 9334192 - DNA, 22 bp, Homo sapiens
tatcctggagaatctgatagga

SEQ ID NO: 9334193 - DNA, 22 bp, Homo sapiens
tatctacaggtgtcaggtaaga

SEQ ID NO: 9334194 - DNA, 22 bp, Homo sapiens
tatacacacctccaaagcagga

SEQ ID NO: 9334195 - DNA, 22 bp, Homo sapiens
tatacacacctccaaagcagga

SEQ ID NO: 9334196 - DNA, 22 bp, Homo sapiens
tatacacacatgctccggcctt

SEQ ID NO: 9334197 - DNA, 22 bp, Homo sapiens
tatacacaaggtgtgcatttgt

SEQ ID NO: 9334198 - DNA, 22 bp, Homo sapiens
tatacacaaggtgtgcatttgt

SEQ ID NO: 9334199 - DNA, 22 bp, Homo sapiens
tatacaatggctgaatcatcca

SEQ ID NO: 9334200 - DNA, 22 bp, Homo sapiens
tatacaatggctgaatcatcca

SEQ ID NO: 9334201 - DNA, 22 bp, Homo sapiens
tatacacaaacaaggggttaag

SEQ ID NO: 9334202 - DNA, 22 bp, Homo sapiens
tatacaatggctgaatcatcca

SEQ ID NO: 9334203 - DNA, 22 bp, Homo sapiens
tataattttagaagagatggaa

SEQ ID NO: 9334204 - DNA, 22 bp, Homo sapiens
tataattttaagtggtaaatta

SEQ ID NO: 9334205 - DNA, 22 bp, Homo sapiens
tataatttttctgtggccagtt

SEQ ID NO: 9334206 - DNA, 22 bp, Homo sapiens
tatacaagaggtgagatgagca

SEQ ID NO: 9334207 - DNA, 22 bp, Homo sapiens
tataatttggggaaagtggtgt

SEQ ID NO: 9334208 - DNA, 22 bp, Homo sapiens
tataattttaagtggtaaatta

SEQ ID NO: 9334209 - DNA, 22 bp, Homo sapiens
tataatttatcatgtcacagtt

SEQ ID NO: 9334210 - DNA, 22 bp, Homo sapiens
tataatttggggaaagtggtgt

SEQ ID NO: 9334211 - DNA, 22 bp, Homo sapiens
tataatttatcatgtcacagtt

SEQ ID NO: 9334212 - DNA, 22 bp, Homo sapiens
tataatttggggaaagtggtgt

SEQ ID NO: 9334213 - DNA, 17 bp, Homo sapiens
tatacacagacagactg

SEQ ID NO: 9334214 - DNA, 17 bp, Homo sapiens
tatacacagacagactg

SEQ ID NO: 9334215 - DNA, 22 bp, Homo sapiens
tatacacaggaatctgtgaaaa

SEQ ID NO: 9334216 - DNA, 22 bp, Homo sapiens
tatacacatatacgtttgtgtg

SEQ ID NO: 9334217 - DNA, 22 bp, Homo sapiens
tatacacatatacgtttgtgtg

SEQ ID NO: 9334218 - DNA, 22 bp, Homo sapiens
tatacacatcctccaaagatag

SEQ ID NO: 9334219 - DNA, 22 bp, Homo sapiens
tatacacatatcttctaggcct

SEQ ID NO: 9334220 - DNA, 22 bp, Homo sapiens
tatacacatcctccaaagatag

SEQ ID NO: 9334221 - DNA, 22 bp, Homo sapiens
tatacacatcctccaaagatag

SEQ ID NO: 9334222 - DNA, 22 bp, Homo sapiens
tatacacatgtgtgtattcata

SEQ ID NO: 9334223 - DNA, 22 bp, Homo sapiens
tatacacattacagtttcagga

SEQ ID NO: 9334224 - DNA, 23 bp, Homo sapiens
tatacacatgtggcagtatagtg

SEQ ID NO: 9334225 - DNA, 23 bp, Homo sapiens
tatacacatgtggcagtatagtg

SEQ ID NO: 9334226 - DNA, 22 bp, Homo sapiens
tatacacatgtgtgtattcata

SEQ ID NO: 9334227 - DNA, 22 bp, Homo sapiens
tatacacatttttacctatagt

SEQ ID NO: 9334228 - DNA, 22 bp, Homo sapiens
tatacacatttttacctatagt

SEQ ID NO: 9334229 - DNA, 22 bp, Homo sapiens
tatacagaaagaattcaagtct

SEQ ID NO: 9334230 - DNA, 22 bp, Homo sapiens
tataactgagaagatacatagt

SEQ ID NO: 9334231 - DNA, 22 bp, Homo sapiens
tataaattattaggctgctaaa

SEQ ID NO: 9334232 - DNA, 22 bp, Homo sapiens
tataaattattaggctgctaaa

SEQ ID NO: 9334233 - DNA, 22 bp, Homo sapiens
tataaattattaggctgctaaa

SEQ ID NO: 9334234 - DNA, 20 bp, Homo sapiens
tataaattcagagctttggt

SEQ ID NO: 9334235 - DNA, 20 bp, Homo sapiens
tataaattcagagctttggt

SEQ ID NO: 9334236 - DNA, 20 bp, Homo sapiens
tataaattcagagctttggt

SEQ ID NO: 9334237 - DNA, 22 bp, Homo sapiens
tataaatgccaggactttagat

SEQ ID NO: 9334238 - DNA, 22 bp, Homo sapiens
tataaattaatgtgcccatgag

SEQ ID NO: 9334239 - DNA, 22 bp, Homo sapiens
taggtgtcttgtgtatggtaca

SEQ ID NO: 9334240 - DNA, 22 bp, Homo sapiens
taggtgtctttctgtccttgtt

SEQ ID NO: 9334241 - DNA, 22 bp, Homo sapiens
taggtgtcttgtgtatggtaca

SEQ ID NO: 9334242 - DNA, 22 bp, Homo sapiens
taggtgtctttctgtccttgtt

SEQ ID NO: 9334243 - DNA, 22 bp, Homo sapiens
taggtgtcttgtcactaccgtt

SEQ ID NO: 9334244 - DNA, 22 bp, Homo sapiens
tataaagtttcgaaagatgtat

SEQ ID NO: 9334245 - DNA, 22 bp, Homo sapiens
tataaagtttcgaaagatgtat

SEQ ID NO: 9334246 - DNA, 22 bp, Homo sapiens
tataaatgcacttttgaaatat

SEQ ID NO: 9334247 - DNA, 20 bp, Homo sapiens
taggtccaatgctcgtcttc

SEQ ID NO: 9334248 - DNA, 22 bp, Homo sapiens
taggtcccagcatcttctgagc

SEQ ID NO: 9334249 - DNA, 22 bp, Homo sapiens
taggtctctcttcttgatggga

SEQ ID NO: 9334250 - DNA, 22 bp, Homo sapiens
taggtctgaggctgcatcttgg

SEQ ID NO: 9334251 - DNA, 20 bp, Homo sapiens
taggtgagggcagatagagg

SEQ ID NO: 9334252 - DNA, 22 bp, Homo sapiens
taggtgagggagcattgtgaga

SEQ ID NO: 9334253 - DNA, 22 bp, Homo sapiens
taggtgaggttacaagagttca

SEQ ID NO: 9334254 - DNA, 22 bp, Homo sapiens
taggtctgtaaatgagagagac

SEQ ID NO: 9334255 - DNA, 22 bp, Homo sapiens
taggtctggccccatgcagcca

SEQ ID NO: 9334256 - DNA, 22 bp, Homo sapiens
taggtctgatttccattcagtc

SEQ ID NO: 9334257 - DNA, 22 bp, Homo sapiens
taggtctgtaccctgtccttct

SEQ ID NO: 9334258 - DNA, 22 bp, Homo sapiens
taggtctgtaaatgagagagac

SEQ ID NO: 9334259 - DNA, 22 bp, Homo sapiens
taggtctgtgcagaggctgagc

SEQ ID NO: 9334260 - DNA, 22 bp, Homo sapiens
taggtcagaacaagcagtatcg

SEQ ID NO: 9334261 - DNA, 22 bp, Homo sapiens
taggggtgtttcgagagaggtt

SEQ ID NO: 9334262 - DNA, 22 bp, Homo sapiens
taggggtgaggccaggcatcag

SEQ ID NO: 9334263 - DNA, 22 bp, Homo sapiens
taggtgagtttggggaagatag

SEQ ID NO: 9334264 - DNA, 22 bp, Homo sapiens
taggtgcctgcacgacccaaac

SEQ ID NO: 9334265 - DNA, 22 bp, Homo sapiens
taggtgcctcggagaaaggacc

SEQ ID NO: 9334266 - DNA, 22 bp, Homo sapiens
taggtggtagagcctggcttgc

SEQ ID NO: 9334267 - DNA, 22 bp, Homo sapiens
taggtggtagagcctggcttgc

SEQ ID NO: 9334268 - DNA, 22 bp, Homo sapiens
taggtggttatgtcagcctaga

SEQ ID NO: 9334269 - DNA, 17 bp, Homo sapiens
taggtggttgctggtct

SEQ ID NO: 9334270 - DNA, 22 bp, Homo sapiens
taggtggttgtctgctttccta

SEQ ID NO: 9334271 - DNA, 22 bp, Homo sapiens
taggtggttatgtcagcctaga

SEQ ID NO: 9334272 - DNA, 22 bp, Homo sapiens
taggtggttataaattcaaggc

SEQ ID NO: 9334273 - DNA, 22 bp, Homo sapiens
taggtggtgggatatgagcatc

SEQ ID NO: 9334274 - DNA, 22 bp, Homo sapiens
taggtggtgtgcgaagagcgtg

SEQ ID NO: 9334275 - DNA, 22 bp, Homo sapiens
taggtggttataaattcaaggc

SEQ ID NO: 9334276 - DNA, 22 bp, Homo sapiens
taggtggtgtgcgaagagcgtg

SEQ ID NO: 9334277 - DNA, 22 bp, Homo sapiens
taggtggtgggatatgagcatc

SEQ ID NO: 9334278 - DNA, 19 bp, Homo sapiens
taggtgtccgccggaggtg

SEQ ID NO: 9334279 - DNA, 22 bp, Homo sapiens
taggtgtcctcgtccaaagatt

SEQ ID NO: 9334280 - DNA, 22 bp, Homo sapiens
taggtgtctaacaataagtgta

SEQ ID NO: 9334281 - DNA, 22 bp, Homo sapiens
taggtgtcctcgtccaaagatt

SEQ ID NO: 9334282 - DNA, 19 bp, Homo sapiens
taggtgtccgccggaggtg

SEQ ID NO: 9334283 - DNA, 22 bp, Homo sapiens
taggtgtccatatatgtgtgta

SEQ ID NO: 9334284 - DNA, 22 bp, Homo sapiens
taggtgtcaggtatagaattta

SEQ ID NO: 9334285 - DNA, 22 bp, Homo sapiens
taggtgtcaggtatagaattta

SEQ ID NO: 9334286 - DNA, 22 bp, Homo sapiens
taggtgtccatatatgtgtgta

SEQ ID NO: 9334287 - DNA, 22 bp, Homo sapiens
taggtgtcaggcctcctccagc

SEQ ID NO: 9334288 - DNA, 22 bp, Homo sapiens
taggtgtcaggcctcctccagc

SEQ ID NO: 9334289 - DNA, 22 bp, Homo sapiens
taggtggttgtctgctttccta

SEQ ID NO: 9334290 - DNA, 17 bp, Homo sapiens
taggtggttgctggtct

SEQ ID NO: 9334291 - DNA, 22 bp, Homo sapiens
taggtgtcttgtcactaccgtt

SEQ ID NO: 9334292 - DNA, 22 bp, Homo sapiens
taggtgtctggacaactttgta

SEQ ID NO: 9334293 - DNA, 22 bp, Homo sapiens
taggtgtctgctcttatttaac

SEQ ID NO: 9334294 - DNA, 22 bp, Homo sapiens
taggtgtctgtcctgggctgtg

SEQ ID NO: 9334295 - DNA, 22 bp, Homo sapiens
taggtgtctggacaactttgta

SEQ ID NO: 9334296 - DNA, 22 bp, Homo sapiens
taggtgtctgtcctgggctgtg

SEQ ID NO: 9334297 - DNA, 22 bp, Homo sapiens
taggtgtctgctcttatttaac

SEQ ID NO: 9334298 - DNA, 23 bp, Homo sapiens
taggtgtctagtgtccactatgt

SEQ ID NO: 9334299 - DNA, 22 bp, Homo sapiens
taggtgtctaacaataagtgta

SEQ ID NO: 9334300 - DNA, 23 bp, Homo sapiens
taggtgtctagtgtccactatgt

SEQ ID NO: 9334301 - DNA, 22 bp, Homo sapiens
taggtgtctgctcttatttaac

SEQ ID NO: 9334302 - DNA, 22 bp, Homo sapiens
tatgtcttttgcttgcaaatag

SEQ ID NO: 9334303 - DNA, 22 bp, Homo sapiens
tatgtctttgtcccactcccag

SEQ ID NO: 9334304 - DNA, 22 bp, Homo sapiens
tatgtctggcatgttgtaatta

SEQ ID NO: 9334305 - DNA, 22 bp, Homo sapiens
tatgtgatataggctatttgat

SEQ ID NO: 9334306 - DNA, 22 bp, Homo sapiens
tatgtgatataggctatttgat

SEQ ID NO: 9334307 - DNA, 22 bp, Homo sapiens
tatgtgatcaaaaaagtttgga

SEQ ID NO: 9334308 - DNA, 16 bp, Homo sapiens
tatgtgtctcatctac

SEQ ID NO: 9334309 - DNA, 22 bp, Homo sapiens
tatgtgtctgtcgtgcataaat

SEQ ID NO: 9334310 - DNA, 22 bp, Homo sapiens
tatgtgtctcagttgtgattga

SEQ ID NO: 9334311 - DNA, 22 bp, Homo sapiens
tatgtgtctcagttgtgattga

SEQ ID NO: 9334312 - DNA, 22 bp, Homo sapiens
tatgtgtctcagttgtgattga

SEQ ID NO: 9334313 - DNA, 22 bp, Homo sapiens
tatgtgtcctgttaccggcagc

SEQ ID NO: 9334314 - DNA, 22 bp, Homo sapiens
tatgtgtcctaagcaatcatcc

SEQ ID NO: 9334315 - DNA, 20 bp, Homo sapiens
tatgtgcagtttggtttatc

SEQ ID NO: 9334316 - DNA, 22 bp, Homo sapiens
tatgtgtctttatctggctctt

SEQ ID NO: 9334317 - DNA, 18 bp, Homo sapiens
tatgtgtctgttacaact

SEQ ID NO: 9334318 - DNA, 22 bp, Homo sapiens
tatgtgtgcatgtatacattaa

SEQ ID NO: 9334319 - DNA, 22 bp, Homo sapiens
tatgtgtgcatgtatacattaa

SEQ ID NO: 9334320 - DNA, 18 bp, Homo sapiens
tatgtgtctgttacaact

SEQ ID NO: 9334321 - DNA, 22 bp, Homo sapiens
tatgtgtctgtcgtgcataaat

SEQ ID NO: 9334322 - DNA, 22 bp, Homo sapiens
tatgtgtctgtcgtgcataaat

SEQ ID NO: 9334323 - DNA, 21 bp, Homo sapiens
tatgtgtctgtggaaaactag

SEQ ID NO: 9334324 - DNA, 16 bp, Homo sapiens
tatgtgtctcatctac

SEQ ID NO: 9334325 - DNA, 22 bp, Homo sapiens
tattagattaactttaatgtct

SEQ ID NO: 9334326 - DNA, 22 bp, Homo sapiens
tattagattaactttaatgtct

SEQ ID NO: 9334327 - DNA, 22 bp, Homo sapiens
tatgtgtggcagctgggagtgt

SEQ ID NO: 9334328 - DNA, 22 bp, Homo sapiens
tattacaatttacattgcactt

SEQ ID NO: 9334329 - DNA, 20 bp, Homo sapiens
tattacacacaatgagcagt

SEQ ID NO: 9334330 - DNA, 22 bp, Homo sapiens
tattacacagtgaaagcatgga

SEQ ID NO: 9334331 - DNA, 20 bp, Homo sapiens
tattacacacaatgagcagt

SEQ ID NO: 9334332 - DNA, 19 bp, Homo sapiens
tatgtgtgcatttgtgcat

SEQ ID NO: 9334333 - DNA, 19 bp, Homo sapiens
tatgtgtgcatttgtgcat

SEQ ID NO: 9334334 - DNA, 22 bp, Homo sapiens
tatgtgtgctttttccatgcat

SEQ ID NO: 9334335 - DNA, 22 bp, Homo sapiens
tattacagaatcaggcataact

SEQ ID NO: 9334336 - DNA, 22 bp, Homo sapiens
tattacagaatcaggcataact

SEQ ID NO: 9334337 - DNA, 22 bp, Homo sapiens
tattacagctttgattatctgg

SEQ ID NO: 9334338 - DNA, 22 bp, Homo sapiens
tattacagggctagttatgagt

SEQ ID NO: 9334339 - DNA, 22 bp, Homo sapiens
tattacagggctagttatgagt

SEQ ID NO: 9334340 - DNA, 22 bp, Homo sapiens
tatgtacacacacatgcatgta

SEQ ID NO: 9334341 - DNA, 22 bp, Homo sapiens
tatgtacacacacatgcatgta

SEQ ID NO: 9334342 - DNA, 22 bp, Homo sapiens
tatgtacacacacatgcatgta

SEQ ID NO: 9334343 - DNA, 22 bp, Homo sapiens
tatgtacacatacacttgtaat

SEQ ID NO: 9334344 - DNA, 22 bp, Homo sapiens
tatgtacacatacacttgtaat

SEQ ID NO: 9334345 - DNA, 22 bp, Homo sapiens
tatgtacacatacacttgtaat

SEQ ID NO: 9334346 - DNA, 22 bp, Homo sapiens
tatgtacaccaaggattgaaaa

SEQ ID NO: 9334347 - DNA, 22 bp, Homo sapiens
tatgtacaccaaggattgaaaa

SEQ ID NO: 9334348 - DNA, 22 bp, Homo sapiens
tatgtacacatacacttgtaat

SEQ ID NO: 9334349 - DNA, 22 bp, Homo sapiens
tatgtacacatacacttgtaat

SEQ ID NO: 9334350 - DNA, 22 bp, Homo sapiens
tatgtacacatacacttgtaat

SEQ ID NO: 9334351 - DNA, 22 bp, Homo sapiens
tatgtacagggatagaacttga

SEQ ID NO: 9334352 - DNA, 22 bp, Homo sapiens
tatgtacacttaagtttgagaa

SEQ ID NO: 9334353 - DNA, 22 bp, Homo sapiens
tatgtacacggtggctctgaag

SEQ ID NO: 9334354 - DNA, 22 bp, Homo sapiens
tatgtacaccggggaaggtggg

SEQ ID NO: 9334355 - DNA, 22 bp, Homo sapiens
tatgtacagtccttaacttaaa

SEQ ID NO: 9334356 - DNA, 22 bp, Homo sapiens
tatgtacagtccttaacttaaa

SEQ ID NO: 9334357 - DNA, 22 bp, Homo sapiens
tatgtacagtccttaacttaaa

SEQ ID NO: 9334358 - DNA, 22 bp, Homo sapiens
tatgtacagtccttaacttaaa

SEQ ID NO: 9334359 - DNA, 22 bp, Homo sapiens
tatgtacataacatgaaatgca

SEQ ID NO: 9334360 - DNA, 22 bp, Homo sapiens
tatgtacagtccttaacttaaa

SEQ ID NO: 9334361 - DNA, 22 bp, Homo sapiens
tatgtacagtccttaacttaaa

SEQ ID NO: 9334362 - DNA, 22 bp, Homo sapiens
tatgtacagggatagaacttga

SEQ ID NO: 9334363 - DNA, 22 bp, Homo sapiens
tatgtctagacccaagaatatg

SEQ ID NO: 9334364 - DNA, 22 bp, Homo sapiens
tatgtctgaatcttatttaaat

SEQ ID NO: 9334365 - DNA, 22 bp, Homo sapiens
tatgtacatacatgtgcatacg

SEQ ID NO: 9334366 - DNA, 22 bp, Homo sapiens
tatgtacataacatgaaatgca

SEQ ID NO: 9334367 - DNA, 22 bp, Homo sapiens
tatgtacataacatgaaatgca

SEQ ID NO: 9334368 - DNA, 22 bp, Homo sapiens
tatgtacaatcagcagttcata

SEQ ID NO: 9334369 - DNA, 22 bp, Homo sapiens
tatgtacaagcacacatgtgac

SEQ ID NO: 9334370 - DNA, 22 bp, Homo sapiens
tatgtacaagcacacatgtgac

SEQ ID NO: 9334371 - DNA, 22 bp, Homo sapiens
tatgtacaagcacacatgtgac

SEQ ID NO: 9334372 - DNA, 22 bp, Homo sapiens
tatgtacaagcacacatgtgac

SEQ ID NO: 9334373 - DNA, 22 bp, Homo sapiens
tatgtacacacacatgcatgta

SEQ ID NO: 9334374 - DNA, 22 bp, Homo sapiens
tatgtacacacacatgcatgta

SEQ ID NO: 9334375 - DNA, 22 bp, Homo sapiens
tatgtacaatttgttgtatgtc

SEQ ID NO: 9334376 - DNA, 22 bp, Homo sapiens
tatgtacacacacatgcatgta

SEQ ID NO: 9334377 - DNA, 22 bp, Homo sapiens
tatgtacaatttgttgtatgtc

SEQ ID NO: 9334378 - DNA, 22 bp, Homo sapiens
tatgtacaatttgttgtatgtc

SEQ ID NO: 9334379 - DNA, 22 bp, Homo sapiens
tatgtacaatcagcagttcata

SEQ ID NO: 9334380 - DNA, 22 bp, Homo sapiens
tatgtacaatcagcagttcata

SEQ ID NO: 9334381 - DNA, 22 bp, Homo sapiens
tatgaggcacttcattagctgg

SEQ ID NO: 9334382 - DNA, 22 bp, Homo sapiens
tatgagtggcgtagaggtaggg

SEQ ID NO: 9334383 - DNA, 22 bp, Homo sapiens
tattatttttattcgagggaaa

SEQ ID NO: 9334384 - DNA, 19 bp, Homo sapiens
tattatttgtagcaaggcc

SEQ ID NO: 9334385 - DNA, 19 bp, Homo sapiens
tattatttgtagcaaggcc

SEQ ID NO: 9334386 - DNA, 22 bp, Homo sapiens
tattattttagcactgaggatt

SEQ ID NO: 9334387 - DNA, 22 bp, Homo sapiens
tattccaactgtcatagtcata

SEQ ID NO: 9334388 - DNA, 22 bp, Homo sapiens
tattcctggtgttggctgggtc

SEQ ID NO: 9334389 - DNA, 22 bp, Homo sapiens
tattaggtagattttactgatt

SEQ ID NO: 9334390 - DNA, 22 bp, Homo sapiens
tattattatattggatgagact

SEQ ID NO: 9334391 - DNA, 22 bp, Homo sapiens
tattattaaatggcagaatttt

SEQ ID NO: 9334392 - DNA, 22 bp, Homo sapiens
tattattgactattcagaatgt

SEQ ID NO: 9334393 - DNA, 22 bp, Homo sapiens
tattattgaatcagttctttga

SEQ ID NO: 9334394 - DNA, 22 bp, Homo sapiens
tattattgacatttacttggtg

SEQ ID NO: 9334395 - DNA, 22 bp, Homo sapiens
tattattatgcatagcatgaaa

SEQ ID NO: 9334396 - DNA, 22 bp, Homo sapiens
tattcttgactgcttactatgt

SEQ ID NO: 9334397 - DNA, 22 bp, Homo sapiens
tattcttgactgcttactatgt

SEQ ID NO: 9334398 - DNA, 22 bp, Homo sapiens
tattcttgtaccttaaatgatt

SEQ ID NO: 9334399 - DNA, 22 bp, Homo sapiens
tattcttgtaccttaaatgatt

SEQ ID NO: 9334400 - DNA, 22 bp, Homo sapiens
tattcttgtatactacaatctt

SEQ ID NO: 9334401 - DNA, 22 bp, Homo sapiens
tattcttgtatactacaatctt

SEQ ID NO: 9334402 - DNA, 22 bp, Homo sapiens
tattcttgtcttttccagaaat

SEQ ID NO: 9334403 - DNA, 22 bp, Homo sapiens
tattgacaatttgtgaaactat

SEQ ID NO: 9334404 - DNA, 22 bp, Homo sapiens
tattgacaataggcaactgagg

SEQ ID NO: 9334405 - DNA, 22 bp, Homo sapiens
tattctgggtaccaaacttcaa

SEQ ID NO: 9334406 - DNA, 22 bp, Homo sapiens
tattctgatttcaagtgagagt

SEQ ID NO: 9334407 - DNA, 22 bp, Homo sapiens
tattctctgcagctgaatgttt

SEQ ID NO: 9334408 - DNA, 22 bp, Homo sapiens
tattctgtgtgatatgtaaatg

SEQ ID NO: 9334409 - DNA, 18 bp, Homo sapiens
tattctgtcctatgaagc

SEQ ID NO: 9334410 - DNA, 22 bp, Homo sapiens
tattctccccggatcagggcaa

SEQ ID NO: 9334411 - DNA, 22 bp, Homo sapiens
tattctcagcaacacacatgga

SEQ ID NO: 9334412 - DNA, 22 bp, Homo sapiens
tattctacagtgttagtgttag

SEQ ID NO: 9334413 - DNA, 22 bp, Homo sapiens
tattctactagcattgttcact

SEQ ID NO: 9334414 - DNA, 22 bp, Homo sapiens
tatttattctttgtactgcctt

SEQ ID NO: 9334415 - DNA, 22 bp, Homo sapiens
tatttattctttgtactgcctt

SEQ ID NO: 9334416 - DNA, 22 bp, Homo sapiens
tatttattctttgtactgcctt

SEQ ID NO: 9334417 - DNA, 22 bp, Homo sapiens
tatttattggacagtgttgctg

SEQ ID NO: 9334418 - DNA, 22 bp, Homo sapiens
tatttattggacagtgttgctg

SEQ ID NO: 9334419 - DNA, 22 bp, Homo sapiens
tatttattggacagtgttgctg

SEQ ID NO: 9334420 - DNA, 22 bp, Homo sapiens
tatttattggacagtgttgctg

SEQ ID NO: 9334421 - DNA, 22 bp, Homo sapiens
tatttattcattcagcaagcat

SEQ ID NO: 9334422 - DNA, 22 bp, Homo sapiens
tatttattcattcagcaagcat

SEQ ID NO: 9334423 - DNA, 22 bp, Homo sapiens
tatttattcattcagcaagcat

SEQ ID NO: 9334424 - DNA, 22 bp, Homo sapiens
tatttattctttgtactgcctt

SEQ ID NO: 9334425 - DNA, 22 bp, Homo sapiens
tatttattctttgtactgcctt

SEQ ID NO: 9334426 - DNA, 22 bp, Homo sapiens
tatttattcattcagcaagcat

SEQ ID NO: 9334427 - DNA, 22 bp, Homo sapiens
tatttattcattcagcaagcat

SEQ ID NO: 9334428 - DNA, 22 bp, Homo sapiens
tatttattcattcagcaagcat

SEQ ID NO: 9334429 - DNA, 21 bp, Homo sapiens
tatttattaatttgtaaggct

SEQ ID NO: 9334430 - DNA, 21 bp, Homo sapiens
tatttattaatttgtaaggct

SEQ ID NO: 9334431 - DNA, 22 bp, Homo sapiens
tatttctaagctgtaagtctga

SEQ ID NO: 9334432 - DNA, 19 bp, Homo sapiens
tatttcaaagtgccgtcta

SEQ ID NO: 9334433 - DNA, 22 bp, Homo sapiens
tatttattggacagtgttgctg

SEQ ID NO: 9334434 - DNA, 22 bp, Homo sapiens
tatttctattccccaggcaagt

SEQ ID NO: 9334435 - DNA, 22 bp, Homo sapiens
tatttctattccccaggcaagt

SEQ ID NO: 9334436 - DNA, 22 bp, Homo sapiens
tatttctcagcattttacatcc

SEQ ID NO: 9334437 - DNA, 22 bp, Homo sapiens
tatttctcagcattttacatcc

SEQ ID NO: 9334438 - DNA, 22 bp, Homo sapiens
tatttctccaagggggccctct

SEQ ID NO: 9334439 - DNA, 22 bp, Homo sapiens
tatttctccctataccctccaa

SEQ ID NO: 9334440 - DNA, 22 bp, Homo sapiens
tatttctccctataccctccaa

SEQ ID NO: 9334441 - DNA, 22 bp, Homo sapiens
tatttctctcacggttgcctgg

SEQ ID NO: 9334442 - DNA, 22 bp, Homo sapiens
tatttctctcacggttgcctgg

SEQ ID NO: 9334443 - DNA, 22 bp, Homo sapiens
tatttctcttcaaaattgatgt

SEQ ID NO: 9334444 - DNA, 22 bp, Homo sapiens
tatttctcttcaaaattgatgt

SEQ ID NO: 9334445 - DNA, 22 bp, Homo sapiens
tatttctgaatccaaaaggtca

SEQ ID NO: 9334446 - DNA, 22 bp, Homo sapiens
tatttctctttgtagggatata

SEQ ID NO: 9334447 - DNA, 22 bp, Homo sapiens
tatttctgagaaccaacttacc

SEQ ID NO: 9334448 - DNA, 22 bp, Homo sapiens
tatttctgagaaccaacttacc

SEQ ID NO: 9334449 - DNA, 22 bp, Homo sapiens
tatttctgagaaccaacttacc

SEQ ID NO: 9334450 - DNA, 22 bp, Homo sapiens
tatttataatctgccaaagaga

SEQ ID NO: 9334451 - DNA, 22 bp, Homo sapiens
tatttataacagtgagaacggg

SEQ ID NO: 9334452 - DNA, 20 bp, Homo sapiens
tatttacaacttagagcctc

SEQ ID NO: 9334453 - DNA, 22 bp, Homo sapiens
tatttaattagtgattgtagag

SEQ ID NO: 9334454 - DNA, 22 bp, Homo sapiens
tattgacactttttgtgtagcc

SEQ ID NO: 9334455 - DNA, 22 bp, Homo sapiens
tatttatgtatgtggatgtgtt

SEQ ID NO: 9334456 - DNA, 22 bp, Homo sapiens
tatttatcgagtgtctactatg

SEQ ID NO: 9334457 - DNA, 22 bp, Homo sapiens
tatttatcgagtgtctactatg

SEQ ID NO: 9334458 - DNA, 21 bp, Homo sapiens
tatttattaatttgtaaggct

SEQ ID NO: 9334459 - DNA, 21 bp, Homo sapiens
tatttattaatttgtaaggct

SEQ ID NO: 9334460 - DNA, 21 bp, Homo sapiens
tatttattaatttgtaaggct

SEQ ID NO: 9334461 - DNA, 22 bp, Homo sapiens
tatttatattctgccttctgct

SEQ ID NO: 9334462 - DNA, 22 bp, Homo sapiens
tatttataccaggtgatcggag

SEQ ID NO: 9334463 - DNA, 22 bp, Homo sapiens
tatttataatctgccaaagaga

SEQ ID NO: 9334464 - DNA, 22 bp, Homo sapiens
tatttataatctgccaaagaga

SEQ ID NO: 9334465 - DNA, 22 bp, Homo sapiens
tatttataatctgccaaagaga

SEQ ID NO: 9334466 - DNA, 22 bp, Homo sapiens
tagggagatgcaagggacggag

SEQ ID NO: 9334467 - DNA, 22 bp, Homo sapiens
tagggagcagccctgccactcc

SEQ ID NO: 9334468 - DNA, 22 bp, Homo sapiens
tagggagctctggcagaaggaa

SEQ ID NO: 9334469 - DNA, 22 bp, Homo sapiens
tagggaggctacttcttgtagg

SEQ ID NO: 9334470 - DNA, 22 bp, Homo sapiens
tagggaggctacttcttgtagg

SEQ ID NO: 9334471 - DNA, 22 bp, Homo sapiens
tagggatgacgaaaggacagag

SEQ ID NO: 9334472 - DNA, 22 bp, Homo sapiens
tagggatgagcaactggtagtg

SEQ ID NO: 9334473 - DNA, 22 bp, Homo sapiens
tagggatgacgaaaggacagag

SEQ ID NO: 9334474 - DNA, 22 bp, Homo sapiens
tagggatgagccagtgggtagt

SEQ ID NO: 9334475 - DNA, 22 bp, Homo sapiens
tagggcagagcttgtacacgat

SEQ ID NO: 9334476 - DNA, 22 bp, Homo sapiens
tagggcagagtccaggatgggc

SEQ ID NO: 9334477 - DNA, 22 bp, Homo sapiens
tagggcagagcttgtacacgat

SEQ ID NO: 9334478 - DNA, 22 bp, Homo sapiens
tagggcaatatttcccagaaaa

SEQ ID NO: 9334479 - DNA, 22 bp, Homo sapiens
tagggatgtggtgagaactgag

SEQ ID NO: 9334480 - DNA, 22 bp, Homo sapiens
tagggatgtcctgagacttggc

SEQ ID NO: 9334481 - DNA, 22 bp, Homo sapiens
tagggatggaaactaggaatct

SEQ ID NO: 9334482 - DNA, 22 bp, Homo sapiens
tagggatggatgatgcctggca

SEQ ID NO: 9334483 - DNA, 22 bp, Homo sapiens
tagggatggcagcatgtagctt

SEQ ID NO: 9334484 - DNA, 22 bp, Homo sapiens
taggctgggagcctgaggctag

SEQ ID NO: 9334485 - DNA, 22 bp, Homo sapiens
taggcactggggaggcagcatg

SEQ ID NO: 9334486 - DNA, 22 bp, Homo sapiens
taggcactggttgtggatagtt

SEQ ID NO: 9334487 - DNA, 22 bp, Homo sapiens
taggctgggcattctggccagg

SEQ ID NO: 9334488 - DNA, 22 bp, Homo sapiens
taggctgggcattctggccagg

SEQ ID NO: 9334489 - DNA, 22 bp, Homo sapiens
taggctgggagcctgaggctag

SEQ ID NO: 9334490 - DNA, 22 bp, Homo sapiens
taggctgggcctgccttccagg

SEQ ID NO: 9334491 - DNA, 22 bp, Homo sapiens
tagggactagtttcaaggctaa

SEQ ID NO: 9334492 - DNA, 22 bp, Homo sapiens
tagggagatgcaagggacggag

SEQ ID NO: 9334493 - DNA, 20 bp, Homo sapiens
tagggagatatgctcttttc

SEQ ID NO: 9334494 - DNA, 22 bp, Homo sapiens
tagggagatgcaagggacggag

SEQ ID NO: 9334495 - DNA, 22 bp, Homo sapiens
tagggactgtgtgagggacttg

SEQ ID NO: 9334496 - DNA, 22 bp, Homo sapiens
tagggagaggaagcaggccgct

SEQ ID NO: 9334497 - DNA, 20 bp, Homo sapiens
tagggagatatgctcttttc

SEQ ID NO: 9334498 - DNA, 22 bp, Homo sapiens
taggatttggctttagtcaggt

SEQ ID NO: 9334499 - DNA, 22 bp, Homo sapiens
taggattttttggattctggat

SEQ ID NO: 9334500 - DNA, 22 bp, Homo sapiens
taggattttaacccacctctga

SEQ ID NO: 9334501 - DNA, 22 bp, Homo sapiens
taggcactgaggggagcaaggt

SEQ ID NO: 9334502 - DNA, 22 bp, Homo sapiens
taggacagtagctggtgcacag

SEQ ID NO: 9334503 - DNA, 22 bp, Homo sapiens
taggagggggaacaaggcatac

SEQ ID NO: 9334504 - DNA, 22 bp, Homo sapiens
taggaaaatatctcttattggg

SEQ ID NO: 9334505 - DNA, 22 bp, Homo sapiens
taggaaacaaagtaatgcaact

SEQ ID NO: 9334506 - DNA, 22 bp, Homo sapiens
taggaaactaatacagtctgga

SEQ ID NO: 9334507 - DNA, 22 bp, Homo sapiens
taggacaggtgaggggctgtgg

SEQ ID NO: 9334508 - DNA, 22 bp, Homo sapiens
taggacaggtgaggggctgtgg

SEQ ID NO: 9334509 - DNA, 22 bp, Homo sapiens
taggatatgcatttttatacat

SEQ ID NO: 9334510 - DNA, 22 bp, Homo sapiens
taggattcctattagctttctc

SEQ ID NO: 9334511 - DNA, 22 bp, Homo sapiens
taggattccagaacagtgctgc

SEQ ID NO: 9334512 - DNA, 22 bp, Homo sapiens
taggatgtagctatgtcatcat

SEQ ID NO: 9334513 - DNA, 22 bp, Homo sapiens
taggatggtcacagagatggac

SEQ ID NO: 9334514 - DNA, 22 bp, Homo sapiens
taggatggtacaaggcaggggt

SEQ ID NO: 9334515 - DNA, 22 bp, Homo sapiens
taggatttaggctttaacatct

SEQ ID NO: 9334516 - DNA, 22 bp, Homo sapiens
taggaaaagtctagattgatga

SEQ ID NO: 9334517 - DNA, 22 bp, Homo sapiens
taggaaaagtctagattgatga

SEQ ID NO: 9334518 - DNA, 22 bp, Homo sapiens
taggaaaagtctagattgatga

SEQ ID NO: 9334519 - DNA, 22 bp, Homo sapiens
taggaaaagcacaggatgttct

SEQ ID NO: 9334520 - DNA, 22 bp, Homo sapiens
taggaaaagcacaggatgttct

SEQ ID NO: 9334521 - DNA, 22 bp, Homo sapiens
taggaaaaatacagaattatat

SEQ ID NO: 9334522 - DNA, 22 bp, Homo sapiens
taggaaaacgtgattttctcac

SEQ ID NO: 9334523 - DNA, 22 bp, Homo sapiens
taggaaaaagaggctggcaagg

SEQ ID NO: 9334524 - DNA, 22 bp, Homo sapiens
taggaaaaatacagaattatat

SEQ ID NO: 9334525 - DNA, 22 bp, Homo sapiens
tagcttttatccactgcttttg

SEQ ID NO: 9334526 - DNA, 22 bp, Homo sapiens
tagctttctcaattttctgcca

SEQ ID NO: 9334527 - DNA, 22 bp, Homo sapiens
tagctttaggcacgtttgaatt

SEQ ID NO: 9334528 - DNA, 22 bp, Homo sapiens
tagctttaggatggttctcttg

SEQ ID NO: 9334529 - DNA, 17 bp, Homo sapiens
tagcagcagtaattgtg

SEQ ID NO: 9334530 - DNA, 22 bp, Homo sapiens
tagcagcatttttgtagagtat

SEQ ID NO: 9334531 - DNA, 22 bp, Homo sapiens
tagcagcccagtttctggccaa

SEQ ID NO: 9334532 - DNA, 22 bp, Homo sapiens
tagcagcccagtttctggccaa

SEQ ID NO: 9334533 - DNA, 22 bp, Homo sapiens
tagcagctacctggctaagagt

SEQ ID NO: 9334534 - DNA, 22 bp, Homo sapiens
tagcagcatgtaagtgagtaga

SEQ ID NO: 9334535 - DNA, 23 bp, Homo sapiens
tagcagcatttttagcctctgtc

SEQ ID NO: 9334536 - DNA, 23 bp, Homo sapiens
tagcagcatttttagcctctgtc

SEQ ID NO: 9334537 - DNA, 22 bp, Homo sapiens
tagcagagcagggatcagagcc

SEQ ID NO: 9334538 - DNA, 19 bp, Homo sapiens
tagcagagatgactccagc

SEQ ID NO: 9334539 - DNA, 19 bp, Homo sapiens
tagcagagatgactccagc

SEQ ID NO: 9334540 - DNA, 22 bp, Homo sapiens
tagcagaggaaatccagagtaa

SEQ ID NO: 9334541 - DNA, 22 bp, Homo sapiens
tagaggtgagatattttatttt

SEQ ID NO: 9334542 - DNA, 22 bp, Homo sapiens
tagaggtgagaggaactttgga

SEQ ID NO: 9334543 - DNA, 22 bp, Homo sapiens
tagaggtgacactgagaccata

SEQ ID NO: 9334544 - DNA, 18 bp, Homo sapiens
tagagggggcctgggcat

SEQ ID NO: 9334545 - DNA, 22 bp, Homo sapiens
tagaggtgttcattctctccat

SEQ ID NO: 9334546 - DNA, 22 bp, Homo sapiens
tagaggtgttgttgatatagaa

SEQ ID NO: 9334547 - DNA, 22 bp, Homo sapiens
tagcagaaccagtcagtgagcc

SEQ ID NO: 9334548 - DNA, 22 bp, Homo sapiens
tagcagaagaaattcagagttg

SEQ ID NO: 9334549 - DNA, 22 bp, Homo sapiens
tagcagagaggggacagtggca

SEQ ID NO: 9334550 - DNA, 22 bp, Homo sapiens
tagcagaagttgcaaactaggg

SEQ ID NO: 9334551 - DNA, 22 bp, Homo sapiens
tagcagaagttgcaaactaggg

SEQ ID NO: 9334552 - DNA, 22 bp, Homo sapiens
tagctcttcatttcatctgatt

SEQ ID NO: 9334553 - DNA, 22 bp, Homo sapiens
tagctttaatgagttggtaaga

SEQ ID NO: 9334554 - DNA, 22 bp, Homo sapiens
tagctttaatgagttggtaaga

SEQ ID NO: 9334555 - DNA, 22 bp, Homo sapiens
tagctttaatgagttggtaaga

SEQ ID NO: 9334556 - DNA, 22 bp, Homo sapiens
tagctcttcaatcactgtctcc

SEQ ID NO: 9334557 - DNA, 22 bp, Homo sapiens
tagctcctggtgagcctactct

SEQ ID NO: 9334558 - DNA, 22 bp, Homo sapiens
tagccgcgtcagcagttcccca

SEQ ID NO: 9334559 - DNA, 22 bp, Homo sapiens
tagcccctgcctttgaacctgg

SEQ ID NO: 9334560 - DNA, 22 bp, Homo sapiens
tagcccatgcagctctgtcatt

SEQ ID NO: 9334561 - DNA, 21 bp, Homo sapiens
tagcccttctccacctcgccc

SEQ ID NO: 9334562 - DNA, 22 bp, Homo sapiens
tagccgcgcttacctcgccgtg

SEQ ID NO: 9334563 - DNA, 22 bp, Homo sapiens
tagcccttttctgagcccacat

SEQ ID NO: 9334564 - DNA, 21 bp, Homo sapiens
tagcccttctccacctcgccc

SEQ ID NO: 9334565 - DNA, 22 bp, Homo sapiens
tagcagctcactaactctgcgt

SEQ ID NO: 9334566 - DNA, 22 bp, Homo sapiens
tagcagctcactaactctgcgt

SEQ ID NO: 9334567 - DNA, 22 bp, Homo sapiens
tagcagctccatttctctggca

SEQ ID NO: 9334568 - DNA, 22 bp, Homo sapiens
tagcagctccatttctctggca

SEQ ID NO: 9334569 - DNA, 22 bp, Homo sapiens
tagcagctcacagcctcccatt

SEQ ID NO: 9334570 - DNA, 22 bp, Homo sapiens
tagcagctatgccattttgaca

SEQ ID NO: 9334571 - DNA, 22 bp, Homo sapiens
taccaaaaccaagccattatct

SEQ ID NO: 9334572 - DNA, 22 bp, Homo sapiens
tacttttagcctatttgattct

SEQ ID NO: 9334573 - DNA, 22 bp, Homo sapiens
tacttttagcctatttgattct

SEQ ID NO: 9334574 - DNA, 22 bp, Homo sapiens
tacttttaaaattcacaggtat

SEQ ID NO: 9334575 - DNA, 22 bp, Homo sapiens
tactttgtggagattaaaaata

SEQ ID NO: 9334576 - DNA, 22 bp, Homo sapiens
tactttgtccatttgcaggcag

SEQ ID NO: 9334577 - DNA, 22 bp, Homo sapiens
tactttgtggagattaaaaata

SEQ ID NO: 9334578 - DNA, 22 bp, Homo sapiens
tactttggttgaatatgtaatg

SEQ ID NO: 9334579 - DNA, 21 bp, Homo sapiens
tactttgcaatgtatctcctt

SEQ ID NO: 9334580 - DNA, 22 bp, Homo sapiens
tactttggatccttacaatagc

SEQ ID NO: 9334581 - DNA, 22 bp, Homo sapiens
tactttggaagagttcatacag

SEQ ID NO: 9334582 - DNA, 22 bp, Homo sapiens
tactttgggtttagaataaact

SEQ ID NO: 9334583 - DNA, 22 bp, Homo sapiens
tactttggggacaatatggaat

SEQ ID NO: 9334584 - DNA, 22 bp, Homo sapiens
tactttggatccttacaatagc

SEQ ID NO: 9334585 - DNA, 22 bp, Homo sapiens
tagaaaagaattttatttgata

SEQ ID NO: 9334586 - DNA, 22 bp, Homo sapiens
tagaaaactaatacatgcttga

SEQ ID NO: 9334587 - DNA, 22 bp, Homo sapiens
tactttttgtctctttgaatgt

SEQ ID NO: 9334588 - DNA, 22 bp, Homo sapiens
tacttttccagggctggctgag

SEQ ID NO: 9334589 - DNA, 22 bp, Homo sapiens
tacttttcctggaaccactgct

SEQ ID NO: 9334590 - DNA, 22 bp, Homo sapiens
tacttttcacccagcccgcttc

SEQ ID NO: 9334591 - DNA, 22 bp, Homo sapiens
tacttttcataatgaagcagca

SEQ ID NO: 9334592 - DNA, 22 bp, Homo sapiens
tacttttcaagcagctggttat

SEQ ID NO: 9334593 - DNA, 22 bp, Homo sapiens
tacttttattattgcccctcca

SEQ ID NO: 9334594 - DNA, 22 bp, Homo sapiens
tacttttattattgcccctcca

SEQ ID NO: 9334595 - DNA, 22 bp, Homo sapiens
tacttttatgtgatgaaatctg

SEQ ID NO: 9334596 - DNA, 22 bp, Homo sapiens
tacttttatgtgatgaaatctg

SEQ ID NO: 9334597 - DNA, 22 bp, Homo sapiens
tacttttctttgtcatgcatct

SEQ ID NO: 9334598 - DNA, 22 bp, Homo sapiens
tacttttctataggtttgaaat

SEQ ID NO: 9334599 - DNA, 22 bp, Homo sapiens
tacttttctgtgtggcagtcac

SEQ ID NO: 9334600 - DNA, 22 bp, Homo sapiens
tactttttagcacagtgtgtgc

SEQ ID NO: 9334601 - DNA, 19 bp, Homo sapiens
tactttttcaggacagagt

SEQ ID NO: 9334602 - DNA, 22 bp, Homo sapiens
tagaaacatgagagaaactctt

SEQ ID NO: 9334603 - DNA, 22 bp, Homo sapiens
tagaaacatgttctgttctgtt

SEQ ID NO: 9334604 - DNA, 22 bp, Homo sapiens
tagaaacatcagctaaccaaaa

SEQ ID NO: 9334605 - DNA, 22 bp, Homo sapiens
tagaaacatcagctaaccaaaa

SEQ ID NO: 9334606 - DNA, 22 bp, Homo sapiens
tagaaacatcagctaaccaaaa

SEQ ID NO: 9334607 - DNA, 22 bp, Homo sapiens
tagaaacattcagttgcagtcc

SEQ ID NO: 9334608 - DNA, 22 bp, Homo sapiens
tagaaacattcagttgcagtcc

SEQ ID NO: 9334609 - DNA, 22 bp, Homo sapiens
tagaaactgatagtcttgtgct

SEQ ID NO: 9334610 - DNA, 22 bp, Homo sapiens
tagaaacaatgacatgcttgta

SEQ ID NO: 9334611 - DNA, 22 bp, Homo sapiens
tagaaacacagagagacccatg

SEQ ID NO: 9334612 - DNA, 22 bp, Homo sapiens
tagaaacagaatatgagtgaga

SEQ ID NO: 9334613 - DNA, 22 bp, Homo sapiens
tagaaacacagatctggtgtca

SEQ ID NO: 9334614 - DNA, 22 bp, Homo sapiens
tagaaacagaaaactgtaatag

SEQ ID NO: 9334615 - DNA, 22 bp, Homo sapiens
tagaaacagaaaactgtaatag

SEQ ID NO: 9334616 - DNA, 22 bp, Homo sapiens
tagaaacagagagatatgcccc

SEQ ID NO: 9334617 - DNA, 22 bp, Homo sapiens
tagaaacagagcaggtggccca

SEQ ID NO: 9334618 - DNA, 22 bp, Homo sapiens
tagaaacagatgtttttgaaga

SEQ ID NO: 9334619 - DNA, 22 bp, Homo sapiens
tagaaacagcatatattagccc

SEQ ID NO: 9334620 - DNA, 22 bp, Homo sapiens
tagaaacagcatatattagccc

SEQ ID NO: 9334621 - DNA, 22 bp, Homo sapiens
tagaaacatataggatggcagg

SEQ ID NO: 9334622 - DNA, 22 bp, Homo sapiens
tagaaacatatgtttgagacat

SEQ ID NO: 9334623 - DNA, 22 bp, Homo sapiens
tagaaacatataggatggcagg

SEQ ID NO: 9334624 - DNA, 22 bp, Homo sapiens
tagaattttctgctttgatagt

SEQ ID NO: 9334625 - DNA, 22 bp, Homo sapiens
tagacaatgccatcttgtggtt

SEQ ID NO: 9334626 - DNA, 22 bp, Homo sapiens
tagacacaggggaatgtgaggt

SEQ ID NO: 9334627 - DNA, 22 bp, Homo sapiens
tagacacatacccttgcccaaa

SEQ ID NO: 9334628 - DNA, 22 bp, Homo sapiens
tagaatgagaaagtgtagcagg

SEQ ID NO: 9334629 - DNA, 22 bp, Homo sapiens
tagaatgacctcctcttagctt

SEQ ID NO: 9334630 - DNA, 22 bp, Homo sapiens
tagaatgtagtgcttcaagatt

SEQ ID NO: 9334631 - DNA, 22 bp, Homo sapiens
tagaatgtggaggtaacagact

SEQ ID NO: 9334632 - DNA, 22 bp, Homo sapiens
tagaggcattaatgaataaaca

SEQ ID NO: 9334633 - DNA, 22 bp, Homo sapiens
tagaggcattgcttaatttcag

SEQ ID NO: 9334634 - DNA, 22 bp, Homo sapiens
tagaggctcctgtgtgtaggtt

SEQ ID NO: 9334635 - DNA, 22 bp, Homo sapiens
tagaggctcttcattgcagtag

SEQ ID NO: 9334636 - DNA, 22 bp, Homo sapiens
tagaggctactagaggcacctg

SEQ ID NO: 9334637 - DNA, 22 bp, Homo sapiens
tagaggctttcagcggtaggtc

SEQ ID NO: 9334638 - DNA, 22 bp, Homo sapiens
tagaggcttctactgctcactt

SEQ ID NO: 9334639 - DNA, 22 bp, Homo sapiens
tagaggctgggaattattttca

SEQ ID NO: 9334640 - DNA, 22 bp, Homo sapiens
tagaggcttctactgctcactt

SEQ ID NO: 9334641 - DNA, 22 bp, Homo sapiens
tagagggaagactgctagattt

SEQ ID NO: 9334642 - DNA, 22 bp, Homo sapiens
tagaggcagaagaaattgacaa

SEQ ID NO: 9334643 - DNA, 22 bp, Homo sapiens
tagaggcagaagaaattgacaa

SEQ ID NO: 9334644 - DNA, 22 bp, Homo sapiens
tagacactagggatttagtact

SEQ ID NO: 9334645 - DNA, 22 bp, Homo sapiens
tagacacatcaagtatagttaa

SEQ ID NO: 9334646 - DNA, 22 bp, Homo sapiens
tagaaatgaatgtttaaaagtc

SEQ ID NO: 9334647 - DNA, 22 bp, Homo sapiens
tagaaatcaggtttttagaaag

SEQ ID NO: 9334648 - DNA, 17 bp, Homo sapiens
tagaaatcatagggttg

SEQ ID NO: 9334649 - DNA, 22 bp, Homo sapiens
tagaaatcatttagaagtattg

SEQ ID NO: 9334650 - DNA, 20 bp, Homo sapiens
tagaaatcttataaaagact

SEQ ID NO: 9334651 - DNA, 22 bp, Homo sapiens
tagaaatcacaaaccagtagtt

SEQ ID NO: 9334652 - DNA, 22 bp, Homo sapiens
tagaaatcagcaggcatatgta

SEQ ID NO: 9334653 - DNA, 22 bp, Homo sapiens
tagaaagtgaaggttaattaat

SEQ ID NO: 9334654 - DNA, 22 bp, Homo sapiens
tagaaagtggttgagagtttag

SEQ ID NO: 9334655 - DNA, 22 bp, Homo sapiens
tagaaaggatattgagatgaat

SEQ ID NO: 9334656 - DNA, 22 bp, Homo sapiens
tagaaagaacttcatgtaaaac

SEQ ID NO: 9334657 - DNA, 22 bp, Homo sapiens
tagaaagtcatgaattacacca

SEQ ID NO: 9334658 - DNA, 21 bp, Homo sapiens
tagaaagtcaaagctatcagc

SEQ ID NO: 9334659 - DNA, 22 bp, Homo sapiens
tagaaagtagccacttacagag

SEQ ID NO: 9334660 - DNA, 22 bp, Homo sapiens
tagaaagtcaaaacactgtgtt

SEQ ID NO: 9334661 - DNA, 22 bp, Homo sapiens
tagaaagtagggaaggtaggat

SEQ ID NO: 9334662 - DNA, 22 bp, Homo sapiens
tagaaagtactaaatttaactg

SEQ ID NO: 9334663 - DNA, 22 bp, Homo sapiens
tagaaagtaaatcagttttatt

SEQ ID NO: 9334664 - DNA, 22 bp, Homo sapiens
tagaaagtaaacacgaagtctc

SEQ ID NO: 9334665 - DNA, 22 bp, Homo sapiens
tacatacatgtatgtgtgtatt

SEQ ID NO: 9334666 - DNA, 22 bp, Homo sapiens
tacatacattacctcatttagt

SEQ ID NO: 9334667 - DNA, 22 bp, Homo sapiens
tacatacattacctcatttagt

SEQ ID NO: 9334668 - DNA, 22 bp, Homo sapiens
tacatacattacctcatttagt

SEQ ID NO: 9334669 - DNA, 22 bp, Homo sapiens
tacatacattacctcatttagt

SEQ ID NO: 9334670 - DNA, 22 bp, Homo sapiens
tacatagaacatgtttaatgtc

SEQ ID NO: 9334671 - DNA, 22 bp, Homo sapiens
tacatagagggtaatagcatca

SEQ ID NO: 9334672 - DNA, 22 bp, Homo sapiens
tacatagagggtaatagcatca

SEQ ID NO: 9334673 - DNA, 22 bp, Homo sapiens
tacatacatggtggaatggtta

SEQ ID NO: 9334674 - DNA, 22 bp, Homo sapiens
tacagtagacaggaccacaggc

SEQ ID NO: 9334675 - DNA, 22 bp, Homo sapiens
tacagtaccctgatgaactaaa

SEQ ID NO: 9334676 - DNA, 22 bp, Homo sapiens
tacagtaatgtgtccctgcagg

SEQ ID NO: 9334677 - DNA, 22 bp, Homo sapiens
tacagtaataaaatgagctaca

SEQ ID NO: 9334678 - DNA, 20 bp, Homo sapiens
tacaggagtgagtgggtggg

SEQ ID NO: 9334679 - DNA, 19 bp, Homo sapiens
tacaggaggcctgcaatct

SEQ ID NO: 9334680 - DNA, 22 bp, Homo sapiens
tacaggaggattatcaaaggat

SEQ ID NO: 9334681 - DNA, 19 bp, Homo sapiens
tacaggcagtttctacaat

SEQ ID NO: 9334682 - DNA, 22 bp, Homo sapiens
tacaggcactgaaatgcttatt

SEQ ID NO: 9334683 - DNA, 22 bp, Homo sapiens
tacaggcactgaaatgcttatt

SEQ ID NO: 9334684 - DNA, 17 bp, Homo sapiens
tacaggagagcaggaac

SEQ ID NO: 9334685 - DNA, 22 bp, Homo sapiens
tacagcacggtgcatttactac

SEQ ID NO: 9334686 - DNA, 22 bp, Homo sapiens
tacagcacggtgcatttactac

SEQ ID NO: 9334687 - DNA, 22 bp, Homo sapiens
tacagcacattgtgatggcact

SEQ ID NO: 9334688 - DNA, 22 bp, Homo sapiens
tacaggagcacaaaagagttga

SEQ ID NO: 9334689 - DNA, 22 bp, Homo sapiens
tacaggagctgctctgtgatac

SEQ ID NO: 9334690 - DNA, 22 bp, Homo sapiens
tacaggagcatggggaagggat

SEQ ID NO: 9334691 - DNA, 22 bp, Homo sapiens
tacaggcatgaatgaaatctgt

SEQ ID NO: 9334692 - DNA, 22 bp, Homo sapiens
tacaggcatgtagcatggtgat

SEQ ID NO: 9334693 - DNA, 22 bp, Homo sapiens
tacaggcatgtagcatggtgat

SEQ ID NO: 9334694 - DNA, 22 bp, Homo sapiens
tacaggcatgtagcatggtgat

SEQ ID NO: 9334695 - DNA, 22 bp, Homo sapiens
tacagggaatgggacataaatc

SEQ ID NO: 9334696 - DNA, 22 bp, Homo sapiens
tacaggctagggagagtgactg

SEQ ID NO: 9334697 - DNA, 22 bp, Homo sapiens
tacaggcccatagtccctgctt

SEQ ID NO: 9334698 - DNA, 20 bp, Homo sapiens
tacaggctctgagagatgat

SEQ ID NO: 9334699 - DNA, 22 bp, Homo sapiens
tacaggctcttgtcagacgtat

SEQ ID NO: 9334700 - DNA, 22 bp, Homo sapiens
tacagggacatggaacaggctc

SEQ ID NO: 9334701 - DNA, 22 bp, Homo sapiens
tacagggaatgggacataaatc

SEQ ID NO: 9334702 - DNA, 22 bp, Homo sapiens
tacagggaccaataataactat

SEQ ID NO: 9334703 - DNA, 22 bp, Homo sapiens
tacagggactcccgcagagata

SEQ ID NO: 9334704 - DNA, 22 bp, Homo sapiens
tacagggactcccgcagagata

SEQ ID NO: 9334705 - DNA, 22 bp, Homo sapiens
tacattgactgtgtgcatcaca

SEQ ID NO: 9334706 - DNA, 22 bp, Homo sapiens
tacatatagacagttactctag

SEQ ID NO: 9334707 - DNA, 22 bp, Homo sapiens
tacatatagacagttactctag

SEQ ID NO: 9334708 - DNA, 22 bp, Homo sapiens
tacatatagacagttactctag

SEQ ID NO: 9334709 - DNA, 22 bp, Homo sapiens
tacatcatggcttcatgctgca

SEQ ID NO: 9334710 - DNA, 22 bp, Homo sapiens
tacatcatggcttcatgctgca

SEQ ID NO: 9334711 - DNA, 22 bp, Homo sapiens
tacatatactgagtgatttgct

SEQ ID NO: 9334712 - DNA, 22 bp, Homo sapiens
tacatatactgagtgatttgct

SEQ ID NO: 9334713 - DNA, 22 bp, Homo sapiens
tacatatagacagttactctag

SEQ ID NO: 9334714 - DNA, 22 bp, Homo sapiens
tacatagtgaacatttacagag

SEQ ID NO: 9334715 - DNA, 22 bp, Homo sapiens
tacatagtattcacattgtttt

SEQ ID NO: 9334716 - DNA, 22 bp, Homo sapiens
tacatatactgagtgatttgct

SEQ ID NO: 9334717 - DNA, 22 bp, Homo sapiens
tacatagttccatttacaggaa

SEQ ID NO: 9334718 - DNA, 22 bp, Homo sapiens
tacatatactgagtgatttgct

SEQ ID NO: 9334719 - DNA, 22 bp, Homo sapiens
tacatctagccttacaattatt

SEQ ID NO: 9334720 - DNA, 22 bp, Homo sapiens
tacatctagccttacaattatt

SEQ ID NO: 9334721 - DNA, 22 bp, Homo sapiens
tacatccaaatgaattagaatt

SEQ ID NO: 9334722 - DNA, 22 bp, Homo sapiens
tacatccaaagttgaggtgcct

SEQ ID NO: 9334723 - DNA, 22 bp, Homo sapiens
tacatcattttggagatgagca

SEQ ID NO: 9334724 - DNA, 22 bp, Homo sapiens
tacatcatgtaagcagaatcat

SEQ ID NO: 9334725 - DNA, 22 bp, Homo sapiens
tacatcatgtaagcagaatcat

SEQ ID NO: 9334726 - DNA, 22 bp, Homo sapiens
tacattcccccaattaccaatg

SEQ ID NO: 9334727 - DNA, 22 bp, Homo sapiens
tacatctcatctgtgctctccg

SEQ ID NO: 9334728 - DNA, 22 bp, Homo sapiens
tacatctatttgacagatacag

SEQ ID NO: 9334729 - DNA, 18 bp, Homo sapiens
tacatctatatagtgttt

SEQ ID NO: 9334730 - DNA, 22 bp, Homo sapiens
tacacttttctggttactcttg

SEQ ID NO: 9334731 - DNA, 22 bp, Homo sapiens
tacacttttctggttactcttg

SEQ ID NO: 9334732 - DNA, 22 bp, Homo sapiens
tacactttttactacagattct

SEQ ID NO: 9334733 - DNA, 22 bp, Homo sapiens
tacagaaaaacatctggagccg

SEQ ID NO: 9334734 - DNA, 22 bp, Homo sapiens
tacagaaaaacatctggagccg

SEQ ID NO: 9334735 - DNA, 22 bp, Homo sapiens
tacactgaaagagaggattgaa

SEQ ID NO: 9334736 - DNA, 22 bp, Homo sapiens
tacactattttactgatacaaa

SEQ ID NO: 9334737 - DNA, 21 bp, Homo sapiens
tacaacaggttttatttcgat

SEQ ID NO: 9334738 - DNA, 22 bp, Homo sapiens
tacagaaagacctctcgggaaa

SEQ ID NO: 9334739 - DNA, 22 bp, Homo sapiens
tacagaaagggatgattgatct

SEQ ID NO: 9334740 - DNA, 20 bp, Homo sapiens
tacagaaacaggacttttgg

SEQ ID NO: 9334741 - DNA, 22 bp, Homo sapiens
tacagaaaaacatctggagccg

SEQ ID NO: 9334742 - DNA, 22 bp, Homo sapiens
tacagaaaaactggcattgaag

SEQ ID NO: 9334743 - DNA, 22 bp, Homo sapiens
tacagaaaaacttggaggcttt

SEQ ID NO: 9334744 - DNA, 22 bp, Homo sapiens
tacagaaaaacttggaggcttt

SEQ ID NO: 9334745 - DNA, 22 bp, Homo sapiens
tacagaaacagcgtggttagaa

SEQ ID NO: 9334746 - DNA, 22 bp, Homo sapiens
tacaacaatttccacattagaa

SEQ ID NO: 9334747 - DNA, 22 bp, Homo sapiens
tacaacaatttccacattagaa

SEQ ID NO: 9334748 - DNA, 22 bp, Homo sapiens
tacaacaatttccacattagaa

SEQ ID NO: 9334749 - DNA, 22 bp, Homo sapiens
tacaaatcagatcatgagttta

SEQ ID NO: 9334750 - DNA, 22 bp, Homo sapiens
tacaaatcagatcatgagttta

SEQ ID NO: 9334751 - DNA, 20 bp, Homo sapiens
tacaacaagtagagacatac

SEQ ID NO: 9334752 - DNA, 22 bp, Homo sapiens
tacaacaggaatttcaactttg

SEQ ID NO: 9334753 - DNA, 22 bp, Homo sapiens
tacaacaatttccacattagaa

SEQ ID NO: 9334754 - DNA, 22 bp, Homo sapiens
tacaacagaagtgtttatttag

SEQ ID NO: 9334755 - DNA, 22 bp, Homo sapiens
tacaaagtcagaataacaggtg

SEQ ID NO: 9334756 - DNA, 22 bp, Homo sapiens
tacaaagtgaaataattctgag

SEQ ID NO: 9334757 - DNA, 22 bp, Homo sapiens
tacaaagtgaaataattctgag

SEQ ID NO: 9334758 - DNA, 22 bp, Homo sapiens
tacaaagtgctttagaaatgaa

SEQ ID NO: 9334759 - DNA, 22 bp, Homo sapiens
tacaaagtttgagaatgctttc

SEQ ID NO: 9334760 - DNA, 22 bp, Homo sapiens
tacaaagtttgagaatgctttc

SEQ ID NO: 9334761 - DNA, 22 bp, Homo sapiens
tacaaagtgctttagaaatgaa

SEQ ID NO: 9334762 - DNA, 22 bp, Homo sapiens
tacagaaatacagtcaggccta

SEQ ID NO: 9334763 - DNA, 22 bp, Homo sapiens
tacagaaatactggggggttct

SEQ ID NO: 9334764 - DNA, 22 bp, Homo sapiens
tacagaaatactggggggttct

SEQ ID NO: 9334765 - DNA, 22 bp, Homo sapiens
tacagaaatcacatcgctttga

SEQ ID NO: 9334766 - DNA, 22 bp, Homo sapiens
tacagaaattgccaccagctct

SEQ ID NO: 9334767 - DNA, 22 bp, Homo sapiens
tacagaagctgagacactgaga

SEQ ID NO: 9334768 - DNA, 22 bp, Homo sapiens
tacagataactgaatgcagact

SEQ ID NO: 9334769 - DNA, 22 bp, Homo sapiens
tacagatagaattagtgagtta

SEQ ID NO: 9334770 - DNA, 22 bp, Homo sapiens
tacagatacagatctagataca

SEQ ID NO: 9334771 - DNA, 22 bp, Homo sapiens
tacagataactgaatgcagact

SEQ ID NO: 9334772 - DNA, 22 bp, Homo sapiens
tacagagttttcctgccaagaa

SEQ ID NO: 9334773 - DNA, 22 bp, Homo sapiens
tacagagtggtgagatcttttg

SEQ ID NO: 9334774 - DNA, 22 bp, Homo sapiens
tacagagtgttattacagaatc

SEQ ID NO: 9334775 - DNA, 22 bp, Homo sapiens
tacagaagttggttttagttta

SEQ ID NO: 9334776 - DNA, 22 bp, Homo sapiens
tacagataggaggaatctgaaa

SEQ ID NO: 9334777 - DNA, 22 bp, Homo sapiens
tacagataggaggaatctgaaa

SEQ ID NO: 9334778 - DNA, 22 bp, Homo sapiens
tacagatatagagatttataga

SEQ ID NO: 9334779 - DNA, 22 bp, Homo sapiens
tacagatatagggcgagcttag

SEQ ID NO: 9334780 - DNA, 18 bp, Homo sapiens
tacagattatagatacat

SEQ ID NO: 9334781 - DNA, 22 bp, Homo sapiens
tacagattgaggtttttaatat

SEQ ID NO: 9334782 - DNA, 18 bp, Homo sapiens
tacagattatagatacat

SEQ ID NO: 9334783 - DNA, 22 bp, Homo sapiens
tacagcaatgctacaagatgac

SEQ ID NO: 9334784 - DNA, 22 bp, Homo sapiens
tacagcaatgcctgaaatagta

SEQ ID NO: 9334785 - DNA, 22 bp, Homo sapiens
tacagattttgtgaagaagtgt

SEQ ID NO: 9334786 - DNA, 22 bp, Homo sapiens
tacagattttgtgaagaagtgt

SEQ ID NO: 9334787 - DNA, 22 bp, Homo sapiens
tacagattttgtgaagaagtgt

SEQ ID NO: 9334788 - DNA, 22 bp, Homo sapiens
tacagatttggggagtaaagtt

SEQ ID NO: 9334789 - DNA, 22 bp, Homo sapiens
taagtaaatttataatgtgatt

SEQ ID NO: 9334790 - DNA, 22 bp, Homo sapiens
taaggtttgtggggagcaaaag

SEQ ID NO: 9334791 - DNA, 22 bp, Homo sapiens
taaggttttgagaccagaacgt

SEQ ID NO: 9334792 - DNA, 22 bp, Homo sapiens
taaggttttgagaccagaacgt

SEQ ID NO: 9334793 - DNA, 22 bp, Homo sapiens
taaggtttggctgtctcttggt

SEQ ID NO: 9334794 - DNA, 22 bp, Homo sapiens
taaggtttcttcagatactagt

SEQ ID NO: 9334795 - DNA, 22 bp, Homo sapiens
taaggtttgcttatcttcgcct

SEQ ID NO: 9334796 - DNA, 22 bp, Homo sapiens
taaggtttgaagaagactgagc

SEQ ID NO: 9334797 - DNA, 22 bp, Homo sapiens
taaggtttgtggggagcaaaag

SEQ ID NO: 9334798 - DNA, 22 bp, Homo sapiens
taaggtttggctgtctcttggt

SEQ ID NO: 9334799 - DNA, 22 bp, Homo sapiens
taagtaactgcataattaaatt

SEQ ID NO: 9334800 - DNA, 23 bp, Homo sapiens
taagtgataaagagtagagatgg

SEQ ID NO: 9334801 - DNA, 22 bp, Homo sapiens
taagtgatgaaagcagatgtct

SEQ ID NO: 9334802 - DNA, 22 bp, Homo sapiens
taagtgatgaagacctgtttgg

SEQ ID NO: 9334803 - DNA, 22 bp, Homo sapiens
taagtgatgagcacagtaatta

SEQ ID NO: 9334804 - DNA, 23 bp, Homo sapiens
taagtgattagaatttgctgtca

SEQ ID NO: 9334805 - DNA, 22 bp, Homo sapiens
taagtgatgtcttggttaatga

SEQ ID NO: 9334806 - DNA, 22 bp, Homo sapiens
taagtgatgatagtacctagaa

SEQ ID NO: 9334807 - DNA, 22 bp, Homo sapiens
taagtgatttataaggagatat

SEQ ID NO: 9334808 - DNA, 23 bp, Homo sapiens
taagtgattccaagtttcaggga

SEQ ID NO: 9334809 - DNA, 17 bp, Homo sapiens
taagtgattatctcata

SEQ ID NO: 9334810 - DNA, 22 bp, Homo sapiens
taagtgatttgtagtatactat

SEQ ID NO: 9334811 - DNA, 22 bp, Homo sapiens
taatactgaaaggagtatcagc

SEQ ID NO: 9334812 - DNA, 22 bp, Homo sapiens
taatacatgtattccagagagt

SEQ ID NO: 9334813 - DNA, 22 bp, Homo sapiens
taatacatgtattccagagagt

SEQ ID NO: 9334814 - DNA, 22 bp, Homo sapiens
taatacatcattcatctaagga

SEQ ID NO: 9334815 - DNA, 22 bp, Homo sapiens
taatacatcattcatctaagga

SEQ ID NO: 9334816 - DNA, 22 bp, Homo sapiens
taatacattacctaacctctct

SEQ ID NO: 9334817 - DNA, 22 bp, Homo sapiens
taatacattacctaacctctct

SEQ ID NO: 9334818 - DNA, 22 bp, Homo sapiens
taagtgggcgccttgaattact

SEQ ID NO: 9334819 - DNA, 22 bp, Homo sapiens
taagtgggtgaagaggaaatat

SEQ ID NO: 9334820 - DNA, 22 bp, Homo sapiens
taagtgggtttgtaatgtgcct

SEQ ID NO: 9334821 - DNA, 22 bp, Homo sapiens
taagtgggcgccttgaattact

SEQ ID NO: 9334822 - DNA, 22 bp, Homo sapiens
taagtgtccctattgtgatttt

SEQ ID NO: 9334823 - DNA, 22 bp, Homo sapiens
taataagcgtagaaggtatatc

SEQ ID NO: 9334824 - DNA, 22 bp, Homo sapiens
taatacagtagcttttacacag

SEQ ID NO: 9334825 - DNA, 22 bp, Homo sapiens
taaggcaatggcattcttgaca

SEQ ID NO: 9334826 - DNA, 22 bp, Homo sapiens
taaggcaaagtgatttcttaaa

SEQ ID NO: 9334827 - DNA, 22 bp, Homo sapiens
taaggcaaagtgatttcttaaa

SEQ ID NO: 9334828 - DNA, 22 bp, Homo sapiens
taaggcattatagagacagcct

SEQ ID NO: 9334829 - DNA, 22 bp, Homo sapiens
taaggccaaggggccatagtct

SEQ ID NO: 9334830 - DNA, 21 bp, Homo sapiens
taaggccaagtctatttctgt

SEQ ID NO: 9334831 - DNA, 22 bp, Homo sapiens
taaggccaagttcatatacaac

SEQ ID NO: 9334832 - DNA, 22 bp, Homo sapiens
taaggccaaactattatagttc

SEQ ID NO: 9334833 - DNA, 19 bp, Homo sapiens
taaggccaaaagtaagtgt

SEQ ID NO: 9334834 - DNA, 22 bp, Homo sapiens
taaggccattatggtgggcccg

SEQ ID NO: 9334835 - DNA, 22 bp, Homo sapiens
taaggccagcatgaatgcagca

SEQ ID NO: 9334836 - DNA, 22 bp, Homo sapiens
taaggccaggctgtggtcggca

SEQ ID NO: 9334837 - DNA, 22 bp, Homo sapiens
taaggccagccagcaaatctgt

SEQ ID NO: 9334838 - DNA, 22 bp, Homo sapiens
taaggccaattacatatgttca

SEQ ID NO: 9334839 - DNA, 22 bp, Homo sapiens
taaggccaattaacaaccaggg

SEQ ID NO: 9334840 - DNA, 22 bp, Homo sapiens
taaggccaccgttatagaacca

SEQ ID NO: 9334841 - DNA, 22 bp, Homo sapiens
taaggtagccctaatgtgggtt

SEQ ID NO: 9334842 - DNA, 22 bp, Homo sapiens
taaggtttaacgccctgtctcg

SEQ ID NO: 9334843 - DNA, 22 bp, Homo sapiens
taaggtttaacgccctgtctcg

SEQ ID NO: 9334844 - DNA, 20 bp, Homo sapiens
taaggtgatctcagagaagc

SEQ ID NO: 9334845 - DNA, 22 bp, Homo sapiens
taaggtttcttcagatactagt

SEQ ID NO: 9334846 - DNA, 22 bp, Homo sapiens
taaggtttctagtttctaaact

SEQ ID NO: 9334847 - DNA, 19 bp, Homo sapiens
taaggtttaccagcaaaat

SEQ ID NO: 9334848 - DNA, 22 bp, Homo sapiens
taaggtttgaagaagactgagc

SEQ ID NO: 9334849 - DNA, 22 bp, Homo sapiens
taaggtttgcttatcttcgcct

SEQ ID NO: 9334850 - DNA, 22 bp, Homo sapiens
taaggtttctagtttctaaact

SEQ ID NO: 9334851 - DNA, 19 bp, Homo sapiens
taaggtttaccagcaaaat

SEQ ID NO: 9334852 - DNA, 22 bp, Homo sapiens
taaggtaactgcttttggctga

SEQ ID NO: 9334853 - DNA, 22 bp, Homo sapiens
taagggttcagaatgcagtggt

SEQ ID NO: 9334854 - DNA, 22 bp, Homo sapiens
taagggttcagaatgcagtggt

SEQ ID NO: 9334855 - DNA, 22 bp, Homo sapiens
taagggttcagaatgcagtggt

SEQ ID NO: 9334856 - DNA, 22 bp, Homo sapiens
tacaaagatagtgttagagtaa

SEQ ID NO: 9334857 - DNA, 22 bp, Homo sapiens
tacaaagtaatgtataatatcg

SEQ ID NO: 9334858 - DNA, 22 bp, Homo sapiens
tacaaagtcacattgaaatgaa

SEQ ID NO: 9334859 - DNA, 22 bp, Homo sapiens
tacaaagtagaaattcagtaaa

SEQ ID NO: 9334860 - DNA, 22 bp, Homo sapiens
tacaaagtaatgtataatatcg

SEQ ID NO: 9334861 - DNA, 22 bp, Homo sapiens
tacaaaggcttaaagagatttc

SEQ ID NO: 9334862 - DNA, 22 bp, Homo sapiens
tacaaaggaggtgcatagaaca

SEQ ID NO: 9334863 - DNA, 22 bp, Homo sapiens
tacaaaggcggtttttctgggc

SEQ ID NO: 9334864 - DNA, 23 bp, Homo sapiens
taattatggaataatttgcaacg

SEQ ID NO: 9334865 - DNA, 22 bp, Homo sapiens
taattatagccgctattttgct

SEQ ID NO: 9334866 - DNA, 22 bp, Homo sapiens
tacaaaaaattgatactgacga

SEQ ID NO: 9334867 - DNA, 22 bp, Homo sapiens
tacaaaaaattgatactgacga

SEQ ID NO: 9334868 - DNA, 22 bp, Homo sapiens
tacaaactgttattattattgt

SEQ ID NO: 9334869 - DNA, 22 bp, Homo sapiens
tacaaactgttattattattgt

SEQ ID NO: 9334870 - DNA, 22 bp, Homo sapiens
tacaaactccgaagtttgtacc

SEQ ID NO: 9334871 - DNA, 22 bp, Homo sapiens
tacaaaaaattgatactgacga

SEQ ID NO: 9334872 - DNA, 22 bp, Homo sapiens
tacaaactctttatatttcata

SEQ ID NO: 9334873 - DNA, 22 bp, Homo sapiens
tacaaagaggtaattgcatata

SEQ ID NO: 9334874 - DNA, 22 bp, Homo sapiens
tacaaagaggtaattgcatata

SEQ ID NO: 9334875 - DNA, 22 bp, Homo sapiens
tacaaagagtttggtctctaga

SEQ ID NO: 9334876 - DNA, 22 bp, Homo sapiens
tacaaagagtttggtctctaga

SEQ ID NO: 9334877 - DNA, 22 bp, Homo sapiens
tacaaacttgttttaagtaagt

SEQ ID NO: 9334878 - DNA, 20 bp, Homo sapiens
tacaaagaatgaggttcagg

SEQ ID NO: 9334879 - DNA, 22 bp, Homo sapiens
tacaaacttgttttaagtaagt

SEQ ID NO: 9334880 - DNA, 22 bp, Homo sapiens
tacaaagaggcagctccatttt

SEQ ID NO: 9334881 - DNA, 22 bp, Homo sapiens
taattatagccgctattttgct

SEQ ID NO: 9334882 - DNA, 22 bp, Homo sapiens
taattataacagttacatctta

SEQ ID NO: 9334883 - DNA, 22 bp, Homo sapiens
taattataacagttacatctta

SEQ ID NO: 9334884 - DNA, 22 bp, Homo sapiens
taattatacaaaaaggcatgca

SEQ ID NO: 9334885 - DNA, 22 bp, Homo sapiens
taattataacatgctttctggc

SEQ ID NO: 9334886 - DNA, 22 bp, Homo sapiens
taattataacatgctttctggc

SEQ ID NO: 9334887 - DNA, 22 bp, Homo sapiens
taattataacagttacatctta

SEQ ID NO: 9334888 - DNA, 21 bp, Homo sapiens
taattagcaaagctgagattc

SEQ ID NO: 9334889 - DNA, 22 bp, Homo sapiens
taattagtgtccagcttctgct

SEQ ID NO: 9334890 - DNA, 22 bp, Homo sapiens
taattagagtttggtaaacaat

SEQ ID NO: 9334891 - DNA, 23 bp, Homo sapiens
taattagatgttgattcctgaga

SEQ ID NO: 9334892 - DNA, 23 bp, Homo sapiens
taattagatgttgattcctgaga

SEQ ID NO: 9334893 - DNA, 22 bp, Homo sapiens
taattacagaggtttgccagtt

SEQ ID NO: 9334894 - DNA, 22 bp, Homo sapiens
taattacaaagcaagcacaggg

SEQ ID NO: 9334895 - DNA, 22 bp, Homo sapiens
taattacagaggtttgccagtt

SEQ ID NO: 9334896 - DNA, 22 bp, Homo sapiens
taattactaagggctgcatacc

SEQ ID NO: 9334897 - DNA, 22 bp, Homo sapiens
taattacaggtccaaaacaatc

SEQ ID NO: 9334898 - DNA, 22 bp, Homo sapiens
taattacaggtccaaaacaatc

SEQ ID NO: 9334899 - DNA, 22 bp, Homo sapiens
taattacaaagcaagcacaggg

SEQ ID NO: 9334900 - DNA, 22 bp, Homo sapiens
taattacaaagcaagcacaggg

SEQ ID NO: 9334901 - DNA, 22 bp, Homo sapiens
taatgtttttctcaacattgct

SEQ ID NO: 9334902 - DNA, 22 bp, Homo sapiens
taatgtttgggaaggtgctttg

SEQ ID NO: 9334903 - DNA, 22 bp, Homo sapiens
taatgtttgagatgttggattt

SEQ ID NO: 9334904 - DNA, 22 bp, Homo sapiens
taatggtgtttttctgtaattt

SEQ ID NO: 9334905 - DNA, 21 bp, Homo sapiens
taatggtgatggttatgttct

SEQ ID NO: 9334906 - DNA, 22 bp, Homo sapiens
taatggttttttggagactgct

SEQ ID NO: 9334907 - DNA, 22 bp, Homo sapiens
taatgtttagaagcagacagct

SEQ ID NO: 9334908 - DNA, 22 bp, Homo sapiens
taatgtttagaagcagacagct

SEQ ID NO: 9334909 - DNA, 22 bp, Homo sapiens
taatgtttccagtctatgatgg

SEQ ID NO: 9334910 - DNA, 22 bp, Homo sapiens
taatagctgttattgttataac

SEQ ID NO: 9334911 - DNA, 22 bp, Homo sapiens
taatactttgaatgagagctaa

SEQ ID NO: 9334912 - DNA, 22 bp, Homo sapiens
taatacttgctttggatgtatg

SEQ ID NO: 9334913 - DNA, 22 bp, Homo sapiens
taatagaatagtggaaacattg

SEQ ID NO: 9334914 - DNA, 22 bp, Homo sapiens
taactcaaatacttatgttact

SEQ ID NO: 9334915 - DNA, 22 bp, Homo sapiens
taactagtcatgtcataacacc

SEQ ID NO: 9334916 - DNA, 22 bp, Homo sapiens
taactaggattacaagcgtgcg

SEQ ID NO: 9334917 - DNA, 22 bp, Homo sapiens
taactcaaatatgttgtctgaa

SEQ ID NO: 9334918 - DNA, 22 bp, Homo sapiens
taactgagcctaaggcagtaga

SEQ ID NO: 9334919 - DNA, 22 bp, Homo sapiens
taactgaatgtattacaacaga

SEQ ID NO: 9334920 - DNA, 22 bp, Homo sapiens
taactacatttcactgcaatta

SEQ ID NO: 9334921 - DNA, 22 bp, Homo sapiens
taactacaagggcggtctctgt

SEQ ID NO: 9334922 - DNA, 22 bp, Homo sapiens
taacctggggcctgaagaccat

SEQ ID NO: 9334923 - DNA, 22 bp, Homo sapiens
taacctggatgtgccaacgtga

SEQ ID NO: 9334924 - DNA, 22 bp, Homo sapiens
taaattgcataagtacaaatga

SEQ ID NO: 9334925 - DNA, 22 bp, Homo sapiens
taaattgcataagtacaaatga

SEQ ID NO: 9334926 - DNA, 23 bp, Homo sapiens
taaattgatggtatgggttaagc

SEQ ID NO: 9334927 - DNA, 22 bp, Homo sapiens
taaattgtgtgttgctagggga

SEQ ID NO: 9334928 - DNA, 22 bp, Homo sapiens
taaattgtggccatttgtgttt

SEQ ID NO: 9334929 - DNA, 22 bp, Homo sapiens
taaattgtcctccccctggtat

SEQ ID NO: 9334930 - DNA, 22 bp, Homo sapiens
taaattgttttctagaagttgt

SEQ ID NO: 9334931 - DNA, 22 bp, Homo sapiens
taaattgaaaatctacagaaca

SEQ ID NO: 9334932 - DNA, 22 bp, Homo sapiens
taaattcagtgagtaatttctg

SEQ ID NO: 9334933 - DNA, 22 bp, Homo sapiens
taaattcagtgagtaatttctg

SEQ ID NO: 9334934 - DNA, 22 bp, Homo sapiens
taaatttacccaaggaacatgt

SEQ ID NO: 9334935 - DNA, 22 bp, Homo sapiens
taacattaaaagagataattga

SEQ ID NO: 9334936 - DNA, 22 bp, Homo sapiens
taacattacggacatctgtcag

SEQ ID NO: 9334937 - DNA, 22 bp, Homo sapiens
taacattaaaagagataattga

SEQ ID NO: 9334938 - DNA, 22 bp, Homo sapiens
taacattaaaagagataattga

SEQ ID NO: 9334939 - DNA, 22 bp, Homo sapiens
taacattaaaagagataattga

SEQ ID NO: 9334940 - DNA, 22 bp, Homo sapiens
taacctacatgagaactttaaa

SEQ ID NO: 9334941 - DNA, 22 bp, Homo sapiens
taaccatattttccattaagtt

SEQ ID NO: 9334942 - DNA, 22 bp, Homo sapiens
taaattatgtcacatgactctg

SEQ ID NO: 9334943 - DNA, 22 bp, Homo sapiens
taaattagggactttagttaat

SEQ ID NO: 9334944 - DNA, 20 bp, Homo sapiens
taaattagccttgaagatta

SEQ ID NO: 9334945 - DNA, 22 bp, Homo sapiens
taaattaaagattggagaagga

SEQ ID NO: 9334946 - DNA, 22 bp, Homo sapiens
taaattaaagattggagaagga

SEQ ID NO: 9334947 - DNA, 22 bp, Homo sapiens
taaattactcaatgcacataaa

SEQ ID NO: 9334948 - DNA, 22 bp, Homo sapiens
taaattactcaatgcacataaa

SEQ ID NO: 9334949 - DNA, 22 bp, Homo sapiens
taaattagagccaggtaagttt

SEQ ID NO: 9334950 - DNA, 22 bp, Homo sapiens
taaattaaagattggagaagga

SEQ ID NO: 9334951 - DNA, 22 bp, Homo sapiens
taaagtgcccagggaaagcggg

SEQ ID NO: 9334952 - DNA, 22 bp, Homo sapiens
taaagtcaaggtactgtttcac

SEQ ID NO: 9334953 - DNA, 22 bp, Homo sapiens
taaagtgctggatttgagtaaa

SEQ ID NO: 9334954 - DNA, 22 bp, Homo sapiens
taaagtagcaagtttagactga

SEQ ID NO: 9334955 - DNA, 22 bp, Homo sapiens
taaagtagcgcctaactaatgt

SEQ ID NO: 9334956 - DNA, 22 bp, Homo sapiens
taaaggttattgcactggagtt

SEQ ID NO: 9334957 - DNA, 22 bp, Homo sapiens
taaaggttgaaaactgactgcc

SEQ ID NO: 9334958 - DNA, 22 bp, Homo sapiens
taaaggtttattcaacaaaata

SEQ ID NO: 9334959 - DNA, 22 bp, Homo sapiens
taaaggttagtagcagggaaac

SEQ ID NO: 9334960 - DNA, 22 bp, Homo sapiens
taaaggttataaaggttagggg

SEQ ID NO: 9334961 - DNA, 22 bp, Homo sapiens
taaacactcacttcatagccat

SEQ ID NO: 9334962 - DNA, 22 bp, Homo sapiens
taaacagaattcaggcaagata

SEQ ID NO: 9334963 - DNA, 22 bp, Homo sapiens
taaagggtaggttttactgtaa

SEQ ID NO: 9334964 - DNA, 22 bp, Homo sapiens
taaacactgccttggtgggtca

SEQ ID NO: 9334965 - DNA, 22 bp, Homo sapiens
taaacagaatgcgtaagaagtg

SEQ ID NO: 9334966 - DNA, 22 bp, Homo sapiens
taaaatttgtccctgagtgttg

SEQ ID NO: 9334967 - DNA, 22 bp, Homo sapiens
taaaattgcggtgaatatttcc

SEQ ID NO: 9334968 - DNA, 22 bp, Homo sapiens
taaaatttgtccctgagtgttg

SEQ ID NO: 9334969 - DNA, 22 bp, Homo sapiens
taaaatggtaactttcatttgc

SEQ ID NO: 9334970 - DNA, 19 bp, Homo sapiens
taaaatgtctgtggtcagt

SEQ ID NO: 9334971 - DNA, 22 bp, Homo sapiens
taaaatgcacagcagttgaaag

SEQ ID NO: 9334972 - DNA, 22 bp, Homo sapiens
taaaatgcacagcagttgaaag

SEQ ID NO: 9334973 - DNA, 22 bp, Homo sapiens
taaaatgatctctcatgttctt

SEQ ID NO: 9334974 - DNA, 22 bp, Homo sapiens
taaaagttttagttgtacataa

SEQ ID NO: 9334975 - DNA, 22 bp, Homo sapiens
gtttttattgtgtaaatgtggg

SEQ ID NO: 9334976 - DNA, 22 bp, Homo sapiens
gtttttatatcctgtggagtgt

SEQ ID NO: 9334977 - DNA, 22 bp, Homo sapiens
gtttttatctaatagcagttat

SEQ ID NO: 9334978 - DNA, 22 bp, Homo sapiens
gtttttatatcctgtggagtgt

SEQ ID NO: 9334979 - DNA, 19 bp, Homo sapiens
gttttgtttgcagaactta

SEQ ID NO: 9334980 - DNA, 22 bp, Homo sapiens
gtttccagggctctcttcatga

SEQ ID NO: 9334981 - DNA, 22 bp, Homo sapiens
gtttccagtcaacttgtgtgtg

SEQ ID NO: 9334982 - DNA, 22 bp, Homo sapiens
gtttccagtcaacttgtgtgtg

SEQ ID NO: 9334983 - DNA, 22 bp, Homo sapiens
gtttccagtcaacttgtgtgtg

SEQ ID NO: 9334984 - DNA, 22 bp, Homo sapiens
gtttccaggctttggtatggtt

SEQ ID NO: 9334985 - DNA, 22 bp, Homo sapiens
gtttccaggctttggtatggtt

SEQ ID NO: 9334986 - DNA, 22 bp, Homo sapiens
gtttccagggctctcttcatga

SEQ ID NO: 9334987 - DNA, 22 bp, Homo sapiens
gtttccaggcccctccctagac

SEQ ID NO: 9334988 - DNA, 22 bp, Homo sapiens
gtttccaggcccctccctagac

SEQ ID NO: 9334989 - DNA, 22 bp, Homo sapiens
gtttccaggcactttttctgct

SEQ ID NO: 9334990 - DNA, 22 bp, Homo sapiens
gtttccaggcagggtgattctc

SEQ ID NO: 9334991 - DNA, 22 bp, Homo sapiens
gtttccaggcagggtgattctc

SEQ ID NO: 9334992 - DNA, 22 bp, Homo sapiens
gtttccaggcagggtgattctc

SEQ ID NO: 9334993 - DNA, 22 bp, Homo sapiens
gtttccaggcgatatcagctgc

SEQ ID NO: 9334994 - DNA, 22 bp, Homo sapiens
gtttccaggcgatatcagctgc

SEQ ID NO: 9334995 - DNA, 22 bp, Homo sapiens
gtttccaggctttggtatggtt

SEQ ID NO: 9334996 - DNA, 22 bp, Homo sapiens
gtttccaggctgggcagcgagc

SEQ ID NO: 9334997 - DNA, 22 bp, Homo sapiens
gtttccaggctgggcagcgagc

SEQ ID NO: 9334998 - DNA, 22 bp, Homo sapiens
gttttcatgtctattgggcata

SEQ ID NO: 9334999 - DNA, 22 bp, Homo sapiens
gtttcccaggctgtggggccct

SEQ ID NO: 9335000 - DNA, 22 bp, Homo sapiens
gtttccagctttctgatgcttg

SEQ ID NO: 9335001 - DNA, 22 bp, Homo sapiens
gtttccagctttctgatgcttg

SEQ ID NO: 9335002 - DNA, 22 bp, Homo sapiens
gtttccagcttgggcccgggga

SEQ ID NO: 9335003 - DNA, 22 bp, Homo sapiens
gtttccagctttctgatgcttg

SEQ ID NO: 9335004 - DNA, 22 bp, Homo sapiens
gtttccagcctcctgggtaaag

SEQ ID NO: 9335005 - DNA, 22 bp, Homo sapiens
gtttccagctcttagcaaaggc

SEQ ID NO: 9335006 - DNA, 22 bp, Homo sapiens
gtttccagctcttagcaaaggc

SEQ ID NO: 9335007 - DNA, 22 bp, Homo sapiens
gtttccagcttgggcccgggga

SEQ ID NO: 9335008 - DNA, 22 bp, Homo sapiens
gtttccaggaagggttgggagg

SEQ ID NO: 9335009 - DNA, 22 bp, Homo sapiens
gtttccaggaagggttgggagg

SEQ ID NO: 9335010 - DNA, 22 bp, Homo sapiens
gtttccaggcactttttctgct

SEQ ID NO: 9335011 - DNA, 22 bp, Homo sapiens
gtttccaggaggctacacctga

SEQ ID NO: 9335012 - DNA, 22 bp, Homo sapiens
gtttccaggaggctacacctga

SEQ ID NO: 9335013 - DNA, 22 bp, Homo sapiens
gtttccagagggaatatttgct

SEQ ID NO: 9335014 - DNA, 22 bp, Homo sapiens
gtttccagagtgagggcacttg

SEQ ID NO: 9335015 - DNA, 22 bp, Homo sapiens
gtttccagagtgagggcacttg

SEQ ID NO: 9335016 - DNA, 22 bp, Homo sapiens
gtttccagagggaatatttgct

SEQ ID NO: 9335017 - DNA, 22 bp, Homo sapiens
gtttccagagtgagggcacttg

SEQ ID NO: 9335018 - DNA, 22 bp, Homo sapiens
gtttccagccctgcaggtttaa

SEQ ID NO: 9335019 - DNA, 22 bp, Homo sapiens
gtttccagcctagagatggtga

SEQ ID NO: 9335020 - DNA, 22 bp, Homo sapiens
gtttccagcctagagatggtga

SEQ ID NO: 9335021 - DNA, 22 bp, Homo sapiens
gtttccagcctcctgggtaaag

SEQ ID NO: 9335022 - DNA, 22 bp, Homo sapiens
gtttccagccctgcaggtttaa

SEQ ID NO: 9335023 - DNA, 22 bp, Homo sapiens
gtttccagccaatcccctcagg

SEQ ID NO: 9335024 - DNA, 22 bp, Homo sapiens
gtttccagccaatcccctcagg

SEQ ID NO: 9335025 - DNA, 22 bp, Homo sapiens
gtttccagcctagagatggtga

SEQ ID NO: 9335026 - DNA, 22 bp, Homo sapiens
gtttccacgtctcagttccaaa

SEQ ID NO: 9335027 - DNA, 22 bp, Homo sapiens
gtttccacttatatggtaccta

SEQ ID NO: 9335028 - DNA, 22 bp, Homo sapiens
gtttccacttgagaggactcct

SEQ ID NO: 9335029 - DNA, 22 bp, Homo sapiens
gtttccagagatcatttacata

SEQ ID NO: 9335030 - DNA, 22 bp, Homo sapiens
gtttccagagatcatttacata

SEQ ID NO: 9335031 - DNA, 22 bp, Homo sapiens
gttttcttcctgcaattggcat

SEQ ID NO: 9335032 - DNA, 22 bp, Homo sapiens
gttttcattactgctgtgattt

SEQ ID NO: 9335033 - DNA, 22 bp, Homo sapiens
gttttcattactgctgtgattt

SEQ ID NO: 9335034 - DNA, 22 bp, Homo sapiens
gttttgaaatgaaagaaccaag

SEQ ID NO: 9335035 - DNA, 19 bp, Homo sapiens
gttttgcaggcagagggga

SEQ ID NO: 9335036 - DNA, 22 bp, Homo sapiens
gttttgatatatgcatacatta

SEQ ID NO: 9335037 - DNA, 18 bp, Homo sapiens
gttttgaattgtcttaca

SEQ ID NO: 9335038 - DNA, 22 bp, Homo sapiens
gtgctccctccttcctcaagga

SEQ ID NO: 9335039 - DNA, 22 bp, Homo sapiens
gtgctccctccttcctcaagga

SEQ ID NO: 9335040 - DNA, 19 bp, Homo sapiens
gtgctccagggcaaggagt

SEQ ID NO: 9335041 - DNA, 22 bp, Homo sapiens
gtgctccaggtcgctcagagag

SEQ ID NO: 9335042 - DNA, 22 bp, Homo sapiens
gtgctcaggggcaatcctggga

SEQ ID NO: 9335043 - DNA, 22 bp, Homo sapiens
gtgctcaggggcaatcctggga

SEQ ID NO: 9335044 - DNA, 22 bp, Homo sapiens
gtgctcaggttcccatgagtgc

SEQ ID NO: 9335045 - DNA, 22 bp, Homo sapiens
gtgctcaggttcccatgagtgc

SEQ ID NO: 9335046 - DNA, 22 bp, Homo sapiens
gtgctcagaaacttgctcattt

SEQ ID NO: 9335047 - DNA, 22 bp, Homo sapiens
gtgctcactccccacagtgccc

SEQ ID NO: 9335048 - DNA, 22 bp, Homo sapiens
gtgctcaggaccaaatgaacca

SEQ ID NO: 9335049 - DNA, 22 bp, Homo sapiens
gtgctcaggaccaaatgaacca

SEQ ID NO: 9335050 - DNA, 22 bp, Homo sapiens
gtgctcagcccggatgagatca

SEQ ID NO: 9335051 - DNA, 22 bp, Homo sapiens
gtgctcagcccggatgagatca

SEQ ID NO: 9335052 - DNA, 22 bp, Homo sapiens
gtgctctcctggctgccctgac

SEQ ID NO: 9335053 - DNA, 22 bp, Homo sapiens
gtgctctgagtttgcatgtcag

SEQ ID NO: 9335054 - DNA, 22 bp, Homo sapiens
gtgctctgagtttgcatgtcag

SEQ ID NO: 9335055 - DNA, 22 bp, Homo sapiens
gtgctctgcctggggtcatggc

SEQ ID NO: 9335056 - DNA, 23 bp, Homo sapiens
gtgctctgcggtctgctagtctg

SEQ ID NO: 9335057 - DNA, 22 bp, Homo sapiens
gtgctctgcctggggtcatggc

SEQ ID NO: 9335058 - DNA, 22 bp, Homo sapiens
gtgctctagaaatagtcagtgg

SEQ ID NO: 9335059 - DNA, 22 bp, Homo sapiens
gtgctctagaaattgtcagtgg

SEQ ID NO: 9335060 - DNA, 22 bp, Homo sapiens
gtgctctaggctacagggatgc

SEQ ID NO: 9335061 - DNA, 22 bp, Homo sapiens
gtgctctaggggtcagtggtta

SEQ ID NO: 9335062 - DNA, 22 bp, Homo sapiens
gtgctctacatgctccatgttt

SEQ ID NO: 9335063 - DNA, 22 bp, Homo sapiens
gtgctctaaggcaccactgagc

SEQ ID NO: 9335064 - DNA, 22 bp, Homo sapiens
gtgctctggctggtctcccggt

SEQ ID NO: 9335065 - DNA, 21 bp, Homo sapiens
gtgctctgggcagcagagggc

SEQ ID NO: 9335066 - DNA, 21 bp, Homo sapiens
gtgctctgggcagcagagggc

SEQ ID NO: 9335067 - DNA, 22 bp, Homo sapiens
gtgctctgtggattgagttgaa

SEQ ID NO: 9335068 - DNA, 22 bp, Homo sapiens
gtgctctgtggattgagttgaa

SEQ ID NO: 9335069 - DNA, 22 bp, Homo sapiens
gtgctctgtgtattaggatgtc

SEQ ID NO: 9335070 - DNA, 22 bp, Homo sapiens
gtgctctgtggattgagttgaa

SEQ ID NO: 9335071 - DNA, 22 bp, Homo sapiens
gtgctctgtggattgagttgaa

SEQ ID NO: 9335072 - DNA, 22 bp, Homo sapiens
gtgctgaaatagaggaggtggc

SEQ ID NO: 9335073 - DNA, 22 bp, Homo sapiens
gtgctctgtgtattaggatgtc

SEQ ID NO: 9335074 - DNA, 22 bp, Homo sapiens
gtgctgaagtgaaattcatcaa

SEQ ID NO: 9335075 - DNA, 22 bp, Homo sapiens
gtgctgaagaagtctgttcgcc

SEQ ID NO: 9335076 - DNA, 18 bp, Homo sapiens
gtgtgcagttgcaggggt

SEQ ID NO: 9335077 - DNA, 22 bp, Homo sapiens
gtgctgaaatggacctcaggaa

SEQ ID NO: 9335078 - DNA, 22 bp, Homo sapiens
gtgctgaacatttgggacttgt

SEQ ID NO: 9335079 - DNA, 22 bp, Homo sapiens
gtgctgaactataaaaagcttt

SEQ ID NO: 9335080 - DNA, 22 bp, Homo sapiens
gtgtgcatagtcgtgcatgcat

SEQ ID NO: 9335081 - DNA, 18 bp, Homo sapiens
gtgtgcagttgcaggggt

SEQ ID NO: 9335082 - DNA, 18 bp, Homo sapiens
gtgtgcagttgcaggggt

SEQ ID NO: 9335083 - DNA, 23 bp, Homo sapiens
gtgtgccaagcactgtgccagga

SEQ ID NO: 9335084 - DNA, 23 bp, Homo sapiens
gtgtgccaagcactgtgccagga

SEQ ID NO: 9335085 - DNA, 22 bp, Homo sapiens
gtgtgcatgtggaagcatgtat

SEQ ID NO: 9335086 - DNA, 22 bp, Homo sapiens
gtgtgcatgtgcttgcacagat

SEQ ID NO: 9335087 - DNA, 22 bp, Homo sapiens
gtgtgcatgtgcttgcacagat

SEQ ID NO: 9335088 - DNA, 22 bp, Homo sapiens
gtgtgccactgcctgaggaccc

SEQ ID NO: 9335089 - DNA, 22 bp, Homo sapiens
gtgtgccaccagtcaaggtgaa

SEQ ID NO: 9335090 - DNA, 22 bp, Homo sapiens
gtgtgccaccactgacaggatt

SEQ ID NO: 9335091 - DNA, 22 bp, Homo sapiens
gtgtgccaccactgacaggatt

SEQ ID NO: 9335092 - DNA, 22 bp, Homo sapiens
gtgtgccagacatgatgctatg

SEQ ID NO: 9335093 - DNA, 22 bp, Homo sapiens
gttaacatttctaggtgcaggg

SEQ ID NO: 9335094 - DNA, 22 bp, Homo sapiens
gtgtgggacgggtgagtggcca

SEQ ID NO: 9335095 - DNA, 22 bp, Homo sapiens
gtgtgggaaggctaggatgctg

SEQ ID NO: 9335096 - DNA, 22 bp, Homo sapiens
gtgtgggaaggctaggatgctg

SEQ ID NO: 9335097 - DNA, 22 bp, Homo sapiens
gtgtggcttgggtgaggcgcct

SEQ ID NO: 9335098 - DNA, 22 bp, Homo sapiens
gtgtggctttctgggtttaatt

SEQ ID NO: 9335099 - DNA, 22 bp, Homo sapiens
gtgtggcttgggtgaggcgcct

SEQ ID NO: 9335100 - DNA, 22 bp, Homo sapiens
gtgtgcctcgccaagctgtcgg

SEQ ID NO: 9335101 - DNA, 22 bp, Homo sapiens
gtgtggcctcaacgggatgcaa

SEQ ID NO: 9335102 - DNA, 22 bp, Homo sapiens
gtgtggccttgggagaggtctg

SEQ ID NO: 9335103 - DNA, 22 bp, Homo sapiens
gtgtggcctcaacgggatgcaa

SEQ ID NO: 9335104 - DNA, 22 bp, Homo sapiens
gtgtggccttgggagaggtctg

SEQ ID NO: 9335105 - DNA, 22 bp, Homo sapiens
gtgtggctgattgacatggtca

SEQ ID NO: 9335106 - DNA, 18 bp, Homo sapiens
gtgtggctgagatgaggc

SEQ ID NO: 9335107 - DNA, 22 bp, Homo sapiens
gtgtggctgattgacatggtca

SEQ ID NO: 9335108 - DNA, 22 bp, Homo sapiens
gtgtggctgccagccaagaggc

SEQ ID NO: 9335109 - DNA, 22 bp, Homo sapiens
gtgtggctgtgggagatgttca

SEQ ID NO: 9335110 - DNA, 22 bp, Homo sapiens
gtgtggctgtttagtgactttc

SEQ ID NO: 9335111 - DNA, 22 bp, Homo sapiens
gtgtggctacctcagaggagca

SEQ ID NO: 9335112 - DNA, 22 bp, Homo sapiens
gtgtggctagaagtgtcttgtt

SEQ ID NO: 9335113 - DNA, 22 bp, Homo sapiens
gtgtggctagaagtgtcttgtt

SEQ ID NO: 9335114 - DNA, 22 bp, Homo sapiens
gtgtggctaggatggctttgct

SEQ ID NO: 9335115 - DNA, 22 bp, Homo sapiens
gtgtggctaggatggctttgct

SEQ ID NO: 9335116 - DNA, 22 bp, Homo sapiens
gtgtggctgaaatcaaggcagg

SEQ ID NO: 9335117 - DNA, 22 bp, Homo sapiens
gttaatttagtagagtccagat

SEQ ID NO: 9335118 - DNA, 22 bp, Homo sapiens
gttaataaaggtatagaatcag

SEQ ID NO: 9335119 - DNA, 22 bp, Homo sapiens
gttaagtaaactatgatttatc

SEQ ID NO: 9335120 - DNA, 22 bp, Homo sapiens
gttacaaactcaggtgccaaaa

SEQ ID NO: 9335121 - DNA, 18 bp, Homo sapiens
gttaattttgaagttcat

SEQ ID NO: 9335122 - DNA, 22 bp, Homo sapiens
gttaatttgcagctttcgagct

SEQ ID NO: 9335123 - DNA, 22 bp, Homo sapiens
gttacaaactcaggtgccaaaa

SEQ ID NO: 9335124 - DNA, 22 bp, Homo sapiens
gttacaaagcacttcaagtgaa

SEQ ID NO: 9335125 - DNA, 22 bp, Homo sapiens
gttacaaaggaagcttcactgc

SEQ ID NO: 9335126 - DNA, 21 bp, Homo sapiens
gttcaagtgatcctcctgtct

SEQ ID NO: 9335127 - DNA, 22 bp, Homo sapiens
gttcaagtttctgagctttaat

SEQ ID NO: 9335128 - DNA, 22 bp, Homo sapiens
gttcaagttatgcctttaccct

SEQ ID NO: 9335129 - DNA, 22 bp, Homo sapiens
gttacaaaggactgggggccac

SEQ ID NO: 9335130 - DNA, 22 bp, Homo sapiens
gttcactggctgtgtgactctg

SEQ ID NO: 9335131 - DNA, 22 bp, Homo sapiens
gttcaccatatggtaatttaat

SEQ ID NO: 9335132 - DNA, 22 bp, Homo sapiens
gttcagcaatagatctagaggc

SEQ ID NO: 9335133 - DNA, 22 bp, Homo sapiens
gttcagtgattctcggtgttca

SEQ ID NO: 9335134 - DNA, 22 bp, Homo sapiens
gttcagtgattctcggtgttca

SEQ ID NO: 9335135 - DNA, 22 bp, Homo sapiens
gttcagtggtgtatccccagtg

SEQ ID NO: 9335136 - DNA, 22 bp, Homo sapiens
gttcagtgtctctctattttat

SEQ ID NO: 9335137 - DNA, 22 bp, Homo sapiens
gttcagtggggccttgggggac

SEQ ID NO: 9335138 - DNA, 22 bp, Homo sapiens
gttcagtgccagttctaagact

SEQ ID NO: 9335139 - DNA, 22 bp, Homo sapiens
gttcagtgtttacatgattgtt

SEQ ID NO: 9335140 - DNA, 22 bp, Homo sapiens
gttcagtgtttttattgacagg

SEQ ID NO: 9335141 - DNA, 22 bp, Homo sapiens
gttcagtgtttgatttctgctg

SEQ ID NO: 9335142 - DNA, 20 bp, Homo sapiens
gttcatgtctcaaatagaaa

SEQ ID NO: 9335143 - DNA, 22 bp, Homo sapiens
gttcatgtggaaatttaaaaca

SEQ ID NO: 9335144 - DNA, 22 bp, Homo sapiens
gttgaggaggttcagggtggtt

SEQ ID NO: 9335145 - DNA, 22 bp, Homo sapiens
gttgaggaggcactcactgtca

SEQ ID NO: 9335146 - DNA, 22 bp, Homo sapiens
gttgagctctccagcttcattt

SEQ ID NO: 9335147 - DNA, 22 bp, Homo sapiens
gttgaggagcaagcatgtgtct

SEQ ID NO: 9335148 - DNA, 22 bp, Homo sapiens
gttcatttatgatgtaacatgt

SEQ ID NO: 9335149 - DNA, 22 bp, Homo sapiens
gtttcagagttagtgctggctg

SEQ ID NO: 9335150 - DNA, 22 bp, Homo sapiens
gtttcagaaatgttctcctgct

SEQ ID NO: 9335151 - DNA, 22 bp, Homo sapiens
gttgtaaatgactggcattggg

SEQ ID NO: 9335152 - DNA, 22 bp, Homo sapiens
gttgtacagacatgaaacttgc

SEQ ID NO: 9335153 - DNA, 22 bp, Homo sapiens
gttgtaaatacagtactgaaac

SEQ ID NO: 9335154 - DNA, 22 bp, Homo sapiens
gttggtgtctgtcttgttcatt

SEQ ID NO: 9335155 - DNA, 22 bp, Homo sapiens
gtttcataggcatgtgacctat

SEQ ID NO: 9335156 - DNA, 22 bp, Homo sapiens
gtttcatggttgtttgatggca

SEQ ID NO: 9335157 - DNA, 22 bp, Homo sapiens
gttgggagcagcagaccaagag

SEQ ID NO: 9335158 - DNA, 22 bp, Homo sapiens
gttggggtccaatgaagcgagc

SEQ ID NO: 9335159 - DNA, 22 bp, Homo sapiens
gttggggtgctataaaaatgat

SEQ ID NO: 9335160 - DNA, 22 bp, Homo sapiens
gttgggagcagcagaccaagag

SEQ ID NO: 9335161 - DNA, 22 bp, Homo sapiens
gttgctcaatgggaataagaat

SEQ ID NO: 9335162 - DNA, 22 bp, Homo sapiens
gttgctcaggcaggagtacagt

SEQ ID NO: 9335163 - DNA, 22 bp, Homo sapiens
gttgcagactcaagaaaataaa

SEQ ID NO: 9335164 - DNA, 22 bp, Homo sapiens
gttgcagatactgaagcacagg

SEQ ID NO: 9335165 - DNA, 22 bp, Homo sapiens
gttgcagacactccacagtcga

SEQ ID NO: 9335166 - DNA, 22 bp, Homo sapiens
gttgattgattgattgactggt

SEQ ID NO: 9335167 - DNA, 22 bp, Homo sapiens
gttgatttgaagagcagaaagt

SEQ ID NO: 9335168 - DNA, 22 bp, Homo sapiens
gttgatttagtgagtgagcagt

SEQ ID NO: 9335169 - DNA, 22 bp, Homo sapiens
gttgccgtttgttctaccagac

SEQ ID NO: 9335170 - DNA, 22 bp, Homo sapiens
gttgcaggaggatggctgcata

SEQ ID NO: 9335171 - DNA, 22 bp, Homo sapiens
gttgcaggaagcacacacatgt

SEQ ID NO: 9335172 - DNA, 22 bp, Homo sapiens
gttgcaggaggatggctgcata

SEQ ID NO: 9335173 - DNA, 22 bp, Homo sapiens
tcccagtgtggcaggccatgga

SEQ ID NO: 9335174 - DNA, 22 bp, Homo sapiens
tcccatcaatgtctgcagaaga

SEQ ID NO: 9335175 - DNA, 22 bp, Homo sapiens
tcccatcacatggagagtgaag

SEQ ID NO: 9335176 - DNA, 22 bp, Homo sapiens
tcccagtgtggcaggccatgga

SEQ ID NO: 9335177 - DNA, 22 bp, Homo sapiens
tcccagtggtcctggccctggg

SEQ ID NO: 9335178 - DNA, 22 bp, Homo sapiens
tcccagtggtcctggccctggg

SEQ ID NO: 9335179 - DNA, 22 bp, Homo sapiens
tcccagtggtcttgaaacaggg

SEQ ID NO: 9335180 - DNA, 22 bp, Homo sapiens
tcccagtgaggtcctggctgtc

SEQ ID NO: 9335181 - DNA, 22 bp, Homo sapiens
tcccagtgaggtcctggctgtc

SEQ ID NO: 9335182 - DNA, 22 bp, Homo sapiens
tcccagtgctgctaaagaggta

SEQ ID NO: 9335183 - DNA, 22 bp, Homo sapiens
tcccaggttccaccatccaggg

SEQ ID NO: 9335184 - DNA, 22 bp, Homo sapiens
tcccagtgagatgaaacaggta

SEQ ID NO: 9335185 - DNA, 22 bp, Homo sapiens
tcccatgtaagaaggagacagg

SEQ ID NO: 9335186 - DNA, 22 bp, Homo sapiens
tcccatgttaccaaggagtcac

SEQ ID NO: 9335187 - DNA, 23 bp, Homo sapiens
tcccattgccctatagtgcctca

SEQ ID NO: 9335188 - DNA, 22 bp, Homo sapiens
tcccatggatagtgaccttgtt

SEQ ID NO: 9335189 - DNA, 22 bp, Homo sapiens
tcccatggtctatatagaggca

SEQ ID NO: 9335190 - DNA, 23 bp, Homo sapiens
tcccatgggctcactgccctgca

SEQ ID NO: 9335191 - DNA, 23 bp, Homo sapiens
tcccatgggctcactgccctgca

SEQ ID NO: 9335192 - DNA, 22 bp, Homo sapiens
tcccagggtgcgcctgccctcg

SEQ ID NO: 9335193 - DNA, 22 bp, Homo sapiens
tcccagggttacagccagggca

SEQ ID NO: 9335194 - DNA, 22 bp, Homo sapiens
tcccaggtgatgctgaggccac

SEQ ID NO: 9335195 - DNA, 22 bp, Homo sapiens
tcccaggttccaccatccaggg

SEQ ID NO: 9335196 - DNA, 22 bp, Homo sapiens
tcccaggtgatgctgaggccac

SEQ ID NO: 9335197 - DNA, 22 bp, Homo sapiens
tcccaggtctttgggttcctca

SEQ ID NO: 9335198 - DNA, 22 bp, Homo sapiens
tcccagggtgaaatgcagtagg

SEQ ID NO: 9335199 - DNA, 22 bp, Homo sapiens
tcccagggtgaaatgcagtagg

SEQ ID NO: 9335200 - DNA, 22 bp, Homo sapiens
tcccacaggggctctgtgggtt

SEQ ID NO: 9335201 - DNA, 22 bp, Homo sapiens
tcccacagggcttctctgtaca

SEQ ID NO: 9335202 - DNA, 22 bp, Homo sapiens
tcccacaggtggagcttgcagt

SEQ ID NO: 9335203 - DNA, 22 bp, Homo sapiens
tcccacaggtggagcttgcagt

SEQ ID NO: 9335204 - DNA, 22 bp, Homo sapiens
tcccacagtgaagttcatgata

SEQ ID NO: 9335205 - DNA, 22 bp, Homo sapiens
tcccagggactgggctaggctt

SEQ ID NO: 9335206 - DNA, 22 bp, Homo sapiens
tcccagggactgggctaggctt

SEQ ID NO: 9335207 - DNA, 22 bp, Homo sapiens
tcccacagcttcgtgcttcccc

SEQ ID NO: 9335208 - DNA, 22 bp, Homo sapiens
tcccacaggagcctgagtccca

SEQ ID NO: 9335209 - DNA, 22 bp, Homo sapiens
tcccacaggagcctgagtccca

SEQ ID NO: 9335210 - DNA, 22 bp, Homo sapiens
tcccacaggcccagggcggaaa

SEQ ID NO: 9335211 - DNA, 22 bp, Homo sapiens
tcccacaggcccagggcggaaa

SEQ ID NO: 9335212 - DNA, 22 bp, Homo sapiens
tccccaggggcatctctctgct

SEQ ID NO: 9335213 - DNA, 22 bp, Homo sapiens
tccccaggggcatctctctgct

SEQ ID NO: 9335214 - DNA, 22 bp, Homo sapiens
tccccaggggcatctctctgct

SEQ ID NO: 9335215 - DNA, 22 bp, Homo sapiens
tccccaggggcctgggcacagt

SEQ ID NO: 9335216 - DNA, 22 bp, Homo sapiens
tccccagggtccctgcttccat

SEQ ID NO: 9335217 - DNA, 22 bp, Homo sapiens
tccccagggtccctgcttccat

SEQ ID NO: 9335218 - DNA, 22 bp, Homo sapiens
tccccaggagttttactttgca

SEQ ID NO: 9335219 - DNA, 22 bp, Homo sapiens
tccccaggagttttactttgca

SEQ ID NO: 9335220 - DNA, 20 bp, Homo sapiens
tccccagggcatcaggagca

SEQ ID NO: 9335221 - DNA, 20 bp, Homo sapiens
tccccagggcatcaggagca

SEQ ID NO: 9335222 - DNA, 22 bp, Homo sapiens
tccccaggggcatctctctgct

SEQ ID NO: 9335223 - DNA, 22 bp, Homo sapiens
tccccagggctgcagagggtgt

SEQ ID NO: 9335224 - DNA, 22 bp, Homo sapiens
tccccagggtccctgcttccat

SEQ ID NO: 9335225 - DNA, 22 bp, Homo sapiens
tccccaggaaggcccttcctgg

SEQ ID NO: 9335226 - DNA, 22 bp, Homo sapiens
tccccaggaaattctgattctt

SEQ ID NO: 9335227 - DNA, 22 bp, Homo sapiens
tccccaggagcaatgattcagt

SEQ ID NO: 9335228 - DNA, 22 bp, Homo sapiens
tccccacctacacactgctcct

SEQ ID NO: 9335229 - DNA, 22 bp, Homo sapiens
tccccacctaagatacccatct

SEQ ID NO: 9335230 - DNA, 22 bp, Homo sapiens
tccccaccccagaactactagg

SEQ ID NO: 9335231 - DNA, 21 bp, Homo sapiens
tccccacatttctaaacagac

SEQ ID NO: 9335232 - DNA, 22 bp, Homo sapiens
tccccacatctctgcatcaggc

SEQ ID NO: 9335233 - DNA, 22 bp, Homo sapiens
tccccacactttcactcctggc

SEQ ID NO: 9335234 - DNA, 22 bp, Homo sapiens
tccccacagcagaagatctgag

SEQ ID NO: 9335235 - DNA, 22 bp, Homo sapiens
tccccaatttgagtcacctctg

SEQ ID NO: 9335236 - DNA, 22 bp, Homo sapiens
tccccaagcaggcaatctcccg

SEQ ID NO: 9335237 - DNA, 19 bp, Homo sapiens
tccccaagagttctagctc

SEQ ID NO: 9335238 - DNA, 22 bp, Homo sapiens
tccaggaggtatgagtggcccc

SEQ ID NO: 9335239 - DNA, 22 bp, Homo sapiens
tccaggagggttttctgccttc

SEQ ID NO: 9335240 - DNA, 22 bp, Homo sapiens
tccaggagggattgggctgtgg

SEQ ID NO: 9335241 - DNA, 22 bp, Homo sapiens
tccaggaggggtaggcagtatg

SEQ ID NO: 9335242 - DNA, 22 bp, Homo sapiens
tccaggaggggtaggcagtatg

SEQ ID NO: 9335243 - DNA, 20 bp, Homo sapiens
tccaggaggttagtgtggct

SEQ ID NO: 9335244 - DNA, 22 bp, Homo sapiens
tccaggaggttgagactgcagt

SEQ ID NO: 9335245 - DNA, 20 bp, Homo sapiens
tccaggaggttagtgtggct

SEQ ID NO: 9335246 - DNA, 22 bp, Homo sapiens
tccaggaggttgagactgcagt

SEQ ID NO: 9335247 - DNA, 22 bp, Homo sapiens
tccaggaggttgagactgcagt

SEQ ID NO: 9335248 - DNA, 22 bp, Homo sapiens
tccaggagtcagacagatggtg

SEQ ID NO: 9335249 - DNA, 22 bp, Homo sapiens
tccaggaggttgagtgagttcc

SEQ ID NO: 9335250 - DNA, 22 bp, Homo sapiens
tccaggagtctagcctcaggcc

SEQ ID NO: 9335251 - DNA, 22 bp, Homo sapiens
tccaggagtgataaggccactg

SEQ ID NO: 9335252 - DNA, 22 bp, Homo sapiens
tccaggagtctagcctcaggcc

SEQ ID NO: 9335253 - DNA, 22 bp, Homo sapiens
tccaggagtcctgggagtgatt

SEQ ID NO: 9335254 - DNA, 22 bp, Homo sapiens
tccaggagtcctgggagtgatt

SEQ ID NO: 9335255 - DNA, 22 bp, Homo sapiens
tccaggagtcctgggtggcccc

SEQ ID NO: 9335256 - DNA, 22 bp, Homo sapiens
tccaggagtcctgggtggcccc

SEQ ID NO: 9335257 - DNA, 22 bp, Homo sapiens
tccaggagtgataaggccactg

SEQ ID NO: 9335258 - DNA, 21 bp, Homo sapiens
tccaggagtggctgggcaggg

SEQ ID NO: 9335259 - DNA, 22 bp, Homo sapiens
tccaggagtgataaggccactg

SEQ ID NO: 9335260 - DNA, 21 bp, Homo sapiens
tccaggagtggctgggcaggg

SEQ ID NO: 9335261 - DNA, 22 bp, Homo sapiens
tccaggagtggggcagaggtct

SEQ ID NO: 9335262 - DNA, 22 bp, Homo sapiens
tccaggagtgtgtgctaatggg

SEQ ID NO: 9335263 - DNA, 22 bp, Homo sapiens
tccaggagtttgagactgcagt

SEQ ID NO: 9335264 - DNA, 22 bp, Homo sapiens
tccaggagtttgagactgcagt

SEQ ID NO: 9335265 - DNA, 22 bp, Homo sapiens
tccaggagtttgagactgcagt

SEQ ID NO: 9335266 - DNA, 22 bp, Homo sapiens
tccaggcatagaaggcacgcac

SEQ ID NO: 9335267 - DNA, 22 bp, Homo sapiens
tccaggcagttttccaggttgt

SEQ ID NO: 9335268 - DNA, 22 bp, Homo sapiens
tccaggcagttttccaggttgt

SEQ ID NO: 9335269 - DNA, 20 bp, Homo sapiens
tccaggcagctcagagtgtc

SEQ ID NO: 9335270 - DNA, 22 bp, Homo sapiens
tccaggcagggcagccatcaag

SEQ ID NO: 9335271 - DNA, 22 bp, Homo sapiens
tccaggccaatgtagcaggccc

SEQ ID NO: 9335272 - DNA, 22 bp, Homo sapiens
tccaggccaatgtagcaggccc

SEQ ID NO: 9335273 - DNA, 22 bp, Homo sapiens
tccaggcattccagccattcca

SEQ ID NO: 9335274 - DNA, 22 bp, Homo sapiens
tccaggccaatgtagcaggccc

SEQ ID NO: 9335275 - DNA, 22 bp, Homo sapiens
tccaggccacatggatggcgat

SEQ ID NO: 9335276 - DNA, 22 bp, Homo sapiens
tccaggccacatggatggcgat

SEQ ID NO: 9335277 - DNA, 22 bp, Homo sapiens
tccaggccacatggatggcgat

SEQ ID NO: 9335278 - DNA, 22 bp, Homo sapiens
tccaggccacgacctcctggat

SEQ ID NO: 9335279 - DNA, 22 bp, Homo sapiens
tccaggccacgacctcctggat

SEQ ID NO: 9335280 - DNA, 22 bp, Homo sapiens
tccaggcatgtctgagtccttc

SEQ ID NO: 9335281 - DNA, 23 bp, Homo sapiens
tccaggcatgagctctggatgga

SEQ ID NO: 9335282 - DNA, 23 bp, Homo sapiens
tccaggcatgagctctggatgga

SEQ ID NO: 9335283 - DNA, 23 bp, Homo sapiens
tccaggcatgagctctggatgga

SEQ ID NO: 9335284 - DNA, 19 bp, Homo sapiens
tccaggcatccttcaggct

SEQ ID NO: 9335285 - DNA, 22 bp, Homo sapiens
tccaggcatcccccaggacaga

SEQ ID NO: 9335286 - DNA, 22 bp, Homo sapiens
tccaggcatagaaggcacgcac

SEQ ID NO: 9335287 - DNA, 22 bp, Homo sapiens
tccaggcatcccccaggacaga

SEQ ID NO: 9335288 - DNA, 22 bp, Homo sapiens
tccaggctgcaaggccacaggg

SEQ ID NO: 9335289 - DNA, 22 bp, Homo sapiens
tccaggctgcaaggccacaggg

SEQ ID NO: 9335290 - DNA, 22 bp, Homo sapiens
tccaggctgcaaggccacaggg

SEQ ID NO: 9335291 - DNA, 22 bp, Homo sapiens
tccaggctgatccatgaagaat

SEQ ID NO: 9335292 - DNA, 19 bp, Homo sapiens
tccaggctgagagtcagct

SEQ ID NO: 9335293 - DNA, 22 bp, Homo sapiens
tccaggctgatccatgaagaat

SEQ ID NO: 9335294 - DNA, 21 bp, Homo sapiens
tccaggctgatgatgtcaact

SEQ ID NO: 9335295 - DNA, 19 bp, Homo sapiens
tccaggctgagagtcagct

SEQ ID NO: 9335296 - DNA, 22 bp, Homo sapiens
tccaggctgacgcagctattta

SEQ ID NO: 9335297 - DNA, 19 bp, Homo sapiens
tccaggctgagagtcagct

SEQ ID NO: 9335298 - DNA, 23 bp, Homo sapiens
tccaggctgaaggagcagatttt

SEQ ID NO: 9335299 - DNA, 23 bp, Homo sapiens
tccaggctgaaggagcagatttt

SEQ ID NO: 9335300 - DNA, 22 bp, Homo sapiens
tccaggctgacgcagctattta

SEQ ID NO: 9335301 - DNA, 22 bp, Homo sapiens
tccaggccactgcagaggctct

SEQ ID NO: 9335302 - DNA, 22 bp, Homo sapiens
tccaggctaggtttacaggaca

SEQ ID NO: 9335303 - DNA, 22 bp, Homo sapiens
tccaggccactgcagaggctct

SEQ ID NO: 9335304 - DNA, 22 bp, Homo sapiens
tccaggctaggtttacaggaca

SEQ ID NO: 9335305 - DNA, 22 bp, Homo sapiens
tccaggctcagcacttgctact

SEQ ID NO: 9335306 - DNA, 22 bp, Homo sapiens
tccaggctctaggctgctctcc

SEQ ID NO: 9335307 - DNA, 22 bp, Homo sapiens
tccaggctctaggctgctctcc

SEQ ID NO: 9335308 - DNA, 22 bp, Homo sapiens
tccaggctctcaggtgtcagca

SEQ ID NO: 9335309 - DNA, 22 bp, Homo sapiens
tccaggctctcaggtgtcagca

SEQ ID NO: 9335310 - DNA, 22 bp, Homo sapiens
tccaggctctcaggtgtcagca

SEQ ID NO: 9335311 - DNA, 22 bp, Homo sapiens
tccaggctctaggctgctctcc

SEQ ID NO: 9335312 - DNA, 22 bp, Homo sapiens
tccatgcagagtccaggcctca

SEQ ID NO: 9335313 - DNA, 22 bp, Homo sapiens
tccatgccaggcagtcgatgca

SEQ ID NO: 9335314 - DNA, 22 bp, Homo sapiens
tcccaagcttagggctctcagt

SEQ ID NO: 9335315 - DNA, 22 bp, Homo sapiens
tcccaaggataagagagtctga

SEQ ID NO: 9335316 - DNA, 20 bp, Homo sapiens
tcccaagggctgagaggatc

SEQ ID NO: 9335317 - DNA, 22 bp, Homo sapiens
tcccaaggtgctcggcaacagg

SEQ ID NO: 9335318 - DNA, 22 bp, Homo sapiens
tcccaaggcacagggcagggac

SEQ ID NO: 9335319 - DNA, 22 bp, Homo sapiens
tcccaaggccaggcatctagaa

SEQ ID NO: 9335320 - DNA, 22 bp, Homo sapiens
tcccacacctgtctattcctag

SEQ ID NO: 9335321 - DNA, 22 bp, Homo sapiens
tcccaattaacaggtatcaggc

SEQ ID NO: 9335322 - DNA, 22 bp, Homo sapiens
tcccaatagcctaagagcctgg

SEQ ID NO: 9335323 - DNA, 23 bp, Homo sapiens
tcccaatagcactgtcatgtttc

SEQ ID NO: 9335324 - DNA, 21 bp, Homo sapiens
tcccacagaaactgcgaaatt

SEQ ID NO: 9335325 - DNA, 22 bp, Homo sapiens
tcccacagatgctgtccagagt

SEQ ID NO: 9335326 - DNA, 22 bp, Homo sapiens
tcccacagagtggctcacctag

SEQ ID NO: 9335327 - DNA, 21 bp, Homo sapiens
tcccacagcgccagctcctgt

SEQ ID NO: 9335328 - DNA, 21 bp, Homo sapiens
tcccacagcgccagctcctgt

SEQ ID NO: 9335329 - DNA, 22 bp, Homo sapiens
tcccacagatgctgtccagagt

SEQ ID NO: 9335330 - DNA, 21 bp, Homo sapiens
tcccacagcgccagctcctgt

SEQ ID NO: 9335331 - DNA, 18 bp, Homo sapiens
tccatgcacatagccccc

SEQ ID NO: 9335332 - DNA, 22 bp, Homo sapiens
tccatgcagagaactgaagtac

SEQ ID NO: 9335333 - DNA, 22 bp, Homo sapiens
tccatgagtttgaggaaaagag

SEQ ID NO: 9335334 - DNA, 22 bp, Homo sapiens
tccatgagaggtaactttacaa

SEQ ID NO: 9335335 - DNA, 22 bp, Homo sapiens
tccatgagaacccttggagata

SEQ ID NO: 9335336 - DNA, 22 bp, Homo sapiens
tccatgacagcgtgagagtttg

SEQ ID NO: 9335337 - DNA, 23 bp, Homo sapiens
tccatgagatgtgggcttctagt

SEQ ID NO: 9335338 - DNA, 22 bp, Homo sapiens
tccatccataccacttggagac

SEQ ID NO: 9335339 - DNA, 22 bp, Homo sapiens
tccatccaggccagcagtaatc

SEQ ID NO: 9335340 - DNA, 22 bp, Homo sapiens
tccatccatgtaggaagatggt

SEQ ID NO: 9335341 - DNA, 21 bp, Homo sapiens
tccatccatcagtccagccag

SEQ ID NO: 9335342 - DNA, 22 bp, Homo sapiens
tccatccctgactcctcctgga

SEQ ID NO: 9335343 - DNA, 22 bp, Homo sapiens
tccatccctgactcctcctgga

SEQ ID NO: 9335344 - DNA, 22 bp, Homo sapiens
tccatccattttctttgctgtt

SEQ ID NO: 9335345 - DNA, 22 bp, Homo sapiens
tccatctcacctgcactctgcg

SEQ ID NO: 9335346 - DNA, 18 bp, Homo sapiens
tccatcctctgctcttca

SEQ ID NO: 9335347 - DNA, 18 bp, Homo sapiens
tccatcctctgctcttca

SEQ ID NO: 9335348 - DNA, 20 bp, Homo sapiens
tccatctggtataagctgat

SEQ ID NO: 9335349 - DNA, 22 bp, Homo sapiens
tccatctggagacttcctggtc

SEQ ID NO: 9335350 - DNA, 22 bp, Homo sapiens
tccatctgcatttggtttctgt

SEQ ID NO: 9335351 - DNA, 20 bp, Homo sapiens
tccagggccctggctcctct

SEQ ID NO: 9335352 - DNA, 20 bp, Homo sapiens
tccagggccctggctcctct

SEQ ID NO: 9335353 - DNA, 20 bp, Homo sapiens
tccagggccctggctcctct

SEQ ID NO: 9335354 - DNA, 22 bp, Homo sapiens
tccagggccatgaagttgcaca

SEQ ID NO: 9335355 - DNA, 22 bp, Homo sapiens
tccagggccccccagttgcacg

SEQ ID NO: 9335356 - DNA, 22 bp, Homo sapiens
tccagggccacagaggatgcta

SEQ ID NO: 9335357 - DNA, 22 bp, Homo sapiens
tccagggccacagaggatgcta

SEQ ID NO: 9335358 - DNA, 22 bp, Homo sapiens
tccagggccacagaggatgcta

SEQ ID NO: 9335359 - DNA, 22 bp, Homo sapiens
tccagggccagtccttgtctgt

SEQ ID NO: 9335360 - DNA, 22 bp, Homo sapiens
tccagggccatctccatgaggc

SEQ ID NO: 9335361 - DNA, 22 bp, Homo sapiens
tccagggccatctccatgaggc

SEQ ID NO: 9335362 - DNA, 22 bp, Homo sapiens
tccagggcagccgcgggtgcgc

SEQ ID NO: 9335363 - DNA, 19 bp, Homo sapiens
tccagggcaggaacatgta

SEQ ID NO: 9335364 - DNA, 19 bp, Homo sapiens
tccagggcaggaacatgta

SEQ ID NO: 9335365 - DNA, 19 bp, Homo sapiens
tccagggcaggaacatgta

SEQ ID NO: 9335366 - DNA, 22 bp, Homo sapiens
tccagggccacagaggatgcta

SEQ ID NO: 9335367 - DNA, 22 bp, Homo sapiens
tccagggcagggtgcgcatggg

SEQ ID NO: 9335368 - DNA, 22 bp, Homo sapiens
tccaggctggaaatgtcaaact

SEQ ID NO: 9335369 - DNA, 22 bp, Homo sapiens
tccaggctggaaatgtcaaact

SEQ ID NO: 9335370 - DNA, 21 bp, Homo sapiens
tccaggctggaaggggcgttg

SEQ ID NO: 9335371 - DNA, 22 bp, Homo sapiens
tccaggctgccacagtgcaacg

SEQ ID NO: 9335372 - DNA, 22 bp, Homo sapiens
tccaggctgcagtcttgccctc

SEQ ID NO: 9335373 - DNA, 22 bp, Homo sapiens
tccaggctgcagtcttgccctc

SEQ ID NO: 9335374 - DNA, 22 bp, Homo sapiens
tccaggctgcagtcttgccctc

SEQ ID NO: 9335375 - DNA, 22 bp, Homo sapiens
tccagggctacaaggcaccaga

SEQ ID NO: 9335376 - DNA, 22 bp, Homo sapiens
tccagggctacaaggcaccaga

SEQ ID NO: 9335377 - DNA, 22 bp, Homo sapiens
tccagggctacaaggcaccaga

SEQ ID NO: 9335378 - DNA, 22 bp, Homo sapiens
tccagggctacaaggcaccaga

SEQ ID NO: 9335379 - DNA, 22 bp, Homo sapiens
tccagggctacaaggcaccaga

SEQ ID NO: 9335380 - DNA, 20 bp, Homo sapiens
tccagggctagggagctcat

SEQ ID NO: 9335381 - DNA, 22 bp, Homo sapiens
tccagggcctgaggttgaagtg

SEQ ID NO: 9335382 - DNA, 21 bp, Homo sapiens
tccagggcgggcgcacggaga

SEQ ID NO: 9335383 - DNA, 21 bp, Homo sapiens
tccagggcgggcgcacggaga

SEQ ID NO: 9335384 - DNA, 22 bp, Homo sapiens
tccagggcgtgtgtgaaggaaa

SEQ ID NO: 9335385 - DNA, 22 bp, Homo sapiens
tccagggctcattccctctgca

SEQ ID NO: 9335386 - DNA, 22 bp, Homo sapiens
tccagttgcccatctctcttct

SEQ ID NO: 9335387 - DNA, 22 bp, Homo sapiens
tccatcaccatttctgcgagct

SEQ ID NO: 9335388 - DNA, 22 bp, Homo sapiens
tccagtttatttttggcagggt

SEQ ID NO: 9335389 - DNA, 22 bp, Homo sapiens
tccatccacattaacagatacg

SEQ ID NO: 9335390 - DNA, 22 bp, Homo sapiens
tccatccaccctgcattatatt

SEQ ID NO: 9335391 - DNA, 22 bp, Homo sapiens
tccatcatgttcacagctatat

SEQ ID NO: 9335392 - DNA, 22 bp, Homo sapiens
tccatcatggcagcagcagtga

SEQ ID NO: 9335393 - DNA, 22 bp, Homo sapiens
tccagcagtgctctagagcgtg

SEQ ID NO: 9335394 - DNA, 22 bp, Homo sapiens
tccagcagtccatgtgagacac

SEQ ID NO: 9335395 - DNA, 22 bp, Homo sapiens
tccagcaggttggtcaggtgca

SEQ ID NO: 9335396 - DNA, 22 bp, Homo sapiens
tccagcaggttggtcaggtgca

SEQ ID NO: 9335397 - DNA, 22 bp, Homo sapiens
tccagccaatcagagctgaggc

SEQ ID NO: 9335398 - DNA, 21 bp, Homo sapiens
tccagcctttccctcacttcc

SEQ ID NO: 9335399 - DNA, 22 bp, Homo sapiens
tccagccaagccttggtagctg

SEQ ID NO: 9335400 - DNA, 22 bp, Homo sapiens
tccagcattttgatacttgaaa

SEQ ID NO: 9335401 - DNA, 22 bp, Homo sapiens
tccagcattttgatacttgaaa

SEQ ID NO: 9335402 - DNA, 22 bp, Homo sapiens
tccagcattcttagacctctat

SEQ ID NO: 9335403 - DNA, 22 bp, Homo sapiens
tccagcattttgatacttgaaa

SEQ ID NO: 9335404 - DNA, 22 bp, Homo sapiens
tccagctcccactctcactgct

SEQ ID NO: 9335405 - DNA, 22 bp, Homo sapiens
tccagctcatctgtctccatta

SEQ ID NO: 9335406 - DNA, 22 bp, Homo sapiens
tccagctcaaattcagcttcca

SEQ ID NO: 9335407 - DNA, 22 bp, Homo sapiens
tccagctcaaattcagcttcca

SEQ ID NO: 9335408 - DNA, 22 bp, Homo sapiens
tccagcctttctactcactgag

SEQ ID NO: 9335409 - DNA, 22 bp, Homo sapiens
tccagctcagggttggctcaag

SEQ ID NO: 9335410 - DNA, 22 bp, Homo sapiens
tccagctcagggttggctcaag

SEQ ID NO: 9335411 - DNA, 22 bp, Homo sapiens
tccagctcctgagttcactgct

SEQ ID NO: 9335412 - DNA, 22 bp, Homo sapiens
tccagctcctgagttcactgct

SEQ ID NO: 9335413 - DNA, 21 bp, Homo sapiens
tccagctcctgccactcctta

SEQ ID NO: 9335414 - DNA, 22 bp, Homo sapiens
tccagctctgattctcactagc

SEQ ID NO: 9335415 - DNA, 22 bp, Homo sapiens
tccagctctgcttcacagtctc

SEQ ID NO: 9335416 - DNA, 22 bp, Homo sapiens
tccagctggggcagtggctggg

SEQ ID NO: 9335417 - DNA, 22 bp, Homo sapiens
tccagctggggacatgggcttc

SEQ ID NO: 9335418 - DNA, 22 bp, Homo sapiens
tccagctctggcttggctagct

SEQ ID NO: 9335419 - DNA, 21 bp, Homo sapiens
tccagctcttatgttcatgaa

SEQ ID NO: 9335420 - DNA, 19 bp, Homo sapiens
tccagctggtatgcccaga

SEQ ID NO: 9335421 - DNA, 22 bp, Homo sapiens
tccagctggggccgaagtggat

SEQ ID NO: 9335422 - DNA, 22 bp, Homo sapiens
tccagctgtactttgtcctggc

SEQ ID NO: 9335423 - DNA, 22 bp, Homo sapiens
tccagctgtactttgtcctggc

SEQ ID NO: 9335424 - DNA, 22 bp, Homo sapiens
tccagctgtgctccaggaggtg

SEQ ID NO: 9335425 - DNA, 21 bp, Homo sapiens
tccagctgtgattatgaatgt

SEQ ID NO: 9335426 - DNA, 22 bp, Homo sapiens
tccagcttcttgacttggtggt

SEQ ID NO: 9335427 - DNA, 22 bp, Homo sapiens
tccagcttgacaaatgatttta

SEQ ID NO: 9335428 - DNA, 22 bp, Homo sapiens
tccagcttgcctggtcttttgg

SEQ ID NO: 9335429 - DNA, 22 bp, Homo sapiens
tccagcttgacaaatgatttta

SEQ ID NO: 9335430 - DNA, 18 bp, Homo sapiens
tccagcttgcacttaaat

SEQ ID NO: 9335431 - DNA, 18 bp, Homo sapiens
tccagcttgcacttaaat

SEQ ID NO: 9335432 - DNA, 22 bp, Homo sapiens
tccagcttgggtgggaggaggt

SEQ ID NO: 9335433 - DNA, 22 bp, Homo sapiens
tccagctttcacgctcctgcct

SEQ ID NO: 9335434 - DNA, 22 bp, Homo sapiens
tccagcttggagagaagtttct

SEQ ID NO: 9335435 - DNA, 22 bp, Homo sapiens
tccagcttgcttcaggatggtc

SEQ ID NO: 9335436 - DNA, 22 bp, Homo sapiens
tccagcttggagagaagtttct

SEQ ID NO: 9335437 - DNA, 22 bp, Homo sapiens
tccagcttggcagagctacctg

SEQ ID NO: 9335438 - DNA, 22 bp, Homo sapiens
tccagcttggcagagctacctg

SEQ ID NO: 9335439 - DNA, 20 bp, Homo sapiens
tccagctgttgagatctgag

SEQ ID NO: 9335440 - DNA, 19 bp, Homo sapiens
tccagctgttttgagtcac

SEQ ID NO: 9335441 - DNA, 22 bp, Homo sapiens
tccagcttataggtagatttaa

SEQ ID NO: 9335442 - DNA, 22 bp, Homo sapiens
tccagcttataggtagatttaa

SEQ ID NO: 9335443 - DNA, 22 bp, Homo sapiens
tccagcttcagctcttggatag

SEQ ID NO: 9335444 - DNA, 22 bp, Homo sapiens
tccagcttccagtggctggctg

SEQ ID NO: 9335445 - DNA, 22 bp, Homo sapiens
tccaggaaaaggcttgcagggg

SEQ ID NO: 9335446 - DNA, 22 bp, Homo sapiens
tccaggaaacactcaagccatg

SEQ ID NO: 9335447 - DNA, 22 bp, Homo sapiens
tccagctttgagattttatgga

SEQ ID NO: 9335448 - DNA, 22 bp, Homo sapiens
tccagctttgagattttatgga

SEQ ID NO: 9335449 - DNA, 20 bp, Homo sapiens
tccagctttgcctctaactg

SEQ ID NO: 9335450 - DNA, 22 bp, Homo sapiens
tccagctttgcctgatcatata

SEQ ID NO: 9335451 - DNA, 22 bp, Homo sapiens
tccagctttggctctagctaca

SEQ ID NO: 9335452 - DNA, 22 bp, Homo sapiens
tccagcttttattggatgagga

SEQ ID NO: 9335453 - DNA, 22 bp, Homo sapiens
tccagcttttaccaaatgagca

SEQ ID NO: 9335454 - DNA, 19 bp, Homo sapiens
tccaggaggctgccattga

SEQ ID NO: 9335455 - DNA, 22 bp, Homo sapiens
tccaggaggctctggttgacgt

SEQ ID NO: 9335456 - DNA, 22 bp, Homo sapiens
tccaggaggctctggttgacgt

SEQ ID NO: 9335457 - DNA, 22 bp, Homo sapiens
tccaggaaagcactgggctggg

SEQ ID NO: 9335458 - DNA, 22 bp, Homo sapiens
tccagagcctttccacccactt

SEQ ID NO: 9335459 - DNA, 22 bp, Homo sapiens
tccagagcctttctgcttgaca

SEQ ID NO: 9335460 - DNA, 22 bp, Homo sapiens
tccagagcctttctgcttgaca

SEQ ID NO: 9335461 - DNA, 22 bp, Homo sapiens
tccagagccttcgataagaaga

SEQ ID NO: 9335462 - DNA, 22 bp, Homo sapiens
tccagagcctgcgcactggctg

SEQ ID NO: 9335463 - DNA, 22 bp, Homo sapiens
tccagagcctggggtttgtaac

SEQ ID NO: 9335464 - DNA, 22 bp, Homo sapiens
tccagagcctggggtttgtaac

SEQ ID NO: 9335465 - DNA, 22 bp, Homo sapiens
tccagagcctgcgcactggctg

SEQ ID NO: 9335466 - DNA, 22 bp, Homo sapiens
tccagagcctatatgttcaact

SEQ ID NO: 9335467 - DNA, 22 bp, Homo sapiens
tccagagcctgcgcactggctg

SEQ ID NO: 9335468 - DNA, 18 bp, Homo sapiens
tccagagctactgtggtg

SEQ ID NO: 9335469 - DNA, 18 bp, Homo sapiens
tccagagctactgtggtg

SEQ ID NO: 9335470 - DNA, 22 bp, Homo sapiens
tccagagctaattcagcagctg

SEQ ID NO: 9335471 - DNA, 23 bp, Homo sapiens
tccagagctcatgctctcaacca

SEQ ID NO: 9335472 - DNA, 22 bp, Homo sapiens
tccagagctacttgctcaactt

SEQ ID NO: 9335473 - DNA, 18 bp, Homo sapiens
tccagagctactgtggtg

SEQ ID NO: 9335474 - DNA, 22 bp, Homo sapiens
tccagagcaggtgtctacacag

SEQ ID NO: 9335475 - DNA, 18 bp, Homo sapiens
tccagagcagtctttggc

SEQ ID NO: 9335476 - DNA, 18 bp, Homo sapiens
tccagagcagtctttggc

SEQ ID NO: 9335477 - DNA, 22 bp, Homo sapiens
tccagagcaggtggtcagaagg

SEQ ID NO: 9335478 - DNA, 22 bp, Homo sapiens
tccagagcaggtggtcagaagg

SEQ ID NO: 9335479 - DNA, 22 bp, Homo sapiens
tccagagccccagtctagtggg

SEQ ID NO: 9335480 - DNA, 22 bp, Homo sapiens
tccagagccccagtctagtggg

SEQ ID NO: 9335481 - DNA, 22 bp, Homo sapiens
tccagagccccaattcacctct

SEQ ID NO: 9335482 - DNA, 22 bp, Homo sapiens
tccagagccccaattcacctct

SEQ ID NO: 9335483 - DNA, 22 bp, Homo sapiens
tccagagcatgcagatcatcaa

SEQ ID NO: 9335484 - DNA, 22 bp, Homo sapiens
tccagagcaaagtttgctaaca

SEQ ID NO: 9335485 - DNA, 17 bp, Homo sapiens
tccagagcacagagctc

SEQ ID NO: 9335486 - DNA, 22 bp, Homo sapiens
tccagagaggtttctccatgct

SEQ ID NO: 9335487 - DNA, 20 bp, Homo sapiens
tccagagagtggcaaagctc

SEQ ID NO: 9335488 - DNA, 22 bp, Homo sapiens
tcattgcagaaataaaggtgaa

SEQ ID NO: 9335489 - DNA, 22 bp, Homo sapiens
tcattgcagcttcaggtgttca

SEQ ID NO: 9335490 - DNA, 22 bp, Homo sapiens
tcattgagttgcacttttacta

SEQ ID NO: 9335491 - DNA, 22 bp, Homo sapiens
tcattgataaagtactgctttt

SEQ ID NO: 9335492 - DNA, 22 bp, Homo sapiens
tcattgatggcttctttcttgc

SEQ ID NO: 9335493 - DNA, 22 bp, Homo sapiens
tcattgaatgagatgcaataga

SEQ ID NO: 9335494 - DNA, 22 bp, Homo sapiens
tcattgaagcattttgtgtatt

SEQ ID NO: 9335495 - DNA, 23 bp, Homo sapiens
tccagcagagccttccaggaggg

SEQ ID NO: 9335496 - DNA, 22 bp, Homo sapiens
tccagcagaccatcaaggctca

SEQ ID NO: 9335497 - DNA, 22 bp, Homo sapiens
tccagcagagtctctgaggggg

SEQ ID NO: 9335498 - DNA, 23 bp, Homo sapiens
tccagcagccaagaagggtagaa

SEQ ID NO: 9335499 - DNA, 22 bp, Homo sapiens
tccagcagccacacctctggac

SEQ ID NO: 9335500 - DNA, 22 bp, Homo sapiens
tccagcagccacacctctggac

SEQ ID NO: 9335501 - DNA, 22 bp, Homo sapiens
tccagcagcccgaaggcccatc

SEQ ID NO: 9335502 - DNA, 22 bp, Homo sapiens
tccagcagcccgaaggcccatc

SEQ ID NO: 9335503 - DNA, 18 bp, Homo sapiens
tccagcaggtctgaggtg

SEQ ID NO: 9335504 - DNA, 18 bp, Homo sapiens
tccagcaggtctgaggtg

SEQ ID NO: 9335505 - DNA, 22 bp, Homo sapiens
tccagagctgggtctgtgctca

SEQ ID NO: 9335506 - DNA, 22 bp, Homo sapiens
tccagagctgggtctgtgctca

SEQ ID NO: 9335507 - DNA, 22 bp, Homo sapiens
tccagagctgagggtcagtaga

SEQ ID NO: 9335508 - DNA, 22 bp, Homo sapiens
tccagagctgagggtcagtaga

SEQ ID NO: 9335509 - DNA, 22 bp, Homo sapiens
tccagagctgggtctgtgctca

SEQ ID NO: 9335510 - DNA, 22 bp, Homo sapiens
tccagagctctgggcatagctg

SEQ ID NO: 9335511 - DNA, 23 bp, Homo sapiens
tccagagctcatgctctcaacca

SEQ ID NO: 9335512 - DNA, 22 bp, Homo sapiens
tccagagctctgggcatagctg

SEQ ID NO: 9335513 - DNA, 22 bp, Homo sapiens
tccagagctgagcagtcattct

SEQ ID NO: 9335514 - DNA, 22 bp, Homo sapiens
tccagagctgagcagtcattct

SEQ ID NO: 9335515 - DNA, 22 bp, Homo sapiens
tccagagctgtcctactgtgag

SEQ ID NO: 9335516 - DNA, 22 bp, Homo sapiens
tccagagctgtcctactgtgag

SEQ ID NO: 9335517 - DNA, 22 bp, Homo sapiens
tccagagctgtcctactgtgag

SEQ ID NO: 9335518 - DNA, 22 bp, Homo sapiens
tccagagctgtatgattttttt

SEQ ID NO: 9335519 - DNA, 22 bp, Homo sapiens
tccagagctgtatgattttttt

SEQ ID NO: 9335520 - DNA, 18 bp, Homo sapiens
tccagagctggtgcttct

SEQ ID NO: 9335521 - DNA, 21 bp, Homo sapiens
tccagaggaggacagactcag

SEQ ID NO: 9335522 - DNA, 22 bp, Homo sapiens
tccagaggcaaaaaggtatgga

SEQ ID NO: 9335523 - DNA, 21 bp, Homo sapiens
tccagaggaggacagactcag

SEQ ID NO: 9335524 - DNA, 14 bp, Homo sapiens
tccagagctttccg

SEQ ID NO: 9335525 - DNA, 22 bp, Homo sapiens
tccagaggctctgagggagagt

SEQ ID NO: 9335526 - DNA, 22 bp, Homo sapiens
tccagaggctccaaagggagat

SEQ ID NO: 9335527 - DNA, 22 bp, Homo sapiens
tccagaggctccaaagggagat

SEQ ID NO: 9335528 - DNA, 20 bp, Homo sapiens
tccagaggccacatccagtg

SEQ ID NO: 9335529 - DNA, 20 bp, Homo sapiens
tccagaggccacatccagtg

SEQ ID NO: 9335530 - DNA, 22 bp, Homo sapiens
tccagaggtatgtagagagtat

SEQ ID NO: 9335531 - DNA, 22 bp, Homo sapiens
tccagaggtatgtagagagtat

SEQ ID NO: 9335532 - DNA, 22 bp, Homo sapiens
tccagaggggcagccctgtgct

SEQ ID NO: 9335533 - DNA, 22 bp, Homo sapiens
tccagagggcgatggctggggg

SEQ ID NO: 9335534 - DNA, 20 bp, Homo sapiens
tcagagaagggactgagatt

SEQ ID NO: 9335535 - DNA, 22 bp, Homo sapiens
tcagagaaggctgagtcacggc

SEQ ID NO: 9335536 - DNA, 22 bp, Homo sapiens
tcagagaaggcaattttatggt

SEQ ID NO: 9335537 - DNA, 22 bp, Homo sapiens
tcagagaactgcagcccttcct

SEQ ID NO: 9335538 - DNA, 22 bp, Homo sapiens
tcagagaactggcatgtttaga

SEQ ID NO: 9335539 - DNA, 22 bp, Homo sapiens
tcagagaagacatcattgtgaa

SEQ ID NO: 9335540 - DNA, 22 bp, Homo sapiens
tcagacagtttgcagtgtgcct

SEQ ID NO: 9335541 - DNA, 22 bp, Homo sapiens
tcagacagtgtgatcagtctct

SEQ ID NO: 9335542 - DNA, 22 bp, Homo sapiens
tcagacagtgtgatcagtctct

SEQ ID NO: 9335543 - DNA, 22 bp, Homo sapiens
tcagacattattttcaagataa

SEQ ID NO: 9335544 - DNA, 22 bp, Homo sapiens
tcagacatgggatatgaagctc

SEQ ID NO: 9335545 - DNA, 22 bp, Homo sapiens
tcagacctctgaccttgccaaa

SEQ ID NO: 9335546 - DNA, 22 bp, Homo sapiens
tcagacctctgaccttgccaaa

SEQ ID NO: 9335547 - DNA, 22 bp, Homo sapiens
tcagacctctgaccttgccaaa

SEQ ID NO: 9335548 - DNA, 20 bp, Homo sapiens
tcagacccagattagcaggt

SEQ ID NO: 9335549 - DNA, 22 bp, Homo sapiens
tcagacagattttgacacttgc

SEQ ID NO: 9335550 - DNA, 22 bp, Homo sapiens
tcagacagcttgcagggaggtg

SEQ ID NO: 9335551 - DNA, 22 bp, Homo sapiens
tcagaaaaggtagctgtgacaa

SEQ ID NO: 9335552 - DNA, 22 bp, Homo sapiens
tcagacaggcctctccagcctc

SEQ ID NO: 9335553 - DNA, 22 bp, Homo sapiens
tcagacagcttgggataactga

SEQ ID NO: 9335554 - DNA, 22 bp, Homo sapiens
tcagacagggagtcagaaaata

SEQ ID NO: 9335555 - DNA, 22 bp, Homo sapiens
tcagacagggcttctcaaactt

SEQ ID NO: 9335556 - DNA, 22 bp, Homo sapiens
tcagacaggctggacagcttgc

SEQ ID NO: 9335557 - DNA, 22 bp, Homo sapiens
tcagacaggcttctttctccct

SEQ ID NO: 9335558 - DNA, 22 bp, Homo sapiens
tcagacagtcatcagagcttgt

SEQ ID NO: 9335559 - DNA, 20 bp, Homo sapiens
tcagacagtcgcagttctgg

SEQ ID NO: 9335560 - DNA, 22 bp, Homo sapiens
tcagacagtcatcagagcttgt

SEQ ID NO: 9335561 - DNA, 22 bp, Homo sapiens
tcacttttgatccctatgcagt

SEQ ID NO: 9335562 - DNA, 22 bp, Homo sapiens
tcacttttgatccctatgcagt

SEQ ID NO: 9335563 - DNA, 22 bp, Homo sapiens
tcacttttgatccctatgcagt

SEQ ID NO: 9335564 - DNA, 22 bp, Homo sapiens
tcacttttgggtttccagtaga

SEQ ID NO: 9335565 - DNA, 22 bp, Homo sapiens
tcactttttgatatcattctgc

SEQ ID NO: 9335566 - DNA, 22 bp, Homo sapiens
tcactttttgatatcattctgc

SEQ ID NO: 9335567 - DNA, 22 bp, Homo sapiens
tcagaaaagagaaaatcttata

SEQ ID NO: 9335568 - DNA, 22 bp, Homo sapiens
tcagaaaagagaaaatcttata

SEQ ID NO: 9335569 - DNA, 22 bp, Homo sapiens
tcagcactgaatctggatttgc

SEQ ID NO: 9335570 - DNA, 22 bp, Homo sapiens
tcagcactgtgtccagtctccc

SEQ ID NO: 9335571 - DNA, 22 bp, Homo sapiens
tcagcaatgtgatactgtgcaa

SEQ ID NO: 9335572 - DNA, 22 bp, Homo sapiens
tcagcaatgtgatactgtgcaa

SEQ ID NO: 9335573 - DNA, 22 bp, Homo sapiens
tcagaggaaaggtcagatggct

SEQ ID NO: 9335574 - DNA, 22 bp, Homo sapiens
tcagaggaaaggtcagatggct

SEQ ID NO: 9335575 - DNA, 22 bp, Homo sapiens
tcagaggaacactgtttcatgc

SEQ ID NO: 9335576 - DNA, 22 bp, Homo sapiens
tcagaggaaaggtcagatggct

SEQ ID NO: 9335577 - DNA, 22 bp, Homo sapiens
tcagaggaaagggaacatagtc

SEQ ID NO: 9335578 - DNA, 22 bp, Homo sapiens
tcagcaagcagggggatgttca

SEQ ID NO: 9335579 - DNA, 20 bp, Homo sapiens
tcagagcagttggcttgtct

SEQ ID NO: 9335580 - DNA, 20 bp, Homo sapiens
tcagagcagttggcttgtct

SEQ ID NO: 9335581 - DNA, 22 bp, Homo sapiens
tcagagcacttggctcatggca

SEQ ID NO: 9335582 - DNA, 22 bp, Homo sapiens
tcagagcattagaggtttgtat

SEQ ID NO: 9335583 - DNA, 22 bp, Homo sapiens
tcagagcattagaggtttgtat

SEQ ID NO: 9335584 - DNA, 22 bp, Homo sapiens
tcagagcattcgggtgacaaat

SEQ ID NO: 9335585 - DNA, 22 bp, Homo sapiens
tcagagcactggtgctaccttg

SEQ ID NO: 9335586 - DNA, 22 bp, Homo sapiens
tcagagcactggtgctaccttg

SEQ ID NO: 9335587 - DNA, 22 bp, Homo sapiens
tcagagctttggagaccaggaa

SEQ ID NO: 9335588 - DNA, 22 bp, Homo sapiens
tcagagcttatctcttgctgga

SEQ ID NO: 9335589 - DNA, 20 bp, Homo sapiens
tcagagctgcaggagagaaa

SEQ ID NO: 9335590 - DNA, 22 bp, Homo sapiens
tcagagctgtgcttcaggaaag

SEQ ID NO: 9335591 - DNA, 22 bp, Homo sapiens
tcagagctcctaagggctgatt

SEQ ID NO: 9335592 - DNA, 20 bp, Homo sapiens
tcagagctgcaggagagaaa

SEQ ID NO: 9335593 - DNA, 22 bp, Homo sapiens
tcaccaggattcctatcagtag

SEQ ID NO: 9335594 - DNA, 22 bp, Homo sapiens
tcaccaggactgagaccttggg

SEQ ID NO: 9335595 - DNA, 22 bp, Homo sapiens
tcaccaggcaactatgtactcc

SEQ ID NO: 9335596 - DNA, 22 bp, Homo sapiens
tcaccaggattgggctgtaggc

SEQ ID NO: 9335597 - DNA, 22 bp, Homo sapiens
tcaccaggattgggctgtaggc

SEQ ID NO: 9335598 - DNA, 22 bp, Homo sapiens
tcaccaggctagagtgcagtgg

SEQ ID NO: 9335599 - DNA, 22 bp, Homo sapiens
tcacccagcagctgcttctgct

SEQ ID NO: 9335600 - DNA, 22 bp, Homo sapiens
tcacagtagttgttctctgttt

SEQ ID NO: 9335601 - DNA, 22 bp, Homo sapiens
tcacagtataacctcatatagg

SEQ ID NO: 9335602 - DNA, 22 bp, Homo sapiens
tcacattttctactactgtacg

SEQ ID NO: 9335603 - DNA, 22 bp, Homo sapiens
tcactacaacctccgcctcctg

SEQ ID NO: 9335604 - DNA, 22 bp, Homo sapiens
tcactagcattgttgaaggact

SEQ ID NO: 9335605 - DNA, 22 bp, Homo sapiens
tcactctgcctccatattacta

SEQ ID NO: 9335606 - DNA, 22 bp, Homo sapiens
tcactctggcctctgcagcagt

SEQ ID NO: 9335607 - DNA, 20 bp, Homo sapiens
tcactctgatgctagggtgg

SEQ ID NO: 9335608 - DNA, 22 bp, Homo sapiens
tcactctgagaggtcactggaa

SEQ ID NO: 9335609 - DNA, 22 bp, Homo sapiens
tcacccaggctggactgcagtg

SEQ ID NO: 9335610 - DNA, 22 bp, Homo sapiens
tcactttggattatgtaatttc

SEQ ID NO: 9335611 - DNA, 22 bp, Homo sapiens
tcactttggattatgtaatttc

SEQ ID NO: 9335612 - DNA, 23 bp, Homo sapiens
tcactttgatgtaattgaaaagc

SEQ ID NO: 9335613 - DNA, 23 bp, Homo sapiens
tcactttgatgtaattgaaaagc

SEQ ID NO: 9335614 - DNA, 22 bp, Homo sapiens
tcactttgatgacattgtagct

SEQ ID NO: 9335615 - DNA, 22 bp, Homo sapiens
tcactttgatgacattgtagct

SEQ ID NO: 9335616 - DNA, 22 bp, Homo sapiens
tcactttaaactactgtggtct

SEQ ID NO: 9335617 - DNA, 22 bp, Homo sapiens
tcactttaatgatttgtagaat

SEQ ID NO: 9335618 - DNA, 22 bp, Homo sapiens
tcactttactttgttaatctgg

SEQ ID NO: 9335619 - DNA, 22 bp, Homo sapiens
tcactttagaggaaacattgag

SEQ ID NO: 9335620 - DNA, 22 bp, Homo sapiens
tcactgtgtcctttctgcgtag

SEQ ID NO: 9335621 - DNA, 22 bp, Homo sapiens
tcactgtgtcctttctgcgtag

SEQ ID NO: 9335622 - DNA, 22 bp, Homo sapiens
tcactgaatgcagatacgtgac

SEQ ID NO: 9335623 - DNA, 22 bp, Homo sapiens
tcactgaatacttgtctcatcc

SEQ ID NO: 9335624 - DNA, 22 bp, Homo sapiens
tcactgaagtcttcaagtagga

SEQ ID NO: 9335625 - DNA, 22 bp, Homo sapiens
tcactgaagactgggctctaaa

SEQ ID NO: 9335626 - DNA, 21 bp, Homo sapiens
tcactgaagcctaagatgttt

SEQ ID NO: 9335627 - DNA, 21 bp, Homo sapiens
tcactgaagcctaagatgttt

SEQ ID NO: 9335628 - DNA, 21 bp, Homo sapiens
tcactgaagcctaagatgttt

SEQ ID NO: 9335629 - DNA, 22 bp, Homo sapiens
tcactgaaggaagacactgtca

SEQ ID NO: 9335630 - DNA, 22 bp, Homo sapiens
tcactgagaagagtaacagcag

SEQ ID NO: 9335631 - DNA, 18 bp, Homo sapiens
tcactgagccgcctctct

SEQ ID NO: 9335632 - DNA, 22 bp, Homo sapiens
tcactgaatttcaagctagtgg

SEQ ID NO: 9335633 - DNA, 22 bp, Homo sapiens
tcactgaatttcaagctagtgg

SEQ ID NO: 9335634 - DNA, 22 bp, Homo sapiens
tcactgtgctctctagataggc

SEQ ID NO: 9335635 - DNA, 19 bp, Homo sapiens
tcactgaggctttgttggc

SEQ ID NO: 9335636 - DNA, 21 bp, Homo sapiens
tcactgaggttaaatagggtt

SEQ ID NO: 9335637 - DNA, 22 bp, Homo sapiens
tcactgaactctcatagagaaa

SEQ ID NO: 9335638 - DNA, 22 bp, Homo sapiens
tcactgaaccagggatctctag

SEQ ID NO: 9335639 - DNA, 22 bp, Homo sapiens
tcactgaactctcatagagaaa

SEQ ID NO: 9335640 - DNA, 22 bp, Homo sapiens
tcactgaaccagggatctctag

SEQ ID NO: 9335641 - DNA, 22 bp, Homo sapiens
tcactgaaagtaattctagtga

SEQ ID NO: 9335642 - DNA, 22 bp, Homo sapiens
tcactgaaagaatgacattatg

SEQ ID NO: 9335643 - DNA, 22 bp, Homo sapiens
tcactctgttttactcactgtt

SEQ ID NO: 9335644 - DNA, 22 bp, Homo sapiens
tcactgaaaaccatacttcttt

SEQ ID NO: 9335645 - DNA, 22 bp, Homo sapiens
tcactctgttagaggaaagtgc

SEQ ID NO: 9335646 - DNA, 22 bp, Homo sapiens
tcactctgtggcccaggcagtg

SEQ ID NO: 9335647 - DNA, 22 bp, Homo sapiens
tcacagggatggaatagaaata

SEQ ID NO: 9335648 - DNA, 22 bp, Homo sapiens
tcacagggcattatggctccag

SEQ ID NO: 9335649 - DNA, 22 bp, Homo sapiens
tcacagggcattatggctccag

SEQ ID NO: 9335650 - DNA, 22 bp, Homo sapiens
tcacaggctctccaccatgagg

SEQ ID NO: 9335651 - DNA, 22 bp, Homo sapiens
tcacaggctccagggcctggat

SEQ ID NO: 9335652 - DNA, 23 bp, Homo sapiens
tcacaggggccagcgctctgtgg

SEQ ID NO: 9335653 - DNA, 23 bp, Homo sapiens
tcacaggggccagcgctctgtgg

SEQ ID NO: 9335654 - DNA, 22 bp, Homo sapiens
tcacagaataaatgtactggcc

SEQ ID NO: 9335655 - DNA, 22 bp, Homo sapiens
tcacagaataaatgtactggcc

SEQ ID NO: 9335656 - DNA, 22 bp, Homo sapiens
tcacagctcactgtagcctcga

SEQ ID NO: 9335657 - DNA, 22 bp, Homo sapiens
tcacagctcactgtagcctcga

SEQ ID NO: 9335658 - DNA, 22 bp, Homo sapiens
tcacagaataaattgagaagac

SEQ ID NO: 9335659 - DNA, 22 bp, Homo sapiens
tcacaggcaaagaagattggtg

SEQ ID NO: 9335660 - DNA, 22 bp, Homo sapiens
tcacaggataaggtggcatcac

SEQ ID NO: 9335661 - DNA, 22 bp, Homo sapiens
tcacagaaggcatcacagaaga

SEQ ID NO: 9335662 - DNA, 22 bp, Homo sapiens
tcacagaaggcatcacagaaga

SEQ ID NO: 9335663 - DNA, 22 bp, Homo sapiens
tcacagaaggaccttgtttcat

SEQ ID NO: 9335664 - DNA, 22 bp, Homo sapiens
tcacagaagttgaatttgcatg

SEQ ID NO: 9335665 - DNA, 22 bp, Homo sapiens
tcacagaagtgtagtgaggaaa

SEQ ID NO: 9335666 - DNA, 22 bp, Homo sapiens
tcacagaaggtggccatagctg

SEQ ID NO: 9335667 - DNA, 22 bp, Homo sapiens
tcacaaagctttgataagcaga

SEQ ID NO: 9335668 - DNA, 22 bp, Homo sapiens
tcacaaaaggccatgtggcttc

SEQ ID NO: 9335669 - DNA, 22 bp, Homo sapiens
tcacaaaaggccatgtggcttc

SEQ ID NO: 9335670 - DNA, 22 bp, Homo sapiens
tcacaaagctttgataagcaga

SEQ ID NO: 9335671 - DNA, 22 bp, Homo sapiens
tcacaaaagcttttgaatttgg

SEQ ID NO: 9335672 - DNA, 22 bp, Homo sapiens
tcacaaaagcttttgaatttgg

SEQ ID NO: 9335673 - DNA, 20 bp, Homo sapiens
tcaattttctacaacatttg

SEQ ID NO: 9335674 - DNA, 22 bp, Homo sapiens
tcacaaaagcttttgaatttgg

SEQ ID NO: 9335675 - DNA, 22 bp, Homo sapiens
tcacaaagggagggatagctgg

SEQ ID NO: 9335676 - DNA, 22 bp, Homo sapiens
tcacaagagctggactgtcttt

SEQ ID NO: 9335677 - DNA, 22 bp, Homo sapiens
tcacaagagtaagttcatgcct

SEQ ID NO: 9335678 - DNA, 22 bp, Homo sapiens
tcacaagatatttcagtccttt

SEQ ID NO: 9335679 - DNA, 22 bp, Homo sapiens
tcacaagataaacatagctcca

SEQ ID NO: 9335680 - DNA, 22 bp, Homo sapiens
tcacaagatacagttagaagca

SEQ ID NO: 9335681 - DNA, 22 bp, Homo sapiens
tcacaagatggctgctgcagcc

SEQ ID NO: 9335682 - DNA, 22 bp, Homo sapiens
tcacaagtttctcttgcatgcg

SEQ ID NO: 9335683 - DNA, 22 bp, Homo sapiens
tcacagaaagctgtgtcctgac

SEQ ID NO: 9335684 - DNA, 22 bp, Homo sapiens
tcacagaaataagatagttatt

SEQ ID NO: 9335685 - DNA, 22 bp, Homo sapiens
tcacagaacaagcctggtggag

SEQ ID NO: 9335686 - DNA, 22 bp, Homo sapiens
tcacagaagaagtagattgcat

SEQ ID NO: 9335687 - DNA, 22 bp, Homo sapiens
tcacagaacaatgtttagttct

SEQ ID NO: 9335688 - DNA, 22 bp, Homo sapiens
tcacagaagagatattgacaga

SEQ ID NO: 9335689 - DNA, 22 bp, Homo sapiens
tcacagaagagcattaagatga

SEQ ID NO: 9335690 - DNA, 22 bp, Homo sapiens
tcacacatgagtaaatacaggg

SEQ ID NO: 9335691 - DNA, 22 bp, Homo sapiens
tcacaatatgggtgtgggaact

SEQ ID NO: 9335692 - DNA, 20 bp, Homo sapiens
tcacaatatgagctcataca

SEQ ID NO: 9335693 - DNA, 22 bp, Homo sapiens
tcacacatgctaagccagagat

SEQ ID NO: 9335694 - DNA, 22 bp, Homo sapiens
tcacacatgctaagccagagat

SEQ ID NO: 9335695 - DNA, 20 bp, Homo sapiens
tcacacatggtaagctatga

SEQ ID NO: 9335696 - DNA, 22 bp, Homo sapiens
tcacagaaacagaatggcacag

SEQ ID NO: 9335697 - DNA, 22 bp, Homo sapiens
tcaaggttttatcctagatcac

SEQ ID NO: 9335698 - DNA, 22 bp, Homo sapiens
tcaaggtttgtctgctcagcat

SEQ ID NO: 9335699 - DNA, 22 bp, Homo sapiens
tcaaggttgttgaggcctgact

SEQ ID NO: 9335700 - DNA, 22 bp, Homo sapiens
tcaaggttaagccagggcctca

SEQ ID NO: 9335701 - DNA, 22 bp, Homo sapiens
tcaaggttcaaggctggcttct

SEQ ID NO: 9335702 - DNA, 22 bp, Homo sapiens
tcaaggttgccaggaaggaaga

SEQ ID NO: 9335703 - DNA, 22 bp, Homo sapiens
tcaaggttgagtaaattgttgg

SEQ ID NO: 9335704 - DNA, 22 bp, Homo sapiens
tcaaggttgcggggaggcacga

SEQ ID NO: 9335705 - DNA, 22 bp, Homo sapiens
tcaagtcccagctcttcactta

SEQ ID NO: 9335706 - DNA, 22 bp, Homo sapiens
tcaagtcctgctgtggaccaca

SEQ ID NO: 9335707 - DNA, 22 bp, Homo sapiens
tcaagggaggagacacagccct

SEQ ID NO: 9335708 - DNA, 22 bp, Homo sapiens
tcaaggccacagtgagcagagt

SEQ ID NO: 9335709 - DNA, 22 bp, Homo sapiens
tcaaggccacagtgagcagagt

SEQ ID NO: 9335710 - DNA, 22 bp, Homo sapiens
tcaaggcctatcctcatttgta

SEQ ID NO: 9335711 - DNA, 22 bp, Homo sapiens
tcaaggccagggaatgtagggg

SEQ ID NO: 9335712 - DNA, 21 bp, Homo sapiens
tcaaggccagcctgggcagcc

SEQ ID NO: 9335713 - DNA, 22 bp, Homo sapiens
tcaaggaggtgcttggcttcac

SEQ ID NO: 9335714 - DNA, 22 bp, Homo sapiens
tcaataaatccctctgaccctg

SEQ ID NO: 9335715 - DNA, 22 bp, Homo sapiens
tcaataaaattgttttcctatc

SEQ ID NO: 9335716 - DNA, 18 bp, Homo sapiens
tcaagtgattctcctgcc

SEQ ID NO: 9335717 - DNA, 22 bp, Homo sapiens
tcaagtgagcgtagctgaatgg

SEQ ID NO: 9335718 - DNA, 22 bp, Homo sapiens
tcaagtgcttgtgaggtatttg

SEQ ID NO: 9335719 - DNA, 22 bp, Homo sapiens
tcaagttaggtggttgttagga

SEQ ID NO: 9335720 - DNA, 20 bp, Homo sapiens
tcaatttcaggtagcatagt

SEQ ID NO: 9335721 - DNA, 22 bp, Homo sapiens
tcaataatggcaggataaattt

SEQ ID NO: 9335722 - DNA, 22 bp, Homo sapiens
tcaatacagaaaggatattttg

SEQ ID NO: 9335723 - DNA, 22 bp, Homo sapiens
tcaatttaaggtactactttgg

SEQ ID NO: 9335724 - DNA, 22 bp, Homo sapiens
tcaatttatgtggctattcatt

SEQ ID NO: 9335725 - DNA, 22 bp, Homo sapiens
tcaagagcatgtatctccctaa

SEQ ID NO: 9335726 - DNA, 20 bp, Homo sapiens
tcaaggactccctgggaaga

SEQ ID NO: 9335727 - DNA, 22 bp, Homo sapiens
tcaaggagacagaaagcaatgg

SEQ ID NO: 9335728 - DNA, 22 bp, Homo sapiens
tcaagctgcatcagtgcagtga

SEQ ID NO: 9335729 - DNA, 22 bp, Homo sapiens
tatttctgtttatttgtacatc

SEQ ID NO: 9335730 - DNA, 22 bp, Homo sapiens
tatttcttcgggattcaagcta

SEQ ID NO: 9335731 - DNA, 22 bp, Homo sapiens
tatttcttcgggattcaagcta

SEQ ID NO: 9335732 - DNA, 22 bp, Homo sapiens
tatttcttgagactcgtcttcc

SEQ ID NO: 9335733 - DNA, 22 bp, Homo sapiens
tatttcttgagactcgtcttcc

SEQ ID NO: 9335734 - DNA, 22 bp, Homo sapiens
tatttcttgagtggtcagtttc

SEQ ID NO: 9335735 - DNA, 22 bp, Homo sapiens
tatttcttgagtggtcagtttc

SEQ ID NO: 9335736 - DNA, 22 bp, Homo sapiens
tcaagaagtctgtaccatttga

SEQ ID NO: 9335737 - DNA, 22 bp, Homo sapiens
tatttctgattgctcatgaggc

SEQ ID NO: 9335738 - DNA, 22 bp, Homo sapiens
tatttctgaggcccaggaagtg

SEQ ID NO: 9335739 - DNA, 22 bp, Homo sapiens
tatttctgggagttcagaaatt

SEQ ID NO: 9335740 - DNA, 20 bp, Homo sapiens
tatttctgggcaaccattta

SEQ ID NO: 9335741 - DNA, 22 bp, Homo sapiens
tatttctgggagttcagaaatt

SEQ ID NO: 9335742 - DNA, 22 bp, Homo sapiens
tatttctgtcagccagatatgg

SEQ ID NO: 9335743 - DNA, 22 bp, Homo sapiens
tatttctgtatgcataaaagga

SEQ ID NO: 9335744 - DNA, 22 bp, Homo sapiens
tatttctgtatgcataaaagga

SEQ ID NO: 9335745 - DNA, 20 bp, Homo sapiens
tatttctgggcaaccattta

SEQ ID NO: 9335746 - DNA, 22 bp, Homo sapiens
tatttctgtttatttgtacatc

SEQ ID NO: 9335747 - DNA, 22 bp, Homo sapiens
tatttctgtttatttgtacatc

SEQ ID NO: 9335748 - DNA, 22 bp, Homo sapiens
tatttcttcgggattcaagcta

SEQ ID NO: 9335749 - DNA, 22 bp, Homo sapiens
tatttctgtttatttgtacatc

SEQ ID NO: 9335750 - DNA, 22 bp, Homo sapiens
tatttctgtttatttgtacatc

SEQ ID NO: 9335751 - DNA, 21 bp, Homo sapiens
tcatgcatgagtttatatata

SEQ ID NO: 9335752 - DNA, 22 bp, Homo sapiens
tcatgcattaacacttcatttt

SEQ ID NO: 9335753 - DNA, 22 bp, Homo sapiens
tcatgcattggaatcttcctag

SEQ ID NO: 9335754 - DNA, 22 bp, Homo sapiens
tcatgcattgcagcacattcag

SEQ ID NO: 9335755 - DNA, 22 bp, Homo sapiens
tcatgccacttacaaaataatg

SEQ ID NO: 9335756 - DNA, 23 bp, Homo sapiens
tcatgcccaggctccagatgtca

SEQ ID NO: 9335757 - DNA, 22 bp, Homo sapiens
tcatgcctgattatgttactca

SEQ ID NO: 9335758 - DNA, 22 bp, Homo sapiens
tcatgctcatcattagagtgac

SEQ ID NO: 9335759 - DNA, 22 bp, Homo sapiens
tcatatttaggcctttaattca

SEQ ID NO: 9335760 - DNA, 22 bp, Homo sapiens
tcatatttaggcctttaattca

SEQ ID NO: 9335761 - DNA, 20 bp, Homo sapiens
tcatatgtggttgtatacaa

SEQ ID NO: 9335762 - DNA, 22 bp, Homo sapiens
tcatattagggtaatgataaga

SEQ ID NO: 9335763 - DNA, 22 bp, Homo sapiens
tcatattagggtaatgataaga

SEQ ID NO: 9335764 - DNA, 22 bp, Homo sapiens
tcatattagggtaatgataaga

SEQ ID NO: 9335765 - DNA, 22 bp, Homo sapiens
tcatatttaggcctttaattca

SEQ ID NO: 9335766 - DNA, 22 bp, Homo sapiens
tcatatttatatgttggcacag

SEQ ID NO: 9335767 - DNA, 22 bp, Homo sapiens
tcatatttcaaaatggctggag

SEQ ID NO: 9335768 - DNA, 21 bp, Homo sapiens
tcatatttctcttgctattgt

SEQ ID NO: 9335769 - DNA, 22 bp, Homo sapiens
tcagtgttattagatgaggttt

SEQ ID NO: 9335770 - DNA, 20 bp, Homo sapiens
tcatatgtggttgtatacaa

SEQ ID NO: 9335771 - DNA, 22 bp, Homo sapiens
tcatatgtcactcatgggcata

SEQ ID NO: 9335772 - DNA, 22 bp, Homo sapiens
tcatattaacaatgaaactcag

SEQ ID NO: 9335773 - DNA, 22 bp, Homo sapiens
tcatatctttgtctaccaggaa

SEQ ID NO: 9335774 - DNA, 22 bp, Homo sapiens
tcatatatttagttgtgcaaca

SEQ ID NO: 9335775 - DNA, 22 bp, Homo sapiens
tcatatattttggcagtgatca

SEQ ID NO: 9335776 - DNA, 22 bp, Homo sapiens
tcatatattttggcagtgatca

SEQ ID NO: 9335777 - DNA, 22 bp, Homo sapiens
tcatatatctgcaaagcagtat

SEQ ID NO: 9335778 - DNA, 21 bp, Homo sapiens
tcatatattccagctgcagct

SEQ ID NO: 9335779 - DNA, 22 bp, Homo sapiens
tcatatacctgcatgtgcatgt

SEQ ID NO: 9335780 - DNA, 22 bp, Homo sapiens
tcatataccagagagtttatat

SEQ ID NO: 9335781 - DNA, 22 bp, Homo sapiens
tcatatactgccttgtagatta

SEQ ID NO: 9335782 - DNA, 22 bp, Homo sapiens
tcattattttggactggagtgt

SEQ ID NO: 9335783 - DNA, 22 bp, Homo sapiens
tcattcactttgaaataaacga

SEQ ID NO: 9335784 - DNA, 22 bp, Homo sapiens
tcattcataaaaattagttggc

SEQ ID NO: 9335785 - DNA, 22 bp, Homo sapiens
tcattcatactcttttctatta

SEQ ID NO: 9335786 - DNA, 22 bp, Homo sapiens
tcattatttgctttagttatgt

SEQ ID NO: 9335787 - DNA, 22 bp, Homo sapiens
tcattatcctagtatcttgaat

SEQ ID NO: 9335788 - DNA, 22 bp, Homo sapiens
tcattacagtgtttatatgtct

SEQ ID NO: 9335789 - DNA, 22 bp, Homo sapiens
tcattacatcttggccaaaact

SEQ ID NO: 9335790 - DNA, 22 bp, Homo sapiens
tcatggcattgttaagggtttt

SEQ ID NO: 9335791 - DNA, 22 bp, Homo sapiens
tcatggcagtttaataagtggt

SEQ ID NO: 9335792 - DNA, 22 bp, Homo sapiens
tcatggagactttgagcctgtt

SEQ ID NO: 9335793 - DNA, 22 bp, Homo sapiens
tcatggagactttgagcctgtt

SEQ ID NO: 9335794 - DNA, 22 bp, Homo sapiens
tcatggaagaaaggtttgtttc

SEQ ID NO: 9335795 - DNA, 22 bp, Homo sapiens
tcatggaaggagtggccaagtg

SEQ ID NO: 9335796 - DNA, 20 bp, Homo sapiens
tcatggaatctcactctagt

SEQ ID NO: 9335797 - DNA, 22 bp, Homo sapiens
tcatgctgtgaactgtatacat

SEQ ID NO: 9335798 - DNA, 22 bp, Homo sapiens
tcatgcttattgcatatttgga

SEQ ID NO: 9335799 - DNA, 22 bp, Homo sapiens
tcatgcttaaaagacacttgag

SEQ ID NO: 9335800 - DNA, 22 bp, Homo sapiens
tcatgctttgggttagaaacct

SEQ ID NO: 9335801 - DNA, 22 bp, Homo sapiens
tcagtggttggatgatggtcgc

SEQ ID NO: 9335802 - DNA, 22 bp, Homo sapiens
tcagtgcagggtgggagagaga

SEQ ID NO: 9335803 - DNA, 22 bp, Homo sapiens
tcagtgtcacaggatgctatgc

SEQ ID NO: 9335804 - DNA, 22 bp, Homo sapiens
tcagtgtcatcacttaatataa

SEQ ID NO: 9335805 - DNA, 22 bp, Homo sapiens
tcagtgtcatatcaagaagatg

SEQ ID NO: 9335806 - DNA, 22 bp, Homo sapiens
tcagtgtgttactttctcctat

SEQ ID NO: 9335807 - DNA, 22 bp, Homo sapiens
tcagtgtctatagataaggttt

SEQ ID NO: 9335808 - DNA, 22 bp, Homo sapiens
tcagtgtctcatatgaggtttc

SEQ ID NO: 9335809 - DNA, 22 bp, Homo sapiens
tcagtgtccaaaaagaggcaag

SEQ ID NO: 9335810 - DNA, 22 bp, Homo sapiens
tcagtgcagcggcagcagctct

SEQ ID NO: 9335811 - DNA, 22 bp, Homo sapiens
tcagtgcagaatagtgatgcat

SEQ ID NO: 9335812 - DNA, 22 bp, Homo sapiens
tcagtgcaaaaaatgggctaga

SEQ ID NO: 9335813 - DNA, 22 bp, Homo sapiens
tcagtgcacagagatttttgtt

SEQ ID NO: 9335814 - DNA, 21 bp, Homo sapiens
tcagtgcaattctatggggaa

SEQ ID NO: 9335815 - DNA, 22 bp, Homo sapiens
tcagtgcaatcaaggtatgttt

SEQ ID NO: 9335816 - DNA, 22 bp, Homo sapiens
tcagtgcacaatgacggtggct

SEQ ID NO: 9335817 - DNA, 22 bp, Homo sapiens
tcagtgatttctggggtgaggg

SEQ ID NO: 9335818 - DNA, 22 bp, Homo sapiens
tcagtgatttctggggtgaggg

SEQ ID NO: 9335819 - DNA, 22 bp, Homo sapiens
tcagtctttaaaagctcaggaa

SEQ ID NO: 9335820 - DNA, 22 bp, Homo sapiens
tcagggaatgtgatacaggaag

SEQ ID NO: 9335821 - DNA, 22 bp, Homo sapiens
tcagggaatgatgcacacagtt

SEQ ID NO: 9335822 - DNA, 22 bp, Homo sapiens
tcagggacagggtgctgctgcg

SEQ ID NO: 9335823 - DNA, 22 bp, Homo sapiens
tcaggtggagacctccttggcc

SEQ ID NO: 9335824 - DNA, 21 bp, Homo sapiens
tcaggtggcagagtgtttatg

SEQ ID NO: 9335825 - DNA, 22 bp, Homo sapiens
tcaggtggccaaatgggagcgc

SEQ ID NO: 9335826 - DNA, 22 bp, Homo sapiens
tcagggacccctctgagtggag

SEQ ID NO: 9335827 - DNA, 22 bp, Homo sapiens
tcaggtggccaaatgggagcgc

SEQ ID NO: 9335828 - DNA, 22 bp, Homo sapiens
tcaggtggagacctccttggcc

SEQ ID NO: 9335829 - DNA, 21 bp, Homo sapiens
tcaggtggcagagtgtttatg

SEQ ID NO: 9335830 - DNA, 22 bp, Homo sapiens
tcaggtggccaaatgggagcgc

SEQ ID NO: 9335831 - DNA, 22 bp, Homo sapiens
tcaggtgtcaagcagggagctg

SEQ ID NO: 9335832 - DNA, 22 bp, Homo sapiens
tcaggtgtattgatgtctgtga

SEQ ID NO: 9335833 - DNA, 22 bp, Homo sapiens
tcaggtgtattgatgtctgtga

SEQ ID NO: 9335834 - DNA, 22 bp, Homo sapiens
tcaggtgtattgatgtctgtga

SEQ ID NO: 9335835 - DNA, 17 bp, Homo sapiens
tcagggaatgaggttgt

SEQ ID NO: 9335836 - DNA, 17 bp, Homo sapiens
tcagggaatgaggttgt

SEQ ID NO: 9335837 - DNA, 17 bp, Homo sapiens
tcagggaatgaggttgt

SEQ ID NO: 9335838 - DNA, 22 bp, Homo sapiens
tcagggaatcagactctgcagc

SEQ ID NO: 9335839 - DNA, 22 bp, Homo sapiens
tcagggaataagtagatgagtg

SEQ ID NO: 9335840 - DNA, 22 bp, Homo sapiens
tcagggaataagtagatgagtg

SEQ ID NO: 9335841 - DNA, 22 bp, Homo sapiens
tcagggaagacttcttagagga

SEQ ID NO: 9335842 - DNA, 22 bp, Homo sapiens
tcagggaagacttcttagagga

SEQ ID NO: 9335843 - DNA, 22 bp, Homo sapiens
tcaggtgtggaccgaggtcaga

SEQ ID NO: 9335844 - DNA, 23 bp, Homo sapiens
tcaggtgtgcggactgctgagtc

SEQ ID NO: 9335845 - DNA, 22 bp, Homo sapiens
tcaggtgtgggcagagaaacca

SEQ ID NO: 9335846 - DNA, 22 bp, Homo sapiens
tcaggtgtggaccgaggtcaga

SEQ ID NO: 9335847 - DNA, 23 bp, Homo sapiens
tcaggtgtgcggactgctgagtc

SEQ ID NO: 9335848 - DNA, 16 bp, Homo sapiens
tcaggtgtgacttttt

SEQ ID NO: 9335849 - DNA, 22 bp, Homo sapiens
tcaggtgtgaactatttggaaa

SEQ ID NO: 9335850 - DNA, 22 bp, Homo sapiens
tcaggtgtgaactatttggaaa

SEQ ID NO: 9335851 - DNA, 23 bp, Homo sapiens
tcaggtgtgcggactgctgagtc

SEQ ID NO: 9335852 - DNA, 16 bp, Homo sapiens
tcaggtgtgacttttt

SEQ ID NO: 9335853 - DNA, 16 bp, Homo sapiens
tcaggtgtgacttttt

SEQ ID NO: 9335854 - DNA, 22 bp, Homo sapiens
tcaggtgtcttgtgggatttta

SEQ ID NO: 9335855 - DNA, 22 bp, Homo sapiens
tcaggtgtctgcctctttgagt

SEQ ID NO: 9335856 - DNA, 22 bp, Homo sapiens
tcaggtgtctgcctctttgagt

SEQ ID NO: 9335857 - DNA, 22 bp, Homo sapiens
tcaggtgtgaactatttggaaa

SEQ ID NO: 9335858 - DNA, 22 bp, Homo sapiens
tcaggtgtcttgtgggatttta

SEQ ID NO: 9335859 - DNA, 22 bp, Homo sapiens
tcaggtgtcttgtgggatttta

SEQ ID NO: 9335860 - DNA, 22 bp, Homo sapiens
tcaggtgtctatctaacctggt

SEQ ID NO: 9335861 - DNA, 22 bp, Homo sapiens
tcaggtgtcaagcagggagctg

SEQ ID NO: 9335862 - DNA, 22 bp, Homo sapiens
tcaggtgtcaagcagggagctg

SEQ ID NO: 9335863 - DNA, 22 bp, Homo sapiens
tcaggtgtctgcctctttgagt

SEQ ID NO: 9335864 - DNA, 22 bp, Homo sapiens
tcaggtgtctatctaacctggt

SEQ ID NO: 9335865 - DNA, 22 bp, Homo sapiens
tcaggtgtctatctaacctggt

SEQ ID NO: 9335866 - DNA, 22 bp, Homo sapiens
tcaggtgtggtcaccacagggt

SEQ ID NO: 9335867 - DNA, 22 bp, Homo sapiens
tcaggtgtggtcaccacagggt

SEQ ID NO: 9335868 - DNA, 22 bp, Homo sapiens
tcaggtgtggtcaccacagggt

SEQ ID NO: 9335869 - DNA, 22 bp, Homo sapiens
tcaggtgtgggcagagaaacca

SEQ ID NO: 9335870 - DNA, 22 bp, Homo sapiens
tcaggtgtggaccgaggtcaga

SEQ ID NO: 9335871 - DNA, 22 bp, Homo sapiens
tcaggtgtgggcagagaaacca

SEQ ID NO: 9335872 - DNA, 22 bp, Homo sapiens
tcaggtgtgtggtggaaggcag

SEQ ID NO: 9335873 - DNA, 22 bp, Homo sapiens
tcaggtgtgtggtggaaggcag

SEQ ID NO: 9335874 - DNA, 22 bp, Homo sapiens
tcaggtgtgtggtggaaggcag

SEQ ID NO: 9335875 - DNA, 22 bp, Homo sapiens
tcaggtgtgtggctctggacca

SEQ ID NO: 9335876 - DNA, 22 bp, Homo sapiens
tcaggtgtgtggctctggacca

SEQ ID NO: 9335877 - DNA, 22 bp, Homo sapiens
tcaggtgtgtggctctggacca

SEQ ID NO: 9335878 - DNA, 22 bp, Homo sapiens
tcaggtgtttaaggatagtgat

SEQ ID NO: 9335879 - DNA, 22 bp, Homo sapiens
tcaggtgttctccactcagttt

SEQ ID NO: 9335880 - DNA, 22 bp, Homo sapiens
tcaggtgttctccactcagttt

SEQ ID NO: 9335881 - DNA, 22 bp, Homo sapiens
tcaggtgttctccactcagttt

SEQ ID NO: 9335882 - DNA, 22 bp, Homo sapiens
tcaggtgttagaagaaatttca

SEQ ID NO: 9335883 - DNA, 22 bp, Homo sapiens
tcaggtgttagaagaaatttca

SEQ ID NO: 9335884 - DNA, 22 bp, Homo sapiens
tcaggtgtgttgtattttacca

SEQ ID NO: 9335885 - DNA, 22 bp, Homo sapiens
tcaggtgtgttgtattttacca

SEQ ID NO: 9335886 - DNA, 22 bp, Homo sapiens
tcaggtgtgttgtattttacca

SEQ ID NO: 9335887 - DNA, 22 bp, Homo sapiens
tcaggtgttagaagaaatttca

SEQ ID NO: 9335888 - DNA, 18 bp, Homo sapiens
tcaggtgttttctgtata

SEQ ID NO: 9335889 - DNA, 22 bp, Homo sapiens
tcaggtgtttaaggatagtgat

SEQ ID NO: 9335890 - DNA, 22 bp, Homo sapiens
tcaggtgtttctggagaagtaa

SEQ ID NO: 9335891 - DNA, 22 bp, Homo sapiens
tcaggtgtttctggagaagtaa

SEQ ID NO: 9335892 - DNA, 22 bp, Homo sapiens
tcaggtgtttaaggatagtgat

SEQ ID NO: 9335893 - DNA, 22 bp, Homo sapiens
tcaggttcagactagtcccagt

SEQ ID NO: 9335894 - DNA, 18 bp, Homo sapiens
tcaggtgttttctgtata

SEQ ID NO: 9335895 - DNA, 22 bp, Homo sapiens
tcaggttcagactagtcccagt

SEQ ID NO: 9335896 - DNA, 22 bp, Homo sapiens
tcaggtgtttctggagaagtaa

SEQ ID NO: 9335897 - DNA, 18 bp, Homo sapiens
tcaggtgttttctgtata

SEQ ID NO: 9335898 - DNA, 22 bp, Homo sapiens
tcagtctctggggcttctgttt

SEQ ID NO: 9335899 - DNA, 17 bp, Homo sapiens
tcagtctctgtcctgga

SEQ ID NO: 9335900 - DNA, 22 bp, Homo sapiens
tcagtctcctttcctctagaca

SEQ ID NO: 9335901 - DNA, 22 bp, Homo sapiens
tcaggttctggtgagggccctt

SEQ ID NO: 9335902 - DNA, 22 bp, Homo sapiens
tcaggtttttctcaaatcaggt

SEQ ID NO: 9335903 - DNA, 17 bp, Homo sapiens
tcagtctctgtcctgga

SEQ ID NO: 9335904 - DNA, 23 bp, Homo sapiens
tcagtcttccctgtcagtaatag

SEQ ID NO: 9335905 - DNA, 22 bp, Homo sapiens
tcagtcttccctccagtgcaac

SEQ ID NO: 9335906 - DNA, 23 bp, Homo sapiens
tcagtcttggcttctgattttcc

SEQ ID NO: 9335907 - DNA, 22 bp, Homo sapiens
tcagtcttgaacagccccctgt

SEQ ID NO: 9335908 - DNA, 22 bp, Homo sapiens
tcagtcttgcttctcttgggtc

SEQ ID NO: 9335909 - DNA, 22 bp, Homo sapiens
tcagtcttctaaagggatgcaa

SEQ ID NO: 9335910 - DNA, 22 bp, Homo sapiens
tcagcaggcacaccaaaaactg

SEQ ID NO: 9335911 - DNA, 21 bp, Homo sapiens
tcagcagcttttgcagtccct

SEQ ID NO: 9335912 - DNA, 21 bp, Homo sapiens
tcagcagcttttgcagtccct

SEQ ID NO: 9335913 - DNA, 22 bp, Homo sapiens
tcagcagaagtatagaggccat

SEQ ID NO: 9335914 - DNA, 21 bp, Homo sapiens
tcagcagcttttgcagtccct

SEQ ID NO: 9335915 - DNA, 22 bp, Homo sapiens
tcagcaggcacggacaggctgc

SEQ ID NO: 9335916 - DNA, 22 bp, Homo sapiens
tcagcaggcaccggaagtgttt

SEQ ID NO: 9335917 - DNA, 22 bp, Homo sapiens
tcagcaggcaccggaagtgttt

SEQ ID NO: 9335918 - DNA, 22 bp, Homo sapiens
tcagcaggcaccggaagtgttt

SEQ ID NO: 9335919 - DNA, 22 bp, Homo sapiens
tcagcaggcacaccaaaaactg

SEQ ID NO: 9335920 - DNA, 21 bp, Homo sapiens
tcagcaggcaccagaaggctg

SEQ ID NO: 9335921 - DNA, 21 bp, Homo sapiens
tcagcaggcaccagaaggctg

SEQ ID NO: 9335922 - DNA, 22 bp, Homo sapiens
tcagcaggcagaaatctgcaga

SEQ ID NO: 9335923 - DNA, 22 bp, Homo sapiens
tcagcaggcagaaatctgcaga

SEQ ID NO: 9335924 - DNA, 22 bp, Homo sapiens
tcagcaggcacggacaggctgc

SEQ ID NO: 9335925 - DNA, 22 bp, Homo sapiens
tcagcctgctccaagtgctgcc

SEQ ID NO: 9335926 - DNA, 22 bp, Homo sapiens
tcagcctgctccaagtgctgcc

SEQ ID NO: 9335927 - DNA, 22 bp, Homo sapiens
tcagctcctatactttgtcctg

SEQ ID NO: 9335928 - DNA, 22 bp, Homo sapiens
tcagctcctcagagcctcagtt

SEQ ID NO: 9335929 - DNA, 22 bp, Homo sapiens
tcagctcctcagagcctcagtt

SEQ ID NO: 9335930 - DNA, 22 bp, Homo sapiens
tcagctccagagttgcacagtg

SEQ ID NO: 9335931 - DNA, 22 bp, Homo sapiens
tcagctccagagttgcacagtg

SEQ ID NO: 9335932 - DNA, 22 bp, Homo sapiens
tcagctcctcatgcaggggata

SEQ ID NO: 9335933 - DNA, 22 bp, Homo sapiens
tcagctcctcatgcaggggata

SEQ ID NO: 9335934 - DNA, 22 bp, Homo sapiens
tcagctcctcagagcctcagtt

SEQ ID NO: 9335935 - DNA, 22 bp, Homo sapiens
tcagctctacacacacctgtgt

SEQ ID NO: 9335936 - DNA, 22 bp, Homo sapiens
tcagctctgcaaggtcacctcc

SEQ ID NO: 9335937 - DNA, 22 bp, Homo sapiens
tcagcctggtgattcctctgtc

SEQ ID NO: 9335938 - DNA, 22 bp, Homo sapiens
tcagcctggtgattcctctgtc

SEQ ID NO: 9335939 - DNA, 22 bp, Homo sapiens
tcagctccacagctcctctgcc

SEQ ID NO: 9335940 - DNA, 22 bp, Homo sapiens
tcagctcatctgagtgtcagcg

SEQ ID NO: 9335941 - DNA, 22 bp, Homo sapiens
tcagccttgtggccctgctcca

SEQ ID NO: 9335942 - DNA, 22 bp, Homo sapiens
tcaggaaggagctggcctgcca

SEQ ID NO: 9335943 - DNA, 22 bp, Homo sapiens
tcaggaaggagctggcctgcca

SEQ ID NO: 9335944 - DNA, 22 bp, Homo sapiens
tcaggaaggcaaattgcatgat

SEQ ID NO: 9335945 - DNA, 22 bp, Homo sapiens
tcaggaaggcaaattgcatgat

SEQ ID NO: 9335946 - DNA, 22 bp, Homo sapiens
tcaggaagctgctctgggtggt

SEQ ID NO: 9335947 - DNA, 22 bp, Homo sapiens
tcaggaagctgctctgggtggt

SEQ ID NO: 9335948 - DNA, 22 bp, Homo sapiens
tcaggaagctgctctgggtggt

SEQ ID NO: 9335949 - DNA, 22 bp, Homo sapiens
tcaggaagctgaattacaaaaa

SEQ ID NO: 9335950 - DNA, 22 bp, Homo sapiens
tcaggaagctgaattacaaaaa

SEQ ID NO: 9335951 - DNA, 22 bp, Homo sapiens
tcaggaaggcacttggtgtgtt

SEQ ID NO: 9335952 - DNA, 22 bp, Homo sapiens
tcaggaaggcacttggtgtgtt

SEQ ID NO: 9335953 - DNA, 22 bp, Homo sapiens
tcaggaaggcaaattgcatgat

SEQ ID NO: 9335954 - DNA, 22 bp, Homo sapiens
tcaggaaggcacttggtgtgtt

SEQ ID NO: 9335955 - DNA, 22 bp, Homo sapiens
tcaggaaggcgccccatcagga

SEQ ID NO: 9335956 - DNA, 22 bp, Homo sapiens
tcaggaaggcgccccatcagga

SEQ ID NO: 9335957 - DNA, 22 bp, Homo sapiens
tcaggaaggcttcacacgagtg

SEQ ID NO: 9335958 - DNA, 22 bp, Homo sapiens
tcaggaaggcttcacacgagtg

SEQ ID NO: 9335959 - DNA, 22 bp, Homo sapiens
tcaggaggttgaccacggggca

SEQ ID NO: 9335960 - DNA, 17 bp, Homo sapiens
tcaggaggtgtttctag

SEQ ID NO: 9335961 - DNA, 22 bp, Homo sapiens
tcaggaggtgtaggtcaagtga

SEQ ID NO: 9335962 - DNA, 22 bp, Homo sapiens
tcaggaagggctcagtctgtgc

SEQ ID NO: 9335963 - DNA, 22 bp, Homo sapiens
tcaggaggtttggattcagtta

SEQ ID NO: 9335964 - DNA, 22 bp, Homo sapiens
tcaggagtaaagaagacttgac

SEQ ID NO: 9335965 - DNA, 22 bp, Homo sapiens
tcaggagtaaagacagagttcc

SEQ ID NO: 9335966 - DNA, 22 bp, Homo sapiens
tcaggagtaagggtaacccaga

SEQ ID NO: 9335967 - DNA, 22 bp, Homo sapiens
tcaggagtaagttataagtatt

SEQ ID NO: 9335968 - DNA, 22 bp, Homo sapiens
tcaggagtcctgcctgcagcct

SEQ ID NO: 9335969 - DNA, 22 bp, Homo sapiens
tcaggagtactggtgtctacag

SEQ ID NO: 9335970 - DNA, 22 bp, Homo sapiens
tcaggagtcctgcctgcagcct

SEQ ID NO: 9335971 - DNA, 22 bp, Homo sapiens
tcaggagtctgtgcagttccac

SEQ ID NO: 9335972 - DNA, 22 bp, Homo sapiens
tcaggaagaaagaagggagtgt

SEQ ID NO: 9335973 - DNA, 22 bp, Homo sapiens
tcaggaagaaagaagggagtgt

SEQ ID NO: 9335974 - DNA, 22 bp, Homo sapiens
tcaggaagaaattctgtatctt

SEQ ID NO: 9335975 - DNA, 22 bp, Homo sapiens
tcaggaagaaattctgtatctt

SEQ ID NO: 9335976 - DNA, 22 bp, Homo sapiens
tcaggaagacaatctttggctc

SEQ ID NO: 9335977 - DNA, 22 bp, Homo sapiens
tcaggaagacaatctttggctc

SEQ ID NO: 9335978 - DNA, 22 bp, Homo sapiens
tcaggaagacaatctttggctc

SEQ ID NO: 9335979 - DNA, 22 bp, Homo sapiens
tcaggaagaagacggggcagga

SEQ ID NO: 9335980 - DNA, 22 bp, Homo sapiens
tcaggaagaagacggggcagga

SEQ ID NO: 9335981 - DNA, 22 bp, Homo sapiens
tcaggaagaagacggggcagga

SEQ ID NO: 9335982 - DNA, 22 bp, Homo sapiens
tcagctctgcaaggtcacctcc

SEQ ID NO: 9335983 - DNA, 22 bp, Homo sapiens
tcaggaagccggttaaatagat

SEQ ID NO: 9335984 - DNA, 22 bp, Homo sapiens
tcaggaagccggttaaatagat

SEQ ID NO: 9335985 - DNA, 22 bp, Homo sapiens
tcaggaagcatcctgaggtgtc

SEQ ID NO: 9335986 - DNA, 22 bp, Homo sapiens
tcaggaagccactccacagaga

SEQ ID NO: 9335987 - DNA, 22 bp, Homo sapiens
tcaggaagccactccacagaga

SEQ ID NO: 9335988 - DNA, 22 bp, Homo sapiens
tcaggaagctactgccagcagc

SEQ ID NO: 9335989 - DNA, 22 bp, Homo sapiens
tcaggaagctactgccagcagc

SEQ ID NO: 9335990 - DNA, 22 bp, Homo sapiens
tcaggaagctcttgctgattct

SEQ ID NO: 9335991 - DNA, 22 bp, Homo sapiens
tcaggaagctcttgctgattct

SEQ ID NO: 9335992 - DNA, 21 bp, Homo sapiens
tcaggaagagccagttcatgc

SEQ ID NO: 9335993 - DNA, 21 bp, Homo sapiens
tcaggaagagccagttcatgc

SEQ ID NO: 9335994 - DNA, 21 bp, Homo sapiens
tcaggaagagcttctcccact

SEQ ID NO: 9335995 - DNA, 21 bp, Homo sapiens
tcaggaagagcttctcccact

SEQ ID NO: 9335996 - DNA, 22 bp, Homo sapiens
tcaggaagattagtttcctacc

SEQ ID NO: 9335997 - DNA, 22 bp, Homo sapiens
tcaggaagattagtttcctacc

SEQ ID NO: 9335998 - DNA, 22 bp, Homo sapiens
tcaggaagcatcctgaggtgtc

SEQ ID NO: 9335999 - DNA, 22 bp, Homo sapiens
tcaggaagcatcctgaggtgtc

SEQ ID NO: 9336000 - DNA, 16 bp, Homo sapiens
tcaggcctggacgagc

SEQ ID NO: 9336001 - DNA, 22 bp, Homo sapiens
tcaggcctggagaaaggaatga

SEQ ID NO: 9336002 - DNA, 22 bp, Homo sapiens
tcaggcctgtgctggaggagat

SEQ ID NO: 9336003 - DNA, 22 bp, Homo sapiens
tcaggcctgtgctggaggagat

SEQ ID NO: 9336004 - DNA, 22 bp, Homo sapiens
tcaggctgaggtcatctgcatc

SEQ ID NO: 9336005 - DNA, 22 bp, Homo sapiens
tcaggctgctggccagcaggct

SEQ ID NO: 9336006 - DNA, 22 bp, Homo sapiens
tcaggctgctggccagcaggct

SEQ ID NO: 9336007 - DNA, 22 bp, Homo sapiens
tcaggctgctggccagcaggct

SEQ ID NO: 9336008 - DNA, 22 bp, Homo sapiens
tcaggctgctggccagcaggct

SEQ ID NO: 9336009 - DNA, 21 bp, Homo sapiens
tcaggctgatgtcgatgttag

SEQ ID NO: 9336010 - DNA, 22 bp, Homo sapiens
tcaggctgataggaggaactga

SEQ ID NO: 9336011 - DNA, 22 bp, Homo sapiens
tcaggctgataggaggaactga

SEQ ID NO: 9336012 - DNA, 22 bp, Homo sapiens
tcaggctggaatgcagtggggc

SEQ ID NO: 9336013 - DNA, 22 bp, Homo sapiens
tcaggctggagtgcagtggcgc

SEQ ID NO: 9336014 - DNA, 22 bp, Homo sapiens
tcaggctggaatgcagtggggc

SEQ ID NO: 9336015 - DNA, 22 bp, Homo sapiens
tcaggctggagtgcagtggcgc

SEQ ID NO: 9336016 - DNA, 22 bp, Homo sapiens
tcaggctggagtgcagtggcgc

SEQ ID NO: 9336017 - DNA, 22 bp, Homo sapiens
tcaggctgctttcatgcttaga

SEQ ID NO: 9336018 - DNA, 18 bp, Homo sapiens
tcaggctggaagtttgcc

SEQ ID NO: 9336019 - DNA, 22 bp, Homo sapiens
tcaggctgctgtactgtgaatg

SEQ ID NO: 9336020 - DNA, 22 bp, Homo sapiens
tcaggctgctgtactgtgaatg

SEQ ID NO: 9336021 - DNA, 22 bp, Homo sapiens
tcaggctgctttcatgcttaga

SEQ ID NO: 9336022 - DNA, 22 bp, Homo sapiens
tcaggctgctttcatgcttaga

SEQ ID NO: 9336023 - DNA, 22 bp, Homo sapiens
tcagggaaatagcagggctgaa

SEQ ID NO: 9336024 - DNA, 22 bp, Homo sapiens
tcagggaaaggggagagtcatt

SEQ ID NO: 9336025 - DNA, 22 bp, Homo sapiens
tcagggaaacctaaggaagcca

SEQ ID NO: 9336026 - DNA, 22 bp, Homo sapiens
tcagggaaaagtcacactgggt

SEQ ID NO: 9336027 - DNA, 22 bp, Homo sapiens
tcagggaaaagtcacactgggt

SEQ ID NO: 9336028 - DNA, 22 bp, Homo sapiens
tcagggaaattcaagggagatt

SEQ ID NO: 9336029 - DNA, 22 bp, Homo sapiens
tcagggaaattcaagggagatt

SEQ ID NO: 9336030 - DNA, 22 bp, Homo sapiens
tcagggaaatttccatgtgttt

SEQ ID NO: 9336031 - DNA, 22 bp, Homo sapiens
tcagggaaatagcagggctgaa

SEQ ID NO: 9336032 - DNA, 22 bp, Homo sapiens
tcagggaaatttccatgtgttt

SEQ ID NO: 9336033 - DNA, 22 bp, Homo sapiens
tcagggaacaatgttatggctt

SEQ ID NO: 9336034 - DNA, 22 bp, Homo sapiens
tcaggctttttctcaacctctt

SEQ ID NO: 9336035 - DNA, 22 bp, Homo sapiens
tcaggctttttctcaacctctt

SEQ ID NO: 9336036 - DNA, 22 bp, Homo sapiens
tcaggctggggtgctaaggtgt

SEQ ID NO: 9336037 - DNA, 22 bp, Homo sapiens
tcaggctgggctcctctcccca

SEQ ID NO: 9336038 - DNA, 22 bp, Homo sapiens
tcaggctgggctcctctcccca

SEQ ID NO: 9336039 - DNA, 22 bp, Homo sapiens
tcaggctgggctcctctcccca

SEQ ID NO: 9336040 - DNA, 22 bp, Homo sapiens
tcaggctggggtgctaaggtgt

SEQ ID NO: 9336041 - DNA, 18 bp, Homo sapiens
tcaggctgggcctccttc

SEQ ID NO: 9336042 - DNA, 22 bp, Homo sapiens
tcaggctgggagacaatcactg

SEQ ID NO: 9336043 - DNA, 18 bp, Homo sapiens
tcaggctgggcctccttc

SEQ ID NO: 9336044 - DNA, 18 bp, Homo sapiens
tcaggctgggcctccttc

SEQ ID NO: 9336045 - DNA, 22 bp, Homo sapiens
tcaggctgggctcctctcccca

SEQ ID NO: 9336046 - DNA, 18 bp, Homo sapiens
tcaggctgggcctccttc

SEQ ID NO: 9336047 - DNA, 18 bp, Homo sapiens
tcaggctgggcctccttc

SEQ ID NO: 9336048 - DNA, 22 bp, Homo sapiens
tcaggctgggagacaatcactg

SEQ ID NO: 9336049 - DNA, 22 bp, Homo sapiens
tcaggctgggagacaatcactg

SEQ ID NO: 9336050 - DNA, 22 bp, Homo sapiens
tcaggctggagtgcagtggcgc

SEQ ID NO: 9336051 - DNA, 22 bp, Homo sapiens
tcaggagttgaaggggatcctg

SEQ ID NO: 9336052 - DNA, 19 bp, Homo sapiens
tcaggagttagttgtgctc

SEQ ID NO: 9336053 - DNA, 22 bp, Homo sapiens
tcaggagtttcaggtgtaagtg

SEQ ID NO: 9336054 - DNA, 22 bp, Homo sapiens
tcaggagtttggcctacagagg

SEQ ID NO: 9336055 - DNA, 22 bp, Homo sapiens
tcaggagtttggcctacagagg

SEQ ID NO: 9336056 - DNA, 21 bp, Homo sapiens
tcaggagtggagagaattggt

SEQ ID NO: 9336057 - DNA, 22 bp, Homo sapiens
tcaggagtgcagcagtttggag

SEQ ID NO: 9336058 - DNA, 22 bp, Homo sapiens
tcaggagtgccagtaccttttg

SEQ ID NO: 9336059 - DNA, 22 bp, Homo sapiens
tcaggagtgataccatttgtca

SEQ ID NO: 9336060 - DNA, 22 bp, Homo sapiens
tcaggagtgataccatttgtca

SEQ ID NO: 9336061 - DNA, 18 bp, Homo sapiens
tcaggagtttgtggatgg

SEQ ID NO: 9336062 - DNA, 22 bp, Homo sapiens
tcaggatgaagtcagaggggtc

SEQ ID NO: 9336063 - DNA, 22 bp, Homo sapiens
tcaggatgaagtcagaggggtc

SEQ ID NO: 9336064 - DNA, 22 bp, Homo sapiens
tcaggatgacttcaaggaggaa

SEQ ID NO: 9336065 - DNA, 22 bp, Homo sapiens
tcaggatgacttcaaggaggaa

SEQ ID NO: 9336066 - DNA, 21 bp, Homo sapiens
tcaggcagtgcaaatacatgg

SEQ ID NO: 9336067 - DNA, 22 bp, Homo sapiens
tcaggcagtctgactccggagg

SEQ ID NO: 9336068 - DNA, 21 bp, Homo sapiens
tcaggcagtgcaaatacatgg

SEQ ID NO: 9336069 - DNA, 21 bp, Homo sapiens
tcaggcagtgcaaatacatgg

SEQ ID NO: 9336070 - DNA, 22 bp, Homo sapiens
tcaggatgttaatatagcatta

SEQ ID NO: 9336071 - DNA, 22 bp, Homo sapiens
tcaggatggagtctatccagtg

SEQ ID NO: 9336072 - DNA, 22 bp, Homo sapiens
tcaggatgacttcaaggaggaa

SEQ ID NO: 9336073 - DNA, 17 bp, Homo sapiens
tcaggatgtagcagtag

SEQ ID NO: 9336074 - DNA, 22 bp, Homo sapiens
tcaggatggcttctgcatcaaa

SEQ ID NO: 9336075 - DNA, 22 bp, Homo sapiens
tcaggccaaggtagacatgact

SEQ ID NO: 9336076 - DNA, 19 bp, Homo sapiens
tcaggcagttattcacaaa

SEQ ID NO: 9336077 - DNA, 19 bp, Homo sapiens
tcaggcagttattcacaaa

SEQ ID NO: 9336078 - DNA, 19 bp, Homo sapiens
tcaggcagttattcacaaa

SEQ ID NO: 9336079 - DNA, 22 bp, Homo sapiens
tcaggcagtggtaaatgagtta

SEQ ID NO: 9336080 - DNA, 19 bp, Homo sapiens
tcaggcagttattcacaaa

SEQ ID NO: 9336081 - DNA, 20 bp, Homo sapiens
tcaggcagtggggaaaggca

SEQ ID NO: 9336082 - DNA, 20 bp, Homo sapiens
tcaggcagtggggaaaggca

SEQ ID NO: 9336083 - DNA, 22 bp, Homo sapiens
tcaggcctgcaggcttcctgga

SEQ ID NO: 9336084 - DNA, 22 bp, Homo sapiens
tcaggcctgcaggcttcctgga

SEQ ID NO: 9336085 - DNA, 22 bp, Homo sapiens
tcaggcctgccctgaaagcaca

SEQ ID NO: 9336086 - DNA, 22 bp, Homo sapiens
tcaggcctgctgtatgatggat

SEQ ID NO: 9336087 - DNA, 22 bp, Homo sapiens
tcaggcctgccctgaaagcaca

SEQ ID NO: 9336088 - DNA, 22 bp, Homo sapiens
tcaggcctgcagtgccaaccca

SEQ ID NO: 9336089 - DNA, 22 bp, Homo sapiens
tcaggcctgcagtgccaaccca

SEQ ID NO: 9336090 - DNA, 22 bp, Homo sapiens
tcaggccacttcacaggtgatt

SEQ ID NO: 9336091 - DNA, 22 bp, Homo sapiens
tcaggcctgcaaatgaatggta

SEQ ID NO: 9336092 - DNA, 22 bp, Homo sapiens
tcaggcctgcaaatgaatggta

SEQ ID NO: 9336093 - DNA, 22 bp, Homo sapiens
tcaggccacttcacaggtgatt

SEQ ID NO: 9336094 - DNA, 22 bp, Homo sapiens
gctgcctcaggcacctcctggc

SEQ ID NO: 9336095 - DNA, 22 bp, Homo sapiens
gctgcctcaggcacctcctggc

SEQ ID NO: 9336096 - DNA, 22 bp, Homo sapiens
gctgcctgtcctgaggagtccg

SEQ ID NO: 9336097 - DNA, 22 bp, Homo sapiens
gctgcctgtcctgaggagtccg

SEQ ID NO: 9336098 - DNA, 22 bp, Homo sapiens
gctgccctaatatcacatgtta

SEQ ID NO: 9336099 - DNA, 22 bp, Homo sapiens
gctgccccgagccatccttcag

SEQ ID NO: 9336100 - DNA, 22 bp, Homo sapiens
gctgccccccggactcggcggg

SEQ ID NO: 9336101 - DNA, 22 bp, Homo sapiens
gctgccccagctgggggctgga

SEQ ID NO: 9336102 - DNA, 22 bp, Homo sapiens
gctgcccattgctctcccactc

SEQ ID NO: 9336103 - DNA, 22 bp, Homo sapiens
gctgcccattccactggatggt

SEQ ID NO: 9336104 - DNA, 22 bp, Homo sapiens
gctgccctagaagtacagagag

SEQ ID NO: 9336105 - DNA, 22 bp, Homo sapiens
gctgccctgtggtccagcaggt

SEQ ID NO: 9336106 - DNA, 22 bp, Homo sapiens
gctgccctgtctgcagcaggac

SEQ ID NO: 9336107 - DNA, 18 bp, Homo sapiens
gctgccctagctcccctc

SEQ ID NO: 9336108 - DNA, 18 bp, Homo sapiens
gctgccctagctcccctc

SEQ ID NO: 9336109 - DNA, 22 bp, Homo sapiens
gctgagggcatgtgtggcgact

SEQ ID NO: 9336110 - DNA, 22 bp, Homo sapiens
gctgagggcagcctcctaggtc

SEQ ID NO: 9336111 - DNA, 22 bp, Homo sapiens
gctgagggcagcctcctaggtc

SEQ ID NO: 9336112 - DNA, 22 bp, Homo sapiens
gctgagggcagcctcctaggtc

SEQ ID NO: 9336113 - DNA, 22 bp, Homo sapiens
gctgagggatagctgctcactg

SEQ ID NO: 9336114 - DNA, 22 bp, Homo sapiens
gctgcccaattacagggccgtg

SEQ ID NO: 9336115 - DNA, 22 bp, Homo sapiens
gctgagggccgcatagggtcat

SEQ ID NO: 9336116 - DNA, 22 bp, Homo sapiens
gctgcccacaaccccgtgtcta

SEQ ID NO: 9336117 - DNA, 22 bp, Homo sapiens
gctgcccagcaggccccagggg

SEQ ID NO: 9336118 - DNA, 22 bp, Homo sapiens
gctgcccagtgtgctcatgcag

SEQ ID NO: 9336119 - DNA, 22 bp, Homo sapiens
gctgcccagggtggagccggct

SEQ ID NO: 9336120 - DNA, 22 bp, Homo sapiens
gctgcccaggcaacattgactt

SEQ ID NO: 9336121 - DNA, 22 bp, Homo sapiens
gctgctcagtgggcctgagcct

SEQ ID NO: 9336122 - DNA, 22 bp, Homo sapiens
gctgctccagtgttctgtctag

SEQ ID NO: 9336123 - DNA, 21 bp, Homo sapiens
gctgctcgagatccagtgctt

SEQ ID NO: 9336124 - DNA, 21 bp, Homo sapiens
gctgctcgagatccagtgctt

SEQ ID NO: 9336125 - DNA, 22 bp, Homo sapiens
gctgctgtctcatgcgatgcgg

SEQ ID NO: 9336126 - DNA, 22 bp, Homo sapiens
gctgctgtgaattttttaaatg

SEQ ID NO: 9336127 - DNA, 22 bp, Homo sapiens
gctgctgtgaattttttaaatg

SEQ ID NO: 9336128 - DNA, 22 bp, Homo sapiens
gctgctgtctggtctgagggct

SEQ ID NO: 9336129 - DNA, 21 bp, Homo sapiens
gctgctgtgggccagggaggc

SEQ ID NO: 9336130 - DNA, 22 bp, Homo sapiens
gctgctgtggcagattggattc

SEQ ID NO: 9336131 - DNA, 22 bp, Homo sapiens
gctgctgtgcctggcgtcctgt

SEQ ID NO: 9336132 - DNA, 22 bp, Homo sapiens
gctgctgtgcctggcgtcctgt

SEQ ID NO: 9336133 - DNA, 22 bp, Homo sapiens
gctgctgtgcctggcgtcctgt

SEQ ID NO: 9336134 - DNA, 22 bp, Homo sapiens
gctgctgtgccccatctgcaga

SEQ ID NO: 9336135 - DNA, 22 bp, Homo sapiens
gctgcttcctagaaggcccagt

SEQ ID NO: 9336136 - DNA, 22 bp, Homo sapiens
gctgctgttgatttagtccaat

SEQ ID NO: 9336137 - DNA, 22 bp, Homo sapiens
gctgctgttgatttagtccaat

SEQ ID NO: 9336138 - DNA, 22 bp, Homo sapiens
gctgctgttcctccagtggatc

SEQ ID NO: 9336139 - DNA, 22 bp, Homo sapiens
gctgctgtgttggagagggact

SEQ ID NO: 9336140 - DNA, 22 bp, Homo sapiens
gctgctgtgtgggagacaggcg

SEQ ID NO: 9336141 - DNA, 22 bp, Homo sapiens
gctgctgtgttctcttgaccca

SEQ ID NO: 9336142 - DNA, 22 bp, Homo sapiens
gctgctgtgttctcttgaccca

SEQ ID NO: 9336143 - DNA, 21 bp, Homo sapiens
gctgctgtgggccagggaggc

SEQ ID NO: 9336144 - DNA, 22 bp, Homo sapiens
gctgctgttccggctacagccc

SEQ ID NO: 9336145 - DNA, 22 bp, Homo sapiens
gctgctgtgttggccactgctt

SEQ ID NO: 9336146 - DNA, 22 bp, Homo sapiens
gctgctgttatgatgttacttt

SEQ ID NO: 9336147 - DNA, 22 bp, Homo sapiens
gctgcctgttgaagggtctgtg

SEQ ID NO: 9336148 - DNA, 22 bp, Homo sapiens
gctgcctgtgtggccactcact

SEQ ID NO: 9336149 - DNA, 22 bp, Homo sapiens
gctgcctgtcctgaggagtccg

SEQ ID NO: 9336150 - DNA, 22 bp, Homo sapiens
gctgcctgtctgctgacccagg

SEQ ID NO: 9336151 - DNA, 22 bp, Homo sapiens
gctgcctgtctgctgacccagg

SEQ ID NO: 9336152 - DNA, 22 bp, Homo sapiens
gctgcctgtctgctgacccagg

SEQ ID NO: 9336153 - DNA, 22 bp, Homo sapiens
gctgcctgtgcgggtcgctagg

SEQ ID NO: 9336154 - DNA, 22 bp, Homo sapiens
gctgcctgtgcgggtcgctagg

SEQ ID NO: 9336155 - DNA, 22 bp, Homo sapiens
gctgcgccggatcccacgttcc

SEQ ID NO: 9336156 - DNA, 20 bp, Homo sapiens
gctgcggttacagagacaca

SEQ ID NO: 9336157 - DNA, 22 bp, Homo sapiens
gctgcggctgtggaggtaccac

SEQ ID NO: 9336158 - DNA, 22 bp, Homo sapiens
gctgctagacagcatgtgagct

SEQ ID NO: 9336159 - DNA, 22 bp, Homo sapiens
gctgctcactgaaggaccctgt

SEQ ID NO: 9336160 - DNA, 22 bp, Homo sapiens
gctgctaagcgtttctgttcca

SEQ ID NO: 9336161 - DNA, 22 bp, Homo sapiens
gctgccttatgtctattagtat

SEQ ID NO: 9336162 - DNA, 22 bp, Homo sapiens
gctgccttagagggagtggttc

SEQ ID NO: 9336163 - DNA, 22 bp, Homo sapiens
gctgccttaacttcttcgctgt

SEQ ID NO: 9336164 - DNA, 22 bp, Homo sapiens
gctgccttcagttctgattcat

SEQ ID NO: 9336165 - DNA, 22 bp, Homo sapiens
gctgcctgttgaagggtctgtg

SEQ ID NO: 9336166 - DNA, 22 bp, Homo sapiens
gctgagacttccactgccatct

SEQ ID NO: 9336167 - DNA, 22 bp, Homo sapiens
gctgagagaaaagtgaggttct

SEQ ID NO: 9336168 - DNA, 22 bp, Homo sapiens
gctgagactggcagcaggaagt

SEQ ID NO: 9336169 - DNA, 22 bp, Homo sapiens
gctgagagatcaaggcaggatt

SEQ ID NO: 9336170 - DNA, 22 bp, Homo sapiens
gctgagagatcaaggcaggatt

SEQ ID NO: 9336171 - DNA, 22 bp, Homo sapiens
gctgagagaaaagtgaggttct

SEQ ID NO: 9336172 - DNA, 22 bp, Homo sapiens
gctgagagatcaaggcaggatt

SEQ ID NO: 9336173 - DNA, 22 bp, Homo sapiens
gctgagagatcaaggcaggatt

SEQ ID NO: 9336174 - DNA, 22 bp, Homo sapiens
gctgagaggcagccagaccctc

SEQ ID NO: 9336175 - DNA, 22 bp, Homo sapiens
gctgagagtccaggaaaacatc

SEQ ID NO: 9336176 - DNA, 22 bp, Homo sapiens
gctgagagtgagcactggatat

SEQ ID NO: 9336177 - DNA, 17 bp, Homo sapiens
gctgagaggcagcacag

SEQ ID NO: 9336178 - DNA, 17 bp, Homo sapiens
gctgagaggcagcacag

SEQ ID NO: 9336179 - DNA, 22 bp, Homo sapiens
gctgagagatcaaggcaggatt

SEQ ID NO: 9336180 - DNA, 22 bp, Homo sapiens
gctgagagcaaagcatgtctag

SEQ ID NO: 9336181 - DNA, 22 bp, Homo sapiens
gctgagagcggccagctgggaa

SEQ ID NO: 9336182 - DNA, 22 bp, Homo sapiens
gctgagagcggccagctgggaa

SEQ ID NO: 9336183 - DNA, 22 bp, Homo sapiens
gctgagagcggccagctgggaa

SEQ ID NO: 9336184 - DNA, 22 bp, Homo sapiens
gctgagagcacatagaaggggc

SEQ ID NO: 9336185 - DNA, 22 bp, Homo sapiens
gctgaggctcaagtcatgggtc

SEQ ID NO: 9336186 - DNA, 22 bp, Homo sapiens
gctgaggctcaagtcatgggtc

SEQ ID NO: 9336187 - DNA, 22 bp, Homo sapiens
gctgaggcggaaggattgctag

SEQ ID NO: 9336188 - DNA, 22 bp, Homo sapiens
gctgaggcggaaggattgctag

SEQ ID NO: 9336189 - DNA, 22 bp, Homo sapiens
gctgaggcggaaggattgctag

SEQ ID NO: 9336190 - DNA, 22 bp, Homo sapiens
gctgaggcctcagaaggctgag

SEQ ID NO: 9336191 - DNA, 22 bp, Homo sapiens
gctgaggcctcagaaggctgag

SEQ ID NO: 9336192 - DNA, 22 bp, Homo sapiens
gctgaggcctcagaaggctgag

SEQ ID NO: 9336193 - DNA, 22 bp, Homo sapiens
gctgaggccccagggtgatggg

SEQ ID NO: 9336194 - DNA, 22 bp, Homo sapiens
gctgaggccccagggtgatggg

SEQ ID NO: 9336195 - DNA, 22 bp, Homo sapiens
gctgaggccagtttaatgagga

SEQ ID NO: 9336196 - DNA, 22 bp, Homo sapiens
gctgaggccagtttaatgagga

SEQ ID NO: 9336197 - DNA, 22 bp, Homo sapiens
gctgaggccaggccccaccgga

SEQ ID NO: 9336198 - DNA, 22 bp, Homo sapiens
gctgaggccaggccccaccgga

SEQ ID NO: 9336199 - DNA, 22 bp, Homo sapiens
gctgagagtgggtgcagtgctt

SEQ ID NO: 9336200 - DNA, 22 bp, Homo sapiens
gctgaggctcctcgggaggaca

SEQ ID NO: 9336201 - DNA, 22 bp, Homo sapiens
gctgaggctgggagcagcctgt

SEQ ID NO: 9336202 - DNA, 22 bp, Homo sapiens
gctgaggctgggagcagcctgt

SEQ ID NO: 9336203 - DNA, 22 bp, Homo sapiens
gctgaggctcaagtcatgggtc

SEQ ID NO: 9336204 - DNA, 22 bp, Homo sapiens
gctgaggctcaatccccttctg

SEQ ID NO: 9336205 - DNA, 22 bp, Homo sapiens
gctgaggctcaatccccttctg

SEQ ID NO: 9336206 - DNA, 22 bp, Homo sapiens
gctgaggctgggagcagcctgt

SEQ ID NO: 9336207 - DNA, 22 bp, Homo sapiens
gctgaggcttagctaaaaattt

SEQ ID NO: 9336208 - DNA, 22 bp, Homo sapiens
gctgaggcttagctaaaaattt

SEQ ID NO: 9336209 - DNA, 22 bp, Homo sapiens
gctgagggaggctgaactgagt

SEQ ID NO: 9336210 - DNA, 22 bp, Homo sapiens
gctgagggaccatgtttcagga

SEQ ID NO: 9336211 - DNA, 22 bp, Homo sapiens
gctgagggaggctgaactgagt

SEQ ID NO: 9336212 - DNA, 22 bp, Homo sapiens
gctgagggatagctgctcactg

SEQ ID NO: 9336213 - DNA, 22 bp, Homo sapiens
gctcctccctgtgcagacccag

SEQ ID NO: 9336214 - DNA, 22 bp, Homo sapiens
gctctggctcaaaccaccggct

SEQ ID NO: 9336215 - DNA, 22 bp, Homo sapiens
gctctggctcaaaccaccggct

SEQ ID NO: 9336216 - DNA, 22 bp, Homo sapiens
gctctggctcaaaccaccggct

SEQ ID NO: 9336217 - DNA, 22 bp, Homo sapiens
gctcctctcccagagctgcagg

SEQ ID NO: 9336218 - DNA, 22 bp, Homo sapiens
gctccctgtgctctgagtgata

SEQ ID NO: 9336219 - DNA, 22 bp, Homo sapiens
gctccctgtgctctgagtgata

SEQ ID NO: 9336220 - DNA, 22 bp, Homo sapiens
gctccctgtgggatgaggcgcc

SEQ ID NO: 9336221 - DNA, 22 bp, Homo sapiens
gctccctgttctcagccatgat

SEQ ID NO: 9336222 - DNA, 22 bp, Homo sapiens
gctccgtgggcattgctaggtg

SEQ ID NO: 9336223 - DNA, 22 bp, Homo sapiens
gctctgggaactgactgccttc

SEQ ID NO: 9336224 - DNA, 18 bp, Homo sapiens
gctctggctcacctccag

SEQ ID NO: 9336225 - DNA, 18 bp, Homo sapiens
gctctggctcacctccag

SEQ ID NO: 9336226 - DNA, 18 bp, Homo sapiens
gctctggctcacctccag

SEQ ID NO: 9336227 - DNA, 22 bp, Homo sapiens
gctctgggaaggatcgtagtga

SEQ ID NO: 9336228 - DNA, 22 bp, Homo sapiens
gctctgggaagtcctttaccat

SEQ ID NO: 9336229 - DNA, 22 bp, Homo sapiens
gctctgggaattcagaaagcct

SEQ ID NO: 9336230 - DNA, 22 bp, Homo sapiens
gctctgggaattcagaaagcct

SEQ ID NO: 9336231 - DNA, 22 bp, Homo sapiens
gctgaatgaatgtattttaaaa

SEQ ID NO: 9336232 - DNA, 22 bp, Homo sapiens
gctgaataggcacagagggcat

SEQ ID NO: 9336233 - DNA, 22 bp, Homo sapiens
gctgaataggggtcccaaagat

SEQ ID NO: 9336234 - DNA, 22 bp, Homo sapiens
gctctggggttggaaagtgatc

SEQ ID NO: 9336235 - DNA, 22 bp, Homo sapiens
gctctggggcccagggatcaca

SEQ ID NO: 9336236 - DNA, 22 bp, Homo sapiens
gctctgggctgccctctggaca

SEQ ID NO: 9336237 - DNA, 22 bp, Homo sapiens
gctctgggctgccctctggaca

SEQ ID NO: 9336238 - DNA, 22 bp, Homo sapiens
gctctgggctgccctctggaca

SEQ ID NO: 9336239 - DNA, 22 bp, Homo sapiens
gctctggggatgcttctgccgt

SEQ ID NO: 9336240 - DNA, 22 bp, Homo sapiens
gctctggggatgcttctgccgt

SEQ ID NO: 9336241 - DNA, 22 bp, Homo sapiens
gctctgggattaccagccttag

SEQ ID NO: 9336242 - DNA, 22 bp, Homo sapiens
gctctgggattaccagccttag

SEQ ID NO: 9336243 - DNA, 22 bp, Homo sapiens
gctctgggaattcagaaagcct

SEQ ID NO: 9336244 - DNA, 20 bp, Homo sapiens
gctctgggagggatgtgatg

SEQ ID NO: 9336245 - DNA, 22 bp, Homo sapiens
gctctgggccgggcaccagcct

SEQ ID NO: 9336246 - DNA, 22 bp, Homo sapiens
gctctgggccgggcaccagcct

SEQ ID NO: 9336247 - DNA, 22 bp, Homo sapiens
gctctgggccatcctggccggg

SEQ ID NO: 9336248 - DNA, 22 bp, Homo sapiens
gctctgggccatcctggccggg

SEQ ID NO: 9336249 - DNA, 22 bp, Homo sapiens
gctctgggccatcctggccggg

SEQ ID NO: 9336250 - DNA, 22 bp, Homo sapiens
gctacaggtgacagcctctgca

SEQ ID NO: 9336251 - DNA, 22 bp, Homo sapiens
gctacaggtgacagcctctgca

SEQ ID NO: 9336252 - DNA, 22 bp, Homo sapiens
gctacaggggtcagtcctttgc

SEQ ID NO: 9336253 - DNA, 22 bp, Homo sapiens
gctacaggtatatagatgaaac

SEQ ID NO: 9336254 - DNA, 22 bp, Homo sapiens
gctacaggagctgtcacatgct

SEQ ID NO: 9336255 - DNA, 22 bp, Homo sapiens
gctacaggagataaaggcctct

SEQ ID NO: 9336256 - DNA, 22 bp, Homo sapiens
gcgtgggctggactgggatgaa

SEQ ID NO: 9336257 - DNA, 22 bp, Homo sapiens
gcgtggcttagagtggggtacc

SEQ ID NO: 9336258 - DNA, 22 bp, Homo sapiens
gcgtggagacaactctggggtg

SEQ ID NO: 9336259 - DNA, 22 bp, Homo sapiens
gcgtggagacaactctggggtg

SEQ ID NO: 9336260 - DNA, 18 bp, Homo sapiens
gcgtggagcgggctcggt

SEQ ID NO: 9336261 - DNA, 18 bp, Homo sapiens
gcgtggagcgggctcggt

SEQ ID NO: 9336262 - DNA, 22 bp, Homo sapiens
gcgtggctcctaacagatctga

SEQ ID NO: 9336263 - DNA, 22 bp, Homo sapiens
gcggtaggagagacagaagtta

SEQ ID NO: 9336264 - DNA, 22 bp, Homo sapiens
gcgtgcaacagcctcttccatt

SEQ ID NO: 9336265 - DNA, 22 bp, Homo sapiens
gcgtgccggccggtggaggcga

SEQ ID NO: 9336266 - DNA, 22 bp, Homo sapiens
gcgtctcaaggcccccaggcca

SEQ ID NO: 9336267 - DNA, 22 bp, Homo sapiens
gcgtctcaaggcccccaggcca

SEQ ID NO: 9336268 - DNA, 22 bp, Homo sapiens
gcgtccccatcatccagccgta

SEQ ID NO: 9336269 - DNA, 22 bp, Homo sapiens
gcgtccagggaaggcccagctg

SEQ ID NO: 9336270 - DNA, 22 bp, Homo sapiens
gcctttatttacgaaagggaaa

SEQ ID NO: 9336271 - DNA, 22 bp, Homo sapiens
gcctttcagtgccttctgttca

SEQ ID NO: 9336272 - DNA, 22 bp, Homo sapiens
gcctttcatctcagctggccgg

SEQ ID NO: 9336273 - DNA, 22 bp, Homo sapiens
gcctttcactggtgccggctgt

SEQ ID NO: 9336274 - DNA, 22 bp, Homo sapiens
gcctttatccctgtacaaggtg

SEQ ID NO: 9336275 - DNA, 22 bp, Homo sapiens
gccttgtttctctcccagataa

SEQ ID NO: 9336276 - DNA, 22 bp, Homo sapiens
gccttgggtttcctatcctgag

SEQ ID NO: 9336277 - DNA, 22 bp, Homo sapiens
gcctttggatatattcagggat

SEQ ID NO: 9336278 - DNA, 22 bp, Homo sapiens
gcctttggagatgtcataggat

SEQ ID NO: 9336279 - DNA, 22 bp, Homo sapiens
gcgggggtggccagcaagacct

SEQ ID NO: 9336280 - DNA, 22 bp, Homo sapiens
gcggggttccgtgccccagagt

SEQ ID NO: 9336281 - DNA, 22 bp, Homo sapiens
gcgggttgaagggcgcatcgaa

SEQ ID NO: 9336282 - DNA, 22 bp, Homo sapiens
gcgggttgaagggcgcatcgaa

SEQ ID NO: 9336283 - DNA, 22 bp, Homo sapiens
gcctgagcaggcgtggaccatg

SEQ ID NO: 9336284 - DNA, 22 bp, Homo sapiens
gcctgagccgcctgagcggcgg

SEQ ID NO: 9336285 - DNA, 19 bp, Homo sapiens
gcctgagccagccatgcaa

SEQ ID NO: 9336286 - DNA, 22 bp, Homo sapiens
gcctctgggggctcagacctgt

SEQ ID NO: 9336287 - DNA, 22 bp, Homo sapiens
gcctctggggcagctgagtcat

SEQ ID NO: 9336288 - DNA, 22 bp, Homo sapiens
gcctctggggcagctgagtcat

SEQ ID NO: 9336289 - DNA, 22 bp, Homo sapiens
gcctctggggcagctgagtcat

SEQ ID NO: 9336290 - DNA, 22 bp, Homo sapiens
gcctctggggttaatagagttt

SEQ ID NO: 9336291 - DNA, 22 bp, Homo sapiens
gcctctgggtgacgaaaggtga

SEQ ID NO: 9336292 - DNA, 22 bp, Homo sapiens
gcctctggggtggagcccagca

SEQ ID NO: 9336293 - DNA, 22 bp, Homo sapiens
gcctctggggtggagcccagca

SEQ ID NO: 9336294 - DNA, 22 bp, Homo sapiens
gcctctgggggctcagacctgt

SEQ ID NO: 9336295 - DNA, 22 bp, Homo sapiens
gcctctgggtgacgaaaggtga

SEQ ID NO: 9336296 - DNA, 22 bp, Homo sapiens
gcctctgggttggtgacaggct

SEQ ID NO: 9336297 - DNA, 22 bp, Homo sapiens
gcctctgggtgacgaaaggtga

SEQ ID NO: 9336298 - DNA, 22 bp, Homo sapiens
gcctctgggttggtgacaggct

SEQ ID NO: 9336299 - DNA, 22 bp, Homo sapiens
gcctctggtccctcatgctgtg

SEQ ID NO: 9336300 - DNA, 22 bp, Homo sapiens
gcctctgggttggtgacaggct

SEQ ID NO: 9336301 - DNA, 22 bp, Homo sapiens
gcctctggtccctcatgctgtg

SEQ ID NO: 9336302 - DNA, 22 bp, Homo sapiens
gccttgctttgcttctggacag

SEQ ID NO: 9336303 - DNA, 22 bp, Homo sapiens
gccttggaaagctggagcagtt

SEQ ID NO: 9336304 - DNA, 22 bp, Homo sapiens
gccttgctaatttctcctcaac

SEQ ID NO: 9336305 - DNA, 22 bp, Homo sapiens
gccttgctgattaccttccttt

SEQ ID NO: 9336306 - DNA, 22 bp, Homo sapiens
gccttgcctcagccatggaaac

SEQ ID NO: 9336307 - DNA, 22 bp, Homo sapiens
gccttgccgctcagcagtgggg

SEQ ID NO: 9336308 - DNA, 21 bp, Homo sapiens
gccttgccacatgtgccacag

SEQ ID NO: 9336309 - DNA, 20 bp, Homo sapiens
gcctgagctccgcctcctgt

SEQ ID NO: 9336310 - DNA, 20 bp, Homo sapiens
gcctgagctccgcctcctgt

SEQ ID NO: 9336311 - DNA, 20 bp, Homo sapiens
gcctgagctattgccaggat

SEQ ID NO: 9336312 - DNA, 22 bp, Homo sapiens
gcctgagctactagggagtctg

SEQ ID NO: 9336313 - DNA, 22 bp, Homo sapiens
gccttggcccacagtgctcctg

SEQ ID NO: 9336314 - DNA, 22 bp, Homo sapiens
gccttggctgttggagcttgat

SEQ ID NO: 9336315 - DNA, 22 bp, Homo sapiens
gccttggctgccaagctgctga

SEQ ID NO: 9336316 - DNA, 22 bp, Homo sapiens
gccttgggccagctgctctgga

SEQ ID NO: 9336317 - DNA, 22 bp, Homo sapiens
gccttgggggtgaaagaggcta

SEQ ID NO: 9336318 - DNA, 22 bp, Homo sapiens
gccttgggggtgaaagaggcta

SEQ ID NO: 9336319 - DNA, 22 bp, Homo sapiens
gccttgggcacaggcagggccc

SEQ ID NO: 9336320 - DNA, 22 bp, Homo sapiens
gccttgggattcttggatgctc

SEQ ID NO: 9336321 - DNA, 22 bp, Homo sapiens
gccttgggacggaggggtcacc

SEQ ID NO: 9336322 - DNA, 22 bp, Homo sapiens
gccttgggaaagtgggaggaga

SEQ ID NO: 9336323 - DNA, 22 bp, Homo sapiens
gccttgggaaagtgggaggaga

SEQ ID NO: 9336324 - DNA, 22 bp, Homo sapiens
gccttgggacggaggggtcacc

SEQ ID NO: 9336325 - DNA, 22 bp, Homo sapiens
gctcagaggttgttcttgggtt

SEQ ID NO: 9336326 - DNA, 22 bp, Homo sapiens
gctcagaggttgttcttgggtt

SEQ ID NO: 9336327 - DNA, 23 bp, Homo sapiens
gctcagaggtttttctctggatg

SEQ ID NO: 9336328 - DNA, 22 bp, Homo sapiens
gctcagagggttttggccaagt

SEQ ID NO: 9336329 - DNA, 23 bp, Homo sapiens
gctcagaggtgaaatgttttggg

SEQ ID NO: 9336330 - DNA, 19 bp, Homo sapiens
gctcagagggccctgtgct

SEQ ID NO: 9336331 - DNA, 19 bp, Homo sapiens
gctcagagggccctgtgct

SEQ ID NO: 9336332 - DNA, 21 bp, Homo sapiens
gctcagagtattgcactgttt

SEQ ID NO: 9336333 - DNA, 17 bp, Homo sapiens
gctcagagtacacgtgt

SEQ ID NO: 9336334 - DNA, 23 bp, Homo sapiens
gctcagaggtttttctctggatg

SEQ ID NO: 9336335 - DNA, 22 bp, Homo sapiens
gctcagagtggcctggctaggg

SEQ ID NO: 9336336 - DNA, 19 bp, Homo sapiens
gctcagagtccccctgcgg

SEQ ID NO: 9336337 - DNA, 22 bp, Homo sapiens
gctcagaggcacgacctcttgg

SEQ ID NO: 9336338 - DNA, 22 bp, Homo sapiens
gctcagaggaggcctttaccta

SEQ ID NO: 9336339 - DNA, 22 bp, Homo sapiens
gctcagaggatgctcctttatg

SEQ ID NO: 9336340 - DNA, 22 bp, Homo sapiens
gctcagaggagcatcataagga

SEQ ID NO: 9336341 - DNA, 22 bp, Homo sapiens
gctcagagggaacaaggggctg

SEQ ID NO: 9336342 - DNA, 22 bp, Homo sapiens
gctcagaggccaagtgcccgcc

SEQ ID NO: 9336343 - DNA, 22 bp, Homo sapiens
gctcagaggccactgttggaaa

SEQ ID NO: 9336344 - DNA, 22 bp, Homo sapiens
gctaccctgggaatctccctca

SEQ ID NO: 9336345 - DNA, 22 bp, Homo sapiens
gctactgttcggcatgctgaag

SEQ ID NO: 9336346 - DNA, 22 bp, Homo sapiens
gctcagagcttgaagttccact

SEQ ID NO: 9336347 - DNA, 22 bp, Homo sapiens
gctactgattgaccttggagag

SEQ ID NO: 9336348 - DNA, 22 bp, Homo sapiens
gctactgattgaccttggagag

SEQ ID NO: 9336349 - DNA, 22 bp, Homo sapiens
gctcagagttaattggatgggt

SEQ ID NO: 9336350 - DNA, 22 bp, Homo sapiens
gctcagagttaaatatagtgct

SEQ ID NO: 9336351 - DNA, 22 bp, Homo sapiens
gctcagagttaaatatagtgct

SEQ ID NO: 9336352 - DNA, 22 bp, Homo sapiens
gctcagcactttctccaaccac

SEQ ID NO: 9336353 - DNA, 19 bp, Homo sapiens
gctcagcagacccagtgct

SEQ ID NO: 9336354 - DNA, 21 bp, Homo sapiens
gctcagcaaaggtgaggtgca

SEQ ID NO: 9336355 - DNA, 22 bp, Homo sapiens
gctcagccgaacttcagagcag

SEQ ID NO: 9336356 - DNA, 19 bp, Homo sapiens
gctcagcagacccagtgct

SEQ ID NO: 9336357 - DNA, 22 bp, Homo sapiens
gctcagccgaacttcagagcag

SEQ ID NO: 9336358 - DNA, 22 bp, Homo sapiens
gctcagctacttacaggtggct

SEQ ID NO: 9336359 - DNA, 22 bp, Homo sapiens
gctcagccgaacttcagagcag

SEQ ID NO: 9336360 - DNA, 23 bp, Homo sapiens
gctcagcctcagcaggcccagga

SEQ ID NO: 9336361 - DNA, 22 bp, Homo sapiens
gctcagctatcagtgttcctga

SEQ ID NO: 9336362 - DNA, 18 bp, Homo sapiens
gctcagctatgggaggtt

SEQ ID NO: 9336363 - DNA, 18 bp, Homo sapiens
gctcagctatgggaggtt

SEQ ID NO: 9336364 - DNA, 18 bp, Homo sapiens
gctcagctatgggaggtt

SEQ ID NO: 9336365 - DNA, 22 bp, Homo sapiens
gctcagctctatggacacaaag

SEQ ID NO: 9336366 - DNA, 22 bp, Homo sapiens
gctccagggacccaagagaaaa

SEQ ID NO: 9336367 - DNA, 22 bp, Homo sapiens
gctccagggagtacatttatca

SEQ ID NO: 9336368 - DNA, 22 bp, Homo sapiens
gctccagggtcagctcagaact

SEQ ID NO: 9336369 - DNA, 22 bp, Homo sapiens
gctccagggtggatgacaattc

SEQ ID NO: 9336370 - DNA, 22 bp, Homo sapiens
gctccagggtcagctcagaact

SEQ ID NO: 9336371 - DNA, 22 bp, Homo sapiens
gctccagggtcagctcagaact

SEQ ID NO: 9336372 - DNA, 22 bp, Homo sapiens
gctccaggataataaagttgtt

SEQ ID NO: 9336373 - DNA, 22 bp, Homo sapiens
gctccaggataataaagttgtt

SEQ ID NO: 9336374 - DNA, 22 bp, Homo sapiens
gctccaggcagagcctctttcg

SEQ ID NO: 9336375 - DNA, 22 bp, Homo sapiens
gctcagctgagcgaaggacatg

SEQ ID NO: 9336376 - DNA, 22 bp, Homo sapiens
gctcagctgagcgaaggacatg

SEQ ID NO: 9336377 - DNA, 22 bp, Homo sapiens
gctccaggaggctcccgcgtct

SEQ ID NO: 9336378 - DNA, 22 bp, Homo sapiens
gctccaggaggctcccgcgtct

SEQ ID NO: 9336379 - DNA, 22 bp, Homo sapiens
gctccctggtagccatgctctc

SEQ ID NO: 9336380 - DNA, 22 bp, Homo sapiens
gctccctggaggatgtgaactt

SEQ ID NO: 9336381 - DNA, 22 bp, Homo sapiens
gctccctggaatgttggctgcc

SEQ ID NO: 9336382 - DNA, 23 bp, Homo sapiens
gctccctgtccctgcacttaggc

SEQ ID NO: 9336383 - DNA, 22 bp, Homo sapiens
gctccctgtctctggggtccat

SEQ ID NO: 9336384 - DNA, 23 bp, Homo sapiens
gctccctgtgctccaggagatgc

SEQ ID NO: 9336385 - DNA, 22 bp, Homo sapiens
gctccctggtagccatgctctc

SEQ ID NO: 9336386 - DNA, 22 bp, Homo sapiens
gctccctggtattgctgccact

SEQ ID NO: 9336387 - DNA, 22 bp, Homo sapiens
gctccctgactcagttcctgag

SEQ ID NO: 9336388 - DNA, 22 bp, Homo sapiens
gctccctgactcagttcctgag

SEQ ID NO: 9336389 - DNA, 22 bp, Homo sapiens
gctccctgcactctgcagccct

SEQ ID NO: 9336390 - DNA, 22 bp, Homo sapiens
gctccctgcagctgagagttcc

SEQ ID NO: 9336391 - DNA, 22 bp, Homo sapiens
gctccctgcctacacggacctt

SEQ ID NO: 9336392 - DNA, 21 bp, Homo sapiens
gctccctgctcagctcctggg

SEQ ID NO: 9336393 - DNA, 21 bp, Homo sapiens
gctccctgctcagctcctggg

SEQ ID NO: 9336394 - DNA, 22 bp, Homo sapiens
gctccaggtggcttatttgtat

SEQ ID NO: 9336395 - DNA, 22 bp, Homo sapiens
gctccaggtgtcccaggtaaaa

SEQ ID NO: 9336396 - DNA, 22 bp, Homo sapiens
gctccaggtgtcccaggtaaaa

SEQ ID NO: 9336397 - DNA, 22 bp, Homo sapiens
gctccaggtatttgccctttta

SEQ ID NO: 9336398 - DNA, 20 bp, Homo sapiens
gctccaggtcagagaggacg

SEQ ID NO: 9336399 - DNA, 22 bp, Homo sapiens
gctccaggtgaatcctctcacc

SEQ ID NO: 9336400 - DNA, 22 bp, Homo sapiens
gctccaggtgaatcctctcacc

SEQ ID NO: 9336401 - DNA, 20 bp, Homo sapiens
gctccaggtcagagaggacg

SEQ ID NO: 9336402 - DNA, 22 bp, Homo sapiens
gctcccagaaccaaggctgggg

SEQ ID NO: 9336403 - DNA, 22 bp, Homo sapiens
gctcccagaaccaaggctgggg

SEQ ID NO: 9336404 - DNA, 22 bp, Homo sapiens
gctcccactgcagccctgagcc

SEQ ID NO: 9336405 - DNA, 22 bp, Homo sapiens
gctcccactgcagccctgagcc

SEQ ID NO: 9336406 - DNA, 22 bp, Homo sapiens
gctcccacctccagcctgagtt

SEQ ID NO: 9336407 - DNA, 22 bp, Homo sapiens
gctcccaccttaaccttcacat

SEQ ID NO: 9336408 - DNA, 22 bp, Homo sapiens
gctcccaccaggcagacctacc

SEQ ID NO: 9336409 - DNA, 22 bp, Homo sapiens
gctggctgttgaataatggcat

SEQ ID NO: 9336410 - DNA, 22 bp, Homo sapiens
gctggctgtgtttcatctctga

SEQ ID NO: 9336411 - DNA, 22 bp, Homo sapiens
gctggctgtgttccttctgcca

SEQ ID NO: 9336412 - DNA, 22 bp, Homo sapiens
gctggctgtgttccttctgcca

SEQ ID NO: 9336413 - DNA, 22 bp, Homo sapiens
gctggctgtgggctccacgctc

SEQ ID NO: 9336414 - DNA, 22 bp, Homo sapiens
gctggctgtggcttaagcaaac

SEQ ID NO: 9336415 - DNA, 22 bp, Homo sapiens
gctggctgtgattttgccaaca

SEQ ID NO: 9336416 - DNA, 22 bp, Homo sapiens
gctggctgtgggctccacgctc

SEQ ID NO: 9336417 - DNA, 22 bp, Homo sapiens
gctggctgtgggctccacgctc

SEQ ID NO: 9336418 - DNA, 21 bp, Homo sapiens
gctggctggctgaccggcctt

SEQ ID NO: 9336419 - DNA, 22 bp, Homo sapiens
gctggctggcgggtgcgtcctc

SEQ ID NO: 9336420 - DNA, 22 bp, Homo sapiens
gctggctggcgggtgcgtcctc

SEQ ID NO: 9336421 - DNA, 21 bp, Homo sapiens
gctggctggctgaccggcctt

SEQ ID NO: 9336422 - DNA, 22 bp, Homo sapiens
gctggctgttggaggtacctgc

SEQ ID NO: 9336423 - DNA, 22 bp, Homo sapiens
gctggctgttggaggtacctgc

SEQ ID NO: 9336424 - DNA, 22 bp, Homo sapiens
gctggcttccatcagagggtga

SEQ ID NO: 9336425 - DNA, 22 bp, Homo sapiens
gctggcttgatagtttctgctt

SEQ ID NO: 9336426 - DNA, 22 bp, Homo sapiens
gctggcttgtaataggaatttc

SEQ ID NO: 9336427 - DNA, 22 bp, Homo sapiens
gctggcttccttctgcagctag

SEQ ID NO: 9336428 - DNA, 22 bp, Homo sapiens
gctggcttccttctgcagctag

SEQ ID NO: 9336429 - DNA, 22 bp, Homo sapiens
gctggctttgtggtctctcctc

SEQ ID NO: 9336430 - DNA, 22 bp, Homo sapiens
gctggctttgtcaagggcagca

SEQ ID NO: 9336431 - DNA, 22 bp, Homo sapiens
gctgggctggaaggccaaggca

SEQ ID NO: 9336432 - DNA, 22 bp, Homo sapiens
gctgggctggccgccgagatcg

SEQ ID NO: 9336433 - DNA, 23 bp, Homo sapiens
gctgggcttactctttcagtgag

SEQ ID NO: 9336434 - DNA, 23 bp, Homo sapiens
gctgggcttactctttcagtgag

SEQ ID NO: 9336435 - DNA, 22 bp, Homo sapiens
gctgggcttcacagagccttta

SEQ ID NO: 9336436 - DNA, 22 bp, Homo sapiens
gctgggctgtagtttgctgacc

SEQ ID NO: 9336437 - DNA, 22 bp, Homo sapiens
gctgggctggccgccgagatcg

SEQ ID NO: 9336438 - DNA, 22 bp, Homo sapiens
gctgggctgtagtttgctgacc

SEQ ID NO: 9336439 - DNA, 22 bp, Homo sapiens
gctgggcttctcaatgctgcct

SEQ ID NO: 9336440 - DNA, 22 bp, Homo sapiens
gctgggcttcacctccagagtt

SEQ ID NO: 9336441 - DNA, 22 bp, Homo sapiens
gctgggcttcacctccagagtt

SEQ ID NO: 9336442 - DNA, 22 bp, Homo sapiens
gctgggcttcacctccagagtt

SEQ ID NO: 9336443 - DNA, 22 bp, Homo sapiens
gctgggcttcacctccagagtt

SEQ ID NO: 9336444 - DNA, 22 bp, Homo sapiens
gctgggcttcacagagccttta

SEQ ID NO: 9336445 - DNA, 22 bp, Homo sapiens
gctggctggaggagggaggttg

SEQ ID NO: 9336446 - DNA, 22 bp, Homo sapiens
gctggctggaggagggaggttg

SEQ ID NO: 9336447 - DNA, 22 bp, Homo sapiens
gctggctggaggtgaggaagaa

SEQ ID NO: 9336448 - DNA, 19 bp, Homo sapiens
gctggctggaggagggaca

SEQ ID NO: 9336449 - DNA, 19 bp, Homo sapiens
gctggctggaggagggaca

SEQ ID NO: 9336450 - DNA, 22 bp, Homo sapiens
gctggctggaatgggagaagaa

SEQ ID NO: 9336451 - DNA, 22 bp, Homo sapiens
gctggctggaactagcagttgg

SEQ ID NO: 9336452 - DNA, 22 bp, Homo sapiens
gctggctggaactagcagttgg

SEQ ID NO: 9336453 - DNA, 22 bp, Homo sapiens
gctggctggaatgggagaagaa

SEQ ID NO: 9336454 - DNA, 19 bp, Homo sapiens
gctggctggaggagggaca

SEQ ID NO: 9336455 - DNA, 22 bp, Homo sapiens
gctggctggaatgggagaagaa

SEQ ID NO: 9336456 - DNA, 22 bp, Homo sapiens
gctggctggaggtgaggaagaa

SEQ ID NO: 9336457 - DNA, 22 bp, Homo sapiens
gctggctggagtaaggagggag

SEQ ID NO: 9336458 - DNA, 22 bp, Homo sapiens
gctggctggaggtgaggaagaa

SEQ ID NO: 9336459 - DNA, 22 bp, Homo sapiens
gctggctggagtaaggagggag

SEQ ID NO: 9336460 - DNA, 22 bp, Homo sapiens
gctggctggagtaaggagggag

SEQ ID NO: 9336461 - DNA, 22 bp, Homo sapiens
gctggctggagtgagctaccct

SEQ ID NO: 9336462 - DNA, 22 bp, Homo sapiens
gctggctggagtgagctaccct

SEQ ID NO: 9336463 - DNA, 22 bp, Homo sapiens
gctggctggatggttggttcgc

SEQ ID NO: 9336464 - DNA, 22 bp, Homo sapiens
gctggctggcacgttcgcacgt

SEQ ID NO: 9336465 - DNA, 22 bp, Homo sapiens
gctggctggatggttggttcgc

SEQ ID NO: 9336466 - DNA, 22 bp, Homo sapiens
gctggctggagtgagctaccct

SEQ ID NO: 9336467 - DNA, 22 bp, Homo sapiens
gctggctggagtgagctaccct

SEQ ID NO: 9336468 - DNA, 22 bp, Homo sapiens
gctggctggcgggtgcgtcctc

SEQ ID NO: 9336469 - DNA, 22 bp, Homo sapiens
gctggctggcgggtgcgtcctc

SEQ ID NO: 9336470 - DNA, 23 bp, Homo sapiens
gctggctggcagtaaaggttgtt

SEQ ID NO: 9336471 - DNA, 22 bp, Homo sapiens
gctggctggcacgttcgcacgt

SEQ ID NO: 9336472 - DNA, 22 bp, Homo sapiens
gctggctgctaggacagctaca

SEQ ID NO: 9336473 - DNA, 22 bp, Homo sapiens
gctggctgctgttgagacttgt

SEQ ID NO: 9336474 - DNA, 22 bp, Homo sapiens
gctggctgctgttgagacttgt

SEQ ID NO: 9336475 - DNA, 22 bp, Homo sapiens
gctggctgcgtcatcacagggc

SEQ ID NO: 9336476 - DNA, 22 bp, Homo sapiens
gctggctgcgtcatcacagggc

SEQ ID NO: 9336477 - DNA, 22 bp, Homo sapiens
gctggctgctaggacagctaca

SEQ ID NO: 9336478 - DNA, 22 bp, Homo sapiens
gctggctgcgtcatcacagggc

SEQ ID NO: 9336479 - DNA, 22 bp, Homo sapiens
gctggctgccttactttgtgga

SEQ ID NO: 9336480 - DNA, 22 bp, Homo sapiens
gctggctgccttactttgtgga

SEQ ID NO: 9336481 - DNA, 22 bp, Homo sapiens
gctggagagataggcatggggt

SEQ ID NO: 9336482 - DNA, 22 bp, Homo sapiens
gctggagagataggcatggggt

SEQ ID NO: 9336483 - DNA, 22 bp, Homo sapiens
gctggagagataggcatggggt

SEQ ID NO: 9336484 - DNA, 22 bp, Homo sapiens
gctggagagataggcatggggt

SEQ ID NO: 9336485 - DNA, 22 bp, Homo sapiens
gctggagagataggcatggggt

SEQ ID NO: 9336486 - DNA, 22 bp, Homo sapiens
gctggagaacccaggaggaaga

SEQ ID NO: 9336487 - DNA, 22 bp, Homo sapiens
gctggagaacccaggaggaaga

SEQ ID NO: 9336488 - DNA, 22 bp, Homo sapiens
gctggagaaactgcagctgagg

SEQ ID NO: 9336489 - DNA, 22 bp, Homo sapiens
gctggagaacccaggaggaaga

SEQ ID NO: 9336490 - DNA, 22 bp, Homo sapiens
gctggagacctcagagaaccca

SEQ ID NO: 9336491 - DNA, 22 bp, Homo sapiens
gctggagaaactgcagctgagg

SEQ ID NO: 9336492 - DNA, 22 bp, Homo sapiens
gctggagaaactgcagctgagg

SEQ ID NO: 9336493 - DNA, 22 bp, Homo sapiens
gctggagaaacaggaggaggaa

SEQ ID NO: 9336494 - DNA, 22 bp, Homo sapiens
gctggagaaacaggaggaggaa

SEQ ID NO: 9336495 - DNA, 22 bp, Homo sapiens
gctgctttaggttgagctcagc

SEQ ID NO: 9336496 - DNA, 22 bp, Homo sapiens
gctgctttacaggtgggggagc

SEQ ID NO: 9336497 - DNA, 22 bp, Homo sapiens
gctggggagggcgtcaaggcca

SEQ ID NO: 9336498 - DNA, 22 bp, Homo sapiens
gctggggcctctgtgaggttaa

SEQ ID NO: 9336499 - DNA, 22 bp, Homo sapiens
gctggggcctctgtgaggttaa

SEQ ID NO: 9336500 - DNA, 22 bp, Homo sapiens
gctggggcctgaacagtcagct

SEQ ID NO: 9336501 - DNA, 22 bp, Homo sapiens
gctggggaggcagcagagaaca

SEQ ID NO: 9336502 - DNA, 19 bp, Homo sapiens
gctgggcttgggtttgtag

SEQ ID NO: 9336503 - DNA, 19 bp, Homo sapiens
gctgggcttgggtttgtag

SEQ ID NO: 9336504 - DNA, 22 bp, Homo sapiens
gctgggcttggtttccctgctt

SEQ ID NO: 9336505 - DNA, 22 bp, Homo sapiens
gctgggcttctcaatgctgcct

SEQ ID NO: 9336506 - DNA, 22 bp, Homo sapiens
gctggggctgggctgaggaaga

SEQ ID NO: 9336507 - DNA, 22 bp, Homo sapiens
gctggggctgggctgaggaaga

SEQ ID NO: 9336508 - DNA, 19 bp, Homo sapiens
gctggggcctgaccagaca

SEQ ID NO: 9336509 - DNA, 19 bp, Homo sapiens
gctggggcctgaccagaca

SEQ ID NO: 9336510 - DNA, 19 bp, Homo sapiens
gctgtgcccctgccgcttg

SEQ ID NO: 9336511 - DNA, 19 bp, Homo sapiens
gctgtgcccctgccgcttg

SEQ ID NO: 9336512 - DNA, 19 bp, Homo sapiens
gctgtgcctctctcctgct

SEQ ID NO: 9336513 - DNA, 22 bp, Homo sapiens
gctgtggcggcagcagctggtg

SEQ ID NO: 9336514 - DNA, 22 bp, Homo sapiens
gctgtggctccaatggtgagcc

SEQ ID NO: 9336515 - DNA, 22 bp, Homo sapiens
gctgtggctgaagatgcaggga

SEQ ID NO: 9336516 - DNA, 22 bp, Homo sapiens
gctgtggctgaagatgcaggga

SEQ ID NO: 9336517 - DNA, 22 bp, Homo sapiens
gctgtgggtaaacgctgagggt

SEQ ID NO: 9336518 - DNA, 22 bp, Homo sapiens
gctgtgggtgctggctccaccc

SEQ ID NO: 9336519 - DNA, 22 bp, Homo sapiens
gctgtgggtccggaccccacgg

SEQ ID NO: 9336520 - DNA, 22 bp, Homo sapiens
gctgtgggttcctggcatttga

SEQ ID NO: 9336521 - DNA, 22 bp, Homo sapiens
gctgtggtctgtgagctccaaa

SEQ ID NO: 9336522 - DNA, 22 bp, Homo sapiens
gctgtgggtttccaatcctgga

SEQ ID NO: 9336523 - DNA, 22 bp, Homo sapiens
gctgtgggtttccaatcctgga

SEQ ID NO: 9336524 - DNA, 22 bp, Homo sapiens
gctgtgggccacacggctgagt

SEQ ID NO: 9336525 - DNA, 22 bp, Homo sapiens
gctgtgggacaggtccagccag

SEQ ID NO: 9336526 - DNA, 22 bp, Homo sapiens
gctgtgggccatggccaagtga

SEQ ID NO: 9336527 - DNA, 22 bp, Homo sapiens
gctgtggggagagaacacacaa

SEQ ID NO: 9336528 - DNA, 22 bp, Homo sapiens
gctgtgggtaaacgctgagggt

SEQ ID NO: 9336529 - DNA, 20 bp, Homo sapiens
gcttgcccacatctgcactg

SEQ ID NO: 9336530 - DNA, 22 bp, Homo sapiens
gcttgcatgattggagtgggtg

SEQ ID NO: 9336531 - DNA, 22 bp, Homo sapiens
gcttgctctttagccatggcca

SEQ ID NO: 9336532 - DNA, 17 bp, Homo sapiens
gcttgccttgtcttcct

SEQ ID NO: 9336533 - DNA, 23 bp, Homo sapiens
gcttgcctggtgtgtggctgacc

SEQ ID NO: 9336534 - DNA, 18 bp, Homo sapiens
gctttatttcttggggaa

SEQ ID NO: 9336535 - DNA, 22 bp, Homo sapiens
gctttatgtgagtagcactgtc

SEQ ID NO: 9336536 - DNA, 18 bp, Homo sapiens
gctttatttcttggggaa

SEQ ID NO: 9336537 - DNA, 19 bp, Homo sapiens
gcttgctttatgaaggggg

SEQ ID NO: 9336538 - DNA, 22 bp, Homo sapiens
gcttgctttgtaaatatctgtg

SEQ ID NO: 9336539 - DNA, 20 bp, Homo sapiens
gcttgctttgtctgatgggc

SEQ ID NO: 9336540 - DNA, 22 bp, Homo sapiens
gcttgctctttagccatggcca

SEQ ID NO: 9336541 - DNA, 22 bp, Homo sapiens
gcttgctggtgcctgcaggctc

SEQ ID NO: 9336542 - DNA, 22 bp, Homo sapiens
gctgtgtcctcacacagccttt

SEQ ID NO: 9336543 - DNA, 22 bp, Homo sapiens
gcttctggtgaggcctcaggaa

SEQ ID NO: 9336544 - DNA, 22 bp, Homo sapiens
gctgtgtgaccctagccagtag

SEQ ID NO: 9336545 - DNA, 22 bp, Homo sapiens
gctgtgtcctcacacagccttt

SEQ ID NO: 9336546 - DNA, 22 bp, Homo sapiens
gctgtgtatcagatgccacggg

SEQ ID NO: 9336547 - DNA, 22 bp, Homo sapiens
gctgtgtatcagatgccacggg

SEQ ID NO: 9336548 - DNA, 19 bp, Homo sapiens
gcttctgtttgggcttaga

SEQ ID NO: 9336549 - DNA, 19 bp, Homo sapiens
gcttctgtttgggcttaga

SEQ ID NO: 9336550 - DNA, 22 bp, Homo sapiens
gcttctgttcaaggatataagg

SEQ ID NO: 9336551 - DNA, 22 bp, Homo sapiens
gcttctgtggtgcatctttgct

SEQ ID NO: 9336552 - DNA, 22 bp, Homo sapiens
gcttctgtggttgtcacgacta

SEQ ID NO: 9336553 - DNA, 22 bp, Homo sapiens
gcttctgttaacttatgttccc

SEQ ID NO: 9336554 - DNA, 22 bp, Homo sapiens
gcttctgtatttattgtccttt

SEQ ID NO: 9336555 - DNA, 22 bp, Homo sapiens
gcttctgtcttagctacctccc

SEQ ID NO: 9336556 - DNA, 22 bp, Homo sapiens
gcttctgtcttagctacctccc

SEQ ID NO: 9336557 - DNA, 21 bp, Homo sapiens
gcttctgtatctagcaggaac

SEQ ID NO: 9336558 - DNA, 21 bp, Homo sapiens
gcttctgtatctagcaggaac

SEQ ID NO: 9336559 - DNA, 22 bp, Homo sapiens
gcttctgtggtgaggtcacctt

SEQ ID NO: 9336560 - DNA, 22 bp, Homo sapiens
gcttctgtggattggctggctt

SEQ ID NO: 9336561 - DNA, 22 bp, Homo sapiens
gcttctgtgagtgcagatgctg

SEQ ID NO: 9336562 - DNA, 22 bp, Homo sapiens
ggagacagtatggcttgtagct

SEQ ID NO: 9336563 - DNA, 22 bp, Homo sapiens
ggaccagtggcagggtgctgtg

SEQ ID NO: 9336564 - DNA, 19 bp, Homo sapiens
ggaccaggtcctgggcagc

SEQ ID NO: 9336565 - DNA, 19 bp, Homo sapiens
ggaccaggtcctgggcagc

SEQ ID NO: 9336566 - DNA, 19 bp, Homo sapiens
ggaccaggtcctgggcagc

SEQ ID NO: 9336567 - DNA, 21 bp, Homo sapiens
ggacatgaggcaggagaggct

SEQ ID NO: 9336568 - DNA, 22 bp, Homo sapiens
ggacatgattagcagggagagc

SEQ ID NO: 9336569 - DNA, 22 bp, Homo sapiens
ggacatgatatttcaggaagac

SEQ ID NO: 9336570 - DNA, 20 bp, Homo sapiens
ggaccagctgtctgaggggc

SEQ ID NO: 9336571 - DNA, 22 bp, Homo sapiens
ggaccaggagctcagagccctc

SEQ ID NO: 9336572 - DNA, 19 bp, Homo sapiens
ggaccagctttcaggaggc

SEQ ID NO: 9336573 - DNA, 22 bp, Homo sapiens
ggacacagtggaagacagcttg

SEQ ID NO: 9336574 - DNA, 22 bp, Homo sapiens
ggacacaggtaaataccactga

SEQ ID NO: 9336575 - DNA, 22 bp, Homo sapiens
ggacaggtgactgcccagagtg

SEQ ID NO: 9336576 - DNA, 22 bp, Homo sapiens
ggacagggttggggcatataaa

SEQ ID NO: 9336577 - DNA, 22 bp, Homo sapiens
ggacagggtaagtactagtgtg

SEQ ID NO: 9336578 - DNA, 22 bp, Homo sapiens
ggacaggtgcaaagggcacatg

SEQ ID NO: 9336579 - DNA, 22 bp, Homo sapiens
ggacaggtgtgaggctggcaca

SEQ ID NO: 9336580 - DNA, 22 bp, Homo sapiens
ggacaggtgtgaggctggcaca

SEQ ID NO: 9336581 - DNA, 22 bp, Homo sapiens
ggacaggtgtgaggctggcaca

SEQ ID NO: 9336582 - DNA, 22 bp, Homo sapiens
ggacaggttcagcagtttataa

SEQ ID NO: 9336583 - DNA, 22 bp, Homo sapiens
ggacagtggcctggtggtatag

SEQ ID NO: 9336584 - DNA, 22 bp, Homo sapiens
ggacagtgtctgcttcaggccc

SEQ ID NO: 9336585 - DNA, 22 bp, Homo sapiens
ggacatagaggccctgcatggc

SEQ ID NO: 9336586 - DNA, 22 bp, Homo sapiens
ggacatagaggccctgcatggc

SEQ ID NO: 9336587 - DNA, 22 bp, Homo sapiens
ggacagtgaatgtggggatgca

SEQ ID NO: 9336588 - DNA, 20 bp, Homo sapiens
ggacagtgagacatatctca

SEQ ID NO: 9336589 - DNA, 19 bp, Homo sapiens
ggacagtctcagcctcatg

SEQ ID NO: 9336590 - DNA, 22 bp, Homo sapiens
ggagagaccctggagaaggtcc

SEQ ID NO: 9336591 - DNA, 22 bp, Homo sapiens
ggagagagacctccatgcccag

SEQ ID NO: 9336592 - DNA, 22 bp, Homo sapiens
ggagagagagattgtgtttatt

SEQ ID NO: 9336593 - DNA, 22 bp, Homo sapiens
ggagcagcactgattagcggtt

SEQ ID NO: 9336594 - DNA, 22 bp, Homo sapiens
ggagcagcactgccacacagag

SEQ ID NO: 9336595 - DNA, 22 bp, Homo sapiens
ggagcagcactgccacacagag

SEQ ID NO: 9336596 - DNA, 22 bp, Homo sapiens
ggagcaggctctgtggtttcca

SEQ ID NO: 9336597 - DNA, 22 bp, Homo sapiens
ggagcagggaattacagcgcag

SEQ ID NO: 9336598 - DNA, 22 bp, Homo sapiens
ggagcagggaattacagcgcag

SEQ ID NO: 9336599 - DNA, 22 bp, Homo sapiens
ggagcagggaattacagcgcag

SEQ ID NO: 9336600 - DNA, 22 bp, Homo sapiens
ggagcagggaattacagcgcag

SEQ ID NO: 9336601 - DNA, 22 bp, Homo sapiens
ggagcagtctaaatgataagag

SEQ ID NO: 9336602 - DNA, 22 bp, Homo sapiens
ggagcatgcgctctgtgaccga

SEQ ID NO: 9336603 - DNA, 22 bp, Homo sapiens
ggagcagttgttgagcaagcca

SEQ ID NO: 9336604 - DNA, 22 bp, Homo sapiens
ggagcagggcagtgaattctgg

SEQ ID NO: 9336605 - DNA, 22 bp, Homo sapiens
ggagcatgggtcagaactcagt

SEQ ID NO: 9336606 - DNA, 22 bp, Homo sapiens
ggagcatgtggggtgagcaggg

SEQ ID NO: 9336607 - DNA, 22 bp, Homo sapiens
ggagcatgtggggtgagcaggg

SEQ ID NO: 9336608 - DNA, 22 bp, Homo sapiens
ggagacagtggtagggcctaag

SEQ ID NO: 9336609 - DNA, 22 bp, Homo sapiens
ggagacagtggtagggcctaag

SEQ ID NO: 9336610 - DNA, 22 bp, Homo sapiens
ggagacagtgacttagagactg

SEQ ID NO: 9336611 - DNA, 22 bp, Homo sapiens
ggagacagtgacttagagactg

SEQ ID NO: 9336612 - DNA, 22 bp, Homo sapiens
ggagactacctagcaggctgtt

SEQ ID NO: 9336613 - DNA, 18 bp, Homo sapiens
ggagactaaactgttgac

SEQ ID NO: 9336614 - DNA, 22 bp, Homo sapiens
ggagaccaggtcagagatggtg

SEQ ID NO: 9336615 - DNA, 22 bp, Homo sapiens
ggagaccagaaggaagcttcga

SEQ ID NO: 9336616 - DNA, 22 bp, Homo sapiens
ggagagaatctgaacctgctcc

SEQ ID NO: 9336617 - DNA, 22 bp, Homo sapiens
ggagagaattccatggacatgt

SEQ ID NO: 9336618 - DNA, 22 bp, Homo sapiens
ggagagaattccatggacatgt

SEQ ID NO: 9336619 - DNA, 22 bp, Homo sapiens
ggagagaactgacctgaaagga

SEQ ID NO: 9336620 - DNA, 22 bp, Homo sapiens
ggagagaactgacctgaaagga

SEQ ID NO: 9336621 - DNA, 22 bp, Homo sapiens
ggagagaaattgaggtagcaag

SEQ ID NO: 9336622 - DNA, 22 bp, Homo sapiens
gctttcatgaaaataatctact

SEQ ID NO: 9336623 - DNA, 17 bp, Homo sapiens
gctttccttgcccctcc

SEQ ID NO: 9336624 - DNA, 22 bp, Homo sapiens
gctttattttgtgagggattac

SEQ ID NO: 9336625 - DNA, 22 bp, Homo sapiens
gctttattttgtgagggattac

SEQ ID NO: 9336626 - DNA, 22 bp, Homo sapiens
gctttgctggcttgaaatgctg

SEQ ID NO: 9336627 - DNA, 22 bp, Homo sapiens
gctttctgaagcagtgtttctc

SEQ ID NO: 9336628 - DNA, 22 bp, Homo sapiens
ggaagacaagcagtggctgagc

SEQ ID NO: 9336629 - DNA, 19 bp, Homo sapiens
gctttggagggaggttcta

SEQ ID NO: 9336630 - DNA, 22 bp, Homo sapiens
gctttggagcctgtgttctgcc

SEQ ID NO: 9336631 - DNA, 22 bp, Homo sapiens
ggaagaggctctcattgagggc

SEQ ID NO: 9336632 - DNA, 22 bp, Homo sapiens
ggaagaggctctcattgagggc

SEQ ID NO: 9336633 - DNA, 22 bp, Homo sapiens
ggaagaggctgagccaggtccc

SEQ ID NO: 9336634 - DNA, 22 bp, Homo sapiens
ggaagaggctctcattgagggc

SEQ ID NO: 9336635 - DNA, 22 bp, Homo sapiens
ggaagaggctctcattgagggc

SEQ ID NO: 9336636 - DNA, 22 bp, Homo sapiens
ggaagaggctctcattgagggc

SEQ ID NO: 9336637 - DNA, 22 bp, Homo sapiens
ggaagaggctgaggccatgctg

SEQ ID NO: 9336638 - DNA, 22 bp, Homo sapiens
ggaagaggctggtagtgcccgt

SEQ ID NO: 9336639 - DNA, 22 bp, Homo sapiens
ggaagaggctgaggccatgctg

SEQ ID NO: 9336640 - DNA, 22 bp, Homo sapiens
ggaagaggctgagccaggtccc

SEQ ID NO: 9336641 - DNA, 22 bp, Homo sapiens
ggaagatgagaagtggggctcc

SEQ ID NO: 9336642 - DNA, 22 bp, Homo sapiens
ggaagagtaacaggaggtggaa

SEQ ID NO: 9336643 - DNA, 22 bp, Homo sapiens
ggaagagtgcaggtttgtttca

SEQ ID NO: 9336644 - DNA, 22 bp, Homo sapiens
ggaagagtaacaggaggtggaa

SEQ ID NO: 9336645 - DNA, 22 bp, Homo sapiens
ggaagagtaacaggaggtggaa

SEQ ID NO: 9336646 - DNA, 22 bp, Homo sapiens
ggaagaggctggtagtgcccgt

SEQ ID NO: 9336647 - DNA, 22 bp, Homo sapiens
ggaagaggctggtagtgcccgt

SEQ ID NO: 9336648 - DNA, 22 bp, Homo sapiens
ggaagagtaacaggaggtggaa

SEQ ID NO: 9336649 - DNA, 22 bp, Homo sapiens
ggaatcgttaggtaagcaggga

SEQ ID NO: 9336650 - DNA, 22 bp, Homo sapiens
ggaagcagcctgaagccaaggg

SEQ ID NO: 9336651 - DNA, 22 bp, Homo sapiens
ggaagcagcctgaagccaaggg

SEQ ID NO: 9336652 - DNA, 22 bp, Homo sapiens
ggaagcagcctgaagccaaggg

SEQ ID NO: 9336653 - DNA, 22 bp, Homo sapiens
ggaagcaggaggctggggtaaa

SEQ ID NO: 9336654 - DNA, 22 bp, Homo sapiens
ggaatgtgttcttactgtattt

SEQ ID NO: 9336655 - DNA, 22 bp, Homo sapiens
ggaatgtaaatttactgttgta

SEQ ID NO: 9336656 - DNA, 22 bp, Homo sapiens
ggaatgtagaatctctggtctc

SEQ ID NO: 9336657 - DNA, 22 bp, Homo sapiens
ggaatgtagtttgtgcactgta

SEQ ID NO: 9336658 - DNA, 22 bp, Homo sapiens
ggaatgtaacgtgaccaagttc

SEQ ID NO: 9336659 - DNA, 22 bp, Homo sapiens
ggaatgtaaatttactgttgta

SEQ ID NO: 9336660 - DNA, 22 bp, Homo sapiens
ggaatgtaccacctattgttag

SEQ ID NO: 9336661 - DNA, 22 bp, Homo sapiens
ggaatgtgcgtactcagtgtca

SEQ ID NO: 9336662 - DNA, 22 bp, Homo sapiens
ggaatgtgctgacacgcgagag

SEQ ID NO: 9336663 - DNA, 22 bp, Homo sapiens
ggaatgtagtttgtgcactgta

SEQ ID NO: 9336664 - DNA, 22 bp, Homo sapiens
ggaatgagctcggagcagaagg

SEQ ID NO: 9336665 - DNA, 22 bp, Homo sapiens
ggaatgagctcggagcagaagg

SEQ ID NO: 9336666 - DNA, 22 bp, Homo sapiens
ggaatgaatttccagctgggtc

SEQ ID NO: 9336667 - DNA, 22 bp, Homo sapiens
ggaatgaaacacttctgattct

SEQ ID NO: 9336668 - DNA, 22 bp, Homo sapiens
ggaatgaatttccagctgggtc

SEQ ID NO: 9336669 - DNA, 22 bp, Homo sapiens
ggaatgaaacacttctgattct

SEQ ID NO: 9336670 - DNA, 20 bp, Homo sapiens
ggaattgctttcctgtcttt

SEQ ID NO: 9336671 - DNA, 22 bp, Homo sapiens
ggacaaaatccaaacttcttag

SEQ ID NO: 9336672 - DNA, 22 bp, Homo sapiens
ggacaaaccaatagacactggc

SEQ ID NO: 9336673 - DNA, 22 bp, Homo sapiens
ggaattctgtagctcttcctct

SEQ ID NO: 9336674 - DNA, 22 bp, Homo sapiens
ggaattgctaacattctgaagg

SEQ ID NO: 9336675 - DNA, 21 bp, Homo sapiens
ggaattgcaggctgtcttttg

SEQ ID NO: 9336676 - DNA, 17 bp, Homo sapiens
ggacacagctcatggct

SEQ ID NO: 9336677 - DNA, 17 bp, Homo sapiens
ggacacagctcatggct

SEQ ID NO: 9336678 - DNA, 22 bp, Homo sapiens
ggacacagataatcacacagat

SEQ ID NO: 9336679 - DNA, 18 bp, Homo sapiens
ggacacagataggtacag

SEQ ID NO: 9336680 - DNA, 20 bp, Homo sapiens
gcagcctcaacaggcacagc

SEQ ID NO: 9336681 - DNA, 20 bp, Homo sapiens
gcagcctcaacaggcacagc

SEQ ID NO: 9336682 - DNA, 20 bp, Homo sapiens
gcagcctcaacaggcacagc

SEQ ID NO: 9336683 - DNA, 22 bp, Homo sapiens
gcagcctcaaactccccagctc

SEQ ID NO: 9336684 - DNA, 22 bp, Homo sapiens
gcagccctgcaggcagctccag

SEQ ID NO: 9336685 - DNA, 22 bp, Homo sapiens
gcagccctggcctggcctactt

SEQ ID NO: 9336686 - DNA, 22 bp, Homo sapiens
gcagcccttcaggtgaggggca

SEQ ID NO: 9336687 - DNA, 22 bp, Homo sapiens
gcagccctttctgggcagggga

SEQ ID NO: 9336688 - DNA, 22 bp, Homo sapiens
gcagctttctttttgcatgtct

SEQ ID NO: 9336689 - DNA, 22 bp, Homo sapiens
gcagctttctttttgcatgtct

SEQ ID NO: 9336690 - DNA, 22 bp, Homo sapiens
gcagctttcttgccctaatctt

SEQ ID NO: 9336691 - DNA, 22 bp, Homo sapiens
gcagctttctgcaatgtcatcc

SEQ ID NO: 9336692 - DNA, 22 bp, Homo sapiens
gcagcctccgcactgcgagtcc

SEQ ID NO: 9336693 - DNA, 22 bp, Homo sapiens
gcagcctccgcactgcgagtcc

SEQ ID NO: 9336694 - DNA, 22 bp, Homo sapiens
gcagctgtcatttacaacaggg

SEQ ID NO: 9336695 - DNA, 22 bp, Homo sapiens
gcagctgtcggaaagctaagtg

SEQ ID NO: 9336696 - DNA, 22 bp, Homo sapiens
gcaggacaaaatttccagggtg

SEQ ID NO: 9336697 - DNA, 23 bp, Homo sapiens
gcaggacaacagagtgggaaggc

SEQ ID NO: 9336698 - DNA, 23 bp, Homo sapiens
gcaggacaacagagtgggaaggc

SEQ ID NO: 9336699 - DNA, 22 bp, Homo sapiens
gcaggacacagatgcaaggcca

SEQ ID NO: 9336700 - DNA, 22 bp, Homo sapiens
gcaggaatatagtatttcgagg

SEQ ID NO: 9336701 - DNA, 22 bp, Homo sapiens
gcaggaagggaaaggttgactc

SEQ ID NO: 9336702 - DNA, 22 bp, Homo sapiens
gcaggaagggaaaggttgactc

SEQ ID NO: 9336703 - DNA, 22 bp, Homo sapiens
gcaggaagccttaccaagccca

SEQ ID NO: 9336704 - DNA, 22 bp, Homo sapiens
gcaggaagcatagaagaatgcc

SEQ ID NO: 9336705 - DNA, 22 bp, Homo sapiens
gcaggaagccttaccaagccca

SEQ ID NO: 9336706 - DNA, 22 bp, Homo sapiens
gcaggaagcatagaagaatgcc

SEQ ID NO: 9336707 - DNA, 22 bp, Homo sapiens
gcaggaagcatagaagaatgcc

SEQ ID NO: 9336708 - DNA, 22 bp, Homo sapiens
gcaggaagcatagaagaatgcc

SEQ ID NO: 9336709 - DNA, 22 bp, Homo sapiens
gcaggaagatgagctcaggtaa

SEQ ID NO: 9336710 - DNA, 22 bp, Homo sapiens
gcaggaagatgagctcaggtaa

SEQ ID NO: 9336711 - DNA, 22 bp, Homo sapiens
gcagctttgtcacggagtgtcg

SEQ ID NO: 9336712 - DNA, 22 bp, Homo sapiens
gcagctttgtggagaggcccat

SEQ ID NO: 9336713 - DNA, 22 bp, Homo sapiens
gcaggaaaggttgagactttgc

SEQ ID NO: 9336714 - DNA, 22 bp, Homo sapiens
gcaggaagatgagctcaggtaa

SEQ ID NO: 9336715 - DNA, 22 bp, Homo sapiens
gcaggaagaggctcgaagcccc

SEQ ID NO: 9336716 - DNA, 22 bp, Homo sapiens
gcaggaagaggctcgaagcccc

SEQ ID NO: 9336717 - DNA, 22 bp, Homo sapiens
gcaggaagaggctcgaagcccc

SEQ ID NO: 9336718 - DNA, 22 bp, Homo sapiens
gcaggaactggagctggatgtt

SEQ ID NO: 9336719 - DNA, 22 bp, Homo sapiens
gcagcccagagcgcaggacccc

SEQ ID NO: 9336720 - DNA, 22 bp, Homo sapiens
gcagcccagagcgcaggacccc

SEQ ID NO: 9336721 - DNA, 22 bp, Homo sapiens
gcagatggtgggggaggagtac

SEQ ID NO: 9336722 - DNA, 22 bp, Homo sapiens
gcagatgtctgtgcctgcaggg

SEQ ID NO: 9336723 - DNA, 22 bp, Homo sapiens
gcagcccaggagcaggcgaccc

SEQ ID NO: 9336724 - DNA, 22 bp, Homo sapiens
gcagcccaggaccctggacaga

SEQ ID NO: 9336725 - DNA, 22 bp, Homo sapiens
gcagccctcgctagctctcccc

SEQ ID NO: 9336726 - DNA, 18 bp, Homo sapiens
gcagcccctcttccttcc

SEQ ID NO: 9336727 - DNA, 18 bp, Homo sapiens
gcagcccctcttccttcc

SEQ ID NO: 9336728 - DNA, 22 bp, Homo sapiens
gcagccccaggagacgcccagg

SEQ ID NO: 9336729 - DNA, 22 bp, Homo sapiens
gcagccctaacctgtcatagtg

SEQ ID NO: 9336730 - DNA, 22 bp, Homo sapiens
gcagatggatcacctgaggtcg

SEQ ID NO: 9336731 - DNA, 22 bp, Homo sapiens
gcagatggagacgaggttccgc

SEQ ID NO: 9336732 - DNA, 22 bp, Homo sapiens
gcagatggatcacctgaggtcg

SEQ ID NO: 9336733 - DNA, 22 bp, Homo sapiens
gcagatggcagcccaggctggg

SEQ ID NO: 9336734 - DNA, 22 bp, Homo sapiens
gcagatggcagcccaggctggg

SEQ ID NO: 9336735 - DNA, 22 bp, Homo sapiens
gcagatggcgcagtggaagttc

SEQ ID NO: 9336736 - DNA, 22 bp, Homo sapiens
gcagatggcgcagtggaagttc

SEQ ID NO: 9336737 - DNA, 23 bp, Homo sapiens
gcagatggccccagagtgctgcc

SEQ ID NO: 9336738 - DNA, 21 bp, Homo sapiens
gcagatgggagtcatcaggct

SEQ ID NO: 9336739 - DNA, 21 bp, Homo sapiens
gcagatgggaagagacgaggc

SEQ ID NO: 9336740 - DNA, 22 bp, Homo sapiens
gcagatgggagccccaggggag

SEQ ID NO: 9336741 - DNA, 22 bp, Homo sapiens
gcagatggctcagacactgggg

SEQ ID NO: 9336742 - DNA, 22 bp, Homo sapiens
gcagatggctcagacactgggg

SEQ ID NO: 9336743 - DNA, 22 bp, Homo sapiens
gcagatggctgagcctgcagat

SEQ ID NO: 9336744 - DNA, 21 bp, Homo sapiens
gcagatgggagtcatcaggct

SEQ ID NO: 9336745 - DNA, 22 bp, Homo sapiens
gcagatggtggaggcaagaggc

SEQ ID NO: 9336746 - DNA, 22 bp, Homo sapiens
gcagatggtggggcaggaaaat

SEQ ID NO: 9336747 - DNA, 22 bp, Homo sapiens
gcagggctgggtcctgtctcat

SEQ ID NO: 9336748 - DNA, 22 bp, Homo sapiens
gcagggctgggtcctgtctcat

SEQ ID NO: 9336749 - DNA, 22 bp, Homo sapiens
gcagggctggggctgctcctga

SEQ ID NO: 9336750 - DNA, 22 bp, Homo sapiens
gcagggctgggtcctgtctcat

SEQ ID NO: 9336751 - DNA, 22 bp, Homo sapiens
gcagggctggggctgctcctga

SEQ ID NO: 9336752 - DNA, 22 bp, Homo sapiens
gcagggctggggctgctcctga

SEQ ID NO: 9336753 - DNA, 22 bp, Homo sapiens
gcagggctgaaggtcccaggcc

SEQ ID NO: 9336754 - DNA, 22 bp, Homo sapiens
gcagggctgtaatttgagcctg

SEQ ID NO: 9336755 - DNA, 22 bp, Homo sapiens
gcagggctgtaatttgagcctg

SEQ ID NO: 9336756 - DNA, 22 bp, Homo sapiens
gcagggctgtggacactttggt

SEQ ID NO: 9336757 - DNA, 22 bp, Homo sapiens
gcagggctgtaatttgagcctg

SEQ ID NO: 9336758 - DNA, 22 bp, Homo sapiens
gcagggctgggtgggagacaga

SEQ ID NO: 9336759 - DNA, 22 bp, Homo sapiens
gcagggctgggtgggagacaga

SEQ ID NO: 9336760 - DNA, 22 bp, Homo sapiens
gcagggctgggtgggagacaga

SEQ ID NO: 9336761 - DNA, 22 bp, Homo sapiens
gcagggcttgcagcagctagac

SEQ ID NO: 9336762 - DNA, 22 bp, Homo sapiens
gcaggggagtccactctatgca

SEQ ID NO: 9336763 - DNA, 22 bp, Homo sapiens
gcagggctttttgaaacatggt

SEQ ID NO: 9336764 - DNA, 22 bp, Homo sapiens
gcagggcttagaaatggtggct

SEQ ID NO: 9336765 - DNA, 22 bp, Homo sapiens
gcagggcttagaaatggtggct

SEQ ID NO: 9336766 - DNA, 22 bp, Homo sapiens
gcagggcttgcagcagctagac

SEQ ID NO: 9336767 - DNA, 22 bp, Homo sapiens
gcagggcttgcagcagctagac

SEQ ID NO: 9336768 - DNA, 22 bp, Homo sapiens
gcagggctgttcaggagggtgg

SEQ ID NO: 9336769 - DNA, 22 bp, Homo sapiens
gcagggctgtggacactttggt

SEQ ID NO: 9336770 - DNA, 22 bp, Homo sapiens
gcagggctgttcaggagggtgg

SEQ ID NO: 9336771 - DNA, 22 bp, Homo sapiens
gcagggctgtttagtgaatagg

SEQ ID NO: 9336772 - DNA, 22 bp, Homo sapiens
gcagggcttagaaatggtggct

SEQ ID NO: 9336773 - DNA, 22 bp, Homo sapiens
gcagggctgttcaggagggtgg

SEQ ID NO: 9336774 - DNA, 22 bp, Homo sapiens
gcagggctgttcaggagggtgg

SEQ ID NO: 9336775 - DNA, 22 bp, Homo sapiens
gcagggctgttcaggagggtgg

SEQ ID NO: 9336776 - DNA, 22 bp, Homo sapiens
gcagggacctgccactgctgtc

SEQ ID NO: 9336777 - DNA, 22 bp, Homo sapiens
gcagggacctcactacccccag

SEQ ID NO: 9336778 - DNA, 22 bp, Homo sapiens
gcagggctctgctgtagtccta

SEQ ID NO: 9336779 - DNA, 22 bp, Homo sapiens
gcagggctgaaggtcccaggcc

SEQ ID NO: 9336780 - DNA, 22 bp, Homo sapiens
gcagggctgaaggtcccaggcc

SEQ ID NO: 9336781 - DNA, 22 bp, Homo sapiens
gcagggctctgctgtagtccta

SEQ ID NO: 9336782 - DNA, 22 bp, Homo sapiens
gcagggacctgccactgctgtc

SEQ ID NO: 9336783 - DNA, 22 bp, Homo sapiens
gcagggaccaaaagaggcagta

SEQ ID NO: 9336784 - DNA, 22 bp, Homo sapiens
gcagggaccaaaagaggcagta

SEQ ID NO: 9336785 - DNA, 22 bp, Homo sapiens
gcagggaccaaaagaggcagta

SEQ ID NO: 9336786 - DNA, 21 bp, Homo sapiens
gcagggaccgcgacttctggg

SEQ ID NO: 9336787 - DNA, 22 bp, Homo sapiens
gcagggacctatgacgatggaa

SEQ ID NO: 9336788 - DNA, 21 bp, Homo sapiens
gcagggaccgcgacttctggg

SEQ ID NO: 9336789 - DNA, 22 bp, Homo sapiens
gcagggaccagggccagatcca

SEQ ID NO: 9336790 - DNA, 22 bp, Homo sapiens
gcagggacacctttgtgaagct

SEQ ID NO: 9336791 - DNA, 22 bp, Homo sapiens
gcagggacagggcagggccttt

SEQ ID NO: 9336792 - DNA, 22 bp, Homo sapiens
gcagggacagggcagggccttt

SEQ ID NO: 9336793 - DNA, 22 bp, Homo sapiens
gcagggacatctttgtctagta

SEQ ID NO: 9336794 - DNA, 22 bp, Homo sapiens
gcagggacatctttgtctagta

SEQ ID NO: 9336795 - DNA, 22 bp, Homo sapiens
gcagggaccaaaagaggcagta

SEQ ID NO: 9336796 - DNA, 22 bp, Homo sapiens
gcagggacatcttcagatcact

SEQ ID NO: 9336797 - DNA, 22 bp, Homo sapiens
gcagggacaaggcaggtgttct

SEQ ID NO: 9336798 - DNA, 22 bp, Homo sapiens
gcagggacaactgtgcacctga

SEQ ID NO: 9336799 - DNA, 22 bp, Homo sapiens
gcagggacaaggcaggtgttct

SEQ ID NO: 9336800 - DNA, 22 bp, Homo sapiens
gcagggacacctttgtgaagct

SEQ ID NO: 9336801 - DNA, 18 bp, Homo sapiens
gcagggacacagggtcac

SEQ ID NO: 9336802 - DNA, 22 bp, Homo sapiens
gcagggacaaggcaggtgttct

SEQ ID NO: 9336803 - DNA, 22 bp, Homo sapiens
gcaggcagatcacctgtcagga

SEQ ID NO: 9336804 - DNA, 22 bp, Homo sapiens
gcaggcagatcacctgtcagga

SEQ ID NO: 9336805 - DNA, 14 bp, Homo sapiens
gcaggcagatcact

SEQ ID NO: 9336806 - DNA, 22 bp, Homo sapiens
gcaggcagatcacctgtcagga

SEQ ID NO: 9336807 - DNA, 22 bp, Homo sapiens
gcaggcagatcacctgtcagga

SEQ ID NO: 9336808 - DNA, 22 bp, Homo sapiens
gcaggcagccacgattcccttg

SEQ ID NO: 9336809 - DNA, 14 bp, Homo sapiens
gcaggcagatcatt

SEQ ID NO: 9336810 - DNA, 22 bp, Homo sapiens
gcaggcagccacgattcccttg

SEQ ID NO: 9336811 - DNA, 19 bp, Homo sapiens
gcaggcagctggggtatcc

SEQ ID NO: 9336812 - DNA, 19 bp, Homo sapiens
gcaggcagctggggtatcc

SEQ ID NO: 9336813 - DNA, 22 bp, Homo sapiens
gcaggcaggtggcatcttgtga

SEQ ID NO: 9336814 - DNA, 19 bp, Homo sapiens
gcaggcagctggggtatcc

SEQ ID NO: 9336815 - DNA, 22 bp, Homo sapiens
gcaggacacagatgcaaggcca

SEQ ID NO: 9336816 - DNA, 22 bp, Homo sapiens
gcaggacacagatgcaaggcca

SEQ ID NO: 9336817 - DNA, 16 bp, Homo sapiens
gcaggacactcagaca

SEQ ID NO: 9336818 - DNA, 22 bp, Homo sapiens
gcaggcagaggtggaggagaca

SEQ ID NO: 9336819 - DNA, 22 bp, Homo sapiens
gcaggcagaggtggaggagaca

SEQ ID NO: 9336820 - DNA, 22 bp, Homo sapiens
gcaggcagaggtggaggagaca

SEQ ID NO: 9336821 - DNA, 22 bp, Homo sapiens
gcaggcagagtcaatttgatcc

SEQ ID NO: 9336822 - DNA, 16 bp, Homo sapiens
gcaggcagatcacatg

SEQ ID NO: 9336823 - DNA, 22 bp, Homo sapiens
gcaggcagagtcaatttgatcc

SEQ ID NO: 9336824 - DNA, 22 bp, Homo sapiens
gcaggcagagtcaatttgatcc

SEQ ID NO: 9336825 - DNA, 22 bp, Homo sapiens
gcaggcagatcacctgtcagga

SEQ ID NO: 9336826 - DNA, 22 bp, Homo sapiens
gcaggcagatcacctgtcagga

SEQ ID NO: 9336827 - DNA, 15 bp, Homo sapiens
gcaggcagatcaccg

SEQ ID NO: 9336828 - DNA, 16 bp, Homo sapiens
gcaggcagatcacatg

SEQ ID NO: 9336829 - DNA, 16 bp, Homo sapiens
gcaggcagatcacatg

SEQ ID NO: 9336830 - DNA, 14 bp, Homo sapiens
gcaggcagatcacc

SEQ ID NO: 9336831 - DNA, 22 bp, Homo sapiens
gcagggaagatcttggagctgc

SEQ ID NO: 9336832 - DNA, 22 bp, Homo sapiens
gcagggaagatcttggagctgc

SEQ ID NO: 9336833 - DNA, 22 bp, Homo sapiens
gcagggaagacccggagcagcg

SEQ ID NO: 9336834 - DNA, 22 bp, Homo sapiens
gcagggaagacccggagcagcg

SEQ ID NO: 9336835 - DNA, 22 bp, Homo sapiens
gcagggaagggaaacagagacc

SEQ ID NO: 9336836 - DNA, 22 bp, Homo sapiens
gcagggaagatcttggagctgc

SEQ ID NO: 9336837 - DNA, 22 bp, Homo sapiens
gcagggaaggggacggaaccag

SEQ ID NO: 9336838 - DNA, 22 bp, Homo sapiens
gcagggaagggaaacagagacc

SEQ ID NO: 9336839 - DNA, 22 bp, Homo sapiens
gcagggacaactgtgcacctga

SEQ ID NO: 9336840 - DNA, 22 bp, Homo sapiens
gcagggacaactgtgcacctga

SEQ ID NO: 9336841 - DNA, 21 bp, Homo sapiens
gcagggacaaagcttcaggag

SEQ ID NO: 9336842 - DNA, 21 bp, Homo sapiens
gcagggacaaagcttcaggag

SEQ ID NO: 9336843 - DNA, 22 bp, Homo sapiens
gcagggaaggggcatgctggag

SEQ ID NO: 9336844 - DNA, 22 bp, Homo sapiens
gcagggaaggggcatgctggag

SEQ ID NO: 9336845 - DNA, 22 bp, Homo sapiens
gcagggaagtttgatctttttc

SEQ ID NO: 9336846 - DNA, 22 bp, Homo sapiens
gcagggaagttgtaatgtaatg

SEQ ID NO: 9336847 - DNA, 22 bp, Homo sapiens
gcaggcagttatttagtagaat

SEQ ID NO: 9336848 - DNA, 19 bp, Homo sapiens
gcaggcagtggcattcgga

SEQ ID NO: 9336849 - DNA, 19 bp, Homo sapiens
gcaggcagtggcattcgga

SEQ ID NO: 9336850 - DNA, 19 bp, Homo sapiens
gcaggcagtggcattcgga

SEQ ID NO: 9336851 - DNA, 22 bp, Homo sapiens
gcaggcagtcatctttcatatt

SEQ ID NO: 9336852 - DNA, 22 bp, Homo sapiens
gcaggcaggtggcatcttgtga

SEQ ID NO: 9336853 - DNA, 22 bp, Homo sapiens
gcaggcagtcatctttcatatt

SEQ ID NO: 9336854 - DNA, 22 bp, Homo sapiens
gcaggcagtcatctttcatatt

SEQ ID NO: 9336855 - DNA, 22 bp, Homo sapiens
gcaggcagttatttagtagaat

SEQ ID NO: 9336856 - DNA, 22 bp, Homo sapiens
gcaggcagttatttagtagaat

SEQ ID NO: 9336857 - DNA, 22 bp, Homo sapiens
gcagggaagacccggagcagcg

SEQ ID NO: 9336858 - DNA, 22 bp, Homo sapiens
gcaggcagttgcagttttctag

SEQ ID NO: 9336859 - DNA, 22 bp, Homo sapiens
gcaggcagttgcagttttctag

SEQ ID NO: 9336860 - DNA, 22 bp, Homo sapiens
gcaggcagttgcagttttctag

SEQ ID NO: 9336861 - DNA, 22 bp, Homo sapiens
gcagggaagacccggagcagcg

SEQ ID NO: 9336862 - DNA, 22 bp, Homo sapiens
gcaggcagttgcagttttctag

SEQ ID NO: 9336863 - DNA, 22 bp, Homo sapiens
gcagaggatagcatatgaacct

SEQ ID NO: 9336864 - DNA, 22 bp, Homo sapiens
gcagaggagtgattatgccgtg

SEQ ID NO: 9336865 - DNA, 22 bp, Homo sapiens
gcagaggagtgattatgccgtg

SEQ ID NO: 9336866 - DNA, 22 bp, Homo sapiens
gcagagcagtactctcttgact

SEQ ID NO: 9336867 - DNA, 22 bp, Homo sapiens
gcagagcaggggctgaacctgg

SEQ ID NO: 9336868 - DNA, 22 bp, Homo sapiens
gcagagcagggattttgccata

SEQ ID NO: 9336869 - DNA, 22 bp, Homo sapiens
gcagagcagggattttgccata

SEQ ID NO: 9336870 - DNA, 22 bp, Homo sapiens
gcagagcagtactctcttgact

SEQ ID NO: 9336871 - DNA, 22 bp, Homo sapiens
gcagagcagaggtgcaggttgg

SEQ ID NO: 9336872 - DNA, 18 bp, Homo sapiens
gcagagcagaagctcaag

SEQ ID NO: 9336873 - DNA, 22 bp, Homo sapiens
gcagagcagagcctgcattggc

SEQ ID NO: 9336874 - DNA, 22 bp, Homo sapiens
gcagagcagcaaatggaaagga

SEQ ID NO: 9336875 - DNA, 22 bp, Homo sapiens
gcagagcagcaaatggaaagga

SEQ ID NO: 9336876 - DNA, 22 bp, Homo sapiens
gcagagcaggaaggaagtcagg

SEQ ID NO: 9336877 - DNA, 22 bp, Homo sapiens
gcagagcaggaaggaagtcagg

SEQ ID NO: 9336878 - DNA, 22 bp, Homo sapiens
gcagaggatagcatatgaacct

SEQ ID NO: 9336879 - DNA, 22 bp, Homo sapiens
gcagaggatcaggctctggaaa

SEQ ID NO: 9336880 - DNA, 22 bp, Homo sapiens
gcagaggatagcatatgaacct

SEQ ID NO: 9336881 - DNA, 22 bp, Homo sapiens
gcagaggatcaggctctggaaa

SEQ ID NO: 9336882 - DNA, 22 bp, Homo sapiens
gcagaggatcaggctctggaaa

SEQ ID NO: 9336883 - DNA, 22 bp, Homo sapiens
gcagaggatcaggctctggaaa

SEQ ID NO: 9336884 - DNA, 22 bp, Homo sapiens
gcagaggcatttctgacgctgc

SEQ ID NO: 9336885 - DNA, 21 bp, Homo sapiens
gcagaggcacggcaccaaggg

SEQ ID NO: 9336886 - DNA, 21 bp, Homo sapiens
gcagaggcacggcaccaaggg

SEQ ID NO: 9336887 - DNA, 22 bp, Homo sapiens
gcagaggtcaaatacctcattt

SEQ ID NO: 9336888 - DNA, 22 bp, Homo sapiens
gcagagggtcctgtgccagcag

SEQ ID NO: 9336889 - DNA, 22 bp, Homo sapiens
gcagaggccaggccaccagcaa

SEQ ID NO: 9336890 - DNA, 22 bp, Homo sapiens
gcagaggcatttctgacgctgc

SEQ ID NO: 9336891 - DNA, 22 bp, Homo sapiens
gcagaggtgaccagcagcaggg

SEQ ID NO: 9336892 - DNA, 22 bp, Homo sapiens
gcagaggtctagcaccaagaat

SEQ ID NO: 9336893 - DNA, 22 bp, Homo sapiens
gcagatggaaagtgcttgaggg

SEQ ID NO: 9336894 - DNA, 20 bp, Homo sapiens
gcagagtgtgagagggtgaa

SEQ ID NO: 9336895 - DNA, 20 bp, Homo sapiens
gcagagtgtgagagggtgaa

SEQ ID NO: 9336896 - DNA, 22 bp, Homo sapiens
gcagactgtatcaatgtcagta

SEQ ID NO: 9336897 - DNA, 22 bp, Homo sapiens
gcagagaaagttttgtcctcag

SEQ ID NO: 9336898 - DNA, 22 bp, Homo sapiens
gcagagaagatgcccaggcttc

SEQ ID NO: 9336899 - DNA, 22 bp, Homo sapiens
gcagagatttcagtaacagcag

SEQ ID NO: 9336900 - DNA, 22 bp, Homo sapiens
gcagagaagatgcccaggcttc

SEQ ID NO: 9336901 - DNA, 18 bp, Homo sapiens
gcagagcagaagctcaag

SEQ ID NO: 9336902 - DNA, 22 bp, Homo sapiens
gcagagcaccaaagtgaaagat

SEQ ID NO: 9336903 - DNA, 22 bp, Homo sapiens
gcagagcaccaaagtgaaagat

SEQ ID NO: 9336904 - DNA, 22 bp, Homo sapiens
gcagactgcgagcgtgctggtg

SEQ ID NO: 9336905 - DNA, 21 bp, Homo sapiens
gcagactgccctgctgtcccc

SEQ ID NO: 9336906 - DNA, 22 bp, Homo sapiens
gcagactggtcttcagccttgg

SEQ ID NO: 9336907 - DNA, 22 bp, Homo sapiens
gcagactgtacctggaagaggg

SEQ ID NO: 9336908 - DNA, 22 bp, Homo sapiens
gcagactgtatcaatgtcagta

SEQ ID NO: 9336909 - DNA, 22 bp, Homo sapiens
gcagactctgagagtgagtgcc

SEQ ID NO: 9336910 - DNA, 22 bp, Homo sapiens
gcagacctgaccttgggcagca

SEQ ID NO: 9336911 - DNA, 22 bp, Homo sapiens
gcagacatgtgttctaacagga

SEQ ID NO: 9336912 - DNA, 22 bp, Homo sapiens
gcacagtggtgaaagcatgggt

SEQ ID NO: 9336913 - DNA, 22 bp, Homo sapiens
gcacagtggagtgtgtccaggg

SEQ ID NO: 9336914 - DNA, 22 bp, Homo sapiens
gcacagttaaagggtcatgtga

SEQ ID NO: 9336915 - DNA, 22 bp, Homo sapiens
gcacatccaatgattgttttga

SEQ ID NO: 9336916 - DNA, 22 bp, Homo sapiens
gcacatccaatgattgttttga

SEQ ID NO: 9336917 - DNA, 22 bp, Homo sapiens
gcacatatgctgtaagcacatg

SEQ ID NO: 9336918 - DNA, 22 bp, Homo sapiens
gcacatacatattagtgtcaca

SEQ ID NO: 9336919 - DNA, 22 bp, Homo sapiens
gcacatacccactgtcaagcac

SEQ ID NO: 9336920 - DNA, 22 bp, Homo sapiens
gcagacaggggcttaggaaagg

SEQ ID NO: 9336921 - DNA, 21 bp, Homo sapiens
gcacatgagggagggcatgcc

SEQ ID NO: 9336922 - DNA, 19 bp, Homo sapiens
gcagacaggtccagagagg

SEQ ID NO: 9336923 - DNA, 22 bp, Homo sapiens
gcacatgactttgaggaaacca

SEQ ID NO: 9336924 - DNA, 22 bp, Homo sapiens
gcacatctggagctctgtggaa

SEQ ID NO: 9336925 - DNA, 20 bp, Homo sapiens
gcacatctgctttggatttc

SEQ ID NO: 9336926 - DNA, 19 bp, Homo sapiens
gcacacatacaccctttgg

SEQ ID NO: 9336927 - DNA, 20 bp, Homo sapiens
gcacacatagaaatgcatat

SEQ ID NO: 9336928 - DNA, 20 bp, Homo sapiens
gcacacatagaaatgcatat

SEQ ID NO: 9336929 - DNA, 20 bp, Homo sapiens
gcacacatagaaatgcatat

SEQ ID NO: 9336930 - DNA, 22 bp, Homo sapiens
gcacacatatatatgagcatgt

SEQ ID NO: 9336931 - DNA, 22 bp, Homo sapiens
gcacacatatatatgagcatgt

SEQ ID NO: 9336932 - DNA, 22 bp, Homo sapiens
gcacacatatatatgagcatgt

SEQ ID NO: 9336933 - DNA, 22 bp, Homo sapiens
gcacacatgcatgcacaggagt

SEQ ID NO: 9336934 - DNA, 22 bp, Homo sapiens
gcacacatgcatgcacaggagt

SEQ ID NO: 9336935 - DNA, 22 bp, Homo sapiens
gcacacatcttgtaatcctgag

SEQ ID NO: 9336936 - DNA, 22 bp, Homo sapiens
gcacacatgcatgcacaggagt

SEQ ID NO: 9336937 - DNA, 22 bp, Homo sapiens
gcacacatgcatgtgtgcatcc

SEQ ID NO: 9336938 - DNA, 22 bp, Homo sapiens
gcacacatgcatgcacaggagt

SEQ ID NO: 9336939 - DNA, 22 bp, Homo sapiens
gcacacatgcatgtgtgcatcc

SEQ ID NO: 9336940 - DNA, 22 bp, Homo sapiens
gcacacatgcatgtgtgcatcc

SEQ ID NO: 9336941 - DNA, 22 bp, Homo sapiens
gcacacatgcatgtgtgcatcc

SEQ ID NO: 9336942 - DNA, 22 bp, Homo sapiens
gcacacatgcgtgtatatgggt

SEQ ID NO: 9336943 - DNA, 22 bp, Homo sapiens
gcacacattcggattcttaacc

SEQ ID NO: 9336944 - DNA, 22 bp, Homo sapiens
gcacacatgcgtgtatatgggt

SEQ ID NO: 9336945 - DNA, 22 bp, Homo sapiens
gcacacatgtgagtgtcctttc

SEQ ID NO: 9336946 - DNA, 22 bp, Homo sapiens
gcacacattcggattcttaacc

SEQ ID NO: 9336947 - DNA, 22 bp, Homo sapiens
gcaaatattcaagacttttcca

SEQ ID NO: 9336948 - DNA, 22 bp, Homo sapiens
gcacacactgttttcctcacat

SEQ ID NO: 9336949 - DNA, 22 bp, Homo sapiens
gcacacagaatcagtgggcata

SEQ ID NO: 9336950 - DNA, 22 bp, Homo sapiens
gcaaatatttctaattcctgaa

SEQ ID NO: 9336951 - DNA, 19 bp, Homo sapiens
gcacacagtagggctggca

SEQ ID NO: 9336952 - DNA, 22 bp, Homo sapiens
gcacacagtagggattcaatga

SEQ ID NO: 9336953 - DNA, 22 bp, Homo sapiens
gcacaggccatgggaggacagc

SEQ ID NO: 9336954 - DNA, 22 bp, Homo sapiens
gcacaggctccggaggagagct

SEQ ID NO: 9336955 - DNA, 22 bp, Homo sapiens
gcacagaaccagacatgaggca

SEQ ID NO: 9336956 - DNA, 22 bp, Homo sapiens
gcacacattctagccttttgtg

SEQ ID NO: 9336957 - DNA, 21 bp, Homo sapiens
gcacaccctccaggcccggcg

SEQ ID NO: 9336958 - DNA, 22 bp, Homo sapiens
gcacaccttagaggggagctgc

SEQ ID NO: 9336959 - DNA, 22 bp, Homo sapiens
gcacagaaatgtctacacatgt

SEQ ID NO: 9336960 - DNA, 22 bp, Homo sapiens
gcacaggctctcttggggacac

SEQ ID NO: 9336961 - DNA, 22 bp, Homo sapiens
gcacagggctgccaggcggctt

SEQ ID NO: 9336962 - DNA, 22 bp, Homo sapiens
gcacagggctgccaggcggctt

SEQ ID NO: 9336963 - DNA, 22 bp, Homo sapiens
gcacagtgataggcagttgtgc

SEQ ID NO: 9336964 - DNA, 22 bp, Homo sapiens
gcaaagcaagattcagatgtag

SEQ ID NO: 9336965 - DNA, 22 bp, Homo sapiens
gcaaagcaagctgtcagcctca

SEQ ID NO: 9336966 - DNA, 22 bp, Homo sapiens
gcaaagcacactggagatgtcg

SEQ ID NO: 9336967 - DNA, 22 bp, Homo sapiens
gcaaagctgggtgtgaatgcac

SEQ ID NO: 9336968 - DNA, 22 bp, Homo sapiens
gcaaaggtagccaaggagctca

SEQ ID NO: 9336969 - DNA, 17 bp, Homo sapiens
gcaaaggtgaggagaga

SEQ ID NO: 9336970 - DNA, 17 bp, Homo sapiens
gcaaaggtgaggagaga

SEQ ID NO: 9336971 - DNA, 22 bp, Homo sapiens
gcaaaggtagccaaggagctca

SEQ ID NO: 9336972 - DNA, 17 bp, Homo sapiens
gcaaaggtgaggagaga

SEQ ID NO: 9336973 - DNA, 22 bp, Homo sapiens
gcaaagtattaaccaacaggat

SEQ ID NO: 9336974 - DNA, 22 bp, Homo sapiens
gcaaaggccactggggcgatgg

SEQ ID NO: 9336975 - DNA, 22 bp, Homo sapiens
gcaaataatatactttgatctc

SEQ ID NO: 9336976 - DNA, 22 bp, Homo sapiens
gcaaatacatgttgagcaccta

SEQ ID NO: 9336977 - DNA, 22 bp, Homo sapiens
gaggcccaaggactctgtcccg

SEQ ID NO: 9336978 - DNA, 22 bp, Homo sapiens
gaggcccaaggactctgtcccg

SEQ ID NO: 9336979 - DNA, 22 bp, Homo sapiens
gaggcccaaggactctgtcccg

SEQ ID NO: 9336980 - DNA, 22 bp, Homo sapiens
gaggccaggaggatctctctaa

SEQ ID NO: 9336981 - DNA, 22 bp, Homo sapiens
gaggccagggtaccatcaacat

SEQ ID NO: 9336982 - DNA, 22 bp, Homo sapiens
gaggccaggaggatctctctaa

SEQ ID NO: 9336983 - DNA, 22 bp, Homo sapiens
gaggccaggaggatctctctaa

SEQ ID NO: 9336984 - DNA, 22 bp, Homo sapiens
gaggccagtgtgctgtgttttc

SEQ ID NO: 9336985 - DNA, 22 bp, Homo sapiens
gaggccagtgaaatgttataaa

SEQ ID NO: 9336986 - DNA, 22 bp, Homo sapiens
gaggcccagcagcgcaggtctt

SEQ ID NO: 9336987 - DNA, 22 bp, Homo sapiens
gaggcccagcagcgcaggtctt

SEQ ID NO: 9336988 - DNA, 22 bp, Homo sapiens
gaggcccagagaggttgcatga

SEQ ID NO: 9336989 - DNA, 20 bp, Homo sapiens
gaggcccagagaggtgaagc

SEQ ID NO: 9336990 - DNA, 20 bp, Homo sapiens
gaggcccagagaggtgaagc

SEQ ID NO: 9336991 - DNA, 22 bp, Homo sapiens
gaggcccaatgcttccctcctt

SEQ ID NO: 9336992 - DNA, 22 bp, Homo sapiens
gaggcccacagggagtaccaag

SEQ ID NO: 9336993 - DNA, 22 bp, Homo sapiens
gaggcccacagggagtaccaag

SEQ ID NO: 9336994 - DNA, 22 bp, Homo sapiens
gcaaagacggactcaggagtgc

SEQ ID NO: 9336995 - DNA, 18 bp, Homo sapiens
gcaaagacaggctgggct

SEQ ID NO: 9336996 - DNA, 22 bp, Homo sapiens
gcaaagaaatgtcagtgagagg

SEQ ID NO: 9336997 - DNA, 22 bp, Homo sapiens
gcaaactggtagctcgcctgcc

SEQ ID NO: 9336998 - DNA, 22 bp, Homo sapiens
gaggcccagcagcgcaggtctt

SEQ ID NO: 9336999 - DNA, 22 bp, Homo sapiens
gcatgcaggaagggcttgggga

SEQ ID NO: 9337000 - DNA, 22 bp, Homo sapiens
gcatgcaggaagggcttgggga

SEQ ID NO: 9337001 - DNA, 19 bp, Homo sapiens
gcatgcagagtaagaaggt

SEQ ID NO: 9337002 - DNA, 22 bp, Homo sapiens
gcagtgggagcttaggcagtgc

SEQ ID NO: 9337003 - DNA, 23 bp, Homo sapiens
gcatgcaacttgcagtagtattc

SEQ ID NO: 9337004 - DNA, 22 bp, Homo sapiens
gcatgcaattatggtattagat

SEQ ID NO: 9337005 - DNA, 22 bp, Homo sapiens
gcatgcacacctgtgcacattt

SEQ ID NO: 9337006 - DNA, 22 bp, Homo sapiens
gcatgcacacactttctcacta

SEQ ID NO: 9337007 - DNA, 22 bp, Homo sapiens
gcatgcacagtttttcacctca

SEQ ID NO: 9337008 - DNA, 22 bp, Homo sapiens
gcatgcactgtatttaagtatc

SEQ ID NO: 9337009 - DNA, 22 bp, Homo sapiens
gcagtggccacatggaggagga

SEQ ID NO: 9337010 - DNA, 22 bp, Homo sapiens
gcagtggccacatggaggagga

SEQ ID NO: 9337011 - DNA, 22 bp, Homo sapiens
gcagtggccacatggaggagga

SEQ ID NO: 9337012 - DNA, 22 bp, Homo sapiens
gcagtggcccagcttgcaggct

SEQ ID NO: 9337013 - DNA, 22 bp, Homo sapiens
gcagtggccacatggaggagga

SEQ ID NO: 9337014 - DNA, 22 bp, Homo sapiens
gcagtggctaagctcgcatgca

SEQ ID NO: 9337015 - DNA, 22 bp, Homo sapiens
gcagtggctaggagtctggcgt

SEQ ID NO: 9337016 - DNA, 22 bp, Homo sapiens
gcagtggcccagcttgcaggct

SEQ ID NO: 9337017 - DNA, 22 bp, Homo sapiens
gcagtgggaaggttggcacatg

SEQ ID NO: 9337018 - DNA, 22 bp, Homo sapiens
gcagtggctaggagtctggcgt

SEQ ID NO: 9337019 - DNA, 17 bp, Homo sapiens
gcagtggaggggtagtt

SEQ ID NO: 9337020 - DNA, 23 bp, Homo sapiens
gcagtggaatgtctctgtttgga

SEQ ID NO: 9337021 - DNA, 22 bp, Homo sapiens
gcagtggatggccagcaggggc

SEQ ID NO: 9337022 - DNA, 22 bp, Homo sapiens
gcagtggatccaatggtatctt

SEQ ID NO: 9337023 - DNA, 22 bp, Homo sapiens
gcagtggcaccgctggctctgg

SEQ ID NO: 9337024 - DNA, 22 bp, Homo sapiens
gcagtggcagctgagggggtat

SEQ ID NO: 9337025 - DNA, 22 bp, Homo sapiens
gcagtggcagagacagcaccaa

SEQ ID NO: 9337026 - DNA, 22 bp, Homo sapiens
gcagtggcagctgagggggtat

SEQ ID NO: 9337027 - DNA, 22 bp, Homo sapiens
gcagtggcagctgagggggtat

SEQ ID NO: 9337028 - DNA, 22 bp, Homo sapiens
gcagtggcagagacagcaccaa

SEQ ID NO: 9337029 - DNA, 22 bp, Homo sapiens
gcagtggcatgatgtgggctca

SEQ ID NO: 9337030 - DNA, 22 bp, Homo sapiens
gcaggggagtggatgatggatt

SEQ ID NO: 9337031 - DNA, 22 bp, Homo sapiens
gcaggggagtccactctatgca

SEQ ID NO: 9337032 - DNA, 22 bp, Homo sapiens
gcaggggagtggatgatggatt

SEQ ID NO: 9337033 - DNA, 22 bp, Homo sapiens
gcaggggagtggatgatggatt

SEQ ID NO: 9337034 - DNA, 22 bp, Homo sapiens
gcagtgaagccagatctgaaat

SEQ ID NO: 9337035 - DNA, 22 bp, Homo sapiens
gcagtggaagcctctttaagca

SEQ ID NO: 9337036 - DNA, 22 bp, Homo sapiens
gcagtgagttatgatcatgcca

SEQ ID NO: 9337037 - DNA, 22 bp, Homo sapiens
gcatggctgctccctggctgca

SEQ ID NO: 9337038 - DNA, 22 bp, Homo sapiens
gcatggctggtgtcctgaggga

SEQ ID NO: 9337039 - DNA, 22 bp, Homo sapiens
gcatggctattatgaggcagaa

SEQ ID NO: 9337040 - DNA, 22 bp, Homo sapiens
gcatggctattctaactcacat

SEQ ID NO: 9337041 - DNA, 22 bp, Homo sapiens
gcatggctctggcctcagtgtg

SEQ ID NO: 9337042 - DNA, 22 bp, Homo sapiens
gcatggctctggcctcagtgtg

SEQ ID NO: 9337043 - DNA, 22 bp, Homo sapiens
gcatggctgttgaagtcagctc

SEQ ID NO: 9337044 - DNA, 22 bp, Homo sapiens
gcatggctgttgaagtcagctc

SEQ ID NO: 9337045 - DNA, 22 bp, Homo sapiens
gcatggctgtgagcaccctgcc

SEQ ID NO: 9337046 - DNA, 22 bp, Homo sapiens
gcatggctgttgaagtcagctc

SEQ ID NO: 9337047 - DNA, 22 bp, Homo sapiens
gcatggcttacagaggctgcag

SEQ ID NO: 9337048 - DNA, 22 bp, Homo sapiens
gcatggcttacagaggctgcag

SEQ ID NO: 9337049 - DNA, 22 bp, Homo sapiens
gcatggcttccaaaagtgctaa

SEQ ID NO: 9337050 - DNA, 22 bp, Homo sapiens
gcatggcttacagaggctgcag

SEQ ID NO: 9337051 - DNA, 20 bp, Homo sapiens
gcatggctaatctgtactga

SEQ ID NO: 9337052 - DNA, 22 bp, Homo sapiens
gcatggctattatgaggcagaa

SEQ ID NO: 9337053 - DNA, 22 bp, Homo sapiens
gcatgctgcccagggactctct

SEQ ID NO: 9337054 - DNA, 22 bp, Homo sapiens
gcatgctgcaccagagcctctc

SEQ ID NO: 9337055 - DNA, 22 bp, Homo sapiens
gcatgctgcaccagagcctctc

SEQ ID NO: 9337056 - DNA, 22 bp, Homo sapiens
gcatgcattttctgagagtcag

SEQ ID NO: 9337057 - DNA, 22 bp, Homo sapiens
gcatgcatttgtacttgatttt

SEQ ID NO: 9337058 - DNA, 22 bp, Homo sapiens
gcatgcatctagatatgcagac

SEQ ID NO: 9337059 - DNA, 22 bp, Homo sapiens
gcatgcatctagatatgcagac

SEQ ID NO: 9337060 - DNA, 22 bp, Homo sapiens
gcatgcattacatgggatatgc

SEQ ID NO: 9337061 - DNA, 22 bp, Homo sapiens
gcatgcatttccattctcacat

SEQ ID NO: 9337062 - DNA, 22 bp, Homo sapiens
gcatgcatttcactaggtatgt

SEQ ID NO: 9337063 - DNA, 22 bp, Homo sapiens
gcatgcatgatgttggcagtgg

SEQ ID NO: 9337064 - DNA, 22 bp, Homo sapiens
gcatgcatgtgtgcagacagtc

SEQ ID NO: 9337065 - DNA, 22 bp, Homo sapiens
gcatgcatggtttgtgactgtg

SEQ ID NO: 9337066 - DNA, 22 bp, Homo sapiens
gccaccagccccatgcgctgtg

SEQ ID NO: 9337067 - DNA, 22 bp, Homo sapiens
gccaccagcagaaaaggggcca

SEQ ID NO: 9337068 - DNA, 22 bp, Homo sapiens
gccacatgtcatgtgctcagta

SEQ ID NO: 9337069 - DNA, 22 bp, Homo sapiens
gccacatgtcatgtgctcagta

SEQ ID NO: 9337070 - DNA, 22 bp, Homo sapiens
gccacatgtcatgtgctcagta

SEQ ID NO: 9337071 - DNA, 22 bp, Homo sapiens
gccacatgcaattgcagcacgt

SEQ ID NO: 9337072 - DNA, 22 bp, Homo sapiens
gccacatccttcagaaagcttt

SEQ ID NO: 9337073 - DNA, 22 bp, Homo sapiens
gccacaggcttaggagggaggt

SEQ ID NO: 9337074 - DNA, 22 bp, Homo sapiens
gccacaggcttaggagggaggt

SEQ ID NO: 9337075 - DNA, 22 bp, Homo sapiens
gccacaggcttaggagggaggt

SEQ ID NO: 9337076 - DNA, 22 bp, Homo sapiens
gccacaggcttaggagggaggt

SEQ ID NO: 9337077 - DNA, 22 bp, Homo sapiens
gccacaggcttaggagggaggt

SEQ ID NO: 9337078 - DNA, 22 bp, Homo sapiens
gccacaggctccagcatcagta

SEQ ID NO: 9337079 - DNA, 22 bp, Homo sapiens
gccaccagggggtgcaaggtcc

SEQ ID NO: 9337080 - DNA, 22 bp, Homo sapiens
gccaccagtgggggcctgggca

SEQ ID NO: 9337081 - DNA, 22 bp, Homo sapiens
gccaccagggggctccagtgag

SEQ ID NO: 9337082 - DNA, 22 bp, Homo sapiens
gccaccaggagcccagtccaaa

SEQ ID NO: 9337083 - DNA, 22 bp, Homo sapiens
gccaccaggagcccagtccaaa

SEQ ID NO: 9337084 - DNA, 22 bp, Homo sapiens
gccaggcagcagcgaggatggt

SEQ ID NO: 9337085 - DNA, 22 bp, Homo sapiens
gccaggcagcagcgaggatggt

SEQ ID NO: 9337086 - DNA, 22 bp, Homo sapiens
gccaggcagatatgtgagctta

SEQ ID NO: 9337087 - DNA, 22 bp, Homo sapiens
gccaggcagccaccctctgcga

SEQ ID NO: 9337088 - DNA, 22 bp, Homo sapiens
gccaggcagccaccctctgcga

SEQ ID NO: 9337089 - DNA, 22 bp, Homo sapiens
gccaggcagcagcgaggatggt

SEQ ID NO: 9337090 - DNA, 22 bp, Homo sapiens
gccaggcagcagcgaggatggt

SEQ ID NO: 9337091 - DNA, 22 bp, Homo sapiens
gccaggcagcaggaagccagtg

SEQ ID NO: 9337092 - DNA, 22 bp, Homo sapiens
gccaggcagctagcaacccctg

SEQ ID NO: 9337093 - DNA, 22 bp, Homo sapiens
gccaggcagctagcaacccctg

SEQ ID NO: 9337094 - DNA, 22 bp, Homo sapiens
gccaggcagctagcaacccctg

SEQ ID NO: 9337095 - DNA, 22 bp, Homo sapiens
gccaggcagctgggagggtgcc

SEQ ID NO: 9337096 - DNA, 22 bp, Homo sapiens
gccaggcagctgggagggtgcc

SEQ ID NO: 9337097 - DNA, 22 bp, Homo sapiens
gccaggcaggccacgctgtgtt

SEQ ID NO: 9337098 - DNA, 22 bp, Homo sapiens
gccaggcaggccacgctgtgtt

SEQ ID NO: 9337099 - DNA, 22 bp, Homo sapiens
gccaggcagttcaagtacacca

SEQ ID NO: 9337100 - DNA, 22 bp, Homo sapiens
gccaggcagttcaagtacacca

SEQ ID NO: 9337101 - DNA, 22 bp, Homo sapiens
gccaggcaggtgtcggagccct

SEQ ID NO: 9337102 - DNA, 22 bp, Homo sapiens
gccaggcaggtgtcggagccct

SEQ ID NO: 9337103 - DNA, 22 bp, Homo sapiens
gccaggcaggtgtcggagccct

SEQ ID NO: 9337104 - DNA, 18 bp, Homo sapiens
gccaggcagggtggggaa

SEQ ID NO: 9337105 - DNA, 18 bp, Homo sapiens
gccaggcagggtggggaa

SEQ ID NO: 9337106 - DNA, 22 bp, Homo sapiens
gccaggcatgggcttctgggcg

SEQ ID NO: 9337107 - DNA, 22 bp, Homo sapiens
gccaggcatgggcttctgggcg

SEQ ID NO: 9337108 - DNA, 22 bp, Homo sapiens
gccagggaacccaagggcctca

SEQ ID NO: 9337109 - DNA, 22 bp, Homo sapiens
gccagggaacccaagggcctca

SEQ ID NO: 9337110 - DNA, 22 bp, Homo sapiens
gccagggaacccaagggcctca

SEQ ID NO: 9337111 - DNA, 22 bp, Homo sapiens
gccaggcatgtcctctgcagaa

SEQ ID NO: 9337112 - DNA, 22 bp, Homo sapiens
gccagggaggctgtagggtcct

SEQ ID NO: 9337113 - DNA, 22 bp, Homo sapiens
gccagggaggctgtagggtcct

SEQ ID NO: 9337114 - DNA, 17 bp, Homo sapiens
gccagggagaggaagcc

SEQ ID NO: 9337115 - DNA, 17 bp, Homo sapiens
gccagggagaggaagcc

SEQ ID NO: 9337116 - DNA, 17 bp, Homo sapiens
gccagggagaggaagcc

SEQ ID NO: 9337117 - DNA, 21 bp, Homo sapiens
gccagggaagagagttggctg

SEQ ID NO: 9337118 - DNA, 21 bp, Homo sapiens
gccagggaagagagttggctg

SEQ ID NO: 9337119 - DNA, 22 bp, Homo sapiens
gccagggctcgcggtccctcgt

SEQ ID NO: 9337120 - DNA, 22 bp, Homo sapiens
gccagggctcgcggtccctcgt

SEQ ID NO: 9337121 - DNA, 22 bp, Homo sapiens
gccagggctgtgcaggtttgtt

SEQ ID NO: 9337122 - DNA, 22 bp, Homo sapiens
gccagggctgtgcaggtttgtt

SEQ ID NO: 9337123 - DNA, 22 bp, Homo sapiens
gccagggctgtgcaggtttgtt

SEQ ID NO: 9337124 - DNA, 22 bp, Homo sapiens
gccagggcaggggagcatctgc

SEQ ID NO: 9337125 - DNA, 21 bp, Homo sapiens
gccagggagttaaagagtctt

SEQ ID NO: 9337126 - DNA, 21 bp, Homo sapiens
gccagggagttaaagagtctt

SEQ ID NO: 9337127 - DNA, 22 bp, Homo sapiens
gccagggcaggggagcatctgc

SEQ ID NO: 9337128 - DNA, 22 bp, Homo sapiens
gccagggagtctgggccacaga

SEQ ID NO: 9337129 - DNA, 22 bp, Homo sapiens
gccagggaggctgtagggtcct

SEQ ID NO: 9337130 - DNA, 22 bp, Homo sapiens
gccagggagtctgggccacaga

SEQ ID NO: 9337131 - DNA, 21 bp, Homo sapiens
gccagggagttaaagagtctt

SEQ ID NO: 9337132 - DNA, 22 bp, Homo sapiens
gccagggagtctgggccacaga

SEQ ID NO: 9337133 - DNA, 18 bp, Homo sapiens
gccagccctccaacctcc

SEQ ID NO: 9337134 - DNA, 22 bp, Homo sapiens
gccagccctgggagacttatgg

SEQ ID NO: 9337135 - DNA, 20 bp, Homo sapiens
gccagccctgacacaggagc

SEQ ID NO: 9337136 - DNA, 20 bp, Homo sapiens
gccagccctgacacaggagc

SEQ ID NO: 9337137 - DNA, 21 bp, Homo sapiens
gccagcctgtttacctgtggt

SEQ ID NO: 9337138 - DNA, 23 bp, Homo sapiens
gccagccttgctctcctgcagcc

SEQ ID NO: 9337139 - DNA, 23 bp, Homo sapiens
gccagccttgctctcctgcagcc

SEQ ID NO: 9337140 - DNA, 23 bp, Homo sapiens
gccagccttgctctcctgcagcc

SEQ ID NO: 9337141 - DNA, 23 bp, Homo sapiens
gccagccttgctctcctgcagcc

SEQ ID NO: 9337142 - DNA, 22 bp, Homo sapiens
gccagcctgtgcttggccaggc

SEQ ID NO: 9337143 - DNA, 22 bp, Homo sapiens
gccagcctgtgggggctctgtg

SEQ ID NO: 9337144 - DNA, 22 bp, Homo sapiens
gccagctcagatgcaggaagga

SEQ ID NO: 9337145 - DNA, 22 bp, Homo sapiens
gccagctcagtgccaggcccct

SEQ ID NO: 9337146 - DNA, 22 bp, Homo sapiens
gccagctcagtgccaggcccct

SEQ ID NO: 9337147 - DNA, 22 bp, Homo sapiens
gccagctcagatgcaggaagga

SEQ ID NO: 9337148 - DNA, 22 bp, Homo sapiens
gccagctcccaagtgagcccct

SEQ ID NO: 9337149 - DNA, 20 bp, Homo sapiens
gccaggcactgttctcaata

SEQ ID NO: 9337150 - DNA, 22 bp, Homo sapiens
gccaggcactgctctaagccct

SEQ ID NO: 9337151 - DNA, 22 bp, Homo sapiens
gccaggcactgctctaagccct

SEQ ID NO: 9337152 - DNA, 22 bp, Homo sapiens
gccaggcactgctctaagccct

SEQ ID NO: 9337153 - DNA, 22 bp, Homo sapiens
gccaggcagagccccgtgcagc

SEQ ID NO: 9337154 - DNA, 22 bp, Homo sapiens
gccaggcagagccccgtgcagc

SEQ ID NO: 9337155 - DNA, 22 bp, Homo sapiens
gccaggcagacaggtcatcagg

SEQ ID NO: 9337156 - DNA, 22 bp, Homo sapiens
gccaggcagacaggtcatcagg

SEQ ID NO: 9337157 - DNA, 22 bp, Homo sapiens
gccagctgaatttccaactgtt

SEQ ID NO: 9337158 - DNA, 22 bp, Homo sapiens
gccagctgaaatttcagttctg

SEQ ID NO: 9337159 - DNA, 22 bp, Homo sapiens
gccagctgaaatttcagttctg

SEQ ID NO: 9337160 - DNA, 22 bp, Homo sapiens
gccagctgaagccctggtggaa

SEQ ID NO: 9337161 - DNA, 22 bp, Homo sapiens
gccagctgaagccctggtggaa

SEQ ID NO: 9337162 - DNA, 22 bp, Homo sapiens
gcccagcactcctctctgacat

SEQ ID NO: 9337163 - DNA, 22 bp, Homo sapiens
gcccagccctgaggtcacagct

SEQ ID NO: 9337164 - DNA, 22 bp, Homo sapiens
gcccagcagctggtggagaagg

SEQ ID NO: 9337165 - DNA, 22 bp, Homo sapiens
gcccagcagatctcagtgtctc

SEQ ID NO: 9337166 - DNA, 22 bp, Homo sapiens
gcccagctgagaagcgcggggc

SEQ ID NO: 9337167 - DNA, 22 bp, Homo sapiens
gcccagctccattcttggtgag

SEQ ID NO: 9337168 - DNA, 22 bp, Homo sapiens
gcccagccctgaggtcacagct

SEQ ID NO: 9337169 - DNA, 22 bp, Homo sapiens
gccagggttcgaatccgtatgg

SEQ ID NO: 9337170 - DNA, 22 bp, Homo sapiens
gccagggtggcagaaggcccca

SEQ ID NO: 9337171 - DNA, 22 bp, Homo sapiens
gccagggtgtgcagggacagga

SEQ ID NO: 9337172 - DNA, 22 bp, Homo sapiens
gccagggtgagggctgagaggt

SEQ ID NO: 9337173 - DNA, 22 bp, Homo sapiens
gccaggggacgcggagcgacga

SEQ ID NO: 9337174 - DNA, 22 bp, Homo sapiens
gccagggggtcagcaggcactt

SEQ ID NO: 9337175 - DNA, 22 bp, Homo sapiens
gcccagcacattgctgaggacc

SEQ ID NO: 9337176 - DNA, 22 bp, Homo sapiens
gcccagcacattgctgaggacc

SEQ ID NO: 9337177 - DNA, 22 bp, Homo sapiens
gcccagcacatctggccttgaa

SEQ ID NO: 9337178 - DNA, 22 bp, Homo sapiens
gcccagcacatctggccttgaa

SEQ ID NO: 9337179 - DNA, 17 bp, Homo sapiens
gcccaggaaggacggcc

SEQ ID NO: 9337180 - DNA, 17 bp, Homo sapiens
gcccaggaaggacggcc

SEQ ID NO: 9337181 - DNA, 22 bp, Homo sapiens
gcccaggaagtgactcagatgt

SEQ ID NO: 9337182 - DNA, 22 bp, Homo sapiens
gcccaggaagtgactcagatgt

SEQ ID NO: 9337183 - DNA, 22 bp, Homo sapiens
gcccaggaaatgccccgtggtg

SEQ ID NO: 9337184 - DNA, 22 bp, Homo sapiens
gcccaggaagttgaggctgccg

SEQ ID NO: 9337185 - DNA, 22 bp, Homo sapiens
gcccaggaagttgaggctgccg

SEQ ID NO: 9337186 - DNA, 16 bp, Homo sapiens
gcccaggacgggaggc

SEQ ID NO: 9337187 - DNA, 22 bp, Homo sapiens
gcccagctttttgaggcaggca

SEQ ID NO: 9337188 - DNA, 22 bp, Homo sapiens
gcccagctgtctggcagggatg

SEQ ID NO: 9337189 - DNA, 22 bp, Homo sapiens
gcccaggaaataaaagtgggct

SEQ ID NO: 9337190 - DNA, 22 bp, Homo sapiens
gcccaggaaataaaagtgggct

SEQ ID NO: 9337191 - DNA, 22 bp, Homo sapiens
gcccaggaaatgccccgtggtg

SEQ ID NO: 9337192 - DNA, 22 bp, Homo sapiens
gcccagctttttgaggcaggca

SEQ ID NO: 9337193 - DNA, 22 bp, Homo sapiens
gcccaggaaagatagggcctca

SEQ ID NO: 9337194 - DNA, 22 bp, Homo sapiens
gcccaggaaagatagggcctca

SEQ ID NO: 9337195 - DNA, 22 bp, Homo sapiens
gcccaggagaggccagggctga

SEQ ID NO: 9337196 - DNA, 22 bp, Homo sapiens
gcccaggagcctggagatgtgt

SEQ ID NO: 9337197 - DNA, 22 bp, Homo sapiens
gcccaggagcctggagatgtgt

SEQ ID NO: 9337198 - DNA, 22 bp, Homo sapiens
gcccaggactcagggtgtcgcg

SEQ ID NO: 9337199 - DNA, 22 bp, Homo sapiens
gcccaggagaggccagggctga

SEQ ID NO: 9337200 - DNA, 22 bp, Homo sapiens
gcccaggagcctggagatgtgt

SEQ ID NO: 9337201 - DNA, 22 bp, Homo sapiens
gcccatggcttccctaggcaca

SEQ ID NO: 9337202 - DNA, 22 bp, Homo sapiens
gcccatggcagaactgtgagca

SEQ ID NO: 9337203 - DNA, 22 bp, Homo sapiens
gcccatgggctccagacctggg

SEQ ID NO: 9337204 - DNA, 18 bp, Homo sapiens
gcccatggtaaatgctgt

SEQ ID NO: 9337205 - DNA, 22 bp, Homo sapiens
gcccatgggcctgaggccctag

SEQ ID NO: 9337206 - DNA, 22 bp, Homo sapiens
gccccacagcctgcggtctcag

SEQ ID NO: 9337207 - DNA, 22 bp, Homo sapiens
gccccaccgagggtgcagtcct

SEQ ID NO: 9337208 - DNA, 22 bp, Homo sapiens
gccccacctgctaccttccagc

SEQ ID NO: 9337209 - DNA, 22 bp, Homo sapiens
gcccatggtcagggaggcaggg

SEQ ID NO: 9337210 - DNA, 22 bp, Homo sapiens
gcccatggtcagggaggcaggg

SEQ ID NO: 9337211 - DNA, 22 bp, Homo sapiens
gcccatggtccaggaagacaga

SEQ ID NO: 9337212 - DNA, 22 bp, Homo sapiens
gcccatggtgaggttgttggtg

SEQ ID NO: 9337213 - DNA, 22 bp, Homo sapiens
gcccatggttacttttctggct

SEQ ID NO: 9337214 - DNA, 22 bp, Homo sapiens
gcccatgtgatttcctgggagt

SEQ ID NO: 9337215 - DNA, 16 bp, Homo sapiens
gccccaatgattctga

SEQ ID NO: 9337216 - DNA, 22 bp, Homo sapiens
gccccaagtccctatgtttcca

SEQ ID NO: 9337217 - DNA, 22 bp, Homo sapiens
gcctcctgagtagctgggattg

SEQ ID NO: 9337218 - DNA, 22 bp, Homo sapiens
gcctcctgacttacactgagct

SEQ ID NO: 9337219 - DNA, 22 bp, Homo sapiens
gcctcctgacttacactgagct

SEQ ID NO: 9337220 - DNA, 22 bp, Homo sapiens
gcctcctgagaagccacaggct

SEQ ID NO: 9337221 - DNA, 22 bp, Homo sapiens
gcctcctgagaagccacaggct

SEQ ID NO: 9337222 - DNA, 22 bp, Homo sapiens
gcctcctggattttagtgccat

SEQ ID NO: 9337223 - DNA, 22 bp, Homo sapiens
gcctcctggattttagtgccat

SEQ ID NO: 9337224 - DNA, 22 bp, Homo sapiens
gcctcctggcctttgctcctca

SEQ ID NO: 9337225 - DNA, 22 bp, Homo sapiens
gcctcctggcctttgctcctca

SEQ ID NO: 9337226 - DNA, 22 bp, Homo sapiens
gcctcctgcccagatgagtgat

SEQ ID NO: 9337227 - DNA, 22 bp, Homo sapiens
gcctcctggaagtcacatgttt

SEQ ID NO: 9337228 - DNA, 22 bp, Homo sapiens
gcctctggcttctgcatcagtg

SEQ ID NO: 9337229 - DNA, 22 bp, Homo sapiens
gcctctgggctctgcccctggc

SEQ ID NO: 9337230 - DNA, 22 bp, Homo sapiens
gcctctgggctctgcccctggc

SEQ ID NO: 9337231 - DNA, 22 bp, Homo sapiens
gcctctgggctctgcccctggc

SEQ ID NO: 9337232 - DNA, 22 bp, Homo sapiens
gcctctgggctctgcccctggc

SEQ ID NO: 9337233 - DNA, 22 bp, Homo sapiens
gcctctggagtcgcagcgtctt

SEQ ID NO: 9337234 - DNA, 22 bp, Homo sapiens
gcctctggcttctgcatcagtg

SEQ ID NO: 9337235 - DNA, 22 bp, Homo sapiens
gcctctggcttctgcatcagtg

SEQ ID NO: 9337236 - DNA, 22 bp, Homo sapiens
gcctctggagttgcttgtaaat

SEQ ID NO: 9337237 - DNA, 22 bp, Homo sapiens
gcctctggagtcgcagcgtctt

SEQ ID NO: 9337238 - DNA, 22 bp, Homo sapiens
gcctcctggttgcttctccaac

SEQ ID NO: 9337239 - DNA, 22 bp, Homo sapiens
gcctcctggttgcttctccaac

SEQ ID NO: 9337240 - DNA, 22 bp, Homo sapiens
gcctcctgggttcatgccattc

SEQ ID NO: 9337241 - DNA, 22 bp, Homo sapiens
gcctcctgggttcatgccattc

SEQ ID NO: 9337242 - DNA, 22 bp, Homo sapiens
gcctcctggggtgccatcatct

SEQ ID NO: 9337243 - DNA, 22 bp, Homo sapiens
gcctcctggggtgccatcatct

SEQ ID NO: 9337244 - DNA, 23 bp, Homo sapiens
gcctcctagcagtaaacatgtta

SEQ ID NO: 9337245 - DNA, 22 bp, Homo sapiens
gcctcctcacaatgtacccacg

SEQ ID NO: 9337246 - DNA, 22 bp, Homo sapiens
gcctcctattaaaatttacctt

SEQ ID NO: 9337247 - DNA, 22 bp, Homo sapiens
gcctcctcacaatgtacccacg

SEQ ID NO: 9337248 - DNA, 22 bp, Homo sapiens
gcctcctccttcccgagggtct

SEQ ID NO: 9337249 - DNA, 22 bp, Homo sapiens
gcctcctccttcccgagggtct

SEQ ID NO: 9337250 - DNA, 22 bp, Homo sapiens
gcctcctccttcccgagggtct

SEQ ID NO: 9337251 - DNA, 22 bp, Homo sapiens
gcctcctgaagtgctgggatta

SEQ ID NO: 9337252 - DNA, 22 bp, Homo sapiens
gcctcctcttgagggtcaggga

SEQ ID NO: 9337253 - DNA, 22 bp, Homo sapiens
gcctcctcttgagggtcaggga

SEQ ID NO: 9337254 - DNA, 22 bp, Homo sapiens
gcctcctgaaaggaagagctcc

SEQ ID NO: 9337255 - DNA, 22 bp, Homo sapiens
gcctcctgaaaggaagagctcc

SEQ ID NO: 9337256 - DNA, 22 bp, Homo sapiens
gccctgtgtatcccctgtgctt

SEQ ID NO: 9337257 - DNA, 22 bp, Homo sapiens
gcctccggagtcacagtgtctt

SEQ ID NO: 9337258 - DNA, 22 bp, Homo sapiens
gcctccggagtcacagtgtctt

SEQ ID NO: 9337259 - DNA, 22 bp, Homo sapiens
gcctccggagtcacagtgtctt

SEQ ID NO: 9337260 - DNA, 22 bp, Homo sapiens
gcctccggagttgcagtgtctt

SEQ ID NO: 9337261 - DNA, 22 bp, Homo sapiens
gcctccggagttgcagtgtctt

SEQ ID NO: 9337262 - DNA, 22 bp, Homo sapiens
gcctccggagttgcagtgtctt

SEQ ID NO: 9337263 - DNA, 22 bp, Homo sapiens
gccccagcctgggaactggagg

SEQ ID NO: 9337264 - DNA, 22 bp, Homo sapiens
gccccagcctcccgagtagctg

SEQ ID NO: 9337265 - DNA, 22 bp, Homo sapiens
gccccagccaaggtgacacgaa

SEQ ID NO: 9337266 - DNA, 22 bp, Homo sapiens
gccccagccaaggtgacacgaa

SEQ ID NO: 9337267 - DNA, 22 bp, Homo sapiens
gccccagcagcaatgcggttga

SEQ ID NO: 9337268 - DNA, 17 bp, Homo sapiens
gccctggagccaggcta

SEQ ID NO: 9337269 - DNA, 22 bp, Homo sapiens
gccctggagggccagcgactgg

SEQ ID NO: 9337270 - DNA, 22 bp, Homo sapiens
gccccaggataaatttgtaaga

SEQ ID NO: 9337271 - DNA, 15 bp, Homo sapiens
gccccaggaatcaaa

SEQ ID NO: 9337272 - DNA, 22 bp, Homo sapiens
gccccaggataaatttgtaaga

SEQ ID NO: 9337273 - DNA, 22 bp, Homo sapiens
gccccaggggaggtgccctgca

SEQ ID NO: 9337274 - DNA, 22 bp, Homo sapiens
gccccaggggaggtgccctgca

SEQ ID NO: 9337275 - DNA, 22 bp, Homo sapiens
gccccagctctgccacaactag

SEQ ID NO: 9337276 - DNA, 22 bp, Homo sapiens
gccccagcgtggctgtgttagg

SEQ ID NO: 9337277 - DNA, 22 bp, Homo sapiens
gccccagcctgggaactggagg

SEQ ID NO: 9337278 - DNA, 22 bp, Homo sapiens
gccctgggcaaggttctggcca

SEQ ID NO: 9337279 - DNA, 22 bp, Homo sapiens
gccctgggcaaggttctggcca

SEQ ID NO: 9337280 - DNA, 22 bp, Homo sapiens
gccctgggcaaggttctggcca

SEQ ID NO: 9337281 - DNA, 22 bp, Homo sapiens
gccctgggcaaggttctggcca

SEQ ID NO: 9337282 - DNA, 22 bp, Homo sapiens
gccctgtgcgactctagaggtt

SEQ ID NO: 9337283 - DNA, 22 bp, Homo sapiens
gccctgggctccctgctccaca

SEQ ID NO: 9337284 - DNA, 22 bp, Homo sapiens
gccctgtggacagtgagaagtg

SEQ ID NO: 9337285 - DNA, 22 bp, Homo sapiens
gccctgtggattaatgagcagg

SEQ ID NO: 9337286 - DNA, 22 bp, Homo sapiens
gccctgtggacagtgagaagtg

SEQ ID NO: 9337287 - DNA, 22 bp, Homo sapiens
gccctggccttcatctcagaca

SEQ ID NO: 9337288 - DNA, 22 bp, Homo sapiens
gccctggccttcatctcagaca

SEQ ID NO: 9337289 - DNA, 22 bp, Homo sapiens
gccctgggattgggtggaggct

SEQ ID NO: 9337290 - DNA, 22 bp, Homo sapiens
gccctgggattgggtggaggct

SEQ ID NO: 9337291 - DNA, 22 bp, Homo sapiens
gccctggatgtacaggcatgtt

SEQ ID NO: 9337292 - DNA, 22 bp, Homo sapiens
gccctggatgtacaggcatgtt

SEQ ID NO: 9337293 - DNA, 22 bp, Homo sapiens
gccctggatggcaggagccatc

SEQ ID NO: 9337294 - DNA, 22 bp, Homo sapiens
gccctggatggcaggagccatc

SEQ ID NO: 9337295 - DNA, 22 bp, Homo sapiens
ggcctctgttctgcattcctcc

SEQ ID NO: 9337296 - DNA, 23 bp, Homo sapiens
ggcctctgtgttctgcccacatg

SEQ ID NO: 9337297 - DNA, 23 bp, Homo sapiens
ggcctctgtgttctgcccacatg

SEQ ID NO: 9337298 - DNA, 22 bp, Homo sapiens
ggcctctgtttggagccaggat

SEQ ID NO: 9337299 - DNA, 22 bp, Homo sapiens
ggcctctgtttggagccaggat

SEQ ID NO: 9337300 - DNA, 22 bp, Homo sapiens
ggcctctgtttggagccaggat

SEQ ID NO: 9337301 - DNA, 22 bp, Homo sapiens
ggcctctggttcgtggtgacct

SEQ ID NO: 9337302 - DNA, 22 bp, Homo sapiens
ggcctctggttcgtggtgacct

SEQ ID NO: 9337303 - DNA, 22 bp, Homo sapiens
ggcctctggttcacagggagga

SEQ ID NO: 9337304 - DNA, 22 bp, Homo sapiens
ggcctcagtgggccgctgcagg

SEQ ID NO: 9337305 - DNA, 22 bp, Homo sapiens
ggcctcagtgggccgctgcagg

SEQ ID NO: 9337306 - DNA, 22 bp, Homo sapiens
ggcctcagtttcttcaactgta

SEQ ID NO: 9337307 - DNA, 22 bp, Homo sapiens
ggcctcagtttcttcaactgta

SEQ ID NO: 9337308 - DNA, 22 bp, Homo sapiens
ggcctcagtttctccatgggtt

SEQ ID NO: 9337309 - DNA, 22 bp, Homo sapiens
ggcctcagtttctccatgggtt

SEQ ID NO: 9337310 - DNA, 22 bp, Homo sapiens
ggcctcagtttctccatgggtt

SEQ ID NO: 9337311 - DNA, 21 bp, Homo sapiens
ggcctcagccacctggctctg

SEQ ID NO: 9337312 - DNA, 22 bp, Homo sapiens
ggcctcagaggaggtgtgagtc

SEQ ID NO: 9337313 - DNA, 22 bp, Homo sapiens
ggcctcagagaaggctgtgcgg

SEQ ID NO: 9337314 - DNA, 21 bp, Homo sapiens
ggcctcagccacctggctctg

SEQ ID NO: 9337315 - DNA, 18 bp, Homo sapiens
ggcctcagcctggccgga

SEQ ID NO: 9337316 - DNA, 21 bp, Homo sapiens
ggcctcagccacctggctctg

SEQ ID NO: 9337317 - DNA, 21 bp, Homo sapiens
ggcctcagccacctggctctg

SEQ ID NO: 9337318 - DNA, 22 bp, Homo sapiens
ggcctcagggtcactctgtaga

SEQ ID NO: 9337319 - DNA, 22 bp, Homo sapiens
ggcctcagggttgggcccatta

SEQ ID NO: 9337320 - DNA, 22 bp, Homo sapiens
ggcctcagggttgggcccatta

SEQ ID NO: 9337321 - DNA, 18 bp, Homo sapiens
ggcctcagcctggccgga

SEQ ID NO: 9337322 - DNA, 18 bp, Homo sapiens
ggcctcagcctggccgga

SEQ ID NO: 9337323 - DNA, 23 bp, Homo sapiens
ggcctcagcgcacagaaactgct

SEQ ID NO: 9337324 - DNA, 22 bp, Homo sapiens
ggcctcagggtcactctgtaga

SEQ ID NO: 9337325 - DNA, 23 bp, Homo sapiens
ggcctcagcgcacagaaactgct

SEQ ID NO: 9337326 - DNA, 22 bp, Homo sapiens
ggcctcagaccggagctggcca

SEQ ID NO: 9337327 - DNA, 19 bp, Homo sapiens
ggccatggcgggggtcaca

SEQ ID NO: 9337328 - DNA, 19 bp, Homo sapiens
ggccatggcgggggtcaca

SEQ ID NO: 9337329 - DNA, 22 bp, Homo sapiens
ggcctcagagaaggctgtgcgg

SEQ ID NO: 9337330 - DNA, 22 bp, Homo sapiens
ggcctcagagaaggctgtgcgg

SEQ ID NO: 9337331 - DNA, 22 bp, Homo sapiens
ggcctcagagaaggctgtgcgg

SEQ ID NO: 9337332 - DNA, 23 bp, Homo sapiens
ggccatggagacttagaatgggc

SEQ ID NO: 9337333 - DNA, 23 bp, Homo sapiens
ggccatggagacttagaatgggc

SEQ ID NO: 9337334 - DNA, 23 bp, Homo sapiens
ggccatggagacttagaatgggc

SEQ ID NO: 9337335 - DNA, 23 bp, Homo sapiens
ggccatggagacttagaatgggc

SEQ ID NO: 9337336 - DNA, 22 bp, Homo sapiens
ggccatggaccccgagctgacc

SEQ ID NO: 9337337 - DNA, 22 bp, Homo sapiens
ggccatgctgttgcctgctggt

SEQ ID NO: 9337338 - DNA, 22 bp, Homo sapiens
ggccatgctgttgcctgctggt

SEQ ID NO: 9337339 - DNA, 22 bp, Homo sapiens
ggccatgcctgtgggtgcaggc

SEQ ID NO: 9337340 - DNA, 22 bp, Homo sapiens
ggcctgagtcccacctggctgt

SEQ ID NO: 9337341 - DNA, 22 bp, Homo sapiens
ggcctgagtcacatcaggagag

SEQ ID NO: 9337342 - DNA, 22 bp, Homo sapiens
ggccttgggatgtggctgcagc

SEQ ID NO: 9337343 - DNA, 19 bp, Homo sapiens
ggcctgcccaatgtctgct

SEQ ID NO: 9337344 - DNA, 17 bp, Homo sapiens
ggcctgcacctcctgct

SEQ ID NO: 9337345 - DNA, 22 bp, Homo sapiens
ggcctgcacagaggtggctcta

SEQ ID NO: 9337346 - DNA, 22 bp, Homo sapiens
ggcctgagaatgtaccagatct

SEQ ID NO: 9337347 - DNA, 22 bp, Homo sapiens
ggcctgagggtgggctctcagt

SEQ ID NO: 9337348 - DNA, 21 bp, Homo sapiens
ggcctgagtataggacaggcc

SEQ ID NO: 9337349 - DNA, 22 bp, Homo sapiens
ggcctcttatctggctcctgca

SEQ ID NO: 9337350 - DNA, 22 bp, Homo sapiens
ggcctcttctgctcatactttc

SEQ ID NO: 9337351 - DNA, 22 bp, Homo sapiens
ggcctcttatctggctcctgca

SEQ ID NO: 9337352 - DNA, 22 bp, Homo sapiens
ggcctgagaaccatggggccaa

SEQ ID NO: 9337353 - DNA, 22 bp, Homo sapiens
ggccttggttctgtcacagccg

SEQ ID NO: 9337354 - DNA, 22 bp, Homo sapiens
ggccttggttccaaagcaggca

SEQ ID NO: 9337355 - DNA, 22 bp, Homo sapiens
ggccttggtggctttgctgatg

SEQ ID NO: 9337356 - DNA, 22 bp, Homo sapiens
ggcctttgctggccctcaggct

SEQ ID NO: 9337357 - DNA, 19 bp, Homo sapiens
ggcctttcacctggatgct

SEQ ID NO: 9337358 - DNA, 22 bp, Homo sapiens
ggcgctggtggtcttgcgagcg

SEQ ID NO: 9337359 - DNA, 22 bp, Homo sapiens
ggcgctggtggtcttgcgagcg

SEQ ID NO: 9337360 - DNA, 22 bp, Homo sapiens
ggcgctggtggtcttgcgagcg

SEQ ID NO: 9337361 - DNA, 22 bp, Homo sapiens
ggcgctggccacggtggctctg

SEQ ID NO: 9337362 - DNA, 22 bp, Homo sapiens
ggcgctggccacggtggctctg

SEQ ID NO: 9337363 - DNA, 22 bp, Homo sapiens
ggccttggtggctttgctgatg

SEQ ID NO: 9337364 - DNA, 22 bp, Homo sapiens
ggccttggtgctctgtgttgca

SEQ ID NO: 9337365 - DNA, 22 bp, Homo sapiens
ggccttggtgccatggccagtt

SEQ ID NO: 9337366 - DNA, 22 bp, Homo sapiens
ggccttggtaaagggatgcatg

SEQ ID NO: 9337367 - DNA, 19 bp, Homo sapiens
ggccaggctgactgtggtc

SEQ ID NO: 9337368 - DNA, 22 bp, Homo sapiens
ggccagggggcttcagactcca

SEQ ID NO: 9337369 - DNA, 22 bp, Homo sapiens
ggccagggggcttcagactcca

SEQ ID NO: 9337370 - DNA, 22 bp, Homo sapiens
ggccagggcctggggactgtcc

SEQ ID NO: 9337371 - DNA, 22 bp, Homo sapiens
ggccagggggcttcagactcca

SEQ ID NO: 9337372 - DNA, 22 bp, Homo sapiens
ggccaggtccagtggaaggccc

SEQ ID NO: 9337373 - DNA, 22 bp, Homo sapiens
ggccagggggcttcagactcca

SEQ ID NO: 9337374 - DNA, 22 bp, Homo sapiens
ggccaggtaagagtgcagccgc

SEQ ID NO: 9337375 - DNA, 22 bp, Homo sapiens
ggccaggtccagtggaaggccc

SEQ ID NO: 9337376 - DNA, 22 bp, Homo sapiens
ggccaggtgcggtggctcacac

SEQ ID NO: 9337377 - DNA, 22 bp, Homo sapiens
ggccaggtggctgtcctggcgt

SEQ ID NO: 9337378 - DNA, 22 bp, Homo sapiens
ggccaggtggctgtcctggcgt

SEQ ID NO: 9337379 - DNA, 22 bp, Homo sapiens
ggccaggtggctgtcctggcgt

SEQ ID NO: 9337380 - DNA, 22 bp, Homo sapiens
ggccaggtggctgtcctggcgt

SEQ ID NO: 9337381 - DNA, 22 bp, Homo sapiens
ggccatgagaatgtgcaggtcc

SEQ ID NO: 9337382 - DNA, 22 bp, Homo sapiens
ggccagtgtgggagtagttctt

SEQ ID NO: 9337383 - DNA, 22 bp, Homo sapiens
ggccagtgtgggagtagttctt

SEQ ID NO: 9337384 - DNA, 22 bp, Homo sapiens
ggccatgccaggctgcctggga

SEQ ID NO: 9337385 - DNA, 22 bp, Homo sapiens
ggccaggttgggtggaagtggc

SEQ ID NO: 9337386 - DNA, 22 bp, Homo sapiens
ggccaggttgggtggaagtggc

SEQ ID NO: 9337387 - DNA, 22 bp, Homo sapiens
ggccagtaagagataggaggca

SEQ ID NO: 9337388 - DNA, 22 bp, Homo sapiens
ggccagtgaccagtaaccagtg

SEQ ID NO: 9337389 - DNA, 21 bp, Homo sapiens
ggccagtggccttgactttcc

SEQ ID NO: 9337390 - DNA, 21 bp, Homo sapiens
ggccagtggaattttatgtca

SEQ ID NO: 9337391 - DNA, 22 bp, Homo sapiens
ggccagtggctctgtgcttggg

SEQ ID NO: 9337392 - DNA, 22 bp, Homo sapiens
ggccagtgtgcaggtcagagat

SEQ ID NO: 9337393 - DNA, 22 bp, Homo sapiens
ggccagtgtgcaggtcagagat

SEQ ID NO: 9337394 - DNA, 22 bp, Homo sapiens
ggccagtggctctgtgcttggg

SEQ ID NO: 9337395 - DNA, 22 bp, Homo sapiens
ggcatggtctttgcttgcagga

SEQ ID NO: 9337396 - DNA, 22 bp, Homo sapiens
ggcatggtctttgcttgcagga

SEQ ID NO: 9337397 - DNA, 22 bp, Homo sapiens
ggcatggtctttgcttgcagga

SEQ ID NO: 9337398 - DNA, 20 bp, Homo sapiens
ggcatgggtggggctcccag

SEQ ID NO: 9337399 - DNA, 22 bp, Homo sapiens
ggcatggtttaagtggtgggga

SEQ ID NO: 9337400 - DNA, 22 bp, Homo sapiens
ggcatgtgcctgaggtcacaca

SEQ ID NO: 9337401 - DNA, 18 bp, Homo sapiens
ggcatgtgagtgctgagg

SEQ ID NO: 9337402 - DNA, 22 bp, Homo sapiens
ggcattaactctgtttcaattt

SEQ ID NO: 9337403 - DNA, 22 bp, Homo sapiens
ggccaaggtggagaaggcactg

SEQ ID NO: 9337404 - DNA, 22 bp, Homo sapiens
ggccaaggtggagaaggcactg

SEQ ID NO: 9337405 - DNA, 22 bp, Homo sapiens
ggccaaggtggagaaggcactg

SEQ ID NO: 9337406 - DNA, 19 bp, Homo sapiens
ggccaggctgactgtggtc

SEQ ID NO: 9337407 - DNA, 19 bp, Homo sapiens
ggccaggctgactgtggtc

SEQ ID NO: 9337408 - DNA, 19 bp, Homo sapiens
ggccaggctgactgtggtc

SEQ ID NO: 9337409 - DNA, 22 bp, Homo sapiens
ggccacagaacagctacaggac

SEQ ID NO: 9337410 - DNA, 22 bp, Homo sapiens
ggccacactctggtagaggtga

SEQ ID NO: 9337411 - DNA, 22 bp, Homo sapiens
ggccacagaacagctacaggac

SEQ ID NO: 9337412 - DNA, 22 bp, Homo sapiens
ggccacagaacagctacaggac

SEQ ID NO: 9337413 - DNA, 22 bp, Homo sapiens
ggccacagaacagctacaggac

SEQ ID NO: 9337414 - DNA, 22 bp, Homo sapiens
ggccacacggagaggctggtct

SEQ ID NO: 9337415 - DNA, 22 bp, Homo sapiens
ggccaatgggaatggccagtag

SEQ ID NO: 9337416 - DNA, 22 bp, Homo sapiens
ggcatggacgtctctgaggcca

SEQ ID NO: 9337417 - DNA, 22 bp, Homo sapiens
ggcatggacgtctctgaggcca

SEQ ID NO: 9337418 - DNA, 20 bp, Homo sapiens
ggcatggcaaatgttcttgc

SEQ ID NO: 9337419 - DNA, 21 bp, Homo sapiens
ggcatggcacctctgggcagg

SEQ ID NO: 9337420 - DNA, 22 bp, Homo sapiens
ggcagtgaatgaaacagaggct

SEQ ID NO: 9337421 - DNA, 22 bp, Homo sapiens
ggcagtgaacagaaatgcagaa

SEQ ID NO: 9337422 - DNA, 22 bp, Homo sapiens
ggcatggggtgtatgtggcacg

SEQ ID NO: 9337423 - DNA, 22 bp, Homo sapiens
ggcatgggccgaggtgcctcct

SEQ ID NO: 9337424 - DNA, 22 bp, Homo sapiens
ggcatggcctgtaagacggaga

SEQ ID NO: 9337425 - DNA, 22 bp, Homo sapiens
ggcatggctcggagtcagaaca

SEQ ID NO: 9337426 - DNA, 22 bp, Homo sapiens
ggcatggcacgggaaacaccag

SEQ ID NO: 9337427 - DNA, 21 bp, Homo sapiens
ggcatggcacctctgggcagg

SEQ ID NO: 9337428 - DNA, 22 bp, Homo sapiens
ggcatgggccgaggtgcctcct

SEQ ID NO: 9337429 - DNA, 22 bp, Homo sapiens
ggcatgggagtgagcaacctta

SEQ ID NO: 9337430 - DNA, 22 bp, Homo sapiens
ggcatggctgggttctggtgag

SEQ ID NO: 9337431 - DNA, 22 bp, Homo sapiens
ggcatggctgttggggatagag

SEQ ID NO: 9337432 - DNA, 22 bp, Homo sapiens
ggcatggctgggttctggtgag

SEQ ID NO: 9337433 - DNA, 22 bp, Homo sapiens
ggcagtcagtttggagatggat

SEQ ID NO: 9337434 - DNA, 22 bp, Homo sapiens
ggcaggtggtaaggatttcata

SEQ ID NO: 9337435 - DNA, 22 bp, Homo sapiens
ggcaggtgtgagatcgaggcca

SEQ ID NO: 9337436 - DNA, 22 bp, Homo sapiens
ggcaggtgtgagatcgaggcca

SEQ ID NO: 9337437 - DNA, 22 bp, Homo sapiens
ggcaggtggccaagtgtctaag

SEQ ID NO: 9337438 - DNA, 22 bp, Homo sapiens
ggcaggtggcactgctgctccc

SEQ ID NO: 9337439 - DNA, 22 bp, Homo sapiens
ggcaggtggccaagtgtctaag

SEQ ID NO: 9337440 - DNA, 21 bp, Homo sapiens
ggcaggtgggtctctgttgct

SEQ ID NO: 9337441 - DNA, 21 bp, Homo sapiens
ggcaggtgggtctctgttgct

SEQ ID NO: 9337442 - DNA, 22 bp, Homo sapiens
ggcaggtggtaaggatttcata

SEQ ID NO: 9337443 - DNA, 22 bp, Homo sapiens
ggcaggtgggaaccctccccac

SEQ ID NO: 9337444 - DNA, 22 bp, Homo sapiens
ggcaggtgggaaccctccccac

SEQ ID NO: 9337445 - DNA, 22 bp, Homo sapiens
ggcaggtgggaaccctccccac

SEQ ID NO: 9337446 - DNA, 22 bp, Homo sapiens
ggcaggtggaagttggcagagc

SEQ ID NO: 9337447 - DNA, 22 bp, Homo sapiens
ggcaggcagatggctgcaccaa

SEQ ID NO: 9337448 - DNA, 22 bp, Homo sapiens
ggcaggtggaagttggcagagc

SEQ ID NO: 9337449 - DNA, 22 bp, Homo sapiens
ggcaggtggaagttggcagagc

SEQ ID NO: 9337450 - DNA, 22 bp, Homo sapiens
ggcaggcagaggctgagacagg

SEQ ID NO: 9337451 - DNA, 22 bp, Homo sapiens
ggcaggcagaggctgagacagg

SEQ ID NO: 9337452 - DNA, 22 bp, Homo sapiens
ggcaggtggacgtgctaaagct

SEQ ID NO: 9337453 - DNA, 15 bp, Homo sapiens
ggcaggtggatcact

SEQ ID NO: 9337454 - DNA, 22 bp, Homo sapiens
ggcaggtggacgtgctaaagct

SEQ ID NO: 9337455 - DNA, 22 bp, Homo sapiens
ggcaggtggacgtgctaaagct

SEQ ID NO: 9337456 - DNA, 22 bp, Homo sapiens
ggcaggtggaagttggcagagc

SEQ ID NO: 9337457 - DNA, 22 bp, Homo sapiens
ggcaggtggattttctactcta

SEQ ID NO: 9337458 - DNA, 15 bp, Homo sapiens
ggcaggtggatcact

SEQ ID NO: 9337459 - DNA, 22 bp, Homo sapiens
ggcaggtggattttctactcta

SEQ ID NO: 9337460 - DNA, 22 bp, Homo sapiens
ggcaggtggcactgctgctccc

SEQ ID NO: 9337461 - DNA, 22 bp, Homo sapiens
ggcaggtggcactgctgctccc

SEQ ID NO: 9337462 - DNA, 22 bp, Homo sapiens
ggcaggtggcactgctgctccc

SEQ ID NO: 9337463 - DNA, 22 bp, Homo sapiens
ggcaggtggcactgctgctccc

SEQ ID NO: 9337464 - DNA, 22 bp, Homo sapiens
ggagccagagcactggggagcc

SEQ ID NO: 9337465 - DNA, 22 bp, Homo sapiens
ggagccagagcactggggagcc

SEQ ID NO: 9337466 - DNA, 22 bp, Homo sapiens
ggagccagaggctgctgctgtg

SEQ ID NO: 9337467 - DNA, 22 bp, Homo sapiens
ggagccagaggctgctgctgtg

SEQ ID NO: 9337468 - DNA, 22 bp, Homo sapiens
ggagccagagtctgcagtgtaa

SEQ ID NO: 9337469 - DNA, 22 bp, Homo sapiens
ggagccagagtctgcagtgtaa

SEQ ID NO: 9337470 - DNA, 22 bp, Homo sapiens
ggagccagattgtataaaaaag

SEQ ID NO: 9337471 - DNA, 22 bp, Homo sapiens
ggagccagagtttaatgtggag

SEQ ID NO: 9337472 - DNA, 22 bp, Homo sapiens
ggagccagagtttaatgtggag

SEQ ID NO: 9337473 - DNA, 22 bp, Homo sapiens
ggagccagctccctccttgtga

SEQ ID NO: 9337474 - DNA, 17 bp, Homo sapiens
ggagccaggagcccacc

SEQ ID NO: 9337475 - DNA, 19 bp, Homo sapiens
ggagccagctgtggaaggc

SEQ ID NO: 9337476 - DNA, 22 bp, Homo sapiens
ggagtatatcgtgtatcatatg

SEQ ID NO: 9337477 - DNA, 22 bp, Homo sapiens
ggagtcacacagagaagataag

SEQ ID NO: 9337478 - DNA, 21 bp, Homo sapiens
ggagtcagggtctggctgggg

SEQ ID NO: 9337479 - DNA, 22 bp, Homo sapiens
ggagtcagcctgtcagagtgta

SEQ ID NO: 9337480 - DNA, 22 bp, Homo sapiens
ggagtcagaatggcagggtggt

SEQ ID NO: 9337481 - DNA, 22 bp, Homo sapiens
ggagtcaccaagtaggagtctt

SEQ ID NO: 9337482 - DNA, 22 bp, Homo sapiens
ggagtcaccaagtaggagtctt

SEQ ID NO: 9337483 - DNA, 22 bp, Homo sapiens
ggagtctgagcttgtgtcctgg

SEQ ID NO: 9337484 - DNA, 22 bp, Homo sapiens
ggagtgaggcatttgtagctga

SEQ ID NO: 9337485 - DNA, 22 bp, Homo sapiens
ggagtgaggcatttgtagctga

SEQ ID NO: 9337486 - DNA, 22 bp, Homo sapiens
ggagtcatctcagctgagaggc

SEQ ID NO: 9337487 - DNA, 17 bp, Homo sapiens
ggagtccaggggttagc

SEQ ID NO: 9337488 - DNA, 18 bp, Homo sapiens
ggagtctcaggagaggaa

SEQ ID NO: 9337489 - DNA, 22 bp, Homo sapiens
ggagtcctgtgtcttccaggaa

SEQ ID NO: 9337490 - DNA, 18 bp, Homo sapiens
ggagtctcaggagaggaa

SEQ ID NO: 9337491 - DNA, 22 bp, Homo sapiens
ggagtgagtactggagtagctg

SEQ ID NO: 9337492 - DNA, 23 bp, Homo sapiens
ggagtgcaatggcgccatctcgg

SEQ ID NO: 9337493 - DNA, 22 bp, Homo sapiens
ggagtgcaggtagcacaggaaa

SEQ ID NO: 9337494 - DNA, 22 bp, Homo sapiens
ggagtgctccgcgagagggatg

SEQ ID NO: 9337495 - DNA, 22 bp, Homo sapiens
ggagtgcagtggtgggatctca

SEQ ID NO: 9337496 - DNA, 22 bp, Homo sapiens
ggattttagagtacctaagtgt

SEQ ID NO: 9337497 - DNA, 22 bp, Homo sapiens
ggattttgttcctagctttaaa

SEQ ID NO: 9337498 - DNA, 22 bp, Homo sapiens
ggcaaagagacatgcatcgggg

SEQ ID NO: 9337499 - DNA, 22 bp, Homo sapiens
ggcaagagtgaggagtgtctct

SEQ ID NO: 9337500 - DNA, 22 bp, Homo sapiens
ggcaaggaagaagccatgatgt

SEQ ID NO: 9337501 - DNA, 22 bp, Homo sapiens
ggcaagctcaggcctcaggtgt

SEQ ID NO: 9337502 - DNA, 22 bp, Homo sapiens
ggcacagcaggagctatgtgaa

SEQ ID NO: 9337503 - DNA, 22 bp, Homo sapiens
ggcaaggaagaagccatgatgt

SEQ ID NO: 9337504 - DNA, 20 bp, Homo sapiens
ggcaagcaactgagggagga

SEQ ID NO: 9337505 - DNA, 22 bp, Homo sapiens
ggcaagagtgaggagtgtctct

SEQ ID NO: 9337506 - DNA, 22 bp, Homo sapiens
ggcaagagtgaggagtgtctct

SEQ ID NO: 9337507 - DNA, 22 bp, Homo sapiens
ggcaagaggtccaagaggtctc

SEQ ID NO: 9337508 - DNA, 22 bp, Homo sapiens
ggcaagaggtccaagaggtctc

SEQ ID NO: 9337509 - DNA, 22 bp, Homo sapiens
ggcaagaggtccaagaggtctc

SEQ ID NO: 9337510 - DNA, 22 bp, Homo sapiens
ggcaagaggtccaagaggtctc

SEQ ID NO: 9337511 - DNA, 22 bp, Homo sapiens
ggcaagagggcagatggagtgc

SEQ ID NO: 9337512 - DNA, 22 bp, Homo sapiens
ggcaagagggcagatggagtgc

SEQ ID NO: 9337513 - DNA, 22 bp, Homo sapiens
ggcaaaggaaaacgtctcagct

SEQ ID NO: 9337514 - DNA, 22 bp, Homo sapiens
ggcaaaggaaaacgtctcagct

SEQ ID NO: 9337515 - DNA, 22 bp, Homo sapiens
ggcaaatttgtcttaagacacc

SEQ ID NO: 9337516 - DNA, 22 bp, Homo sapiens
ggcaacaactggacatagctgg

SEQ ID NO: 9337517 - DNA, 22 bp, Homo sapiens
ggcaaattgctgcaattactta

SEQ ID NO: 9337518 - DNA, 17 bp, Homo sapiens
ggcaacatgttcttctg

SEQ ID NO: 9337519 - DNA, 22 bp, Homo sapiens
ggcaacattctccagatccttt

SEQ ID NO: 9337520 - DNA, 22 bp, Homo sapiens
ggcacagccactttggagaact

SEQ ID NO: 9337521 - DNA, 22 bp, Homo sapiens
ggcacagccctctctgtggaca

SEQ ID NO: 9337522 - DNA, 22 bp, Homo sapiens
ggcacagccactttggagaact

SEQ ID NO: 9337523 - DNA, 22 bp, Homo sapiens
ggcacagccctctctgtggaca

SEQ ID NO: 9337524 - DNA, 22 bp, Homo sapiens
ggcacagcgactaccatcgaaa

SEQ ID NO: 9337525 - DNA, 22 bp, Homo sapiens
ggcacagctacttgctcactct

SEQ ID NO: 9337526 - DNA, 17 bp, Homo sapiens
ggcaccagacggagagt

SEQ ID NO: 9337527 - DNA, 17 bp, Homo sapiens
ggcaccagacggagagt

SEQ ID NO: 9337528 - DNA, 22 bp, Homo sapiens
ggcacaggagctagtcaaagcc

SEQ ID NO: 9337529 - DNA, 22 bp, Homo sapiens
ggcacaggaatctgtgaagtgc

SEQ ID NO: 9337530 - DNA, 22 bp, Homo sapiens
ggcacaggaatctgtgaagtgc

SEQ ID NO: 9337531 - DNA, 22 bp, Homo sapiens
ggcacaggaatctgtgaagtgc

SEQ ID NO: 9337532 - DNA, 20 bp, Homo sapiens
ggcagagggcctgggagaag

SEQ ID NO: 9337533 - DNA, 20 bp, Homo sapiens
ggcagagggcctgggagaag

SEQ ID NO: 9337534 - DNA, 22 bp, Homo sapiens
ggcagaggaggggtgaatttgc

SEQ ID NO: 9337535 - DNA, 20 bp, Homo sapiens
ggcagagggcctgggagaag

SEQ ID NO: 9337536 - DNA, 22 bp, Homo sapiens
ggcagaggagctggaaacatgg

SEQ ID NO: 9337537 - DNA, 22 bp, Homo sapiens
ggcagaggagctggaaacatgg

SEQ ID NO: 9337538 - DNA, 22 bp, Homo sapiens
ggcagaggaggggtgaatttgc

SEQ ID NO: 9337539 - DNA, 22 bp, Homo sapiens
ggcagaggaagctggaagtggg

SEQ ID NO: 9337540 - DNA, 22 bp, Homo sapiens
ggcagaggaagctggaagtggg

SEQ ID NO: 9337541 - DNA, 22 bp, Homo sapiens
ggcaccaggctgggcataggcc

SEQ ID NO: 9337542 - DNA, 22 bp, Homo sapiens
ggcaccaggctgggcataggcc

SEQ ID NO: 9337543 - DNA, 20 bp, Homo sapiens
ggcaccaggctaggattgga

SEQ ID NO: 9337544 - DNA, 22 bp, Homo sapiens
ggcaccaggacatgactcccag

SEQ ID NO: 9337545 - DNA, 22 bp, Homo sapiens
ggcaccaggatcagtctgtcat

SEQ ID NO: 9337546 - DNA, 23 bp, Homo sapiens
ggcaccaggccatggagcgggag

SEQ ID NO: 9337547 - DNA, 22 bp, Homo sapiens
ggcagaggagctggaaacatgg

SEQ ID NO: 9337548 - DNA, 22 bp, Homo sapiens
ggcagaggaaggatgaattcac

SEQ ID NO: 9337549 - DNA, 22 bp, Homo sapiens
ggcagaggaaggatgaattcac

SEQ ID NO: 9337550 - DNA, 22 bp, Homo sapiens
ggcaggcagaggctgagacagg

SEQ ID NO: 9337551 - DNA, 22 bp, Homo sapiens
ggcaggcactgtgctaggcgct

SEQ ID NO: 9337552 - DNA, 22 bp, Homo sapiens
ggcaggcactgtgctaggcgct

SEQ ID NO: 9337553 - DNA, 22 bp, Homo sapiens
ggcaggcacatttgggggccgt

SEQ ID NO: 9337554 - DNA, 22 bp, Homo sapiens
ggcaggcacatttgggggccgt

SEQ ID NO: 9337555 - DNA, 22 bp, Homo sapiens
ggcaggcaccagctcagcaata

SEQ ID NO: 9337556 - DNA, 22 bp, Homo sapiens
ggcaggcaaggcagcctggtga

SEQ ID NO: 9337557 - DNA, 22 bp, Homo sapiens
ggcaggcaacggaccactagtc

SEQ ID NO: 9337558 - DNA, 22 bp, Homo sapiens
ggcaggcaacggaccactagtc

SEQ ID NO: 9337559 - DNA, 18 bp, Homo sapiens
ggcaggatttcaactttc

SEQ ID NO: 9337560 - DNA, 21 bp, Homo sapiens
ggcaggatggcagtggacccc

SEQ ID NO: 9337561 - DNA, 21 bp, Homo sapiens
ggcaggatggcagtggacccc

SEQ ID NO: 9337562 - DNA, 22 bp, Homo sapiens
ggcaggcaagtctgctctgtga

SEQ ID NO: 9337563 - DNA, 22 bp, Homo sapiens
ggcaggcaaggcagcctggtga

SEQ ID NO: 9337564 - DNA, 22 bp, Homo sapiens
ggcaggcaaggcagcctggtga

SEQ ID NO: 9337565 - DNA, 22 bp, Homo sapiens
ggcaggcaatgaggatgggaag

SEQ ID NO: 9337566 - DNA, 22 bp, Homo sapiens
ggcaggcaatgaggatgggaag

SEQ ID NO: 9337567 - DNA, 22 bp, Homo sapiens
ggcaggaggaagagttagcacc

SEQ ID NO: 9337568 - DNA, 22 bp, Homo sapiens
ggcaggagggcggacaatgacc

SEQ ID NO: 9337569 - DNA, 22 bp, Homo sapiens
ggcaggaggtgagtggcgggtg

SEQ ID NO: 9337570 - DNA, 22 bp, Homo sapiens
ggcaggaggtgagtggcgggtg

SEQ ID NO: 9337571 - DNA, 22 bp, Homo sapiens
ggcaggaggtgagtggcgggtg

SEQ ID NO: 9337572 - DNA, 20 bp, Homo sapiens
ggcagagggcctgggagaag

SEQ ID NO: 9337573 - DNA, 20 bp, Homo sapiens
ggcagagggcctgggagaag

SEQ ID NO: 9337574 - DNA, 20 bp, Homo sapiens
ggcagagggcctgggagaag

SEQ ID NO: 9337575 - DNA, 22 bp, Homo sapiens
ggcagaggtagctggaaccagg

SEQ ID NO: 9337576 - DNA, 22 bp, Homo sapiens
ggcagaggtagctggaaccagg

SEQ ID NO: 9337577 - DNA, 20 bp, Homo sapiens
ggcagagggcctgggagaag

SEQ ID NO: 9337578 - DNA, 22 bp, Homo sapiens
ggcagaggtagctggaaccagg

SEQ ID NO: 9337579 - DNA, 22 bp, Homo sapiens
ggcagaggtagctggaaccagg

SEQ ID NO: 9337580 - DNA, 22 bp, Homo sapiens
ggcagaggtagctggaaccagg

SEQ ID NO: 9337581 - DNA, 22 bp, Homo sapiens
ggcagaggtagctggaaccagg

SEQ ID NO: 9337582 - DNA, 22 bp, Homo sapiens
ggctgggctccgggagcatgcg

SEQ ID NO: 9337583 - DNA, 22 bp, Homo sapiens
ggctgggctccgggagcatgcg

SEQ ID NO: 9337584 - DNA, 22 bp, Homo sapiens
ggctgggctcgctgattggctg

SEQ ID NO: 9337585 - DNA, 22 bp, Homo sapiens
ggctgggctcgctgattggctg

SEQ ID NO: 9337586 - DNA, 22 bp, Homo sapiens
ggctgggctccgggagcatgcg

SEQ ID NO: 9337587 - DNA, 22 bp, Homo sapiens
ggctgggctccgggagcatgcg

SEQ ID NO: 9337588 - DNA, 22 bp, Homo sapiens
ggctgggccgcggctacccaga

SEQ ID NO: 9337589 - DNA, 19 bp, Homo sapiens
ggctgggccctgtttctcc

SEQ ID NO: 9337590 - DNA, 22 bp, Homo sapiens
ggctgggcatccatccatgaga

SEQ ID NO: 9337591 - DNA, 22 bp, Homo sapiens
ggctgggcatccatccatgaga

SEQ ID NO: 9337592 - DNA, 22 bp, Homo sapiens
ggctgggcatccatccatgaga

SEQ ID NO: 9337593 - DNA, 22 bp, Homo sapiens
ggctgggccagggcctgtggac

SEQ ID NO: 9337594 - DNA, 22 bp, Homo sapiens
ggctgggccagggcctgtggac

SEQ ID NO: 9337595 - DNA, 21 bp, Homo sapiens
ggctgggcaggacccacccct

SEQ ID NO: 9337596 - DNA, 22 bp, Homo sapiens
ggctgggcaggtctgcacaggg

SEQ ID NO: 9337597 - DNA, 22 bp, Homo sapiens
ggctgggcaggtctgcacaggg

SEQ ID NO: 9337598 - DNA, 22 bp, Homo sapiens
ggctgggcaggtctgcacaggg

SEQ ID NO: 9337599 - DNA, 22 bp, Homo sapiens
ggcttctccaggtactgagcat

SEQ ID NO: 9337600 - DNA, 22 bp, Homo sapiens
ggcttctccaggtactgagcat

SEQ ID NO: 9337601 - DNA, 22 bp, Homo sapiens
ggctgggctgctgggtcagagc

SEQ ID NO: 9337602 - DNA, 22 bp, Homo sapiens
ggctgggctgctgggtcagagc

SEQ ID NO: 9337603 - DNA, 22 bp, Homo sapiens
ggctgggctgcggctgtacctg

SEQ ID NO: 9337604 - DNA, 22 bp, Homo sapiens
ggctgggctgcggctgtacctg

SEQ ID NO: 9337605 - DNA, 22 bp, Homo sapiens
ggctgggctgcggctgtacctg

SEQ ID NO: 9337606 - DNA, 22 bp, Homo sapiens
ggcttctctccagtatgcattc

SEQ ID NO: 9337607 - DNA, 22 bp, Homo sapiens
ggcttctctcccccagctccac

SEQ ID NO: 9337608 - DNA, 22 bp, Homo sapiens
ggcttctctcttcacatggctt

SEQ ID NO: 9337609 - DNA, 22 bp, Homo sapiens
ggcttctctaaagatcatgcgt

SEQ ID NO: 9337610 - DNA, 22 bp, Homo sapiens
ggcttctctaaagatcatgcgt

SEQ ID NO: 9337611 - DNA, 22 bp, Homo sapiens
ggcttctcctggaagtacagag

SEQ ID NO: 9337612 - DNA, 22 bp, Homo sapiens
ggcttctcccctttgagtcttc

SEQ ID NO: 9337613 - DNA, 22 bp, Homo sapiens
ggcttctcccattcttcagggg

SEQ ID NO: 9337614 - DNA, 22 bp, Homo sapiens
ggcttctcccattcttcagggg

SEQ ID NO: 9337615 - DNA, 22 bp, Homo sapiens
ggcttctcccattcttcagggg

SEQ ID NO: 9337616 - DNA, 22 bp, Homo sapiens
ggcttctcctggaagtacagag

SEQ ID NO: 9337617 - DNA, 22 bp, Homo sapiens
ggcttctcccttcttctgattg

SEQ ID NO: 9337618 - DNA, 22 bp, Homo sapiens
ggcttctcccctttgagtcttc

SEQ ID NO: 9337619 - DNA, 22 bp, Homo sapiens
ggcttctgaaatctctgtgcgt

SEQ ID NO: 9337620 - DNA, 22 bp, Homo sapiens
ggcttctgagtgctctgctgtt

SEQ ID NO: 9337621 - DNA, 22 bp, Homo sapiens
ggcttctgctcagcctgcacgc

SEQ ID NO: 9337622 - DNA, 22 bp, Homo sapiens
ggcttctgctcagcctgcacgc

SEQ ID NO: 9337623 - DNA, 22 bp, Homo sapiens
ggcttctgctcagcctgcacgc

SEQ ID NO: 9337624 - DNA, 22 bp, Homo sapiens
ggcttctgctcagcctgcacgc

SEQ ID NO: 9337625 - DNA, 22 bp, Homo sapiens
ggctgggaggccgtgctgacct

SEQ ID NO: 9337626 - DNA, 22 bp, Homo sapiens
ggctgggaggccgtgctgacct

SEQ ID NO: 9337627 - DNA, 22 bp, Homo sapiens
ggctgggaggccgtgctgacct

SEQ ID NO: 9337628 - DNA, 22 bp, Homo sapiens
ggctgggaggccgtgctgacct

SEQ ID NO: 9337629 - DNA, 22 bp, Homo sapiens
ggctggcttggtgagctgtcac

SEQ ID NO: 9337630 - DNA, 22 bp, Homo sapiens
ggctgggcaaacaagactcttc

SEQ ID NO: 9337631 - DNA, 22 bp, Homo sapiens
ggctgggcaaacaagactcttc

SEQ ID NO: 9337632 - DNA, 22 bp, Homo sapiens
ggctgggcaaacaagactcttc

SEQ ID NO: 9337633 - DNA, 22 bp, Homo sapiens
ggctgggcagcagctgttaagc

SEQ ID NO: 9337634 - DNA, 22 bp, Homo sapiens
ggctggcttgcggagtcacaga

SEQ ID NO: 9337635 - DNA, 22 bp, Homo sapiens
ggctggcttggtgagctgtcac

SEQ ID NO: 9337636 - DNA, 22 bp, Homo sapiens
ggctggcttggtgagctgtcac

SEQ ID NO: 9337637 - DNA, 22 bp, Homo sapiens
ggctggcttgcggagtcacaga

SEQ ID NO: 9337638 - DNA, 22 bp, Homo sapiens
ggctgctggggacgtgggagag

SEQ ID NO: 9337639 - DNA, 21 bp, Homo sapiens
ggctgctgggagagctgcgtg

SEQ ID NO: 9337640 - DNA, 21 bp, Homo sapiens
ggctgctgggagagctgcgtg

SEQ ID NO: 9337641 - DNA, 22 bp, Homo sapiens
ggctgctggcattgaggtaggt

SEQ ID NO: 9337642 - DNA, 22 bp, Homo sapiens
ggctgctggcattgaggtaggt

SEQ ID NO: 9337643 - DNA, 22 bp, Homo sapiens
ggctgctggcattgaggtaggt

SEQ ID NO: 9337644 - DNA, 22 bp, Homo sapiens
ggctgctggcattgaggtaggt

SEQ ID NO: 9337645 - DNA, 22 bp, Homo sapiens
ggctgctggcagatgtagttta

SEQ ID NO: 9337646 - DNA, 22 bp, Homo sapiens
ggctgctggattgtgtatctgt

SEQ ID NO: 9337647 - DNA, 22 bp, Homo sapiens
ggctgctgggaatatgccagct

SEQ ID NO: 9337648 - DNA, 22 bp, Homo sapiens
ggctgctgggaatatgccagct

SEQ ID NO: 9337649 - DNA, 22 bp, Homo sapiens
ggctgctgggaatatgccagct

SEQ ID NO: 9337650 - DNA, 22 bp, Homo sapiens
ggctgctgggaatatgccagct

SEQ ID NO: 9337651 - DNA, 22 bp, Homo sapiens
ggctgctgggaatatgccagct

SEQ ID NO: 9337652 - DNA, 22 bp, Homo sapiens
ggctgctggcctctccccggcc

SEQ ID NO: 9337653 - DNA, 22 bp, Homo sapiens
ggctgagagtggatcccaggga

SEQ ID NO: 9337654 - DNA, 22 bp, Homo sapiens
ggctgagaggacgtcgggctca

SEQ ID NO: 9337655 - DNA, 22 bp, Homo sapiens
ggctgagagtggatcccaggga

SEQ ID NO: 9337656 - DNA, 22 bp, Homo sapiens
ggctgagcaattttgatgacat

SEQ ID NO: 9337657 - DNA, 22 bp, Homo sapiens
ggctgagcactttaggcaggag

SEQ ID NO: 9337658 - DNA, 22 bp, Homo sapiens
ggctgagcaattttgatgacat

SEQ ID NO: 9337659 - DNA, 22 bp, Homo sapiens
ggctgagcactttaggcaggag

SEQ ID NO: 9337660 - DNA, 22 bp, Homo sapiens
ggctgctgacttcatccagctt

SEQ ID NO: 9337661 - DNA, 22 bp, Homo sapiens
ggctgctgacttcatccagctt

SEQ ID NO: 9337662 - DNA, 22 bp, Homo sapiens
ggctgctgacaaacatgatcat

SEQ ID NO: 9337663 - DNA, 22 bp, Homo sapiens
ggctgctgaagtgtggcaatct

SEQ ID NO: 9337664 - DNA, 22 bp, Homo sapiens
ggctgagcactttaggcaggag

SEQ ID NO: 9337665 - DNA, 22 bp, Homo sapiens
ggctgctgaagtgtggcaatct

SEQ ID NO: 9337666 - DNA, 19 bp, Homo sapiens
ggctgctgaagagaattac

SEQ ID NO: 9337667 - DNA, 22 bp, Homo sapiens
ggctgctgagttggccaggaga

SEQ ID NO: 9337668 - DNA, 22 bp, Homo sapiens
ggctgctgcccacccctgcatg

SEQ ID NO: 9337669 - DNA, 22 bp, Homo sapiens
ggctgctgagtcacgacagtga

SEQ ID NO: 9337670 - DNA, 22 bp, Homo sapiens
ggctgctgagtcacgacagtga

SEQ ID NO: 9337671 - DNA, 22 bp, Homo sapiens
ggctgctgccctcctaagtgca

SEQ ID NO: 9337672 - DNA, 22 bp, Homo sapiens
ggctgctgccctcctaagtgca

SEQ ID NO: 9337673 - DNA, 22 bp, Homo sapiens
ggctgctgcccacccctgcatg

SEQ ID NO: 9337674 - DNA, 22 bp, Homo sapiens
ggctgctgctgtgtaggcctgt

SEQ ID NO: 9337675 - DNA, 22 bp, Homo sapiens
ggctgctggaagactgaacaag

SEQ ID NO: 9337676 - DNA, 22 bp, Homo sapiens
ggctgctggagttgggtctctc

SEQ ID NO: 9337677 - DNA, 22 bp, Homo sapiens
ggctgctgctgtgtaggcctgt

SEQ ID NO: 9337678 - DNA, 22 bp, Homo sapiens
ggctgctgctgtgtaggcctgt

SEQ ID NO: 9337679 - DNA, 22 bp, Homo sapiens
ggctccagatgtctcctggcaa

SEQ ID NO: 9337680 - DNA, 22 bp, Homo sapiens
ggctccagatgtctcctggcaa

SEQ ID NO: 9337681 - DNA, 22 bp, Homo sapiens
ggctccagccctggctcttcac

SEQ ID NO: 9337682 - DNA, 22 bp, Homo sapiens
ggctccaggaacctcctctcct

SEQ ID NO: 9337683 - DNA, 22 bp, Homo sapiens
ggctccaggaacctcctctcct

SEQ ID NO: 9337684 - DNA, 18 bp, Homo sapiens
ggctccaggacctaccca

SEQ ID NO: 9337685 - DNA, 18 bp, Homo sapiens
ggctccaggacctaccca

SEQ ID NO: 9337686 - DNA, 22 bp, Homo sapiens
ggctccaggagatgctgggcag

SEQ ID NO: 9337687 - DNA, 23 bp, Homo sapiens
ggctccaggcctgacgggcgcgg

SEQ ID NO: 9337688 - DNA, 22 bp, Homo sapiens
ggctccaggagggccttggcca

SEQ ID NO: 9337689 - DNA, 22 bp, Homo sapiens
ggctctgctcacagcccgcagc

SEQ ID NO: 9337690 - DNA, 22 bp, Homo sapiens
ggctccaggagatgctgggcag

SEQ ID NO: 9337691 - DNA, 22 bp, Homo sapiens
ggctccaggagggccttggcca

SEQ ID NO: 9337692 - DNA, 22 bp, Homo sapiens
ggctccaggagatgctgggcag

SEQ ID NO: 9337693 - DNA, 22 bp, Homo sapiens
ggctctgctcacagcccgcagc

SEQ ID NO: 9337694 - DNA, 22 bp, Homo sapiens
ggctctgctcctggtgccagtg

SEQ ID NO: 9337695 - DNA, 22 bp, Homo sapiens
ggctctgctgcaagtcttcctc

SEQ ID NO: 9337696 - DNA, 22 bp, Homo sapiens
ggctctgctcctggtgccagtg

SEQ ID NO: 9337697 - DNA, 22 bp, Homo sapiens
ggctctggagacatgtggagag

SEQ ID NO: 9337698 - DNA, 22 bp, Homo sapiens
ggctctggagacatgtggagag

SEQ ID NO: 9337699 - DNA, 22 bp, Homo sapiens
ggctccagatgtcccctggcaa

SEQ ID NO: 9337700 - DNA, 22 bp, Homo sapiens
ggctccagaggccttacctgca

SEQ ID NO: 9337701 - DNA, 22 bp, Homo sapiens
ggctccagaggccttacctgca

SEQ ID NO: 9337702 - DNA, 22 bp, Homo sapiens
ggctccagaaatcatagagcag

SEQ ID NO: 9337703 - DNA, 22 bp, Homo sapiens
ggctccagaaacttcagtccat

SEQ ID NO: 9337704 - DNA, 22 bp, Homo sapiens
ggctccagaaacttcagtccat

SEQ ID NO: 9337705 - DNA, 22 bp, Homo sapiens
ggctccagaaacttcagtccat

SEQ ID NO: 9337706 - DNA, 22 bp, Homo sapiens
ggctccagaaacttcagtccat

SEQ ID NO: 9337707 - DNA, 22 bp, Homo sapiens
ggcggaggttgcagtaagccga

SEQ ID NO: 9337708 - DNA, 22 bp, Homo sapiens
ggcggccctgcacgtgctgagg

SEQ ID NO: 9337709 - DNA, 21 bp, Homo sapiens
ggcggcgcagagctgcggctc

SEQ ID NO: 9337710 - DNA, 22 bp, Homo sapiens
ggcggccgccttcggccacggc

SEQ ID NO: 9337711 - DNA, 22 bp, Homo sapiens
ggcgggagcagcagctctgagc

SEQ ID NO: 9337712 - DNA, 22 bp, Homo sapiens
ggcgggagcagcagctctgagc

SEQ ID NO: 9337713 - DNA, 22 bp, Homo sapiens
ggcgggaagttcttgcccactt

SEQ ID NO: 9337714 - DNA, 22 bp, Homo sapiens
ggcggctactcctcctggtgag

SEQ ID NO: 9337715 - DNA, 22 bp, Homo sapiens
ggcgggaggctgaggagttggt

SEQ ID NO: 9337716 - DNA, 22 bp, Homo sapiens
ggcgggaggctgaggagttggt

SEQ ID NO: 9337717 - DNA, 22 bp, Homo sapiens
ggcgggaggctgaggagttggt

SEQ ID NO: 9337718 - DNA, 22 bp, Homo sapiens
ggcgggggtccaggagcctgca

SEQ ID NO: 9337719 - DNA, 22 bp, Homo sapiens
ggctgagaagacagtggggtgg

SEQ ID NO: 9337720 - DNA, 22 bp, Homo sapiens
ggctgagaaggagtgggtgagg

SEQ ID NO: 9337721 - DNA, 22 bp, Homo sapiens
ggctgagaaggagtgggtgagg

SEQ ID NO: 9337722 - DNA, 22 bp, Homo sapiens
ggctgagaacaggcccagcctc

SEQ ID NO: 9337723 - DNA, 22 bp, Homo sapiens
ggctgaagtgtagtggctcact

SEQ ID NO: 9337724 - DNA, 22 bp, Homo sapiens
ggctgaagttctttttgttcag

SEQ ID NO: 9337725 - DNA, 22 bp, Homo sapiens
ggctgagaatcaacaacctgct

SEQ ID NO: 9337726 - DNA, 22 bp, Homo sapiens
ggctgagacaacctgggaccca

SEQ ID NO: 9337727 - DNA, 22 bp, Homo sapiens
ggctgagactagagtgaggcat

SEQ ID NO: 9337728 - DNA, 22 bp, Homo sapiens
ggctgagactagagtgaggcat

SEQ ID NO: 9337729 - DNA, 23 bp, Homo sapiens
ggctgagactacaggcgcttgcc

SEQ ID NO: 9337730 - DNA, 22 bp, Homo sapiens
ggctgagactagagtgaggcat

SEQ ID NO: 9337731 - DNA, 22 bp, Homo sapiens
ggctgagactagagtgaggcat

SEQ ID NO: 9337732 - DNA, 22 bp, Homo sapiens
ggctcttgagaggcacaggttt

SEQ ID NO: 9337733 - DNA, 22 bp, Homo sapiens
ggctcttctgtttcacaggcca

SEQ ID NO: 9337734 - DNA, 22 bp, Homo sapiens
ggctcttgggagctcagagttg

SEQ ID NO: 9337735 - DNA, 22 bp, Homo sapiens
ggctctgggccagagttggctt

SEQ ID NO: 9337736 - DNA, 22 bp, Homo sapiens
ggctctgggccagagttggctt

SEQ ID NO: 9337737 - DNA, 22 bp, Homo sapiens
ggctcttctgtggcagccaagg

SEQ ID NO: 9337738 - DNA, 22 bp, Homo sapiens
ggctgaaggatgaaagctgcag

SEQ ID NO: 9337739 - DNA, 22 bp, Homo sapiens
ggctgaagaactgggagtctca

SEQ ID NO: 9337740 - DNA, 22 bp, Homo sapiens
ggctctggagacatgtggagag

SEQ ID NO: 9337741 - DNA, 22 bp, Homo sapiens
ggctctggagatgtccgacctg

SEQ ID NO: 9337742 - DNA, 22 bp, Homo sapiens
ggctctggagcacagacgtctg

SEQ ID NO: 9337743 - DNA, 22 bp, Homo sapiens
ggctctggagcacagacgtctg

SEQ ID NO: 9337744 - DNA, 22 bp, Homo sapiens
ggctctggagatgtccgacctg

SEQ ID NO: 9337745 - DNA, 22 bp, Homo sapiens
ggctctggagatgtccgacctg

SEQ ID NO: 9337746 - DNA, 22 bp, Homo sapiens
ggctctggagcacagacgtctg

SEQ ID NO: 9337747 - DNA, 22 bp, Homo sapiens
ggctctggcaaggggaggctac

SEQ ID NO: 9337748 - DNA, 22 bp, Homo sapiens
ggctctggcaaggggaggctac

SEQ ID NO: 9337749 - DNA, 22 bp, Homo sapiens
ggctctggcaaggggaggctac

SEQ ID NO: 9337750 - DNA, 22 bp, Homo sapiens
ggctctggcgagctttagtaca

SEQ ID NO: 9337751 - DNA, 22 bp, Homo sapiens
ggctctggcggctctttcaata

SEQ ID NO: 9337752 - DNA, 22 bp, Homo sapiens
ggctctggcgagctttagtaca

SEQ ID NO: 9337753 - DNA, 19 bp, Homo sapiens
ggctctggcggctgtagcc

SEQ ID NO: 9337754 - DNA, 19 bp, Homo sapiens
ggctctggcggctgtagcc

SEQ ID NO: 9337755 - DNA, 19 bp, Homo sapiens
ggctctggcggctgtagcc

SEQ ID NO: 9337756 - DNA, 19 bp, Homo sapiens
ggctctggcggctgtagcc

SEQ ID NO: 9337757 - DNA, 19 bp, Homo sapiens
ggctctggcggctgtagcc

SEQ ID NO: 9337758 - DNA, 22 bp, Homo sapiens
ggctctggctactccaccctgt

SEQ ID NO: 9337759 - DNA, 22 bp, Homo sapiens
ggctctggcgtccaatggagcg

SEQ ID NO: 9337760 - DNA, 22 bp, Homo sapiens
ggctctggcgtccaatggagcg

SEQ ID NO: 9337761 - DNA, 22 bp, Homo sapiens
ggctctggctcctggctttgtg

SEQ ID NO: 9337762 - DNA, 22 bp, Homo sapiens
ggctctggctcctggctttgtg

SEQ ID NO: 9337763 - DNA, 22 bp, Homo sapiens
ggctctggctactccaccctgt

SEQ ID NO: 9337764 - DNA, 22 bp, Homo sapiens
ggctctgggaaatggtcttcct

SEQ ID NO: 9337765 - DNA, 22 bp, Homo sapiens
ggctctgggaaatggtcttcct

SEQ ID NO: 9337766 - DNA, 22 bp, Homo sapiens
ggctctggctcctggctttgtg

SEQ ID NO: 9337767 - DNA, 22 bp, Homo sapiens
ggctctgggcatagaaggaagc

SEQ ID NO: 9337768 - DNA, 22 bp, Homo sapiens
ggctctgggccagagttggctt

SEQ ID NO: 9337769 - DNA, 22 bp, Homo sapiens
ggctctgggcatagaaggaagc

SEQ ID NO: 9337770 - DNA, 22 bp, Homo sapiens
ggctctgggcatagaaggaagc

SEQ ID NO: 9337771 - DNA, 22 bp, Homo sapiens
gggcaggaacaaatcaaatgat

SEQ ID NO: 9337772 - DNA, 22 bp, Homo sapiens
gggcagctggcttataggtttg

SEQ ID NO: 9337773 - DNA, 22 bp, Homo sapiens
gggcagctgcccctctctgggc

SEQ ID NO: 9337774 - DNA, 22 bp, Homo sapiens
gggcagctgcagggatggtgac

SEQ ID NO: 9337775 - DNA, 22 bp, Homo sapiens
gggcacaggaatttgggatgtg

SEQ ID NO: 9337776 - DNA, 22 bp, Homo sapiens
gggcacaggagaaggatctggc

SEQ ID NO: 9337777 - DNA, 22 bp, Homo sapiens
gggcacaggagaaggatctggc

SEQ ID NO: 9337778 - DNA, 22 bp, Homo sapiens
gggcacaggaatttgggatgtg

SEQ ID NO: 9337779 - DNA, 22 bp, Homo sapiens
gggcacaggaatttgggatgtg

SEQ ID NO: 9337780 - DNA, 22 bp, Homo sapiens
gggcagctctggctgtgggaag

SEQ ID NO: 9337781 - DNA, 22 bp, Homo sapiens
gggcagctctgcccatcagagg

SEQ ID NO: 9337782 - DNA, 22 bp, Homo sapiens
gggcagctgcagggatggtgac

SEQ ID NO: 9337783 - DNA, 22 bp, Homo sapiens
gggcaggagaaggtggatgtcc

SEQ ID NO: 9337784 - DNA, 16 bp, Homo sapiens
gggcaggaatcagggt

SEQ ID NO: 9337785 - DNA, 22 bp, Homo sapiens
gggcaggagaaggtggatgtcc

SEQ ID NO: 9337786 - DNA, 22 bp, Homo sapiens
gggcaggagaaggtggatgtcc

SEQ ID NO: 9337787 - DNA, 22 bp, Homo sapiens
gggcaggagagaacagtcatgg

SEQ ID NO: 9337788 - DNA, 22 bp, Homo sapiens
gggcaggagaaggtggatgtcc

SEQ ID NO: 9337789 - DNA, 22 bp, Homo sapiens
gggcaggaggctaattctgcat

SEQ ID NO: 9337790 - DNA, 22 bp, Homo sapiens
gggcaggagagggccacctgga

SEQ ID NO: 9337791 - DNA, 22 bp, Homo sapiens
gggcaggagagggccacctgga

SEQ ID NO: 9337792 - DNA, 22 bp, Homo sapiens
gggcaggagagggccacctgga

SEQ ID NO: 9337793 - DNA, 18 bp, Homo sapiens
gggcatggatgcagcatc

SEQ ID NO: 9337794 - DNA, 18 bp, Homo sapiens
gggcatggatgcagcatc

SEQ ID NO: 9337795 - DNA, 18 bp, Homo sapiens
gggcatggatgcagcatc

SEQ ID NO: 9337796 - DNA, 23 bp, Homo sapiens
gggcatggagtgtaggtggaagg

SEQ ID NO: 9337797 - DNA, 22 bp, Homo sapiens
gggcaggaggctaattctgcat

SEQ ID NO: 9337798 - DNA, 17 bp, Homo sapiens
gggcagggactcctggg

SEQ ID NO: 9337799 - DNA, 22 bp, Homo sapiens
gggcatgcctgcgcagtgcatg

SEQ ID NO: 9337800 - DNA, 22 bp, Homo sapiens
gggcaggctgagcatgtcacct

SEQ ID NO: 9337801 - DNA, 22 bp, Homo sapiens
gggcatgcctgcgcagtgcatg

SEQ ID NO: 9337802 - DNA, 22 bp, Homo sapiens
gggcaagaagctggaagcattc

SEQ ID NO: 9337803 - DNA, 22 bp, Homo sapiens
gggcaagcacagcgagcgtgcg

SEQ ID NO: 9337804 - DNA, 19 bp, Homo sapiens
gggcaaatcccttctttct

SEQ ID NO: 9337805 - DNA, 22 bp, Homo sapiens
gggcaaagtggtggaggcagtt

SEQ ID NO: 9337806 - DNA, 22 bp, Homo sapiens
gggcacagcctaactatggaga

SEQ ID NO: 9337807 - DNA, 22 bp, Homo sapiens
gggcacagcctaactatggaga

SEQ ID NO: 9337808 - DNA, 22 bp, Homo sapiens
gggatggggtcgggaccctgct

SEQ ID NO: 9337809 - DNA, 22 bp, Homo sapiens
gggatgtcactgtgcctggcac

SEQ ID NO: 9337810 - DNA, 22 bp, Homo sapiens
gggatgtcgtgggtggcagctg

SEQ ID NO: 9337811 - DNA, 22 bp, Homo sapiens
gggatggggtcgggaccctgct

SEQ ID NO: 9337812 - DNA, 22 bp, Homo sapiens
gggatggggtcaacatgtacct

SEQ ID NO: 9337813 - DNA, 22 bp, Homo sapiens
gggattaatgtctctttgaaag

SEQ ID NO: 9337814 - DNA, 22 bp, Homo sapiens
gggattaaacaccacttgaagg

SEQ ID NO: 9337815 - DNA, 21 bp, Homo sapiens
gggattaagtgacttgcctga

SEQ ID NO: 9337816 - DNA, 15 bp, Homo sapiens
gggattaaagagccc

SEQ ID NO: 9337817 - DNA, 22 bp, Homo sapiens
gggattgaattgggggatcaca

SEQ ID NO: 9337818 - DNA, 22 bp, Homo sapiens
gggatttcaccatgttggttgg

SEQ ID NO: 9337819 - DNA, 22 bp, Homo sapiens
gggatttgaatcttgagttgag

SEQ ID NO: 9337820 - DNA, 22 bp, Homo sapiens
gggatttgtgggatggccagtg

SEQ ID NO: 9337821 - DNA, 22 bp, Homo sapiens
gggatggggagctggaaagggg

SEQ ID NO: 9337822 - DNA, 22 bp, Homo sapiens
gggatggggagctggaaagggg

SEQ ID NO: 9337823 - DNA, 22 bp, Homo sapiens
gggatggggagctggaaagggg

SEQ ID NO: 9337824 - DNA, 22 bp, Homo sapiens
gggatggggagctggaaagggg

SEQ ID NO: 9337825 - DNA, 22 bp, Homo sapiens
gggatggggggaagcgtccatg

SEQ ID NO: 9337826 - DNA, 22 bp, Homo sapiens
gggaggagctgagtgtgtgtgc

SEQ ID NO: 9337827 - DNA, 22 bp, Homo sapiens
gggaggagctgagtgtgtgtgc

SEQ ID NO: 9337828 - DNA, 22 bp, Homo sapiens
gggaggagctgagtgtgtgtgc

SEQ ID NO: 9337829 - DNA, 22 bp, Homo sapiens
gggaggacggtccagggcaaag

SEQ ID NO: 9337830 - DNA, 22 bp, Homo sapiens
gggaggagcttggagattcact

SEQ ID NO: 9337831 - DNA, 22 bp, Homo sapiens
gggaggagctgagtgtgtgtgc

SEQ ID NO: 9337832 - DNA, 22 bp, Homo sapiens
gggaggagctgagtgtgtgtgc

SEQ ID NO: 9337833 - DNA, 22 bp, Homo sapiens
gggagcttctggaaggcaggaa

SEQ ID NO: 9337834 - DNA, 22 bp, Homo sapiens
gggaggaaatgtgcagcgaatt

SEQ ID NO: 9337835 - DNA, 22 bp, Homo sapiens
gggaggaaagagaagtggtcca

SEQ ID NO: 9337836 - DNA, 19 bp, Homo sapiens
gggagctgtctgcccgtgg

SEQ ID NO: 9337837 - DNA, 22 bp, Homo sapiens
gggagctgtgggattggttgag

SEQ ID NO: 9337838 - DNA, 23 bp, Homo sapiens
gggagctgtggtgaaaagaggtg

SEQ ID NO: 9337839 - DNA, 22 bp, Homo sapiens
gggaggaaggcttgggtgagta

SEQ ID NO: 9337840 - DNA, 22 bp, Homo sapiens
gggaggaaggcttgggtgagta

SEQ ID NO: 9337841 - DNA, 22 bp, Homo sapiens
gggaggaaggcttgggtgagta

SEQ ID NO: 9337842 - DNA, 22 bp, Homo sapiens
gggaggaaatgtgcagcgaatt

SEQ ID NO: 9337843 - DNA, 22 bp, Homo sapiens
gggagaggttacccgagcaact

SEQ ID NO: 9337844 - DNA, 22 bp, Homo sapiens
gggagaggttacccgagcaact

SEQ ID NO: 9337845 - DNA, 22 bp, Homo sapiens
gggagaggttacccgagcaact

SEQ ID NO: 9337846 - DNA, 22 bp, Homo sapiens
gggagaggttacccgagcaact

SEQ ID NO: 9337847 - DNA, 18 bp, Homo sapiens
gggagctgggaagctggt

SEQ ID NO: 9337848 - DNA, 18 bp, Homo sapiens
gggagctgggaagctggt

SEQ ID NO: 9337849 - DNA, 22 bp, Homo sapiens
gggagctggcggattccccagg

SEQ ID NO: 9337850 - DNA, 17 bp, Homo sapiens
gggagatgaagggatat

SEQ ID NO: 9337851 - DNA, 22 bp, Homo sapiens
gggagatgaatcagaagtgatc

SEQ ID NO: 9337852 - DNA, 22 bp, Homo sapiens
gggagctgtaagggacaggtag

SEQ ID NO: 9337853 - DNA, 22 bp, Homo sapiens
gggagctgtagtccagataccg

SEQ ID NO: 9337854 - DNA, 22 bp, Homo sapiens
gggagctgtcatcagtgttgtc

SEQ ID NO: 9337855 - DNA, 22 bp, Homo sapiens
gggagctgtcatcagtgttgtc

SEQ ID NO: 9337856 - DNA, 18 bp, Homo sapiens
gggagctgggaagctggt

SEQ ID NO: 9337857 - DNA, 22 bp, Homo sapiens
gggagctgggctggttttgctg

SEQ ID NO: 9337858 - DNA, 22 bp, Homo sapiens
gggagctggggcatttataccc

SEQ ID NO: 9337859 - DNA, 22 bp, Homo sapiens
gggagctggttcctgccctcca

SEQ ID NO: 9337860 - DNA, 22 bp, Homo sapiens
gggagagcgcgctagggccgag

SEQ ID NO: 9337861 - DNA, 19 bp, Homo sapiens
gggagagccaggctcaccc

SEQ ID NO: 9337862 - DNA, 22 bp, Homo sapiens
gggagagcgcgctagggccgag

SEQ ID NO: 9337863 - DNA, 22 bp, Homo sapiens
gggagaggttacccgagcaact

SEQ ID NO: 9337864 - DNA, 22 bp, Homo sapiens
gggagaggttacccgagcaact

SEQ ID NO: 9337865 - DNA, 22 bp, Homo sapiens
gggagagagagctcatgttgaa

SEQ ID NO: 9337866 - DNA, 22 bp, Homo sapiens
gggagagagagctcatgttgaa

SEQ ID NO: 9337867 - DNA, 19 bp, Homo sapiens
gggagagccaggctcaccc

SEQ ID NO: 9337868 - DNA, 22 bp, Homo sapiens
gggagagagagctcatgttgaa

SEQ ID NO: 9337869 - DNA, 22 bp, Homo sapiens
gggagacccccaatgccaggtc

SEQ ID NO: 9337870 - DNA, 22 bp, Homo sapiens
gggagacagttcagatagtttc

SEQ ID NO: 9337871 - DNA, 22 bp, Homo sapiens
gggagagaattattgccagacc

SEQ ID NO: 9337872 - DNA, 22 bp, Homo sapiens
ggctttaaggtttaggaagcaa

SEQ ID NO: 9337873 - DNA, 22 bp, Homo sapiens
ggctttatagggtagaggatca

SEQ ID NO: 9337874 - DNA, 22 bp, Homo sapiens
gggaatgtaatcatggaatgct

SEQ ID NO: 9337875 - DNA, 22 bp, Homo sapiens
gggaatgtaagatatatactag

SEQ ID NO: 9337876 - DNA, 22 bp, Homo sapiens
gggaatgtgaaacagtaaggga

SEQ ID NO: 9337877 - DNA, 22 bp, Homo sapiens
gggaatgtagcaaatctgcaat

SEQ ID NO: 9337878 - DNA, 22 bp, Homo sapiens
gggaatgtaattaatctccttc

SEQ ID NO: 9337879 - DNA, 22 bp, Homo sapiens
gggaatgtacagaggacacagg

SEQ ID NO: 9337880 - DNA, 20 bp, Homo sapiens
gggaatgtgccccttacccc

SEQ ID NO: 9337881 - DNA, 22 bp, Homo sapiens
gggaatgtgcaggatcgtgggc

SEQ ID NO: 9337882 - DNA, 22 bp, Homo sapiens
gggaatgtgcagccacagtgag

SEQ ID NO: 9337883 - DNA, 22 bp, Homo sapiens
gggaatgtgattgttgttttaa

SEQ ID NO: 9337884 - DNA, 22 bp, Homo sapiens
gggaatgtgagtagggtgagtt

SEQ ID NO: 9337885 - DNA, 22 bp, Homo sapiens
gggacaggcaaaggtatgcttc

SEQ ID NO: 9337886 - DNA, 22 bp, Homo sapiens
gggacagctggtctacctggta

SEQ ID NO: 9337887 - DNA, 22 bp, Homo sapiens
gggacagcagaaagaaggcaag

SEQ ID NO: 9337888 - DNA, 22 bp, Homo sapiens
ggcttgggagcaggcatgtgac

SEQ ID NO: 9337889 - DNA, 22 bp, Homo sapiens
ggcttggcttgggctcagaggc

SEQ ID NO: 9337890 - DNA, 22 bp, Homo sapiens
ggcttggcttgggctcagaggc

SEQ ID NO: 9337891 - DNA, 22 bp, Homo sapiens
ggcttgggagcaggcatgtgac

SEQ ID NO: 9337892 - DNA, 22 bp, Homo sapiens
ggcttgggagcaggcatgtgac

SEQ ID NO: 9337893 - DNA, 22 bp, Homo sapiens
ggcttggctgtctcccagccca

SEQ ID NO: 9337894 - DNA, 22 bp, Homo sapiens
ggcttcttagaatttgacttac

SEQ ID NO: 9337895 - DNA, 22 bp, Homo sapiens
ggcttggctacaagccatgggc

SEQ ID NO: 9337896 - DNA, 22 bp, Homo sapiens
ggctttaaacactgaaattgca

SEQ ID NO: 9337897 - DNA, 22 bp, Homo sapiens
ggctttaacaacagaaatttat

SEQ ID NO: 9337898 - DNA, 20 bp, Homo sapiens
ggcttgtctgagtccctggc

SEQ ID NO: 9337899 - DNA, 20 bp, Homo sapiens
ggcttgtctgagtccctggc

SEQ ID NO: 9337900 - DNA, 22 bp, Homo sapiens
ggcttgtcatgttgatgttctt

SEQ ID NO: 9337901 - DNA, 21 bp, Homo sapiens
ggcttgtcaccatagctactg

SEQ ID NO: 9337902 - DNA, 22 bp, Homo sapiens
ggcttgtccttgggctgtgcat

SEQ ID NO: 9337903 - DNA, 19 bp, Homo sapiens
ggcttgtctcggcagccgc

SEQ ID NO: 9337904 - DNA, 22 bp, Homo sapiens
gggacaggctgagacttgagct

SEQ ID NO: 9337905 - DNA, 22 bp, Homo sapiens
gggacaggctgagacttgagct

SEQ ID NO: 9337906 - DNA, 22 bp, Homo sapiens
gggacaggctgagacttgagct

SEQ ID NO: 9337907 - DNA, 22 bp, Homo sapiens
gggacaggctgagacttgagct

SEQ ID NO: 9337908 - DNA, 22 bp, Homo sapiens
gggacaggcccctcgctagctt

SEQ ID NO: 9337909 - DNA, 22 bp, Homo sapiens
gggacaggcccctcgctagctt

SEQ ID NO: 9337910 - DNA, 22 bp, Homo sapiens
gggacatgaggccatagtgatt

SEQ ID NO: 9337911 - DNA, 22 bp, Homo sapiens
gggacatgaggccatagtgatt

SEQ ID NO: 9337912 - DNA, 22 bp, Homo sapiens
gggacatgcccctcagtgggtg

SEQ ID NO: 9337913 - DNA, 22 bp, Homo sapiens
gggacatgaggccatagtgatt

SEQ ID NO: 9337914 - DNA, 22 bp, Homo sapiens
gggacatgaagcatcggaggca

SEQ ID NO: 9337915 - DNA, 22 bp, Homo sapiens
gggacatggaggcgcgcaggca

SEQ ID NO: 9337916 - DNA, 22 bp, Homo sapiens
gggacatgcccctcagtgggtg

SEQ ID NO: 9337917 - DNA, 22 bp, Homo sapiens
gggacatggctaggattccaat

SEQ ID NO: 9337918 - DNA, 22 bp, Homo sapiens
gggaccactccgacatgtaggg

SEQ ID NO: 9337919 - DNA, 22 bp, Homo sapiens
gggacatttgctatcggagttc

SEQ ID NO: 9337920 - DNA, 22 bp, Homo sapiens
gggacatttatcagatgaccat

SEQ ID NO: 9337921 - DNA, 22 bp, Homo sapiens
gggagaagtggaaatctcatta

SEQ ID NO: 9337922 - DNA, 23 bp, Homo sapiens
gggaccagctagggctgtgacct

SEQ ID NO: 9337923 - DNA, 23 bp, Homo sapiens
gggaccagctagggctgtgacct

SEQ ID NO: 9337924 - DNA, 22 bp, Homo sapiens
gtccccctgaaagcagccgcag

SEQ ID NO: 9337925 - DNA, 22 bp, Homo sapiens
gtccccctgaaagcagccgcag

SEQ ID NO: 9337926 - DNA, 22 bp, Homo sapiens
gtcccctcaaaattcatatgtt

SEQ ID NO: 9337927 - DNA, 22 bp, Homo sapiens
gtccccagctgtgacgagagcc

SEQ ID NO: 9337928 - DNA, 22 bp, Homo sapiens
gtccccagctgtgacgagagcc

SEQ ID NO: 9337929 - DNA, 22 bp, Homo sapiens
gtcccctcagccacccatgggg

SEQ ID NO: 9337930 - DNA, 22 bp, Homo sapiens
gtcccctcagccacccatgggg

SEQ ID NO: 9337931 - DNA, 22 bp, Homo sapiens
gtcccctggcccccagcgtcgg

SEQ ID NO: 9337932 - DNA, 22 bp, Homo sapiens
gtcccctgtccagggccagcca

SEQ ID NO: 9337933 - DNA, 22 bp, Homo sapiens
gtccccttggtaaccttcagct

SEQ ID NO: 9337934 - DNA, 22 bp, Homo sapiens
gtccctctgtgtccctgcagtc

SEQ ID NO: 9337935 - DNA, 22 bp, Homo sapiens
gtccctctgtgtccctgcagtc

SEQ ID NO: 9337936 - DNA, 22 bp, Homo sapiens
gtccctgagcctggcatttccc

SEQ ID NO: 9337937 - DNA, 22 bp, Homo sapiens
gtccctgcatcaccacgggact

SEQ ID NO: 9337938 - DNA, 22 bp, Homo sapiens
gtccctcactggaccatatgaa

SEQ ID NO: 9337939 - DNA, 22 bp, Homo sapiens
gtccctcagtagtgcacagtgg

SEQ ID NO: 9337940 - DNA, 22 bp, Homo sapiens
gtccctcagtagtgcacagtgg

SEQ ID NO: 9337941 - DNA, 23 bp, Homo sapiens
gtccctcacccctaggcaatgcc

SEQ ID NO: 9337942 - DNA, 22 bp, Homo sapiens
gtccctcacccagatgctccca

SEQ ID NO: 9337943 - DNA, 22 bp, Homo sapiens
gtccctcaaggtccagtcatgg

SEQ ID NO: 9337944 - DNA, 22 bp, Homo sapiens
gtcctgggcccaggggctgcct

SEQ ID NO: 9337945 - DNA, 22 bp, Homo sapiens
gtcctgggcccaggggctgcct

SEQ ID NO: 9337946 - DNA, 22 bp, Homo sapiens
gtcctgggcatgcagggctttc

SEQ ID NO: 9337947 - DNA, 22 bp, Homo sapiens
gtcctgggcatgcagggctttc

SEQ ID NO: 9337948 - DNA, 22 bp, Homo sapiens
gtcctgggcatgcagggctttc

SEQ ID NO: 9337949 - DNA, 20 bp, Homo sapiens
gtcctgggagccacagcaca

SEQ ID NO: 9337950 - DNA, 17 bp, Homo sapiens
gtcctgggaggagagag

SEQ ID NO: 9337951 - DNA, 17 bp, Homo sapiens
gtcctgggaggagagag

SEQ ID NO: 9337952 - DNA, 17 bp, Homo sapiens
gtcctgggaggagagag

SEQ ID NO: 9337953 - DNA, 17 bp, Homo sapiens
gtcctgggaggagagag

SEQ ID NO: 9337954 - DNA, 17 bp, Homo sapiens
gtcctgggaggagagag

SEQ ID NO: 9337955 - DNA, 22 bp, Homo sapiens
gtcctgggaggggctggtcctg

SEQ ID NO: 9337956 - DNA, 22 bp, Homo sapiens
gtcctgggagatgggaccctga

SEQ ID NO: 9337957 - DNA, 20 bp, Homo sapiens
gtcctgggagccacagcaca

SEQ ID NO: 9337958 - DNA, 22 bp, Homo sapiens
gtcctgggaaggaagccaggga

SEQ ID NO: 9337959 - DNA, 22 bp, Homo sapiens
gtcctgggaaggaagccaggga

SEQ ID NO: 9337960 - DNA, 22 bp, Homo sapiens
gtcctgggaaggaagccaggga

SEQ ID NO: 9337961 - DNA, 22 bp, Homo sapiens
gtccctgcatctgcaggccatg

SEQ ID NO: 9337962 - DNA, 22 bp, Homo sapiens
gtccctgcatctgcaggccatg

SEQ ID NO: 9337963 - DNA, 22 bp, Homo sapiens
gtccctgcatcaccacgggact

SEQ ID NO: 9337964 - DNA, 22 bp, Homo sapiens
gtccctgccctcctgggactca

SEQ ID NO: 9337965 - DNA, 22 bp, Homo sapiens
gtccctgccctcctgggactca

SEQ ID NO: 9337966 - DNA, 22 bp, Homo sapiens
gtccctggaaaagagctggtga

SEQ ID NO: 9337967 - DNA, 22 bp, Homo sapiens
gtccctggaaaagagctggtga

SEQ ID NO: 9337968 - DNA, 22 bp, Homo sapiens
gtccctggaatggactctgcgc

SEQ ID NO: 9337969 - DNA, 23 bp, Homo sapiens
gtatttcagcattctcagttaaa

SEQ ID NO: 9337970 - DNA, 22 bp, Homo sapiens
gtatttccattagtgtgtgcac

SEQ ID NO: 9337971 - DNA, 22 bp, Homo sapiens
gtcattttctagaattatttga

SEQ ID NO: 9337972 - DNA, 22 bp, Homo sapiens
gtcattttgctgcatatttaga

SEQ ID NO: 9337973 - DNA, 22 bp, Homo sapiens
gtcatttttcactgcatataga

SEQ ID NO: 9337974 - DNA, 22 bp, Homo sapiens
gtcatttttgactttgaagtga

SEQ ID NO: 9337975 - DNA, 22 bp, Homo sapiens
gtcatttttgactttgaagtga

SEQ ID NO: 9337976 - DNA, 22 bp, Homo sapiens
gtccaagagtcaagaagggggc

SEQ ID NO: 9337977 - DNA, 22 bp, Homo sapiens
gtccaagagtcaagaagggggc

SEQ ID NO: 9337978 - DNA, 22 bp, Homo sapiens
gtccaagagctcattatccgga

SEQ ID NO: 9337979 - DNA, 22 bp, Homo sapiens
gtcatttttttcgtaatagtgg

SEQ ID NO: 9337980 - DNA, 22 bp, Homo sapiens
gtccaaaagagccagccgggcg

SEQ ID NO: 9337981 - DNA, 22 bp, Homo sapiens
gtccacaaaattactatcttac

SEQ ID NO: 9337982 - DNA, 22 bp, Homo sapiens
gtccacaacatcagactaactg

SEQ ID NO: 9337983 - DNA, 22 bp, Homo sapiens
gtccacaagcaggaagtgagcc

SEQ ID NO: 9337984 - DNA, 22 bp, Homo sapiens
gtccccagaaaggtgaggcagg

SEQ ID NO: 9337985 - DNA, 22 bp, Homo sapiens
gtccccagaaaggtgaggcagg

SEQ ID NO: 9337986 - DNA, 22 bp, Homo sapiens
gtcccattgttctgggcttggc

SEQ ID NO: 9337987 - DNA, 22 bp, Homo sapiens
gtccactctctgccgtgcctgt

SEQ ID NO: 9337988 - DNA, 22 bp, Homo sapiens
gtccacttcaggactggccgct

SEQ ID NO: 9337989 - DNA, 21 bp, Homo sapiens
gtccacttccttcctgcttct

SEQ ID NO: 9337990 - DNA, 22 bp, Homo sapiens
gtccacttctgacttgttcaga

SEQ ID NO: 9337991 - DNA, 22 bp, Homo sapiens
gtccacttctgcctttctggat

SEQ ID NO: 9337992 - DNA, 22 bp, Homo sapiens
gtccacttgctgtgttcttaat

SEQ ID NO: 9337993 - DNA, 22 bp, Homo sapiens
gtccacttggcacaaggcactt

SEQ ID NO: 9337994 - DNA, 22 bp, Homo sapiens
gtccacagagggctgggcaggc

SEQ ID NO: 9337995 - DNA, 18 bp, Homo sapiens
gtccacagccctcacagc

SEQ ID NO: 9337996 - DNA, 22 bp, Homo sapiens
gtccacagctggccagggcctc

SEQ ID NO: 9337997 - DNA, 22 bp, Homo sapiens
gtccacagggatggccacacat

SEQ ID NO: 9337998 - DNA, 21 bp, Homo sapiens
gtccacaggggtttgtcctgg

SEQ ID NO: 9337999 - DNA, 22 bp, Homo sapiens
gtccacagggatggccacacat

SEQ ID NO: 9338000 - DNA, 19 bp, Homo sapiens
gtccactccactcggtctc

SEQ ID NO: 9338001 - DNA, 22 bp, Homo sapiens
gtccactcccagtgcctgaggc

SEQ ID NO: 9338002 - DNA, 22 bp, Homo sapiens
gtccactcccagtgcctgaggc

SEQ ID NO: 9338003 - DNA, 22 bp, Homo sapiens
gtccaccttcttggtcaggccc

SEQ ID NO: 9338004 - DNA, 22 bp, Homo sapiens
gtccacccatgacacctgcctg

SEQ ID NO: 9338005 - DNA, 22 bp, Homo sapiens
gtagaaattccatttactttga

SEQ ID NO: 9338006 - DNA, 22 bp, Homo sapiens
gtagaacatggtagggcaggtg

SEQ ID NO: 9338007 - DNA, 22 bp, Homo sapiens
gtagaacactggggctctgttg

SEQ ID NO: 9338008 - DNA, 22 bp, Homo sapiens
gtacctgggggatccacttctt

SEQ ID NO: 9338009 - DNA, 22 bp, Homo sapiens
gtacctgggggatccacttctt

SEQ ID NO: 9338010 - DNA, 22 bp, Homo sapiens
gtagaatattttgttctactat

SEQ ID NO: 9338011 - DNA, 22 bp, Homo sapiens
gtagaatatatggttagtattg

SEQ ID NO: 9338012 - DNA, 22 bp, Homo sapiens
gtagaataggggtattgcttca

SEQ ID NO: 9338013 - DNA, 22 bp, Homo sapiens
gtagaataggggtattgcttca

SEQ ID NO: 9338014 - DNA, 22 bp, Homo sapiens
gtagaataaatgtacacatctg

SEQ ID NO: 9338015 - DNA, 22 bp, Homo sapiens
gtagaactaggacttcaggtat

SEQ ID NO: 9338016 - DNA, 22 bp, Homo sapiens
gtattagactgagaaatggagt

SEQ ID NO: 9338017 - DNA, 22 bp, Homo sapiens
gtattagaagaaattataggta

SEQ ID NO: 9338018 - DNA, 22 bp, Homo sapiens
gtattattaagtgtatttgacc

SEQ ID NO: 9338019 - DNA, 22 bp, Homo sapiens
gtattcctaagtcatgacaaat

SEQ ID NO: 9338020 - DNA, 22 bp, Homo sapiens
gtattctgggccgattacaaaa

SEQ ID NO: 9338021 - DNA, 22 bp, Homo sapiens
gtatttataggggaatgagagt

SEQ ID NO: 9338022 - DNA, 22 bp, Homo sapiens
gtatttcacatatggatatgct

SEQ ID NO: 9338023 - DNA, 22 bp, Homo sapiens
gtatttataggggaatgagagt

SEQ ID NO: 9338024 - DNA, 22 bp, Homo sapiens
gtattgtatttatttatgtgac

SEQ ID NO: 9338025 - DNA, 22 bp, Homo sapiens
gtattgtatatttgcaaataca

SEQ ID NO: 9338026 - DNA, 22 bp, Homo sapiens
gtattgtattgaacacatgtga

SEQ ID NO: 9338027 - DNA, 22 bp, Homo sapiens
gtaaaacatgttttaactagga

SEQ ID NO: 9338028 - DNA, 22 bp, Homo sapiens
gtaaaacaagctttatggttcc

SEQ ID NO: 9338029 - DNA, 22 bp, Homo sapiens
ggttttatagcagtactatcag

SEQ ID NO: 9338030 - DNA, 22 bp, Homo sapiens
ggttttatcctacccacacagc

SEQ ID NO: 9338031 - DNA, 22 bp, Homo sapiens
ggttttattaccccttaaacac

SEQ ID NO: 9338032 - DNA, 22 bp, Homo sapiens
ggttttattaactttaacatca

SEQ ID NO: 9338033 - DNA, 22 bp, Homo sapiens
ggttttattaactttaacatca

SEQ ID NO: 9338034 - DNA, 22 bp, Homo sapiens
ggttttcaaagaggcatttcat

SEQ ID NO: 9338035 - DNA, 22 bp, Homo sapiens
ggttttctgctgaagatttcac

SEQ ID NO: 9338036 - DNA, 22 bp, Homo sapiens
ggtttcaactcagctagtaagg

SEQ ID NO: 9338037 - DNA, 22 bp, Homo sapiens
ggtttccaaagatagagtagta

SEQ ID NO: 9338038 - DNA, 22 bp, Homo sapiens
ggtttcctttgcttctcctgag

SEQ ID NO: 9338039 - DNA, 22 bp, Homo sapiens
ggtttgaacagctttggagaag

SEQ ID NO: 9338040 - DNA, 22 bp, Homo sapiens
ggtttgcacgatatttccatgg

SEQ ID NO: 9338041 - DNA, 19 bp, Homo sapiens
ggtttgaagaaaatcttgc

SEQ ID NO: 9338042 - DNA, 22 bp, Homo sapiens
ggttttaactacagaattgcaa

SEQ ID NO: 9338043 - DNA, 22 bp, Homo sapiens
ggtttgttggggtccaggccca

SEQ ID NO: 9338044 - DNA, 22 bp, Homo sapiens
ggtttgtggagctggaaacact

SEQ ID NO: 9338045 - DNA, 22 bp, Homo sapiens
gtaaaactgtctaatggtatat

SEQ ID NO: 9338046 - DNA, 22 bp, Homo sapiens
gtacatttatttttgcagcata

SEQ ID NO: 9338047 - DNA, 22 bp, Homo sapiens
gtacatttatttttgcagcata

SEQ ID NO: 9338048 - DNA, 22 bp, Homo sapiens
gtacatttcagtttccttaaga

SEQ ID NO: 9338049 - DNA, 22 bp, Homo sapiens
gtacatttctcccaacactaaa

SEQ ID NO: 9338050 - DNA, 22 bp, Homo sapiens
gtgcactgtctggtcaagagca

SEQ ID NO: 9338051 - DNA, 22 bp, Homo sapiens
gtgcacatcgtgcaggtttgtt

SEQ ID NO: 9338052 - DNA, 22 bp, Homo sapiens
gtgcacatcgtgcaggtttgtt

SEQ ID NO: 9338053 - DNA, 22 bp, Homo sapiens
gtgcagacccacgtccagggcc

SEQ ID NO: 9338054 - DNA, 22 bp, Homo sapiens
gtgcacttgatctagacagatt

SEQ ID NO: 9338055 - DNA, 22 bp, Homo sapiens
gtgcagagaaatgagaagtcga

SEQ ID NO: 9338056 - DNA, 22 bp, Homo sapiens
gtgcagagaaatgagaagtcga

SEQ ID NO: 9338057 - DNA, 22 bp, Homo sapiens
gtgcagagcaagggctgagggc

SEQ ID NO: 9338058 - DNA, 22 bp, Homo sapiens
gtgcacatatttgtgcatgcat

SEQ ID NO: 9338059 - DNA, 23 bp, Homo sapiens
gtgcacagtcaagcccagcttag

SEQ ID NO: 9338060 - DNA, 22 bp, Homo sapiens
gtgagcaggatttcatggtgta

SEQ ID NO: 9338061 - DNA, 22 bp, Homo sapiens
gtgagcaggatttcatggtgta

SEQ ID NO: 9338062 - DNA, 22 bp, Homo sapiens
gtgagcaggatttcatggtgta

SEQ ID NO: 9338063 - DNA, 22 bp, Homo sapiens
gtgagcagctcagggtggtctc

SEQ ID NO: 9338064 - DNA, 22 bp, Homo sapiens
gtgagcagcctcacctgagggt

SEQ ID NO: 9338065 - DNA, 22 bp, Homo sapiens
gtgagcaggataggggctccct

SEQ ID NO: 9338066 - DNA, 22 bp, Homo sapiens
gtgagcagctcagggtggtctc

SEQ ID NO: 9338067 - DNA, 22 bp, Homo sapiens
gtgagcaggataggggctccct

SEQ ID NO: 9338068 - DNA, 22 bp, Homo sapiens
gtgagcaggataggggctccct

SEQ ID NO: 9338069 - DNA, 22 bp, Homo sapiens
gtgagagaaattggagggaatg

SEQ ID NO: 9338070 - DNA, 22 bp, Homo sapiens
gtgagagaaattggagggaatg

SEQ ID NO: 9338071 - DNA, 22 bp, Homo sapiens
gtgagagaatttgagttaaatt

SEQ ID NO: 9338072 - DNA, 22 bp, Homo sapiens
gtgagactcgcctttgtgtagc

SEQ ID NO: 9338073 - DNA, 22 bp, Homo sapiens
gtgactttaacttcagattaga

SEQ ID NO: 9338074 - DNA, 22 bp, Homo sapiens
gtgagaataccagcagtgagaa

SEQ ID NO: 9338075 - DNA, 22 bp, Homo sapiens
gtgagacaagatttgtaggcag

SEQ ID NO: 9338076 - DNA, 22 bp, Homo sapiens
gtgagacaattcctcagtagac

SEQ ID NO: 9338077 - DNA, 22 bp, Homo sapiens
gtgagacaattcctcagtagac

SEQ ID NO: 9338078 - DNA, 22 bp, Homo sapiens
gtgcatttatatttgcctttgg

SEQ ID NO: 9338079 - DNA, 22 bp, Homo sapiens
gtgcatttaggtcacatgatgt

SEQ ID NO: 9338080 - DNA, 22 bp, Homo sapiens
gtgcatttaggtcacatgatgt

SEQ ID NO: 9338081 - DNA, 22 bp, Homo sapiens
gtgcatttaggtcacatgatgt

SEQ ID NO: 9338082 - DNA, 22 bp, Homo sapiens
gtgcatttaggtcacatgatgt

SEQ ID NO: 9338083 - DNA, 22 bp, Homo sapiens
gtgctaggattacaggcatggg

SEQ ID NO: 9338084 - DNA, 22 bp, Homo sapiens
gtgctaggtactttgatcggtt

SEQ ID NO: 9338085 - DNA, 22 bp, Homo sapiens
gtgccacagaccaccgtgctgg

SEQ ID NO: 9338086 - DNA, 22 bp, Homo sapiens
gtgcatttgtgcatgcacatgt

SEQ ID NO: 9338087 - DNA, 22 bp, Homo sapiens
gtgcatttggtgactctcaccc

SEQ ID NO: 9338088 - DNA, 22 bp, Homo sapiens
gtgcatttgacgaatactcact

SEQ ID NO: 9338089 - DNA, 22 bp, Homo sapiens
gtgcatttgacgaatactcact

SEQ ID NO: 9338090 - DNA, 22 bp, Homo sapiens
gtgcatttggtgactctcaccc

SEQ ID NO: 9338091 - DNA, 22 bp, Homo sapiens
gtgcatttggtgactctcaccc

SEQ ID NO: 9338092 - DNA, 20 bp, Homo sapiens
gtgcatttcacctgtactgt

SEQ ID NO: 9338093 - DNA, 20 bp, Homo sapiens
gtgcatttcacctgtactgt

SEQ ID NO: 9338094 - DNA, 22 bp, Homo sapiens
gtgcatttcaaggcacagctaa

SEQ ID NO: 9338095 - DNA, 22 bp, Homo sapiens
gtgcatttcaaggcacagctaa

SEQ ID NO: 9338096 - DNA, 22 bp, Homo sapiens
gtgcatttgacgaatactcact

SEQ ID NO: 9338097 - DNA, 22 bp, Homo sapiens
gtgcatttctcatacactaaat

SEQ ID NO: 9338098 - DNA, 22 bp, Homo sapiens
gtgcatttctcatacactaaat

SEQ ID NO: 9338099 - DNA, 22 bp, Homo sapiens
gtgcagtatctctgggagtggg

SEQ ID NO: 9338100 - DNA, 22 bp, Homo sapiens
gtgcagtgaccctggagagctg

SEQ ID NO: 9338101 - DNA, 22 bp, Homo sapiens
gtgcaggtgttttggctgccag

SEQ ID NO: 9338102 - DNA, 22 bp, Homo sapiens
gtgcaggtgttttggctgccag

SEQ ID NO: 9338103 - DNA, 22 bp, Homo sapiens
gtgcaggtggttggcccagccg

SEQ ID NO: 9338104 - DNA, 22 bp, Homo sapiens
gtgcaggtggcttctagcttct

SEQ ID NO: 9338105 - DNA, 20 bp, Homo sapiens
gtgcaggttccccttgcact

SEQ ID NO: 9338106 - DNA, 22 bp, Homo sapiens
gtgcaggtttaggaagcagctc

SEQ ID NO: 9338107 - DNA, 22 bp, Homo sapiens
gtgcaggtttaggaagcagctc

SEQ ID NO: 9338108 - DNA, 20 bp, Homo sapiens
gtgcaggttccccttgcact

SEQ ID NO: 9338109 - DNA, 22 bp, Homo sapiens
gtgcaggtggatttgggctcaa

SEQ ID NO: 9338110 - DNA, 22 bp, Homo sapiens
gtgcaggtggatttgggctcaa

SEQ ID NO: 9338111 - DNA, 22 bp, Homo sapiens
gtgcaggtggctggtggcaccc

SEQ ID NO: 9338112 - DNA, 22 bp, Homo sapiens
gtgcaggtggctggtggcaccc

SEQ ID NO: 9338113 - DNA, 22 bp, Homo sapiens
gtgcaggtgacctaatccatgt

SEQ ID NO: 9338114 - DNA, 22 bp, Homo sapiens
gtgcagatcctgattgcagttc

SEQ ID NO: 9338115 - DNA, 22 bp, Homo sapiens
gtgcagattcccgggcctctcc

SEQ ID NO: 9338116 - DNA, 22 bp, Homo sapiens
gtgcagggtagcgacggcagga

SEQ ID NO: 9338117 - DNA, 20 bp, Homo sapiens
gtgcagatgtcctttcacac

SEQ ID NO: 9338118 - DNA, 22 bp, Homo sapiens
gtgcagagcaagggctgagggc

SEQ ID NO: 9338119 - DNA, 21 bp, Homo sapiens
gtgcagaggaatgtagggggc

SEQ ID NO: 9338120 - DNA, 22 bp, Homo sapiens
gtgaccatcatctcagctagtt

SEQ ID NO: 9338121 - DNA, 22 bp, Homo sapiens
gtgaccatcatctcagctagtt

SEQ ID NO: 9338122 - DNA, 22 bp, Homo sapiens
gtgaaggactgaatgaaaatgt

SEQ ID NO: 9338123 - DNA, 22 bp, Homo sapiens
gtgaaggactagcatggagggc

SEQ ID NO: 9338124 - DNA, 18 bp, Homo sapiens
gtgaagctttattgaatg

SEQ ID NO: 9338125 - DNA, 18 bp, Homo sapiens
gtgaagctttattgaatg

SEQ ID NO: 9338126 - DNA, 22 bp, Homo sapiens
gtgaagcatatgcttctctgcc

SEQ ID NO: 9338127 - DNA, 19 bp, Homo sapiens
gtgaagctaagtatttgga

SEQ ID NO: 9338128 - DNA, 19 bp, Homo sapiens
gtgaagctaagtatttgga

SEQ ID NO: 9338129 - DNA, 22 bp, Homo sapiens
gtgaagagctgttgcagagatt

SEQ ID NO: 9338130 - DNA, 17 bp, Homo sapiens
gtgaagagtcattgaat

SEQ ID NO: 9338131 - DNA, 22 bp, Homo sapiens
gtgaaatatttaacgtccaggt

SEQ ID NO: 9338132 - DNA, 22 bp, Homo sapiens
gtgaaatattttgtttatgtca

SEQ ID NO: 9338133 - DNA, 22 bp, Homo sapiens
gtgaacattttcttgcaaattg

SEQ ID NO: 9338134 - DNA, 22 bp, Homo sapiens
gtgaacatcagattacatgaga

SEQ ID NO: 9338135 - DNA, 22 bp, Homo sapiens
gtgaacattgaggcagaaagga

SEQ ID NO: 9338136 - DNA, 22 bp, Homo sapiens
gtgaacatcagattacatgaga

SEQ ID NO: 9338137 - DNA, 22 bp, Homo sapiens
gtgaaacttcacattttgatag

SEQ ID NO: 9338138 - DNA, 22 bp, Homo sapiens
gtgaaaataaggctggttcttg

SEQ ID NO: 9338139 - DNA, 22 bp, Homo sapiens
gtctggagtggggcctgagaat

SEQ ID NO: 9338140 - DNA, 18 bp, Homo sapiens
gtctggaggtcaggagct

SEQ ID NO: 9338141 - DNA, 22 bp, Homo sapiens
gtctggagtaccataaaaagga

SEQ ID NO: 9338142 - DNA, 22 bp, Homo sapiens
gtctggaggcccgtcagcccta

SEQ ID NO: 9338143 - DNA, 22 bp, Homo sapiens
gtctggagggaagagatgtcag

SEQ ID NO: 9338144 - DNA, 22 bp, Homo sapiens
gtctgcccagaagacatcccct

SEQ ID NO: 9338145 - DNA, 22 bp, Homo sapiens
gtctgccccagaccctgaccca

SEQ ID NO: 9338146 - DNA, 22 bp, Homo sapiens
gtcctgggggcagctgtgtcca

SEQ ID NO: 9338147 - DNA, 22 bp, Homo sapiens
gtcctgggggcagctgtgtcca

SEQ ID NO: 9338148 - DNA, 22 bp, Homo sapiens
gtcctggggattatagagtgtt

SEQ ID NO: 9338149 - DNA, 22 bp, Homo sapiens
gtctgcccggccttcctccacc

SEQ ID NO: 9338150 - DNA, 22 bp, Homo sapiens
gtctgcccttcctctccacgat

SEQ ID NO: 9338151 - DNA, 22 bp, Homo sapiens
gtcctggggattatagagtgtt

SEQ ID NO: 9338152 - DNA, 22 bp, Homo sapiens
gtcctggggatacagaagtgaa

SEQ ID NO: 9338153 - DNA, 22 bp, Homo sapiens
gtcctggggatacagaagtgaa

SEQ ID NO: 9338154 - DNA, 22 bp, Homo sapiens
gtcctggggatacagaagtgaa

SEQ ID NO: 9338155 - DNA, 22 bp, Homo sapiens
gtcctggggaatacagaagccg

SEQ ID NO: 9338156 - DNA, 22 bp, Homo sapiens
gtcctggggaatacagaagccg

SEQ ID NO: 9338157 - DNA, 22 bp, Homo sapiens
gtcctggggaatacagaagccg

SEQ ID NO: 9338158 - DNA, 22 bp, Homo sapiens
gtcctggggaatacagaagccg

SEQ ID NO: 9338159 - DNA, 22 bp, Homo sapiens
gtcctggggaatacagaagccg

SEQ ID NO: 9338160 - DNA, 22 bp, Homo sapiens
gtcctgggcggagggctgctgt

SEQ ID NO: 9338161 - DNA, 22 bp, Homo sapiens
gtcctgggcggagggctgctgt

SEQ ID NO: 9338162 - DNA, 22 bp, Homo sapiens
gtcctgggcggagggctgctgt

SEQ ID NO: 9338163 - DNA, 22 bp, Homo sapiens
gtcctgggcctgctgaggctga

SEQ ID NO: 9338164 - DNA, 22 bp, Homo sapiens
gtcctgggcctgctgaggctga

SEQ ID NO: 9338165 - DNA, 22 bp, Homo sapiens
gtctgcccttggctcagccata

SEQ ID NO: 9338166 - DNA, 22 bp, Homo sapiens
gtctgcctctttctttctgggt

SEQ ID NO: 9338167 - DNA, 22 bp, Homo sapiens
gtctgcctggaggcagctgctg

SEQ ID NO: 9338168 - DNA, 22 bp, Homo sapiens
gtctgcctgggacgctgggagt

SEQ ID NO: 9338169 - DNA, 22 bp, Homo sapiens
gtctgctcatgctaccgcgggc

SEQ ID NO: 9338170 - DNA, 22 bp, Homo sapiens
gtctgctcatgctaccgcgggc

SEQ ID NO: 9338171 - DNA, 22 bp, Homo sapiens
gtctgctcatgctaccgcgggc

SEQ ID NO: 9338172 - DNA, 22 bp, Homo sapiens
gtctgctggtgcctggcctgcg

SEQ ID NO: 9338173 - DNA, 22 bp, Homo sapiens
gtctgctgcagtcgtggctcta

SEQ ID NO: 9338174 - DNA, 22 bp, Homo sapiens
gtctgctggtgcctggcctgcg

SEQ ID NO: 9338175 - DNA, 22 bp, Homo sapiens
gtctggagcctgggtccctgct

SEQ ID NO: 9338176 - DNA, 22 bp, Homo sapiens
gtctggaggaggaagaaggcac

SEQ ID NO: 9338177 - DNA, 22 bp, Homo sapiens
gggcttgctgtttagttccatt

SEQ ID NO: 9338178 - DNA, 20 bp, Homo sapiens
gggcttggaggactcgaggg

SEQ ID NO: 9338179 - DNA, 22 bp, Homo sapiens
gggcttgcttaaggtcacccgg

SEQ ID NO: 9338180 - DNA, 22 bp, Homo sapiens
gggcttggagtaggctgatgaa

SEQ ID NO: 9338181 - DNA, 22 bp, Homo sapiens
gggcttggagtaggctgatgaa

SEQ ID NO: 9338182 - DNA, 22 bp, Homo sapiens
gggcttggagtaggctgatgaa

SEQ ID NO: 9338183 - DNA, 22 bp, Homo sapiens
gggcttggctcataagtggatg

SEQ ID NO: 9338184 - DNA, 22 bp, Homo sapiens
gggcttggccccagaagagcta

SEQ ID NO: 9338185 - DNA, 19 bp, Homo sapiens
gggcttggggctgaagcct

SEQ ID NO: 9338186 - DNA, 22 bp, Homo sapiens
gggcttgggtattgtgagaggt

SEQ ID NO: 9338187 - DNA, 22 bp, Homo sapiens
gggcttgggtattgtgagaggt

SEQ ID NO: 9338188 - DNA, 22 bp, Homo sapiens
gggcttgggtattgtgagaggt

SEQ ID NO: 9338189 - DNA, 22 bp, Homo sapiens
gggcttgggtattgtgagaggt

SEQ ID NO: 9338190 - DNA, 22 bp, Homo sapiens
gggcttcttgagctgccggccc

SEQ ID NO: 9338191 - DNA, 22 bp, Homo sapiens
gggcttcttgagctgccggccc

SEQ ID NO: 9338192 - DNA, 22 bp, Homo sapiens
gggcttcttgagctgccggccc

SEQ ID NO: 9338193 - DNA, 22 bp, Homo sapiens
gggctgctgtgttcctgaggca

SEQ ID NO: 9338194 - DNA, 22 bp, Homo sapiens
gggctgctgtgttcctgaggca

SEQ ID NO: 9338195 - DNA, 22 bp, Homo sapiens
gggcttgctaagaagagcgcat

SEQ ID NO: 9338196 - DNA, 22 bp, Homo sapiens
gggcttgctaagaagagcgcat

SEQ ID NO: 9338197 - DNA, 22 bp, Homo sapiens
gggcttgaggtgaaggtaggga

SEQ ID NO: 9338198 - DNA, 22 bp, Homo sapiens
gggctgctgcccaggaggcacc

SEQ ID NO: 9338199 - DNA, 22 bp, Homo sapiens
gggctgctgcccaggaggcacc

SEQ ID NO: 9338200 - DNA, 22 bp, Homo sapiens
gggctgctgccaatcacagcct

SEQ ID NO: 9338201 - DNA, 22 bp, Homo sapiens
gggctgctgccaccaggtggat

SEQ ID NO: 9338202 - DNA, 22 bp, Homo sapiens
gggctgctgccaccaggtggat

SEQ ID NO: 9338203 - DNA, 22 bp, Homo sapiens
gggctgctgtagagaacatgtt

SEQ ID NO: 9338204 - DNA, 22 bp, Homo sapiens
gggctgctgggcaagaaacatt

SEQ ID NO: 9338205 - DNA, 22 bp, Homo sapiens
gggctgctgtagagaacatgtt

SEQ ID NO: 9338206 - DNA, 22 bp, Homo sapiens
gggctgctgctgccagcgacac

SEQ ID NO: 9338207 - DNA, 22 bp, Homo sapiens
gggctgctgctgccagcgacac

SEQ ID NO: 9338208 - DNA, 22 bp, Homo sapiens
gggctgctgctgccagcgacac

SEQ ID NO: 9338209 - DNA, 22 bp, Homo sapiens
gggctgcctttcttctgggagc

SEQ ID NO: 9338210 - DNA, 23 bp, Homo sapiens
gggctgctccaggccaaggctgg

SEQ ID NO: 9338211 - DNA, 22 bp, Homo sapiens
gggctgctgccaatcacagcct

SEQ ID NO: 9338212 - DNA, 23 bp, Homo sapiens
gggctgctccaggccaaggctgg

SEQ ID NO: 9338213 - DNA, 22 bp, Homo sapiens
gggctgctataacaagatacct

SEQ ID NO: 9338214 - DNA, 22 bp, Homo sapiens
gggctgctacgagaactgaata

SEQ ID NO: 9338215 - DNA, 22 bp, Homo sapiens
gggctgattcgatgggggtaga

SEQ ID NO: 9338216 - DNA, 22 bp, Homo sapiens
gggctgcacgtattctgctcac

SEQ ID NO: 9338217 - DNA, 22 bp, Homo sapiens
gggctgccaagcctgcctgcct

SEQ ID NO: 9338218 - DNA, 22 bp, Homo sapiens
gggctgccaagcctgcctgcct

SEQ ID NO: 9338219 - DNA, 22 bp, Homo sapiens
gggctgcactagggcaaggtga

SEQ ID NO: 9338220 - DNA, 22 bp, Homo sapiens
gggctgcatcagcaggacccgg

SEQ ID NO: 9338221 - DNA, 22 bp, Homo sapiens
gggctgagttcctgcctcactc

SEQ ID NO: 9338222 - DNA, 22 bp, Homo sapiens
gggctgagtgtcccaggccgaa

SEQ ID NO: 9338223 - DNA, 22 bp, Homo sapiens
gggctgagtgtcccaggccgaa

SEQ ID NO: 9338224 - DNA, 22 bp, Homo sapiens
gggctgagtgtcccaggccgaa

SEQ ID NO: 9338225 - DNA, 22 bp, Homo sapiens
gggctgagtgtcccaggccgaa

SEQ ID NO: 9338226 - DNA, 22 bp, Homo sapiens
gggctgagggccaattcctact

SEQ ID NO: 9338227 - DNA, 22 bp, Homo sapiens
gggctgagggccaattcctact

SEQ ID NO: 9338228 - DNA, 22 bp, Homo sapiens
gggctgaggctaccactggtct

SEQ ID NO: 9338229 - DNA, 22 bp, Homo sapiens
gggctgagccacagcttttgtt

SEQ ID NO: 9338230 - DNA, 22 bp, Homo sapiens
gggctgagccacagcttttgtt

SEQ ID NO: 9338231 - DNA, 22 bp, Homo sapiens
gggctgagccacagcttttgtt

SEQ ID NO: 9338232 - DNA, 22 bp, Homo sapiens
gggctgagcacatactgacagc

SEQ ID NO: 9338233 - DNA, 22 bp, Homo sapiens
gggctgagccatttgaaccttg

SEQ ID NO: 9338234 - DNA, 22 bp, Homo sapiens
gggctgagccatttgaaccttg

SEQ ID NO: 9338235 - DNA, 22 bp, Homo sapiens
gggctgagctaagctgggttga

SEQ ID NO: 9338236 - DNA, 22 bp, Homo sapiens
gggctgagctgttctgagttta

SEQ ID NO: 9338237 - DNA, 22 bp, Homo sapiens
gggctgagctaagctgggttga

SEQ ID NO: 9338238 - DNA, 22 bp, Homo sapiens
gggctgagctgttctgagttta

SEQ ID NO: 9338239 - DNA, 22 bp, Homo sapiens
gggctgagctaagctgggttga

SEQ ID NO: 9338240 - DNA, 22 bp, Homo sapiens
gggctgaggaacatattttgtt

SEQ ID NO: 9338241 - DNA, 22 bp, Homo sapiens
gggctgaggctaccactggtct

SEQ ID NO: 9338242 - DNA, 22 bp, Homo sapiens
gggctgagagtgactgttctgt

SEQ ID NO: 9338243 - DNA, 22 bp, Homo sapiens
gggctgagagctggaatctgag

SEQ ID NO: 9338244 - DNA, 22 bp, Homo sapiens
gggctgagagctggaatctgag

SEQ ID NO: 9338245 - DNA, 22 bp, Homo sapiens
gggctgagagctggaatctgag

SEQ ID NO: 9338246 - DNA, 22 bp, Homo sapiens
gggctgagagctggaatctgag

SEQ ID NO: 9338247 - DNA, 21 bp, Homo sapiens
gggccacaccttctgcagacc

SEQ ID NO: 9338248 - DNA, 22 bp, Homo sapiens
gggctgagattggtgccctgtc

SEQ ID NO: 9338249 - DNA, 22 bp, Homo sapiens
gggctgagattggtgccctgtc

SEQ ID NO: 9338250 - DNA, 22 bp, Homo sapiens
gggctgagcacatactgacagc

SEQ ID NO: 9338251 - DNA, 22 bp, Homo sapiens
gggctgagcacatactgacagc

SEQ ID NO: 9338252 - DNA, 22 bp, Homo sapiens
gggctgagcacatactgacagc

SEQ ID NO: 9338253 - DNA, 22 bp, Homo sapiens
gggctgagagtgactgttctgt

SEQ ID NO: 9338254 - DNA, 22 bp, Homo sapiens
gggctgagattggtgccctgtc

SEQ ID NO: 9338255 - DNA, 22 bp, Homo sapiens
gggctgagattggtgccctgtc

SEQ ID NO: 9338256 - DNA, 22 bp, Homo sapiens
gggctgagagtgactgttctgt

SEQ ID NO: 9338257 - DNA, 22 bp, Homo sapiens
gggctgagattggtgccctgtc

SEQ ID NO: 9338258 - DNA, 22 bp, Homo sapiens
gggctgagagtgactgttctgt

SEQ ID NO: 9338259 - DNA, 22 bp, Homo sapiens
gggcatggccaggtgaggggtc

SEQ ID NO: 9338260 - DNA, 18 bp, Homo sapiens
gggcatggatgcagcatc

SEQ ID NO: 9338261 - DNA, 22 bp, Homo sapiens
gggcatggcgtgtgctggattc

SEQ ID NO: 9338262 - DNA, 22 bp, Homo sapiens
gggcatggccaggtgaggggtc

SEQ ID NO: 9338263 - DNA, 22 bp, Homo sapiens
gggcatggcgtgtgctggattc

SEQ ID NO: 9338264 - DNA, 22 bp, Homo sapiens
gggcatggccaggtgaggggtc

SEQ ID NO: 9338265 - DNA, 22 bp, Homo sapiens
gggcatggccaggtgaggggtc

SEQ ID NO: 9338266 - DNA, 22 bp, Homo sapiens
gggcatggcgtgtgctggattc

SEQ ID NO: 9338267 - DNA, 22 bp, Homo sapiens
gggcatggggcggacctggttc

SEQ ID NO: 9338268 - DNA, 22 bp, Homo sapiens
gggcatggtggcaggcacctgt

SEQ ID NO: 9338269 - DNA, 22 bp, Homo sapiens
gggcatgtaggaatccatggag

SEQ ID NO: 9338270 - DNA, 22 bp, Homo sapiens
gggcatgtaggaatccatggag

SEQ ID NO: 9338271 - DNA, 22 bp, Homo sapiens
gggcatgttttcgtaaactcag

SEQ ID NO: 9338272 - DNA, 22 bp, Homo sapiens
gggccaaggggagctggaaggg

SEQ ID NO: 9338273 - DNA, 21 bp, Homo sapiens
gggccacaccttctgcagacc

SEQ ID NO: 9338274 - DNA, 22 bp, Homo sapiens
gggccacacagggcagctccct

SEQ ID NO: 9338275 - DNA, 22 bp, Homo sapiens
ggggaagaatgctctctagaga

SEQ ID NO: 9338276 - DNA, 17 bp, Homo sapiens
gggctttaggtggtgta

SEQ ID NO: 9338277 - DNA, 22 bp, Homo sapiens
gggctttaggggccagtgacca

SEQ ID NO: 9338278 - DNA, 22 bp, Homo sapiens
ggggaagaatggcagaaaacat

SEQ ID NO: 9338279 - DNA, 22 bp, Homo sapiens
gggctttaacacccagtcaggg

SEQ ID NO: 9338280 - DNA, 22 bp, Homo sapiens
gggctttagattgcagaggatt

SEQ ID NO: 9338281 - DNA, 19 bp, Homo sapiens
gggctttactccaagtggg

SEQ ID NO: 9338282 - DNA, 18 bp, Homo sapiens
gggctttacagagtggag

SEQ ID NO: 9338283 - DNA, 22 bp, Homo sapiens
gggctttaatcttgttaactag

SEQ ID NO: 9338284 - DNA, 22 bp, Homo sapiens
ggggaagaggcgtgatggatcc

SEQ ID NO: 9338285 - DNA, 22 bp, Homo sapiens
ggggaagaggcgtgatggatcc

SEQ ID NO: 9338286 - DNA, 22 bp, Homo sapiens
ggggaagaggcgtgatggatcc

SEQ ID NO: 9338287 - DNA, 22 bp, Homo sapiens
ggggcctccagcactaggcagc

SEQ ID NO: 9338288 - DNA, 22 bp, Homo sapiens
ggggcctccagcactaggcagc

SEQ ID NO: 9338289 - DNA, 22 bp, Homo sapiens
ggggccgaccgcggttcaggcc

SEQ ID NO: 9338290 - DNA, 22 bp, Homo sapiens
ggggccgaccgcggttcaggcc

SEQ ID NO: 9338291 - DNA, 22 bp, Homo sapiens
ggggccgaccgcggttcaggcc

SEQ ID NO: 9338292 - DNA, 22 bp, Homo sapiens
ggggaaggatatgattagacta

SEQ ID NO: 9338293 - DNA, 22 bp, Homo sapiens
ggggccgaccgcggttcaggcc

SEQ ID NO: 9338294 - DNA, 22 bp, Homo sapiens
ggggaaggaaagttattagcag

SEQ ID NO: 9338295 - DNA, 22 bp, Homo sapiens
ggggaagatggccctccatgtg

SEQ ID NO: 9338296 - DNA, 22 bp, Homo sapiens
ggggctggctcactaagagact

SEQ ID NO: 9338297 - DNA, 22 bp, Homo sapiens
ggggctgggatttgaacccagg

SEQ ID NO: 9338298 - DNA, 22 bp, Homo sapiens
ggggctggctcactaagagact

SEQ ID NO: 9338299 - DNA, 20 bp, Homo sapiens
ggggctgcatgcagagaaga

SEQ ID NO: 9338300 - DNA, 22 bp, Homo sapiens
ggggctgatggaactcaggcct

SEQ ID NO: 9338301 - DNA, 22 bp, Homo sapiens
ggggctgatggaactcaggcct

SEQ ID NO: 9338302 - DNA, 22 bp, Homo sapiens
ggggctctaggtaaagcaacat

SEQ ID NO: 9338303 - DNA, 22 bp, Homo sapiens
ggggctctcaggtctccccaaa

SEQ ID NO: 9338304 - DNA, 22 bp, Homo sapiens
ggggctctcaggtctccccaaa

SEQ ID NO: 9338305 - DNA, 22 bp, Homo sapiens
ggggctctcaggtctccccaaa

SEQ ID NO: 9338306 - DNA, 22 bp, Homo sapiens
ggggctctgcctctcccacgcc

SEQ ID NO: 9338307 - DNA, 22 bp, Homo sapiens
ggggctctgcctctcccacgcc

SEQ ID NO: 9338308 - DNA, 22 bp, Homo sapiens
ggggctcagttcggacagcctg

SEQ ID NO: 9338309 - DNA, 22 bp, Homo sapiens
ggggctcagttcggacagcctg

SEQ ID NO: 9338310 - DNA, 22 bp, Homo sapiens
ggggctcaggggaagtgtccag

SEQ ID NO: 9338311 - DNA, 22 bp, Homo sapiens
ggggctcagttcggacagcctg

SEQ ID NO: 9338312 - DNA, 22 bp, Homo sapiens
ggggctcttagagagcctagtg

SEQ ID NO: 9338313 - DNA, 22 bp, Homo sapiens
ggggctctgtgacagtaaccct

SEQ ID NO: 9338314 - DNA, 22 bp, Homo sapiens
ggggctcttagagagcctagtg

SEQ ID NO: 9338315 - DNA, 22 bp, Homo sapiens
ggggctctggagaaaggccagt

SEQ ID NO: 9338316 - DNA, 22 bp, Homo sapiens
ggggctctgctctgagccgtgt

SEQ ID NO: 9338317 - DNA, 22 bp, Homo sapiens
ggggctctggagaaaggccagt

SEQ ID NO: 9338318 - DNA, 22 bp, Homo sapiens
ggggctctgctctgagccgtgt

SEQ ID NO: 9338319 - DNA, 22 bp, Homo sapiens
ggggctctgctctgagccgtgt

SEQ ID NO: 9338320 - DNA, 22 bp, Homo sapiens
ggggtgtgagtagagctgggga

SEQ ID NO: 9338321 - DNA, 22 bp, Homo sapiens
ggggtggggttactcattgtgc

SEQ ID NO: 9338322 - DNA, 22 bp, Homo sapiens
ggggtgtggacggctgtgccag

SEQ ID NO: 9338323 - DNA, 22 bp, Homo sapiens
ggggtgtgtctgacaatggtat

SEQ ID NO: 9338324 - DNA, 22 bp, Homo sapiens
ggggtgtggacggctgtgccag

SEQ ID NO: 9338325 - DNA, 22 bp, Homo sapiens
ggggtgtgagtagagctgggga

SEQ ID NO: 9338326 - DNA, 22 bp, Homo sapiens
ggggtgtgagtagagctgggga

SEQ ID NO: 9338327 - DNA, 21 bp, Homo sapiens
ggggttggcaagagcagagac

SEQ ID NO: 9338328 - DNA, 21 bp, Homo sapiens
ggggttggcaagagcagagac

SEQ ID NO: 9338329 - DNA, 21 bp, Homo sapiens
ggggttggcaagagcagagac

SEQ ID NO: 9338330 - DNA, 21 bp, Homo sapiens
ggggttggcaagagcagagac

SEQ ID NO: 9338331 - DNA, 22 bp, Homo sapiens
ggggttgatcacagaggggtct

SEQ ID NO: 9338332 - DNA, 22 bp, Homo sapiens
ggggtgggcgtgcagggacacc

SEQ ID NO: 9338333 - DNA, 22 bp, Homo sapiens
ggggtgggcgtgcagggacacc

SEQ ID NO: 9338334 - DNA, 22 bp, Homo sapiens
ggggctggtggtggtttctcca

SEQ ID NO: 9338335 - DNA, 22 bp, Homo sapiens
ggggtgggcgtgcagggacacc

SEQ ID NO: 9338336 - DNA, 22 bp, Homo sapiens
ggggtgggcgtgcagggacacc

SEQ ID NO: 9338337 - DNA, 22 bp, Homo sapiens
ggggtgggcgtgcagggacacc

SEQ ID NO: 9338338 - DNA, 22 bp, Homo sapiens
gggtagggtgacttaggctggc

SEQ ID NO: 9338339 - DNA, 22 bp, Homo sapiens
gggtagggtgacttaggctggc

SEQ ID NO: 9338340 - DNA, 22 bp, Homo sapiens
gggtaggctgctcctggggccc

SEQ ID NO: 9338341 - DNA, 22 bp, Homo sapiens
gggtaggcccctcttgcttggg

SEQ ID NO: 9338342 - DNA, 22 bp, Homo sapiens
gggtaggctctgcaggctgggt

SEQ ID NO: 9338343 - DNA, 22 bp, Homo sapiens
gggtaggctctgcaggctgggt

SEQ ID NO: 9338344 - DNA, 22 bp, Homo sapiens
gggtaggatggtagaagggacc

SEQ ID NO: 9338345 - DNA, 22 bp, Homo sapiens
gggtaggcaaagcaatgacgtt

SEQ ID NO: 9338346 - DNA, 22 bp, Homo sapiens
gggtaggagaggtgtctgtgtg

SEQ ID NO: 9338347 - DNA, 22 bp, Homo sapiens
gggtaggagaggtgtctgtgtg

SEQ ID NO: 9338348 - DNA, 22 bp, Homo sapiens
gggtaggaaatccagaggtggc

SEQ ID NO: 9338349 - DNA, 22 bp, Homo sapiens
gggtggaggagaacaggcccca

SEQ ID NO: 9338350 - DNA, 22 bp, Homo sapiens
gggtggagcttggacaccagta

SEQ ID NO: 9338351 - DNA, 22 bp, Homo sapiens
gggtggagcttggacaccagta

SEQ ID NO: 9338352 - DNA, 22 bp, Homo sapiens
gggtggagcttggacaccagta

SEQ ID NO: 9338353 - DNA, 22 bp, Homo sapiens
gggtggagcctgagaatttgca

SEQ ID NO: 9338354 - DNA, 22 bp, Homo sapiens
gggtggagtgtgaaatctggct

SEQ ID NO: 9338355 - DNA, 20 bp, Homo sapiens
gggtggagttgcggtctgtg

SEQ ID NO: 9338356 - DNA, 22 bp, Homo sapiens
gggtggagtagaaagatgaatt

SEQ ID NO: 9338357 - DNA, 22 bp, Homo sapiens
gggtggagtagaaagatgaatt

SEQ ID NO: 9338358 - DNA, 22 bp, Homo sapiens
gggtggaggtgggttttgagat

SEQ ID NO: 9338359 - DNA, 22 bp, Homo sapiens
gggtggcaggattggcaggagt

SEQ ID NO: 9338360 - DNA, 22 bp, Homo sapiens
gggtggcaggattggcaggagt

SEQ ID NO: 9338361 - DNA, 22 bp, Homo sapiens
gggtggcaggattggcaggagt

SEQ ID NO: 9338362 - DNA, 22 bp, Homo sapiens
gggtggcagctgttgccaaggt

SEQ ID NO: 9338363 - DNA, 22 bp, Homo sapiens
gggtggcagctgttgccaaggt

SEQ ID NO: 9338364 - DNA, 22 bp, Homo sapiens
gggtggcagctgttgccaaggt

SEQ ID NO: 9338365 - DNA, 22 bp, Homo sapiens
gggtggcacaggtgcagagggt

SEQ ID NO: 9338366 - DNA, 22 bp, Homo sapiens
gggtggcacaggtgcagagggt

SEQ ID NO: 9338367 - DNA, 22 bp, Homo sapiens
gggtggcacaggtgcagagggt

SEQ ID NO: 9338368 - DNA, 20 bp, Homo sapiens
gggtggagttgcggtctgtg

SEQ ID NO: 9338369 - DNA, 22 bp, Homo sapiens
gggtggcacaggtgcagagggt

SEQ ID NO: 9338370 - DNA, 22 bp, Homo sapiens
gggtggcaaaggcgctgaaagg

SEQ ID NO: 9338371 - DNA, 22 bp, Homo sapiens
gggtggcatagggtgatggctt

SEQ ID NO: 9338372 - DNA, 22 bp, Homo sapiens
gggtggcatagggtgatggctt

SEQ ID NO: 9338373 - DNA, 22 bp, Homo sapiens
gggtggcatagggtgatggctt

SEQ ID NO: 9338374 - DNA, 22 bp, Homo sapiens
gggtggcatctctctgagctgt

SEQ ID NO: 9338375 - DNA, 21 bp, Homo sapiens
gggtggccgcatgggtgcgtg

SEQ ID NO: 9338376 - DNA, 22 bp, Homo sapiens
gggtggcatctctctgagctgt

SEQ ID NO: 9338377 - DNA, 22 bp, Homo sapiens
gggtggccttaggcaagtcact

SEQ ID NO: 9338378 - DNA, 22 bp, Homo sapiens
gggtggccttcatagctcaggg

SEQ ID NO: 9338379 - DNA, 22 bp, Homo sapiens
ggtagggcaaagtagggcacct

SEQ ID NO: 9338380 - DNA, 22 bp, Homo sapiens
ggtagggcaaagtagggcacct

SEQ ID NO: 9338381 - DNA, 22 bp, Homo sapiens
ggtaggggaagacaagtgaaaa

SEQ ID NO: 9338382 - DNA, 22 bp, Homo sapiens
gggtggctcctatgggcatagc

SEQ ID NO: 9338383 - DNA, 22 bp, Homo sapiens
gggtggctaggtatcccccatt

SEQ ID NO: 9338384 - DNA, 22 bp, Homo sapiens
gggtggctcctatgggcatagc

SEQ ID NO: 9338385 - DNA, 22 bp, Homo sapiens
gggtggctcctatgggcatagc

SEQ ID NO: 9338386 - DNA, 22 bp, Homo sapiens
gggtggctcctatgggcatagc

SEQ ID NO: 9338387 - DNA, 22 bp, Homo sapiens
gggtggctgactgttttgtgga

SEQ ID NO: 9338388 - DNA, 22 bp, Homo sapiens
gggtggctcctatgggcatagc

SEQ ID NO: 9338389 - DNA, 22 bp, Homo sapiens
ggtcagagccgttagcattcag

SEQ ID NO: 9338390 - DNA, 22 bp, Homo sapiens
ggtcagagctggagagataggg

SEQ ID NO: 9338391 - DNA, 22 bp, Homo sapiens
ggtcagagctggagagataggg

SEQ ID NO: 9338392 - DNA, 22 bp, Homo sapiens
ggtcagagccatggagcaactg

SEQ ID NO: 9338393 - DNA, 22 bp, Homo sapiens
ggtcagagggtgggctgcctgt

SEQ ID NO: 9338394 - DNA, 22 bp, Homo sapiens
ggtcagaggaggaataggacat

SEQ ID NO: 9338395 - DNA, 22 bp, Homo sapiens
ggtcagaggaggaataggacat

SEQ ID NO: 9338396 - DNA, 22 bp, Homo sapiens
ggtcagaggggattccttggga

SEQ ID NO: 9338397 - DNA, 22 bp, Homo sapiens
ggtcagaggggattccttggga

SEQ ID NO: 9338398 - DNA, 22 bp, Homo sapiens
ggtcagagaaaagtagggtgtt

SEQ ID NO: 9338399 - DNA, 22 bp, Homo sapiens
ggtcagagaaaagtagggtgtt

SEQ ID NO: 9338400 - DNA, 22 bp, Homo sapiens
ggtcagagatgaggtctaaagt

SEQ ID NO: 9338401 - DNA, 19 bp, Homo sapiens
ggtcagagagatccaggct

SEQ ID NO: 9338402 - DNA, 22 bp, Homo sapiens
ggtagggtgggccgaagctcaa

SEQ ID NO: 9338403 - DNA, 22 bp, Homo sapiens
ggtcactgtctgaggtactgga

SEQ ID NO: 9338404 - DNA, 20 bp, Homo sapiens
ggtcactgtggctgcaggat

SEQ ID NO: 9338405 - DNA, 22 bp, Homo sapiens
ggtcacttctttcatcgaaact

SEQ ID NO: 9338406 - DNA, 22 bp, Homo sapiens
ggtcacttcagataactggtgt

SEQ ID NO: 9338407 - DNA, 22 bp, Homo sapiens
ggtctcagactggcaggcagtg

SEQ ID NO: 9338408 - DNA, 22 bp, Homo sapiens
ggtctcagactggcaggcagtg

SEQ ID NO: 9338409 - DNA, 22 bp, Homo sapiens
ggtctcagactggcaggcagtg

SEQ ID NO: 9338410 - DNA, 22 bp, Homo sapiens
ggtctacattgagagagctgct

SEQ ID NO: 9338411 - DNA, 22 bp, Homo sapiens
ggtctagagtggggcctggaaa

SEQ ID NO: 9338412 - DNA, 22 bp, Homo sapiens
ggtcgccagccctagtctgctg

SEQ ID NO: 9338413 - DNA, 22 bp, Homo sapiens
ggtcgagtcacttgttgccttt

SEQ ID NO: 9338414 - DNA, 22 bp, Homo sapiens
ggtccttgggtctcctgtgttt

SEQ ID NO: 9338415 - DNA, 22 bp, Homo sapiens
ggtcagcagccatgccatgaat

SEQ ID NO: 9338416 - DNA, 22 bp, Homo sapiens
ggtcagaggtcccagaagaagc

SEQ ID NO: 9338417 - DNA, 22 bp, Homo sapiens
ggtcagaggtcacaagctggca

SEQ ID NO: 9338418 - DNA, 22 bp, Homo sapiens
ggtcagaggtcccagaagaagc

SEQ ID NO: 9338419 - DNA, 22 bp, Homo sapiens
ggtcagcagtgcagggcagagc

SEQ ID NO: 9338420 - DNA, 22 bp, Homo sapiens
ggtccctggaagtccctcttct

SEQ ID NO: 9338421 - DNA, 22 bp, Homo sapiens
ggtccctggggaactaggctgt

SEQ ID NO: 9338422 - DNA, 22 bp, Homo sapiens
ggtccctggggaactaggctgt

SEQ ID NO: 9338423 - DNA, 22 bp, Homo sapiens
ggtccctggttccctctgagct

SEQ ID NO: 9338424 - DNA, 18 bp, Homo sapiens
ggtcctgggcctggctca

SEQ ID NO: 9338425 - DNA, 18 bp, Homo sapiens
ggtcctgggcctggctca

SEQ ID NO: 9338426 - DNA, 22 bp, Homo sapiens
ggtccttcagtaggttccagac

SEQ ID NO: 9338427 - DNA, 22 bp, Homo sapiens
ggtctccaaagcttaggactac

SEQ ID NO: 9338428 - DNA, 19 bp, Homo sapiens
ggtctcagtgcagctgcag

SEQ ID NO: 9338429 - DNA, 19 bp, Homo sapiens
ggtctcagtgcagctgcag

SEQ ID NO: 9338430 - DNA, 22 bp, Homo sapiens
ggtctccaaagctgcattgatg

SEQ ID NO: 9338431 - DNA, 22 bp, Homo sapiens
ggtctcagtgaaggagtgtgct

SEQ ID NO: 9338432 - DNA, 19 bp, Homo sapiens
ggtctcagtgcagctgcag

SEQ ID NO: 9338433 - DNA, 19 bp, Homo sapiens
ggtctcagtgcagctgcag

SEQ ID NO: 9338434 - DNA, 22 bp, Homo sapiens
ggtctcaggtagggcctaggaa

SEQ ID NO: 9338435 - DNA, 22 bp, Homo sapiens
ggtctcaggtagggcctaggaa

SEQ ID NO: 9338436 - DNA, 22 bp, Homo sapiens
ggtctcagccctcgccagcagc

SEQ ID NO: 9338437 - DNA, 22 bp, Homo sapiens
ggtctcagccctcgccagcagc

SEQ ID NO: 9338438 - DNA, 22 bp, Homo sapiens
ggtctcagccctcgccagcagc

SEQ ID NO: 9338439 - DNA, 22 bp, Homo sapiens
ggtctcagaggtttctgctcag

SEQ ID NO: 9338440 - DNA, 22 bp, Homo sapiens
ggtctcagaggtttctgctcag

SEQ ID NO: 9338441 - DNA, 22 bp, Homo sapiens
ggtctcagaggtttctgctcag

SEQ ID NO: 9338442 - DNA, 22 bp, Homo sapiens
ggtctcagactggcaggcagtg

SEQ ID NO: 9338443 - DNA, 22 bp, Homo sapiens
ggtctcaggagactggagagca

SEQ ID NO: 9338444 - DNA, 22 bp, Homo sapiens
ggtctcaggagactggagagca

SEQ ID NO: 9338445 - DNA, 22 bp, Homo sapiens
ggtctcaggagactggagagca

SEQ ID NO: 9338446 - DNA, 22 bp, Homo sapiens
ggtctcagctggagtccttggt

SEQ ID NO: 9338447 - DNA, 22 bp, Homo sapiens
ggtctcagctggagtccttggt

SEQ ID NO: 9338448 - DNA, 22 bp, Homo sapiens
ggtctctgagtgaggacctggg

SEQ ID NO: 9338449 - DNA, 22 bp, Homo sapiens
ggtctctgacttagagatggat

SEQ ID NO: 9338450 - DNA, 22 bp, Homo sapiens
ggtctctgacttagagatggat

SEQ ID NO: 9338451 - DNA, 22 bp, Homo sapiens
ggtctctgagtgaggacctggg

SEQ ID NO: 9338452 - DNA, 22 bp, Homo sapiens
ggtctctgacttagagatggat

SEQ ID NO: 9338453 - DNA, 22 bp, Homo sapiens
ggtctctgcagctcccggcccc

SEQ ID NO: 9338454 - DNA, 22 bp, Homo sapiens
ggtctctgtcactgagtggccc

SEQ ID NO: 9338455 - DNA, 22 bp, Homo sapiens
ggtctctgtcactgagtggccc

SEQ ID NO: 9338456 - DNA, 22 bp, Homo sapiens
ggtctctgctcagatgccactt

SEQ ID NO: 9338457 - DNA, 22 bp, Homo sapiens
ggtctctggccttggagattga

SEQ ID NO: 9338458 - DNA, 22 bp, Homo sapiens
ggtctctctgctttcccccaga

SEQ ID NO: 9338459 - DNA, 22 bp, Homo sapiens
ggtctctgaacttccactgcgc

SEQ ID NO: 9338460 - DNA, 22 bp, Homo sapiens
ggtctctgaagcttttagtccc

SEQ ID NO: 9338461 - DNA, 20 bp, Homo sapiens
ggtctctgacagctggttgc

SEQ ID NO: 9338462 - DNA, 20 bp, Homo sapiens
ggtctctgacagctggttgc

SEQ ID NO: 9338463 - DNA, 22 bp, Homo sapiens
ggtctccagctgggaccctgca

SEQ ID NO: 9338464 - DNA, 22 bp, Homo sapiens
ggtgtgggtcagctttattaat

SEQ ID NO: 9338465 - DNA, 22 bp, Homo sapiens
ggtgtgggggcagctctgatat

SEQ ID NO: 9338466 - DNA, 22 bp, Homo sapiens
ggtgtgggggcaagtttgagat

SEQ ID NO: 9338467 - DNA, 22 bp, Homo sapiens
ggtgtgggtccttgtgcttgct

SEQ ID NO: 9338468 - DNA, 22 bp, Homo sapiens
ggtgtgggtccttgtgcttgct

SEQ ID NO: 9338469 - DNA, 22 bp, Homo sapiens
ggtgtggggaggttctgcttct

SEQ ID NO: 9338470 - DNA, 22 bp, Homo sapiens
ggtgtggggaggttctgcttct

SEQ ID NO: 9338471 - DNA, 22 bp, Homo sapiens
ggtgtggggaggttctgcttct

SEQ ID NO: 9338472 - DNA, 22 bp, Homo sapiens
ggtgtgggccctgatgtcagca

SEQ ID NO: 9338473 - DNA, 22 bp, Homo sapiens
ggtgtgggcagatgccctactt

SEQ ID NO: 9338474 - DNA, 22 bp, Homo sapiens
ggtgtgggccctgatgtcagca

SEQ ID NO: 9338475 - DNA, 22 bp, Homo sapiens
ggtgtgggagagattctttcct

SEQ ID NO: 9338476 - DNA, 21 bp, Homo sapiens
ggtgtgggatggactgaacca

SEQ ID NO: 9338477 - DNA, 22 bp, Homo sapiens
ggtgtggatcatctgaggtcag

SEQ ID NO: 9338478 - DNA, 22 bp, Homo sapiens
ggtgtggatcatctgaggtcag

SEQ ID NO: 9338479 - DNA, 22 bp, Homo sapiens
ggtgtgggaactacaggttttt

SEQ ID NO: 9338480 - DNA, 22 bp, Homo sapiens
ggtgtggcagtggacctgtgaa

SEQ ID NO: 9338481 - DNA, 22 bp, Homo sapiens
ggtgtggcagtggacctgtgaa

SEQ ID NO: 9338482 - DNA, 22 bp, Homo sapiens
ggtgtggctgtgagtttttgat

SEQ ID NO: 9338483 - DNA, 22 bp, Homo sapiens
ggtgtccttagaaagcagacct

SEQ ID NO: 9338484 - DNA, 22 bp, Homo sapiens
ggtgtccttcgtccgctggcat

SEQ ID NO: 9338485 - DNA, 22 bp, Homo sapiens
ggtgtccttagaaagcagacct

SEQ ID NO: 9338486 - DNA, 22 bp, Homo sapiens
ggtgtccttcgtccgctggcat

SEQ ID NO: 9338487 - DNA, 22 bp, Homo sapiens
ggtgtccttgcagaaggcggcg

SEQ ID NO: 9338488 - DNA, 22 bp, Homo sapiens
ggtgtccttcgtccgctggcat

SEQ ID NO: 9338489 - DNA, 22 bp, Homo sapiens
ggtgtccttgctccttcagctt

SEQ ID NO: 9338490 - DNA, 22 bp, Homo sapiens
ggtgtccttgcagaaggcggcg

SEQ ID NO: 9338491 - DNA, 22 bp, Homo sapiens
ggtgtccttgctccttcagctt

SEQ ID NO: 9338492 - DNA, 22 bp, Homo sapiens
ggtggctctcttaagggcagcg

SEQ ID NO: 9338493 - DNA, 22 bp, Homo sapiens
ggtggctctcttaagggcagcg

SEQ ID NO: 9338494 - DNA, 22 bp, Homo sapiens
ggtggctctctgtcagtgacag

SEQ ID NO: 9338495 - DNA, 22 bp, Homo sapiens
ggtggctctccctggactcagc

SEQ ID NO: 9338496 - DNA, 22 bp, Homo sapiens
ggtggctctccctggactcagc

SEQ ID NO: 9338497 - DNA, 19 bp, Homo sapiens
ggtggctctccctcaggga

SEQ ID NO: 9338498 - DNA, 22 bp, Homo sapiens
ggtggctctccctggactcagc

SEQ ID NO: 9338499 - DNA, 22 bp, Homo sapiens
ggtggctctcaggcttctcgga

SEQ ID NO: 9338500 - DNA, 19 bp, Homo sapiens
ggtggctctccctcaggga

SEQ ID NO: 9338501 - DNA, 22 bp, Homo sapiens
ggtggctcggccagtgcaggcc

SEQ ID NO: 9338502 - DNA, 22 bp, Homo sapiens
ggtggctcggccagtgcaggcc

SEQ ID NO: 9338503 - DNA, 17 bp, Homo sapiens
ggtggctcgggcgcggc

SEQ ID NO: 9338504 - DNA, 22 bp, Homo sapiens
ggtgtgtgaggagtcacttagt

SEQ ID NO: 9338505 - DNA, 19 bp, Homo sapiens
ggtgtgtgctggggcctgt

SEQ ID NO: 9338506 - DNA, 22 bp, Homo sapiens
ggtgtgtgaggagtcacttagt

SEQ ID NO: 9338507 - DNA, 19 bp, Homo sapiens
ggtgtgtgctggggcctgt

SEQ ID NO: 9338508 - DNA, 22 bp, Homo sapiens
ggtgtgtggttttgatacagtc

SEQ ID NO: 9338509 - DNA, 22 bp, Homo sapiens
ggtgtgtggttttgatacagtc

SEQ ID NO: 9338510 - DNA, 22 bp, Homo sapiens
ggtgtgtggtcctctcacttag

SEQ ID NO: 9338511 - DNA, 22 bp, Homo sapiens
ggtgtgtggtcctctcacttag

SEQ ID NO: 9338512 - DNA, 19 bp, Homo sapiens
ggtgtgtgctggggcctgt

SEQ ID NO: 9338513 - DNA, 22 bp, Homo sapiens
ggtgtgtgtggattagcatgcc

SEQ ID NO: 9338514 - DNA, 20 bp, Homo sapiens
ggtgtgttggttcagcatgg

SEQ ID NO: 9338515 - DNA, 22 bp, Homo sapiens
ggtgtgtgtggattagcatgcc

SEQ ID NO: 9338516 - DNA, 22 bp, Homo sapiens
ggtgtgtggttttgatacagtc

SEQ ID NO: 9338517 - DNA, 22 bp, Homo sapiens
ggtttattgaaggccaccccac

SEQ ID NO: 9338518 - DNA, 22 bp, Homo sapiens
ggtttattgttaataagtttga

SEQ ID NO: 9338519 - DNA, 22 bp, Homo sapiens
ggtttattaatgtgaactgtat

SEQ ID NO: 9338520 - DNA, 22 bp, Homo sapiens
ggtttaattggtccaggatggg

SEQ ID NO: 9338521 - DNA, 22 bp, Homo sapiens
ggtgtttaaaggctcagcagga

SEQ ID NO: 9338522 - DNA, 22 bp, Homo sapiens
ggtttaattacctgcatctcaa

SEQ ID NO: 9338523 - DNA, 22 bp, Homo sapiens
ggtgttgtacattctgtggatt

SEQ ID NO: 9338524 - DNA, 22 bp, Homo sapiens
ggtgttgcagttgaagactggt

SEQ ID NO: 9338525 - DNA, 22 bp, Homo sapiens
ggtgttgcagttgaagactggt

SEQ ID NO: 9338526 - DNA, 22 bp, Homo sapiens
ggtgttaaacatgatccattac

SEQ ID NO: 9338527 - DNA, 22 bp, Homo sapiens
ggtgttaacaaagattgaaatg

SEQ ID NO: 9338528 - DNA, 22 bp, Homo sapiens
ggtggctcaaagagagcacaga

SEQ ID NO: 9338529 - DNA, 21 bp, Homo sapiens
ggtggctagaaagcagtgaga

SEQ ID NO: 9338530 - DNA, 18 bp, Homo sapiens
ggtggcggggatggaggt

SEQ ID NO: 9338531 - DNA, 22 bp, Homo sapiens
ggtggctcacgcctgtaagccc

SEQ ID NO: 9338532 - DNA, 19 bp, Homo sapiens
ggtggctcagggcccagcc

SEQ ID NO: 9338533 - DNA, 19 bp, Homo sapiens
ggtggctcagggcccagcc

SEQ ID NO: 9338534 - DNA, 21 bp, Homo sapiens
ggtggctcacctgattggata

SEQ ID NO: 9338535 - DNA, 21 bp, Homo sapiens
ggtggctcacctgattggata

SEQ ID NO: 9338536 - DNA, 22 bp, Homo sapiens
ggtggctcaaagagagcacaga

SEQ ID NO: 9338537 - DNA, 22 bp, Homo sapiens
ggtggctccgcttccatgggct

SEQ ID NO: 9338538 - DNA, 22 bp, Homo sapiens
ggtggctccgcttccatgggct

SEQ ID NO: 9338539 - DNA, 22 bp, Homo sapiens
ggtggctcagtgtcaggccctg

SEQ ID NO: 9338540 - DNA, 22 bp, Homo sapiens
ggtggctcagtgtcaggccctg

SEQ ID NO: 9338541 - DNA, 18 bp, Homo sapiens
ggtggctcagtcatgggg

SEQ ID NO: 9338542 - DNA, 18 bp, Homo sapiens
ggtggctcagtcatgggg

SEQ ID NO: 9338543 - DNA, 18 bp, Homo sapiens
ggtggctcagtcatgggg

SEQ ID NO: 9338544 - DNA, 18 bp, Homo sapiens
ggtggctcagtcatgggg

SEQ ID NO: 9338545 - DNA, 22 bp, Homo sapiens
ggtggctcagggctccaagcat

SEQ ID NO: 9338546 - DNA, 22 bp, Homo sapiens
ggtggcctctgcaggcctcgac

SEQ ID NO: 9338547 - DNA, 22 bp, Homo sapiens
ggtggcctctgcaggcctcgac

SEQ ID NO: 9338548 - DNA, 22 bp, Homo sapiens
ggtggcctctcatgcaaggtag

SEQ ID NO: 9338549 - DNA, 22 bp, Homo sapiens
ggtggcctcagcaaggctggca

SEQ ID NO: 9338550 - DNA, 22 bp, Homo sapiens
ggtggcctccagggcataggtg

SEQ ID NO: 9338551 - DNA, 22 bp, Homo sapiens
ggtggcctccagggcataggtg

SEQ ID NO: 9338552 - DNA, 22 bp, Homo sapiens
ggtggcctccagggcataggtg

SEQ ID NO: 9338553 - DNA, 22 bp, Homo sapiens
ggtggcctcggtggtgcacagg

SEQ ID NO: 9338554 - DNA, 17 bp, Homo sapiens
ggtggcctgcagtggct

SEQ ID NO: 9338555 - DNA, 17 bp, Homo sapiens
ggtggcctgcagtggct

SEQ ID NO: 9338556 - DNA, 22 bp, Homo sapiens
ggtggcctgcaagtgcagatgg

SEQ ID NO: 9338557 - DNA, 17 bp, Homo sapiens
ggtggcctgcagtggct

SEQ ID NO: 9338558 - DNA, 22 bp, Homo sapiens
ggtggcctgaattagctcaggg

SEQ ID NO: 9338559 - DNA, 22 bp, Homo sapiens
ggtggccttttatgagcagggt

SEQ ID NO: 9338560 - DNA, 22 bp, Homo sapiens
ggtggccttttatgagcagggt

SEQ ID NO: 9338561 - DNA, 21 bp, Homo sapiens
ggtggccttggtgagagacct

SEQ ID NO: 9338562 - DNA, 21 bp, Homo sapiens
ggtggccttggtgagagacct

SEQ ID NO: 9338563 - DNA, 22 bp, Homo sapiens
ggtctggcctccgggcaggtgg

SEQ ID NO: 9338564 - DNA, 22 bp, Homo sapiens
ggtggcctcagcaaggctggca

SEQ ID NO: 9338565 - DNA, 22 bp, Homo sapiens
ggtctggcactcatgcagcagg

SEQ ID NO: 9338566 - DNA, 16 bp, Homo sapiens
ggtctggaggatgtct

SEQ ID NO: 9338567 - DNA, 22 bp, Homo sapiens
ggtctggagcttggctaaggga

SEQ ID NO: 9338568 - DNA, 22 bp, Homo sapiens
ggtctggataattccagtacct

SEQ ID NO: 9338569 - DNA, 22 bp, Homo sapiens
ggtctggagtagatgagtcatg

SEQ ID NO: 9338570 - DNA, 22 bp, Homo sapiens
ggtctggagtaggatgatggct

SEQ ID NO: 9338571 - DNA, 22 bp, Homo sapiens
ggtctggattttgaacaaaatt

SEQ ID NO: 9338572 - DNA, 22 bp, Homo sapiens
ggtctggattttatctactgta

SEQ ID NO: 9338573 - DNA, 22 bp, Homo sapiens
ggtctggatttctgcttctttc

SEQ ID NO: 9338574 - DNA, 22 bp, Homo sapiens
ggtctggataattccagtacct

SEQ ID NO: 9338575 - DNA, 22 bp, Homo sapiens
ggtctggatattcaccagggcc

SEQ ID NO: 9338576 - DNA, 22 bp, Homo sapiens
ggtctggatgctgaggttccca

SEQ ID NO: 9338577 - DNA, 22 bp, Homo sapiens
ggtctctgtttggggctggcaa

SEQ ID NO: 9338578 - DNA, 22 bp, Homo sapiens
ggtctctgttgcctccatcaag

SEQ ID NO: 9338579 - DNA, 22 bp, Homo sapiens
ggtctctgtttggggctggcaa

SEQ ID NO: 9338580 - DNA, 22 bp, Homo sapiens
ggtctctgttgcctccatcaag

SEQ ID NO: 9338581 - DNA, 22 bp, Homo sapiens
ggtctcttagtgcaacatacta

SEQ ID NO: 9338582 - DNA, 22 bp, Homo sapiens
ggtctcttcaggagcttgagcg

SEQ ID NO: 9338583 - DNA, 22 bp, Homo sapiens
ggtctctttgcttcagctacag

SEQ ID NO: 9338584 - DNA, 22 bp, Homo sapiens
ggtctctttgcttcagctacag

SEQ ID NO: 9338585 - DNA, 22 bp, Homo sapiens
ggtctctttgcttcagctacag

SEQ ID NO: 9338586 - DNA, 22 bp, Homo sapiens
ggtctcttgtccaaggtcacac

SEQ ID NO: 9338587 - DNA, 22 bp, Homo sapiens
ggtctcttccagctttatcact

SEQ ID NO: 9338588 - DNA, 22 bp, Homo sapiens
ggtctctttccttggcttgcac

SEQ ID NO: 9338589 - DNA, 22 bp, Homo sapiens
ggtctcttgtccaaggtcacac

SEQ ID NO: 9338590 - DNA, 22 bp, Homo sapiens
ggtctcttcaggagcttgagcg

SEQ ID NO: 9338591 - DNA, 21 bp, Homo sapiens
ggtctcttcatctgtaacctg

SEQ ID NO: 9338592 - DNA, 22 bp, Homo sapiens
ggtctcttcaggagcttgagcg

SEQ ID NO: 9338593 - DNA, 22 bp, Homo sapiens
ggtctggacagaatgtgacact

SEQ ID NO: 9338594 - DNA, 22 bp, Homo sapiens
ggtctggaccatggacgccggg

SEQ ID NO: 9338595 - DNA, 22 bp, Homo sapiens
ggtctggaccctcctggagtgg

SEQ ID NO: 9338596 - DNA, 22 bp, Homo sapiens
ggtctggagctaatcttgttgg

SEQ ID NO: 9338597 - DNA, 22 bp, Homo sapiens
ggtctggaccctcctggagtgg

SEQ ID NO: 9338598 - DNA, 22 bp, Homo sapiens
ggtctgaattccagcccctctg

SEQ ID NO: 9338599 - DNA, 22 bp, Homo sapiens
ggtctgaaattatgtcactgct

SEQ ID NO: 9338600 - DNA, 23 bp, Homo sapiens
ggtctggaattcgcggagttaac

SEQ ID NO: 9338601 - DNA, 22 bp, Homo sapiens
ggtctggaatggagtaggggtg

SEQ ID NO: 9338602 - DNA, 22 bp, Homo sapiens
gaagattgaaggctgggaatta

SEQ ID NO: 9338603 - DNA, 22 bp, Homo sapiens
gaagattgaaggctgggaatta

SEQ ID NO: 9338604 - DNA, 22 bp, Homo sapiens
gaagattgaaggctgggaatta

SEQ ID NO: 9338605 - DNA, 22 bp, Homo sapiens
gaagattgaaggctgggaatta

SEQ ID NO: 9338606 - DNA, 22 bp, Homo sapiens
gaagattgaaggctgggaatta

SEQ ID NO: 9338607 - DNA, 22 bp, Homo sapiens
gaagatgggaatgatgagtggg

SEQ ID NO: 9338608 - DNA, 22 bp, Homo sapiens
gaagatctgcagcctcaggcga

SEQ ID NO: 9338609 - DNA, 22 bp, Homo sapiens
gaagaggtagcattggcaggtg

SEQ ID NO: 9338610 - DNA, 22 bp, Homo sapiens
gaagccaggggcctgacaggca

SEQ ID NO: 9338611 - DNA, 22 bp, Homo sapiens
gaagccaggggcctgacaggca

SEQ ID NO: 9338612 - DNA, 22 bp, Homo sapiens
gaagccaggggcctgacaggca

SEQ ID NO: 9338613 - DNA, 22 bp, Homo sapiens
gaagccagccttgtctgcctct

SEQ ID NO: 9338614 - DNA, 22 bp, Homo sapiens
gaagccagcatccctctcccat

SEQ ID NO: 9338615 - DNA, 22 bp, Homo sapiens
gaagccagcagtggagaaagga

SEQ ID NO: 9338616 - DNA, 22 bp, Homo sapiens
gaagcccagcaaactgtgatca

SEQ ID NO: 9338617 - DNA, 22 bp, Homo sapiens
gaagcccaggcttccttggctt

SEQ ID NO: 9338618 - DNA, 22 bp, Homo sapiens
gaagccagtgtttgaagaattt

SEQ ID NO: 9338619 - DNA, 22 bp, Homo sapiens
gaagccagtgtttgaagaattt

SEQ ID NO: 9338620 - DNA, 22 bp, Homo sapiens
gaagccagtactgtgctctgca

SEQ ID NO: 9338621 - DNA, 22 bp, Homo sapiens
gaagccagtactgtgctctgca

SEQ ID NO: 9338622 - DNA, 22 bp, Homo sapiens
gaagccagtactgtgctctgca

SEQ ID NO: 9338623 - DNA, 22 bp, Homo sapiens
gaagccccaaaccctcgccatc

SEQ ID NO: 9338624 - DNA, 22 bp, Homo sapiens
gaagacaagctgagtgttgtcc

SEQ ID NO: 9338625 - DNA, 22 bp, Homo sapiens
gaagacaattctgggtggagga

SEQ ID NO: 9338626 - DNA, 22 bp, Homo sapiens
gaagacaattctgggtggagga

SEQ ID NO: 9338627 - DNA, 21 bp, Homo sapiens
gaacatttgggttgtttctac

SEQ ID NO: 9338628 - DNA, 20 bp, Homo sapiens
gaacatttggccatactgag

SEQ ID NO: 9338629 - DNA, 20 bp, Homo sapiens
gaacatttggccatactgag

SEQ ID NO: 9338630 - DNA, 21 bp, Homo sapiens
gaacatttgggttgtttctac

SEQ ID NO: 9338631 - DNA, 22 bp, Homo sapiens
gaagacagaaacctgtttggct

SEQ ID NO: 9338632 - DNA, 22 bp, Homo sapiens
gaagacctcataattcacatgc

SEQ ID NO: 9338633 - DNA, 22 bp, Homo sapiens
gaagacctgtttatgctgcatt

SEQ ID NO: 9338634 - DNA, 22 bp, Homo sapiens
gaagaccaatttgggccatggc

SEQ ID NO: 9338635 - DNA, 22 bp, Homo sapiens
gaagacattttatgcatactct

SEQ ID NO: 9338636 - DNA, 22 bp, Homo sapiens
gaagagaagcatcaataggtaa

SEQ ID NO: 9338637 - DNA, 22 bp, Homo sapiens
gaagagctgcacactggggact

SEQ ID NO: 9338638 - DNA, 22 bp, Homo sapiens
gaagagctccaaaaacagtgag

SEQ ID NO: 9338639 - DNA, 22 bp, Homo sapiens
gaagaggctttcctagggcaag

SEQ ID NO: 9338640 - DNA, 22 bp, Homo sapiens
gaagaggctttcctagggcaag

SEQ ID NO: 9338641 - DNA, 22 bp, Homo sapiens
gaagaggctttcctagggcaag

SEQ ID NO: 9338642 - DNA, 22 bp, Homo sapiens
gaagaggcaattgaataagcta

SEQ ID NO: 9338643 - DNA, 22 bp, Homo sapiens
gaagaggatgacaggagccggt

SEQ ID NO: 9338644 - DNA, 22 bp, Homo sapiens
gaagaggatgacaggagccggt

SEQ ID NO: 9338645 - DNA, 22 bp, Homo sapiens
gaagaggatgacaggagccggt

SEQ ID NO: 9338646 - DNA, 22 bp, Homo sapiens
gaagaggatgacaggagccggt

SEQ ID NO: 9338647 - DNA, 22 bp, Homo sapiens
gaagaggactgtggcatcctag

SEQ ID NO: 9338648 - DNA, 22 bp, Homo sapiens
gaagaggatgacaggagccggt

SEQ ID NO: 9338649 - DNA, 22 bp, Homo sapiens
gaaatgcaggcttggattcagc

SEQ ID NO: 9338650 - DNA, 22 bp, Homo sapiens
gaaatcattatatggtattgct

SEQ ID NO: 9338651 - DNA, 22 bp, Homo sapiens
gaaatcatattctcagtccttc

SEQ ID NO: 9338652 - DNA, 22 bp, Homo sapiens
gaaatcatagcacatggggctg

SEQ ID NO: 9338653 - DNA, 22 bp, Homo sapiens
gaaatcatgagatctcttggac

SEQ ID NO: 9338654 - DNA, 22 bp, Homo sapiens
gaaatcatctgagtaataatct

SEQ ID NO: 9338655 - DNA, 22 bp, Homo sapiens
gaaatcatctgagtaataatct

SEQ ID NO: 9338656 - DNA, 22 bp, Homo sapiens
gaaatcatctgagtaataatct

SEQ ID NO: 9338657 - DNA, 22 bp, Homo sapiens
gaaatcattagcaaagatatgt

SEQ ID NO: 9338658 - DNA, 22 bp, Homo sapiens
gaaatcattagcaaagatatgt

SEQ ID NO: 9338659 - DNA, 22 bp, Homo sapiens
gaaatcattagcaaagatatgt

SEQ ID NO: 9338660 - DNA, 22 bp, Homo sapiens
gaaatcattagcaaagatatgt

SEQ ID NO: 9338661 - DNA, 22 bp, Homo sapiens
gaaatgcatggatcttggcaga

SEQ ID NO: 9338662 - DNA, 22 bp, Homo sapiens
gaaatggtgtgctgtgcaatga

SEQ ID NO: 9338663 - DNA, 22 bp, Homo sapiens
gaaatgtaattctcttgaagat

SEQ ID NO: 9338664 - DNA, 22 bp, Homo sapiens
gaacagcagcttcctgggaatt

SEQ ID NO: 9338665 - DNA, 22 bp, Homo sapiens
gaaatgtagaattgcttaactg

SEQ ID NO: 9338666 - DNA, 20 bp, Homo sapiens
gaaatgtacacattaccaca

SEQ ID NO: 9338667 - DNA, 20 bp, Homo sapiens
gaaatgtacacattaccaca

SEQ ID NO: 9338668 - DNA, 22 bp, Homo sapiens
gaaatgtactttaaagccatcc

SEQ ID NO: 9338669 - DNA, 22 bp, Homo sapiens
gaaatgtactttaaagccatcc

SEQ ID NO: 9338670 - DNA, 22 bp, Homo sapiens
gaacagggagtacggcacattt

SEQ ID NO: 9338671 - DNA, 22 bp, Homo sapiens
gaacaggtaatcagtaaaatgt

SEQ ID NO: 9338672 - DNA, 22 bp, Homo sapiens
gaacagctataatcatctgtcc

SEQ ID NO: 9338673 - DNA, 22 bp, Homo sapiens
gaacatttggatttgtaaattt

SEQ ID NO: 9338674 - DNA, 22 bp, Homo sapiens
gaacatttggatttgtaaattt

SEQ ID NO: 9338675 - DNA, 22 bp, Homo sapiens
gaacatttggcatgagaatttg

SEQ ID NO: 9338676 - DNA, 22 bp, Homo sapiens
gaacatttggatttgtaaattt

SEQ ID NO: 9338677 - DNA, 22 bp, Homo sapiens
ctttcacaagatttgagatgct

SEQ ID NO: 9338678 - DNA, 22 bp, Homo sapiens
ctttcagaagaggacctttcca

SEQ ID NO: 9338679 - DNA, 22 bp, Homo sapiens
ctttcactttaatctgacacct

SEQ ID NO: 9338680 - DNA, 22 bp, Homo sapiens
ctttcacagcttgaaaagtatt

SEQ ID NO: 9338681 - DNA, 22 bp, Homo sapiens
ctttcagaggttactcaggaaa

SEQ ID NO: 9338682 - DNA, 18 bp, Homo sapiens
ctttcagtaatttcagcc

SEQ ID NO: 9338683 - DNA, 18 bp, Homo sapiens
ctttcagtaatttcagcc

SEQ ID NO: 9338684 - DNA, 22 bp, Homo sapiens
ctttcagttaatgactccatag

SEQ ID NO: 9338685 - DNA, 22 bp, Homo sapiens
ctttcagttacagttacacaca

SEQ ID NO: 9338686 - DNA, 22 bp, Homo sapiens
ctttcagtctttacaaggttgc

SEQ ID NO: 9338687 - DNA, 22 bp, Homo sapiens
ctttcagtcagttaactcagaa

SEQ ID NO: 9338688 - DNA, 22 bp, Homo sapiens
ctttcagttagtacctagtggc

SEQ ID NO: 9338689 - DNA, 22 bp, Homo sapiens
ctttcagttagtacctagtggc

SEQ ID NO: 9338690 - DNA, 22 bp, Homo sapiens
ctttcagttacagttacacaca

SEQ ID NO: 9338691 - DNA, 22 bp, Homo sapiens
ctttcagttacagttacacaca

SEQ ID NO: 9338692 - DNA, 22 bp, Homo sapiens
ctttcataaggggttttataat

SEQ ID NO: 9338693 - DNA, 22 bp, Homo sapiens
ctttccaactctagtgaaattt

SEQ ID NO: 9338694 - DNA, 23 bp, Homo sapiens
ctttcattgtggtttcacagagc

SEQ ID NO: 9338695 - DNA, 22 bp, Homo sapiens
ctttcattcttagatattagtg

SEQ ID NO: 9338696 - DNA, 22 bp, Homo sapiens
ctttcattcttagatattagtg

SEQ ID NO: 9338697 - DNA, 22 bp, Homo sapiens
gaaatcaatttcttggttgata

SEQ ID NO: 9338698 - DNA, 22 bp, Homo sapiens
gaaatcaaacccttttctgata

SEQ ID NO: 9338699 - DNA, 22 bp, Homo sapiens
gaaatatttctcttgagcccct

SEQ ID NO: 9338700 - DNA, 22 bp, Homo sapiens
gaaatatttctcttgagcccct

SEQ ID NO: 9338701 - DNA, 22 bp, Homo sapiens
gaaatatttctcttgagcccct

SEQ ID NO: 9338702 - DNA, 22 bp, Homo sapiens
ctttccaactgggtgggcagct

SEQ ID NO: 9338703 - DNA, 22 bp, Homo sapiens
gaaatatttctcttgagcccct

SEQ ID NO: 9338704 - DNA, 22 bp, Homo sapiens
gaaatatttctcttgagcccct

SEQ ID NO: 9338705 - DNA, 22 bp, Homo sapiens
gacacagaatgggtgctcagta

SEQ ID NO: 9338706 - DNA, 22 bp, Homo sapiens
gacaataaaatgatcttacagt

SEQ ID NO: 9338707 - DNA, 22 bp, Homo sapiens
gacaataaaatgatcttacagt

SEQ ID NO: 9338708 - DNA, 22 bp, Homo sapiens
gacacagaaggtcacatgttca

SEQ ID NO: 9338709 - DNA, 16 bp, Homo sapiens
gacaagtggaggggcc

SEQ ID NO: 9338710 - DNA, 22 bp, Homo sapiens
gacaagtgggctgcagcttttg

SEQ ID NO: 9338711 - DNA, 22 bp, Homo sapiens
gacaagtgggctgcagcttttg

SEQ ID NO: 9338712 - DNA, 22 bp, Homo sapiens
gacaagtgctgatttatctccc

SEQ ID NO: 9338713 - DNA, 22 bp, Homo sapiens
gacaagtgcatgatttctatct

SEQ ID NO: 9338714 - DNA, 22 bp, Homo sapiens
gacaagtgcccattattcttta

SEQ ID NO: 9338715 - DNA, 22 bp, Homo sapiens
gacaagtgatgattataattca

SEQ ID NO: 9338716 - DNA, 22 bp, Homo sapiens
gacaagggttctgcagagcctg

SEQ ID NO: 9338717 - DNA, 22 bp, Homo sapiens
gacacagagacttgcagttgta

SEQ ID NO: 9338718 - DNA, 22 bp, Homo sapiens
gacacagaccaccaggccctgg

SEQ ID NO: 9338719 - DNA, 22 bp, Homo sapiens
gacaggccaggggctgaggtgg

SEQ ID NO: 9338720 - DNA, 22 bp, Homo sapiens
gacaggccccctcaggactgat

SEQ ID NO: 9338721 - DNA, 22 bp, Homo sapiens
gacaggccaggggctgaggtgg

SEQ ID NO: 9338722 - DNA, 22 bp, Homo sapiens
gacaggccaggggctgaggtgg

SEQ ID NO: 9338723 - DNA, 22 bp, Homo sapiens
gacaggcccgagtagctgatga

SEQ ID NO: 9338724 - DNA, 22 bp, Homo sapiens
gacaggccccctcaggactgat

SEQ ID NO: 9338725 - DNA, 17 bp, Homo sapiens
gacaggctcagtgacga

SEQ ID NO: 9338726 - DNA, 22 bp, Homo sapiens
gacaggctaggttgctgtcctc

SEQ ID NO: 9338727 - DNA, 22 bp, Homo sapiens
gacaggggtccctctgggctgt

SEQ ID NO: 9338728 - DNA, 22 bp, Homo sapiens
gacagggctgtgggaggagcag

SEQ ID NO: 9338729 - DNA, 22 bp, Homo sapiens
gacagggctgtgggaggagcag

SEQ ID NO: 9338730 - DNA, 21 bp, Homo sapiens
gacaggggaagaagcaaggag

SEQ ID NO: 9338731 - DNA, 23 bp, Homo sapiens
gacagggctgacttggcagctgc

SEQ ID NO: 9338732 - DNA, 22 bp, Homo sapiens
gacagggacacagccagtgagg

SEQ ID NO: 9338733 - DNA, 22 bp, Homo sapiens
gacagggacacagccagtgagg

SEQ ID NO: 9338734 - DNA, 22 bp, Homo sapiens
gacagggaacttcattagctgt

SEQ ID NO: 9338735 - DNA, 22 bp, Homo sapiens
gacaggctttgagtcccagaac

SEQ ID NO: 9338736 - DNA, 22 bp, Homo sapiens
gacagggaaacattgaagtgtc

SEQ ID NO: 9338737 - DNA, 22 bp, Homo sapiens
gacaggctttctcaggatgagc

SEQ ID NO: 9338738 - DNA, 22 bp, Homo sapiens
gacaggcttcctaagtgccaga

SEQ ID NO: 9338739 - DNA, 22 bp, Homo sapiens
gacaggcttcctaagtgccaga

SEQ ID NO: 9338740 - DNA, 22 bp, Homo sapiens
gacaggctggcaatgccctgct

SEQ ID NO: 9338741 - DNA, 17 bp, Homo sapiens
gacaggctcagtgacga

SEQ ID NO: 9338742 - DNA, 22 bp, Homo sapiens
gacaggctgtgatggccgggag

SEQ ID NO: 9338743 - DNA, 22 bp, Homo sapiens
gacaggcttagggagggtgctc

SEQ ID NO: 9338744 - DNA, 22 bp, Homo sapiens
gacaggcttcatgatggcagga

SEQ ID NO: 9338745 - DNA, 22 bp, Homo sapiens
gacaggcttcatgatggcagga

SEQ ID NO: 9338746 - DNA, 22 bp, Homo sapiens
gacaggcttcatcctcagagtt

SEQ ID NO: 9338747 - DNA, 22 bp, Homo sapiens
gacagggtccaaaggcagggga

SEQ ID NO: 9338748 - DNA, 22 bp, Homo sapiens
gacagggtccaaaggcagggga

SEQ ID NO: 9338749 - DNA, 22 bp, Homo sapiens
gacagggttgagtaaactggga

SEQ ID NO: 9338750 - DNA, 22 bp, Homo sapiens
gacagggtggctgatagggctc

SEQ ID NO: 9338751 - DNA, 22 bp, Homo sapiens
gacaggtaccggtcagactacg

SEQ ID NO: 9338752 - DNA, 22 bp, Homo sapiens
gacaggtgagatgaggaacacc

SEQ ID NO: 9338753 - DNA, 22 bp, Homo sapiens
gacaggtgaaacagcaaggtaa

SEQ ID NO: 9338754 - DNA, 22 bp, Homo sapiens
gacaggtgaaacagcaaggtaa

SEQ ID NO: 9338755 - DNA, 22 bp, Homo sapiens
gacaggtatttgagagctggga

SEQ ID NO: 9338756 - DNA, 22 bp, Homo sapiens
gacaggtgaaacagcaaggtaa

SEQ ID NO: 9338757 - DNA, 22 bp, Homo sapiens
gacaggtgaaacagcaaggtaa

SEQ ID NO: 9338758 - DNA, 20 bp, Homo sapiens
gacaggtgctaaagaggggc

SEQ ID NO: 9338759 - DNA, 21 bp, Homo sapiens
gacaggtgattcagagcaggg

SEQ ID NO: 9338760 - DNA, 21 bp, Homo sapiens
gacaggtgattcagagcaggg

SEQ ID NO: 9338761 - DNA, 21 bp, Homo sapiens
gacaggtgattcagagcaggg

SEQ ID NO: 9338762 - DNA, 21 bp, Homo sapiens
gacaggtgattcagagcaggg

SEQ ID NO: 9338763 - DNA, 22 bp, Homo sapiens
gacaggtgagatgaggaacacc

SEQ ID NO: 9338764 - DNA, 22 bp, Homo sapiens
gacaggtgtgatgatttaggct

SEQ ID NO: 9338765 - DNA, 22 bp, Homo sapiens
gacaggtgtgtgtatattaggg

SEQ ID NO: 9338766 - DNA, 22 bp, Homo sapiens
gacaggtgtgatgatttaggct

SEQ ID NO: 9338767 - DNA, 22 bp, Homo sapiens
gacaggtgggttctcgtatctg

SEQ ID NO: 9338768 - DNA, 22 bp, Homo sapiens
gacaggtgggttctcgtatctg

SEQ ID NO: 9338769 - DNA, 18 bp, Homo sapiens
gacaggtgggtgagacca

SEQ ID NO: 9338770 - DNA, 18 bp, Homo sapiens
gacaggtgggtgagacca

SEQ ID NO: 9338771 - DNA, 22 bp, Homo sapiens
gacaggtgctaagggacctggc

SEQ ID NO: 9338772 - DNA, 22 bp, Homo sapiens
gacaggtgctaagggacctggc

SEQ ID NO: 9338773 - DNA, 20 bp, Homo sapiens
gacaggtgctaaagaggggc

SEQ ID NO: 9338774 - DNA, 22 bp, Homo sapiens
gacaggtggggaaactaaggta

SEQ ID NO: 9338775 - DNA, 22 bp, Homo sapiens
gacaggtgctaagggacctggc

SEQ ID NO: 9338776 - DNA, 18 bp, Homo sapiens
gacaggtgggtgagacca

SEQ ID NO: 9338777 - DNA, 22 bp, Homo sapiens
gacaggtgggtacctttatgga

SEQ ID NO: 9338778 - DNA, 22 bp, Homo sapiens
gacaggtgggtacctttatgga

SEQ ID NO: 9338779 - DNA, 22 bp, Homo sapiens
gacaggtggggaaactaaggta

SEQ ID NO: 9338780 - DNA, 22 bp, Homo sapiens
gacaggtggggaaactaaggta

SEQ ID NO: 9338781 - DNA, 22 bp, Homo sapiens
gacctcagctgtggggatgctg

SEQ ID NO: 9338782 - DNA, 22 bp, Homo sapiens
gacccttagaatgtgatcttat

SEQ ID NO: 9338783 - DNA, 22 bp, Homo sapiens
gacccttagaatgtgatcttat

SEQ ID NO: 9338784 - DNA, 22 bp, Homo sapiens
gaccctgtttctacaaataatt

SEQ ID NO: 9338785 - DNA, 22 bp, Homo sapiens
gaccctggtgggcactggcacc

SEQ ID NO: 9338786 - DNA, 22 bp, Homo sapiens
gaccctggtgtccaggtcctgc

SEQ ID NO: 9338787 - DNA, 22 bp, Homo sapiens
gaccctggtgtccaggtcctgc

SEQ ID NO: 9338788 - DNA, 22 bp, Homo sapiens
gacccagtgggggcctgatctg

SEQ ID NO: 9338789 - DNA, 22 bp, Homo sapiens
gaccccaaaccctgtattcttc

SEQ ID NO: 9338790 - DNA, 22 bp, Homo sapiens
gaccctggctggagctggcctg

SEQ ID NO: 9338791 - DNA, 22 bp, Homo sapiens
gaccctggctgccgcggtctgg

SEQ ID NO: 9338792 - DNA, 22 bp, Homo sapiens
gaccctggcaggtagcctcaca

SEQ ID NO: 9338793 - DNA, 22 bp, Homo sapiens
gacccagtgactcgtctctgtg

SEQ ID NO: 9338794 - DNA, 22 bp, Homo sapiens
gacccagtgactcgtctctgtg

SEQ ID NO: 9338795 - DNA, 22 bp, Homo sapiens
gacccagtcacacttgtgcttt

SEQ ID NO: 9338796 - DNA, 22 bp, Homo sapiens
gacagtaagaccttaccagcct

SEQ ID NO: 9338797 - DNA, 22 bp, Homo sapiens
gaatacatatcagatgtgtttc

SEQ ID NO: 9338798 - DNA, 22 bp, Homo sapiens
gaatacatatcagatgtgtttc

SEQ ID NO: 9338799 - DNA, 22 bp, Homo sapiens
gaatacatgatacatgaactgc

SEQ ID NO: 9338800 - DNA, 22 bp, Homo sapiens
gaatacatgaaccctcctgtgg

SEQ ID NO: 9338801 - DNA, 22 bp, Homo sapiens
gaatacatctgaaggctatgaa

SEQ ID NO: 9338802 - DNA, 22 bp, Homo sapiens
gaatacatccagagcagggctg

SEQ ID NO: 9338803 - DNA, 22 bp, Homo sapiens
gaatacaagccaggcacaaggc

SEQ ID NO: 9338804 - DNA, 22 bp, Homo sapiens
gaagtttatttcaatctattca

SEQ ID NO: 9338805 - DNA, 22 bp, Homo sapiens
gaagtttattttacacatccat

SEQ ID NO: 9338806 - DNA, 22 bp, Homo sapiens
gaagtttatggtgcttgtaagg

SEQ ID NO: 9338807 - DNA, 22 bp, Homo sapiens
gaagtttagagtgttgtaattt

SEQ ID NO: 9338808 - DNA, 22 bp, Homo sapiens
gaagtttaggttcttatgttta

SEQ ID NO: 9338809 - DNA, 22 bp, Homo sapiens
gaagtttaggttcttatgttta

SEQ ID NO: 9338810 - DNA, 22 bp, Homo sapiens
gaagtttagagtttggagtcct

SEQ ID NO: 9338811 - DNA, 22 bp, Homo sapiens
gaataacattggaaccctgaag

SEQ ID NO: 9338812 - DNA, 22 bp, Homo sapiens
gaataaactcctcagcttcctt

SEQ ID NO: 9338813 - DNA, 22 bp, Homo sapiens
gaataaactcctcagcttcctt

SEQ ID NO: 9338814 - DNA, 22 bp, Homo sapiens
gaagcctcaacatctctgcgtc

SEQ ID NO: 9338815 - DNA, 22 bp, Homo sapiens
gaagcttcgtggctcttcaaat

SEQ ID NO: 9338816 - DNA, 22 bp, Homo sapiens
gaaggaaaacagatctgcctga

SEQ ID NO: 9338817 - DNA, 22 bp, Homo sapiens
gaaggaagattctgttggaatc

SEQ ID NO: 9338818 - DNA, 22 bp, Homo sapiens
gaagtttacctctgccttgctt

SEQ ID NO: 9338819 - DNA, 22 bp, Homo sapiens
gaagtttagaagtgacaggttt

SEQ ID NO: 9338820 - DNA, 22 bp, Homo sapiens
gaagtttagaagtgacaggttt

SEQ ID NO: 9338821 - DNA, 23 bp, Homo sapiens
gaagttctgttcagccagacaag

SEQ ID NO: 9338822 - DNA, 22 bp, Homo sapiens
gaatatcccgctatgcaaagta

SEQ ID NO: 9338823 - DNA, 22 bp, Homo sapiens
gaatatatttctcttaccttta

SEQ ID NO: 9338824 - DNA, 22 bp, Homo sapiens
gaatatcccgctatgcaaagta

SEQ ID NO: 9338825 - DNA, 22 bp, Homo sapiens
gaatatctgggagtgggaagct

SEQ ID NO: 9338826 - DNA, 22 bp, Homo sapiens
gaatatctgtctggttgaggaa

SEQ ID NO: 9338827 - DNA, 22 bp, Homo sapiens
gacaacagtggtttcaggttcc

SEQ ID NO: 9338828 - DNA, 22 bp, Homo sapiens
gaatattagtatcagttatacc

SEQ ID NO: 9338829 - DNA, 22 bp, Homo sapiens
gacaacaggcagacgtcagaaa

SEQ ID NO: 9338830 - DNA, 22 bp, Homo sapiens
gaatattagtatcagttatacc

SEQ ID NO: 9338831 - DNA, 22 bp, Homo sapiens
gacaagatttagagtctgctaa

SEQ ID NO: 9338832 - DNA, 22 bp, Homo sapiens
gacaagcaagagtttgctgggc

SEQ ID NO: 9338833 - DNA, 22 bp, Homo sapiens
gaatagataagtgactatttgg

SEQ ID NO: 9338834 - DNA, 22 bp, Homo sapiens
gaatagattatacttgaagcat

SEQ ID NO: 9338835 - DNA, 22 bp, Homo sapiens
gaatagatagcttggatggttg

SEQ ID NO: 9338836 - DNA, 22 bp, Homo sapiens
gaatagatatccttgagggtct

SEQ ID NO: 9338837 - DNA, 22 bp, Homo sapiens
gaatagctgtaggctagtgtct

SEQ ID NO: 9338838 - DNA, 22 bp, Homo sapiens
gaatagcttccttttttccaaa

SEQ ID NO: 9338839 - DNA, 22 bp, Homo sapiens
gaatatattggtgaaaatagtt

SEQ ID NO: 9338840 - DNA, 22 bp, Homo sapiens
gaatatattggtgaaaatagtt

SEQ ID NO: 9338841 - DNA, 22 bp, Homo sapiens
gaatatattattcagcttttca

SEQ ID NO: 9338842 - DNA, 22 bp, Homo sapiens
gaatatattattcagcttttca

SEQ ID NO: 9338843 - DNA, 23 bp, Homo sapiens
gaatagttttagaaattggagaa

SEQ ID NO: 9338844 - DNA, 22 bp, Homo sapiens
gaatacatgtgtgtatagaggt

SEQ ID NO: 9338845 - DNA, 22 bp, Homo sapiens
gaatacatgttgtttccctgga

SEQ ID NO: 9338846 - DNA, 22 bp, Homo sapiens
gaatacatggcagggagtcatc

SEQ ID NO: 9338847 - DNA, 22 bp, Homo sapiens
gaatacatgcacgacacggggg

SEQ ID NO: 9338848 - DNA, 22 bp, Homo sapiens
gaatacatgattaaagtttgat

SEQ ID NO: 9338849 - DNA, 22 bp, Homo sapiens
gaatacattggaaatcagaata

SEQ ID NO: 9338850 - DNA, 22 bp, Homo sapiens
gaatacattggaaatcagaata

SEQ ID NO: 9338851 - DNA, 22 bp, Homo sapiens
gaatacatttgccgtggttctc

SEQ ID NO: 9338852 - DNA, 22 bp, Homo sapiens
gagatgtttagggtggggagag

SEQ ID NO: 9338853 - DNA, 22 bp, Homo sapiens
gagatgtttagggtggggagag

SEQ ID NO: 9338854 - DNA, 23 bp, Homo sapiens
gagatgtgggtttgttcagtgtc

SEQ ID NO: 9338855 - DNA, 22 bp, Homo sapiens
gagatgtgatcctttgctgtgt

SEQ ID NO: 9338856 - DNA, 22 bp, Homo sapiens
gagatgtgatcctttgctgtgt

SEQ ID NO: 9338857 - DNA, 22 bp, Homo sapiens
gagattgggtcttgctctgtca

SEQ ID NO: 9338858 - DNA, 22 bp, Homo sapiens
gagatggagtctttttctgtca

SEQ ID NO: 9338859 - DNA, 22 bp, Homo sapiens
gagatggtgttccactgccagt

SEQ ID NO: 9338860 - DNA, 22 bp, Homo sapiens
gagatggaaaactgctggtagt

SEQ ID NO: 9338861 - DNA, 22 bp, Homo sapiens
gagatgctttgtgtatagacaa

SEQ ID NO: 9338862 - DNA, 22 bp, Homo sapiens
gagatggaatctgtgtggaggg

SEQ ID NO: 9338863 - DNA, 22 bp, Homo sapiens
gagatggaatctgtgtggaggg

SEQ ID NO: 9338864 - DNA, 22 bp, Homo sapiens
gagcagcaggtggggctggctt

SEQ ID NO: 9338865 - DNA, 22 bp, Homo sapiens
gagcagcagttgttacaatgat

SEQ ID NO: 9338866 - DNA, 22 bp, Homo sapiens
gagcagcaggtggggctggctt

SEQ ID NO: 9338867 - DNA, 22 bp, Homo sapiens
gagcagcagctgggccaggttc

SEQ ID NO: 9338868 - DNA, 18 bp, Homo sapiens
gagcagcaggatcaagaa

SEQ ID NO: 9338869 - DNA, 22 bp, Homo sapiens
gagcagcaggccaggttgcagg

SEQ ID NO: 9338870 - DNA, 22 bp, Homo sapiens
gagcagcaggtggctgtgatgg

SEQ ID NO: 9338871 - DNA, 22 bp, Homo sapiens
gagcagcagctgggccaggttc

SEQ ID NO: 9338872 - DNA, 22 bp, Homo sapiens
gagcagcactgagttagcagct

SEQ ID NO: 9338873 - DNA, 22 bp, Homo sapiens
gagcagcacttgaggcatgtca

SEQ ID NO: 9338874 - DNA, 22 bp, Homo sapiens
gagcagcagattgtctccatgg

SEQ ID NO: 9338875 - DNA, 22 bp, Homo sapiens
gagcagatgtgtgccaggatgc

SEQ ID NO: 9338876 - DNA, 22 bp, Homo sapiens
gagcagatctcaggccttctgt

SEQ ID NO: 9338877 - DNA, 18 bp, Homo sapiens
gagcagaggctcaactgg

SEQ ID NO: 9338878 - DNA, 22 bp, Homo sapiens
gagcagagtctatttccacact

SEQ ID NO: 9338879 - DNA, 23 bp, Homo sapiens
gagatttagcagacaaagctctt

SEQ ID NO: 9338880 - DNA, 22 bp, Homo sapiens
gagatttagagagacttaaaca

SEQ ID NO: 9338881 - DNA, 22 bp, Homo sapiens
gagccagagctacaagtgtctg

SEQ ID NO: 9338882 - DNA, 22 bp, Homo sapiens
gagccagcagccggcaccacca

SEQ ID NO: 9338883 - DNA, 22 bp, Homo sapiens
gagccagggctgtgagctgagc

SEQ ID NO: 9338884 - DNA, 22 bp, Homo sapiens
gagccagaaaagctgcctgact

SEQ ID NO: 9338885 - DNA, 22 bp, Homo sapiens
gagccaccttcaactcaggaat

SEQ ID NO: 9338886 - DNA, 22 bp, Homo sapiens
gagccaccttcaactcaggaat

SEQ ID NO: 9338887 - DNA, 22 bp, Homo sapiens
gagccagaaaagctgcctgact

SEQ ID NO: 9338888 - DNA, 22 bp, Homo sapiens
gagccagacaggctagagcggg

SEQ ID NO: 9338889 - DNA, 22 bp, Homo sapiens
gagccagagatccaggatggct

SEQ ID NO: 9338890 - DNA, 22 bp, Homo sapiens
gagccaggtcgggccgcggcga

SEQ ID NO: 9338891 - DNA, 16 bp, Homo sapiens
gagccaggtgccttga

SEQ ID NO: 9338892 - DNA, 22 bp, Homo sapiens
gagccaggttggaggctgcagt

SEQ ID NO: 9338893 - DNA, 22 bp, Homo sapiens
gagccaggttggaggctgcagt

SEQ ID NO: 9338894 - DNA, 22 bp, Homo sapiens
gagccagggctgtgagctgagc

SEQ ID NO: 9338895 - DNA, 22 bp, Homo sapiens
gagccaggggtcagctccgagg

SEQ ID NO: 9338896 - DNA, 22 bp, Homo sapiens
gagccaggggtcagctccgagg

SEQ ID NO: 9338897 - DNA, 22 bp, Homo sapiens
gagccagggtttgaaactagac

SEQ ID NO: 9338898 - DNA, 20 bp, Homo sapiens
gagcagctgtttgcattgca

SEQ ID NO: 9338899 - DNA, 22 bp, Homo sapiens
gagcagctgttctgacttgtct

SEQ ID NO: 9338900 - DNA, 22 bp, Homo sapiens
gagcagctgtggggttgaccat

SEQ ID NO: 9338901 - DNA, 22 bp, Homo sapiens
gagcagctgtccccaaagcttc

SEQ ID NO: 9338902 - DNA, 22 bp, Homo sapiens
gagcagctggtaggtgaaccca

SEQ ID NO: 9338903 - DNA, 22 bp, Homo sapiens
gagcagctggaggccttgttgg

SEQ ID NO: 9338904 - DNA, 22 bp, Homo sapiens
gagcagctggctgtattggttt

SEQ ID NO: 9338905 - DNA, 22 bp, Homo sapiens
gagccaccttcaactcaggaat

SEQ ID NO: 9338906 - DNA, 17 bp, Homo sapiens
gagccaccctgtgcgag

SEQ ID NO: 9338907 - DNA, 22 bp, Homo sapiens
gagccacagtggattgattcca

SEQ ID NO: 9338908 - DNA, 22 bp, Homo sapiens
gagccaagctcttctccatgag

SEQ ID NO: 9338909 - DNA, 22 bp, Homo sapiens
gagccaagattgtgtccctgca

SEQ ID NO: 9338910 - DNA, 22 bp, Homo sapiens
gagcatttttgtctgcatttta

SEQ ID NO: 9338911 - DNA, 22 bp, Homo sapiens
gagaattagggcgtaattcaga

SEQ ID NO: 9338912 - DNA, 22 bp, Homo sapiens
gagaattactgtttttataaca

SEQ ID NO: 9338913 - DNA, 22 bp, Homo sapiens
gagaattttctagtagtttcat

SEQ ID NO: 9338914 - DNA, 22 bp, Homo sapiens
gagaagggggctcgagtgtcct

SEQ ID NO: 9338915 - DNA, 22 bp, Homo sapiens
gagaagggggctcgagtgtcct

SEQ ID NO: 9338916 - DNA, 22 bp, Homo sapiens
gagaatgtggagcctgtggttg

SEQ ID NO: 9338917 - DNA, 22 bp, Homo sapiens
gagaagggcttgggagtcaaca

SEQ ID NO: 9338918 - DNA, 22 bp, Homo sapiens
gagaagggggctcgagtgtcct

SEQ ID NO: 9338919 - DNA, 22 bp, Homo sapiens
gagaagggatatgccactctcg

SEQ ID NO: 9338920 - DNA, 22 bp, Homo sapiens
gagaagggatatgccactctcg

SEQ ID NO: 9338921 - DNA, 22 bp, Homo sapiens
gagaaggctgatccttggagtt

SEQ ID NO: 9338922 - DNA, 22 bp, Homo sapiens
gagaaggctggtcttaagtcga

SEQ ID NO: 9338923 - DNA, 22 bp, Homo sapiens
gagaagggatatgccactctcg

SEQ ID NO: 9338924 - DNA, 22 bp, Homo sapiens
gagaaggatgtggctcatagct

SEQ ID NO: 9338925 - DNA, 22 bp, Homo sapiens
gagaaggatgaggaaatggtat

SEQ ID NO: 9338926 - DNA, 22 bp, Homo sapiens
gagaaggaggcgaagcgtgtgc

SEQ ID NO: 9338927 - DNA, 22 bp, Homo sapiens
gacctctgaaggcagagcaggg

SEQ ID NO: 9338928 - DNA, 22 bp, Homo sapiens
gacctctgggtgatgcccaggc

SEQ ID NO: 9338929 - DNA, 22 bp, Homo sapiens
gagaaggactacacatctggcc

SEQ ID NO: 9338930 - DNA, 22 bp, Homo sapiens
gacctccgtgtacacctcccag

SEQ ID NO: 9338931 - DNA, 22 bp, Homo sapiens
gacctcatgatccacctgcctt

SEQ ID NO: 9338932 - DNA, 22 bp, Homo sapiens
gacctccagcggccctgcagag

SEQ ID NO: 9338933 - DNA, 22 bp, Homo sapiens
gacctcagtattgttcaggatg

SEQ ID NO: 9338934 - DNA, 22 bp, Homo sapiens
gacctcagctgtggggatgctg

SEQ ID NO: 9338935 - DNA, 22 bp, Homo sapiens
gacctcagtgaatggtcatgta

SEQ ID NO: 9338936 - DNA, 16 bp, Homo sapiens
gacctcagtgctggct

SEQ ID NO: 9338937 - DNA, 22 bp, Homo sapiens
gagatgcaagcaagtctatttt

SEQ ID NO: 9338938 - DNA, 22 bp, Homo sapiens
gagatgatctttcctgtagtcc

SEQ ID NO: 9338939 - DNA, 22 bp, Homo sapiens
gagatgctatggctattcccct

SEQ ID NO: 9338940 - DNA, 22 bp, Homo sapiens
gagatgctgtcaggctatctgt

SEQ ID NO: 9338941 - DNA, 22 bp, Homo sapiens
gagatcttcctgagattcattt

SEQ ID NO: 9338942 - DNA, 22 bp, Homo sapiens
gagatcttcaaggttttagata

SEQ ID NO: 9338943 - DNA, 22 bp, Homo sapiens
gagaggcttaagggctgtgaag

SEQ ID NO: 9338944 - DNA, 22 bp, Homo sapiens
gagaggctgtgtgccattgttg

SEQ ID NO: 9338945 - DNA, 22 bp, Homo sapiens
gagaggctgggttggagatcga

SEQ ID NO: 9338946 - DNA, 22 bp, Homo sapiens
gagaggctggtaaagtctgaac

SEQ ID NO: 9338947 - DNA, 22 bp, Homo sapiens
gagaggcttaagggctgtgaag

SEQ ID NO: 9338948 - DNA, 22 bp, Homo sapiens
gagaggcttaagggctgtgaag

SEQ ID NO: 9338949 - DNA, 22 bp, Homo sapiens
gagaggcttgtgtgaagaacaa

SEQ ID NO: 9338950 - DNA, 22 bp, Homo sapiens
gagatcctgtaggcagctaaga

SEQ ID NO: 9338951 - DNA, 22 bp, Homo sapiens
gagagggatactgagttttggt

SEQ ID NO: 9338952 - DNA, 22 bp, Homo sapiens
gagagggagccagccaggaacc

SEQ ID NO: 9338953 - DNA, 22 bp, Homo sapiens
gagagggagccagccaggaacc

SEQ ID NO: 9338954 - DNA, 22 bp, Homo sapiens
gagaggcatggaacagattctt

SEQ ID NO: 9338955 - DNA, 22 bp, Homo sapiens
gagaggcatggaacagattctt

SEQ ID NO: 9338956 - DNA, 22 bp, Homo sapiens
gagaggcatggaacagattctt

SEQ ID NO: 9338957 - DNA, 22 bp, Homo sapiens
gagaggcatggaacagattctt

SEQ ID NO: 9338958 - DNA, 22 bp, Homo sapiens
gagaggcatggaacagattctt

SEQ ID NO: 9338959 - DNA, 22 bp, Homo sapiens
gagaggccatggctgtgcagtg

SEQ ID NO: 9338960 - DNA, 22 bp, Homo sapiens
gagaggccatggggtgggatgc

SEQ ID NO: 9338961 - DNA, 22 bp, Homo sapiens
gagaggccatggctgtgcagtg

SEQ ID NO: 9338962 - DNA, 22 bp, Homo sapiens
gagaggccacctgacgagcagt

SEQ ID NO: 9338963 - DNA, 22 bp, Homo sapiens
gagaggccaaaatccctgcccc

SEQ ID NO: 9338964 - DNA, 22 bp, Homo sapiens
gagaggccaagggatccgtgag

SEQ ID NO: 9338965 - DNA, 22 bp, Homo sapiens
gagaggcctgggcccgtgagct

SEQ ID NO: 9338966 - DNA, 19 bp, Homo sapiens
gagaggcctgtgcttgaag

SEQ ID NO: 9338967 - DNA, 22 bp, Homo sapiens
gagaggcctgagaggctgcgga

SEQ ID NO: 9338968 - DNA, 22 bp, Homo sapiens
gagaggctcagggacttgctga

SEQ ID NO: 9338969 - DNA, 22 bp, Homo sapiens
gagaggctcagggacttgctga

SEQ ID NO: 9338970 - DNA, 22 bp, Homo sapiens
gagaggctatgaggttctgtgt

SEQ ID NO: 9338971 - DNA, 18 bp, Homo sapiens
gagaggcccggctgtgcc

SEQ ID NO: 9338972 - DNA, 18 bp, Homo sapiens
gagaggcccggctgtgcc

SEQ ID NO: 9338973 - DNA, 22 bp, Homo sapiens
gagaggccctgtggtcccagct

SEQ ID NO: 9338974 - DNA, 22 bp, Homo sapiens
gagaggccctgtggtcccagct

SEQ ID NO: 9338975 - DNA, 22 bp, Homo sapiens
gagaggccctgtggtcccagct

SEQ ID NO: 9338976 - DNA, 22 bp, Homo sapiens
gagaggcctgagaggctgcgga

SEQ ID NO: 9338977 - DNA, 22 bp, Homo sapiens
gagcttggcagtgtcactaggg

SEQ ID NO: 9338978 - DNA, 22 bp, Homo sapiens
gagcttggctggacctcacgga

SEQ ID NO: 9338979 - DNA, 22 bp, Homo sapiens
gagcttttcccgtctttctcgt

SEQ ID NO: 9338980 - DNA, 22 bp, Homo sapiens
gagcttctcaacagttatctct

SEQ ID NO: 9338981 - DNA, 22 bp, Homo sapiens
gagcttctgccatagagggact

SEQ ID NO: 9338982 - DNA, 22 bp, Homo sapiens
gagcttcttgtttcttcatctg

SEQ ID NO: 9338983 - DNA, 21 bp, Homo sapiens
gagcttgcaagcattatggga

SEQ ID NO: 9338984 - DNA, 22 bp, Homo sapiens
gagcttcctgatgccgaccagt

SEQ ID NO: 9338985 - DNA, 22 bp, Homo sapiens
gagcttaaatggctaaatataa

SEQ ID NO: 9338986 - DNA, 22 bp, Homo sapiens
gagcttccactctagaaggagt

SEQ ID NO: 9338987 - DNA, 22 bp, Homo sapiens
gagcttccagagacatcagagt

SEQ ID NO: 9338988 - DNA, 22 bp, Homo sapiens
gagcttccatccttactgtgtg

SEQ ID NO: 9338989 - DNA, 22 bp, Homo sapiens
gagcttccatccttactgtgtg

SEQ ID NO: 9338990 - DNA, 22 bp, Homo sapiens
gagcttccctctgcagtccctg

SEQ ID NO: 9338991 - DNA, 22 bp, Homo sapiens
gagcttccatccttactgtgtg

SEQ ID NO: 9338992 - DNA, 22 bp, Homo sapiens
gagctgtgttcatgaggagaaa

SEQ ID NO: 9338993 - DNA, 22 bp, Homo sapiens
gagctgtgttcatgaggagaaa

SEQ ID NO: 9338994 - DNA, 19 bp, Homo sapiens
gagctgagagtagcactgg

SEQ ID NO: 9338995 - DNA, 19 bp, Homo sapiens
gagctgagagtagcactgg

SEQ ID NO: 9338996 - DNA, 19 bp, Homo sapiens
gagctgagagtagcactgg

SEQ ID NO: 9338997 - DNA, 22 bp, Homo sapiens
gagctgagacacactttggcaa

SEQ ID NO: 9338998 - DNA, 22 bp, Homo sapiens
gagctgagacacactttggcaa

SEQ ID NO: 9338999 - DNA, 22 bp, Homo sapiens
gagctgagaagcagcgcttgat

SEQ ID NO: 9339000 - DNA, 18 bp, Homo sapiens
gagctgagaagaggatgc

SEQ ID NO: 9339001 - DNA, 22 bp, Homo sapiens
gagctcttcctttcaggaggcc

SEQ ID NO: 9339002 - DNA, 22 bp, Homo sapiens
gagctcttcgcctgtcgctgag

SEQ ID NO: 9339003 - DNA, 18 bp, Homo sapiens
gagctcttcccttttctc

SEQ ID NO: 9339004 - DNA, 18 bp, Homo sapiens
gagctcttcccttttctc

SEQ ID NO: 9339005 - DNA, 22 bp, Homo sapiens
gagctcttatagttctagcagt

SEQ ID NO: 9339006 - DNA, 22 bp, Homo sapiens
gagctcttccccatcttacatc

SEQ ID NO: 9339007 - DNA, 22 bp, Homo sapiens
gagctcttccccatcttacatc

SEQ ID NO: 9339008 - DNA, 22 bp, Homo sapiens
gagctcttatagttctagcagt

SEQ ID NO: 9339009 - DNA, 22 bp, Homo sapiens
gagctcttctaaagatggcaat

SEQ ID NO: 9339010 - DNA, 22 bp, Homo sapiens
gagctcttctggggtaagggac

SEQ ID NO: 9339011 - DNA, 22 bp, Homo sapiens
gagctcttgcttctagtccagg

SEQ ID NO: 9339012 - DNA, 22 bp, Homo sapiens
gagctcttctggttagatgttg

SEQ ID NO: 9339013 - DNA, 22 bp, Homo sapiens
gagctcttgtagtatgcggtaa

SEQ ID NO: 9339014 - DNA, 22 bp, Homo sapiens
gagctcttgcttctagtccagg

SEQ ID NO: 9339015 - DNA, 22 bp, Homo sapiens
gagctgaaatatgaagccaatt

SEQ ID NO: 9339016 - DNA, 22 bp, Homo sapiens
gagctgaacaaattgcgagtgg

SEQ ID NO: 9339017 - DNA, 22 bp, Homo sapiens
gagctcttttgccagtcactgc

SEQ ID NO: 9339018 - DNA, 22 bp, Homo sapiens
gagctcttttgatgaaggtagt

SEQ ID NO: 9339019 - DNA, 22 bp, Homo sapiens
gagctctttcggttgttttcga

SEQ ID NO: 9339020 - DNA, 22 bp, Homo sapiens
gagctctttgaacctgggcagt

SEQ ID NO: 9339021 - DNA, 22 bp, Homo sapiens
gagctctttaccaggtcaggac

SEQ ID NO: 9339022 - DNA, 22 bp, Homo sapiens
gagctctttcagttgactccta

SEQ ID NO: 9339023 - DNA, 22 bp, Homo sapiens
gagctctttcatggttctgtga

SEQ ID NO: 9339024 - DNA, 22 bp, Homo sapiens
gagctctttcctgcccatactg

SEQ ID NO: 9339025 - DNA, 22 bp, Homo sapiens
gagcctggattgaagtgggtgg

SEQ ID NO: 9339026 - DNA, 22 bp, Homo sapiens
gagcctggagctggaacgaagc

SEQ ID NO: 9339027 - DNA, 22 bp, Homo sapiens
gagcctggattgaagtgggtgg

SEQ ID NO: 9339028 - DNA, 22 bp, Homo sapiens
gagcctggattgaagtgggtgg

SEQ ID NO: 9339029 - DNA, 22 bp, Homo sapiens
gagcctggattgtcaccgactt

SEQ ID NO: 9339030 - DNA, 22 bp, Homo sapiens
gagcctggagctggaacgaagc

SEQ ID NO: 9339031 - DNA, 22 bp, Homo sapiens
gagcctgcgagggagtaaggca

SEQ ID NO: 9339032 - DNA, 22 bp, Homo sapiens
gagcctgcccctccaccaggat

SEQ ID NO: 9339033 - DNA, 22 bp, Homo sapiens
gagcctggacatctcaggccca

SEQ ID NO: 9339034 - DNA, 22 bp, Homo sapiens
gagcctcgtggcggccactgcg

SEQ ID NO: 9339035 - DNA, 22 bp, Homo sapiens
gagcctgaatttgacctgctta

SEQ ID NO: 9339036 - DNA, 22 bp, Homo sapiens
gagccaggtttgaatctcagtc

SEQ ID NO: 9339037 - DNA, 22 bp, Homo sapiens
gagccaggtttgaatctcagtc

SEQ ID NO: 9339038 - DNA, 22 bp, Homo sapiens
gagctagggaggaggcttgctc

SEQ ID NO: 9339039 - DNA, 22 bp, Homo sapiens
gagctaggggtagtcaggagac

SEQ ID NO: 9339040 - DNA, 22 bp, Homo sapiens
gagctactgaaatattgatttt

SEQ ID NO: 9339041 - DNA, 22 bp, Homo sapiens
gagctactgaaatattgatttt

SEQ ID NO: 9339042 - DNA, 22 bp, Homo sapiens
gagctagcttcttccaggtttc

SEQ ID NO: 9339043 - DNA, 22 bp, Homo sapiens
gagctagagggagaagggcact

SEQ ID NO: 9339044 - DNA, 22 bp, Homo sapiens
gagctagagggagaagggcact

SEQ ID NO: 9339045 - DNA, 22 bp, Homo sapiens
gagcgggaggaacggctcgggc

SEQ ID NO: 9339046 - DNA, 22 bp, Homo sapiens
gagcgggaggaacggctcgggc

SEQ ID NO: 9339047 - DNA, 22 bp, Homo sapiens
gagctaagaagcaaataaatca

SEQ ID NO: 9339048 - DNA, 22 bp, Homo sapiens
gagctactgaaatattgatttt

SEQ ID NO: 9339049 - DNA, 22 bp, Homo sapiens
gagctctaaccagggacaatta

SEQ ID NO: 9339050 - DNA, 22 bp, Homo sapiens
gagctatagatgtttacatact

SEQ ID NO: 9339051 - DNA, 22 bp, Homo sapiens
gagctatagatgtttacatact

SEQ ID NO: 9339052 - DNA, 22 bp, Homo sapiens
gagctctgaaaaagcttgcctt

SEQ ID NO: 9339053 - DNA, 22 bp, Homo sapiens
gagctctgaaaaagcttgcctt

SEQ ID NO: 9339054 - DNA, 22 bp, Homo sapiens
gagctctgatgtttagtggaga

SEQ ID NO: 9339055 - DNA, 22 bp, Homo sapiens
gagctctgactgctgggtgaca

SEQ ID NO: 9339056 - DNA, 22 bp, Homo sapiens
gagctctgaaaaagcttgcctt

SEQ ID NO: 9339057 - DNA, 22 bp, Homo sapiens
gagctctgaaaaagcttgcctt

SEQ ID NO: 9339058 - DNA, 22 bp, Homo sapiens
gagctctgactgctgggtgaca

SEQ ID NO: 9339059 - DNA, 22 bp, Homo sapiens
gagctcttagatagggcaggaa

SEQ ID NO: 9339060 - DNA, 22 bp, Homo sapiens
gagctcttatagttctagcagt

SEQ ID NO: 9339061 - DNA, 22 bp, Homo sapiens
gagctctgttctcgtcctgctg

SEQ ID NO: 9339062 - DNA, 22 bp, Homo sapiens
gagctctgttctcgtcctgctg

SEQ ID NO: 9339063 - DNA, 22 bp, Homo sapiens
gagctctgttctcgtcctgctg

SEQ ID NO: 9339064 - DNA, 22 bp, Homo sapiens
gagctctgtgtggcttgggtgg

SEQ ID NO: 9339065 - DNA, 22 bp, Homo sapiens
gagctctgtgtagcctgagggt

SEQ ID NO: 9339066 - DNA, 22 bp, Homo sapiens
gagctctgtgtagcctgagggt

SEQ ID NO: 9339067 - DNA, 22 bp, Homo sapiens
gaggcagaagttgcagtgagca

SEQ ID NO: 9339068 - DNA, 22 bp, Homo sapiens
gaggcactgctgggcccctgta

SEQ ID NO: 9339069 - DNA, 22 bp, Homo sapiens
gaggcactgctgggcccctgta

SEQ ID NO: 9339070 - DNA, 22 bp, Homo sapiens
gaggcagaagttgcagtgagca

SEQ ID NO: 9339071 - DNA, 22 bp, Homo sapiens
gaggcagaagttgcagtgagca

SEQ ID NO: 9339072 - DNA, 22 bp, Homo sapiens
gaggcagaagttgcagtgagca

SEQ ID NO: 9339073 - DNA, 22 bp, Homo sapiens
gaggcagaagttgcagtgagca

SEQ ID NO: 9339074 - DNA, 22 bp, Homo sapiens
gaggcagagaccttcaggacct

SEQ ID NO: 9339075 - DNA, 22 bp, Homo sapiens
gaggcagaagttgcagtgagca

SEQ ID NO: 9339076 - DNA, 22 bp, Homo sapiens
gaggcagagaccttcaggacct

SEQ ID NO: 9339077 - DNA, 22 bp, Homo sapiens
gaggcagaggaaggtggtctct

SEQ ID NO: 9339078 - DNA, 22 bp, Homo sapiens
gaggcagagactccaccttcag

SEQ ID NO: 9339079 - DNA, 22 bp, Homo sapiens
gaggcagagaccttcaggacct

SEQ ID NO: 9339080 - DNA, 22 bp, Homo sapiens
gaggcagagaccttcaggacct

SEQ ID NO: 9339081 - DNA, 22 bp, Homo sapiens
gaggcagagactccaccttcag

SEQ ID NO: 9339082 - DNA, 22 bp, Homo sapiens
gaggcaccagacatggcctcat

SEQ ID NO: 9339083 - DNA, 22 bp, Homo sapiens
gaggcaccagccccgctagcct

SEQ ID NO: 9339084 - DNA, 22 bp, Homo sapiens
gaggcaccagacatggcctcat

SEQ ID NO: 9339085 - DNA, 22 bp, Homo sapiens
gaggcacatcacttggtgcatt

SEQ ID NO: 9339086 - DNA, 22 bp, Homo sapiens
gaggcacaatacatgtctcaag

SEQ ID NO: 9339087 - DNA, 22 bp, Homo sapiens
gaggcactctcgacaagggtgg

SEQ ID NO: 9339088 - DNA, 22 bp, Homo sapiens
gaggcactgaatacttgagggt

SEQ ID NO: 9339089 - DNA, 22 bp, Homo sapiens
gaggcacctcgcgggaggaggc

SEQ ID NO: 9339090 - DNA, 22 bp, Homo sapiens
gaggcactgagagtgggggatg

SEQ ID NO: 9339091 - DNA, 22 bp, Homo sapiens
gaggcagaggttgcagtgagct

SEQ ID NO: 9339092 - DNA, 22 bp, Homo sapiens
gaggccagatactctcttctgc

SEQ ID NO: 9339093 - DNA, 22 bp, Homo sapiens
gaggccagatgtcatgtcttat

SEQ ID NO: 9339094 - DNA, 22 bp, Homo sapiens
gaggccagatgtcatgtcttat

SEQ ID NO: 9339095 - DNA, 22 bp, Homo sapiens
gaggccagatgtcatgtcttat

SEQ ID NO: 9339096 - DNA, 22 bp, Homo sapiens
gaggccagatgtcatgtcttat

SEQ ID NO: 9339097 - DNA, 22 bp, Homo sapiens
gaggccagatgtcatgtcttat

SEQ ID NO: 9339098 - DNA, 22 bp, Homo sapiens
gaggcagaggaaggtggtctct

SEQ ID NO: 9339099 - DNA, 22 bp, Homo sapiens
gaggcagaggaaggtggtctct

SEQ ID NO: 9339100 - DNA, 22 bp, Homo sapiens
gaggcagaggaaggtggtctct

SEQ ID NO: 9339101 - DNA, 22 bp, Homo sapiens
gaggccagcgcgcagcactttt

SEQ ID NO: 9339102 - DNA, 22 bp, Homo sapiens
gaggccagcgcgcagcactttt

SEQ ID NO: 9339103 - DNA, 22 bp, Homo sapiens
gaggccagcgcgcagcactttt

SEQ ID NO: 9339104 - DNA, 22 bp, Homo sapiens
gaggccagcgcgcagcactttt

SEQ ID NO: 9339105 - DNA, 22 bp, Homo sapiens
gaggccagcgcgcagcactttt

SEQ ID NO: 9339106 - DNA, 22 bp, Homo sapiens
gaggccagcccctcttgaaggc

SEQ ID NO: 9339107 - DNA, 22 bp, Homo sapiens
gaggccagcccctcttgaaggc

SEQ ID NO: 9339108 - DNA, 22 bp, Homo sapiens
gaggccagcccctcttgaaggc

SEQ ID NO: 9339109 - DNA, 22 bp, Homo sapiens
gaggccagcccctcttgaaggc

SEQ ID NO: 9339110 - DNA, 22 bp, Homo sapiens
gaggccagcccctcttgaaggc

SEQ ID NO: 9339111 - DNA, 22 bp, Homo sapiens
gaggccagcccctcttgaaggc

SEQ ID NO: 9339112 - DNA, 22 bp, Homo sapiens
gaggccaggacatgaaagctga

SEQ ID NO: 9339113 - DNA, 22 bp, Homo sapiens
gaggccaggaggatctctctaa

SEQ ID NO: 9339114 - DNA, 22 bp, Homo sapiens
gaggccaggacatgaaagctga

SEQ ID NO: 9339115 - DNA, 22 bp, Homo sapiens
gaggccaggacatgaaagctga

SEQ ID NO: 9339116 - DNA, 22 bp, Homo sapiens
gaggccaggacatgaaagctga

SEQ ID NO: 9339117 - DNA, 22 bp, Homo sapiens
gaggccaggacatgaaagctga

SEQ ID NO: 9339118 - DNA, 22 bp, Homo sapiens
gaggccaggaagcccaagatca

SEQ ID NO: 9339119 - DNA, 22 bp, Homo sapiens
gaggccaggaagcccaagatca

SEQ ID NO: 9339120 - DNA, 22 bp, Homo sapiens
gaggccaggaagcccaagatca

SEQ ID NO: 9339121 - DNA, 22 bp, Homo sapiens
gaggccaggaagcccaagatca

SEQ ID NO: 9339122 - DNA, 22 bp, Homo sapiens
gaggccaggacatgaaagctga

SEQ ID NO: 9339123 - DNA, 22 bp, Homo sapiens
gaggccagctacccaagggtca

SEQ ID NO: 9339124 - DNA, 22 bp, Homo sapiens
gaggccagctacccaagggtca

SEQ ID NO: 9339125 - DNA, 22 bp, Homo sapiens
gaggccagctacccaagggtca

SEQ ID NO: 9339126 - DNA, 22 bp, Homo sapiens
gaggccagctacccaagggtca

SEQ ID NO: 9339127 - DNA, 22 bp, Homo sapiens
gaggccagctagtccaggaagt

SEQ ID NO: 9339128 - DNA, 22 bp, Homo sapiens
gaggccagctagtccaggaagt

SEQ ID NO: 9339129 - DNA, 22 bp, Homo sapiens
gaggccagctagtccaggaagt

SEQ ID NO: 9339130 - DNA, 22 bp, Homo sapiens
gaggccagctagtccaggaagt

SEQ ID NO: 9339131 - DNA, 22 bp, Homo sapiens
gaggccagctagtccaggaagt

SEQ ID NO: 9339132 - DNA, 22 bp, Homo sapiens
gaggaggcactagttagtgaca

SEQ ID NO: 9339133 - DNA, 22 bp, Homo sapiens
gaggaggagtatatattagaat

SEQ ID NO: 9339134 - DNA, 22 bp, Homo sapiens
gaggaggcactagttagtgaca

SEQ ID NO: 9339135 - DNA, 22 bp, Homo sapiens
gaggaggcacttgagcagatgt

SEQ ID NO: 9339136 - DNA, 22 bp, Homo sapiens
gaggaggcacttgagcagatgt

SEQ ID NO: 9339137 - DNA, 22 bp, Homo sapiens
gaggaggaagttctctgtaggc

SEQ ID NO: 9339138 - DNA, 22 bp, Homo sapiens
gaggaggaggaagtggaaccca

SEQ ID NO: 9339139 - DNA, 22 bp, Homo sapiens
gaggaggaggaagtggaaccca

SEQ ID NO: 9339140 - DNA, 22 bp, Homo sapiens
gaggaggaagttctctgtaggc

SEQ ID NO: 9339141 - DNA, 19 bp, Homo sapiens
gaggaggaaaactagtgta

SEQ ID NO: 9339142 - DNA, 19 bp, Homo sapiens
gaggaggaaaactagtgta

SEQ ID NO: 9339143 - DNA, 19 bp, Homo sapiens
gaggaggaaaactagtgta

SEQ ID NO: 9339144 - DNA, 22 bp, Homo sapiens
gaggaggaaaccctgttcctct

SEQ ID NO: 9339145 - DNA, 22 bp, Homo sapiens
gaggaggaagttctctgtaggc

SEQ ID NO: 9339146 - DNA, 22 bp, Homo sapiens
gaggaggaagttctctgtaggc

SEQ ID NO: 9339147 - DNA, 22 bp, Homo sapiens
gaggaggaaaggagttgaaatg

SEQ ID NO: 9339148 - DNA, 22 bp, Homo sapiens
gaggaggctaagtgggctctgg

SEQ ID NO: 9339149 - DNA, 22 bp, Homo sapiens
gaggaggctaagtgggctctgg

SEQ ID NO: 9339150 - DNA, 22 bp, Homo sapiens
gaggaggctaagtgggctctgg

SEQ ID NO: 9339151 - DNA, 22 bp, Homo sapiens
gaggaggccagtggaaggaagc

SEQ ID NO: 9339152 - DNA, 22 bp, Homo sapiens
gaggcaaggccgcacgtctcag

SEQ ID NO: 9339153 - DNA, 22 bp, Homo sapiens
gaggaggctaagtgggctctgg

SEQ ID NO: 9339154 - DNA, 22 bp, Homo sapiens
gaggagccctgttccccaggcc

SEQ ID NO: 9339155 - DNA, 18 bp, Homo sapiens
gaggagccgtccctacta

SEQ ID NO: 9339156 - DNA, 22 bp, Homo sapiens
gaggagctgtctttgtgatctt

SEQ ID NO: 9339157 - DNA, 19 bp, Homo sapiens
gaggagctatcggagacag

SEQ ID NO: 9339158 - DNA, 22 bp, Homo sapiens
gaggagcttgtgagaagatgtc

SEQ ID NO: 9339159 - DNA, 22 bp, Homo sapiens
gaggagcttgaggctaggagcc

SEQ ID NO: 9339160 - DNA, 22 bp, Homo sapiens
gaggagcttcagaggaatctta

SEQ ID NO: 9339161 - DNA, 22 bp, Homo sapiens
gaggagcttgaggctaggagcc

SEQ ID NO: 9339162 - DNA, 22 bp, Homo sapiens
gaggaaaatattcagggaggtt

SEQ ID NO: 9339163 - DNA, 22 bp, Homo sapiens
gaggagccctgttccccaggcc

SEQ ID NO: 9339164 - DNA, 22 bp, Homo sapiens
gaggagccctgttccccaggcc

SEQ ID NO: 9339165 - DNA, 22 bp, Homo sapiens
gaggaaaatattcagggaggtt

SEQ ID NO: 9339166 - DNA, 22 bp, Homo sapiens
gaggaaaatattcagggaggtt

SEQ ID NO: 9339167 - DNA, 22 bp, Homo sapiens
gaggaaaataacaactaagggc

SEQ ID NO: 9339168 - DNA, 22 bp, Homo sapiens
gaggaaaataacaactaagggc

SEQ ID NO: 9339169 - DNA, 22 bp, Homo sapiens
gaggaaaataacaactaagggc

SEQ ID NO: 9339170 - DNA, 22 bp, Homo sapiens
ctggggcattgggagaggcctg

SEQ ID NO: 9339171 - DNA, 22 bp, Homo sapiens
ctggggcattgggagaggcctg

SEQ ID NO: 9339172 - DNA, 22 bp, Homo sapiens
ctggggcattgggagaggcctg

SEQ ID NO: 9339173 - DNA, 22 bp, Homo sapiens
ctggggctcactttggtcaggc

SEQ ID NO: 9339174 - DNA, 22 bp, Homo sapiens
ctggggccctgggtctgccctc

SEQ ID NO: 9339175 - DNA, 22 bp, Homo sapiens
ctggggctcactttggtcaggc

SEQ ID NO: 9339176 - DNA, 22 bp, Homo sapiens
ctggggctcactttggtcaggc

SEQ ID NO: 9339177 - DNA, 23 bp, Homo sapiens
ctggggctcattgcagtagccat

SEQ ID NO: 9339178 - DNA, 22 bp, Homo sapiens
ctggggctctctggaatgcttg

SEQ ID NO: 9339179 - DNA, 22 bp, Homo sapiens
ctggggctctctggaatgcttg

SEQ ID NO: 9339180 - DNA, 22 bp, Homo sapiens
ctggggctgcagcgatcttcat

SEQ ID NO: 9339181 - DNA, 22 bp, Homo sapiens
ctggggctgcagcgatcttcat

SEQ ID NO: 9339182 - DNA, 22 bp, Homo sapiens
ctggggctgcggacgggagccc

SEQ ID NO: 9339183 - DNA, 22 bp, Homo sapiens
ctggggctgcggtggaggagcc

SEQ ID NO: 9339184 - DNA, 22 bp, Homo sapiens
ctggggctgcggtggaggagcc

SEQ ID NO: 9339185 - DNA, 22 bp, Homo sapiens
ctggggtgtgctcagagcaggg

SEQ ID NO: 9339186 - DNA, 22 bp, Homo sapiens
ctggggtgtgctcagagcaggg

SEQ ID NO: 9339187 - DNA, 22 bp, Homo sapiens
ctggggtgtgctcagagcaggg

SEQ ID NO: 9339188 - DNA, 22 bp, Homo sapiens
ctggggtgtgctcagagcaggg

SEQ ID NO: 9339189 - DNA, 22 bp, Homo sapiens
ctggggtgtgctcagagcaggg

SEQ ID NO: 9339190 - DNA, 22 bp, Homo sapiens
ctggggtgtgctcagagcaggg

SEQ ID NO: 9339191 - DNA, 22 bp, Homo sapiens
ctgggtctggtgtcaggcgacg

SEQ ID NO: 9339192 - DNA, 22 bp, Homo sapiens
ctgggtctggtgtcaggcgacg

SEQ ID NO: 9339193 - DNA, 22 bp, Homo sapiens
ctgggtctggtgtcaggcgacg

SEQ ID NO: 9339194 - DNA, 22 bp, Homo sapiens
ctgggtctggccacaggaagta

SEQ ID NO: 9339195 - DNA, 22 bp, Homo sapiens
ctgggtctccggcagcctcggg

SEQ ID NO: 9339196 - DNA, 22 bp, Homo sapiens
ctgggtctccggcagcctcggg

SEQ ID NO: 9339197 - DNA, 22 bp, Homo sapiens
ctgggtctccggcagcctcggg

SEQ ID NO: 9339198 - DNA, 22 bp, Homo sapiens
ctggggttggccagggccctag

SEQ ID NO: 9339199 - DNA, 22 bp, Homo sapiens
ctgggtctggccacaggaagta

SEQ ID NO: 9339200 - DNA, 22 bp, Homo sapiens
ctgggtctggaggccaagggtg

SEQ ID NO: 9339201 - DNA, 22 bp, Homo sapiens
ctgggctgcaggcactaattgg

SEQ ID NO: 9339202 - DNA, 22 bp, Homo sapiens
ctgggctgcaggagtggggcaa

SEQ ID NO: 9339203 - DNA, 22 bp, Homo sapiens
ctgggctgcagttcctggtcct

SEQ ID NO: 9339204 - DNA, 22 bp, Homo sapiens
ctgggctgcatcaaagaggcat

SEQ ID NO: 9339205 - DNA, 22 bp, Homo sapiens
ctgggctgcatcaaagaggcat

SEQ ID NO: 9339206 - DNA, 22 bp, Homo sapiens
ctgggctgcagcgggagcgacg

SEQ ID NO: 9339207 - DNA, 22 bp, Homo sapiens
ctgggctctgcagttgatgttt

SEQ ID NO: 9339208 - DNA, 22 bp, Homo sapiens
ctgggctgcagcgggagcgacg

SEQ ID NO: 9339209 - DNA, 22 bp, Homo sapiens
ctgggctgcagcgggagcgacg

SEQ ID NO: 9339210 - DNA, 22 bp, Homo sapiens
ctgggctgcaggagtggggcaa

SEQ ID NO: 9339211 - DNA, 22 bp, Homo sapiens
ctgggctgcaggagtggggcaa

SEQ ID NO: 9339212 - DNA, 22 bp, Homo sapiens
ctgggctgcaggagtggggcaa

SEQ ID NO: 9339213 - DNA, 19 bp, Homo sapiens
ctgggccagagctgtcctc

SEQ ID NO: 9339214 - DNA, 19 bp, Homo sapiens
ctgggccagagctgtcctc

SEQ ID NO: 9339215 - DNA, 22 bp, Homo sapiens
ctgggctctgcggtgtcgctct

SEQ ID NO: 9339216 - DNA, 22 bp, Homo sapiens
ctgggctctgcagttgatgttt

SEQ ID NO: 9339217 - DNA, 22 bp, Homo sapiens
ctgggccagatccagcctcaca

SEQ ID NO: 9339218 - DNA, 22 bp, Homo sapiens
ctgggccagatccagcctcaca

SEQ ID NO: 9339219 - DNA, 22 bp, Homo sapiens
ctgggctgccaggtaggcacac

SEQ ID NO: 9339220 - DNA, 22 bp, Homo sapiens
ctgggctgcatcaaagaggcat

SEQ ID NO: 9339221 - DNA, 22 bp, Homo sapiens
ctgggctgcatcaaagaggcat

SEQ ID NO: 9339222 - DNA, 22 bp, Homo sapiens
ctgggctgccaggtaggcacac

SEQ ID NO: 9339223 - DNA, 20 bp, Homo sapiens
ctgggctgcccagctatggg

SEQ ID NO: 9339224 - DNA, 22 bp, Homo sapiens
ctgggctgccaggtaggcacac

SEQ ID NO: 9339225 - DNA, 22 bp, Homo sapiens
ctgggctgccaggtaggcacac

SEQ ID NO: 9339226 - DNA, 20 bp, Homo sapiens
ctgggctgcccagctatggg

SEQ ID NO: 9339227 - DNA, 20 bp, Homo sapiens
ctgggctgcccagctatggg

SEQ ID NO: 9339228 - DNA, 20 bp, Homo sapiens
ctgggctgcccagctatggg

SEQ ID NO: 9339229 - DNA, 20 bp, Homo sapiens
ctgggctgcccagctatggg

SEQ ID NO: 9339230 - DNA, 22 bp, Homo sapiens
ctgggctgcggttctctgaagc

SEQ ID NO: 9339231 - DNA, 22 bp, Homo sapiens
ctgggctgctgtccactagggt

SEQ ID NO: 9339232 - DNA, 22 bp, Homo sapiens
ctgggctgctcagccccctcgc

SEQ ID NO: 9339233 - DNA, 22 bp, Homo sapiens
ctgggctgctcagccccctcgc

SEQ ID NO: 9339234 - DNA, 22 bp, Homo sapiens
ctgggctgctcagccccctcgc

SEQ ID NO: 9339235 - DNA, 22 bp, Homo sapiens
ctgggctgcgggcgcccctcca

SEQ ID NO: 9339236 - DNA, 22 bp, Homo sapiens
ctgggctgcggtggtaggttgt

SEQ ID NO: 9339237 - DNA, 22 bp, Homo sapiens
ctgggctgcggtggtaggttgt

SEQ ID NO: 9339238 - DNA, 22 bp, Homo sapiens
ctgggctgcggtggtaggttgt

SEQ ID NO: 9339239 - DNA, 22 bp, Homo sapiens
ctgggctgcgggcgcccctcca

SEQ ID NO: 9339240 - DNA, 22 bp, Homo sapiens
ctgggctgcgggcgcccctcca

SEQ ID NO: 9339241 - DNA, 22 bp, Homo sapiens
ctgggctgctgtccactagggt

SEQ ID NO: 9339242 - DNA, 22 bp, Homo sapiens
ctgggctgctgtccactagggt

SEQ ID NO: 9339243 - DNA, 23 bp, Homo sapiens
ctgggctgcttgagtccctggct

SEQ ID NO: 9339244 - DNA, 23 bp, Homo sapiens
ctgggctgcttgagtccctggct

SEQ ID NO: 9339245 - DNA, 23 bp, Homo sapiens
ctgggctgcttgagtccctggct

SEQ ID NO: 9339246 - DNA, 22 bp, Homo sapiens
ctgggctgcttgctgaaggggt

SEQ ID NO: 9339247 - DNA, 22 bp, Homo sapiens
ctgggctgcttgctgaaggggt

SEQ ID NO: 9339248 - DNA, 22 bp, Homo sapiens
ctgggctggacacacttaacct

SEQ ID NO: 9339249 - DNA, 22 bp, Homo sapiens
ctgggctggacacacttaacct

SEQ ID NO: 9339250 - DNA, 22 bp, Homo sapiens
ctgggctgcttgctgaaggggt

SEQ ID NO: 9339251 - DNA, 22 bp, Homo sapiens
ctgggctgcttgctgaaggggt

SEQ ID NO: 9339252 - DNA, 20 bp, Homo sapiens
ctggggaggaggatgtgttc

SEQ ID NO: 9339253 - DNA, 20 bp, Homo sapiens
ctggggaggaggatgtgttc

SEQ ID NO: 9339254 - DNA, 22 bp, Homo sapiens
ctgggaggcagaggttgcagtg

SEQ ID NO: 9339255 - DNA, 22 bp, Homo sapiens
ctgggaggcagaggttgtagtg

SEQ ID NO: 9339256 - DNA, 22 bp, Homo sapiens
ctgggaggcagtctctctagaa

SEQ ID NO: 9339257 - DNA, 22 bp, Homo sapiens
ctgggaggcagtctctctagaa

SEQ ID NO: 9339258 - DNA, 22 bp, Homo sapiens
ctgggaggcagaggttgtagtg

SEQ ID NO: 9339259 - DNA, 22 bp, Homo sapiens
ctgggaggcagaggttgcagtg

SEQ ID NO: 9339260 - DNA, 22 bp, Homo sapiens
ctgggaggcactattcaggagg

SEQ ID NO: 9339261 - DNA, 22 bp, Homo sapiens
ctgggaggcactattcaggagg

SEQ ID NO: 9339262 - DNA, 22 bp, Homo sapiens
ctgggaggcccacgttgggaag

SEQ ID NO: 9339263 - DNA, 22 bp, Homo sapiens
ctgggaggcagtctctctagaa

SEQ ID NO: 9339264 - DNA, 22 bp, Homo sapiens
ctgggaggcccacgttgggaag

SEQ ID NO: 9339265 - DNA, 22 bp, Homo sapiens
ctgggaggcggagcttgcagtg

SEQ ID NO: 9339266 - DNA, 22 bp, Homo sapiens
ctgggaggcggagcttgcagtg

SEQ ID NO: 9339267 - DNA, 22 bp, Homo sapiens
ctgggaggcggagcttgcagtg

SEQ ID NO: 9339268 - DNA, 22 bp, Homo sapiens
ctgggaggcggagcttgcagtg

SEQ ID NO: 9339269 - DNA, 22 bp, Homo sapiens
ctgggcaggagaggtggttgga

SEQ ID NO: 9339270 - DNA, 22 bp, Homo sapiens
ctgggcaggagaggtggttgga

SEQ ID NO: 9339271 - DNA, 22 bp, Homo sapiens
ctgggccacaagcctgtgtgat

SEQ ID NO: 9339272 - DNA, 22 bp, Homo sapiens
ctgggccacaaaaaactcctgt

SEQ ID NO: 9339273 - DNA, 22 bp, Homo sapiens
ctgggccacaaaaaactcctgt

SEQ ID NO: 9339274 - DNA, 22 bp, Homo sapiens
ctgggccacagactcaaggcag

SEQ ID NO: 9339275 - DNA, 22 bp, Homo sapiens
ctgggcatggacagctgcacag

SEQ ID NO: 9339276 - DNA, 22 bp, Homo sapiens
ctgggcatatacgtgcaagtca

SEQ ID NO: 9339277 - DNA, 23 bp, Homo sapiens
ctgggcatggagcttcagaggct

SEQ ID NO: 9339278 - DNA, 23 bp, Homo sapiens
ctgggcatggagcttcagaggct

SEQ ID NO: 9339279 - DNA, 23 bp, Homo sapiens
ctgggcatggagcttcagaggct

SEQ ID NO: 9339280 - DNA, 22 bp, Homo sapiens
ctgggcagtttattcagttctg

SEQ ID NO: 9339281 - DNA, 22 bp, Homo sapiens
ctgggcagtttattcagttctg

SEQ ID NO: 9339282 - DNA, 22 bp, Homo sapiens
ctgggcaggagggctctatgga

SEQ ID NO: 9339283 - DNA, 22 bp, Homo sapiens
ctggctttcatttcaagcacgt

SEQ ID NO: 9339284 - DNA, 22 bp, Homo sapiens
ctggctttaggttggagagctg

SEQ ID NO: 9339285 - DNA, 22 bp, Homo sapiens
ctggctttcattcattcaggcc

SEQ ID NO: 9339286 - DNA, 22 bp, Homo sapiens
ctggctgtgctgcaggctttgg

SEQ ID NO: 9339287 - DNA, 22 bp, Homo sapiens
ctggcttgcagctcatcataaa

SEQ ID NO: 9339288 - DNA, 22 bp, Homo sapiens
ctggcttggcttattcatggaa

SEQ ID NO: 9339289 - DNA, 22 bp, Homo sapiens
ctggcttggcttattcatggaa

SEQ ID NO: 9339290 - DNA, 22 bp, Homo sapiens
ctggctttacctcactggggct

SEQ ID NO: 9339291 - DNA, 22 bp, Homo sapiens
ctggctttctatttggtgctat

SEQ ID NO: 9339292 - DNA, 22 bp, Homo sapiens
ctggctttctctgtggtgttca

SEQ ID NO: 9339293 - DNA, 22 bp, Homo sapiens
ctggctttctgcaaatctccat

SEQ ID NO: 9339294 - DNA, 22 bp, Homo sapiens
ctggctttctgcacagaattgg

SEQ ID NO: 9339295 - DNA, 22 bp, Homo sapiens
ctggctttgctggactgggagt

SEQ ID NO: 9339296 - DNA, 18 bp, Homo sapiens
ctggctttcttatccatc

SEQ ID NO: 9339297 - DNA, 22 bp, Homo sapiens
ctggctttgaaatgcatttcag

SEQ ID NO: 9339298 - DNA, 22 bp, Homo sapiens
ctggctttgaaggtctttccta

SEQ ID NO: 9339299 - DNA, 22 bp, Homo sapiens
ctggcttttggaaacaggctca

SEQ ID NO: 9339300 - DNA, 22 bp, Homo sapiens
ctggcttttgcaggtgttgcta

SEQ ID NO: 9339301 - DNA, 22 bp, Homo sapiens
ctgggaactgtactgccttgaa

SEQ ID NO: 9339302 - DNA, 22 bp, Homo sapiens
ctggcttttcaaactgttcagt

SEQ ID NO: 9339303 - DNA, 22 bp, Homo sapiens
ctggctttgtatagttccctga

SEQ ID NO: 9339304 - DNA, 22 bp, Homo sapiens
ctggctttggtcatgtgatcat

SEQ ID NO: 9339305 - DNA, 22 bp, Homo sapiens
ctgggagctcagccctggggtg

SEQ ID NO: 9339306 - DNA, 22 bp, Homo sapiens
ctgggagctcagccctggggtg

SEQ ID NO: 9339307 - DNA, 22 bp, Homo sapiens
ctgggagctagctctgagctga

SEQ ID NO: 9339308 - DNA, 22 bp, Homo sapiens
ctgggaagaaattgtgggaggc

SEQ ID NO: 9339309 - DNA, 22 bp, Homo sapiens
ctgggaagaaattgtgggaggc

SEQ ID NO: 9339310 - DNA, 22 bp, Homo sapiens
ctgggagctagctctgagctga

SEQ ID NO: 9339311 - DNA, 22 bp, Homo sapiens
ctgggaggcaccgcgtcgtgct

SEQ ID NO: 9339312 - DNA, 22 bp, Homo sapiens
ctgggaggattcattgaggtga

SEQ ID NO: 9339313 - DNA, 22 bp, Homo sapiens
ctgggaggattcattgaggtga

SEQ ID NO: 9339314 - DNA, 22 bp, Homo sapiens
ctgggagctgaggctgacgctg

SEQ ID NO: 9339315 - DNA, 19 bp, Homo sapiens
ctggccaggccaggggccc

SEQ ID NO: 9339316 - DNA, 22 bp, Homo sapiens
ctggccaggccccttgcagggc

SEQ ID NO: 9339317 - DNA, 22 bp, Homo sapiens
ctggccaggccccttgcagggc

SEQ ID NO: 9339318 - DNA, 19 bp, Homo sapiens
ctggccaggccaggggccc

SEQ ID NO: 9339319 - DNA, 19 bp, Homo sapiens
ctggccaggccaggggccc

SEQ ID NO: 9339320 - DNA, 22 bp, Homo sapiens
ctggccaggcatcccctgatcc

SEQ ID NO: 9339321 - DNA, 22 bp, Homo sapiens
ctggccaggcatcccctgatcc

SEQ ID NO: 9339322 - DNA, 22 bp, Homo sapiens
ctggccctattccaggccttcc

SEQ ID NO: 9339323 - DNA, 22 bp, Homo sapiens
ctggccctattccaggccttcc

SEQ ID NO: 9339324 - DNA, 22 bp, Homo sapiens
ctggccctatgagcctcctgat

SEQ ID NO: 9339325 - DNA, 22 bp, Homo sapiens
ctggccaggccccttgcagggc

SEQ ID NO: 9339326 - DNA, 22 bp, Homo sapiens
ctggccctcggagtccagctgc

SEQ ID NO: 9339327 - DNA, 22 bp, Homo sapiens
ctggccctcggagtccagctgc

SEQ ID NO: 9339328 - DNA, 22 bp, Homo sapiens
ctggccctcgtcagtttcactg

SEQ ID NO: 9339329 - DNA, 22 bp, Homo sapiens
ctggccctcggagtccagctgc

SEQ ID NO: 9339330 - DNA, 22 bp, Homo sapiens
ctggccctcagactcatgggca

SEQ ID NO: 9339331 - DNA, 22 bp, Homo sapiens
ctggccctcagactcatgggca

SEQ ID NO: 9339332 - DNA, 22 bp, Homo sapiens
ctggccctcagactcatgggca

SEQ ID NO: 9339333 - DNA, 16 bp, Homo sapiens
ctggccctggctctgg

SEQ ID NO: 9339334 - DNA, 22 bp, Homo sapiens
ctggccctggagggctgtgcga

SEQ ID NO: 9339335 - DNA, 22 bp, Homo sapiens
ctggccctggagggctgtgcga

SEQ ID NO: 9339336 - DNA, 22 bp, Homo sapiens
ctggccctgccagagatcaaca

SEQ ID NO: 9339337 - DNA, 22 bp, Homo sapiens
ctggccctgcctaatgtacttg

SEQ ID NO: 9339338 - DNA, 22 bp, Homo sapiens
ctggccctgctccgcgccgcgg

SEQ ID NO: 9339339 - DNA, 22 bp, Homo sapiens
ctggccctgtggaggcaggaac

SEQ ID NO: 9339340 - DNA, 22 bp, Homo sapiens
ctggccctgtcagcacagaatc

SEQ ID NO: 9339341 - DNA, 22 bp, Homo sapiens
ctggccctgtaggatgtgagtt

SEQ ID NO: 9339342 - DNA, 23 bp, Homo sapiens
ctggccctggctctgtgatcatg

SEQ ID NO: 9339343 - DNA, 22 bp, Homo sapiens
ctggccctggagggctgtgcga

SEQ ID NO: 9339344 - DNA, 22 bp, Homo sapiens
ctggccctggtaaggacaccca

SEQ ID NO: 9339345 - DNA, 22 bp, Homo sapiens
ctggccctggtaaggacaccca

SEQ ID NO: 9339346 - DNA, 22 bp, Homo sapiens
ctggccctggctggagcccagg

SEQ ID NO: 9339347 - DNA, 22 bp, Homo sapiens
ctggccctggctggagcccagg

SEQ ID NO: 9339348 - DNA, 22 bp, Homo sapiens
ctggctcagacagctgtgcagt

SEQ ID NO: 9339349 - DNA, 22 bp, Homo sapiens
ctggctcaggaaagttgctgct

SEQ ID NO: 9339350 - DNA, 22 bp, Homo sapiens
ctggcctgtgggctgtctccgg

SEQ ID NO: 9339351 - DNA, 22 bp, Homo sapiens
ctggctcacctccgctccagca

SEQ ID NO: 9339352 - DNA, 22 bp, Homo sapiens
ctggcctgtcctgacccagcct

SEQ ID NO: 9339353 - DNA, 22 bp, Homo sapiens
ctggctcactagccctgccctg

SEQ ID NO: 9339354 - DNA, 22 bp, Homo sapiens
ctggctcactagccctgccctg

SEQ ID NO: 9339355 - DNA, 22 bp, Homo sapiens
ctggctcacctccgctccagca

SEQ ID NO: 9339356 - DNA, 20 bp, Homo sapiens
ctggctggaaacttagcctt

SEQ ID NO: 9339357 - DNA, 22 bp, Homo sapiens
ctggctgcttgttttgatgggt

SEQ ID NO: 9339358 - DNA, 16 bp, Homo sapiens
ctggctggaagcctgg

SEQ ID NO: 9339359 - DNA, 22 bp, Homo sapiens
ctggctggaacgccgaggcggc

SEQ ID NO: 9339360 - DNA, 22 bp, Homo sapiens
ctggctggaacgccgaggcggc

SEQ ID NO: 9339361 - DNA, 22 bp, Homo sapiens
ctggctggaagttagagaactt

SEQ ID NO: 9339362 - DNA, 22 bp, Homo sapiens
ctggctggagaaatgaaattct

SEQ ID NO: 9339363 - DNA, 22 bp, Homo sapiens
ctggctggagcaggcatcttgt

SEQ ID NO: 9339364 - DNA, 22 bp, Homo sapiens
ctggctggacttgtgcatgtca

SEQ ID NO: 9339365 - DNA, 22 bp, Homo sapiens
ctggctgtgcagtcttccagaa

SEQ ID NO: 9339366 - DNA, 22 bp, Homo sapiens
ctggctgtgcagtcttccagaa

SEQ ID NO: 9339367 - DNA, 22 bp, Homo sapiens
ctggctgcgtctgctctgacag

SEQ ID NO: 9339368 - DNA, 22 bp, Homo sapiens
ctggctgctggcctgaggatgc

SEQ ID NO: 9339369 - DNA, 22 bp, Homo sapiens
ctggctgctggcctgaggatgc

SEQ ID NO: 9339370 - DNA, 22 bp, Homo sapiens
ctggctgcgtctgctctgacag

SEQ ID NO: 9339371 - DNA, 22 bp, Homo sapiens
ctggctgcgctagtccagaaga

SEQ ID NO: 9339372 - DNA, 22 bp, Homo sapiens
ctggctgcttgggacagccatg

SEQ ID NO: 9339373 - DNA, 22 bp, Homo sapiens
ctggctgcttgggacagccatg

SEQ ID NO: 9339374 - DNA, 22 bp, Homo sapiens
ctggctgcttgtagactcgact

SEQ ID NO: 9339375 - DNA, 22 bp, Homo sapiens
ctggctgcctatagtctccctt

SEQ ID NO: 9339376 - DNA, 22 bp, Homo sapiens
ctggctgcctatagtctccctt

SEQ ID NO: 9339377 - DNA, 22 bp, Homo sapiens
ctggctgccagcatttggggga

SEQ ID NO: 9339378 - DNA, 22 bp, Homo sapiens
ctggctgcctggagtgagggag

SEQ ID NO: 9339379 - DNA, 22 bp, Homo sapiens
ctggctgcctggagtgagggag

SEQ ID NO: 9339380 - DNA, 22 bp, Homo sapiens
ctggctgccagcatttggggga

SEQ ID NO: 9339381 - DNA, 22 bp, Homo sapiens
ctggctgccacttcagggtctt

SEQ ID NO: 9339382 - DNA, 22 bp, Homo sapiens
ctggctgcattggcaagtcaat

SEQ ID NO: 9339383 - DNA, 22 bp, Homo sapiens
ctggctgccacttcagggtctt

SEQ ID NO: 9339384 - DNA, 22 bp, Homo sapiens
ctggctgcattggcaagtcaat

SEQ ID NO: 9339385 - DNA, 22 bp, Homo sapiens
ctggctcttctgggttctgtgt

SEQ ID NO: 9339386 - DNA, 21 bp, Homo sapiens
ctggctctgttgtcacccggc

SEQ ID NO: 9339387 - DNA, 22 bp, Homo sapiens
ctggctcttcagtgcttggttc

SEQ ID NO: 9339388 - DNA, 22 bp, Homo sapiens
ctggctcttcagtgcttggttc

SEQ ID NO: 9339389 - DNA, 22 bp, Homo sapiens
ctggctccaaggaagaggtttt

SEQ ID NO: 9339390 - DNA, 22 bp, Homo sapiens
ctggctccaaggaagaggtttt

SEQ ID NO: 9339391 - DNA, 22 bp, Homo sapiens
ctggctgcaggatgaggctgcc

SEQ ID NO: 9339392 - DNA, 22 bp, Homo sapiens
ctggctgcaggatgaggctgcc

SEQ ID NO: 9339393 - DNA, 22 bp, Homo sapiens
ctggctgcagtagcaagagact

SEQ ID NO: 9339394 - DNA, 22 bp, Homo sapiens
ctggctgcagtagcaagagact

SEQ ID NO: 9339395 - DNA, 22 bp, Homo sapiens
ctggctgcaggaaggagtgggc

SEQ ID NO: 9339396 - DNA, 22 bp, Homo sapiens
ctggctgcaggaaggagtgggc

SEQ ID NO: 9339397 - DNA, 22 bp, Homo sapiens
ctggctcatccaggtgttgctc

SEQ ID NO: 9339398 - DNA, 22 bp, Homo sapiens
ctggctcatagagcagctccaa

SEQ ID NO: 9339399 - DNA, 23 bp, Homo sapiens
ctggctcatcctggttgcagtgg

SEQ ID NO: 9339400 - DNA, 22 bp, Homo sapiens
ctggctcatgtgatgagggcaa

SEQ ID NO: 9339401 - DNA, 22 bp, Homo sapiens
ctggctcattttagcatcaggt

SEQ ID NO: 9339402 - DNA, 22 bp, Homo sapiens
ctggctcattttagcatcaggt

SEQ ID NO: 9339403 - DNA, 22 bp, Homo sapiens
ctggccagcctgtcgatgccct

SEQ ID NO: 9339404 - DNA, 22 bp, Homo sapiens
ctggccagctgacagcagggct

SEQ ID NO: 9339405 - DNA, 22 bp, Homo sapiens
ctggccagcctgtcgatgccct

SEQ ID NO: 9339406 - DNA, 22 bp, Homo sapiens
ctggccagcctcccaggtaccc

SEQ ID NO: 9339407 - DNA, 22 bp, Homo sapiens
ctggccagcctcccaggtaccc

SEQ ID NO: 9339408 - DNA, 22 bp, Homo sapiens
ctggccaggaggtaaccagatg

SEQ ID NO: 9339409 - DNA, 22 bp, Homo sapiens
ctggccaggaggtaaccagatg

SEQ ID NO: 9339410 - DNA, 22 bp, Homo sapiens
ctggccaggaggtaaccagatg

SEQ ID NO: 9339411 - DNA, 22 bp, Homo sapiens
ctggccagctgacagcagggct

SEQ ID NO: 9339412 - DNA, 22 bp, Homo sapiens
ctggccagctgacagcagggct

SEQ ID NO: 9339413 - DNA, 22 bp, Homo sapiens
ctggccagctgacagcagggct

SEQ ID NO: 9339414 - DNA, 22 bp, Homo sapiens
ctggccagaggttcctctgccc

SEQ ID NO: 9339415 - DNA, 22 bp, Homo sapiens
ctggccactgcacctcttcctt

SEQ ID NO: 9339416 - DNA, 21 bp, Homo sapiens
ctggccactgcacctcttcct

SEQ ID NO: 9339417 - DNA, 22 bp, Homo sapiens
ctggccagagttggagggtgtg

SEQ ID NO: 9339418 - DNA, 22 bp, Homo sapiens
ctggccagatgttacgtccaat

SEQ ID NO: 9339419 - DNA, 22 bp, Homo sapiens
ctggccagcatggctgaagtac

SEQ ID NO: 9339420 - DNA, 22 bp, Homo sapiens
ctggccagatgttacgtccaat

SEQ ID NO: 9339421 - DNA, 22 bp, Homo sapiens
ctggccagatgttacgtccaat

SEQ ID NO: 9339422 - DNA, 22 bp, Homo sapiens
ctggccagatgttacgtccaat

SEQ ID NO: 9339423 - DNA, 22 bp, Homo sapiens
ctggccagcatggctgaagtac

SEQ ID NO: 9339424 - DNA, 22 bp, Homo sapiens
ctggccagcatttttgctttag

SEQ ID NO: 9339425 - DNA, 22 bp, Homo sapiens
ctggcagggcaggggtttgtgc

SEQ ID NO: 9339426 - DNA, 22 bp, Homo sapiens
ctggcagggcaggggtttgtgc

SEQ ID NO: 9339427 - DNA, 22 bp, Homo sapiens
ctggccacccatgcctccctga

SEQ ID NO: 9339428 - DNA, 22 bp, Homo sapiens
ctggccactgattcctcccctg

SEQ ID NO: 9339429 - DNA, 22 bp, Homo sapiens
ctggcaggctctctggtcggtt

SEQ ID NO: 9339430 - DNA, 22 bp, Homo sapiens
ctggcaggctctctggtcggtt

SEQ ID NO: 9339431 - DNA, 22 bp, Homo sapiens
ctggcaggcggaggttgcagtg

SEQ ID NO: 9339432 - DNA, 22 bp, Homo sapiens
ctggcaggcggaggttgcagtg

SEQ ID NO: 9339433 - DNA, 22 bp, Homo sapiens
ctggcaggcggcagagcccagg

SEQ ID NO: 9339434 - DNA, 22 bp, Homo sapiens
ctggcaggcggcagagcccagg

SEQ ID NO: 9339435 - DNA, 22 bp, Homo sapiens
ctggcaggcggaggttgcagtg

SEQ ID NO: 9339436 - DNA, 22 bp, Homo sapiens
ctggcaggcggaggttgcagtg

SEQ ID NO: 9339437 - DNA, 22 bp, Homo sapiens
ctggcaggcaaattggtgggag

SEQ ID NO: 9339438 - DNA, 22 bp, Homo sapiens
ctggcaggcaaattggtgggag

SEQ ID NO: 9339439 - DNA, 22 bp, Homo sapiens
ctggcaggcagacttctgcaag

SEQ ID NO: 9339440 - DNA, 22 bp, Homo sapiens
ctggcaggcagacttctgcaag

SEQ ID NO: 9339441 - DNA, 22 bp, Homo sapiens
ctggcaggcactcatgaaataa

SEQ ID NO: 9339442 - DNA, 22 bp, Homo sapiens
ctggcaggatctaaccagggaa

SEQ ID NO: 9339443 - DNA, 22 bp, Homo sapiens
ctggcaggatctaaccagggaa

SEQ ID NO: 9339444 - DNA, 22 bp, Homo sapiens
ctggcaggatctaaccagggaa

SEQ ID NO: 9339445 - DNA, 22 bp, Homo sapiens
ctggcaggcaaattggtgggag

SEQ ID NO: 9339446 - DNA, 22 bp, Homo sapiens
ctggcaggcaaattggtgggag

SEQ ID NO: 9339447 - DNA, 22 bp, Homo sapiens
ctggcaggcaaattggtgggag

SEQ ID NO: 9339448 - DNA, 22 bp, Homo sapiens
ctggcaggagctgtggccgtag

SEQ ID NO: 9339449 - DNA, 22 bp, Homo sapiens
ctggcaggagctgtggccgtag

SEQ ID NO: 9339450 - DNA, 22 bp, Homo sapiens
ctggcaggagttgggattttga

SEQ ID NO: 9339451 - DNA, 22 bp, Homo sapiens
ctggcaggatctaaccagggaa

SEQ ID NO: 9339452 - DNA, 22 bp, Homo sapiens
ctggcaggagttgggattttga

SEQ ID NO: 9339453 - DNA, 20 bp, Homo sapiens
ctggcaggagcgagtctacc

SEQ ID NO: 9339454 - DNA, 20 bp, Homo sapiens
ctggcaggagcgagtctacc

SEQ ID NO: 9339455 - DNA, 22 bp, Homo sapiens
ctggcagcttcctttgcatctg

SEQ ID NO: 9339456 - DNA, 22 bp, Homo sapiens
ctggcaggaagaggaaaggtca

SEQ ID NO: 9339457 - DNA, 22 bp, Homo sapiens
ctggcaggaagaggaaaggtca

SEQ ID NO: 9339458 - DNA, 22 bp, Homo sapiens
ctggcagcttcctttgcatctg

SEQ ID NO: 9339459 - DNA, 19 bp, Homo sapiens
ctggcagcctgtctgtgtc

SEQ ID NO: 9339460 - DNA, 22 bp, Homo sapiens
ctggcagcttcaggacactcgg

SEQ ID NO: 9339461 - DNA, 22 bp, Homo sapiens
ctggcagcttcaggacactcgg

SEQ ID NO: 9339462 - DNA, 22 bp, Homo sapiens
ctggcagcttcaggacactcgg

SEQ ID NO: 9339463 - DNA, 19 bp, Homo sapiens
ctggcagcctgtctgtgtc

SEQ ID NO: 9339464 - DNA, 22 bp, Homo sapiens
ctggcagcccaacctagagtct

SEQ ID NO: 9339465 - DNA, 22 bp, Homo sapiens
ctggcagcccaacctagagtct

SEQ ID NO: 9339466 - DNA, 22 bp, Homo sapiens
ctggcaggaaggcatttagaca

SEQ ID NO: 9339467 - DNA, 22 bp, Homo sapiens
ctggcaggaagttagatggtaa

SEQ ID NO: 9339468 - DNA, 22 bp, Homo sapiens
ctggcaggaagaggaaaggtca

SEQ ID NO: 9339469 - DNA, 22 bp, Homo sapiens
ctggcaggaagaggaaaggtca

SEQ ID NO: 9339470 - DNA, 22 bp, Homo sapiens
ctggcaggaagttagatggtaa

SEQ ID NO: 9339471 - DNA, 22 bp, Homo sapiens
ctggcaggaagttagatggtaa

SEQ ID NO: 9339472 - DNA, 22 bp, Homo sapiens
ctggcaggagcattcacagagg

SEQ ID NO: 9339473 - DNA, 22 bp, Homo sapiens
ctggcaggagcattcacagagg

SEQ ID NO: 9339474 - DNA, 22 bp, Homo sapiens
ctggcaggaagttagatggtaa

SEQ ID NO: 9339475 - DNA, 22 bp, Homo sapiens
ctggcagcatttttttcagaag

SEQ ID NO: 9339476 - DNA, 22 bp, Homo sapiens
ctggcagcccaacctagagtct

SEQ ID NO: 9339477 - DNA, 22 bp, Homo sapiens
ctggcagccaagtgggatactc

SEQ ID NO: 9339478 - DNA, 22 bp, Homo sapiens
ctggcagccaagtgggatactc

SEQ ID NO: 9339479 - DNA, 22 bp, Homo sapiens
ctgccagctcaaagcgcagcta

SEQ ID NO: 9339480 - DNA, 22 bp, Homo sapiens
ctgccagcagaggccagcgctg

SEQ ID NO: 9339481 - DNA, 22 bp, Homo sapiens
ctgccagcagaggccagcgctg

SEQ ID NO: 9339482 - DNA, 22 bp, Homo sapiens
ctgccagccaggccaggtaggc

SEQ ID NO: 9339483 - DNA, 22 bp, Homo sapiens
ctgccagccaggccaggtaggc

SEQ ID NO: 9339484 - DNA, 22 bp, Homo sapiens
ctgccagctagctcctagttga

SEQ ID NO: 9339485 - DNA, 22 bp, Homo sapiens
ctgccagcactgcctcctgagg

SEQ ID NO: 9339486 - DNA, 22 bp, Homo sapiens
ctgccagcagaggccagcgctg

SEQ ID NO: 9339487 - DNA, 22 bp, Homo sapiens
ctgccagcactgcctcctgagg

SEQ ID NO: 9339488 - DNA, 22 bp, Homo sapiens
ctgccagcaagctaccctggca

SEQ ID NO: 9339489 - DNA, 22 bp, Homo sapiens
ctgccaccatgccccagcagag

SEQ ID NO: 9339490 - DNA, 22 bp, Homo sapiens
ctgccaccatgccccagcagag

SEQ ID NO: 9339491 - DNA, 22 bp, Homo sapiens
ctgccaccaaatagctgcatga

SEQ ID NO: 9339492 - DNA, 22 bp, Homo sapiens
ctgccaagtaatgcctgggctc

SEQ ID NO: 9339493 - DNA, 22 bp, Homo sapiens
ctgccacaagctggccctgtgt

SEQ ID NO: 9339494 - DNA, 22 bp, Homo sapiens
ctgccacaggggagcaggcaga

SEQ ID NO: 9339495 - DNA, 22 bp, Homo sapiens
ctgccacaggggagcaggcaga

SEQ ID NO: 9339496 - DNA, 22 bp, Homo sapiens
ctgcatccatgttgctgcaaag

SEQ ID NO: 9339497 - DNA, 22 bp, Homo sapiens
ctgccaaggctggggaggacaa

SEQ ID NO: 9339498 - DNA, 22 bp, Homo sapiens
ctgcatccatctcctagcacag

SEQ ID NO: 9339499 - DNA, 21 bp, Homo sapiens
ctgccacctgctccatcagca

SEQ ID NO: 9339500 - DNA, 22 bp, Homo sapiens
ctgccactttcacccagtgctc

SEQ ID NO: 9339501 - DNA, 22 bp, Homo sapiens
ctgccactttcacccagtgctc

SEQ ID NO: 9339502 - DNA, 22 bp, Homo sapiens
ctgccactttcacccagtgctc

SEQ ID NO: 9339503 - DNA, 22 bp, Homo sapiens
ctgccagacacgttatgctcat

SEQ ID NO: 9339504 - DNA, 22 bp, Homo sapiens
ctgccagagtacttgtaagaat

SEQ ID NO: 9339505 - DNA, 22 bp, Homo sapiens
ctgccagcaagctaccctggca

SEQ ID NO: 9339506 - DNA, 22 bp, Homo sapiens
ctgccagaagagaacaccagtt

SEQ ID NO: 9339507 - DNA, 22 bp, Homo sapiens
ctgccagaagagaacaccagtt

SEQ ID NO: 9339508 - DNA, 22 bp, Homo sapiens
ctgccagaaggttcctgctgca

SEQ ID NO: 9339509 - DNA, 22 bp, Homo sapiens
ctgccagaagagaacaccagtt

SEQ ID NO: 9339510 - DNA, 22 bp, Homo sapiens
ctgtggccccaccctcttggcc

SEQ ID NO: 9339511 - DNA, 22 bp, Homo sapiens
ctgtggctcaggcctgtaagcc

SEQ ID NO: 9339512 - DNA, 22 bp, Homo sapiens
ctgtggccagatggtgccagtt

SEQ ID NO: 9339513 - DNA, 22 bp, Homo sapiens
ctgtggccagatggtgccagtt

SEQ ID NO: 9339514 - DNA, 17 bp, Homo sapiens
ctgtggccacctggatg

SEQ ID NO: 9339515 - DNA, 22 bp, Homo sapiens
ctgtgcccataatctggtattt

SEQ ID NO: 9339516 - DNA, 23 bp, Homo sapiens
ctgtgcccggggctccacctgat

SEQ ID NO: 9339517 - DNA, 19 bp, Homo sapiens
ctgtgccctatgacttgta

SEQ ID NO: 9339518 - DNA, 22 bp, Homo sapiens
ctgtgccctctttgctggcctt

SEQ ID NO: 9339519 - DNA, 22 bp, Homo sapiens
ctgtgccaggcccgggtgggtg

SEQ ID NO: 9339520 - DNA, 22 bp, Homo sapiens
ctgtgccatctgcactctcgtc

SEQ ID NO: 9339521 - DNA, 22 bp, Homo sapiens
ctgtgccatcctagggctgctg

SEQ ID NO: 9339522 - DNA, 22 bp, Homo sapiens
ctgtgcccaggctggagtgcag

SEQ ID NO: 9339523 - DNA, 22 bp, Homo sapiens
ctgtgcccagctccctgactgc

SEQ ID NO: 9339524 - DNA, 22 bp, Homo sapiens
ctgtgcccacctggctctgagg

SEQ ID NO: 9339525 - DNA, 22 bp, Homo sapiens
ctgtgccattctttgtagcatg

SEQ ID NO: 9339526 - DNA, 22 bp, Homo sapiens
ctgtgcagtgtggggtaggcct

SEQ ID NO: 9339527 - DNA, 22 bp, Homo sapiens
ctgtgcagtgtggggtaggcct

SEQ ID NO: 9339528 - DNA, 22 bp, Homo sapiens
ctgtgcatggcagatgctgtta

SEQ ID NO: 9339529 - DNA, 22 bp, Homo sapiens
ctgtgcatgcgcggagctgaaa

SEQ ID NO: 9339530 - DNA, 22 bp, Homo sapiens
ctgtgcattgtcttgtctgtag

SEQ ID NO: 9339531 - DNA, 22 bp, Homo sapiens
ctgtgccaggcccagctgactt

SEQ ID NO: 9339532 - DNA, 22 bp, Homo sapiens
ctgtgccagagggtgaccaagg

SEQ ID NO: 9339533 - DNA, 22 bp, Homo sapiens
ctgtgccactgccccaggcctc

SEQ ID NO: 9339534 - DNA, 22 bp, Homo sapiens
ctgtgcagtggcagcgtgtggg

SEQ ID NO: 9339535 - DNA, 22 bp, Homo sapiens
ctgtgcagtccagccctggaca

SEQ ID NO: 9339536 - DNA, 22 bp, Homo sapiens
ctgtgcagtggcagcgtgtggg

SEQ ID NO: 9339537 - DNA, 22 bp, Homo sapiens
ctgtgagtcttcagcaagtgtt

SEQ ID NO: 9339538 - DNA, 22 bp, Homo sapiens
ctgtgcagtaggtcagggctgg

SEQ ID NO: 9339539 - DNA, 22 bp, Homo sapiens
ctgtgagggccagagtcagggc

SEQ ID NO: 9339540 - DNA, 22 bp, Homo sapiens
ctgtcctgtggacctgaggacg

SEQ ID NO: 9339541 - DNA, 22 bp, Homo sapiens
ctgtcctgtgcattgtcagatg

SEQ ID NO: 9339542 - DNA, 22 bp, Homo sapiens
ctgtcctgtggacctgaggacg

SEQ ID NO: 9339543 - DNA, 22 bp, Homo sapiens
ctgtcctgtgctttttactgtc

SEQ ID NO: 9339544 - DNA, 22 bp, Homo sapiens
ctgtcctgtctgcttttaattt

SEQ ID NO: 9339545 - DNA, 22 bp, Homo sapiens
ctgtcctgtagctccatcagtc

SEQ ID NO: 9339546 - DNA, 23 bp, Homo sapiens
ctgtcctgtagttcacgttggcc

SEQ ID NO: 9339547 - DNA, 22 bp, Homo sapiens
ctgtcctgaagttttcatgaga

SEQ ID NO: 9339548 - DNA, 22 bp, Homo sapiens
ctgtcctctgtcctcagcagga

SEQ ID NO: 9339549 - DNA, 22 bp, Homo sapiens
ctgtcctgaaagggagattggg

SEQ ID NO: 9339550 - DNA, 22 bp, Homo sapiens
ctgtcccttcattattcactac

SEQ ID NO: 9339551 - DNA, 22 bp, Homo sapiens
ctgtcccttcattattcactac

SEQ ID NO: 9339552 - DNA, 22 bp, Homo sapiens
ctgtcccttcattattcactac

SEQ ID NO: 9339553 - DNA, 22 bp, Homo sapiens
ctgtccctgagcaactcctgtt

SEQ ID NO: 9339554 - DNA, 22 bp, Homo sapiens
ctgggtgctgtgggctcagagg

SEQ ID NO: 9339555 - DNA, 22 bp, Homo sapiens
ctgtccctgagcaactcctgtt

SEQ ID NO: 9339556 - DNA, 22 bp, Homo sapiens
ctgtccctgagcaactcctgtt

SEQ ID NO: 9339557 - DNA, 22 bp, Homo sapiens
ctgggtgcgtgagcgcatgcgt

SEQ ID NO: 9339558 - DNA, 22 bp, Homo sapiens
ctgggtgcgtgagcgcatgcgt

SEQ ID NO: 9339559 - DNA, 22 bp, Homo sapiens
ctgggtgccagcatggctgagt

SEQ ID NO: 9339560 - DNA, 22 bp, Homo sapiens
ctgggtgccagcatggctgagt

SEQ ID NO: 9339561 - DNA, 22 bp, Homo sapiens
ctgggtgccacgggcaccctgg

SEQ ID NO: 9339562 - DNA, 22 bp, Homo sapiens
ctgggtgccacgggcaccctgg

SEQ ID NO: 9339563 - DNA, 22 bp, Homo sapiens
ctgggtgccagcatggctgagt

SEQ ID NO: 9339564 - DNA, 22 bp, Homo sapiens
ctgggtgagttgatgaaggaga

SEQ ID NO: 9339565 - DNA, 22 bp, Homo sapiens
ctgggtgattcctgtccaggca

SEQ ID NO: 9339566 - DNA, 22 bp, Homo sapiens
ctgggtgagtataggaaaggga

SEQ ID NO: 9339567 - DNA, 22 bp, Homo sapiens
ctgggtgagttgatgaaggaga

SEQ ID NO: 9339568 - DNA, 22 bp, Homo sapiens
ctgggtgacagagtgagatggt

SEQ ID NO: 9339569 - DNA, 22 bp, Homo sapiens
ctgggtgaatttgaaggaaagg

SEQ ID NO: 9339570 - DNA, 22 bp, Homo sapiens
ctgggtcttcagcagcaggcgg

SEQ ID NO: 9339571 - DNA, 22 bp, Homo sapiens
ctgggtctgtgcccagggacct

SEQ ID NO: 9339572 - DNA, 22 bp, Homo sapiens
ctgggtctgtgcccagggacct

SEQ ID NO: 9339573 - DNA, 22 bp, Homo sapiens
ctgggtctgtgcccagggacct

SEQ ID NO: 9339574 - DNA, 19 bp, Homo sapiens
ctgggtcttattctgtgaa

SEQ ID NO: 9339575 - DNA, 22 bp, Homo sapiens
ctgggtcttcagcagcaggcgg

SEQ ID NO: 9339576 - DNA, 19 bp, Homo sapiens
ctgtcctggtttggtccct

SEQ ID NO: 9339577 - DNA, 22 bp, Homo sapiens
ctgtcctggtgctggggatccc

SEQ ID NO: 9339578 - DNA, 21 bp, Homo sapiens
ctgtcctggtctagaggcaca

SEQ ID NO: 9339579 - DNA, 22 bp, Homo sapiens
ctgtcctgtactttgaggccct

SEQ ID NO: 9339580 - DNA, 22 bp, Homo sapiens
ctgtcctggagggcataggacg

SEQ ID NO: 9339581 - DNA, 22 bp, Homo sapiens
ctgtcctggccgcccttgtgag

SEQ ID NO: 9339582 - DNA, 22 bp, Homo sapiens
ctgtcctggggaaagccagccc

SEQ ID NO: 9339583 - DNA, 22 bp, Homo sapiens
ctgtcctggccgcccttgtgag

SEQ ID NO: 9339584 - DNA, 22 bp, Homo sapiens
ctgtcctggtactttgaggttc

SEQ ID NO: 9339585 - DNA, 22 bp, Homo sapiens
ctgtcctgggggtggtccttgc

SEQ ID NO: 9339586 - DNA, 22 bp, Homo sapiens
ctgtcctgcccaccctgcaggg

SEQ ID NO: 9339587 - DNA, 23 bp, Homo sapiens
ctgtcctgccatccacagcggcc

SEQ ID NO: 9339588 - DNA, 22 bp, Homo sapiens
ctgtcctgccagtcctggactc

SEQ ID NO: 9339589 - DNA, 22 bp, Homo sapiens
ctgtcctgccagtcctggactc

SEQ ID NO: 9339590 - DNA, 22 bp, Homo sapiens
ctgtcctgcagttgggggcagg

SEQ ID NO: 9339591 - DNA, 22 bp, Homo sapiens
ctgtcctgagttcttggaggtc

SEQ ID NO: 9339592 - DNA, 20 bp, Homo sapiens
ctgtcctgatcttttcagaa

SEQ ID NO: 9339593 - DNA, 22 bp, Homo sapiens
ctgtcctgagataaagatgagg

SEQ ID NO: 9339594 - DNA, 22 bp, Homo sapiens
ctgtcctgaggcaggtggcctg

SEQ ID NO: 9339595 - DNA, 22 bp, Homo sapiens
ctgtcctgatggtgccactggt

SEQ ID NO: 9339596 - DNA, 20 bp, Homo sapiens
ctgtggctcatgcatctgcc

SEQ ID NO: 9339597 - DNA, 22 bp, Homo sapiens
ctgtggctctcagaggctgctg

SEQ ID NO: 9339598 - DNA, 22 bp, Homo sapiens
ctgtggctctctgcagggtccc

SEQ ID NO: 9339599 - DNA, 22 bp, Homo sapiens
ctgtggctgcgtaggtctggca

SEQ ID NO: 9339600 - DNA, 22 bp, Homo sapiens
ctgtggctctttagttgagcac

SEQ ID NO: 9339601 - DNA, 22 bp, Homo sapiens
ctgtgtcctgcgtcaagccaat

SEQ ID NO: 9339602 - DNA, 22 bp, Homo sapiens
ctgtgtcctttaaaaaagacac

SEQ ID NO: 9339603 - DNA, 22 bp, Homo sapiens
ctgtgtcctgtctcctaaggtg

SEQ ID NO: 9339604 - DNA, 22 bp, Homo sapiens
ctgtgtcctgtctcctaaggtg

SEQ ID NO: 9339605 - DNA, 22 bp, Homo sapiens
ctgtgtcctcccgctgcaccca

SEQ ID NO: 9339606 - DNA, 22 bp, Homo sapiens
ctgtgtcctccccatcacttct

SEQ ID NO: 9339607 - DNA, 22 bp, Homo sapiens
ctgtgtcctcccgctgcaccca

SEQ ID NO: 9339608 - DNA, 22 bp, Homo sapiens
ctgtgtccttttagttgctgtg

SEQ ID NO: 9339609 - DNA, 22 bp, Homo sapiens
ctgtgtctaatcaggtcagtca

SEQ ID NO: 9339610 - DNA, 22 bp, Homo sapiens
ctgtgtctaatcaggtcagtca

SEQ ID NO: 9339611 - DNA, 22 bp, Homo sapiens
ctgtgtagagcggctgcgagcg

SEQ ID NO: 9339612 - DNA, 22 bp, Homo sapiens
ctgtgtagcctcatgtgggctt

SEQ ID NO: 9339613 - DNA, 22 bp, Homo sapiens
ctgtggctgtatttggccagag

SEQ ID NO: 9339614 - DNA, 23 bp, Homo sapiens
ctgttaaattccttaagagcagg

SEQ ID NO: 9339615 - DNA, 22 bp, Homo sapiens
ctgtgtctgcctgggatccatt

SEQ ID NO: 9339616 - DNA, 22 bp, Homo sapiens
ctgtgtcttcacatttgtgtgc

SEQ ID NO: 9339617 - DNA, 22 bp, Homo sapiens
ctgtgtcttcacatttgtgtgc

SEQ ID NO: 9339618 - DNA, 22 bp, Homo sapiens
ctgtgtcttcaatgtactggga

SEQ ID NO: 9339619 - DNA, 22 bp, Homo sapiens
ctgtgtcttcaatgtactggga

SEQ ID NO: 9339620 - DNA, 22 bp, Homo sapiens
ctgtgtctcatccgcctctggc

SEQ ID NO: 9339621 - DNA, 22 bp, Homo sapiens
ctgtgtctccttggtgggatat

SEQ ID NO: 9339622 - DNA, 22 bp, Homo sapiens
ctgtgtctccttggtgggatat

SEQ ID NO: 9339623 - DNA, 22 bp, Homo sapiens
ctgtgtctctccttacaagact

SEQ ID NO: 9339624 - DNA, 22 bp, Homo sapiens
ctgtgtctgaataactctgtgt

SEQ ID NO: 9339625 - DNA, 21 bp, Homo sapiens
ctgttcactgtgctgtgcaaa

SEQ ID NO: 9339626 - DNA, 22 bp, Homo sapiens
ctgttcagaaaaaatcttcatg

SEQ ID NO: 9339627 - DNA, 17 bp, Homo sapiens
ctgttccccactactca

SEQ ID NO: 9339628 - DNA, 22 bp, Homo sapiens
ctgttctatcattaaaagctat

SEQ ID NO: 9339629 - DNA, 22 bp, Homo sapiens
ctgttctctggcggtggctgtt

SEQ ID NO: 9339630 - DNA, 22 bp, Homo sapiens
ctgttctctggcggtggctgtt

SEQ ID NO: 9339631 - DNA, 22 bp, Homo sapiens
ctgttctggagacactgatgaa

SEQ ID NO: 9339632 - DNA, 18 bp, Homo sapiens
ctgttgagatgtggctga

SEQ ID NO: 9339633 - DNA, 18 bp, Homo sapiens
ctgttgagatgtggctga

SEQ ID NO: 9339634 - DNA, 22 bp, Homo sapiens
ctgttcttctagtccactgaca

SEQ ID NO: 9339635 - DNA, 22 bp, Homo sapiens
cttgccagtgttgcagaagctc

SEQ ID NO: 9339636 - DNA, 22 bp, Homo sapiens
cttgggtgctcagggaaagctt

SEQ ID NO: 9339637 - DNA, 22 bp, Homo sapiens
cttgggtgctggaggctgccgc

SEQ ID NO: 9339638 - DNA, 22 bp, Homo sapiens
cttgcctaacaaattccccctt

SEQ ID NO: 9339639 - DNA, 22 bp, Homo sapiens
cttgccatctaaccagactgcc

SEQ ID NO: 9339640 - DNA, 22 bp, Homo sapiens
cttgtatacagtgtacacattg

SEQ ID NO: 9339641 - DNA, 22 bp, Homo sapiens
cttgtacatgataatctcactc

SEQ ID NO: 9339642 - DNA, 22 bp, Homo sapiens
cttgtagaattgaaatggtctc

SEQ ID NO: 9339643 - DNA, 22 bp, Homo sapiens
cttgtacactcagtacttctag

SEQ ID NO: 9339644 - DNA, 22 bp, Homo sapiens
cttgggtgtgaccttggcattg

SEQ ID NO: 9339645 - DNA, 22 bp, Homo sapiens
cttgggtgctggaggctgccgc

SEQ ID NO: 9339646 - DNA, 20 bp, Homo sapiens
cttgtacatgataaagattt

SEQ ID NO: 9339647 - DNA, 22 bp, Homo sapiens
cttgtcagcactttgccgaaaa

SEQ ID NO: 9339648 - DNA, 22 bp, Homo sapiens
cttgtattcagcatcttaacta

SEQ ID NO: 9339649 - DNA, 22 bp, Homo sapiens
cttgtctgtgtcggataaaact

SEQ ID NO: 9339650 - DNA, 22 bp, Homo sapiens
cttgtcctttacttgagactca

SEQ ID NO: 9339651 - DNA, 21 bp, Homo sapiens
cttgtctgcagtgtttatagc

SEQ ID NO: 9339652 - DNA, 22 bp, Homo sapiens
cttgtcagtgtactttcttttg

SEQ ID NO: 9339653 - DNA, 22 bp, Homo sapiens
cttgtccagatgtttgttaggt

SEQ ID NO: 9339654 - DNA, 22 bp, Homo sapiens
cttgtcagccaattgtggattt

SEQ ID NO: 9339655 - DNA, 22 bp, Homo sapiens
cttgatgagtcagaactgaagg

SEQ ID NO: 9339656 - DNA, 22 bp, Homo sapiens
cttgatgatagcaggcagggaa

SEQ ID NO: 9339657 - DNA, 22 bp, Homo sapiens
cttgactttgccttttaaatgt

SEQ ID NO: 9339658 - DNA, 22 bp, Homo sapiens
cttgcacaaagtcacctagtca

SEQ ID NO: 9339659 - DNA, 22 bp, Homo sapiens
cttgcacacgtgtatgtacatg

SEQ ID NO: 9339660 - DNA, 22 bp, Homo sapiens
cttgatttattacccactatat

SEQ ID NO: 9339661 - DNA, 22 bp, Homo sapiens
cttgatgtataagttgatatgt

SEQ ID NO: 9339662 - DNA, 22 bp, Homo sapiens
cttgatgtataagttgatatgt

SEQ ID NO: 9339663 - DNA, 22 bp, Homo sapiens
cttgcacatttcacacaatagg

SEQ ID NO: 9339664 - DNA, 23 bp, Homo sapiens
cttgcaggaagcagatggcacac

SEQ ID NO: 9339665 - DNA, 22 bp, Homo sapiens
cttgcaggcagggcctcctgga

SEQ ID NO: 9339666 - DNA, 22 bp, Homo sapiens
cttgcagggctgatgggaagtg

SEQ ID NO: 9339667 - DNA, 22 bp, Homo sapiens
cttgcagggctgatgggaagtg

SEQ ID NO: 9339668 - DNA, 22 bp, Homo sapiens
cttgcaggctacatggaacctg

SEQ ID NO: 9339669 - DNA, 22 bp, Homo sapiens
cttgcaggcctttctagctcta

SEQ ID NO: 9339670 - DNA, 22 bp, Homo sapiens
cttcctgggacacctaactcta

SEQ ID NO: 9339671 - DNA, 22 bp, Homo sapiens
cttcctggccattgccatggca

SEQ ID NO: 9339672 - DNA, 22 bp, Homo sapiens
cttcctggcatgggtctcatga

SEQ ID NO: 9339673 - DNA, 22 bp, Homo sapiens
cttcctggccattgccatggca

SEQ ID NO: 9339674 - DNA, 22 bp, Homo sapiens
cttcctggctcggtgcctcacc

SEQ ID NO: 9339675 - DNA, 22 bp, Homo sapiens
cttgacactgtcactcaggcca

SEQ ID NO: 9339676 - DNA, 22 bp, Homo sapiens
cttcctggatgagcaggctgat

SEQ ID NO: 9339677 - DNA, 22 bp, Homo sapiens
cttcctggatgaagcccagcat

SEQ ID NO: 9339678 - DNA, 22 bp, Homo sapiens
cttcctggatgagcaggctgat

SEQ ID NO: 9339679 - DNA, 22 bp, Homo sapiens
cttcctgctcccctgccaattc

SEQ ID NO: 9339680 - DNA, 22 bp, Homo sapiens
cttcctggatgaagcccagcat

SEQ ID NO: 9339681 - DNA, 22 bp, Homo sapiens
cttcctgcaggacagccatctg

SEQ ID NO: 9339682 - DNA, 22 bp, Homo sapiens
cttcctgcaacacctgtgttgc

SEQ ID NO: 9339683 - DNA, 22 bp, Homo sapiens
cttcctgcattgtgccagagtt

SEQ ID NO: 9339684 - DNA, 22 bp, Homo sapiens
cttcctgcattgtgccagagtt

SEQ ID NO: 9339685 - DNA, 22 bp, Homo sapiens
cttcctgcccacttcctgctgg

SEQ ID NO: 9339686 - DNA, 22 bp, Homo sapiens
cttcctgcattgtgccagagtt

SEQ ID NO: 9339687 - DNA, 22 bp, Homo sapiens
cttcctgcccacttcctgctgg

SEQ ID NO: 9339688 - DNA, 22 bp, Homo sapiens
cttcctgcccacttcctgctgg

SEQ ID NO: 9339689 - DNA, 22 bp, Homo sapiens
cttcagccagctggggatgcgg

SEQ ID NO: 9339690 - DNA, 22 bp, Homo sapiens
cttcagccctgagtgccagcag

SEQ ID NO: 9339691 - DNA, 22 bp, Homo sapiens
cttcagaagaaaagcagtgtgt

SEQ ID NO: 9339692 - DNA, 22 bp, Homo sapiens
cttcagaagaaaagcagtgtgt

SEQ ID NO: 9339693 - DNA, 22 bp, Homo sapiens
cttattttgctgatgacccagg

SEQ ID NO: 9339694 - DNA, 22 bp, Homo sapiens
cttattttgctgatgacccagg

SEQ ID NO: 9339695 - DNA, 22 bp, Homo sapiens
cttattttgctgatgacccagg

SEQ ID NO: 9339696 - DNA, 22 bp, Homo sapiens
cttattttgctgatgacccagg

SEQ ID NO: 9339697 - DNA, 22 bp, Homo sapiens
cttattttgctgatgacccagg

SEQ ID NO: 9339698 - DNA, 22 bp, Homo sapiens
cttattttaagtcagtttgggt

SEQ ID NO: 9339699 - DNA, 22 bp, Homo sapiens
cttattttgctgatgacccagg

SEQ ID NO: 9339700 - DNA, 22 bp, Homo sapiens
cttattttaagtcagtttgggt

SEQ ID NO: 9339701 - DNA, 22 bp, Homo sapiens
cttatttcctgacatggaaaga

SEQ ID NO: 9339702 - DNA, 22 bp, Homo sapiens
cttatttcagccctgggcaccc

SEQ ID NO: 9339703 - DNA, 22 bp, Homo sapiens
cttatttatgtctgtctctaat

SEQ ID NO: 9339704 - DNA, 22 bp, Homo sapiens
cttatttactgatccacagatg

SEQ ID NO: 9339705 - DNA, 22 bp, Homo sapiens
cttatttactgatccacagatg

SEQ ID NO: 9339706 - DNA, 19 bp, Homo sapiens
cttatttctggttttgggt

SEQ ID NO: 9339707 - DNA, 19 bp, Homo sapiens
cttatttctggttttgggt

SEQ ID NO: 9339708 - DNA, 22 bp, Homo sapiens
cttatttctccatccagagtca

SEQ ID NO: 9339709 - DNA, 22 bp, Homo sapiens
cttatttcctgacatggaaaga

SEQ ID NO: 9339710 - DNA, 22 bp, Homo sapiens
cttatttcagccctgggcaccc

SEQ ID NO: 9339711 - DNA, 22 bp, Homo sapiens
cttatttatgtctgtctctaat

SEQ ID NO: 9339712 - DNA, 22 bp, Homo sapiens
cttatttctccatccagagtca

SEQ ID NO: 9339713 - DNA, 22 bp, Homo sapiens
cttatttaatgagggttagaat

SEQ ID NO: 9339714 - DNA, 22 bp, Homo sapiens
cttattggagagttgggccctt

SEQ ID NO: 9339715 - DNA, 22 bp, Homo sapiens
cttattgaaagcccctgtgcct

SEQ ID NO: 9339716 - DNA, 22 bp, Homo sapiens
cttattggtggagtcaggccct

SEQ ID NO: 9339717 - DNA, 22 bp, Homo sapiens
cttattggtgctttttctcata

SEQ ID NO: 9339718 - DNA, 22 bp, Homo sapiens
cttattggtcccaggaggagaa

SEQ ID NO: 9339719 - DNA, 22 bp, Homo sapiens
cttattgggatgagaggatgca

SEQ ID NO: 9339720 - DNA, 22 bp, Homo sapiens
ctgttgttcatcatctgtcatt

SEQ ID NO: 9339721 - DNA, 22 bp, Homo sapiens
cttatcagattatctgggctgt

SEQ ID NO: 9339722 - DNA, 22 bp, Homo sapiens
cttatcagattatctgggctgt

SEQ ID NO: 9339723 - DNA, 22 bp, Homo sapiens
ctgttgttccgggagctgcagc

SEQ ID NO: 9339724 - DNA, 22 bp, Homo sapiens
ctgttgtttgctagtgtactct

SEQ ID NO: 9339725 - DNA, 22 bp, Homo sapiens
cttatattttaggaacagacaa

SEQ ID NO: 9339726 - DNA, 22 bp, Homo sapiens
cttatattttaggaacagacaa

SEQ ID NO: 9339727 - DNA, 19 bp, Homo sapiens
cttcagtgttcacctggcc

SEQ ID NO: 9339728 - DNA, 22 bp, Homo sapiens
cttcagtgttcccatctgtaaa

SEQ ID NO: 9339729 - DNA, 22 bp, Homo sapiens
cttccctttctggtgacttctc

SEQ ID NO: 9339730 - DNA, 22 bp, Homo sapiens
cttccctttttatgtcttcagc

SEQ ID NO: 9339731 - DNA, 23 bp, Homo sapiens
cttcagtgtgggactgcagcgtg

SEQ ID NO: 9339732 - DNA, 22 bp, Homo sapiens
cttcagtgtcctctctagtaga

SEQ ID NO: 9339733 - DNA, 22 bp, Homo sapiens
cttcagtggtcatttgtgataa

SEQ ID NO: 9339734 - DNA, 18 bp, Homo sapiens
cttcagtggctgctctgc

SEQ ID NO: 9339735 - DNA, 22 bp, Homo sapiens
cttcctctgcctcccgtgctca

SEQ ID NO: 9339736 - DNA, 22 bp, Homo sapiens
cttcctctgcctcccgtgctca

SEQ ID NO: 9339737 - DNA, 22 bp, Homo sapiens
cttcctctgcggcgccgggcgc

SEQ ID NO: 9339738 - DNA, 22 bp, Homo sapiens
cttcctctgaggcttctgagtc

SEQ ID NO: 9339739 - DNA, 22 bp, Homo sapiens
cttcctctgcctcccgtgctca

SEQ ID NO: 9339740 - DNA, 22 bp, Homo sapiens
cttcctaaaagcttcaagagaa

SEQ ID NO: 9339741 - DNA, 22 bp, Homo sapiens
cttcctgaaggatggcagcctc

SEQ ID NO: 9339742 - DNA, 22 bp, Homo sapiens
cttcctgaaatgtctcaccagt

SEQ ID NO: 9339743 - DNA, 22 bp, Homo sapiens
cttcctctgtggccagagtgta

SEQ ID NO: 9339744 - DNA, 22 bp, Homo sapiens
cttcctctgtgtcctgggcttc

SEQ ID NO: 9339745 - DNA, 22 bp, Homo sapiens
cttcctctgtgtcctgggcttg

SEQ ID NO: 9339746 - DNA, 22 bp, Homo sapiens
cttcagggaggagcatgggttc

SEQ ID NO: 9339747 - DNA, 22 bp, Homo sapiens
cttcagtgatataggcttctcc

SEQ ID NO: 9339748 - DNA, 22 bp, Homo sapiens
cttcagtgcatgtttataatca

SEQ ID NO: 9339749 - DNA, 22 bp, Homo sapiens
cttcagtgattgcagaaagcct

SEQ ID NO: 9339750 - DNA, 22 bp, Homo sapiens
cttcagtgaatgttgagtaagg

SEQ ID NO: 9339751 - DNA, 22 bp, Homo sapiens
cttcagtgacattccttccctc

SEQ ID NO: 9339752 - DNA, 18 bp, Homo sapiens
cttcagtgacagtctggc

SEQ ID NO: 9339753 - DNA, 22 bp, Homo sapiens
cttcagtgacagccacccaggc

SEQ ID NO: 9339754 - DNA, 22 bp, Homo sapiens
cttcagctgcagttatgtttag

SEQ ID NO: 9339755 - DNA, 22 bp, Homo sapiens
cttcagctttcagcttccctga

SEQ ID NO: 9339756 - DNA, 20 bp, Homo sapiens
cttcaggacccatcctcccc

SEQ ID NO: 9339757 - DNA, 22 bp, Homo sapiens
cttcaggattaatttggggcct

SEQ ID NO: 9339758 - DNA, 22 bp, Homo sapiens
cttcagcctcatctcagcccgt

SEQ ID NO: 9339759 - DNA, 22 bp, Homo sapiens
cttcagccctgagtgccagcag

SEQ ID NO: 9339760 - DNA, 22 bp, Homo sapiens
cttcagctgcagttatgtttag

SEQ ID NO: 9339761 - DNA, 22 bp, Homo sapiens
tttcacagtgctctgtaagtat

SEQ ID NO: 9339762 - DNA, 22 bp, Homo sapiens
tttcacagttagcatgaggact

SEQ ID NO: 9339763 - DNA, 22 bp, Homo sapiens
tttcacatagaaagtgatttac

SEQ ID NO: 9339764 - DNA, 22 bp, Homo sapiens
tttcctaaggctcattttaaaa

SEQ ID NO: 9339765 - DNA, 22 bp, Homo sapiens
tttcctaagatagatacttcag

SEQ ID NO: 9339766 - DNA, 22 bp, Homo sapiens
tttcctaactcatcggatgtac

SEQ ID NO: 9339767 - DNA, 20 bp, Homo sapiens
tttccactgtaatgtatgat

SEQ ID NO: 9339768 - DNA, 22 bp, Homo sapiens
tttccactgtagagatgttgaa

SEQ ID NO: 9339769 - DNA, 22 bp, Homo sapiens
tttcctaacacaatgcatgaga

SEQ ID NO: 9339770 - DNA, 22 bp, Homo sapiens
tttcctacccttccaggcagag

SEQ ID NO: 9339771 - DNA, 22 bp, Homo sapiens
tttcctactgccctatacacac

SEQ ID NO: 9339772 - DNA, 22 bp, Homo sapiens
tttcctaatcccaatgacattt

SEQ ID NO: 9339773 - DNA, 20 bp, Homo sapiens
tttcctaagtggtttgctga

SEQ ID NO: 9339774 - DNA, 22 bp, Homo sapiens
tttcctaagggatgcggctcaa

SEQ ID NO: 9339775 - DNA, 22 bp, Homo sapiens
tttcctaaggtagtgataattt

SEQ ID NO: 9339776 - DNA, 22 bp, Homo sapiens
tttcacaggtacaaacactcct

SEQ ID NO: 9339777 - DNA, 22 bp, Homo sapiens
tttcacaggtaagcaatacagg

SEQ ID NO: 9339778 - DNA, 22 bp, Homo sapiens
tttcacaggtaagcaatacagg

SEQ ID NO: 9339779 - DNA, 22 bp, Homo sapiens
tttcacaaatgtctttaacttg

SEQ ID NO: 9339780 - DNA, 21 bp, Homo sapiens
tttcacaaaagtatgtgacaa

SEQ ID NO: 9339781 - DNA, 21 bp, Homo sapiens
tttcacaaaagtatgtgacaa

SEQ ID NO: 9339782 - DNA, 22 bp, Homo sapiens
tttcacaaactgaggagacaat

SEQ ID NO: 9339783 - DNA, 22 bp, Homo sapiens
tttcaattaggatgtttccatg

SEQ ID NO: 9339784 - DNA, 22 bp, Homo sapiens
ctcctggccctgagctcccagg

SEQ ID NO: 9339785 - DNA, 22 bp, Homo sapiens
ctcctggccctgagctcccagg

SEQ ID NO: 9339786 - DNA, 22 bp, Homo sapiens
ctcctggccctgagctcccagg

SEQ ID NO: 9339787 - DNA, 22 bp, Homo sapiens
tttcaaatggagtcgtgaaatg

SEQ ID NO: 9339788 - DNA, 21 bp, Homo sapiens
tttcaatttgccttgagtcat

SEQ ID NO: 9339789 - DNA, 22 bp, Homo sapiens
tttcaatttccaggctagaatt

SEQ ID NO: 9339790 - DNA, 22 bp, Homo sapiens
tttcaatttccaggctagaatt

SEQ ID NO: 9339791 - DNA, 22 bp, Homo sapiens
tttcaattccaccaaagcgccc

SEQ ID NO: 9339792 - DNA, 22 bp, Homo sapiens
tttcaattgactttggaagaaa

SEQ ID NO: 9339793 - DNA, 22 bp, Homo sapiens
ctctccaggttagagcacttat

SEQ ID NO: 9339794 - DNA, 22 bp, Homo sapiens
ctctccagtcatattctcagtc

SEQ ID NO: 9339795 - DNA, 22 bp, Homo sapiens
ctctcctggtgtggaggacagg

SEQ ID NO: 9339796 - DNA, 22 bp, Homo sapiens
ctctcctggtgtggaggacagg

SEQ ID NO: 9339797 - DNA, 22 bp, Homo sapiens
ctctcctggggagcacacacac

SEQ ID NO: 9339798 - DNA, 22 bp, Homo sapiens
ctctccaggggtagatgccttc

SEQ ID NO: 9339799 - DNA, 22 bp, Homo sapiens
ctctccaggcgaggtcctactg

SEQ ID NO: 9339800 - DNA, 22 bp, Homo sapiens
ctctccaggagagcactttgag

SEQ ID NO: 9339801 - DNA, 22 bp, Homo sapiens
ctctctgagtggctgtactttc

SEQ ID NO: 9339802 - DNA, 22 bp, Homo sapiens
ctctctgatgtcaggtcgctga

SEQ ID NO: 9339803 - DNA, 22 bp, Homo sapiens
ctctctgctgtatccttaggct

SEQ ID NO: 9339804 - DNA, 22 bp, Homo sapiens
ctctctgagtggctgtactttc

SEQ ID NO: 9339805 - DNA, 22 bp, Homo sapiens
ctctctgagtgagggacaagct

SEQ ID NO: 9339806 - DNA, 22 bp, Homo sapiens
ctctctggaagggggagctgat

SEQ ID NO: 9339807 - DNA, 22 bp, Homo sapiens
ctctctgctgtatccttaggct

SEQ ID NO: 9339808 - DNA, 22 bp, Homo sapiens
ctctctgctgtatccttaggct

SEQ ID NO: 9339809 - DNA, 22 bp, Homo sapiens
ctctctctttagaagcgtctgg

SEQ ID NO: 9339810 - DNA, 22 bp, Homo sapiens
ctctctgaaactggagagtctc

SEQ ID NO: 9339811 - DNA, 22 bp, Homo sapiens
ctctctctttagaagcgtctgg

SEQ ID NO: 9339812 - DNA, 22 bp, Homo sapiens
ctctctgaggaaggagcatctg

SEQ ID NO: 9339813 - DNA, 22 bp, Homo sapiens
ctctctgaggaaggagcatctg

SEQ ID NO: 9339814 - DNA, 22 bp, Homo sapiens
ctctctcttgtgttgctgcaga

SEQ ID NO: 9339815 - DNA, 22 bp, Homo sapiens
ctctctcttgtgttgctgcaga

SEQ ID NO: 9339816 - DNA, 22 bp, Homo sapiens
ctctctcttgtgttgctgcaga

SEQ ID NO: 9339817 - DNA, 22 bp, Homo sapiens
ctctctcttgtgttgctgcaga

SEQ ID NO: 9339818 - DNA, 17 bp, Homo sapiens
ctctccttcctctgagg

SEQ ID NO: 9339819 - DNA, 22 bp, Homo sapiens
ctctcctggtgtggaggacagg

SEQ ID NO: 9339820 - DNA, 22 bp, Homo sapiens
ctctctctatgcgttgttccta

SEQ ID NO: 9339821 - DNA, 23 bp, Homo sapiens
ctctctctaccatgtgaggacac

SEQ ID NO: 9339822 - DNA, 20 bp, Homo sapiens
ctctctctccattcccaggg

SEQ ID NO: 9339823 - DNA, 22 bp, Homo sapiens
ctctctctatgcgttgttccta

SEQ ID NO: 9339824 - DNA, 20 bp, Homo sapiens
ctctctctccattcccaggg

SEQ ID NO: 9339825 - DNA, 20 bp, Homo sapiens
ctctctctccattcccaggg

SEQ ID NO: 9339826 - DNA, 20 bp, Homo sapiens
ctctctctccattcccaggg

SEQ ID NO: 9339827 - DNA, 22 bp, Homo sapiens
ctctctctatgcgttgttccta

SEQ ID NO: 9339828 - DNA, 22 bp, Homo sapiens
ctcctccagtgggtccctcagg

SEQ ID NO: 9339829 - DNA, 22 bp, Homo sapiens
ctcctccagtgggtccctcagg

SEQ ID NO: 9339830 - DNA, 22 bp, Homo sapiens
ctcctccagtcctccaaggaca

SEQ ID NO: 9339831 - DNA, 22 bp, Homo sapiens
ctcctccagtcctccaaggaca

SEQ ID NO: 9339832 - DNA, 22 bp, Homo sapiens
ctcctccagtgggtccctcagg

SEQ ID NO: 9339833 - DNA, 22 bp, Homo sapiens
ctcctcccaattgccaagtgct

SEQ ID NO: 9339834 - DNA, 22 bp, Homo sapiens
ctcctccagcttccagtggctc

SEQ ID NO: 9339835 - DNA, 22 bp, Homo sapiens
ctcctccagcttccagtggctc

SEQ ID NO: 9339836 - DNA, 22 bp, Homo sapiens
ctcctccagctctccctggggg

SEQ ID NO: 9339837 - DNA, 22 bp, Homo sapiens
ctcctccagctctccctggggg

SEQ ID NO: 9339838 - DNA, 22 bp, Homo sapiens
ctcctccagctctccctggggg

SEQ ID NO: 9339839 - DNA, 22 bp, Homo sapiens
ctcctccacccgctggggccca

SEQ ID NO: 9339840 - DNA, 22 bp, Homo sapiens
tttattgttgttagtcataagt

SEQ ID NO: 9339841 - DNA, 22 bp, Homo sapiens
tttattgtttagaagggggctg

SEQ ID NO: 9339842 - DNA, 22 bp, Homo sapiens
tttattgttgttagtcataagt

SEQ ID NO: 9339843 - DNA, 22 bp, Homo sapiens
tttattgtgttgaaactgaatt

SEQ ID NO: 9339844 - DNA, 22 bp, Homo sapiens
tttattgttgggtcttaagctg

SEQ ID NO: 9339845 - DNA, 22 bp, Homo sapiens
tttattgttatcatgggtgagt

SEQ ID NO: 9339846 - DNA, 22 bp, Homo sapiens
tttatttaccttatgtcctcca

SEQ ID NO: 9339847 - DNA, 22 bp, Homo sapiens
tttatttaccttatgtcctcca

SEQ ID NO: 9339848 - DNA, 22 bp, Homo sapiens
tttatttaaagtcgtgtgttaa

SEQ ID NO: 9339849 - DNA, 22 bp, Homo sapiens
tttatttaaagtcgtgtgttaa

SEQ ID NO: 9339850 - DNA, 22 bp, Homo sapiens
tttatttaaagtcgtgtgttaa

SEQ ID NO: 9339851 - DNA, 22 bp, Homo sapiens
tttatttaaagtcgtgtgttaa

SEQ ID NO: 9339852 - DNA, 22 bp, Homo sapiens
tttatttaaagtcgtgtgttaa

SEQ ID NO: 9339853 - DNA, 22 bp, Homo sapiens
tttatttaaagtcgtgtgttaa

SEQ ID NO: 9339854 - DNA, 22 bp, Homo sapiens
tttatttaccttatgtcctcca

SEQ ID NO: 9339855 - DNA, 22 bp, Homo sapiens
tttatttaccttatgtcctcca

SEQ ID NO: 9339856 - DNA, 22 bp, Homo sapiens
tttatttaccttatgtcctcca

SEQ ID NO: 9339857 - DNA, 22 bp, Homo sapiens
ctcctggatgcaggctgtctgc

SEQ ID NO: 9339858 - DNA, 16 bp, Homo sapiens
tttatttactagtgtt

SEQ ID NO: 9339859 - DNA, 22 bp, Homo sapiens
ctcctggcactcagtgtggaag

SEQ ID NO: 9339860 - DNA, 22 bp, Homo sapiens
ctcctggcactcagtgtggaag

SEQ ID NO: 9339861 - DNA, 22 bp, Homo sapiens
ctcctggatgcaggctgtctgc

SEQ ID NO: 9339862 - DNA, 22 bp, Homo sapiens
ctcctggatgcaggctgtctgc

SEQ ID NO: 9339863 - DNA, 22 bp, Homo sapiens
ctcctggatgcaggctgtctgc

SEQ ID NO: 9339864 - DNA, 22 bp, Homo sapiens
ctcctggcagttccccttgtca

SEQ ID NO: 9339865 - DNA, 22 bp, Homo sapiens
ctcctggcagttccccttgtca

SEQ ID NO: 9339866 - DNA, 17 bp, Homo sapiens
ctcctggccacccctct

SEQ ID NO: 9339867 - DNA, 17 bp, Homo sapiens
ctcctggccacccctct

SEQ ID NO: 9339868 - DNA, 22 bp, Homo sapiens
ctcctggccacgttcttgctgg

SEQ ID NO: 9339869 - DNA, 22 bp, Homo sapiens
ctcctggccccagatcccaatc

SEQ ID NO: 9339870 - DNA, 22 bp, Homo sapiens
ctcctggccccagatcccaatc

SEQ ID NO: 9339871 - DNA, 22 bp, Homo sapiens
ctcctggccacgttcttgctgg

SEQ ID NO: 9339872 - DNA, 22 bp, Homo sapiens
ctcctggccacgttcttgctgg

SEQ ID NO: 9339873 - DNA, 17 bp, Homo sapiens
ctcctggccacccctct

SEQ ID NO: 9339874 - DNA, 22 bp, Homo sapiens
ctcctggccacgttcttgctgg

SEQ ID NO: 9339875 - DNA, 22 bp, Homo sapiens
ctcctggcaggctgagtgaaat

SEQ ID NO: 9339876 - DNA, 22 bp, Homo sapiens
ctcctggcaggctgagtgaaat

SEQ ID NO: 9339877 - DNA, 17 bp, Homo sapiens
ctcctggcagcctcagg

SEQ ID NO: 9339878 - DNA, 17 bp, Homo sapiens
ctcctggcagcctcagg

SEQ ID NO: 9339879 - DNA, 22 bp, Homo sapiens
ctcctggcactgtcttgaccca

SEQ ID NO: 9339880 - DNA, 22 bp, Homo sapiens
ctcctggcagcaacatttatat

SEQ ID NO: 9339881 - DNA, 22 bp, Homo sapiens
ctcctggcactgtcttgaccca

SEQ ID NO: 9339882 - DNA, 22 bp, Homo sapiens
ctcctggcactgtcttgaccca

SEQ ID NO: 9339883 - DNA, 17 bp, Homo sapiens
ctcctggcagcctcagg

SEQ ID NO: 9339884 - DNA, 22 bp, Homo sapiens
ctcctggcagcaacatttatat

SEQ ID NO: 9339885 - DNA, 22 bp, Homo sapiens
ctcctccacagacctactgaat

SEQ ID NO: 9339886 - DNA, 22 bp, Homo sapiens
ctcctccacagacctactgaat

SEQ ID NO: 9339887 - DNA, 22 bp, Homo sapiens
ctcctccacagagtccttgcca

SEQ ID NO: 9339888 - DNA, 22 bp, Homo sapiens
ctcctccacagacctactgaat

SEQ ID NO: 9339889 - DNA, 18 bp, Homo sapiens
ctcctccacagcccctgc

SEQ ID NO: 9339890 - DNA, 18 bp, Homo sapiens
ctcctccacagcccctgc

SEQ ID NO: 9339891 - DNA, 18 bp, Homo sapiens
ctcctccacagcccctgc

SEQ ID NO: 9339892 - DNA, 22 bp, Homo sapiens
ctcctccacagagtccttgcca

SEQ ID NO: 9339893 - DNA, 22 bp, Homo sapiens
ctcctccacagagtccttgcca

SEQ ID NO: 9339894 - DNA, 22 bp, Homo sapiens
tttagtctgactattacctcca

SEQ ID NO: 9339895 - DNA, 22 bp, Homo sapiens
tttaggtaagctgaatatgaag

SEQ ID NO: 9339896 - DNA, 22 bp, Homo sapiens
tttagtagaatgatacagggca

SEQ ID NO: 9339897 - DNA, 22 bp, Homo sapiens
tttagtagaatagtatatcaaa

SEQ ID NO: 9339898 - DNA, 22 bp, Homo sapiens
tttagtaagttcactgcaaagc

SEQ ID NO: 9339899 - DNA, 23 bp, Homo sapiens
ctccccagtgtcctcatgcatct

SEQ ID NO: 9339900 - DNA, 22 bp, Homo sapiens
tttaatctattccctaaacacc

SEQ ID NO: 9339901 - DNA, 23 bp, Homo sapiens
ctccccagtgtcctcatgcatct

SEQ ID NO: 9339902 - DNA, 22 bp, Homo sapiens
tttaatctattccctaaacacc

SEQ ID NO: 9339903 - DNA, 22 bp, Homo sapiens
ctcccctccttaggtcttctag

SEQ ID NO: 9339904 - DNA, 22 bp, Homo sapiens
ctccccatccaggcagcaggtg

SEQ ID NO: 9339905 - DNA, 22 bp, Homo sapiens
ctccccatggcaacagttatgg

SEQ ID NO: 9339906 - DNA, 22 bp, Homo sapiens
ctccccattatgcagtcattat

SEQ ID NO: 9339907 - DNA, 22 bp, Homo sapiens
ctccccattgtgacctcatcca

SEQ ID NO: 9339908 - DNA, 22 bp, Homo sapiens
ctccccattgtgacctcatcca

SEQ ID NO: 9339909 - DNA, 22 bp, Homo sapiens
ctccccattgtgacctcatcca

SEQ ID NO: 9339910 - DNA, 22 bp, Homo sapiens
ctccccattgtgacctcatcca

SEQ ID NO: 9339911 - DNA, 22 bp, Homo sapiens
ctccccattatgcagtcattat

SEQ ID NO: 9339912 - DNA, 22 bp, Homo sapiens
ctcccggcacttggcatgtcat

SEQ ID NO: 9339913 - DNA, 22 bp, Homo sapiens
ctccccttcttgccagatcctt

SEQ ID NO: 9339914 - DNA, 22 bp, Homo sapiens
ctcccgtggatgttcttcagtc

SEQ ID NO: 9339915 - DNA, 22 bp, Homo sapiens
ctcccgtggatgttcttcagtc

SEQ ID NO: 9339916 - DNA, 22 bp, Homo sapiens
ctcccgtgatcctggaggagag

SEQ ID NO: 9339917 - DNA, 22 bp, Homo sapiens
ctcccgtgccactggctcctgc

SEQ ID NO: 9339918 - DNA, 22 bp, Homo sapiens
tttagactaattcctaaagggc

SEQ ID NO: 9339919 - DNA, 21 bp, Homo sapiens
tttagagaatactcactattt

SEQ ID NO: 9339920 - DNA, 22 bp, Homo sapiens
tttaggcagtcattgaacaagt

SEQ ID NO: 9339921 - DNA, 22 bp, Homo sapiens
ttcttttagaatttcctaaggt

SEQ ID NO: 9339922 - DNA, 22 bp, Homo sapiens
ttcttttagaatttcctaaggt

SEQ ID NO: 9339923 - DNA, 22 bp, Homo sapiens
ttcttttcaagaggggcaagga

SEQ ID NO: 9339924 - DNA, 22 bp, Homo sapiens
ttcttttagtcattcagggaag

SEQ ID NO: 9339925 - DNA, 22 bp, Homo sapiens
ttcttttagtcattcagggaag

SEQ ID NO: 9339926 - DNA, 22 bp, Homo sapiens
ttcttttacattaagatttcag

SEQ ID NO: 9339927 - DNA, 22 bp, Homo sapiens
ttcttttacattaagatttcag

SEQ ID NO: 9339928 - DNA, 22 bp, Homo sapiens
ttcttttacattaagatttcag

SEQ ID NO: 9339929 - DNA, 22 bp, Homo sapiens
ttcttttacattaagatttcag

SEQ ID NO: 9339930 - DNA, 22 bp, Homo sapiens
ctcacaggtcatgtggtggctt

SEQ ID NO: 9339931 - DNA, 22 bp, Homo sapiens
ctcacaggttagttgtgtggat

SEQ ID NO: 9339932 - DNA, 22 bp, Homo sapiens
ttctttctgtccataatgagac

SEQ ID NO: 9339933 - DNA, 22 bp, Homo sapiens
ttctttcttagcaatctatggt

SEQ ID NO: 9339934 - DNA, 22 bp, Homo sapiens
ttctttcttagcaatctatggt

SEQ ID NO: 9339935 - DNA, 22 bp, Homo sapiens
ttctttcttagcaatctatggt

SEQ ID NO: 9339936 - DNA, 22 bp, Homo sapiens
ttcttttaatttctgtctgcag

SEQ ID NO: 9339937 - DNA, 22 bp, Homo sapiens
ttcttttaatttctgtctgcag

SEQ ID NO: 9339938 - DNA, 22 bp, Homo sapiens
ttcttttaattgtgggggagtg

SEQ ID NO: 9339939 - DNA, 22 bp, Homo sapiens
ttgaaaggtgctgtgtgctgat

SEQ ID NO: 9339940 - DNA, 22 bp, Homo sapiens
ttgaaaggtgacattgttagag

SEQ ID NO: 9339941 - DNA, 22 bp, Homo sapiens
ttgaaaggtgaacatgatgcac

SEQ ID NO: 9339942 - DNA, 23 bp, Homo sapiens
ttgaaaggtagctggcagctaga

SEQ ID NO: 9339943 - DNA, 23 bp, Homo sapiens
ttgaaaggtagctggcagctaga

SEQ ID NO: 9339944 - DNA, 22 bp, Homo sapiens
ttcttttcggcctgtgagaagg

SEQ ID NO: 9339945 - DNA, 22 bp, Homo sapiens
ttgaaagggttaaagtggtaaa

SEQ ID NO: 9339946 - DNA, 22 bp, Homo sapiens
ttcttttcggcctgtgagaagg

SEQ ID NO: 9339947 - DNA, 22 bp, Homo sapiens
ttcttttcctacacagcgattt

SEQ ID NO: 9339948 - DNA, 22 bp, Homo sapiens
ttcttttcctacacagcgattt

SEQ ID NO: 9339949 - DNA, 22 bp, Homo sapiens
ttcttttcctacacagcgattt

SEQ ID NO: 9339950 - DNA, 22 bp, Homo sapiens
ttcttttcctgtggctcatcca

SEQ ID NO: 9339951 - DNA, 18 bp, Homo sapiens
ttcttttcatgtgatctc

SEQ ID NO: 9339952 - DNA, 18 bp, Homo sapiens
ttcttttcatgtgatctc

SEQ ID NO: 9339953 - DNA, 22 bp, Homo sapiens
ctcatctggcttcagtaacagt

SEQ ID NO: 9339954 - DNA, 22 bp, Homo sapiens
ttgaaatatcaagttattagtg

SEQ ID NO: 9339955 - DNA, 22 bp, Homo sapiens
ctcatctgtatatagtgaatga

SEQ ID NO: 9339956 - DNA, 22 bp, Homo sapiens
ctcatctgtctgggctggtttt

SEQ ID NO: 9339957 - DNA, 22 bp, Homo sapiens
ttgaaatagatgcgtcagagat

SEQ ID NO: 9339958 - DNA, 22 bp, Homo sapiens
ttgaaatactgcattgttcagt

SEQ ID NO: 9339959 - DNA, 22 bp, Homo sapiens
ctcatttatccaaaagccagtt

SEQ ID NO: 9339960 - DNA, 22 bp, Homo sapiens
ctcatttaacagattaaaaagt

SEQ ID NO: 9339961 - DNA, 22 bp, Homo sapiens
ctcatttacctttgcaatcaag

SEQ ID NO: 9339962 - DNA, 22 bp, Homo sapiens
ctcatttatgtaatgattaagg

SEQ ID NO: 9339963 - DNA, 22 bp, Homo sapiens
ctcatttatttctcccaaaaca

SEQ ID NO: 9339964 - DNA, 22 bp, Homo sapiens
ctccaagggttgtgggtggtca

SEQ ID NO: 9339965 - DNA, 22 bp, Homo sapiens
ctccaagggtcttccaccagga

SEQ ID NO: 9339966 - DNA, 22 bp, Homo sapiens
ctccaaggctctggtgctgagg

SEQ ID NO: 9339967 - DNA, 23 bp, Homo sapiens
ctccaaggcccaactgtctaggc

SEQ ID NO: 9339968 - DNA, 22 bp, Homo sapiens
ctccaaggctaggagcatgttc

SEQ ID NO: 9339969 - DNA, 22 bp, Homo sapiens
ctccaaggagaaatgggcaaca

SEQ ID NO: 9339970 - DNA, 22 bp, Homo sapiens
ctccaaggaagccccaagggat

SEQ ID NO: 9339971 - DNA, 22 bp, Homo sapiens
ctccacagcccctccagtggca

SEQ ID NO: 9339972 - DNA, 22 bp, Homo sapiens
ctccaaggtttcagaacaaatg

SEQ ID NO: 9339973 - DNA, 22 bp, Homo sapiens
ctccaaggttttccctgtcctt

SEQ ID NO: 9339974 - DNA, 22 bp, Homo sapiens
ctccacaggtggtgtttgcttc

SEQ ID NO: 9339975 - DNA, 22 bp, Homo sapiens
ctccacagcccctccagtggca

SEQ ID NO: 9339976 - DNA, 22 bp, Homo sapiens
ctccacagcccctccagtggca

SEQ ID NO: 9339977 - DNA, 22 bp, Homo sapiens
ctccagattctggatgactggg

SEQ ID NO: 9339978 - DNA, 22 bp, Homo sapiens
ctccagcagaaagggcgagtgg

SEQ ID NO: 9339979 - DNA, 22 bp, Homo sapiens
ctccagattccgtttattcagg

SEQ ID NO: 9339980 - DNA, 22 bp, Homo sapiens
ctccagattccgtttattcagg

SEQ ID NO: 9339981 - DNA, 22 bp, Homo sapiens
ctccagatccagctgagctgca

SEQ ID NO: 9339982 - DNA, 22 bp, Homo sapiens
ctccagatccagctgagctgca

SEQ ID NO: 9339983 - DNA, 22 bp, Homo sapiens
ttgtacaacgttttaaatttga

SEQ ID NO: 9339984 - DNA, 22 bp, Homo sapiens
ttgtacaacacatattctacag

SEQ ID NO: 9339985 - DNA, 22 bp, Homo sapiens
ttgtacaacacatattctacag

SEQ ID NO: 9339986 - DNA, 22 bp, Homo sapiens
ttgtacaacgttttaaatttga

SEQ ID NO: 9339987 - DNA, 22 bp, Homo sapiens
ttgtacaacgttttaaatttga

SEQ ID NO: 9339988 - DNA, 22 bp, Homo sapiens
ttgtacaaatgcatattcctgg

SEQ ID NO: 9339989 - DNA, 22 bp, Homo sapiens
ttgtacaacacatattctacag

SEQ ID NO: 9339990 - DNA, 22 bp, Homo sapiens
ttgtacaaatgcatattcctgg

SEQ ID NO: 9339991 - DNA, 22 bp, Homo sapiens
ttgtacaaataggaacctctga

SEQ ID NO: 9339992 - DNA, 22 bp, Homo sapiens
ctccaccccgtgccggtgctgg

SEQ ID NO: 9339993 - DNA, 22 bp, Homo sapiens
ttgtaattagtttttgatctgg

SEQ ID NO: 9339994 - DNA, 22 bp, Homo sapiens
ttgtaattagtttttgatctgg

SEQ ID NO: 9339995 - DNA, 22 bp, Homo sapiens
ttgtacaaaggatttggaagag

SEQ ID NO: 9339996 - DNA, 22 bp, Homo sapiens
ttgtacaaataggaacctctga

SEQ ID NO: 9339997 - DNA, 22 bp, Homo sapiens
ttgtacaaaggatttggaagag

SEQ ID NO: 9339998 - DNA, 22 bp, Homo sapiens
ttgtacaaagatttcacagctc

SEQ ID NO: 9339999 - DNA, 22 bp, Homo sapiens
ttgtacaaagatttcacagctc

SEQ ID NO: 9340000 - DNA, 22 bp, Homo sapiens
ttgtaatttgttcccaagcaga

SEQ ID NO: 9340001 - DNA, 22 bp, Homo sapiens
ctcccaggactcagaggagaag

SEQ ID NO: 9340002 - DNA, 22 bp, Homo sapiens
ctcccaggactcagaggagaag

SEQ ID NO: 9340003 - DNA, 22 bp, Homo sapiens
ctcccagccttcgccagtctga

SEQ ID NO: 9340004 - DNA, 22 bp, Homo sapiens
ctcccagccttcgccagtctga

SEQ ID NO: 9340005 - DNA, 22 bp, Homo sapiens
ctcccagccttcgccagtctga

SEQ ID NO: 9340006 - DNA, 22 bp, Homo sapiens
ctcccagccttcgccagtctga

SEQ ID NO: 9340007 - DNA, 22 bp, Homo sapiens
ctcccagattcctgctgtggga

SEQ ID NO: 9340008 - DNA, 22 bp, Homo sapiens
ctcccagccttcgccagtctga

SEQ ID NO: 9340009 - DNA, 22 bp, Homo sapiens
ctcccagattcctgctgtggga

SEQ ID NO: 9340010 - DNA, 22 bp, Homo sapiens
ctcccagagaccaagctgagaa

SEQ ID NO: 9340011 - DNA, 22 bp, Homo sapiens
ctcccagaaaattctcagacaa

SEQ ID NO: 9340012 - DNA, 22 bp, Homo sapiens
ctcccagaaaattctcagacaa

SEQ ID NO: 9340013 - DNA, 22 bp, Homo sapiens
ctcccagacatgtgcctccttg

SEQ ID NO: 9340014 - DNA, 22 bp, Homo sapiens
ctcccaaggggtaagggagctg

SEQ ID NO: 9340015 - DNA, 22 bp, Homo sapiens
ctccattgttcgcgcagctgca

SEQ ID NO: 9340016 - DNA, 22 bp, Homo sapiens
ctccatgggggctggcctgtgt

SEQ ID NO: 9340017 - DNA, 22 bp, Homo sapiens
ctccatgggggctggcctgtgt

SEQ ID NO: 9340018 - DNA, 22 bp, Homo sapiens
ctccatgggggctggcctgtgt

SEQ ID NO: 9340019 - DNA, 22 bp, Homo sapiens
ctccatggggaaatgaaggtgg

SEQ ID NO: 9340020 - DNA, 22 bp, Homo sapiens
ctccatggggaaatgaaggtgg

SEQ ID NO: 9340021 - DNA, 22 bp, Homo sapiens
ctcccaggcacagggaggagcc

SEQ ID NO: 9340022 - DNA, 22 bp, Homo sapiens
ctcccaggcagggctgcccact

SEQ ID NO: 9340023 - DNA, 22 bp, Homo sapiens
ctcccaggcagggctgcccact

SEQ ID NO: 9340024 - DNA, 22 bp, Homo sapiens
ctcccaggccatgctctagcca

SEQ ID NO: 9340025 - DNA, 22 bp, Homo sapiens
ctcccaggccatgctctagcca

SEQ ID NO: 9340026 - DNA, 22 bp, Homo sapiens
tttaacagatgctatgtctacc

SEQ ID NO: 9340027 - DNA, 22 bp, Homo sapiens
tttaatatctcacacttccatg

SEQ ID NO: 9340028 - DNA, 22 bp, Homo sapiens
tttaatatttctttcctgaagc

SEQ ID NO: 9340029 - DNA, 22 bp, Homo sapiens
tttaatatttctttcctgaagc

SEQ ID NO: 9340030 - DNA, 22 bp, Homo sapiens
tttaatatccagtggatacaaa

SEQ ID NO: 9340031 - DNA, 22 bp, Homo sapiens
tttaatatccagtggatacaaa

SEQ ID NO: 9340032 - DNA, 22 bp, Homo sapiens
tttaatatctcacacttccatg

SEQ ID NO: 9340033 - DNA, 22 bp, Homo sapiens
ctccatggaaccggggctgctt

SEQ ID NO: 9340034 - DNA, 22 bp, Homo sapiens
ctccatggctttcgcatctgca

SEQ ID NO: 9340035 - DNA, 22 bp, Homo sapiens
ctccatggggaaatgaaggtgg

SEQ ID NO: 9340036 - DNA, 22 bp, Homo sapiens
ctccatggctttcgcatctgca

SEQ ID NO: 9340037 - DNA, 22 bp, Homo sapiens
ctccatggaaaaggctgttgtt

SEQ ID NO: 9340038 - DNA, 22 bp, Homo sapiens
ctccatggaaccggggctgctt

SEQ ID NO: 9340039 - DNA, 22 bp, Homo sapiens
ctccagtgcgtcttagtaaacc

SEQ ID NO: 9340040 - DNA, 22 bp, Homo sapiens
ttgtgtaacttgagcaaacaca

SEQ ID NO: 9340041 - DNA, 20 bp, Homo sapiens
ttgtggtttagattatctga

SEQ ID NO: 9340042 - DNA, 22 bp, Homo sapiens
ttgtggttgactaaatttgtaa

SEQ ID NO: 9340043 - DNA, 22 bp, Homo sapiens
ttgtggggtgatttgccacggg

SEQ ID NO: 9340044 - DNA, 22 bp, Homo sapiens
ttgtggggttggcagttcttta

SEQ ID NO: 9340045 - DNA, 20 bp, Homo sapiens
ttgtgggggcaatggtatgc

SEQ ID NO: 9340046 - DNA, 22 bp, Homo sapiens
ttgtgggggctgccctgtacgg

SEQ ID NO: 9340047 - DNA, 22 bp, Homo sapiens
ttgtggggttggcagttcttta

SEQ ID NO: 9340048 - DNA, 22 bp, Homo sapiens
ttgtggttaaccgcacattttt

SEQ ID NO: 9340049 - DNA, 22 bp, Homo sapiens
ttgtgaaatcgtgtttggaagc

SEQ ID NO: 9340050 - DNA, 22 bp, Homo sapiens
ttgtgaaaagccgcaagtatag

SEQ ID NO: 9340051 - DNA, 22 bp, Homo sapiens
ttgtgaaaagccgcaagtatag

SEQ ID NO: 9340052 - DNA, 22 bp, Homo sapiens
ttgtcttttgtgggaaatatgg

SEQ ID NO: 9340053 - DNA, 22 bp, Homo sapiens
ttgtggggaaacactgtttctt

SEQ ID NO: 9340054 - DNA, 22 bp, Homo sapiens
ttgtggggaaacactgtttctt

SEQ ID NO: 9340055 - DNA, 22 bp, Homo sapiens
ttgtgggcttgcctggctcttg

SEQ ID NO: 9340056 - DNA, 22 bp, Homo sapiens
ttgtggggaacccctgtcccac

SEQ ID NO: 9340057 - DNA, 22 bp, Homo sapiens
ttgtggggaggatttgatgaga

SEQ ID NO: 9340058 - DNA, 22 bp, Homo sapiens
ttgtggggcaacagcaggtgaa

SEQ ID NO: 9340059 - DNA, 22 bp, Homo sapiens
ttgtggggccccaatgttgctg

SEQ ID NO: 9340060 - DNA, 22 bp, Homo sapiens
ttgtggggcaacagcaggtgaa

SEQ ID NO: 9340061 - DNA, 20 bp, Homo sapiens
ttgtgggggcaatggtatgc

SEQ ID NO: 9340062 - DNA, 20 bp, Homo sapiens
ctccagcccctgccctggtc

SEQ ID NO: 9340063 - DNA, 20 bp, Homo sapiens
ctccagcccctgccctggtc

SEQ ID NO: 9340064 - DNA, 22 bp, Homo sapiens
ctccagccagagtgcctctgtt

SEQ ID NO: 9340065 - DNA, 22 bp, Homo sapiens
ctccagccagagtgcctctgtt

SEQ ID NO: 9340066 - DNA, 22 bp, Homo sapiens
ctccagccagagtgcctctgtt

SEQ ID NO: 9340067 - DNA, 22 bp, Homo sapiens
ttgtattttgttatgctactgc

SEQ ID NO: 9340068 - DNA, 20 bp, Homo sapiens
ctccagcccctgccctggtc

SEQ ID NO: 9340069 - DNA, 22 bp, Homo sapiens
ttgtattttgttatgctactgc

SEQ ID NO: 9340070 - DNA, 22 bp, Homo sapiens
ttgtcttattttatcataagca

SEQ ID NO: 9340071 - DNA, 22 bp, Homo sapiens
ttgtctttcccagcttctagag

SEQ ID NO: 9340072 - DNA, 22 bp, Homo sapiens
ttgtctttggaaatttaatgtt

SEQ ID NO: 9340073 - DNA, 22 bp, Homo sapiens
ttgtcttttgtgggaaatatgg

SEQ ID NO: 9340074 - DNA, 22 bp, Homo sapiens
ctgcactgagctctcccagccc

SEQ ID NO: 9340075 - DNA, 21 bp, Homo sapiens
ctgcactgtgatttaaaatgt

SEQ ID NO: 9340076 - DNA, 18 bp, Homo sapiens
ctgcacttcagcttgggc

SEQ ID NO: 9340077 - DNA, 22 bp, Homo sapiens
ctgcaggcccccttcctggagt

SEQ ID NO: 9340078 - DNA, 22 bp, Homo sapiens
ctgcaggctcgaagacacggat

SEQ ID NO: 9340079 - DNA, 22 bp, Homo sapiens
ctgcagggagcagatggcgtgt

SEQ ID NO: 9340080 - DNA, 22 bp, Homo sapiens
ctgcagggagcagatggcgtgt

SEQ ID NO: 9340081 - DNA, 22 bp, Homo sapiens
ctgcagggagcagatggcgtgt

SEQ ID NO: 9340082 - DNA, 22 bp, Homo sapiens
ctgcagggatgtgaggcccgtt

SEQ ID NO: 9340083 - DNA, 22 bp, Homo sapiens
ctgcactgagcatctaacctta

SEQ ID NO: 9340084 - DNA, 19 bp, Homo sapiens
ctgcactgagaaaaggagg

SEQ ID NO: 9340085 - DNA, 22 bp, Homo sapiens
ctgcaccatccttcatgctctg

SEQ ID NO: 9340086 - DNA, 22 bp, Homo sapiens
ctgcacagtttgatttcttgct

SEQ ID NO: 9340087 - DNA, 22 bp, Homo sapiens
ctgcacagtgttggaagctgcc

SEQ ID NO: 9340088 - DNA, 22 bp, Homo sapiens
ctgcaccacagcctgaggcagc

SEQ ID NO: 9340089 - DNA, 22 bp, Homo sapiens
ctgcagggcccaaggtcaacgg

SEQ ID NO: 9340090 - DNA, 22 bp, Homo sapiens
ctgcagggccatgggttctata

SEQ ID NO: 9340091 - DNA, 22 bp, Homo sapiens
ctgcagggcccgcctgagccct

SEQ ID NO: 9340092 - DNA, 22 bp, Homo sapiens
ctgcagggcccgcctgagccct

SEQ ID NO: 9340093 - DNA, 22 bp, Homo sapiens
ctgcagggcccgcctgagccct

SEQ ID NO: 9340094 - DNA, 22 bp, Homo sapiens
ctgcaggggcagtccacttcct

SEQ ID NO: 9340095 - DNA, 22 bp, Homo sapiens
ctgcaggggcagtccacttcct

SEQ ID NO: 9340096 - DNA, 22 bp, Homo sapiens
ctgcaggggcctcgagcacagg

SEQ ID NO: 9340097 - DNA, 22 bp, Homo sapiens
ctgcaggggcctcgagcacagg

SEQ ID NO: 9340098 - DNA, 22 bp, Homo sapiens
ctgcagggcttaccttgctctg

SEQ ID NO: 9340099 - DNA, 22 bp, Homo sapiens
ctgcagggcttaccttgctctg

SEQ ID NO: 9340100 - DNA, 22 bp, Homo sapiens
ctgcaggggaccaaagtctgac

SEQ ID NO: 9340101 - DNA, 22 bp, Homo sapiens
ctgcagggcagggcctcctggc

SEQ ID NO: 9340102 - DNA, 22 bp, Homo sapiens
ctgcagggcattgtaactcttt

SEQ ID NO: 9340103 - DNA, 22 bp, Homo sapiens
ctgcagggcagggcctcctggc

SEQ ID NO: 9340104 - DNA, 22 bp, Homo sapiens
ctgcagggattgcttctgtata

SEQ ID NO: 9340105 - DNA, 22 bp, Homo sapiens
ctgcagggatgtgaggcccgtt

SEQ ID NO: 9340106 - DNA, 22 bp, Homo sapiens
ctgcagggatgtgaggcccgtt

SEQ ID NO: 9340107 - DNA, 19 bp, Homo sapiens
ctgcagggatgtgcagagt

SEQ ID NO: 9340108 - DNA, 19 bp, Homo sapiens
ctgcagggatgtgcagagt

SEQ ID NO: 9340109 - DNA, 19 bp, Homo sapiens
ctgcagggatgtgcagagt

SEQ ID NO: 9340110 - DNA, 22 bp, Homo sapiens
ctgcacagagcagggcagacac

SEQ ID NO: 9340111 - DNA, 22 bp, Homo sapiens
ctgcacacatcgcactgcccgt

SEQ ID NO: 9340112 - DNA, 22 bp, Homo sapiens
ctgcacacatatggcttctctc

SEQ ID NO: 9340113 - DNA, 22 bp, Homo sapiens
ctgcacagagcggcagttctta

SEQ ID NO: 9340114 - DNA, 22 bp, Homo sapiens
ctgcaaagctgttcacaaattt

SEQ ID NO: 9340115 - DNA, 22 bp, Homo sapiens
ctgaggccgtctgggtctgcag

SEQ ID NO: 9340116 - DNA, 22 bp, Homo sapiens
ctgaggccgtctgggtctgcag

SEQ ID NO: 9340117 - DNA, 22 bp, Homo sapiens
ctgaggccggagcactgaagag

SEQ ID NO: 9340118 - DNA, 22 bp, Homo sapiens
ctgaggccggagcactgaagag

SEQ ID NO: 9340119 - DNA, 22 bp, Homo sapiens
ctgcacagctggccagggagag

SEQ ID NO: 9340120 - DNA, 22 bp, Homo sapiens
ctgcacagctggccagggagag

SEQ ID NO: 9340121 - DNA, 22 bp, Homo sapiens
ctgcacagtggacagtgaagat

SEQ ID NO: 9340122 - DNA, 22 bp, Homo sapiens
ctgaggcatgggaagttgggtg

SEQ ID NO: 9340123 - DNA, 22 bp, Homo sapiens
ctgaggcatgggaagttgggtg

SEQ ID NO: 9340124 - DNA, 22 bp, Homo sapiens
ctgaggcatgttacaggacata

SEQ ID NO: 9340125 - DNA, 22 bp, Homo sapiens
ctgaggcatgttacaggacata

SEQ ID NO: 9340126 - DNA, 22 bp, Homo sapiens
ctgaggcatgttacaggacata

SEQ ID NO: 9340127 - DNA, 22 bp, Homo sapiens
ctgaggcatgttacaggacata

SEQ ID NO: 9340128 - DNA, 22 bp, Homo sapiens
ctgaggcatgttacaggacata

SEQ ID NO: 9340129 - DNA, 22 bp, Homo sapiens
ctgaggcatgttacaggacata

SEQ ID NO: 9340130 - DNA, 22 bp, Homo sapiens
ctgaggccagctgcagagctct

SEQ ID NO: 9340131 - DNA, 22 bp, Homo sapiens
ctgaggccagctgcagagctct

SEQ ID NO: 9340132 - DNA, 22 bp, Homo sapiens
ctgaggccagagtgggcctctt

SEQ ID NO: 9340133 - DNA, 18 bp, Homo sapiens
ctgaggccaactacactg

SEQ ID NO: 9340134 - DNA, 22 bp, Homo sapiens
ctgaggccagagtgggcctctt

SEQ ID NO: 9340135 - DNA, 22 bp, Homo sapiens
ctgaggccagagtgggcctctt

SEQ ID NO: 9340136 - DNA, 22 bp, Homo sapiens
ctgaggccagaacccgaccctg

SEQ ID NO: 9340137 - DNA, 17 bp, Homo sapiens
ctgaggcccagggccca

SEQ ID NO: 9340138 - DNA, 17 bp, Homo sapiens
ctgaggcccagggccca

SEQ ID NO: 9340139 - DNA, 18 bp, Homo sapiens
ctgaggcccagagagggc

SEQ ID NO: 9340140 - DNA, 18 bp, Homo sapiens
ctgaggcccagagagggc

SEQ ID NO: 9340141 - DNA, 18 bp, Homo sapiens
ctgaggcccagagagggc

SEQ ID NO: 9340142 - DNA, 19 bp, Homo sapiens
ctgaggcccatgtaccatg

SEQ ID NO: 9340143 - DNA, 19 bp, Homo sapiens
ctgaggcccatgtaccatg

SEQ ID NO: 9340144 - DNA, 22 bp, Homo sapiens
ctgaggcccctctcttgagctt

SEQ ID NO: 9340145 - DNA, 22 bp, Homo sapiens
ctgaggcccctctcttgagctt

SEQ ID NO: 9340146 - DNA, 22 bp, Homo sapiens
ctgaggcccctcttgtgagcat

SEQ ID NO: 9340147 - DNA, 22 bp, Homo sapiens
ctgaggcccctcttgtgagcat

SEQ ID NO: 9340148 - DNA, 22 bp, Homo sapiens
ctgagccataagggaggctggg

SEQ ID NO: 9340149 - DNA, 20 bp, Homo sapiens
ctgagccaactctcttcttg

SEQ ID NO: 9340150 - DNA, 22 bp, Homo sapiens
ctgagccaaggggacagtgaca

SEQ ID NO: 9340151 - DNA, 22 bp, Homo sapiens
ctgactccctgattctgggttt

SEQ ID NO: 9340152 - DNA, 22 bp, Homo sapiens
ctgagccaaccacagcaggagc

SEQ ID NO: 9340153 - DNA, 22 bp, Homo sapiens
ctgactatctttctcaaagtgg

SEQ ID NO: 9340154 - DNA, 23 bp, Homo sapiens
ctgactcatcccaccacctcctc

SEQ ID NO: 9340155 - DNA, 22 bp, Homo sapiens
ctgactcagcagctgatgatcc

SEQ ID NO: 9340156 - DNA, 23 bp, Homo sapiens
ctgactcatcccaccacctcctc

SEQ ID NO: 9340157 - DNA, 22 bp, Homo sapiens
ctgacctgcccttaggcttctc

SEQ ID NO: 9340158 - DNA, 21 bp, Homo sapiens
ctgaggcagcacagctagtca

SEQ ID NO: 9340159 - DNA, 22 bp, Homo sapiens
ctgaggcagagggcagaccaga

SEQ ID NO: 9340160 - DNA, 22 bp, Homo sapiens
ctgaggcagagggcagaccaga

SEQ ID NO: 9340161 - DNA, 22 bp, Homo sapiens
ctgaggcagagggcagaccaga

SEQ ID NO: 9340162 - DNA, 22 bp, Homo sapiens
ctgagcctcctgcttctatttc

SEQ ID NO: 9340163 - DNA, 22 bp, Homo sapiens
ctgagcccttgaacccaagtcc

SEQ ID NO: 9340164 - DNA, 22 bp, Homo sapiens
ctgagcctccaggaggggggtg

SEQ ID NO: 9340165 - DNA, 22 bp, Homo sapiens
ctgagcccttgtcttcctggtc

SEQ ID NO: 9340166 - DNA, 22 bp, Homo sapiens
ctgagccctggctcgcctggag

SEQ ID NO: 9340167 - DNA, 22 bp, Homo sapiens
ctgagccctgcctcttgtcact

SEQ ID NO: 9340168 - DNA, 20 bp, Homo sapiens
ctgagcccccagcctgcagg

SEQ ID NO: 9340169 - DNA, 22 bp, Homo sapiens
ctgagccccatctgaggtgccc

SEQ ID NO: 9340170 - DNA, 20 bp, Homo sapiens
ctgagcccagatcccaggtc

SEQ ID NO: 9340171 - DNA, 20 bp, Homo sapiens
ctgagcccagatcccaggtc

SEQ ID NO: 9340172 - DNA, 22 bp, Homo sapiens
ctgagcccctctgacctcagag

SEQ ID NO: 9340173 - DNA, 22 bp, Homo sapiens
ctgagcccctctgacctcagag

SEQ ID NO: 9340174 - DNA, 22 bp, Homo sapiens
ctgagccctcctgcttgctgag

SEQ ID NO: 9340175 - DNA, 22 bp, Homo sapiens
ctgagcccgggtgctctacccc

SEQ ID NO: 9340176 - DNA, 20 bp, Homo sapiens
ctgagcccccagcctgcagg

SEQ ID NO: 9340177 - DNA, 22 bp, Homo sapiens
ctctttctgattcgctgggacc

SEQ ID NO: 9340178 - DNA, 22 bp, Homo sapiens
ctgaatatcatttatcattggc

SEQ ID NO: 9340179 - DNA, 22 bp, Homo sapiens
ctctttctcattgtcagcagaa

SEQ ID NO: 9340180 - DNA, 22 bp, Homo sapiens
ctctttctcattgtcagcagaa

SEQ ID NO: 9340181 - DNA, 22 bp, Homo sapiens
ctctttcctcgatgggctcctg

SEQ ID NO: 9340182 - DNA, 22 bp, Homo sapiens
ctctttcctcagccacagtcta

SEQ ID NO: 9340183 - DNA, 22 bp, Homo sapiens
ctctttctgattcgctgggacc

SEQ ID NO: 9340184 - DNA, 22 bp, Homo sapiens
ctctttctgattcgctgggacc

SEQ ID NO: 9340185 - DNA, 22 bp, Homo sapiens
ctctttctgattcgctgggacc

SEQ ID NO: 9340186 - DNA, 17 bp, Homo sapiens
ctctttataaagagtta

SEQ ID NO: 9340187 - DNA, 19 bp, Homo sapiens
ctctttccattgtatttgc

SEQ ID NO: 9340188 - DNA, 22 bp, Homo sapiens
ctctttccagggtaccccaggt

SEQ ID NO: 9340189 - DNA, 21 bp, Homo sapiens
ctctttatatagtaaagatat

SEQ ID NO: 9340190 - DNA, 22 bp, Homo sapiens
ctgacatttactgagcacttac

SEQ ID NO: 9340191 - DNA, 22 bp, Homo sapiens
ctgacatgttgacaagaaataa

SEQ ID NO: 9340192 - DNA, 22 bp, Homo sapiens
ctgacaggttggtagctttgga

SEQ ID NO: 9340193 - DNA, 22 bp, Homo sapiens
ctgacagtctcattgatttgct

SEQ ID NO: 9340194 - DNA, 22 bp, Homo sapiens
ctgaccagggtagaggtgagag

SEQ ID NO: 9340195 - DNA, 22 bp, Homo sapiens
ctgacccttgctcgggccctgt

SEQ ID NO: 9340196 - DNA, 19 bp, Homo sapiens
ctgacccaggacaccacgg

SEQ ID NO: 9340197 - DNA, 22 bp, Homo sapiens
ctgaatcatgccattttgctta

SEQ ID NO: 9340198 - DNA, 22 bp, Homo sapiens
ctgacagatacttatgacataa

SEQ ID NO: 9340199 - DNA, 22 bp, Homo sapiens
ctgaatatcatttatcattggc

SEQ ID NO: 9340200 - DNA, 22 bp, Homo sapiens
ctgaatattagtcatgtctgat

SEQ ID NO: 9340201 - DNA, 22 bp, Homo sapiens
ctgacagatgctgctggcagta

SEQ ID NO: 9340202 - DNA, 22 bp, Homo sapiens
ctgacagatacttatgacataa

SEQ ID NO: 9340203 - DNA, 22 bp, Homo sapiens
ctgacagattagatgtgcatat

SEQ ID NO: 9340204 - DNA, 22 bp, Homo sapiens
ctgacaggctgagatccctggt

SEQ ID NO: 9340205 - DNA, 22 bp, Homo sapiens
ctctgccagtttctggcctcag

SEQ ID NO: 9340206 - DNA, 22 bp, Homo sapiens
ctctgccagccaaagtcatcac

SEQ ID NO: 9340207 - DNA, 22 bp, Homo sapiens
ctctgccagtttctggcctcag

SEQ ID NO: 9340208 - DNA, 22 bp, Homo sapiens
ctctgccactcgaagtcaagga

SEQ ID NO: 9340209 - DNA, 22 bp, Homo sapiens
ctctgccatttatcagaactgt

SEQ ID NO: 9340210 - DNA, 22 bp, Homo sapiens
ctctgccatcttggagctcaag

SEQ ID NO: 9340211 - DNA, 22 bp, Homo sapiens
ctctgccactcgaagtcaagga

SEQ ID NO: 9340212 - DNA, 22 bp, Homo sapiens
ctctgccaagatgacaggtaag

SEQ ID NO: 9340213 - DNA, 20 bp, Homo sapiens
ctctgcagcaaggcctgggt

SEQ ID NO: 9340214 - DNA, 20 bp, Homo sapiens
ctctgcagcaaggcctgggt

SEQ ID NO: 9340215 - DNA, 22 bp, Homo sapiens
ctctgcagaggcccaaggctga

SEQ ID NO: 9340216 - DNA, 22 bp, Homo sapiens
tttccttgttattatttgtcct

SEQ ID NO: 9340217 - DNA, 20 bp, Homo sapiens
tttcctttcattttagtacc

SEQ ID NO: 9340218 - DNA, 22 bp, Homo sapiens
tttcctttatgacatcaccact

SEQ ID NO: 9340219 - DNA, 22 bp, Homo sapiens
ctctgcccgcggatgccacgtc

SEQ ID NO: 9340220 - DNA, 19 bp, Homo sapiens
ctctgccctacagaaagct

SEQ ID NO: 9340221 - DNA, 22 bp, Homo sapiens
ctctgcccgcggatgccacgtc

SEQ ID NO: 9340222 - DNA, 21 bp, Homo sapiens
ctctgcccagggcctcctgcc

SEQ ID NO: 9340223 - DNA, 22 bp, Homo sapiens
ctctgcccagtgcccacaggag

SEQ ID NO: 9340224 - DNA, 22 bp, Homo sapiens
ctctgcccagtgcccacaggag

SEQ ID NO: 9340225 - DNA, 22 bp, Homo sapiens
ctctgcccgcggatgccacgtc

SEQ ID NO: 9340226 - DNA, 22 bp, Homo sapiens
ctctgcccccagctggtgcttg

SEQ ID NO: 9340227 - DNA, 22 bp, Homo sapiens
ctctgcccagtgcccacaggag

SEQ ID NO: 9340228 - DNA, 22 bp, Homo sapiens
tttgcattttagatttaggcct

SEQ ID NO: 9340229 - DNA, 22 bp, Homo sapiens
tttgcattttagatttaggcct

SEQ ID NO: 9340230 - DNA, 22 bp, Homo sapiens
tttgccacattctatacatttg

SEQ ID NO: 9340231 - DNA, 19 bp, Homo sapiens
ctctgcctccctcctgggt

SEQ ID NO: 9340232 - DNA, 19 bp, Homo sapiens
ctctgcctccctcctgggt

SEQ ID NO: 9340233 - DNA, 22 bp, Homo sapiens
ctctgccctcgcacatctgcca

SEQ ID NO: 9340234 - DNA, 19 bp, Homo sapiens
ctctgcctccctcctgggt

SEQ ID NO: 9340235 - DNA, 22 bp, Homo sapiens
ctctgccctcgcacatctgcca

SEQ ID NO: 9340236 - DNA, 21 bp, Homo sapiens
tttgccttcacgaagcatcct

SEQ ID NO: 9340237 - DNA, 19 bp, Homo sapiens
tttgcctgtataccctgtg

SEQ ID NO: 9340238 - DNA, 22 bp, Homo sapiens
tttgccttctctgaacctattt

SEQ ID NO: 9340239 - DNA, 22 bp, Homo sapiens
tttgccctcaggtttttatgtg

SEQ ID NO: 9340240 - DNA, 22 bp, Homo sapiens
tttgccattgcctgtcagttgt

SEQ ID NO: 9340241 - DNA, 20 bp, Homo sapiens
ctctgctttaggagagtcag

SEQ ID NO: 9340242 - DNA, 22 bp, Homo sapiens
tttgctctgacagtgccagaga

SEQ ID NO: 9340243 - DNA, 22 bp, Homo sapiens
ctctgctttttagggagcctag

SEQ ID NO: 9340244 - DNA, 22 bp, Homo sapiens
ctctggaaaaccactagcagga

SEQ ID NO: 9340245 - DNA, 22 bp, Homo sapiens
ctctggaaaaccactagcagga

SEQ ID NO: 9340246 - DNA, 22 bp, Homo sapiens
ctctggaaatggccatagtcat

SEQ ID NO: 9340247 - DNA, 22 bp, Homo sapiens
ctctggaaatggccatagtcat

SEQ ID NO: 9340248 - DNA, 22 bp, Homo sapiens
ctctggaaaattgtgtgggggt

SEQ ID NO: 9340249 - DNA, 22 bp, Homo sapiens
ctctggaaatggccatagtcat

SEQ ID NO: 9340250 - DNA, 22 bp, Homo sapiens
ctctggaaaaccactagcagga

SEQ ID NO: 9340251 - DNA, 22 bp, Homo sapiens
ctctggaaaattgtgtgggggt

SEQ ID NO: 9340252 - DNA, 22 bp, Homo sapiens
tttgggaataattgcacagatt

SEQ ID NO: 9340253 - DNA, 22 bp, Homo sapiens
tttgggcaattcagtgggacct

SEQ ID NO: 9340254 - DNA, 22 bp, Homo sapiens
tttgggaacttaattatgtctg

SEQ ID NO: 9340255 - DNA, 22 bp, Homo sapiens
tttgggaaccagaagttcaaaa

SEQ ID NO: 9340256 - DNA, 22 bp, Homo sapiens
ctctggaattaaggaagcctgt

SEQ ID NO: 9340257 - DNA, 22 bp, Homo sapiens
tttggaattggcattctattct

SEQ ID NO: 9340258 - DNA, 22 bp, Homo sapiens
tttggaattggaaagtgctgtg

SEQ ID NO: 9340259 - DNA, 22 bp, Homo sapiens
ctctggaatgggtgtttctaac

SEQ ID NO: 9340260 - DNA, 22 bp, Homo sapiens
ctctggaatgggtgtttctaac

SEQ ID NO: 9340261 - DNA, 22 bp, Homo sapiens
ctctggaatgggtgtttctaac

SEQ ID NO: 9340262 - DNA, 22 bp, Homo sapiens
ctctggaatgtttacatgccct

SEQ ID NO: 9340263 - DNA, 22 bp, Homo sapiens
ctctggaatgtttacatgccct

SEQ ID NO: 9340264 - DNA, 22 bp, Homo sapiens
ctctggaagaatacacttagaa

SEQ ID NO: 9340265 - DNA, 22 bp, Homo sapiens
ctctggaagaatacacttagaa

SEQ ID NO: 9340266 - DNA, 22 bp, Homo sapiens
ctctggaagaatacacttagaa

SEQ ID NO: 9340267 - DNA, 20 bp, Homo sapiens
ctctggaagagtttaaatgg

SEQ ID NO: 9340268 - DNA, 20 bp, Homo sapiens
ctctggaagagtttaaatgg

SEQ ID NO: 9340269 - DNA, 20 bp, Homo sapiens
ctctggaagagtttaaatgg

SEQ ID NO: 9340270 - DNA, 22 bp, Homo sapiens
ctctggaagtgatggcaggtca

SEQ ID NO: 9340271 - DNA, 22 bp, Homo sapiens
ctctggaagtgatggcaggtca

SEQ ID NO: 9340272 - DNA, 22 bp, Homo sapiens
ctctggaagtgatggcaggtca

SEQ ID NO: 9340273 - DNA, 22 bp, Homo sapiens
ctctggaagatgacctgggtaa

SEQ ID NO: 9340274 - DNA, 22 bp, Homo sapiens
ctctggaagatgacctgggtaa

SEQ ID NO: 9340275 - DNA, 22 bp, Homo sapiens
ctctggaagatgacctgggtaa

SEQ ID NO: 9340276 - DNA, 22 bp, Homo sapiens
tttgtacatatataaaatctgt

SEQ ID NO: 9340277 - DNA, 22 bp, Homo sapiens
tttgtacatataaatcttgtat

SEQ ID NO: 9340278 - DNA, 22 bp, Homo sapiens
tttgtacatatataaaatctgt

SEQ ID NO: 9340279 - DNA, 22 bp, Homo sapiens
tttgtacatatataaaatctgt

SEQ ID NO: 9340280 - DNA, 22 bp, Homo sapiens
tttgtacatataaatcttgtat

SEQ ID NO: 9340281 - DNA, 22 bp, Homo sapiens
tttgttctgaaaactcaagtcc

SEQ ID NO: 9340282 - DNA, 22 bp, Homo sapiens
tttgttctattttagagatgaa

SEQ ID NO: 9340283 - DNA, 22 bp, Homo sapiens
tttgttctattttagagatgaa

SEQ ID NO: 9340284 - DNA, 22 bp, Homo sapiens
ttttaagaactgttctgtgctt

SEQ ID NO: 9340285 - DNA, 22 bp, Homo sapiens
ttttaagatgctagtatttcag

SEQ ID NO: 9340286 - DNA, 22 bp, Homo sapiens
ttttaagaggaggctgtttgaa

SEQ ID NO: 9340287 - DNA, 22 bp, Homo sapiens
tttgtacactgtctactatgaa

SEQ ID NO: 9340288 - DNA, 22 bp, Homo sapiens
tttgtacactgtctactatgaa

SEQ ID NO: 9340289 - DNA, 22 bp, Homo sapiens
tttgtacactgtctactatgaa

SEQ ID NO: 9340290 - DNA, 22 bp, Homo sapiens
tttgtacagtgatgttgtatgc

SEQ ID NO: 9340291 - DNA, 22 bp, Homo sapiens
tttgtacagtgaaagcgaggtt

SEQ ID NO: 9340292 - DNA, 23 bp, Homo sapiens
tttgtacagaattttgccttcag

SEQ ID NO: 9340293 - DNA, 22 bp, Homo sapiens
tttgtacacctacctaatacag

SEQ ID NO: 9340294 - DNA, 22 bp, Homo sapiens
tttgtacacaggtcattcaggg

SEQ ID NO: 9340295 - DNA, 22 bp, Homo sapiens
ttttaatactgctattgtagga

SEQ ID NO: 9340296 - DNA, 22 bp, Homo sapiens
ttttaatactgctattgtagga

SEQ ID NO: 9340297 - DNA, 22 bp, Homo sapiens
ttttaagttggattgctaagta

SEQ ID NO: 9340298 - DNA, 22 bp, Homo sapiens
ttttaatactgctattgtagga

SEQ ID NO: 9340299 - DNA, 22 bp, Homo sapiens
ttttaagttaatataattgagg

SEQ ID NO: 9340300 - DNA, 19 bp, Homo sapiens
ttttaagtgccctttcttc

SEQ ID NO: 9340301 - DNA, 19 bp, Homo sapiens
ttttaagtcctctctattc

SEQ ID NO: 9340302 - DNA, 22 bp, Homo sapiens
ttttagcactaagtgatatgct

SEQ ID NO: 9340303 - DNA, 22 bp, Homo sapiens
ttttagattgggaaatgtaaag

SEQ ID NO: 9340304 - DNA, 22 bp, Homo sapiens
ttttagattataagtctaattc

SEQ ID NO: 9340305 - DNA, 22 bp, Homo sapiens
ttttagatagtttaactgcact

SEQ ID NO: 9340306 - DNA, 22 bp, Homo sapiens
ttttaatactgctattgtagga

SEQ ID NO: 9340307 - DNA, 22 bp, Homo sapiens
ttttcacattgtcccagcacta

SEQ ID NO: 9340308 - DNA, 22 bp, Homo sapiens
ttttcaccagcttgctacaatt

SEQ ID NO: 9340309 - DNA, 22 bp, Homo sapiens
ttttcagaattagcataccatt

SEQ ID NO: 9340310 - DNA, 22 bp, Homo sapiens
ttttcagagagcttttatgtcc

SEQ ID NO: 9340311 - DNA, 22 bp, Homo sapiens
ttttcagaaagatgagaaatta

SEQ ID NO: 9340312 - DNA, 22 bp, Homo sapiens
ttttcagaaagatgagaaatta

SEQ ID NO: 9340313 - DNA, 22 bp, Homo sapiens
ttttcacttaaggaatttcatg

SEQ ID NO: 9340314 - DNA, 22 bp, Homo sapiens
ttttcagaggcctaagaggttt

SEQ ID NO: 9340315 - DNA, 22 bp, Homo sapiens
ttttcagaggcctaagaggttt

SEQ ID NO: 9340316 - DNA, 22 bp, Homo sapiens
ttttcagtgggcaatgatgtga

SEQ ID NO: 9340317 - DNA, 22 bp, Homo sapiens
ttttcagtggcttgcatatgtt

SEQ ID NO: 9340318 - DNA, 22 bp, Homo sapiens
ttttcagtaatgtctacataat

SEQ ID NO: 9340319 - DNA, 22 bp, Homo sapiens
ttttcagtaatgtctacataat

SEQ ID NO: 9340320 - DNA, 22 bp, Homo sapiens
ttttcagtggtatctttgtaaa

SEQ ID NO: 9340321 - DNA, 22 bp, Homo sapiens
ttttcagttactgtttatgtga

SEQ ID NO: 9340322 - DNA, 22 bp, Homo sapiens
ttttcagttatagaatggtaga

SEQ ID NO: 9340323 - DNA, 22 bp, Homo sapiens
ctcttgtggtttataaagatat

SEQ ID NO: 9340324 - DNA, 22 bp, Homo sapiens
ctcttcttgcctgatgaggcag

SEQ ID NO: 9340325 - DNA, 22 bp, Homo sapiens
ctcttcttgaaagaggaattca

SEQ ID NO: 9340326 - DNA, 22 bp, Homo sapiens
ctcttcttgaaagaggaattca

SEQ ID NO: 9340327 - DNA, 22 bp, Homo sapiens
ctctttactgctactacaaaga

SEQ ID NO: 9340328 - DNA, 22 bp, Homo sapiens
ctctttactgctactacaaaga

SEQ ID NO: 9340329 - DNA, 20 bp, Homo sapiens
ctctttacatgtctcttcct

SEQ ID NO: 9340330 - DNA, 22 bp, Homo sapiens
ctctttaagctcctaacagcca

SEQ ID NO: 9340331 - DNA, 22 bp, Homo sapiens
ctcttgtttcctttctgcagtc

SEQ ID NO: 9340332 - DNA, 22 bp, Homo sapiens
ctcttcaggtttctgctctgga

SEQ ID NO: 9340333 - DNA, 22 bp, Homo sapiens
ctcttcagatatacagtactct

SEQ ID NO: 9340334 - DNA, 22 bp, Homo sapiens
ctcttcagttcacccctaagca

SEQ ID NO: 9340335 - DNA, 22 bp, Homo sapiens
ctcttcagttcacccctaagca

SEQ ID NO: 9340336 - DNA, 22 bp, Homo sapiens
ctcttccatattactcagggta

SEQ ID NO: 9340337 - DNA, 22 bp, Homo sapiens
ctcttccatttctacttcacag

SEQ ID NO: 9340338 - DNA, 22 bp, Homo sapiens
ctcttccacctccttcaggaga

SEQ ID NO: 9340339 - DNA, 22 bp, Homo sapiens
ctcttccatattactcagggta

SEQ ID NO: 9340340 - DNA, 22 bp, Homo sapiens
ctcttcattagttcctgtccca

SEQ ID NO: 9340341 - DNA, 22 bp, Homo sapiens
ctcttcattagttcctgtccca

SEQ ID NO: 9340342 - DNA, 22 bp, Homo sapiens
ctcttccacctccttcaggaga

SEQ ID NO: 9340343 - DNA, 22 bp, Homo sapiens
ctcttagtttgtaaaaataatt

SEQ ID NO: 9340344 - DNA, 22 bp, Homo sapiens
ctctgtttctcagcctatttcc

SEQ ID NO: 9340345 - DNA, 23 bp, Homo sapiens
ttttagtgactcctttatctgcc

SEQ ID NO: 9340346 - DNA, 22 bp, Homo sapiens
ttttagtaccaaccagaagatg

SEQ ID NO: 9340347 - DNA, 22 bp, Homo sapiens
ctcacaccagcttacaagactt

SEQ ID NO: 9340348 - DNA, 22 bp, Homo sapiens
ctcacagggttctatcgaagag

SEQ ID NO: 9340349 - DNA, 22 bp, Homo sapiens
ctcacaggtcatgtggtggctt

SEQ ID NO: 9340350 - DNA, 22 bp, Homo sapiens
ctcacaggagaaagtcatggtc

SEQ ID NO: 9340351 - DNA, 22 bp, Homo sapiens
ctcaagtctgatgggttaggtt

SEQ ID NO: 9340352 - DNA, 22 bp, Homo sapiens
ctcaagtctattgataagtgca

SEQ ID NO: 9340353 - DNA, 22 bp, Homo sapiens
ctcaagtctgagtactggctct

SEQ ID NO: 9340354 - DNA, 22 bp, Homo sapiens
ctcaagtcagaaataaaagcat

SEQ ID NO: 9340355 - DNA, 22 bp, Homo sapiens
ctcaagtccatagaatcaggaa

SEQ ID NO: 9340356 - DNA, 22 bp, Homo sapiens
ctcaaaatccataaaatcaggt

SEQ ID NO: 9340357 - DNA, 22 bp, Homo sapiens
ctcaagaggatatgtccagaaa

SEQ ID NO: 9340358 - DNA, 22 bp, Homo sapiens
ctcaagatattccagctctcaa

SEQ ID NO: 9340359 - DNA, 22 bp, Homo sapiens
ctcaagataatgacaaaaagag

SEQ ID NO: 9340360 - DNA, 22 bp, Homo sapiens
ctcaagatattccagctctcaa

SEQ ID NO: 9340361 - DNA, 22 bp, Homo sapiens
ctattattatgttaactggact

SEQ ID NO: 9340362 - DNA, 22 bp, Homo sapiens
ctattattatgttaactggact

SEQ ID NO: 9340363 - DNA, 22 bp, Homo sapiens
ctattatttcctcatctataaa

SEQ ID NO: 9340364 - DNA, 22 bp, Homo sapiens
ctcaaaatccataaaatcaggt

SEQ ID NO: 9340365 - DNA, 22 bp, Homo sapiens
ctattactgacttctgtattta

SEQ ID NO: 9340366 - DNA, 22 bp, Homo sapiens
ctattagaaagcatcttctata

SEQ ID NO: 9340367 - DNA, 22 bp, Homo sapiens
ctattagaaagcatcttctata

SEQ ID NO: 9340368 - DNA, 22 bp, Homo sapiens
ctattagacacaattagtgatt

SEQ ID NO: 9340369 - DNA, 22 bp, Homo sapiens
ctattagacacaattagtgatt

SEQ ID NO: 9340370 - DNA, 22 bp, Homo sapiens
ctattattagataatctacttg

SEQ ID NO: 9340371 - DNA, 22 bp, Homo sapiens
ctattattagcaaaaggtggat

SEQ ID NO: 9340372 - DNA, 22 bp, Homo sapiens
ctagcacagtatggtatcagat

SEQ ID NO: 9340373 - DNA, 22 bp, Homo sapiens
ctagatttctagttcattatcc

SEQ ID NO: 9340374 - DNA, 22 bp, Homo sapiens
ctagatgccaatttttatggat

SEQ ID NO: 9340375 - DNA, 21 bp, Homo sapiens
ttctctggcttctgtagctgg

SEQ ID NO: 9340376 - DNA, 22 bp, Homo sapiens
ttctctggccatagctggctag

SEQ ID NO: 9340377 - DNA, 22 bp, Homo sapiens
ttctctggcctgaggcgaggcc

SEQ ID NO: 9340378 - DNA, 22 bp, Homo sapiens
ttctctggccatagctggctag

SEQ ID NO: 9340379 - DNA, 22 bp, Homo sapiens
ttctctggcgcgctgtgctatg

SEQ ID NO: 9340380 - DNA, 22 bp, Homo sapiens
ctagccagactcaagggccacc

SEQ ID NO: 9340381 - DNA, 22 bp, Homo sapiens
ctagccagatgattcccaaata

SEQ ID NO: 9340382 - DNA, 22 bp, Homo sapiens
ctatatacttttcacagatgtt

SEQ ID NO: 9340383 - DNA, 22 bp, Homo sapiens
ctatatacttttcacagatgtt

SEQ ID NO: 9340384 - DNA, 22 bp, Homo sapiens
ctagccagatttaaagagagac

SEQ ID NO: 9340385 - DNA, 22 bp, Homo sapiens
ctatatacttttcacagatgtt

SEQ ID NO: 9340386 - DNA, 22 bp, Homo sapiens
ctagcaggtcaaaccagctgat

SEQ ID NO: 9340387 - DNA, 22 bp, Homo sapiens
ctagcagggtcgacgtctggcg

SEQ ID NO: 9340388 - DNA, 22 bp, Homo sapiens
ctagcagggtcgacgtctggcg

SEQ ID NO: 9340389 - DNA, 22 bp, Homo sapiens
ctagcaggtcaaaccagctgat

SEQ ID NO: 9340390 - DNA, 22 bp, Homo sapiens
ctagcagggtcgacgtctggcg

SEQ ID NO: 9340391 - DNA, 22 bp, Homo sapiens
ctagcagggattgggcactggg

SEQ ID NO: 9340392 - DNA, 22 bp, Homo sapiens
ctagcagggattgggcactggg

SEQ ID NO: 9340393 - DNA, 22 bp, Homo sapiens
ctagcaggctaatgtaagcttg

SEQ ID NO: 9340394 - DNA, 22 bp, Homo sapiens
ctattacaatctgctactatga

SEQ ID NO: 9340395 - DNA, 19 bp, Homo sapiens
ctatgtttatatatccagt

SEQ ID NO: 9340396 - DNA, 22 bp, Homo sapiens
ctatgtgtcttgaaacaagact

SEQ ID NO: 9340397 - DNA, 22 bp, Homo sapiens
ctatgtttatctgtatttctgt

SEQ ID NO: 9340398 - DNA, 22 bp, Homo sapiens
ctattaaacactactgtgcact

SEQ ID NO: 9340399 - DNA, 22 bp, Homo sapiens
ctattaaatactcttcaaattg

SEQ ID NO: 9340400 - DNA, 22 bp, Homo sapiens
ctatggtgatagaaatcagaat

SEQ ID NO: 9340401 - DNA, 22 bp, Homo sapiens
ctatggtctggaccgaggtcct

SEQ ID NO: 9340402 - DNA, 22 bp, Homo sapiens
ctatgtatgcgattagaatttt

SEQ ID NO: 9340403 - DNA, 22 bp, Homo sapiens
ctatgtactggattagctccca

SEQ ID NO: 9340404 - DNA, 22 bp, Homo sapiens
ctatgtatgcgattagaatttt

SEQ ID NO: 9340405 - DNA, 22 bp, Homo sapiens
ctatgtaccatgcctgatgtta

SEQ ID NO: 9340406 - DNA, 23 bp, Homo sapiens
ctatggttttaaaggtggatatc

SEQ ID NO: 9340407 - DNA, 22 bp, Homo sapiens
ctatatatatcatcttccagtt

SEQ ID NO: 9340408 - DNA, 22 bp, Homo sapiens
ctatatatatcatcttccagtt

SEQ ID NO: 9340409 - DNA, 22 bp, Homo sapiens
ctatatatatcatcttccagtt

SEQ ID NO: 9340410 - DNA, 22 bp, Homo sapiens
ctatggcatgtcacctgctgag

SEQ ID NO: 9340411 - DNA, 22 bp, Homo sapiens
ctacaggtatgtgcatgacatc

SEQ ID NO: 9340412 - DNA, 22 bp, Homo sapiens
ctacaggctcagggagccctct

SEQ ID NO: 9340413 - DNA, 22 bp, Homo sapiens
ctacaggctcagggagccctct

SEQ ID NO: 9340414 - DNA, 22 bp, Homo sapiens
ctacaggctcagggagccctct

SEQ ID NO: 9340415 - DNA, 22 bp, Homo sapiens
ctacaggtcagtaagacctaga

SEQ ID NO: 9340416 - DNA, 22 bp, Homo sapiens
ctacaggtcaagcagtagctct

SEQ ID NO: 9340417 - DNA, 22 bp, Homo sapiens
ctacagagtatctaaagaggta

SEQ ID NO: 9340418 - DNA, 22 bp, Homo sapiens
ctacagagtatctaaagaggta

SEQ ID NO: 9340419 - DNA, 22 bp, Homo sapiens
ctacagctgtgtgtttatgtgc

SEQ ID NO: 9340420 - DNA, 22 bp, Homo sapiens
ttcctgggcaggacgagagtct

SEQ ID NO: 9340421 - DNA, 22 bp, Homo sapiens
ttcctgggccttaaatcttttg

SEQ ID NO: 9340422 - DNA, 22 bp, Homo sapiens
ttcctgggctctggctggccta

SEQ ID NO: 9340423 - DNA, 22 bp, Homo sapiens
ttcctgggagctagccacatct

SEQ ID NO: 9340424 - DNA, 22 bp, Homo sapiens
ttcctgggaggctgtgtacttg

SEQ ID NO: 9340425 - DNA, 22 bp, Homo sapiens
ttcctgggattattgtcaagca

SEQ ID NO: 9340426 - DNA, 22 bp, Homo sapiens
ttcctgggattattgtcaagca

SEQ ID NO: 9340427 - DNA, 22 bp, Homo sapiens
ttcctgggactggagcagccca

SEQ ID NO: 9340428 - DNA, 22 bp, Homo sapiens
ttcctgggactggagcagccca

SEQ ID NO: 9340429 - DNA, 22 bp, Homo sapiens
ttcctggcttcatactttgtac

SEQ ID NO: 9340430 - DNA, 22 bp, Homo sapiens
ttcctggctgtcatgccctagt

SEQ ID NO: 9340431 - DNA, 22 bp, Homo sapiens
ttcctggcttttgggctaattc

SEQ ID NO: 9340432 - DNA, 22 bp, Homo sapiens
ttcctggcttgtcacatctacg

SEQ ID NO: 9340433 - DNA, 22 bp, Homo sapiens
ttcctggctgatctaccaaagt

SEQ ID NO: 9340434 - DNA, 22 bp, Homo sapiens
ttcctggctggcggttttggtg

SEQ ID NO: 9340435 - DNA, 22 bp, Homo sapiens
ttcctggctgaactgaactcct

SEQ ID NO: 9340436 - DNA, 19 bp, Homo sapiens
ttcctggctcttctgtttt

SEQ ID NO: 9340437 - DNA, 19 bp, Homo sapiens
ttcctggctcttctgtttt

SEQ ID NO: 9340438 - DNA, 20 bp, Homo sapiens
ttcctggctctaggaccttg

SEQ ID NO: 9340439 - DNA, 22 bp, Homo sapiens
ttcctggctctctgttgcacag

SEQ ID NO: 9340440 - DNA, 20 bp, Homo sapiens
ttcctggctctaggaccttg

SEQ ID NO: 9340441 - DNA, 22 bp, Homo sapiens
ctacagagtatctaaagaggta

SEQ ID NO: 9340442 - DNA, 21 bp, Homo sapiens
ctacagaggagagggaaaggc

SEQ ID NO: 9340443 - DNA, 22 bp, Homo sapiens
ctacaacatagtcttctacaga

SEQ ID NO: 9340444 - DNA, 22 bp, Homo sapiens
ctacaacaccaggcacggagtg

SEQ ID NO: 9340445 - DNA, 22 bp, Homo sapiens
ctacagagaactcagctgccct

SEQ ID NO: 9340446 - DNA, 22 bp, Homo sapiens
ctaaatgacttccagtggttat

SEQ ID NO: 9340447 - DNA, 22 bp, Homo sapiens
ctaaatgacaggtaccatagtg

SEQ ID NO: 9340448 - DNA, 22 bp, Homo sapiens
ctaaatcaggccttacagcttc

SEQ ID NO: 9340449 - DNA, 22 bp, Homo sapiens
ctaaatcatcatttatgtttgt

SEQ ID NO: 9340450 - DNA, 22 bp, Homo sapiens
ctaaatgatattttggtttcct

SEQ ID NO: 9340451 - DNA, 21 bp, Homo sapiens
ttcctggggaaggagctgcct

SEQ ID NO: 9340452 - DNA, 22 bp, Homo sapiens
ttcctgggctttcccctctggt

SEQ ID NO: 9340453 - DNA, 21 bp, Homo sapiens
ttcctggggaaggagctgcct

SEQ ID NO: 9340454 - DNA, 22 bp, Homo sapiens
ttcctgggctttcccctctggt

SEQ ID NO: 9340455 - DNA, 22 bp, Homo sapiens
ttcctgggctgcagagagcacc

SEQ ID NO: 9340456 - DNA, 22 bp, Homo sapiens
ctaccttcaagttcctccctct

SEQ ID NO: 9340457 - DNA, 22 bp, Homo sapiens
ctaccttactttaaccctgcaa

SEQ ID NO: 9340458 - DNA, 22 bp, Homo sapiens
ctacccttaagtttctgtgggg

SEQ ID NO: 9340459 - DNA, 22 bp, Homo sapiens
ctacccttaagtttctgtgggg

SEQ ID NO: 9340460 - DNA, 22 bp, Homo sapiens
ctaccttatcagagtggtaagg

SEQ ID NO: 9340461 - DNA, 22 bp, Homo sapiens
ctactagatcagtatgcctcaa

SEQ ID NO: 9340462 - DNA, 22 bp, Homo sapiens
ctactactccaccacttaccag

SEQ ID NO: 9340463 - DNA, 22 bp, Homo sapiens
ctactatttgtcctttataagc

SEQ ID NO: 9340464 - DNA, 22 bp, Homo sapiens
ctactctcccatgattctctgt

SEQ ID NO: 9340465 - DNA, 22 bp, Homo sapiens
ctactgccattgtctctgccat

SEQ ID NO: 9340466 - DNA, 22 bp, Homo sapiens
ctactgccattgtctctgccat

SEQ ID NO: 9340467 - DNA, 22 bp, Homo sapiens
ctactgtattatggacattacg

SEQ ID NO: 9340468 - DNA, 22 bp, Homo sapiens
ctactgtaatagatgaatttga

SEQ ID NO: 9340469 - DNA, 22 bp, Homo sapiens
ctactgtagtggcctatttacc

SEQ ID NO: 9340470 - DNA, 22 bp, Homo sapiens
ctactgtagttaaagttttgta

SEQ ID NO: 9340471 - DNA, 20 bp, Homo sapiens
ctactttaggcactgagaat

SEQ ID NO: 9340472 - DNA, 19 bp, Homo sapiens
ctactttataatatgcctc

SEQ ID NO: 9340473 - DNA, 22 bp, Homo sapiens
ctactttaacaattcgcaagaa

SEQ ID NO: 9340474 - DNA, 22 bp, Homo sapiens
ctacttgttcactgtaggtcgc

SEQ ID NO: 9340475 - DNA, 22 bp, Homo sapiens
ctactttacctccatcagactg

SEQ ID NO: 9340476 - DNA, 22 bp, Homo sapiens
ctactttaattttctgcagaga

SEQ ID NO: 9340477 - DNA, 22 bp, Homo sapiens
ctacttgttcactgtaggtcgc

SEQ ID NO: 9340478 - DNA, 22 bp, Homo sapiens
ttctctggagagtatcttctta

SEQ ID NO: 9340479 - DNA, 22 bp, Homo sapiens
ttctctggagagtatcttctta

SEQ ID NO: 9340480 - DNA, 22 bp, Homo sapiens
ttctctggactatttgcactcc

SEQ ID NO: 9340481 - DNA, 22 bp, Homo sapiens
ttctctggatgtttctcagtca

SEQ ID NO: 9340482 - DNA, 22 bp, Homo sapiens
ttcagagtaggatactagctta

SEQ ID NO: 9340483 - DNA, 20 bp, Homo sapiens
ttcagaggtgaagttgtggt

SEQ ID NO: 9340484 - DNA, 22 bp, Homo sapiens
ttcagaggtaagggtctcagaa

SEQ ID NO: 9340485 - DNA, 22 bp, Homo sapiens
ttcagagtcagggatctcagag

SEQ ID NO: 9340486 - DNA, 22 bp, Homo sapiens
ttcagataaattgttttgtgat

SEQ ID NO: 9340487 - DNA, 22 bp, Homo sapiens
ttcagataaactacaaataatt

SEQ ID NO: 9340488 - DNA, 22 bp, Homo sapiens
ttcacacagcaactgtatgaat

SEQ ID NO: 9340489 - DNA, 21 bp, Homo sapiens
ttcagaggatgccaaggtcca

SEQ ID NO: 9340490 - DNA, 22 bp, Homo sapiens
ttcagaggctctgccaatgtgt

SEQ ID NO: 9340491 - DNA, 22 bp, Homo sapiens
ttcagaaagtgaatcttgttat

SEQ ID NO: 9340492 - DNA, 22 bp, Homo sapiens
ttcagcaaacacgatgcttgtt

SEQ ID NO: 9340493 - DNA, 22 bp, Homo sapiens
ttcagattttttaataggtaat

SEQ ID NO: 9340494 - DNA, 22 bp, Homo sapiens
ttcagatatcattaatttagta

SEQ ID NO: 9340495 - DNA, 22 bp, Homo sapiens
ttcagatatcattaatttagta

SEQ ID NO: 9340496 - DNA, 22 bp, Homo sapiens
ttcagggcagctagaaccagga

SEQ ID NO: 9340497 - DNA, 22 bp, Homo sapiens
ttcagggcatgagggacacatc

SEQ ID NO: 9340498 - DNA, 22 bp, Homo sapiens
ttcagggcagacagaagagatg

SEQ ID NO: 9340499 - DNA, 22 bp, Homo sapiens
ttcagggcagacagaagagatg

SEQ ID NO: 9340500 - DNA, 22 bp, Homo sapiens
ttcagggcagacagaagagatg

SEQ ID NO: 9340501 - DNA, 22 bp, Homo sapiens
cggtcaggtgcagcgttggcac

SEQ ID NO: 9340502 - DNA, 22 bp, Homo sapiens
cggtcaggtgcagcgttggcac

SEQ ID NO: 9340503 - DNA, 22 bp, Homo sapiens
ttcagggagagcgggacgggtg

SEQ ID NO: 9340504 - DNA, 22 bp, Homo sapiens
ttcagggagagcgggacgggtg

SEQ ID NO: 9340505 - DNA, 22 bp, Homo sapiens
ttcagggagagcgggacgggtg

SEQ ID NO: 9340506 - DNA, 22 bp, Homo sapiens
ttcagggacttagtgtcagttt

SEQ ID NO: 9340507 - DNA, 22 bp, Homo sapiens
ttcatgaacgaacatatgtata

SEQ ID NO: 9340508 - DNA, 22 bp, Homo sapiens
ctaaaattacctaccagtttag

SEQ ID NO: 9340509 - DNA, 22 bp, Homo sapiens
ctaaaattatcaagataattcc

SEQ ID NO: 9340510 - DNA, 22 bp, Homo sapiens
ctaaacttttataacattgaga

SEQ ID NO: 9340511 - DNA, 15 bp, Homo sapiens
ctaaaatccctgggc

SEQ ID NO: 9340512 - DNA, 22 bp, Homo sapiens
ctaaatactagccttcagattt

SEQ ID NO: 9340513 - DNA, 17 bp, Homo sapiens
ctaaatacttgcgtttc

SEQ ID NO: 9340514 - DNA, 22 bp, Homo sapiens
ctaaaggattcttagttcctgg

SEQ ID NO: 9340515 - DNA, 22 bp, Homo sapiens
cggtggtcccaagagggtggca

SEQ ID NO: 9340516 - DNA, 22 bp, Homo sapiens
cggtggtctcctgcgacatgaa

SEQ ID NO: 9340517 - DNA, 22 bp, Homo sapiens
cggtggtcacaaacaatgacta

SEQ ID NO: 9340518 - DNA, 22 bp, Homo sapiens
cggtggtcataagtggctggcg

SEQ ID NO: 9340519 - DNA, 22 bp, Homo sapiens
cggtggtcattatactcctttc

SEQ ID NO: 9340520 - DNA, 21 bp, Homo sapiens
cggtggctcccgggatggctc

SEQ ID NO: 9340521 - DNA, 22 bp, Homo sapiens
cggtggctcaggcccccagcag

SEQ ID NO: 9340522 - DNA, 21 bp, Homo sapiens
cggtggctcccgggatggctc

SEQ ID NO: 9340523 - DNA, 19 bp, Homo sapiens
cggtggcttgcagggaggt

SEQ ID NO: 9340524 - DNA, 19 bp, Homo sapiens
cggtggcttgcagggaggt

SEQ ID NO: 9340525 - DNA, 22 bp, Homo sapiens
cgtagctcacgccccctctccc

SEQ ID NO: 9340526 - DNA, 19 bp, Homo sapiens
cgtacctgacacagaacag

SEQ ID NO: 9340527 - DNA, 22 bp, Homo sapiens
cgtaggtggctcagcacctggg

SEQ ID NO: 9340528 - DNA, 22 bp, Homo sapiens
cggtggccaacaagaggccggg

SEQ ID NO: 9340529 - DNA, 22 bp, Homo sapiens
ttcatctggaagttcccaaggc

SEQ ID NO: 9340530 - DNA, 22 bp, Homo sapiens
ttcatccatatgcagagagctt

SEQ ID NO: 9340531 - DNA, 22 bp, Homo sapiens
cgtcacttcttagtctattttc

SEQ ID NO: 9340532 - DNA, 22 bp, Homo sapiens
cgtcaggtgtgattatttttca

SEQ ID NO: 9340533 - DNA, 22 bp, Homo sapiens
cgtcaggtccccagtgaagttg

SEQ ID NO: 9340534 - DNA, 22 bp, Homo sapiens
cgtcaggtttgtggcacctggg

SEQ ID NO: 9340535 - DNA, 22 bp, Homo sapiens
cgtatttagaaggctgctgaaa

SEQ ID NO: 9340536 - DNA, 22 bp, Homo sapiens
cgtcactggcgtgaagtgagga

SEQ ID NO: 9340537 - DNA, 22 bp, Homo sapiens
cgtcacttcttagtctattttc

SEQ ID NO: 9340538 - DNA, 19 bp, Homo sapiens
cctttcagaacagaagcca

SEQ ID NO: 9340539 - DNA, 19 bp, Homo sapiens
cctttcagaacagaagcca

SEQ ID NO: 9340540 - DNA, 18 bp, Homo sapiens
cctttcctcccctcagct

SEQ ID NO: 9340541 - DNA, 22 bp, Homo sapiens
cctttctctatcgacccatcgc

SEQ ID NO: 9340542 - DNA, 22 bp, Homo sapiens
cctttctcattttaagcattag

SEQ ID NO: 9340543 - DNA, 22 bp, Homo sapiens
cctttctctatcgacccatcgc

SEQ ID NO: 9340544 - DNA, 22 bp, Homo sapiens
cctttcctttttagtgtgggag

SEQ ID NO: 9340545 - DNA, 20 bp, Homo sapiens
ttaggaagtcacaatttcag

SEQ ID NO: 9340546 - DNA, 22 bp, Homo sapiens
ttaggaaggacttggattctgg

SEQ ID NO: 9340547 - DNA, 22 bp, Homo sapiens
ttaggaagttatagtggaaatg

SEQ ID NO: 9340548 - DNA, 22 bp, Homo sapiens
ttaggaagtgtgtccagaagcg

SEQ ID NO: 9340549 - DNA, 22 bp, Homo sapiens
ttaggaagtttcagaaaatgca

SEQ ID NO: 9340550 - DNA, 22 bp, Homo sapiens
ttaggcatgaacaggattcatt

SEQ ID NO: 9340551 - DNA, 22 bp, Homo sapiens
ttaggcattggaaggtcagctt

SEQ ID NO: 9340552 - DNA, 22 bp, Homo sapiens
ttaggatttgaaaaggggcaga

SEQ ID NO: 9340553 - DNA, 22 bp, Homo sapiens
ttaggatttgaaaaggggcaga

SEQ ID NO: 9340554 - DNA, 22 bp, Homo sapiens
ttaggagtccagatgtcttggg

SEQ ID NO: 9340555 - DNA, 22 bp, Homo sapiens
ttaggattaaaagttaatgcaa

SEQ ID NO: 9340556 - DNA, 22 bp, Homo sapiens
ttaggcatagttttgataaata

SEQ ID NO: 9340557 - DNA, 22 bp, Homo sapiens
cgcaggtgccggcagatggggt

SEQ ID NO: 9340558 - DNA, 19 bp, Homo sapiens
cgcaggtggaaggagccgc

SEQ ID NO: 9340559 - DNA, 19 bp, Homo sapiens
cgcaggtggaaggagccgc

SEQ ID NO: 9340560 - DNA, 22 bp, Homo sapiens
cgcaggtgccggcagatggggt

SEQ ID NO: 9340561 - DNA, 22 bp, Homo sapiens
cgcagctggatatcatgtgcct

SEQ ID NO: 9340562 - DNA, 22 bp, Homo sapiens
cgcagctgtccatgtgtggggg

SEQ ID NO: 9340563 - DNA, 22 bp, Homo sapiens
cgcaggtgttcagtaaatgtat

SEQ ID NO: 9340564 - DNA, 22 bp, Homo sapiens
cgcaggtgtgttttcaggacta

SEQ ID NO: 9340565 - DNA, 22 bp, Homo sapiens
cgcaggtgggcccttcattgat

SEQ ID NO: 9340566 - DNA, 22 bp, Homo sapiens
cgcaggtgggcccttcattgat

SEQ ID NO: 9340567 - DNA, 22 bp, Homo sapiens
cgcaggtgtgttttcaggacta

SEQ ID NO: 9340568 - DNA, 22 bp, Homo sapiens
cgcatacatagaaacacacaga

SEQ ID NO: 9340569 - DNA, 22 bp, Homo sapiens
cgcaggtgttcagtaaatgtat

SEQ ID NO: 9340570 - DNA, 22 bp, Homo sapiens
cgccaggcttggtagctcatgc

SEQ ID NO: 9340571 - DNA, 22 bp, Homo sapiens
cgcatacatagaaacacacaga

SEQ ID NO: 9340572 - DNA, 22 bp, Homo sapiens
cgccagtggcagctggaacagg

SEQ ID NO: 9340573 - DNA, 22 bp, Homo sapiens
cgccaggcttggtagctcatgc

SEQ ID NO: 9340574 - DNA, 22 bp, Homo sapiens
cgccagaactgtaagagaataa

SEQ ID NO: 9340575 - DNA, 22 bp, Homo sapiens
cgccccggacgtctgaccaaac

SEQ ID NO: 9340576 - DNA, 22 bp, Homo sapiens
cgccccctcggccacctgcggg

SEQ ID NO: 9340577 - DNA, 22 bp, Homo sapiens
cgccccagtctgtaggtgcccc

SEQ ID NO: 9340578 - DNA, 22 bp, Homo sapiens
cgccgcctgctgcagcagctgt

SEQ ID NO: 9340579 - DNA, 22 bp, Homo sapiens
cgccgcgcgttgattttctgtt

SEQ ID NO: 9340580 - DNA, 22 bp, Homo sapiens
cgccgcgccttgggagttccct

SEQ ID NO: 9340581 - DNA, 22 bp, Homo sapiens
cgccgcctgctgcagcagctgt

SEQ ID NO: 9340582 - DNA, 18 bp, Homo sapiens
cgccctgctataaatgac

SEQ ID NO: 9340583 - DNA, 22 bp, Homo sapiens
ttcaagtctgaagaggactaat

SEQ ID NO: 9340584 - DNA, 22 bp, Homo sapiens
cgcccaggctggagagcagtgg

SEQ ID NO: 9340585 - DNA, 22 bp, Homo sapiens
cgcccaggctggagagcagtgg

SEQ ID NO: 9340586 - DNA, 20 bp, Homo sapiens
cgcccaggagggcccatgtg

SEQ ID NO: 9340587 - DNA, 20 bp, Homo sapiens
cgcccaggagggcccatgtg

SEQ ID NO: 9340588 - DNA, 22 bp, Homo sapiens
cgcccagggcaggaggccgctc

SEQ ID NO: 9340589 - DNA, 22 bp, Homo sapiens
cgcccagggcaggaggccgctc

SEQ ID NO: 9340590 - DNA, 22 bp, Homo sapiens
cgcccagggcaggaggccgctc

SEQ ID NO: 9340591 - DNA, 22 bp, Homo sapiens
cgcccagggcaggaggccgctc

SEQ ID NO: 9340592 - DNA, 22 bp, Homo sapiens
ttcacaatttcccttcatcagg

SEQ ID NO: 9340593 - DNA, 22 bp, Homo sapiens
ttcacaatttcccttcatcagg

SEQ ID NO: 9340594 - DNA, 22 bp, Homo sapiens
ttcacacagaatctgaggagct

SEQ ID NO: 9340595 - DNA, 22 bp, Homo sapiens
ttcacacagcaactgtatgaat

SEQ ID NO: 9340596 - DNA, 19 bp, Homo sapiens
ttcacaattatgaaattag

SEQ ID NO: 9340597 - DNA, 22 bp, Homo sapiens
ttcacaattaactttatactta

SEQ ID NO: 9340598 - DNA, 22 bp, Homo sapiens
ttcaagttttatatccatggct

SEQ ID NO: 9340599 - DNA, 22 bp, Homo sapiens
cctgggagtgtcagacttgctt

SEQ ID NO: 9340600 - DNA, 22 bp, Homo sapiens
cctgggagtgtcagacttgctt

SEQ ID NO: 9340601 - DNA, 22 bp, Homo sapiens
cctgggagtgtgccatctctgt

SEQ ID NO: 9340602 - DNA, 22 bp, Homo sapiens
cctgggagtgtgccatctctgt

SEQ ID NO: 9340603 - DNA, 22 bp, Homo sapiens
cctgggagtgtcagacttgctt

SEQ ID NO: 9340604 - DNA, 22 bp, Homo sapiens
cctgggagtgtgccatctctgt

SEQ ID NO: 9340605 - DNA, 22 bp, Homo sapiens
cctgggagtgtgccatctctgt

SEQ ID NO: 9340606 - DNA, 22 bp, Homo sapiens
cctgggagtgtgccatctctgt

SEQ ID NO: 9340607 - DNA, 22 bp, Homo sapiens
cctgggagtggcactcacagca

SEQ ID NO: 9340608 - DNA, 22 bp, Homo sapiens
cctgggagtggcactcacagca

SEQ ID NO: 9340609 - DNA, 22 bp, Homo sapiens
cctgggagtggcactcacagca

SEQ ID NO: 9340610 - DNA, 19 bp, Homo sapiens
cctgggagtcagctgaagg

SEQ ID NO: 9340611 - DNA, 19 bp, Homo sapiens
cctgggagtcagctgaagg

SEQ ID NO: 9340612 - DNA, 22 bp, Homo sapiens
cctgggagtggcactcacagca

SEQ ID NO: 9340613 - DNA, 19 bp, Homo sapiens
cctgggagtcagctgaagg

SEQ ID NO: 9340614 - DNA, 19 bp, Homo sapiens
cctgggagtcagctgaagg

SEQ ID NO: 9340615 - DNA, 22 bp, Homo sapiens
cctgggaggtggatgttgcggt

SEQ ID NO: 9340616 - DNA, 22 bp, Homo sapiens
cctgggaggtggatgttgcggt

SEQ ID NO: 9340617 - DNA, 22 bp, Homo sapiens
cctgggaggctgaggctgcagt

SEQ ID NO: 9340618 - DNA, 22 bp, Homo sapiens
cctgggaggctgaggctgcagt

SEQ ID NO: 9340619 - DNA, 21 bp, Homo sapiens
tgggggagaattggttgcttt

SEQ ID NO: 9340620 - DNA, 21 bp, Homo sapiens
tgggggagaattggttgcttt

SEQ ID NO: 9340621 - DNA, 22 bp, Homo sapiens
tgggggaagagcttgttaaagt

SEQ ID NO: 9340622 - DNA, 22 bp, Homo sapiens
tggggctgtggattctcacgaa

SEQ ID NO: 9340623 - DNA, 22 bp, Homo sapiens
tggggctgtggattctcacgaa

SEQ ID NO: 9340624 - DNA, 22 bp, Homo sapiens
tggggcttctcctgtaggctca

SEQ ID NO: 9340625 - DNA, 22 bp, Homo sapiens
tggggctgtgagactacaggat

SEQ ID NO: 9340626 - DNA, 22 bp, Homo sapiens
tggggctgtccttagtctgaga

SEQ ID NO: 9340627 - DNA, 22 bp, Homo sapiens
tggggccaagaaggtctcatgt

SEQ ID NO: 9340628 - DNA, 23 bp, Homo sapiens
tggggccaagtgaggaagggtct

SEQ ID NO: 9340629 - DNA, 23 bp, Homo sapiens
tggggccaagtgaggaagggtct

SEQ ID NO: 9340630 - DNA, 22 bp, Homo sapiens
tggggcagctccatctattcca

SEQ ID NO: 9340631 - DNA, 22 bp, Homo sapiens
tggggcagctccatctattcca

SEQ ID NO: 9340632 - DNA, 22 bp, Homo sapiens
tggggcagccacatagacaaca

SEQ ID NO: 9340633 - DNA, 22 bp, Homo sapiens
tggggcagccacatagacaaca

SEQ ID NO: 9340634 - DNA, 22 bp, Homo sapiens
tggggcagttaataaacattct

SEQ ID NO: 9340635 - DNA, 22 bp, Homo sapiens
tggggcagtggcttttcaccct

SEQ ID NO: 9340636 - DNA, 22 bp, Homo sapiens
tggggcagggatgggaaactat

SEQ ID NO: 9340637 - DNA, 22 bp, Homo sapiens
tggggcagggatgggaaactat

SEQ ID NO: 9340638 - DNA, 22 bp, Homo sapiens
tgtgtattaatgtttgtatatg

SEQ ID NO: 9340639 - DNA, 22 bp, Homo sapiens
tgtgtctcaagtcagagcatca

SEQ ID NO: 9340640 - DNA, 22 bp, Homo sapiens
tgtgtattaatgtttgtatatg

SEQ ID NO: 9340641 - DNA, 22 bp, Homo sapiens
tgtgtatgttttgaggttgcta

SEQ ID NO: 9340642 - DNA, 22 bp, Homo sapiens
tgtgtatgtgtatacactatat

SEQ ID NO: 9340643 - DNA, 22 bp, Homo sapiens
tgtgtatgtgtatacactatat

SEQ ID NO: 9340644 - DNA, 22 bp, Homo sapiens
tgtgtatgtctgtatgcacaca

SEQ ID NO: 9340645 - DNA, 23 bp, Homo sapiens
tgtgtatgtatctatgcataggt

SEQ ID NO: 9340646 - DNA, 22 bp, Homo sapiens
tgtgtatgtaagcatgtgcata

SEQ ID NO: 9340647 - DNA, 22 bp, Homo sapiens
tgtgtatgtaagcatgtgcata

SEQ ID NO: 9340648 - DNA, 22 bp, Homo sapiens
tgtgtatattaggacacattct

SEQ ID NO: 9340649 - DNA, 22 bp, Homo sapiens
tgtgtatatgtaaatatagttg

SEQ ID NO: 9340650 - DNA, 22 bp, Homo sapiens
tgtgtatattaggacacattct

SEQ ID NO: 9340651 - DNA, 22 bp, Homo sapiens
tgtgtatgcatacacacataga

SEQ ID NO: 9340652 - DNA, 22 bp, Homo sapiens
tgtgtatgcatacacacataga

SEQ ID NO: 9340653 - DNA, 22 bp, Homo sapiens
tgtgtatgcatacacacataga

SEQ ID NO: 9340654 - DNA, 22 bp, Homo sapiens
tgtgtctgaactagttgctctc

SEQ ID NO: 9340655 - DNA, 22 bp, Homo sapiens
tgtgtctgaactagttgctctc

SEQ ID NO: 9340656 - DNA, 22 bp, Homo sapiens
tgtgtctgcactgagtcctcac

SEQ ID NO: 9340657 - DNA, 22 bp, Homo sapiens
tgtgtctgcactgagtcctcac

SEQ ID NO: 9340658 - DNA, 23 bp, Homo sapiens
tgtgtctgaggatatatgtgcat

SEQ ID NO: 9340659 - DNA, 23 bp, Homo sapiens
tgtgtctgaggatatatgtgcat

SEQ ID NO: 9340660 - DNA, 19 bp, Homo sapiens
tgtgtctctgtgtagcctg

SEQ ID NO: 9340661 - DNA, 22 bp, Homo sapiens
tgtgtctcctttccctgtctaa

SEQ ID NO: 9340662 - DNA, 22 bp, Homo sapiens
tgtgtctccatagccagctagc

SEQ ID NO: 9340663 - DNA, 22 bp, Homo sapiens
tgtgtctgaacatgctttgtaa

SEQ ID NO: 9340664 - DNA, 22 bp, Homo sapiens
tgtgtctctttgtcctagagct

SEQ ID NO: 9340665 - DNA, 22 bp, Homo sapiens
tgtgtctctttgtcctagagct

SEQ ID NO: 9340666 - DNA, 22 bp, Homo sapiens
cctgggcaacatagtgagacct

SEQ ID NO: 9340667 - DNA, 22 bp, Homo sapiens
cctgggcaacatagtgagacct

SEQ ID NO: 9340668 - DNA, 22 bp, Homo sapiens
cctgggcaacatagtgagacct

SEQ ID NO: 9340669 - DNA, 22 bp, Homo sapiens
cctgggcaacatagtgagaccc

SEQ ID NO: 9340670 - DNA, 22 bp, Homo sapiens
cctgggcaacatagtgagaccc

SEQ ID NO: 9340671 - DNA, 22 bp, Homo sapiens
cctgggcaacatagtgagaccc

SEQ ID NO: 9340672 - DNA, 22 bp, Homo sapiens
cctgggcaacatagggagaccc

SEQ ID NO: 9340673 - DNA, 22 bp, Homo sapiens
cctgggcaacatagggagaccc

SEQ ID NO: 9340674 - DNA, 22 bp, Homo sapiens
cctgggcaacatagggagaccc

SEQ ID NO: 9340675 - DNA, 22 bp, Homo sapiens
cctgggcaaattatgttactca

SEQ ID NO: 9340676 - DNA, 22 bp, Homo sapiens
cctgggcaaatgccagagacaa

SEQ ID NO: 9340677 - DNA, 22 bp, Homo sapiens
cctgggatttgcgccagacctt

SEQ ID NO: 9340678 - DNA, 22 bp, Homo sapiens
cctgggcaaatgccagagacaa

SEQ ID NO: 9340679 - DNA, 22 bp, Homo sapiens
cctgggcaatatagtgaggccc

SEQ ID NO: 9340680 - DNA, 22 bp, Homo sapiens
cctgggcaatatagtgaggccc

SEQ ID NO: 9340681 - DNA, 22 bp, Homo sapiens
tgtgggtcctcctgtgtgcccg

SEQ ID NO: 9340682 - DNA, 22 bp, Homo sapiens
tgtgggtcatagtatcgtgtta

SEQ ID NO: 9340683 - DNA, 22 bp, Homo sapiens
tgtgggtcttccaaagaagggc

SEQ ID NO: 9340684 - DNA, 22 bp, Homo sapiens
tgtgggtcctcctgtgtgcccg

SEQ ID NO: 9340685 - DNA, 20 bp, Homo sapiens
tgtgtataaatatatgtttc

SEQ ID NO: 9340686 - DNA, 20 bp, Homo sapiens
tgtgtataaatatatgtttc

SEQ ID NO: 9340687 - DNA, 22 bp, Homo sapiens
tgtgtataaaagcagtgcagga

SEQ ID NO: 9340688 - DNA, 22 bp, Homo sapiens
tgtgtataattagaccatttac

SEQ ID NO: 9340689 - DNA, 22 bp, Homo sapiens
tgtgtataactcttaattcatt

SEQ ID NO: 9340690 - DNA, 22 bp, Homo sapiens
tgtgtataactcttaattcatt

SEQ ID NO: 9340691 - DNA, 22 bp, Homo sapiens
tgtgtatacgagtatgaatatg

SEQ ID NO: 9340692 - DNA, 22 bp, Homo sapiens
tgtgtatacgagtatgaatatg

SEQ ID NO: 9340693 - DNA, 22 bp, Homo sapiens
tgtgtatacatacatacacacg

SEQ ID NO: 9340694 - DNA, 22 bp, Homo sapiens
tgtgtatacaacttataggagc

SEQ ID NO: 9340695 - DNA, 22 bp, Homo sapiens
tgtgtatagaaagtaggaaagg

SEQ ID NO: 9340696 - DNA, 22 bp, Homo sapiens
tgtgtatagatgcatgcatata

SEQ ID NO: 9340697 - DNA, 22 bp, Homo sapiens
tgtgtatagatgcatgcatata

SEQ ID NO: 9340698 - DNA, 22 bp, Homo sapiens
tgtgtataggttgtgctaatag

SEQ ID NO: 9340699 - DNA, 22 bp, Homo sapiens
tgtgtatatatgtgcacatgta

SEQ ID NO: 9340700 - DNA, 22 bp, Homo sapiens
tgtgtatatatgtttaagtcat

SEQ ID NO: 9340701 - DNA, 22 bp, Homo sapiens
cctgggctctgaggagggagtc

SEQ ID NO: 9340702 - DNA, 22 bp, Homo sapiens
cctgggctctgaggagggagtc

SEQ ID NO: 9340703 - DNA, 22 bp, Homo sapiens
cctgggctctgtcagaattggg

SEQ ID NO: 9340704 - DNA, 22 bp, Homo sapiens
cctgggctctgaggagggagtc

SEQ ID NO: 9340705 - DNA, 22 bp, Homo sapiens
cctgggctctgaggagggagtc

SEQ ID NO: 9340706 - DNA, 22 bp, Homo sapiens
cctgggctctgaggagggagtc

SEQ ID NO: 9340707 - DNA, 22 bp, Homo sapiens
cctgggctctatcctgacccag

SEQ ID NO: 9340708 - DNA, 22 bp, Homo sapiens
cctgggctcaagtgatcctcct

SEQ ID NO: 9340709 - DNA, 22 bp, Homo sapiens
cctgggctctatcctgacccag

SEQ ID NO: 9340710 - DNA, 22 bp, Homo sapiens
cctgggctcaagtgatcctcct

SEQ ID NO: 9340711 - DNA, 22 bp, Homo sapiens
cctgggctcgcgcacttcaccc

SEQ ID NO: 9340712 - DNA, 22 bp, Homo sapiens
tgtgtctgcccttagtacatct

SEQ ID NO: 9340713 - DNA, 22 bp, Homo sapiens
tgtgtctggataggtaatggat

SEQ ID NO: 9340714 - DNA, 22 bp, Homo sapiens
tgtgtctggataggtaatggat

SEQ ID NO: 9340715 - DNA, 22 bp, Homo sapiens
cctgggctgcatgatggcattt

SEQ ID NO: 9340716 - DNA, 22 bp, Homo sapiens
cctgggctgcatgatggcattt

SEQ ID NO: 9340717 - DNA, 22 bp, Homo sapiens
cctgggctgcatgatggcattt

SEQ ID NO: 9340718 - DNA, 22 bp, Homo sapiens
cctgggctgaagtcaagtgtgg

SEQ ID NO: 9340719 - DNA, 22 bp, Homo sapiens
cctgggctctgtcagaattggg

SEQ ID NO: 9340720 - DNA, 22 bp, Homo sapiens
cctgggctctgaggagggagtc

SEQ ID NO: 9340721 - DNA, 16 bp, Homo sapiens
cctgggctctgttgga

SEQ ID NO: 9340722 - DNA, 22 bp, Homo sapiens
cctgggctggagtacagcagtg

SEQ ID NO: 9340723 - DNA, 22 bp, Homo sapiens
cctgggctgctcatggggatga

SEQ ID NO: 9340724 - DNA, 22 bp, Homo sapiens
cctgggctggagtacagcagtg

SEQ ID NO: 9340725 - DNA, 22 bp, Homo sapiens
cctgggcttccacgagcagagg

SEQ ID NO: 9340726 - DNA, 22 bp, Homo sapiens
cctgggcttacgacctctgact

SEQ ID NO: 9340727 - DNA, 22 bp, Homo sapiens
cctgggcttacgacctctgact

SEQ ID NO: 9340728 - DNA, 22 bp, Homo sapiens
cctgggcttacgacctctgact

SEQ ID NO: 9340729 - DNA, 22 bp, Homo sapiens
cctgggctgttgcatcatcctt

SEQ ID NO: 9340730 - DNA, 22 bp, Homo sapiens
cctgggcttacgacctctgact

SEQ ID NO: 9340731 - DNA, 22 bp, Homo sapiens
cctgggctgggcgtctcatggg

SEQ ID NO: 9340732 - DNA, 22 bp, Homo sapiens
cctgggctgggcgtctcatggg

SEQ ID NO: 9340733 - DNA, 22 bp, Homo sapiens
cctgggctggagtacagcagtg

SEQ ID NO: 9340734 - DNA, 21 bp, Homo sapiens
cctgggctgtggtttggagac

SEQ ID NO: 9340735 - DNA, 21 bp, Homo sapiens
cctgggctgtggtttggagac

SEQ ID NO: 9340736 - DNA, 22 bp, Homo sapiens
cctgggctgtacctgtgcgcgg

SEQ ID NO: 9340737 - DNA, 22 bp, Homo sapiens
cctgggctgtacctgtgcgcgg

SEQ ID NO: 9340738 - DNA, 22 bp, Homo sapiens
tgttacaaatgcggagtttgtg

SEQ ID NO: 9340739 - DNA, 22 bp, Homo sapiens
tgttacaaactgttgtttctat

SEQ ID NO: 9340740 - DNA, 22 bp, Homo sapiens
tgttacaagtcttgaggtactt

SEQ ID NO: 9340741 - DNA, 19 bp, Homo sapiens
tgttcagatatgtcagctt

SEQ ID NO: 9340742 - DNA, 22 bp, Homo sapiens
tgttcattactgctgtttgcca

SEQ ID NO: 9340743 - DNA, 22 bp, Homo sapiens
tgttacaagtcttgaggtactt

SEQ ID NO: 9340744 - DNA, 22 bp, Homo sapiens
tgttacacagcagaatagcaag

SEQ ID NO: 9340745 - DNA, 22 bp, Homo sapiens
tgttacagaatgaatttccgga

SEQ ID NO: 9340746 - DNA, 22 bp, Homo sapiens
tgttacagaaatattgcttctt

SEQ ID NO: 9340747 - DNA, 22 bp, Homo sapiens
tgttacagaaagtttatgaatg

SEQ ID NO: 9340748 - DNA, 22 bp, Homo sapiens
tgttacaggaaatagaattacc

SEQ ID NO: 9340749 - DNA, 22 bp, Homo sapiens
tgttacagtcattgttttctga

SEQ ID NO: 9340750 - DNA, 22 bp, Homo sapiens
tgttacagtactacaattctgc

SEQ ID NO: 9340751 - DNA, 22 bp, Homo sapiens
tgttcatttggcccttttgtat

SEQ ID NO: 9340752 - DNA, 22 bp, Homo sapiens
tgttcattctgtatatgctgta

SEQ ID NO: 9340753 - DNA, 22 bp, Homo sapiens
tgttcattcgctattgtctatg

SEQ ID NO: 9340754 - DNA, 22 bp, Homo sapiens
tgttcattattcttcatctgcc

SEQ ID NO: 9340755 - DNA, 23 bp, Homo sapiens
tgttccagatacgccttttcctc

SEQ ID NO: 9340756 - DNA, 23 bp, Homo sapiens
tgttccagatacgccttttcctc

SEQ ID NO: 9340757 - DNA, 22 bp, Homo sapiens
tgttccagattcggcgtgggac

SEQ ID NO: 9340758 - DNA, 22 bp, Homo sapiens
tgttccagatttagccaaccga

SEQ ID NO: 9340759 - DNA, 22 bp, Homo sapiens
tgttccagattcggcgtgggac

SEQ ID NO: 9340760 - DNA, 22 bp, Homo sapiens
tgttccagggcgcgaaggtggt

SEQ ID NO: 9340761 - DNA, 22 bp, Homo sapiens
tgttccataagtggtgctttgt

SEQ ID NO: 9340762 - DNA, 22 bp, Homo sapiens
cctgggtgtcatgggcagctgg

SEQ ID NO: 9340763 - DNA, 22 bp, Homo sapiens
cctggtgcttaccagagctttt

SEQ ID NO: 9340764 - DNA, 22 bp, Homo sapiens
cctgggtgtcatgggcagctgg

SEQ ID NO: 9340765 - DNA, 22 bp, Homo sapiens
cctggtttcaggaacataatct

SEQ ID NO: 9340766 - DNA, 22 bp, Homo sapiens
tgtttactggaccagggagggg

SEQ ID NO: 9340767 - DNA, 22 bp, Homo sapiens
cctggtttctccatgtctcatt

SEQ ID NO: 9340768 - DNA, 22 bp, Homo sapiens
tgtttacttaaatgttttcata

SEQ ID NO: 9340769 - DNA, 22 bp, Homo sapiens
cctggtttgggtgccagtgagt

SEQ ID NO: 9340770 - DNA, 22 bp, Homo sapiens
tgtttactggctcctgtggttc

SEQ ID NO: 9340771 - DNA, 22 bp, Homo sapiens
tgtttacttgaggtggaaacaa

SEQ ID NO: 9340772 - DNA, 22 bp, Homo sapiens
tgtttacttctttccatggctt

SEQ ID NO: 9340773 - DNA, 22 bp, Homo sapiens
tgtttacttcatcgagtacttc

SEQ ID NO: 9340774 - DNA, 22 bp, Homo sapiens
tgtttacttatgtgggtcacat

SEQ ID NO: 9340775 - DNA, 21 bp, Homo sapiens
cctggttggcgtagctcagtc

SEQ ID NO: 9340776 - DNA, 22 bp, Homo sapiens
cctggttgagggaggtgtggac

SEQ ID NO: 9340777 - DNA, 22 bp, Homo sapiens
cctggtttaatgctcactgttg

SEQ ID NO: 9340778 - DNA, 22 bp, Homo sapiens
cctggtttatgccagatcctgt

SEQ ID NO: 9340779 - DNA, 21 bp, Homo sapiens
ttactaaacaaaacatgcagg

SEQ ID NO: 9340780 - DNA, 22 bp, Homo sapiens
ccttctagcaaatcaacataaa

SEQ ID NO: 9340781 - DNA, 22 bp, Homo sapiens
ccttctagcaaatcaacataaa

SEQ ID NO: 9340782 - DNA, 22 bp, Homo sapiens
ccttctagcaaatcaacataaa

SEQ ID NO: 9340783 - DNA, 22 bp, Homo sapiens
ccttcctttgcatcatttctag

SEQ ID NO: 9340784 - DNA, 22 bp, Homo sapiens
ccttccttttactgtctccgga

SEQ ID NO: 9340785 - DNA, 22 bp, Homo sapiens
ccttccttttactgtctccgga

SEQ ID NO: 9340786 - DNA, 22 bp, Homo sapiens
ccttccttgagaagcaattcct

SEQ ID NO: 9340787 - DNA, 22 bp, Homo sapiens
ccttccttgagaagcaattcct

SEQ ID NO: 9340788 - DNA, 22 bp, Homo sapiens
ccttccttgtctacaaaagctc

SEQ ID NO: 9340789 - DNA, 22 bp, Homo sapiens
ccttcctttcagggctatgcct

SEQ ID NO: 9340790 - DNA, 22 bp, Homo sapiens
ccttcctttcagggctatgcct

SEQ ID NO: 9340791 - DNA, 22 bp, Homo sapiens
ccttcctttgcatcatttctag

SEQ ID NO: 9340792 - DNA, 22 bp, Homo sapiens
ccttcctttgcaggtcaggtca

SEQ ID NO: 9340793 - DNA, 22 bp, Homo sapiens
ttactaagccagtggtatagat

SEQ ID NO: 9340794 - DNA, 22 bp, Homo sapiens
ttactaaggactctaagttcta

SEQ ID NO: 9340795 - DNA, 20 bp, Homo sapiens
ttactaatctcaatgacctg

SEQ ID NO: 9340796 - DNA, 22 bp, Homo sapiens
ttacttttctattcgatatgtg

SEQ ID NO: 9340797 - DNA, 22 bp, Homo sapiens
ttacttttgcaccaaactaata

SEQ ID NO: 9340798 - DNA, 22 bp, Homo sapiens
ttagaaaaaacgtcttctagtg

SEQ ID NO: 9340799 - DNA, 20 bp, Homo sapiens
cctttagaaactcatatgta

SEQ ID NO: 9340800 - DNA, 22 bp, Homo sapiens
cctttacatctgacttctttca

SEQ ID NO: 9340801 - DNA, 22 bp, Homo sapiens
cctttacagtatggttgtatca

SEQ ID NO: 9340802 - DNA, 22 bp, Homo sapiens
ttagaatttctgctcactttga

SEQ ID NO: 9340803 - DNA, 22 bp, Homo sapiens
ttagaatcaggtgttataatca

SEQ ID NO: 9340804 - DNA, 22 bp, Homo sapiens
ttagaagtggtaagtagaaaga

SEQ ID NO: 9340805 - DNA, 22 bp, Homo sapiens
ttagaagttcaggtctgtaatc

SEQ ID NO: 9340806 - DNA, 22 bp, Homo sapiens
ttagaagtggtaagtagaaaga

SEQ ID NO: 9340807 - DNA, 22 bp, Homo sapiens
ttagaagtgggcctatagtcct

SEQ ID NO: 9340808 - DNA, 22 bp, Homo sapiens
ttagaagtgggcctatagtcct

SEQ ID NO: 9340809 - DNA, 20 bp, Homo sapiens
ttagaagtggctatttcctc

SEQ ID NO: 9340810 - DNA, 22 bp, Homo sapiens
ttagaaaaatgttcagtagttt

SEQ ID NO: 9340811 - DNA, 21 bp, Homo sapiens
ttagaagtaattttctccagc

SEQ ID NO: 9340812 - DNA, 22 bp, Homo sapiens
ttagaagtacatttagaacata

SEQ ID NO: 9340813 - DNA, 22 bp, Homo sapiens
ttagaagtacataagacaagga

SEQ ID NO: 9340814 - DNA, 21 bp, Homo sapiens
ttagaagtaattttctccagc

SEQ ID NO: 9340815 - DNA, 22 bp, Homo sapiens
ttagaagtcagtatataggtgg

SEQ ID NO: 9340816 - DNA, 22 bp, Homo sapiens
ttagaagtcagtatataggtgg

SEQ ID NO: 9340817 - DNA, 22 bp, Homo sapiens
ttagaagtcatctagtctaaaa

SEQ ID NO: 9340818 - DNA, 22 bp, Homo sapiens
ttagaagtcatctagtctaaaa

SEQ ID NO: 9340819 - DNA, 22 bp, Homo sapiens
ttagaagtgaaatagctgtaca

SEQ ID NO: 9340820 - DNA, 22 bp, Homo sapiens
ttagaagtgaaatagctgtaca

SEQ ID NO: 9340821 - DNA, 20 bp, Homo sapiens
ttagaagtggctatttcctc

SEQ ID NO: 9340822 - DNA, 22 bp, Homo sapiens
ttagaagtgaaatgctgcagag

SEQ ID NO: 9340823 - DNA, 20 bp, Homo sapiens
cctgtgtggccagctgaggc

SEQ ID NO: 9340824 - DNA, 22 bp, Homo sapiens
cctgtgtgtaggccaggggagt

SEQ ID NO: 9340825 - DNA, 22 bp, Homo sapiens
cctgtgtgcacacgaggccatg

SEQ ID NO: 9340826 - DNA, 22 bp, Homo sapiens
cctgtgtgcacacgaggccatg

SEQ ID NO: 9340827 - DNA, 22 bp, Homo sapiens
cctgtgtctttgcctcagggtc

SEQ ID NO: 9340828 - DNA, 22 bp, Homo sapiens
cctgtgtcttccccactggtgt

SEQ ID NO: 9340829 - DNA, 23 bp, Homo sapiens
cctgtgtctgttgctgaataatg

SEQ ID NO: 9340830 - DNA, 22 bp, Homo sapiens
cctgtgtcttccccactggtgt

SEQ ID NO: 9340831 - DNA, 22 bp, Homo sapiens
cctgtgtcctaatccatcaggc

SEQ ID NO: 9340832 - DNA, 22 bp, Homo sapiens
cctgtgtccttggcagatatcc

SEQ ID NO: 9340833 - DNA, 22 bp, Homo sapiens
ccttccccaggtgctcactgtc

SEQ ID NO: 9340834 - DNA, 20 bp, Homo sapiens
ccttccccacccgctgaggt

SEQ ID NO: 9340835 - DNA, 20 bp, Homo sapiens
ccttccccacccgctgaggt

SEQ ID NO: 9340836 - DNA, 19 bp, Homo sapiens
ccttccccttcagcctctg

SEQ ID NO: 9340837 - DNA, 22 bp, Homo sapiens
ccttcccatgcagcctgtctga

SEQ ID NO: 9340838 - DNA, 22 bp, Homo sapiens
ccttcccaggctagaccaacat

SEQ ID NO: 9340839 - DNA, 22 bp, Homo sapiens
ccttcattattcctgaactgtt

SEQ ID NO: 9340840 - DNA, 17 bp, Homo sapiens
ccttcctcatctccttc

SEQ ID NO: 9340841 - DNA, 22 bp, Homo sapiens
ccttcctcatccatttctcttg

SEQ ID NO: 9340842 - DNA, 17 bp, Homo sapiens
ccttcctcatctccttc

SEQ ID NO: 9340843 - DNA, 17 bp, Homo sapiens
ccttcctcatctccttc

SEQ ID NO: 9340844 - DNA, 22 bp, Homo sapiens
ccttcctcatccatttctcttg

SEQ ID NO: 9340845 - DNA, 22 bp, Homo sapiens
ccttccctaaagcgtcgcttag

SEQ ID NO: 9340846 - DNA, 22 bp, Homo sapiens
ccttcctggctgtccgcctgat

SEQ ID NO: 9340847 - DNA, 22 bp, Homo sapiens
ccttccttcaagcacacatcta

SEQ ID NO: 9340848 - DNA, 22 bp, Homo sapiens
ccttcctggctgtccgcctgat

SEQ ID NO: 9340849 - DNA, 19 bp, Homo sapiens
ccttcctccccagggccat

SEQ ID NO: 9340850 - DNA, 19 bp, Homo sapiens
ccttcctccccagggccat

SEQ ID NO: 9340851 - DNA, 22 bp, Homo sapiens
ccttcctggagcccatgcagat

SEQ ID NO: 9340852 - DNA, 22 bp, Homo sapiens
cctgtctctgttaccacatttg

SEQ ID NO: 9340853 - DNA, 22 bp, Homo sapiens
cctgtctctttcaatctgagag

SEQ ID NO: 9340854 - DNA, 22 bp, Homo sapiens
cctgtctctgcagggccctgcc

SEQ ID NO: 9340855 - DNA, 22 bp, Homo sapiens
cctgtcagccccacttctgcct

SEQ ID NO: 9340856 - DNA, 22 bp, Homo sapiens
cctgtcagccccacttctgcct

SEQ ID NO: 9340857 - DNA, 22 bp, Homo sapiens
cctgtcagatgaagtaattgtg

SEQ ID NO: 9340858 - DNA, 22 bp, Homo sapiens
tgtttataaattttcttgccat

SEQ ID NO: 9340859 - DNA, 22 bp, Homo sapiens
tgtttataaattttcttgccat

SEQ ID NO: 9340860 - DNA, 22 bp, Homo sapiens
tgtttacttttaattacctgtc

SEQ ID NO: 9340861 - DNA, 22 bp, Homo sapiens
tgtttactttccttctcacagg

SEQ ID NO: 9340862 - DNA, 22 bp, Homo sapiens
tgtttactttccttctcacagg

SEQ ID NO: 9340863 - DNA, 22 bp, Homo sapiens
cctgtctgcagatatctcaggt

SEQ ID NO: 9340864 - DNA, 22 bp, Homo sapiens
cctgtctgcaaggggtggatcc

SEQ ID NO: 9340865 - DNA, 22 bp, Homo sapiens
cctgtctgaatcatgatttcct

SEQ ID NO: 9340866 - DNA, 22 bp, Homo sapiens
cctgtctgagccagggtgggca

SEQ ID NO: 9340867 - DNA, 22 bp, Homo sapiens
cctgtctgcatgagtgagcata

SEQ ID NO: 9340868 - DNA, 22 bp, Homo sapiens
cctgtctgcatgatccctgcca

SEQ ID NO: 9340869 - DNA, 22 bp, Homo sapiens
cctgtctgcatgatccctgcca

SEQ ID NO: 9340870 - DNA, 22 bp, Homo sapiens
cctgtctgcatgatccctgcca

SEQ ID NO: 9340871 - DNA, 22 bp, Homo sapiens
cctgtctggtgagggggttgca

SEQ ID NO: 9340872 - DNA, 22 bp, Homo sapiens
cctgtctgtattattcaccact

SEQ ID NO: 9340873 - DNA, 22 bp, Homo sapiens
cctgtctgtcctttgcattctt

SEQ ID NO: 9340874 - DNA, 22 bp, Homo sapiens
cctgtctggggactccctgggt

SEQ ID NO: 9340875 - DNA, 22 bp, Homo sapiens
cctgtctggccttccacggggg

SEQ ID NO: 9340876 - DNA, 22 bp, Homo sapiens
cctgtctggccaccagggcgat

SEQ ID NO: 9340877 - DNA, 22 bp, Homo sapiens
cctgtctgtttgcccattcttg

SEQ ID NO: 9340878 - DNA, 23 bp, Homo sapiens
cctgtctgtgctgggtggacaca

SEQ ID NO: 9340879 - DNA, 22 bp, Homo sapiens
cctgtctgttctgactggtcag

SEQ ID NO: 9340880 - DNA, 22 bp, Homo sapiens
cctgtgccatcctgagcatccc

SEQ ID NO: 9340881 - DNA, 23 bp, Homo sapiens
cctgtgacactgtttgtggtaag

SEQ ID NO: 9340882 - DNA, 22 bp, Homo sapiens
cctgtctgtttgcccattcttg

SEQ ID NO: 9340883 - DNA, 22 bp, Homo sapiens
cctgtgctccctatgtatctgg

SEQ ID NO: 9340884 - DNA, 22 bp, Homo sapiens
cctgtgctccctatgtatctgg

SEQ ID NO: 9340885 - DNA, 22 bp, Homo sapiens
cctgtgctcccatagcttctgt

SEQ ID NO: 9340886 - DNA, 21 bp, Homo sapiens
cctgtgctatcagcttgggtt

SEQ ID NO: 9340887 - DNA, 22 bp, Homo sapiens
cctgtgccttccttaggcacct

SEQ ID NO: 9340888 - DNA, 22 bp, Homo sapiens
cctgtgccttaaccctttaggc

SEQ ID NO: 9340889 - DNA, 22 bp, Homo sapiens
cctgtgccctacacctttccag

SEQ ID NO: 9340890 - DNA, 22 bp, Homo sapiens
cctgtgccatcctgagcatccc

SEQ ID NO: 9340891 - DNA, 22 bp, Homo sapiens
cctgtgccctcagcctggctct

SEQ ID NO: 9340892 - DNA, 22 bp, Homo sapiens
cctgtgccctcagcctggctct

SEQ ID NO: 9340893 - DNA, 20 bp, Homo sapiens
cctgtgcttatcacttgctg

SEQ ID NO: 9340894 - DNA, 22 bp, Homo sapiens
cctgtgggttttctgtagaaat

SEQ ID NO: 9340895 - DNA, 22 bp, Homo sapiens
cctgtgggttttctgtagaaat

SEQ ID NO: 9340896 - DNA, 22 bp, Homo sapiens
cctgtgggttttcaagatgcta

SEQ ID NO: 9340897 - DNA, 22 bp, Homo sapiens
cctgtgggtcacatgggtgact

SEQ ID NO: 9340898 - DNA, 22 bp, Homo sapiens
cctgtgggtcacatgggtgact

SEQ ID NO: 9340899 - DNA, 21 bp, Homo sapiens
cctgtggtctggagggagcac

SEQ ID NO: 9340900 - DNA, 22 bp, Homo sapiens
cctgtgtcatcagctgtggcta

SEQ ID NO: 9340901 - DNA, 22 bp, Homo sapiens
cctgtgtcagcccctgcctcca

SEQ ID NO: 9340902 - DNA, 22 bp, Homo sapiens
cctgtgtcaccggaacggagga

SEQ ID NO: 9340903 - DNA, 22 bp, Homo sapiens
cctgtgtccagttccaggttgt

SEQ ID NO: 9340904 - DNA, 22 bp, Homo sapiens
cctgtgtcatcagctgtggcta

SEQ ID NO: 9340905 - DNA, 19 bp, Homo sapiens
ttaaagtgcgagaagtctt

SEQ ID NO: 9340906 - DNA, 22 bp, Homo sapiens
ttaaagtaatctgtgtgaattt

SEQ ID NO: 9340907 - DNA, 22 bp, Homo sapiens
ttaaagtaatctgtgtgaattt

SEQ ID NO: 9340908 - DNA, 22 bp, Homo sapiens
cctgtgggaaaggtctgctctc

SEQ ID NO: 9340909 - DNA, 22 bp, Homo sapiens
taatcatggcctcaaattttat

SEQ ID NO: 9340910 - DNA, 22 bp, Homo sapiens
taatcatatgggtaatccaatg

SEQ ID NO: 9340911 - DNA, 22 bp, Homo sapiens
taatcatatgggtaatccaatg

SEQ ID NO: 9340912 - DNA, 22 bp, Homo sapiens
taatcacatcagggtaaatggg

SEQ ID NO: 9340913 - DNA, 22 bp, Homo sapiens
taatatttctaccctgctgcct

SEQ ID NO: 9340914 - DNA, 22 bp, Homo sapiens
taatcacagaaacagactgttt

SEQ ID NO: 9340915 - DNA, 22 bp, Homo sapiens
taatatctggcattcaaacatg

SEQ ID NO: 9340916 - DNA, 22 bp, Homo sapiens
taatatctggcattcaaacatg

SEQ ID NO: 9340917 - DNA, 22 bp, Homo sapiens
taatacagatacaaaggaggac

SEQ ID NO: 9340918 - DNA, 22 bp, Homo sapiens
taatatttctaccctgctgcct

SEQ ID NO: 9340919 - DNA, 22 bp, Homo sapiens
taatatttctaccctgctgcct

SEQ ID NO: 9340920 - DNA, 22 bp, Homo sapiens
caggcagggagctggaaaggat

SEQ ID NO: 9340921 - DNA, 22 bp, Homo sapiens
caggcatgagccaggcccctcc

SEQ ID NO: 9340922 - DNA, 22 bp, Homo sapiens
caggcagggagctggaaaggat

SEQ ID NO: 9340923 - DNA, 22 bp, Homo sapiens
caggcatgcttctgtctgggca

SEQ ID NO: 9340924 - DNA, 22 bp, Homo sapiens
caggcatgatgggaagtgcctg

SEQ ID NO: 9340925 - DNA, 22 bp, Homo sapiens
caggcatgatgggaagtgcctg

SEQ ID NO: 9340926 - DNA, 22 bp, Homo sapiens
caggcatgcttctgtctgggca

SEQ ID NO: 9340927 - DNA, 22 bp, Homo sapiens
caggcatggaaaagcccagagg

SEQ ID NO: 9340928 - DNA, 22 bp, Homo sapiens
caggcatggaaaagcccagagg

SEQ ID NO: 9340929 - DNA, 22 bp, Homo sapiens
caggcatggagaggcagagact

SEQ ID NO: 9340930 - DNA, 22 bp, Homo sapiens
caggcatggagaggcagagact

SEQ ID NO: 9340931 - DNA, 22 bp, Homo sapiens
caggcatgggccatgggaagtg

SEQ ID NO: 9340932 - DNA, 22 bp, Homo sapiens
caggcatggatctggaatcatt

SEQ ID NO: 9340933 - DNA, 22 bp, Homo sapiens
taatgttacactgcatggttca

SEQ ID NO: 9340934 - DNA, 22 bp, Homo sapiens
caggcagggagctggaaaggat

SEQ ID NO: 9340935 - DNA, 22 bp, Homo sapiens
caggcagggagctggaaaggat

SEQ ID NO: 9340936 - DNA, 22 bp, Homo sapiens
taatgtcttgtgagagctggag

SEQ ID NO: 9340937 - DNA, 22 bp, Homo sapiens
tacaaaaaattgatactgacga

SEQ ID NO: 9340938 - DNA, 22 bp, Homo sapiens
tacaaaaaattgatactgacga

SEQ ID NO: 9340939 - DNA, 22 bp, Homo sapiens
tacaaaaaattgatactgacga

SEQ ID NO: 9340940 - DNA, 22 bp, Homo sapiens
caggcattgttctaggttctca

SEQ ID NO: 9340941 - DNA, 22 bp, Homo sapiens
caggcattgccattcctccaga

SEQ ID NO: 9340942 - DNA, 22 bp, Homo sapiens
caggcattgtgacgagtgttct

SEQ ID NO: 9340943 - DNA, 22 bp, Homo sapiens
caggcattgtgacgagtgttct

SEQ ID NO: 9340944 - DNA, 22 bp, Homo sapiens
caggcattcctctatgaatatt

SEQ ID NO: 9340945 - DNA, 22 bp, Homo sapiens
caggcattgccattcctccaga

SEQ ID NO: 9340946 - DNA, 22 bp, Homo sapiens
caggcatgtggcccaggggtga

SEQ ID NO: 9340947 - DNA, 22 bp, Homo sapiens
caggcatgggccatgggaagtg

SEQ ID NO: 9340948 - DNA, 22 bp, Homo sapiens
caggcatgtggcccaggggtga

SEQ ID NO: 9340949 - DNA, 22 bp, Homo sapiens
caggcatggtgagaactcagcc

SEQ ID NO: 9340950 - DNA, 22 bp, Homo sapiens
caggcatgtggcccaggggtga

SEQ ID NO: 9340951 - DNA, 22 bp, Homo sapiens
tacaaaacagtgctctggtcct

SEQ ID NO: 9340952 - DNA, 22 bp, Homo sapiens
tacaaaacagtgctctggtcct

SEQ ID NO: 9340953 - DNA, 22 bp, Homo sapiens
caggccagggttgagaagagaa

SEQ ID NO: 9340954 - DNA, 22 bp, Homo sapiens
caggccagagcgcgtggttggg

SEQ ID NO: 9340955 - DNA, 22 bp, Homo sapiens
caggccagagcgcgtggttggg

SEQ ID NO: 9340956 - DNA, 22 bp, Homo sapiens
caggcccacgaggcacacagag

SEQ ID NO: 9340957 - DNA, 22 bp, Homo sapiens
caggcccactgcttgtctagtc

SEQ ID NO: 9340958 - DNA, 22 bp, Homo sapiens
caggcccagaggcctcttccca

SEQ ID NO: 9340959 - DNA, 22 bp, Homo sapiens
caggcccacgaggcacacagag

SEQ ID NO: 9340960 - DNA, 22 bp, Homo sapiens
caggcccacgaggcacacagag

SEQ ID NO: 9340961 - DNA, 22 bp, Homo sapiens
caggcccaagactgatgagtct

SEQ ID NO: 9340962 - DNA, 22 bp, Homo sapiens
caggcccaagactgatgagtct

SEQ ID NO: 9340963 - DNA, 22 bp, Homo sapiens
caggcccaaatgcaaccttctt

SEQ ID NO: 9340964 - DNA, 22 bp, Homo sapiens
caggcccaaatgcaaccttctt

SEQ ID NO: 9340965 - DNA, 22 bp, Homo sapiens
caggccagttttgatttaagcc

SEQ ID NO: 9340966 - DNA, 22 bp, Homo sapiens
caggccagtgtgcttcccaggc

SEQ ID NO: 9340967 - DNA, 22 bp, Homo sapiens
caggccagtgtgcttcccaggc

SEQ ID NO: 9340968 - DNA, 19 bp, Homo sapiens
caggccagtgtcagggggc

SEQ ID NO: 9340969 - DNA, 22 bp, Homo sapiens
caggccagtgtgcttcccaggc

SEQ ID NO: 9340970 - DNA, 22 bp, Homo sapiens
caggccaggtgctctagaatca

SEQ ID NO: 9340971 - DNA, 22 bp, Homo sapiens
caggccaggtggcaggcaaaac

SEQ ID NO: 9340972 - DNA, 22 bp, Homo sapiens
caggccaggtggcaggcaaaac

SEQ ID NO: 9340973 - DNA, 22 bp, Homo sapiens
caggccaggtgctctagaatca

SEQ ID NO: 9340974 - DNA, 22 bp, Homo sapiens
caggccagggttgagaagagaa

SEQ ID NO: 9340975 - DNA, 22 bp, Homo sapiens
caggccagggttgagaagagaa

SEQ ID NO: 9340976 - DNA, 22 bp, Homo sapiens
caggccagggttgagaagagaa

SEQ ID NO: 9340977 - DNA, 22 bp, Homo sapiens
caggccagggttgagaagagaa

SEQ ID NO: 9340978 - DNA, 19 bp, Homo sapiens
caggccagtgtcagggggc

SEQ ID NO: 9340979 - DNA, 19 bp, Homo sapiens
caggccagtgtcagggggc

SEQ ID NO: 9340980 - DNA, 19 bp, Homo sapiens
caggccagtgtcagggggc

SEQ ID NO: 9340981 - DNA, 22 bp, Homo sapiens
caggccaggtggcaggcaaaac

SEQ ID NO: 9340982 - DNA, 22 bp, Homo sapiens
caggccaggtggcaggcaaaac

SEQ ID NO: 9340983 - DNA, 22 bp, Homo sapiens
caggccagtgggaaatagggat

SEQ ID NO: 9340984 - DNA, 22 bp, Homo sapiens
caggccagtgggaaatagggat

SEQ ID NO: 9340985 - DNA, 22 bp, Homo sapiens
caggccagtgggaaatagggat

SEQ ID NO: 9340986 - DNA, 22 bp, Homo sapiens
taagtcttcatagtctaatgtc

SEQ ID NO: 9340987 - DNA, 22 bp, Homo sapiens
taagtcgtggatgattcttcgg

SEQ ID NO: 9340988 - DNA, 22 bp, Homo sapiens
caggcaccaatagggatcgtgg

SEQ ID NO: 9340989 - DNA, 22 bp, Homo sapiens
taagtcttgaaatatttcctat

SEQ ID NO: 9340990 - DNA, 23 bp, Homo sapiens
cagctcagagtgtgtcctgtttc

SEQ ID NO: 9340991 - DNA, 23 bp, Homo sapiens
cagctcagcacataggaggtact

SEQ ID NO: 9340992 - DNA, 22 bp, Homo sapiens
taaggcagcctcagggtagggt

SEQ ID NO: 9340993 - DNA, 22 bp, Homo sapiens
taagtcacttaagtttgcatgt

SEQ ID NO: 9340994 - DNA, 22 bp, Homo sapiens
taagtcatcccataacagtgct

SEQ ID NO: 9340995 - DNA, 22 bp, Homo sapiens
cagctcagacgcaggtcgagca

SEQ ID NO: 9340996 - DNA, 22 bp, Homo sapiens
cagctattttgcctatcatggt

SEQ ID NO: 9340997 - DNA, 20 bp, Homo sapiens
gtgcttcagaagccattgct

SEQ ID NO: 9340998 - DNA, 22 bp, Homo sapiens
gtgcttcactgacctgttttca

SEQ ID NO: 9340999 - DNA, 22 bp, Homo sapiens
taataattaacagtgatgggtc

SEQ ID NO: 9341000 - DNA, 22 bp, Homo sapiens
taataattaacagtgatgggtc

SEQ ID NO: 9341001 - DNA, 22 bp, Homo sapiens
taataattagttattgatcgtg

SEQ ID NO: 9341002 - DNA, 21 bp, Homo sapiens
taataattccactacagagta

SEQ ID NO: 9341003 - DNA, 22 bp, Homo sapiens
caggcagatgctgacaagagtt

SEQ ID NO: 9341004 - DNA, 22 bp, Homo sapiens
caggcagatgctgacaagagtt

SEQ ID NO: 9341005 - DNA, 22 bp, Homo sapiens
caggcagatttgctgccctcca

SEQ ID NO: 9341006 - DNA, 22 bp, Homo sapiens
caggcagatttgctgccctcca

SEQ ID NO: 9341007 - DNA, 22 bp, Homo sapiens
caggcagcagaggagtgtggga

SEQ ID NO: 9341008 - DNA, 21 bp, Homo sapiens
taataattccactacagagta

SEQ ID NO: 9341009 - DNA, 21 bp, Homo sapiens
taataattccactacagagta

SEQ ID NO: 9341010 - DNA, 22 bp, Homo sapiens
taataattggcaatgttgagca

SEQ ID NO: 9341011 - DNA, 22 bp, Homo sapiens
taataattttaaagaaggctag

SEQ ID NO: 9341012 - DNA, 22 bp, Homo sapiens
caggcagagttagtgatttagg

SEQ ID NO: 9341013 - DNA, 22 bp, Homo sapiens
caggcagagttagtgatttagg

SEQ ID NO: 9341014 - DNA, 22 bp, Homo sapiens
caggcagagttagagcaactgg

SEQ ID NO: 9341015 - DNA, 22 bp, Homo sapiens
caggcagatgctgacaagagtt

SEQ ID NO: 9341016 - DNA, 22 bp, Homo sapiens
caggcacgggggcatggcctct

SEQ ID NO: 9341017 - DNA, 22 bp, Homo sapiens
caggcacgggggcatggcctct

SEQ ID NO: 9341018 - DNA, 22 bp, Homo sapiens
caggcagagccaatcgtggggt

SEQ ID NO: 9341019 - DNA, 22 bp, Homo sapiens
caggcagagttagagcaactgg

SEQ ID NO: 9341020 - DNA, 22 bp, Homo sapiens
caggcacctcacgtgggtccca

SEQ ID NO: 9341021 - DNA, 22 bp, Homo sapiens
caggcacctcacgtgggtccca

SEQ ID NO: 9341022 - DNA, 22 bp, Homo sapiens
caggcaccctctgaggggaagc

SEQ ID NO: 9341023 - DNA, 22 bp, Homo sapiens
caggcacctgtgtgtctcaggg

SEQ ID NO: 9341024 - DNA, 22 bp, Homo sapiens
caggcacctttgtgcatgggca

SEQ ID NO: 9341025 - DNA, 22 bp, Homo sapiens
caggcacctgtgtgtctcaggg

SEQ ID NO: 9341026 - DNA, 22 bp, Homo sapiens
caggcacctgtgtgtctcaggg

SEQ ID NO: 9341027 - DNA, 22 bp, Homo sapiens
caggcaccagtgagaagggcct

SEQ ID NO: 9341028 - DNA, 22 bp, Homo sapiens
caggcaccacactaggggctga

SEQ ID NO: 9341029 - DNA, 22 bp, Homo sapiens
caggcaccaatagggatcgtgg

SEQ ID NO: 9341030 - DNA, 22 bp, Homo sapiens
caggcaccacactaggggctga

SEQ ID NO: 9341031 - DNA, 22 bp, Homo sapiens
caggcaccacactaggggctga

SEQ ID NO: 9341032 - DNA, 22 bp, Homo sapiens
caggcaccccaggtgagcactg

SEQ ID NO: 9341033 - DNA, 22 bp, Homo sapiens
caggcacccagcccagtcgcac

SEQ ID NO: 9341034 - DNA, 22 bp, Homo sapiens
caggcaccccaggtgagcactg

SEQ ID NO: 9341035 - DNA, 22 bp, Homo sapiens
caggctgccgtggggtccaggc

SEQ ID NO: 9341036 - DNA, 22 bp, Homo sapiens
caggctgccgtggggtccaggc

SEQ ID NO: 9341037 - DNA, 22 bp, Homo sapiens
caggctggagttcagtggtgtg

SEQ ID NO: 9341038 - DNA, 22 bp, Homo sapiens
caggctggagttcagtggtgtg

SEQ ID NO: 9341039 - DNA, 22 bp, Homo sapiens
caggctggagtgcagtggtgcc

SEQ ID NO: 9341040 - DNA, 22 bp, Homo sapiens
caggctggagttcagtggtgtg

SEQ ID NO: 9341041 - DNA, 22 bp, Homo sapiens
caggctggcaatgcgtcaagca

SEQ ID NO: 9341042 - DNA, 22 bp, Homo sapiens
caggctgccaaggctggggagg

SEQ ID NO: 9341043 - DNA, 22 bp, Homo sapiens
caggctgcagtgcagtggctat

SEQ ID NO: 9341044 - DNA, 22 bp, Homo sapiens
caggctgcagtgcagtggctat

SEQ ID NO: 9341045 - DNA, 22 bp, Homo sapiens
caggctgcagtgcagtggctat

SEQ ID NO: 9341046 - DNA, 22 bp, Homo sapiens
caggctgcagtgcagtggctat

SEQ ID NO: 9341047 - DNA, 22 bp, Homo sapiens
caggctgcagtgcagtggctat

SEQ ID NO: 9341048 - DNA, 22 bp, Homo sapiens
caggctgccctagcttggacat

SEQ ID NO: 9341049 - DNA, 22 bp, Homo sapiens
caggctgcccggcaagttgcgc

SEQ ID NO: 9341050 - DNA, 22 bp, Homo sapiens
caggctgccgaggctgcagaat

SEQ ID NO: 9341051 - DNA, 22 bp, Homo sapiens
caggctgccgaggctgcagaat

SEQ ID NO: 9341052 - DNA, 22 bp, Homo sapiens
caggctgccgaggctgcagaat

SEQ ID NO: 9341053 - DNA, 22 bp, Homo sapiens
caggctgccgaggctgcagaat

SEQ ID NO: 9341054 - DNA, 22 bp, Homo sapiens
caggctgccgtgaagcaggcct

SEQ ID NO: 9341055 - DNA, 22 bp, Homo sapiens
caggctgccgtgaagcaggcct

SEQ ID NO: 9341056 - DNA, 22 bp, Homo sapiens
caggctgccgtgaagcaggcct

SEQ ID NO: 9341057 - DNA, 22 bp, Homo sapiens
caggctgccgtgaagcaggcct

SEQ ID NO: 9341058 - DNA, 22 bp, Homo sapiens
caggctgccgtgaagcaggcct

SEQ ID NO: 9341059 - DNA, 22 bp, Homo sapiens
tagaaaatagggcctgtggagc

SEQ ID NO: 9341060 - DNA, 22 bp, Homo sapiens
tagaaaatagggcctgtggagc

SEQ ID NO: 9341061 - DNA, 22 bp, Homo sapiens
tagaaacaaagacctgggtgct

SEQ ID NO: 9341062 - DNA, 22 bp, Homo sapiens
tagaaacaaaatctgatgactc

SEQ ID NO: 9341063 - DNA, 22 bp, Homo sapiens
caggctgggactgacccctgct

SEQ ID NO: 9341064 - DNA, 22 bp, Homo sapiens
caggctgggactgacccctgct

SEQ ID NO: 9341065 - DNA, 22 bp, Homo sapiens
caggctgggactgacccctgct

SEQ ID NO: 9341066 - DNA, 22 bp, Homo sapiens
caggctgggactgacccctgct

SEQ ID NO: 9341067 - DNA, 22 bp, Homo sapiens
caggctgggcagcctccccggc

SEQ ID NO: 9341068 - DNA, 22 bp, Homo sapiens
tagaaaagccccagctggaggg

SEQ ID NO: 9341069 - DNA, 22 bp, Homo sapiens
caggctggcaatgcgtcaagca

SEQ ID NO: 9341070 - DNA, 22 bp, Homo sapiens
caggctgggaacgccacccgct

SEQ ID NO: 9341071 - DNA, 22 bp, Homo sapiens
caggctgggaacgccacccgct

SEQ ID NO: 9341072 - DNA, 22 bp, Homo sapiens
caggctgggactgacccctgct

SEQ ID NO: 9341073 - DNA, 22 bp, Homo sapiens
caggcttggcagggaggctggt

SEQ ID NO: 9341074 - DNA, 22 bp, Homo sapiens
caggctgtctgaatggaggccc

SEQ ID NO: 9341075 - DNA, 22 bp, Homo sapiens
caggcttggagggcagtggcat

SEQ ID NO: 9341076 - DNA, 22 bp, Homo sapiens
caggctgtctgaatggaggccc

SEQ ID NO: 9341077 - DNA, 22 bp, Homo sapiens
tagaaacaagggagaggattct

SEQ ID NO: 9341078 - DNA, 22 bp, Homo sapiens
caggcttggcagggaggctggt

SEQ ID NO: 9341079 - DNA, 22 bp, Homo sapiens
caggcttgggagcagagccact

SEQ ID NO: 9341080 - DNA, 22 bp, Homo sapiens
caggcttgggagcagagccact

SEQ ID NO: 9341081 - DNA, 22 bp, Homo sapiens
caggcttgggttctctgagtta

SEQ ID NO: 9341082 - DNA, 22 bp, Homo sapiens
caggcttgtgtctcagctgcag

SEQ ID NO: 9341083 - DNA, 22 bp, Homo sapiens
caggctttactttctctctgaa

SEQ ID NO: 9341084 - DNA, 22 bp, Homo sapiens
caggctttactttctctctgaa

SEQ ID NO: 9341085 - DNA, 22 bp, Homo sapiens
caggcttttgcatagcactggg

SEQ ID NO: 9341086 - DNA, 22 bp, Homo sapiens
caggcttttgcatagcactggg

SEQ ID NO: 9341087 - DNA, 22 bp, Homo sapiens
caggctttttctgctgtcctct

SEQ ID NO: 9341088 - DNA, 22 bp, Homo sapiens
caggctttttctgctgtcctct

SEQ ID NO: 9341089 - DNA, 22 bp, Homo sapiens
cagggaaactaggaaataagct

SEQ ID NO: 9341090 - DNA, 22 bp, Homo sapiens
cagggaaagtcccaccccacac

SEQ ID NO: 9341091 - DNA, 22 bp, Homo sapiens
cagggaagaatagttagcaaag

SEQ ID NO: 9341092 - DNA, 22 bp, Homo sapiens
cagggaagaatagttagcaaag

SEQ ID NO: 9341093 - DNA, 22 bp, Homo sapiens
cagggaaggctgcaaatgttaa

SEQ ID NO: 9341094 - DNA, 22 bp, Homo sapiens
cagggaagagccgatgctgcag

SEQ ID NO: 9341095 - DNA, 22 bp, Homo sapiens
cagggacaaagtgagaaaggaa

SEQ ID NO: 9341096 - DNA, 22 bp, Homo sapiens
cagggacaaacaaggttgggga

SEQ ID NO: 9341097 - DNA, 22 bp, Homo sapiens
cagggacaaacaaggttgggga

SEQ ID NO: 9341098 - DNA, 22 bp, Homo sapiens
cagggacaatggcagagcctga

SEQ ID NO: 9341099 - DNA, 22 bp, Homo sapiens
cagggacaatggcagagcctga

SEQ ID NO: 9341100 - DNA, 22 bp, Homo sapiens
cagggacaaagtgagaaaggaa

SEQ ID NO: 9341101 - DNA, 22 bp, Homo sapiens
cagggacaaggaataagattag

SEQ ID NO: 9341102 - DNA, 22 bp, Homo sapiens
cagggacaatggcagagcctga

SEQ ID NO: 9341103 - DNA, 20 bp, Homo sapiens
cagggacagcagtgggtttt

SEQ ID NO: 9341104 - DNA, 20 bp, Homo sapiens
cagggacagcagtgggtttt

SEQ ID NO: 9341105 - DNA, 22 bp, Homo sapiens
cagggacagcactaaactcttg

SEQ ID NO: 9341106 - DNA, 22 bp, Homo sapiens
cagggacagcactaaactcttg

SEQ ID NO: 9341107 - DNA, 22 bp, Homo sapiens
cagggacagagactgcaccttg

SEQ ID NO: 9341108 - DNA, 22 bp, Homo sapiens
cagggacagagactgcaccttg

SEQ ID NO: 9341109 - DNA, 22 bp, Homo sapiens
cagggacagacagatatatttg

SEQ ID NO: 9341110 - DNA, 22 bp, Homo sapiens
cagggacagagactgcaccttg

SEQ ID NO: 9341111 - DNA, 22 bp, Homo sapiens
tagattctgtatgtctgctctc

SEQ ID NO: 9341112 - DNA, 22 bp, Homo sapiens
tagattctgtttcctctggttt

SEQ ID NO: 9341113 - DNA, 22 bp, Homo sapiens
tagattcaagtattcagtttgg

SEQ ID NO: 9341114 - DNA, 22 bp, Homo sapiens
cagggacagccttggggtggcg

SEQ ID NO: 9341115 - DNA, 22 bp, Homo sapiens
tagatacacacacagtcatgtg

SEQ ID NO: 9341116 - DNA, 22 bp, Homo sapiens
tagattatccctgatttgtcca

SEQ ID NO: 9341117 - DNA, 22 bp, Homo sapiens
tagattcagatatttaggacaa

SEQ ID NO: 9341118 - DNA, 22 bp, Homo sapiens
tagattcagatatttaggacaa

SEQ ID NO: 9341119 - DNA, 22 bp, Homo sapiens
tagattcagatatttaggacaa

SEQ ID NO: 9341120 - DNA, 22 bp, Homo sapiens
tagatacaggctctctgagcct

SEQ ID NO: 9341121 - DNA, 22 bp, Homo sapiens
tagattcatgcagtatgctagt

SEQ ID NO: 9341122 - DNA, 22 bp, Homo sapiens
tagattcatgcagtatgctagt

SEQ ID NO: 9341123 - DNA, 22 bp, Homo sapiens
caggcctcttccatgcagcagc

SEQ ID NO: 9341124 - DNA, 22 bp, Homo sapiens
caggcctcttccatgcagcagc

SEQ ID NO: 9341125 - DNA, 19 bp, Homo sapiens
caggcctcttaccctctct

SEQ ID NO: 9341126 - DNA, 22 bp, Homo sapiens
caggcctgaccctgagcttcac

SEQ ID NO: 9341127 - DNA, 18 bp, Homo sapiens
caggcctcttgatcttcc

SEQ ID NO: 9341128 - DNA, 18 bp, Homo sapiens
caggcctcttgatcttcc

SEQ ID NO: 9341129 - DNA, 22 bp, Homo sapiens
caggcctcttccatgcagcagc

SEQ ID NO: 9341130 - DNA, 22 bp, Homo sapiens
caggcctgagacatctgagata

SEQ ID NO: 9341131 - DNA, 22 bp, Homo sapiens
caggcctgaccctgagcttcac

SEQ ID NO: 9341132 - DNA, 22 bp, Homo sapiens
caggcctgagacatctgagata

SEQ ID NO: 9341133 - DNA, 22 bp, Homo sapiens
caggcctgagacatctgagata

SEQ ID NO: 9341134 - DNA, 22 bp, Homo sapiens
caggcctgagtgtggaagtctt

SEQ ID NO: 9341135 - DNA, 22 bp, Homo sapiens
caggcctgagtgtggaagtctt

SEQ ID NO: 9341136 - DNA, 22 bp, Homo sapiens
caggcctgcaggaaaggctccc

SEQ ID NO: 9341137 - DNA, 22 bp, Homo sapiens
caggcctgcaggaaaggctccc

SEQ ID NO: 9341138 - DNA, 22 bp, Homo sapiens
caggcctgcaggaaaggctccc

SEQ ID NO: 9341139 - DNA, 22 bp, Homo sapiens
caggcctgcttcttacccttca

SEQ ID NO: 9341140 - DNA, 22 bp, Homo sapiens
tacatgtttactccaagtcagg

SEQ ID NO: 9341141 - DNA, 22 bp, Homo sapiens
caggcccagcccttagccaggt

SEQ ID NO: 9341142 - DNA, 22 bp, Homo sapiens
caggcccagcccttagccaggt

SEQ ID NO: 9341143 - DNA, 22 bp, Homo sapiens
caggcccagggagggagaccaa

SEQ ID NO: 9341144 - DNA, 22 bp, Homo sapiens
caggcccaggccagtggttccc

SEQ ID NO: 9341145 - DNA, 22 bp, Homo sapiens
caggcccagaggcctcttccca

SEQ ID NO: 9341146 - DNA, 22 bp, Homo sapiens
caggcccagcccagcccttcga

SEQ ID NO: 9341147 - DNA, 22 bp, Homo sapiens
caggcccagcccagcccttcga

SEQ ID NO: 9341148 - DNA, 22 bp, Homo sapiens
caggcccagcccttagccaggt

SEQ ID NO: 9341149 - DNA, 22 bp, Homo sapiens
caggcctcctatgagcactagc

SEQ ID NO: 9341150 - DNA, 22 bp, Homo sapiens
caggcctcctatgagcactagc

SEQ ID NO: 9341151 - DNA, 22 bp, Homo sapiens
caggcctcgaggagacagctac

SEQ ID NO: 9341152 - DNA, 22 bp, Homo sapiens
caggcccagggagggagaccaa

SEQ ID NO: 9341153 - DNA, 22 bp, Homo sapiens
caggcccagggagggagaccaa

SEQ ID NO: 9341154 - DNA, 22 bp, Homo sapiens
caggccgggcactgcgctaggt

SEQ ID NO: 9341155 - DNA, 22 bp, Homo sapiens
caggccggggcggcgccatctt

SEQ ID NO: 9341156 - DNA, 22 bp, Homo sapiens
caggccgggcactgcgctaggt

SEQ ID NO: 9341157 - DNA, 22 bp, Homo sapiens
caggcctctccttagtctggca

SEQ ID NO: 9341158 - DNA, 22 bp, Homo sapiens
caggcctctatggtcagctgag

SEQ ID NO: 9341159 - DNA, 22 bp, Homo sapiens
caggcctctatggtcagctgag

SEQ ID NO: 9341160 - DNA, 22 bp, Homo sapiens
caggcctctatggtcagctgag

SEQ ID NO: 9341161 - DNA, 20 bp, Homo sapiens
caggcctctgggggccctgg

SEQ ID NO: 9341162 - DNA, 22 bp, Homo sapiens
caggcctctccttagtctggca

SEQ ID NO: 9341163 - DNA, 19 bp, Homo sapiens
caggcctcttaccctctct

SEQ ID NO: 9341164 - DNA, 19 bp, Homo sapiens
caggcctctggtctgctgt

SEQ ID NO: 9341165 - DNA, 19 bp, Homo sapiens
caggcctctggtctgctgt

SEQ ID NO: 9341166 - DNA, 22 bp, Homo sapiens
caggcctttctggggaagtgag

SEQ ID NO: 9341167 - DNA, 22 bp, Homo sapiens
caggcctttgcacgtgcagttg

SEQ ID NO: 9341168 - DNA, 18 bp, Homo sapiens
caggcctttgagacagaa

SEQ ID NO: 9341169 - DNA, 18 bp, Homo sapiens
caggcctttgagacagaa

SEQ ID NO: 9341170 - DNA, 22 bp, Homo sapiens
caggccttttttcctgcagtgt

SEQ ID NO: 9341171 - DNA, 22 bp, Homo sapiens
caggcgagggccctgaggagcc

SEQ ID NO: 9341172 - DNA, 22 bp, Homo sapiens
caggcgagtgaacagactctca

SEQ ID NO: 9341173 - DNA, 22 bp, Homo sapiens
tacattgtctgcaattttctct

SEQ ID NO: 9341174 - DNA, 22 bp, Homo sapiens
tacattgtattatccgtgattg

SEQ ID NO: 9341175 - DNA, 22 bp, Homo sapiens
tacattgttttttcttgccatc

SEQ ID NO: 9341176 - DNA, 22 bp, Homo sapiens
tacattgtttgagatagtttgt

SEQ ID NO: 9341177 - DNA, 22 bp, Homo sapiens
tacatttacagagccttctctg

SEQ ID NO: 9341178 - DNA, 22 bp, Homo sapiens
tacatttacagagccttctctg

SEQ ID NO: 9341179 - DNA, 22 bp, Homo sapiens
tacatttacagagccttctctg

SEQ ID NO: 9341180 - DNA, 22 bp, Homo sapiens
tacatttataaggcttctctgt

SEQ ID NO: 9341181 - DNA, 22 bp, Homo sapiens
tacatttataaggcttctctgt

SEQ ID NO: 9341182 - DNA, 22 bp, Homo sapiens
tacatttataaggcttctctgt

SEQ ID NO: 9341183 - DNA, 22 bp, Homo sapiens
tacatttataaggcttctctgt

SEQ ID NO: 9341184 - DNA, 22 bp, Homo sapiens
tacatttataaggcttctctgt

SEQ ID NO: 9341185 - DNA, 22 bp, Homo sapiens
tactttattgtaaatgctgatg

SEQ ID NO: 9341186 - DNA, 22 bp, Homo sapiens
tactttattcaggaaggctggt

SEQ ID NO: 9341187 - DNA, 18 bp, Homo sapiens
tactttattccccctcca

SEQ ID NO: 9341188 - DNA, 22 bp, Homo sapiens
tactttattcaggaaggctggt

SEQ ID NO: 9341189 - DNA, 22 bp, Homo sapiens
tactttatcagcgtcaaaggta

SEQ ID NO: 9341190 - DNA, 22 bp, Homo sapiens
tactttatattgtggctggcca

SEQ ID NO: 9341191 - DNA, 22 bp, Homo sapiens
tactttacagtattagataatt

SEQ ID NO: 9341192 - DNA, 22 bp, Homo sapiens
caggctcaagccctgcttatat

SEQ ID NO: 9341193 - DNA, 22 bp, Homo sapiens
caggctcaaggctgacttccat

SEQ ID NO: 9341194 - DNA, 22 bp, Homo sapiens
caggctagattggggccagtag

SEQ ID NO: 9341195 - DNA, 22 bp, Homo sapiens
caggctagattggggccagtag

SEQ ID NO: 9341196 - DNA, 22 bp, Homo sapiens
caggctagcagggcccagggca

SEQ ID NO: 9341197 - DNA, 22 bp, Homo sapiens
caggctacatttgctctgagaa

SEQ ID NO: 9341198 - DNA, 22 bp, Homo sapiens
tacttgttatcatcttttcctt

SEQ ID NO: 9341199 - DNA, 22 bp, Homo sapiens
tactttaaaaactgataattca

SEQ ID NO: 9341200 - DNA, 22 bp, Homo sapiens
tactttaaaaactgataattca

SEQ ID NO: 9341201 - DNA, 22 bp, Homo sapiens
tacttgttgatcagttgttaaa

SEQ ID NO: 9341202 - DNA, 22 bp, Homo sapiens
tcaaaacactattacctttaat

SEQ ID NO: 9341203 - DNA, 22 bp, Homo sapiens
tcaagcaaagtttagctggtta

SEQ ID NO: 9341204 - DNA, 22 bp, Homo sapiens
tcaagcaaagatacaaatggaa

SEQ ID NO: 9341205 - DNA, 22 bp, Homo sapiens
tcaagcaagttgcatattgcta

SEQ ID NO: 9341206 - DNA, 22 bp, Homo sapiens
tcaagcaagtgtttggtgtaaa

SEQ ID NO: 9341207 - DNA, 22 bp, Homo sapiens
tcaagccatcaggcagcgggtt

SEQ ID NO: 9341208 - DNA, 22 bp, Homo sapiens
tcaagccactggcagaagatta

SEQ ID NO: 9341209 - DNA, 19 bp, Homo sapiens
tcaagcagtctgatttagg

SEQ ID NO: 9341210 - DNA, 22 bp, Homo sapiens
tcaagctattggctgaggctgc

SEQ ID NO: 9341211 - DNA, 22 bp, Homo sapiens
tcaagctcattcctctaacctc

SEQ ID NO: 9341212 - DNA, 22 bp, Homo sapiens
tcaagctcattcctctaacctc

SEQ ID NO: 9341213 - DNA, 19 bp, Homo sapiens
tcaaaacacaaatggttga

SEQ ID NO: 9341214 - DNA, 22 bp, Homo sapiens
tcaaaacactattacctttaat

SEQ ID NO: 9341215 - DNA, 22 bp, Homo sapiens
tcaaaaattttctgaggatgag

SEQ ID NO: 9341216 - DNA, 22 bp, Homo sapiens
tcaaaaattttctgaggatgag

SEQ ID NO: 9341217 - DNA, 22 bp, Homo sapiens
tattttatctgccagagtggag

SEQ ID NO: 9341218 - DNA, 22 bp, Homo sapiens
tcaaaaatgttttatattggta

SEQ ID NO: 9341219 - DNA, 22 bp, Homo sapiens
tattttcaccatgtatccctgt

SEQ ID NO: 9341220 - DNA, 22 bp, Homo sapiens
tcaaaaatgttttatattggta

SEQ ID NO: 9341221 - DNA, 22 bp, Homo sapiens
tattttacagactactttagat

SEQ ID NO: 9341222 - DNA, 22 bp, Homo sapiens
tattttacatgacaggtgttta

SEQ ID NO: 9341223 - DNA, 22 bp, Homo sapiens
tattttacatgatccagagttg

SEQ ID NO: 9341224 - DNA, 22 bp, Homo sapiens
tattttactatttggcaaagtc

SEQ ID NO: 9341225 - DNA, 22 bp, Homo sapiens
tattttatctgccagagtggag

SEQ ID NO: 9341226 - DNA, 22 bp, Homo sapiens
tattttatctgccagagtggag

SEQ ID NO: 9341227 - DNA, 22 bp, Homo sapiens
tattttaggtaatatccattgt

SEQ ID NO: 9341228 - DNA, 22 bp, Homo sapiens
tattttactttaaagcgagaga

SEQ ID NO: 9341229 - DNA, 22 bp, Homo sapiens
caggtgggtgtatgaatgcaaa

SEQ ID NO: 9341230 - DNA, 19 bp, Homo sapiens
caggtggtaatctgagcct

SEQ ID NO: 9341231 - DNA, 19 bp, Homo sapiens
caggtggtaatctgagcct

SEQ ID NO: 9341232 - DNA, 22 bp, Homo sapiens
caggtggtacttaaagtcagaa

SEQ ID NO: 9341233 - DNA, 22 bp, Homo sapiens
caggtggtacttaaagtcagaa

SEQ ID NO: 9341234 - DNA, 23 bp, Homo sapiens
caggtggtagagaaaaatccaga

SEQ ID NO: 9341235 - DNA, 22 bp, Homo sapiens
caggtggtcaggcaaggacacg

SEQ ID NO: 9341236 - DNA, 23 bp, Homo sapiens
caggtggtagagaaaaatccaga

SEQ ID NO: 9341237 - DNA, 22 bp, Homo sapiens
cagtattttccttgttaactta

SEQ ID NO: 9341238 - DNA, 22 bp, Homo sapiens
cagtatttttaagctgctttgt

SEQ ID NO: 9341239 - DNA, 21 bp, Homo sapiens
cagtattttaagcagtgagtt

SEQ ID NO: 9341240 - DNA, 22 bp, Homo sapiens
cagtcacatggatgatggatag

SEQ ID NO: 9341241 - DNA, 22 bp, Homo sapiens
cagtcacatttcgacataacta

SEQ ID NO: 9341242 - DNA, 22 bp, Homo sapiens
cagtcacatttcgacataacta

SEQ ID NO: 9341243 - DNA, 22 bp, Homo sapiens
cagtcaccaccaggtggcagta

SEQ ID NO: 9341244 - DNA, 22 bp, Homo sapiens
cagtcaccaccaggtggcagta

SEQ ID NO: 9341245 - DNA, 22 bp, Homo sapiens
cagtcactggaatagctgagga

SEQ ID NO: 9341246 - DNA, 22 bp, Homo sapiens
cagtcactccagcctgcctcag

SEQ ID NO: 9341247 - DNA, 22 bp, Homo sapiens
cagtcactccagcctgcctcag

SEQ ID NO: 9341248 - DNA, 22 bp, Homo sapiens
cagtcaccttgaggactcagac

SEQ ID NO: 9341249 - DNA, 22 bp, Homo sapiens
cagtcaccatagaataaaacat

SEQ ID NO: 9341250 - DNA, 22 bp, Homo sapiens
cagtcacctagacagaacttac

SEQ ID NO: 9341251 - DNA, 22 bp, Homo sapiens
cagtcacctgaagacttgacca

SEQ ID NO: 9341252 - DNA, 22 bp, Homo sapiens
cagtcacctagacagaacttac

SEQ ID NO: 9341253 - DNA, 22 bp, Homo sapiens
cagtcaacagagagcccgtcag

SEQ ID NO: 9341254 - DNA, 22 bp, Homo sapiens
cagtcacaagcgtacctaattt

SEQ ID NO: 9341255 - DNA, 22 bp, Homo sapiens
cagtcacataggtatacacata

SEQ ID NO: 9341256 - DNA, 22 bp, Homo sapiens
cagtcacataggtatacacata

SEQ ID NO: 9341257 - DNA, 22 bp, Homo sapiens
cagtcacaggtggagaaccgag

SEQ ID NO: 9341258 - DNA, 22 bp, Homo sapiens
tattttaaagactgccagccta

SEQ ID NO: 9341259 - DNA, 22 bp, Homo sapiens
tatttgaagacagggtctttaa

SEQ ID NO: 9341260 - DNA, 22 bp, Homo sapiens
tattttaaagtgaagggtcttg

SEQ ID NO: 9341261 - DNA, 22 bp, Homo sapiens
tattttacagactactttagat

SEQ ID NO: 9341262 - DNA, 22 bp, Homo sapiens
tattttacagactactttagat

SEQ ID NO: 9341263 - DNA, 22 bp, Homo sapiens
tattttacaaatgggaatgctg

SEQ ID NO: 9341264 - DNA, 22 bp, Homo sapiens
tattttacagactactttagat

SEQ ID NO: 9341265 - DNA, 22 bp, Homo sapiens
cagtcacttacaaaaatataat

SEQ ID NO: 9341266 - DNA, 22 bp, Homo sapiens
cagtcaggctgcgcttctctga

SEQ ID NO: 9341267 - DNA, 22 bp, Homo sapiens
cagtcagtaatgtggcacctgt

SEQ ID NO: 9341268 - DNA, 22 bp, Homo sapiens
cagtcagttatccacacaccag

SEQ ID NO: 9341269 - DNA, 22 bp, Homo sapiens
cagtcagggacaccagctagga

SEQ ID NO: 9341270 - DNA, 22 bp, Homo sapiens
caggtagaggctgccatcagct

SEQ ID NO: 9341271 - DNA, 22 bp, Homo sapiens
caggtagctgctggccatgtac

SEQ ID NO: 9341272 - DNA, 22 bp, Homo sapiens
caggtaggatggaagggctcaa

SEQ ID NO: 9341273 - DNA, 22 bp, Homo sapiens
caggtaggaaaagggtgtcagg

SEQ ID NO: 9341274 - DNA, 22 bp, Homo sapiens
caggtaggcagccggtctctgg

SEQ ID NO: 9341275 - DNA, 22 bp, Homo sapiens
caggtaaggtcacattctgaag

SEQ ID NO: 9341276 - DNA, 22 bp, Homo sapiens
caggtaaggtcacattctgaag

SEQ ID NO: 9341277 - DNA, 22 bp, Homo sapiens
caggtaagaccgtttaggcagt

SEQ ID NO: 9341278 - DNA, 22 bp, Homo sapiens
caggtaagagacggattggccc

SEQ ID NO: 9341279 - DNA, 22 bp, Homo sapiens
cagggtttcaccatgttagcag

SEQ ID NO: 9341280 - DNA, 22 bp, Homo sapiens
cagggtttcaccatgttagcag

SEQ ID NO: 9341281 - DNA, 22 bp, Homo sapiens
cagggtggggctggctatcaaa

SEQ ID NO: 9341282 - DNA, 22 bp, Homo sapiens
cagggtggggctggctatcaaa

SEQ ID NO: 9341283 - DNA, 22 bp, Homo sapiens
caggtcagaggtagatgagatg

SEQ ID NO: 9341284 - DNA, 22 bp, Homo sapiens
caggtcagaggcgcagccccca

SEQ ID NO: 9341285 - DNA, 22 bp, Homo sapiens
caggtcagaggtagatgagatg

SEQ ID NO: 9341286 - DNA, 22 bp, Homo sapiens
caggtcagaggcgcagccccca

SEQ ID NO: 9341287 - DNA, 22 bp, Homo sapiens
caggtattttcaaggcttgtgt

SEQ ID NO: 9341288 - DNA, 22 bp, Homo sapiens
caggtagtccacagtgagggag

SEQ ID NO: 9341289 - DNA, 22 bp, Homo sapiens
caggtaggtatggtgcagtctt

SEQ ID NO: 9341290 - DNA, 22 bp, Homo sapiens
caggtaggtatggtgcagtctt

SEQ ID NO: 9341291 - DNA, 22 bp, Homo sapiens
caggtatatgtgcatccataga

SEQ ID NO: 9341292 - DNA, 22 bp, Homo sapiens
caggtataacgtgcatgttgta

SEQ ID NO: 9341293 - DNA, 22 bp, Homo sapiens
caggtagtccagctctgggacc

SEQ ID NO: 9341294 - DNA, 22 bp, Homo sapiens
caggtagggatatgatggtgat

SEQ ID NO: 9341295 - DNA, 22 bp, Homo sapiens
caggtagggatatgatggtgat

SEQ ID NO: 9341296 - DNA, 22 bp, Homo sapiens
caggtgcctcaggatgagacaa

SEQ ID NO: 9341297 - DNA, 22 bp, Homo sapiens
caggtgcctcaggatgagacaa

SEQ ID NO: 9341298 - DNA, 16 bp, Homo sapiens
caggtgcctctcccga

SEQ ID NO: 9341299 - DNA, 22 bp, Homo sapiens
caggtgcctcaggatgagacaa

SEQ ID NO: 9341300 - DNA, 22 bp, Homo sapiens
caggtgccgggaatgcagcaat

SEQ ID NO: 9341301 - DNA, 22 bp, Homo sapiens
caggtgcccagctcctgctgtg

SEQ ID NO: 9341302 - DNA, 22 bp, Homo sapiens
caggtgcccagctcctgctgtg

SEQ ID NO: 9341303 - DNA, 22 bp, Homo sapiens
caggtgccgggaatgcagcaat

SEQ ID NO: 9341304 - DNA, 22 bp, Homo sapiens
caggtgcccaggggacagtggc

SEQ ID NO: 9341305 - DNA, 22 bp, Homo sapiens
caggtgctgtcctgcacatgtc

SEQ ID NO: 9341306 - DNA, 22 bp, Homo sapiens
caggtgctgtcctgcacatgtc

SEQ ID NO: 9341307 - DNA, 22 bp, Homo sapiens
caggtgctgcgtggcggagctg

SEQ ID NO: 9341308 - DNA, 22 bp, Homo sapiens
caggtgctctgctgcaggtaag

SEQ ID NO: 9341309 - DNA, 22 bp, Homo sapiens
caggtgctctgctgcaggtaag

SEQ ID NO: 9341310 - DNA, 22 bp, Homo sapiens
caggtccaactatttatctgtg

SEQ ID NO: 9341311 - DNA, 22 bp, Homo sapiens
caggtcagctggtgccccaggt

SEQ ID NO: 9341312 - DNA, 22 bp, Homo sapiens
caggtcagcacttggaggtgca

SEQ ID NO: 9341313 - DNA, 18 bp, Homo sapiens
caggtcagcctggcctca

SEQ ID NO: 9341314 - DNA, 22 bp, Homo sapiens
caggtcagcacttggaggtgca

SEQ ID NO: 9341315 - DNA, 22 bp, Homo sapiens
caggtcagcacttggaggtgca

SEQ ID NO: 9341316 - DNA, 22 bp, Homo sapiens
caggtccacagcccatcactgc

SEQ ID NO: 9341317 - DNA, 22 bp, Homo sapiens
caggtccaattgcgctaaaatc

SEQ ID NO: 9341318 - DNA, 22 bp, Homo sapiens
caggtccacagcccatcactgc

SEQ ID NO: 9341319 - DNA, 22 bp, Homo sapiens
caggtccaagagatcctcctac

SEQ ID NO: 9341320 - DNA, 22 bp, Homo sapiens
caggtccaattgcgctaaaatc

SEQ ID NO: 9341321 - DNA, 22 bp, Homo sapiens
caggtccaaggttcctgaatag

SEQ ID NO: 9341322 - DNA, 22 bp, Homo sapiens
caggtgcccagctcctgctgtg

SEQ ID NO: 9341323 - DNA, 22 bp, Homo sapiens
caggtgccatagacgggcctgg

SEQ ID NO: 9341324 - DNA, 22 bp, Homo sapiens
caggtccacagcccatcactgc

SEQ ID NO: 9341325 - DNA, 22 bp, Homo sapiens
caggtggctaacggcctcatag

SEQ ID NO: 9341326 - DNA, 22 bp, Homo sapiens
caggtggctaacggcctcatag

SEQ ID NO: 9341327 - DNA, 22 bp, Homo sapiens
tattaaatgttatttgggttgt

SEQ ID NO: 9341328 - DNA, 22 bp, Homo sapiens
caggtggctgagctgacctttg

SEQ ID NO: 9341329 - DNA, 20 bp, Homo sapiens
tattaggtagcactgggata

SEQ ID NO: 9341330 - DNA, 22 bp, Homo sapiens
tattaaatgttatttgggttgt

SEQ ID NO: 9341331 - DNA, 22 bp, Homo sapiens
caggtggatctctaaggactga

SEQ ID NO: 9341332 - DNA, 22 bp, Homo sapiens
caggtggagctgactgagggca

SEQ ID NO: 9341333 - DNA, 22 bp, Homo sapiens
caggtggcagaggtctctggaa

SEQ ID NO: 9341334 - DNA, 22 bp, Homo sapiens
caggtggcagaggtctctggaa

SEQ ID NO: 9341335 - DNA, 22 bp, Homo sapiens
caggtggcagaggtctctggaa

SEQ ID NO: 9341336 - DNA, 22 bp, Homo sapiens
caggtggcagtgcctgcattct

SEQ ID NO: 9341337 - DNA, 22 bp, Homo sapiens
caggtggcatgactgcctacaa

SEQ ID NO: 9341338 - DNA, 22 bp, Homo sapiens
caggtggcatgactgcctacaa

SEQ ID NO: 9341339 - DNA, 22 bp, Homo sapiens
caggtggccagtactcaaggat

SEQ ID NO: 9341340 - DNA, 22 bp, Homo sapiens
caggtggccagtactcaaggat

SEQ ID NO: 9341341 - DNA, 22 bp, Homo sapiens
caggtggccagtactcaaggat

SEQ ID NO: 9341342 - DNA, 22 bp, Homo sapiens
caggtggccttgccatctcctg

SEQ ID NO: 9341343 - DNA, 22 bp, Homo sapiens
tattagttgcaaaacattgact

SEQ ID NO: 9341344 - DNA, 22 bp, Homo sapiens
tattataaaattactggcaggg

SEQ ID NO: 9341345 - DNA, 22 bp, Homo sapiens
tattatatttagtaatgtggag

SEQ ID NO: 9341346 - DNA, 22 bp, Homo sapiens
caggtgggtacatcacagagac

SEQ ID NO: 9341347 - DNA, 18 bp, Homo sapiens
caggtgggtctcctgccc

SEQ ID NO: 9341348 - DNA, 18 bp, Homo sapiens
caggtgggtctcctgccc

SEQ ID NO: 9341349 - DNA, 22 bp, Homo sapiens
tattattaaatggcagaatttt

SEQ ID NO: 9341350 - DNA, 22 bp, Homo sapiens
caggtgggtacatcacagagac

SEQ ID NO: 9341351 - DNA, 22 bp, Homo sapiens
cagggctgggttaaaagcaggg

SEQ ID NO: 9341352 - DNA, 22 bp, Homo sapiens
cagggctgggttaaaagcaggg

SEQ ID NO: 9341353 - DNA, 23 bp, Homo sapiens
cagggctggtagggaagagcgtg

SEQ ID NO: 9341354 - DNA, 23 bp, Homo sapiens
cagggctggtagggaagagcgtg

SEQ ID NO: 9341355 - DNA, 23 bp, Homo sapiens
cagggctggtagggaagagcgtg

SEQ ID NO: 9341356 - DNA, 22 bp, Homo sapiens
cagggctgggttaaaagcaggg

SEQ ID NO: 9341357 - DNA, 22 bp, Homo sapiens
cagggctggatttcatttctag

SEQ ID NO: 9341358 - DNA, 22 bp, Homo sapiens
cagggctggatttcatttctag

SEQ ID NO: 9341359 - DNA, 23 bp, Homo sapiens
cagggctggtagggaagagcgtg

SEQ ID NO: 9341360 - DNA, 23 bp, Homo sapiens
cagggctggtagggaagagcgtg

SEQ ID NO: 9341361 - DNA, 23 bp, Homo sapiens
cagggctggtagggaagagcgtg

SEQ ID NO: 9341362 - DNA, 23 bp, Homo sapiens
cagggctggtagggaagagcgtg

SEQ ID NO: 9341363 - DNA, 22 bp, Homo sapiens
cagggctggtttgtcgaagaaa

SEQ ID NO: 9341364 - DNA, 22 bp, Homo sapiens
cagggctggtttgtcgaagaaa

SEQ ID NO: 9341365 - DNA, 22 bp, Homo sapiens
cagggctggtttgtcgaagaaa

SEQ ID NO: 9341366 - DNA, 22 bp, Homo sapiens
cagggctggtttgtcgaagaaa

SEQ ID NO: 9341367 - DNA, 22 bp, Homo sapiens
cagggctggtttgtcgaagaaa

SEQ ID NO: 9341368 - DNA, 22 bp, Homo sapiens
cagggctgtaaattagtgctga

SEQ ID NO: 9341369 - DNA, 22 bp, Homo sapiens
cagggctgtaaattagtgctga

SEQ ID NO: 9341370 - DNA, 22 bp, Homo sapiens
cagggctgtaaattagtgctga

SEQ ID NO: 9341371 - DNA, 22 bp, Homo sapiens
cagggctgtctccaaaggcccc

SEQ ID NO: 9341372 - DNA, 22 bp, Homo sapiens
cagggctgtctccaaaggcccc

SEQ ID NO: 9341373 - DNA, 22 bp, Homo sapiens
cagggctgtctccaaaggcccc

SEQ ID NO: 9341374 - DNA, 22 bp, Homo sapiens
cagggctgtaaattagtgctga

SEQ ID NO: 9341375 - DNA, 22 bp, Homo sapiens
cagggctgtaaattagtgctga

SEQ ID NO: 9341376 - DNA, 22 bp, Homo sapiens
taggctgggctgagctggacgg

SEQ ID NO: 9341377 - DNA, 22 bp, Homo sapiens
cagggctgagaatttagagaca

SEQ ID NO: 9341378 - DNA, 22 bp, Homo sapiens
cagggctgagaatttagagaca

SEQ ID NO: 9341379 - DNA, 22 bp, Homo sapiens
cagggctgaagaaattcaaaag

SEQ ID NO: 9341380 - DNA, 22 bp, Homo sapiens
cagggctgaagaaattcaaaag

SEQ ID NO: 9341381 - DNA, 22 bp, Homo sapiens
cagggctgaagaaattcaaaag

SEQ ID NO: 9341382 - DNA, 22 bp, Homo sapiens
taggctgggctgagctggacgg

SEQ ID NO: 9341383 - DNA, 18 bp, Homo sapiens
taggctgggggctgtagt

SEQ ID NO: 9341384 - DNA, 22 bp, Homo sapiens
taggctgggctgagctggacgg

SEQ ID NO: 9341385 - DNA, 18 bp, Homo sapiens
taggctgggggctgtagt

SEQ ID NO: 9341386 - DNA, 22 bp, Homo sapiens
taggctgggggtaggaattgag

SEQ ID NO: 9341387 - DNA, 22 bp, Homo sapiens
cagggctgaactgagcttgtga

SEQ ID NO: 9341388 - DNA, 22 bp, Homo sapiens
cagggctgaaatcaaggtgtag

SEQ ID NO: 9341389 - DNA, 22 bp, Homo sapiens
cagggctgaactgagcttgtga

SEQ ID NO: 9341390 - DNA, 22 bp, Homo sapiens
cagggctgaactgagcttgtga

SEQ ID NO: 9341391 - DNA, 22 bp, Homo sapiens
cagggctcttccggagcaggga

SEQ ID NO: 9341392 - DNA, 22 bp, Homo sapiens
cagggctgaaatcaaggtgtag

SEQ ID NO: 9341393 - DNA, 22 bp, Homo sapiens
cagggctgaaatcaaggtgtag

SEQ ID NO: 9341394 - DNA, 22 bp, Homo sapiens
cagggctgaaatcaaggtgtag

SEQ ID NO: 9341395 - DNA, 22 bp, Homo sapiens
cagggctcttccggagcaggga

SEQ ID NO: 9341396 - DNA, 22 bp, Homo sapiens
cagggctcttcatcacacagta

SEQ ID NO: 9341397 - DNA, 22 bp, Homo sapiens
cagggctcttccggagcaggga

SEQ ID NO: 9341398 - DNA, 20 bp, Homo sapiens
cagggctctgggcctggcct

SEQ ID NO: 9341399 - DNA, 20 bp, Homo sapiens
cagggctctgggcctggcct

SEQ ID NO: 9341400 - DNA, 20 bp, Homo sapiens
cagggctctgggcctggcct

SEQ ID NO: 9341401 - DNA, 22 bp, Homo sapiens
cagggctgtggctttgtgctgt

SEQ ID NO: 9341402 - DNA, 22 bp, Homo sapiens
cagggctgtggaaaactggtgc

SEQ ID NO: 9341403 - DNA, 22 bp, Homo sapiens
cagggctgtggaaaactggtgc

SEQ ID NO: 9341404 - DNA, 22 bp, Homo sapiens
cagggctgtggctttgtgctgt

SEQ ID NO: 9341405 - DNA, 22 bp, Homo sapiens
cagggctgtggaaaactggtgc

SEQ ID NO: 9341406 - DNA, 17 bp, Homo sapiens
cagggctgtctgcctag

SEQ ID NO: 9341407 - DNA, 22 bp, Homo sapiens
cagggctgtgcccatcttcccc

SEQ ID NO: 9341408 - DNA, 22 bp, Homo sapiens
cagggctgtgcccatcttcccc

SEQ ID NO: 9341409 - DNA, 22 bp, Homo sapiens
cagggctgtgcccatcttcccc

SEQ ID NO: 9341410 - DNA, 17 bp, Homo sapiens
cagggctgtctgcctag

SEQ ID NO: 9341411 - DNA, 17 bp, Homo sapiens
cagggctgtctgcctag

SEQ ID NO: 9341412 - DNA, 22 bp, Homo sapiens
cagggctgtctccaaaggcccc

SEQ ID NO: 9341413 - DNA, 22 bp, Homo sapiens
cagggctgtctccaaaggcccc

SEQ ID NO: 9341414 - DNA, 17 bp, Homo sapiens
cagggctgtctgcctag

SEQ ID NO: 9341415 - DNA, 22 bp, Homo sapiens
caggggctgtttgcctcaggcc

SEQ ID NO: 9341416 - DNA, 22 bp, Homo sapiens
caggggcttaagtgacagaagg

SEQ ID NO: 9341417 - DNA, 22 bp, Homo sapiens
caggggggcaggagtcattgat

SEQ ID NO: 9341418 - DNA, 22 bp, Homo sapiens
cagggtggggctggctatcaaa

SEQ ID NO: 9341419 - DNA, 22 bp, Homo sapiens
cagggtccccgggtctcctgtg

SEQ ID NO: 9341420 - DNA, 22 bp, Homo sapiens
cagggtccccgggtctcctgtg

SEQ ID NO: 9341421 - DNA, 22 bp, Homo sapiens
cagggtagtaatttaatacaag

SEQ ID NO: 9341422 - DNA, 22 bp, Homo sapiens
cagggtcaggctgctagaagct

SEQ ID NO: 9341423 - DNA, 22 bp, Homo sapiens
cagggtcaggctgctagaagct

SEQ ID NO: 9341424 - DNA, 22 bp, Homo sapiens
caggggtggctgcagcagaggt

SEQ ID NO: 9341425 - DNA, 22 bp, Homo sapiens
caggggtgtttttggccaggag

SEQ ID NO: 9341426 - DNA, 22 bp, Homo sapiens
cagggggtggtccaggctgcgc

SEQ ID NO: 9341427 - DNA, 22 bp, Homo sapiens
caggggtggctgcagcagaggt

SEQ ID NO: 9341428 - DNA, 22 bp, Homo sapiens
caggggtgtttttggccaggag

SEQ ID NO: 9341429 - DNA, 22 bp, Homo sapiens
caggggtgtttttggccaggag

SEQ ID NO: 9341430 - DNA, 22 bp, Homo sapiens
cagggtagacagtaggtgtctg

SEQ ID NO: 9341431 - DNA, 22 bp, Homo sapiens
cagggtagggcaagggaacctg

SEQ ID NO: 9341432 - DNA, 22 bp, Homo sapiens
cagggctccatgcagggactcc

SEQ ID NO: 9341433 - DNA, 22 bp, Homo sapiens
cagggcctcatcctcagagatt

SEQ ID NO: 9341434 - DNA, 20 bp, Homo sapiens
cagggcctatgattgagctt

SEQ ID NO: 9341435 - DNA, 22 bp, Homo sapiens
cagggcctcatggccggggtgc

SEQ ID NO: 9341436 - DNA, 22 bp, Homo sapiens
cagggcctcatcctcagagatt

SEQ ID NO: 9341437 - DNA, 23 bp, Homo sapiens
cagggccctgctcaatttctcca

SEQ ID NO: 9341438 - DNA, 20 bp, Homo sapiens
cagggcctaagagctgaaaa

SEQ ID NO: 9341439 - DNA, 20 bp, Homo sapiens
cagggcctaagagctgaaaa

SEQ ID NO: 9341440 - DNA, 20 bp, Homo sapiens
cagggcctatgattgagctt

SEQ ID NO: 9341441 - DNA, 20 bp, Homo sapiens
cagggcctatgattgagctt

SEQ ID NO: 9341442 - DNA, 22 bp, Homo sapiens
cagggccccagggatgtctgct

SEQ ID NO: 9341443 - DNA, 22 bp, Homo sapiens
cagggcccagtccctgctgtca

SEQ ID NO: 9341444 - DNA, 19 bp, Homo sapiens
taggccagaagttttccac

SEQ ID NO: 9341445 - DNA, 22 bp, Homo sapiens
taggccagaggagcagctttgg

SEQ ID NO: 9341446 - DNA, 22 bp, Homo sapiens
taggccacaaataagatcctgt

SEQ ID NO: 9341447 - DNA, 22 bp, Homo sapiens
tagcttctaatacttaccaatt

SEQ ID NO: 9341448 - DNA, 22 bp, Homo sapiens
tagcttctcataatttatgctg

SEQ ID NO: 9341449 - DNA, 22 bp, Homo sapiens
tagcttatctatacagactttt

SEQ ID NO: 9341450 - DNA, 22 bp, Homo sapiens
tagcttatggtctctagggaat

SEQ ID NO: 9341451 - DNA, 22 bp, Homo sapiens
tagcttataaaggttttcaaag

SEQ ID NO: 9341452 - DNA, 18 bp, Homo sapiens
taggaggatactgagatg

SEQ ID NO: 9341453 - DNA, 22 bp, Homo sapiens
taggaggcagtcgttcttcagt

SEQ ID NO: 9341454 - DNA, 22 bp, Homo sapiens
taggcagggattagggttgatt

SEQ ID NO: 9341455 - DNA, 22 bp, Homo sapiens
taggcagggattagggttgatt

SEQ ID NO: 9341456 - DNA, 22 bp, Homo sapiens
taggcaggtgtgcactgcccac

SEQ ID NO: 9341457 - DNA, 22 bp, Homo sapiens
taggcaggtgtgcactgcccac

SEQ ID NO: 9341458 - DNA, 22 bp, Homo sapiens
taggaggcatttgctcccaggg

SEQ ID NO: 9341459 - DNA, 18 bp, Homo sapiens
taggaggctcctgggggc

SEQ ID NO: 9341460 - DNA, 22 bp, Homo sapiens
taggaggcttaaagctgctcag

SEQ ID NO: 9341461 - DNA, 22 bp, Homo sapiens
taggcattacctaacattacct

SEQ ID NO: 9341462 - DNA, 22 bp, Homo sapiens
taggcatgcaaataaatgtgca

SEQ ID NO: 9341463 - DNA, 22 bp, Homo sapiens
taggcatgcaaataaatgtgca

SEQ ID NO: 9341464 - DNA, 22 bp, Homo sapiens
taggcaggtgtgcactgcccac

SEQ ID NO: 9341465 - DNA, 22 bp, Homo sapiens
cagggagcagcccctagaagta

SEQ ID NO: 9341466 - DNA, 22 bp, Homo sapiens
cagggagcactgcgagcggcag

SEQ ID NO: 9341467 - DNA, 22 bp, Homo sapiens
cagggagatcttggctcctggt

SEQ ID NO: 9341468 - DNA, 22 bp, Homo sapiens
cagggagcaggctctgtccatc

SEQ ID NO: 9341469 - DNA, 22 bp, Homo sapiens
cagggagcagcgctggggcctc

SEQ ID NO: 9341470 - DNA, 22 bp, Homo sapiens
cagggagcagcgctggggcctc

SEQ ID NO: 9341471 - DNA, 22 bp, Homo sapiens
tagattctttgctagatcattg

SEQ ID NO: 9341472 - DNA, 22 bp, Homo sapiens
tagatttcaggagacaaaatgg

SEQ ID NO: 9341473 - DNA, 22 bp, Homo sapiens
tagatttaagaccctgaatttg

SEQ ID NO: 9341474 - DNA, 22 bp, Homo sapiens
tagatttcgctgcatctcaatc

SEQ ID NO: 9341475 - DNA, 22 bp, Homo sapiens
tagatttcctcttcctcattcc

SEQ ID NO: 9341476 - DNA, 22 bp, Homo sapiens
tagatttcaggctggcttgcgg

SEQ ID NO: 9341477 - DNA, 20 bp, Homo sapiens
tagatttcatacttctcttt

SEQ ID NO: 9341478 - DNA, 22 bp, Homo sapiens
tagatttctaacagtgtgcttg

SEQ ID NO: 9341479 - DNA, 22 bp, Homo sapiens
tagatttctaacagtgtgcttg

SEQ ID NO: 9341480 - DNA, 22 bp, Homo sapiens
tagatttctcattcatagattg

SEQ ID NO: 9341481 - DNA, 19 bp, Homo sapiens
tagatttgatcatctggat

SEQ ID NO: 9341482 - DNA, 22 bp, Homo sapiens
cagggccattggcgtggctgtc

SEQ ID NO: 9341483 - DNA, 22 bp, Homo sapiens
cagggccatgaggcacagggtc

SEQ ID NO: 9341484 - DNA, 22 bp, Homo sapiens
tagcttaacagcaaaactgttg

SEQ ID NO: 9341485 - DNA, 22 bp, Homo sapiens
tagcttaaaccaatctgaataa

SEQ ID NO: 9341486 - DNA, 22 bp, Homo sapiens
tagcttaacagcaaaactgttg

SEQ ID NO: 9341487 - DNA, 22 bp, Homo sapiens
tagcttaatatgaaacacataa

SEQ ID NO: 9341488 - DNA, 22 bp, Homo sapiens
cagggccatgaggcacagggtc

SEQ ID NO: 9341489 - DNA, 22 bp, Homo sapiens
cagggccatgaggcacagggtc

SEQ ID NO: 9341490 - DNA, 22 bp, Homo sapiens
cagggccatatcttgtgcacca

SEQ ID NO: 9341491 - DNA, 22 bp, Homo sapiens
cagggccatatcttgtgcacca

SEQ ID NO: 9341492 - DNA, 22 bp, Homo sapiens
cagggccatatcttgtgcacca

SEQ ID NO: 9341493 - DNA, 22 bp, Homo sapiens
cagggccagggctatggtgaag

SEQ ID NO: 9341494 - DNA, 22 bp, Homo sapiens
cagggccaggctgatggcctgg

SEQ ID NO: 9341495 - DNA, 22 bp, Homo sapiens
cagggccagttctcgcagcagt

SEQ ID NO: 9341496 - DNA, 22 bp, Homo sapiens
cagggccagttctcgcagcagt

SEQ ID NO: 9341497 - DNA, 22 bp, Homo sapiens
cagggccaggctgatggcctgg

SEQ ID NO: 9341498 - DNA, 22 bp, Homo sapiens
cagggccaggctgatggcctgg

SEQ ID NO: 9341499 - DNA, 22 bp, Homo sapiens
cagggccactgtagatgaggag

SEQ ID NO: 9341500 - DNA, 22 bp, Homo sapiens
cagggccactgcatgaggttca

SEQ ID NO: 9341501 - DNA, 22 bp, Homo sapiens
cagttagcactcagtttccaga

SEQ ID NO: 9341502 - DNA, 22 bp, Homo sapiens
cagttctggagtttcattcttt

SEQ ID NO: 9341503 - DNA, 22 bp, Homo sapiens
cagttgatgggactcatgtggg

SEQ ID NO: 9341504 - DNA, 22 bp, Homo sapiens
cagttgatgtttagactctgca

SEQ ID NO: 9341505 - DNA, 23 bp, Homo sapiens
cagttgatgttaccttccttaga

SEQ ID NO: 9341506 - DNA, 22 bp, Homo sapiens
cagttgattgacttaagtacct

SEQ ID NO: 9341507 - DNA, 22 bp, Homo sapiens
cagttgataataccagagagag

SEQ ID NO: 9341508 - DNA, 21 bp, Homo sapiens
cagttgatagagatcttgagc

SEQ ID NO: 9341509 - DNA, 22 bp, Homo sapiens
cagttgatcactataggcttca

SEQ ID NO: 9341510 - DNA, 22 bp, Homo sapiens
cagttgatattgcagacaagca

SEQ ID NO: 9341511 - DNA, 22 bp, Homo sapiens
cagttgatatagaaaaaagtga

SEQ ID NO: 9341512 - DNA, 20 bp, Homo sapiens
cagttgaaataatttgtttg

SEQ ID NO: 9341513 - DNA, 22 bp, Homo sapiens
cagttctttgtggggagttctc

SEQ ID NO: 9341514 - DNA, 22 bp, Homo sapiens
cagttgaaaagattttattctg

SEQ ID NO: 9341515 - DNA, 22 bp, Homo sapiens
tcaatatattccatgttttctc

SEQ ID NO: 9341516 - DNA, 22 bp, Homo sapiens
tcaatatagcagtgtacttgag

SEQ ID NO: 9341517 - DNA, 22 bp, Homo sapiens
tcaatatattccatgttttctc

SEQ ID NO: 9341518 - DNA, 22 bp, Homo sapiens
tcaatcatagtccttctctaga

SEQ ID NO: 9341519 - DNA, 22 bp, Homo sapiens
tcaatcattcttgccatttatt

SEQ ID NO: 9341520 - DNA, 22 bp, Homo sapiens
tcaatcataatgaagtgaagaa

SEQ ID NO: 9341521 - DNA, 21 bp, Homo sapiens
tcagagagtcacagtgaactg

SEQ ID NO: 9341522 - DNA, 22 bp, Homo sapiens
cagttggtgatgaggctagtag

SEQ ID NO: 9341523 - DNA, 22 bp, Homo sapiens
cagttggtcttcccttggagca

SEQ ID NO: 9341524 - DNA, 22 bp, Homo sapiens
cagttggttttgaggctgtact

SEQ ID NO: 9341525 - DNA, 22 bp, Homo sapiens
cagttgatttttatggtgtgaa

SEQ ID NO: 9341526 - DNA, 22 bp, Homo sapiens
cagttgatttttatggtgtgaa

SEQ ID NO: 9341527 - DNA, 22 bp, Homo sapiens
cagttgcctactacatggcagg

SEQ ID NO: 9341528 - DNA, 22 bp, Homo sapiens
cagttgctggatgtgcagctct

SEQ ID NO: 9341529 - DNA, 22 bp, Homo sapiens
tcagagcaaattcctgtgagcc

SEQ ID NO: 9341530 - DNA, 22 bp, Homo sapiens
tcagagcaacttttcctgcttt

SEQ ID NO: 9341531 - DNA, 22 bp, Homo sapiens
tcagagatcttcaggatgggac

SEQ ID NO: 9341532 - DNA, 22 bp, Homo sapiens
tcagagagtgcaaaatatagct

SEQ ID NO: 9341533 - DNA, 23 bp, Homo sapiens
cataaaatattagtatggtagca

SEQ ID NO: 9341534 - DNA, 23 bp, Homo sapiens
cataaaatattagtatggtagca

SEQ ID NO: 9341535 - DNA, 23 bp, Homo sapiens
cataaaatattagtatggtagca

SEQ ID NO: 9341536 - DNA, 23 bp, Homo sapiens
cataaaatattagtatggtagca

SEQ ID NO: 9341537 - DNA, 22 bp, Homo sapiens
cagtttttgccattaagagtaa

SEQ ID NO: 9341538 - DNA, 22 bp, Homo sapiens
cagtttttcaaaattacatgat

SEQ ID NO: 9341539 - DNA, 22 bp, Homo sapiens
cagttttggtgatatttgagaa

SEQ ID NO: 9341540 - DNA, 22 bp, Homo sapiens
cagtttttagattagttggtgg

SEQ ID NO: 9341541 - DNA, 22 bp, Homo sapiens
tcagatccgagtgtgccaagga

SEQ ID NO: 9341542 - DNA, 22 bp, Homo sapiens
tcagatattctctaagaacaat

SEQ ID NO: 9341543 - DNA, 22 bp, Homo sapiens
tcagatcaggatgcagcaacat

SEQ ID NO: 9341544 - DNA, 22 bp, Homo sapiens
tcagatattcaattaagttaaa

SEQ ID NO: 9341545 - DNA, 22 bp, Homo sapiens
tcagaggagatggttaccaggg

SEQ ID NO: 9341546 - DNA, 23 bp, Homo sapiens
tcagagcaagatgatgtatgagc

SEQ ID NO: 9341547 - DNA, 22 bp, Homo sapiens
tcagaggagccaaagttctgag

SEQ ID NO: 9341548 - DNA, 22 bp, Homo sapiens
tcagaggagcaaaagaggggat

SEQ ID NO: 9341549 - DNA, 22 bp, Homo sapiens
tcagaggatcatgtccctactc

SEQ ID NO: 9341550 - DNA, 22 bp, Homo sapiens
tcagaggatagaaatacttatt

SEQ ID NO: 9341551 - DNA, 23 bp, Homo sapiens
tcagaggatcatcaaacgttttc

SEQ ID NO: 9341552 - DNA, 22 bp, Homo sapiens
tcagaggagggactcagaccca

SEQ ID NO: 9341553 - DNA, 22 bp, Homo sapiens
tcagaggaggcatttaaacaga

SEQ ID NO: 9341554 - DNA, 22 bp, Homo sapiens
tcagaggagctgcagaacgctg

SEQ ID NO: 9341555 - DNA, 22 bp, Homo sapiens
tcagaggatgctgttctttaat

SEQ ID NO: 9341556 - DNA, 20 bp, Homo sapiens
tcagataaggtgatctgtgg

SEQ ID NO: 9341557 - DNA, 22 bp, Homo sapiens
tcagatatagtcatttaaataa

SEQ ID NO: 9341558 - DNA, 22 bp, Homo sapiens
tcagatatagtcatttaaataa

SEQ ID NO: 9341559 - DNA, 22 bp, Homo sapiens
tcagatattcaattaagttaaa

SEQ ID NO: 9341560 - DNA, 22 bp, Homo sapiens
tcagatattcaattaagttaaa

SEQ ID NO: 9341561 - DNA, 22 bp, Homo sapiens
tcagatatggagtctaaaacca

SEQ ID NO: 9341562 - DNA, 22 bp, Homo sapiens
tcagatatgaattcatatctct

SEQ ID NO: 9341563 - DNA, 22 bp, Homo sapiens
tcaggctgcctatcagactgtg

SEQ ID NO: 9341564 - DNA, 17 bp, Homo sapiens
tcaggctgtgcctggta

SEQ ID NO: 9341565 - DNA, 22 bp, Homo sapiens
tcaggctgtatatcttgcactc

SEQ ID NO: 9341566 - DNA, 21 bp, Homo sapiens
tcaggctgtctgctggttcca

SEQ ID NO: 9341567 - DNA, 21 bp, Homo sapiens
tcaggctgtctgctggttcca

SEQ ID NO: 9341568 - DNA, 17 bp, Homo sapiens
tcaggctgtgcctggta

SEQ ID NO: 9341569 - DNA, 22 bp, Homo sapiens
tcaggctgtgggcactggccat

SEQ ID NO: 9341570 - DNA, 22 bp, Homo sapiens
tcaggctgtgggcactggccat

SEQ ID NO: 9341571 - DNA, 22 bp, Homo sapiens
tcaggctgtgggcactggccat

SEQ ID NO: 9341572 - DNA, 22 bp, Homo sapiens
tcaggctgtggcttcagttctt

SEQ ID NO: 9341573 - DNA, 22 bp, Homo sapiens
tcaggctgtggctttgaccgca

SEQ ID NO: 9341574 - DNA, 22 bp, Homo sapiens
tcaggctgtggcttcagttctt

SEQ ID NO: 9341575 - DNA, 17 bp, Homo sapiens
tcaggctgtgcctggta

SEQ ID NO: 9341576 - DNA, 22 bp, Homo sapiens
tcaggctgtgtctttaaacaat

SEQ ID NO: 9341577 - DNA, 22 bp, Homo sapiens
tcaggctgtgggcactggccat

SEQ ID NO: 9341578 - DNA, 22 bp, Homo sapiens
tcaggctgttagccacctcctc

SEQ ID NO: 9341579 - DNA, 22 bp, Homo sapiens
tcaggctgttagccacctcctc

SEQ ID NO: 9341580 - DNA, 22 bp, Homo sapiens
tcagggagaggtgagagcctgt

SEQ ID NO: 9341581 - DNA, 22 bp, Homo sapiens
tcaggcctcagcagcccacagg

SEQ ID NO: 9341582 - DNA, 22 bp, Homo sapiens
tcaggcctcaagctgctttaag

SEQ ID NO: 9341583 - DNA, 22 bp, Homo sapiens
tcaggcctagaacacagcagat

SEQ ID NO: 9341584 - DNA, 22 bp, Homo sapiens
tcaggccctttgctgctgcccc

SEQ ID NO: 9341585 - DNA, 22 bp, Homo sapiens
tcaggcctagggagaaaattca

SEQ ID NO: 9341586 - DNA, 22 bp, Homo sapiens
tcaggcctagggagccacacca

SEQ ID NO: 9341587 - DNA, 22 bp, Homo sapiens
tcaggcctagggagccacacca

SEQ ID NO: 9341588 - DNA, 22 bp, Homo sapiens
tcaggcccttctcccaggactc

SEQ ID NO: 9341589 - DNA, 22 bp, Homo sapiens
tcaggccctttgctgctgcccc

SEQ ID NO: 9341590 - DNA, 22 bp, Homo sapiens
tcaggccctttgctgctgcccc

SEQ ID NO: 9341591 - DNA, 22 bp, Homo sapiens
tcaggcccttctcccaggactc

SEQ ID NO: 9341592 - DNA, 22 bp, Homo sapiens
tcaggccccttgtcagctctgt

SEQ ID NO: 9341593 - DNA, 22 bp, Homo sapiens
tcaggccccatcccagacttat

SEQ ID NO: 9341594 - DNA, 22 bp, Homo sapiens
tcaggccccatcccagacttat

SEQ ID NO: 9341595 - DNA, 22 bp, Homo sapiens
tcaggcccagagtcacggatcc

SEQ ID NO: 9341596 - DNA, 22 bp, Homo sapiens
tcaggccccttgtcagctctgt

SEQ ID NO: 9341597 - DNA, 22 bp, Homo sapiens
tcaggccccttgtcagctctgt

SEQ ID NO: 9341598 - DNA, 22 bp, Homo sapiens
catagaaactgagacaaggatt

SEQ ID NO: 9341599 - DNA, 22 bp, Homo sapiens
tcagcaggggccgttgggtgga

SEQ ID NO: 9341600 - DNA, 22 bp, Homo sapiens
tcagcagggtttgacttctaat

SEQ ID NO: 9341601 - DNA, 22 bp, Homo sapiens
tcagcagggtttgacttctaat

SEQ ID NO: 9341602 - DNA, 22 bp, Homo sapiens
tcagcaggtctgaggcggggcc

SEQ ID NO: 9341603 - DNA, 22 bp, Homo sapiens
tcagcaggtctgaggcggggcc

SEQ ID NO: 9341604 - DNA, 22 bp, Homo sapiens
tcagcaggtgaacatcatgcca

SEQ ID NO: 9341605 - DNA, 22 bp, Homo sapiens
tcagcaggtgaacatcatgcca

SEQ ID NO: 9341606 - DNA, 22 bp, Homo sapiens
tcagcaggtggtgggcaggtga

SEQ ID NO: 9341607 - DNA, 22 bp, Homo sapiens
tcagcaggtggtgggcaggtga

SEQ ID NO: 9341608 - DNA, 22 bp, Homo sapiens
tcagcaggtggtgggcaggtga

SEQ ID NO: 9341609 - DNA, 22 bp, Homo sapiens
tcagcaggtgcctcagattctt

SEQ ID NO: 9341610 - DNA, 22 bp, Homo sapiens
tcagcaggtgcctcagattctt

SEQ ID NO: 9341611 - DNA, 22 bp, Homo sapiens
tcagcaggtggtgggcaggtga

SEQ ID NO: 9341612 - DNA, 22 bp, Homo sapiens
tcagcaggtgctttgtttactc

SEQ ID NO: 9341613 - DNA, 22 bp, Homo sapiens
tcagcaggtgctttgtttactc

SEQ ID NO: 9341614 - DNA, 22 bp, Homo sapiens
cataatatctccgattacttgc

SEQ ID NO: 9341615 - DNA, 22 bp, Homo sapiens
cataatatctccgattacttgc

SEQ ID NO: 9341616 - DNA, 22 bp, Homo sapiens
cataatgtatgcattttccagc

SEQ ID NO: 9341617 - DNA, 22 bp, Homo sapiens
cataattaggcagttgatcatt

SEQ ID NO: 9341618 - DNA, 22 bp, Homo sapiens
cataatttcccaagagattgaa

SEQ ID NO: 9341619 - DNA, 22 bp, Homo sapiens
cataatttcccaagagattgaa

SEQ ID NO: 9341620 - DNA, 22 bp, Homo sapiens
cataatttcactgtcgtatggc

SEQ ID NO: 9341621 - DNA, 22 bp, Homo sapiens
cataattagagaattcatgtta

SEQ ID NO: 9341622 - DNA, 22 bp, Homo sapiens
cataattactgatatgctgatt

SEQ ID NO: 9341623 - DNA, 22 bp, Homo sapiens
cataattttccatggtttgcta

SEQ ID NO: 9341624 - DNA, 18 bp, Homo sapiens
cataattttctttcttta

SEQ ID NO: 9341625 - DNA, 22 bp, Homo sapiens
cataatttgtggtagtggggga

SEQ ID NO: 9341626 - DNA, 22 bp, Homo sapiens
cataattttccatggtttgcta

SEQ ID NO: 9341627 - DNA, 22 bp, Homo sapiens
cataatttctgtatcagcacca

SEQ ID NO: 9341628 - DNA, 22 bp, Homo sapiens
cataatttctaccagggccata

SEQ ID NO: 9341629 - DNA, 22 bp, Homo sapiens
cataatttgatatgcttgatgg

SEQ ID NO: 9341630 - DNA, 22 bp, Homo sapiens
tcaggcagagtggaagctgcaa

SEQ ID NO: 9341631 - DNA, 22 bp, Homo sapiens
tcaggcagagtggaagctgcaa

SEQ ID NO: 9341632 - DNA, 18 bp, Homo sapiens
cataattttctttcttta

SEQ ID NO: 9341633 - DNA, 22 bp, Homo sapiens
tcaggcccagagtcacggatcc

SEQ ID NO: 9341634 - DNA, 22 bp, Homo sapiens
tcaggcagagttaatttgctcc

SEQ ID NO: 9341635 - DNA, 22 bp, Homo sapiens
catgcacacacagttctaatta

SEQ ID NO: 9341636 - DNA, 22 bp, Homo sapiens
catgcacacacagttctaatta

SEQ ID NO: 9341637 - DNA, 22 bp, Homo sapiens
catgcacacacgtgcatgtacg

SEQ ID NO: 9341638 - DNA, 22 bp, Homo sapiens
catgcaggcctatggagcagtg

SEQ ID NO: 9341639 - DNA, 22 bp, Homo sapiens
catgcaggcctatggagcagtg

SEQ ID NO: 9341640 - DNA, 22 bp, Homo sapiens
catgacatctgcttagtatgaa

SEQ ID NO: 9341641 - DNA, 22 bp, Homo sapiens
catgacacccaggcatagcacc

SEQ ID NO: 9341642 - DNA, 22 bp, Homo sapiens
catgaatacggatgctcggaga

SEQ ID NO: 9341643 - DNA, 22 bp, Homo sapiens
catgaatatttagtatttactt

SEQ ID NO: 9341644 - DNA, 22 bp, Homo sapiens
catgaatatttagtatttactt

SEQ ID NO: 9341645 - DNA, 22 bp, Homo sapiens
catgaatatacatcctgatggc

SEQ ID NO: 9341646 - DNA, 22 bp, Homo sapiens
catgaaggaattaaggtaagga

SEQ ID NO: 9341647 - DNA, 22 bp, Homo sapiens
catgaatttatattattagtga

SEQ ID NO: 9341648 - DNA, 22 bp, Homo sapiens
catgacaataagccagcagaaa

SEQ ID NO: 9341649 - DNA, 22 bp, Homo sapiens
catgaatttatattattagtga

SEQ ID NO: 9341650 - DNA, 22 bp, Homo sapiens
catgaattttaagactgttttt

SEQ ID NO: 9341651 - DNA, 22 bp, Homo sapiens
catgaattagcaatggtgtgca

SEQ ID NO: 9341652 - DNA, 22 bp, Homo sapiens
catgaattatttttcacaagat

SEQ ID NO: 9341653 - DNA, 22 bp, Homo sapiens
catgcaggttatatgtgcttct

SEQ ID NO: 9341654 - DNA, 22 bp, Homo sapiens
catgcaggtgaccaggtgtggg

SEQ ID NO: 9341655 - DNA, 22 bp, Homo sapiens
catgcaggtgaccaggtgtggg

SEQ ID NO: 9341656 - DNA, 22 bp, Homo sapiens
catgcagtgactcagacacagg

SEQ ID NO: 9341657 - DNA, 22 bp, Homo sapiens
catgcagggactagagaacagg

SEQ ID NO: 9341658 - DNA, 22 bp, Homo sapiens
catgcagggactagagaacagg

SEQ ID NO: 9341659 - DNA, 22 bp, Homo sapiens
catgcagggagcagaggagaca

SEQ ID NO: 9341660 - DNA, 22 bp, Homo sapiens
catgcagggacttgtgctccat

SEQ ID NO: 9341661 - DNA, 22 bp, Homo sapiens
catgcagggacttgtgctccat

SEQ ID NO: 9341662 - DNA, 22 bp, Homo sapiens
catgcaggtctggagcttgggg

SEQ ID NO: 9341663 - DNA, 22 bp, Homo sapiens
catgcagggagcagaggagaca

SEQ ID NO: 9341664 - DNA, 22 bp, Homo sapiens
catgcatacacaggtcaggcag

SEQ ID NO: 9341665 - DNA, 20 bp, Homo sapiens
catgcatgacactggaaagg

SEQ ID NO: 9341666 - DNA, 22 bp, Homo sapiens
catgcatattactagcacagca

SEQ ID NO: 9341667 - DNA, 22 bp, Homo sapiens
catgcatattactagcacagca

SEQ ID NO: 9341668 - DNA, 22 bp, Homo sapiens
catgcatcagaatcacctagag

SEQ ID NO: 9341669 - DNA, 22 bp, Homo sapiens
catgcatcagaatcacctagag

SEQ ID NO: 9341670 - DNA, 22 bp, Homo sapiens
catgcatagctttggagctagg

SEQ ID NO: 9341671 - DNA, 22 bp, Homo sapiens
catgcatatgtcaaaaaagcta

SEQ ID NO: 9341672 - DNA, 22 bp, Homo sapiens
catgcatatatgctacatgcaa

SEQ ID NO: 9341673 - DNA, 22 bp, Homo sapiens
catggcaggaggctgctggcag

SEQ ID NO: 9341674 - DNA, 22 bp, Homo sapiens
catggcaggaaggacatgcact

SEQ ID NO: 9341675 - DNA, 22 bp, Homo sapiens
catggcaggaggctgctggcag

SEQ ID NO: 9341676 - DNA, 22 bp, Homo sapiens
catggcaggatctgggcccaca

SEQ ID NO: 9341677 - DNA, 22 bp, Homo sapiens
catggcagggctgtgggcaggt

SEQ ID NO: 9341678 - DNA, 22 bp, Homo sapiens
catggcaggcttcttcagcctt

SEQ ID NO: 9341679 - DNA, 22 bp, Homo sapiens
catggcagggctgtgggcaggt

SEQ ID NO: 9341680 - DNA, 22 bp, Homo sapiens
catggcagggctgtgggcaggt

SEQ ID NO: 9341681 - DNA, 22 bp, Homo sapiens
catggcaggtgcagattctgtg

SEQ ID NO: 9341682 - DNA, 22 bp, Homo sapiens
catggcagtgattcagcctttg

SEQ ID NO: 9341683 - DNA, 22 bp, Homo sapiens
catggcagtgattcagcctttg

SEQ ID NO: 9341684 - DNA, 22 bp, Homo sapiens
tccaggagaaggccatccagcg

SEQ ID NO: 9341685 - DNA, 22 bp, Homo sapiens
tccaggagaaggccatccagcg

SEQ ID NO: 9341686 - DNA, 22 bp, Homo sapiens
tccaggagaaggccatccagcg

SEQ ID NO: 9341687 - DNA, 20 bp, Homo sapiens
tccagctgggaacagctgat

SEQ ID NO: 9341688 - DNA, 20 bp, Homo sapiens
tccagctgggaacagctgat

SEQ ID NO: 9341689 - DNA, 22 bp, Homo sapiens
catggccacatctagctgcaag

SEQ ID NO: 9341690 - DNA, 22 bp, Homo sapiens
catggccagcccccagttcctc

SEQ ID NO: 9341691 - DNA, 22 bp, Homo sapiens
catggccacatctagctgcaag

SEQ ID NO: 9341692 - DNA, 22 bp, Homo sapiens
catggccacatctagctgcaag

SEQ ID NO: 9341693 - DNA, 22 bp, Homo sapiens
catggccacatctagctgcaag

SEQ ID NO: 9341694 - DNA, 22 bp, Homo sapiens
catggcagctcctccagtgtga

SEQ ID NO: 9341695 - DNA, 22 bp, Homo sapiens
catggcagcctgccctgcttgc

SEQ ID NO: 9341696 - DNA, 22 bp, Homo sapiens
catggcagagcctgcaggtggg

SEQ ID NO: 9341697 - DNA, 23 bp, Homo sapiens
catggcagcaagagctcatggcc

SEQ ID NO: 9341698 - DNA, 23 bp, Homo sapiens
catggcagcaagagctcatggcc

SEQ ID NO: 9341699 - DNA, 22 bp, Homo sapiens
catggcaggaaaatgaacaggc

SEQ ID NO: 9341700 - DNA, 22 bp, Homo sapiens
catggcagctttgggaggagga

SEQ ID NO: 9341701 - DNA, 22 bp, Homo sapiens
catggcagctttgggaggagga

SEQ ID NO: 9341702 - DNA, 22 bp, Homo sapiens
catggcagctttgggaggagga

SEQ ID NO: 9341703 - DNA, 22 bp, Homo sapiens
catggaaggcaaaagacacaga

SEQ ID NO: 9341704 - DNA, 22 bp, Homo sapiens
catggcagagaaggggaactgg

SEQ ID NO: 9341705 - DNA, 22 bp, Homo sapiens
catggcagagcctgcaggtggg

SEQ ID NO: 9341706 - DNA, 22 bp, Homo sapiens
catggcagagcctgcaggtggg

SEQ ID NO: 9341707 - DNA, 22 bp, Homo sapiens
catgcatttggagttttcaagt

SEQ ID NO: 9341708 - DNA, 22 bp, Homo sapiens
catgcatttctaccaaggaata

SEQ ID NO: 9341709 - DNA, 22 bp, Homo sapiens
catgcattgtaatttttagtct

SEQ ID NO: 9341710 - DNA, 22 bp, Homo sapiens
catgcattttctattcactcag

SEQ ID NO: 9341711 - DNA, 22 bp, Homo sapiens
catggaaggcaaaagacacaga

SEQ ID NO: 9341712 - DNA, 22 bp, Homo sapiens
catgcatgtcagggatcctgga

SEQ ID NO: 9341713 - DNA, 22 bp, Homo sapiens
catgcatgtgcagaaaggggtt

SEQ ID NO: 9341714 - DNA, 22 bp, Homo sapiens
catgcatggtcatgctgggact

SEQ ID NO: 9341715 - DNA, 22 bp, Homo sapiens
catgcatgtttactacagtgac

SEQ ID NO: 9341716 - DNA, 22 bp, Homo sapiens
catgcattacaattgcatagta

SEQ ID NO: 9341717 - DNA, 22 bp, Homo sapiens
catgcattacaattgcatagta

SEQ ID NO: 9341718 - DNA, 22 bp, Homo sapiens
catgcattcagaatctctcaca

SEQ ID NO: 9341719 - DNA, 22 bp, Homo sapiens
catgcattgtaatttttagtct

SEQ ID NO: 9341720 - DNA, 22 bp, Homo sapiens
catgcattcctcctctgcctta

SEQ ID NO: 9341721 - DNA, 22 bp, Homo sapiens
tcagtgccaattctgccatggg

SEQ ID NO: 9341722 - DNA, 22 bp, Homo sapiens
tcagtgccatgggcagacaggc

SEQ ID NO: 9341723 - DNA, 22 bp, Homo sapiens
tcagtgccatgggcagacaggc

SEQ ID NO: 9341724 - DNA, 22 bp, Homo sapiens
tcagtgccaattctgccatggg

SEQ ID NO: 9341725 - DNA, 22 bp, Homo sapiens
tcagtccctaaggatatgggct

SEQ ID NO: 9341726 - DNA, 21 bp, Homo sapiens
tcagtccctgggtgtgtccca

SEQ ID NO: 9341727 - DNA, 22 bp, Homo sapiens
tcagtgcattcatgggtggctg

SEQ ID NO: 9341728 - DNA, 22 bp, Homo sapiens
tcagtcccttaaaggtggcagc

SEQ ID NO: 9341729 - DNA, 22 bp, Homo sapiens
tcagtcccaaggtcctgaggtg

SEQ ID NO: 9341730 - DNA, 22 bp, Homo sapiens
tcagtccccagatgtgtgctgt

SEQ ID NO: 9341731 - DNA, 22 bp, Homo sapiens
tcagtcccaaggtcctgaggtg

SEQ ID NO: 9341732 - DNA, 22 bp, Homo sapiens
tcagtccataggtgggcctgag

SEQ ID NO: 9341733 - DNA, 23 bp, Homo sapiens
tcagtcccaacagcttctcctgg

SEQ ID NO: 9341734 - DNA, 22 bp, Homo sapiens
tcagtccaggattgggagtgac

SEQ ID NO: 9341735 - DNA, 22 bp, Homo sapiens
tcagtccaggggctgtgatgtc

SEQ ID NO: 9341736 - DNA, 22 bp, Homo sapiens
catctcacagcaaactgctgaa

SEQ ID NO: 9341737 - DNA, 22 bp, Homo sapiens
catctcacttccctgcagcatc

SEQ ID NO: 9341738 - DNA, 22 bp, Homo sapiens
catctcacttccctgcagcatc

SEQ ID NO: 9341739 - DNA, 22 bp, Homo sapiens
tcagtgctgagtagcgtgcacc

SEQ ID NO: 9341740 - DNA, 22 bp, Homo sapiens
tcagtgctctgaggtccagggt

SEQ ID NO: 9341741 - DNA, 19 bp, Homo sapiens
tcagtgctcctatgtcctt

SEQ ID NO: 9341742 - DNA, 22 bp, Homo sapiens
tcagtgctgccatggcagggcc

SEQ ID NO: 9341743 - DNA, 22 bp, Homo sapiens
tcagtgctgagtagcgtgcacc

SEQ ID NO: 9341744 - DNA, 22 bp, Homo sapiens
tcagtgctaaaagagctggtgt

SEQ ID NO: 9341745 - DNA, 22 bp, Homo sapiens
tcagtgcctactttgatcaatt

SEQ ID NO: 9341746 - DNA, 20 bp, Homo sapiens
tcagtgctcaggcaccaggt

SEQ ID NO: 9341747 - DNA, 20 bp, Homo sapiens
tcagtgctcaggcaccaggt

SEQ ID NO: 9341748 - DNA, 22 bp, Homo sapiens
tcagtgctaaaagagctggtgt

SEQ ID NO: 9341749 - DNA, 22 bp, Homo sapiens
tcagtgctcaggggagccgagg

SEQ ID NO: 9341750 - DNA, 22 bp, Homo sapiens
tcagtgctcaggggagccgagg

SEQ ID NO: 9341751 - DNA, 22 bp, Homo sapiens
tcagtgctcctaaagtgaatgc

SEQ ID NO: 9341752 - DNA, 22 bp, Homo sapiens
tcagtgctcctaaagtgaatgc

SEQ ID NO: 9341753 - DNA, 19 bp, Homo sapiens
tcagtcatatatctgcacc

SEQ ID NO: 9341754 - DNA, 22 bp, Homo sapiens
tcagtcatcccagctttcatct

SEQ ID NO: 9341755 - DNA, 22 bp, Homo sapiens
tcagtccaatgattgtaggaca

SEQ ID NO: 9341756 - DNA, 21 bp, Homo sapiens
tcagtcattgcctccttctgg

SEQ ID NO: 9341757 - DNA, 22 bp, Homo sapiens
tcagtcaggagatgccagagat

SEQ ID NO: 9341758 - DNA, 22 bp, Homo sapiens
tcagtcacttttgcctgctaca

SEQ ID NO: 9341759 - DNA, 22 bp, Homo sapiens
tcaggtgtatcatggagttgaa

SEQ ID NO: 9341760 - DNA, 22 bp, Homo sapiens
tcaggtgtatcatggagttgaa

SEQ ID NO: 9341761 - DNA, 22 bp, Homo sapiens
tcaggtgtatcatggagttgaa

SEQ ID NO: 9341762 - DNA, 22 bp, Homo sapiens
tcagggattgcaaaattcatcc

SEQ ID NO: 9341763 - DNA, 22 bp, Homo sapiens
tcagtcaccaatgggaggagga

SEQ ID NO: 9341764 - DNA, 22 bp, Homo sapiens
tcagtcaccttgactatagctg

SEQ ID NO: 9341765 - DNA, 22 bp, Homo sapiens
tcagtcacactcactgaggtag

SEQ ID NO: 9341766 - DNA, 22 bp, Homo sapiens
tcagtcacactcactgaggtag

SEQ ID NO: 9341767 - DNA, 19 bp, Homo sapiens
tcagggagtttacagcatg

SEQ ID NO: 9341768 - DNA, 22 bp, Homo sapiens
tcagggagtgttggcaggatca

SEQ ID NO: 9341769 - DNA, 22 bp, Homo sapiens
tcagggaggtgtctgccagaga

SEQ ID NO: 9341770 - DNA, 22 bp, Homo sapiens
tcagggaggtgtctgccagaga

SEQ ID NO: 9341771 - DNA, 22 bp, Homo sapiens
tcagggagatttggggactcaa

SEQ ID NO: 9341772 - DNA, 22 bp, Homo sapiens
tcagggagcctggacttcaagg

SEQ ID NO: 9341773 - DNA, 22 bp, Homo sapiens
catgaacaatttgctcactgat

SEQ ID NO: 9341774 - DNA, 22 bp, Homo sapiens
catgaacaccaggcatgaacaa

SEQ ID NO: 9341775 - DNA, 22 bp, Homo sapiens
catgaagcatgttttgtcatga

SEQ ID NO: 9341776 - DNA, 22 bp, Homo sapiens
catctgcctaagtggccctgtt

SEQ ID NO: 9341777 - DNA, 17 bp, Homo sapiens
catctgctctgcccctt

SEQ ID NO: 9341778 - DNA, 17 bp, Homo sapiens
catctgctctgcccctt

SEQ ID NO: 9341779 - DNA, 22 bp, Homo sapiens
catctgctctgtctgccatgtt

SEQ ID NO: 9341780 - DNA, 22 bp, Homo sapiens
catctgctgacttgacaagtac

SEQ ID NO: 9341781 - DNA, 22 bp, Homo sapiens
catctgctgttccttggactca

SEQ ID NO: 9341782 - DNA, 22 bp, Homo sapiens
catctgaatttgccttagtttc

SEQ ID NO: 9341783 - DNA, 22 bp, Homo sapiens
catctgaagtgaattgcttttt

SEQ ID NO: 9341784 - DNA, 22 bp, Homo sapiens
catctgaaatctgcctacaagc

SEQ ID NO: 9341785 - DNA, 20 bp, Homo sapiens
catctgagcccacagaagtc

SEQ ID NO: 9341786 - DNA, 22 bp, Homo sapiens
catctgccactctctcccacca

SEQ ID NO: 9341787 - DNA, 22 bp, Homo sapiens
catctgcaggggaagccagttt

SEQ ID NO: 9341788 - DNA, 19 bp, Homo sapiens
catctggatgattctcctg

SEQ ID NO: 9341789 - DNA, 22 bp, Homo sapiens
catctgctgttccttggactca

SEQ ID NO: 9341790 - DNA, 22 bp, Homo sapiens
catctggacaaaactctgaagg

SEQ ID NO: 9341791 - DNA, 22 bp, Homo sapiens
catctggacaaaactctgaagg

SEQ ID NO: 9341792 - DNA, 22 bp, Homo sapiens
catctgggttctcagatggata

SEQ ID NO: 9341793 - DNA, 22 bp, Homo sapiens
catctggggctgtctgctaatc

SEQ ID NO: 9341794 - DNA, 22 bp, Homo sapiens
catctgggttctcagatggata

SEQ ID NO: 9341795 - DNA, 22 bp, Homo sapiens
catctgtaaagtaggaatattg

SEQ ID NO: 9341796 - DNA, 22 bp, Homo sapiens
catctggtttaaaagaagaaag

SEQ ID NO: 9341797 - DNA, 22 bp, Homo sapiens
catctggttagttgatgaaact

SEQ ID NO: 9341798 - DNA, 22 bp, Homo sapiens
catctggttagttgatgaaact

SEQ ID NO: 9341799 - DNA, 22 bp, Homo sapiens
catctggtttaaaagaagaaag

SEQ ID NO: 9341800 - DNA, 22 bp, Homo sapiens
catctgtcaggcagaacccaga

SEQ ID NO: 9341801 - DNA, 22 bp, Homo sapiens
tcctaattgcttcatgtgttgt

SEQ ID NO: 9341802 - DNA, 22 bp, Homo sapiens
tcctacaatgcacagaatagcc

SEQ ID NO: 9341803 - DNA, 22 bp, Homo sapiens
tcctagaactccaggacagtcc

SEQ ID NO: 9341804 - DNA, 22 bp, Homo sapiens
tcctacagatactaaggagatc

SEQ ID NO: 9341805 - DNA, 22 bp, Homo sapiens
ccaaggagctgcaggcacttgt

SEQ ID NO: 9341806 - DNA, 22 bp, Homo sapiens
ccaaggagcaagtttacacctg

SEQ ID NO: 9341807 - DNA, 22 bp, Homo sapiens
ccaaggagaatgacaccatgga

SEQ ID NO: 9341808 - DNA, 22 bp, Homo sapiens
ccaaggagaatgacaccatgga

SEQ ID NO: 9341809 - DNA, 22 bp, Homo sapiens
tcctagaactccaggacagtcc

SEQ ID NO: 9341810 - DNA, 22 bp, Homo sapiens
ccaaggagctgcaggcacttgt

SEQ ID NO: 9341811 - DNA, 22 bp, Homo sapiens
ccaaggcaacgttggtgtcagg

SEQ ID NO: 9341812 - DNA, 22 bp, Homo sapiens
ccaaggccacaaacagcctggc

SEQ ID NO: 9341813 - DNA, 22 bp, Homo sapiens
ccaaggccacaaacagcctggc

SEQ ID NO: 9341814 - DNA, 22 bp, Homo sapiens
ccaaggccatcaggtaggtcct

SEQ ID NO: 9341815 - DNA, 22 bp, Homo sapiens
ccaaggcacactctgcaaggtt

SEQ ID NO: 9341816 - DNA, 22 bp, Homo sapiens
ccaaggcaatgtgcagctggtg

SEQ ID NO: 9341817 - DNA, 22 bp, Homo sapiens
ccaaggcacactctgcaaggtt

SEQ ID NO: 9341818 - DNA, 22 bp, Homo sapiens
ccaaggcccctgtggtctagcc

SEQ ID NO: 9341819 - DNA, 18 bp, Homo sapiens
ccaaggcccctgctgggg

SEQ ID NO: 9341820 - DNA, 22 bp, Homo sapiens
ccaaggcccctgtggtctagcc

SEQ ID NO: 9341821 - DNA, 18 bp, Homo sapiens
ccaaggcccctgctgggg

SEQ ID NO: 9341822 - DNA, 18 bp, Homo sapiens
ccaaggcccctgctgggg

SEQ ID NO: 9341823 - DNA, 18 bp, Homo sapiens
ccaaggcccctgctgggg

SEQ ID NO: 9341824 - DNA, 22 bp, Homo sapiens
ccaaggctcctcagctggtctt

SEQ ID NO: 9341825 - DNA, 22 bp, Homo sapiens
ccaaggctgtggggctgtgcag

SEQ ID NO: 9341826 - DNA, 22 bp, Homo sapiens
ccaaggctggagtgcagtggcg

SEQ ID NO: 9341827 - DNA, 22 bp, Homo sapiens
ccaaggctgtcattcagtagct

SEQ ID NO: 9341828 - DNA, 22 bp, Homo sapiens
ccaaggctgtcattcagtagct

SEQ ID NO: 9341829 - DNA, 22 bp, Homo sapiens
ccaaggctggagtgcagtggcg

SEQ ID NO: 9341830 - DNA, 22 bp, Homo sapiens
ccaaggctggagtgcagtggcg

SEQ ID NO: 9341831 - DNA, 22 bp, Homo sapiens
ccaaggctggagggcttatgta

SEQ ID NO: 9341832 - DNA, 22 bp, Homo sapiens
tcctggaggacagaggcatctc

SEQ ID NO: 9341833 - DNA, 22 bp, Homo sapiens
tcctggaggacagaggcatctc

SEQ ID NO: 9341834 - DNA, 22 bp, Homo sapiens
ccaagggaaaccgagaggctgg

SEQ ID NO: 9341835 - DNA, 22 bp, Homo sapiens
ccaaggcttcctgacctacatg

SEQ ID NO: 9341836 - DNA, 22 bp, Homo sapiens
ccaagggaaaccgagaggctgg

SEQ ID NO: 9341837 - DNA, 22 bp, Homo sapiens
ccaaggcttcccagagatgctc

SEQ ID NO: 9341838 - DNA, 22 bp, Homo sapiens
ccaaggcttcccagagatgctc

SEQ ID NO: 9341839 - DNA, 22 bp, Homo sapiens
ccaaggcttcccagagatgctc

SEQ ID NO: 9341840 - DNA, 22 bp, Homo sapiens
tcctggcagagagcatgaggcc

SEQ ID NO: 9341841 - DNA, 22 bp, Homo sapiens
tcctggcagaaatggggctgtg

SEQ ID NO: 9341842 - DNA, 22 bp, Homo sapiens
tcctggcagaaatggggctgtg

SEQ ID NO: 9341843 - DNA, 22 bp, Homo sapiens
tcctggcagagggcggcctcga

SEQ ID NO: 9341844 - DNA, 22 bp, Homo sapiens
tcctggcagcccgcaggtgctg

SEQ ID NO: 9341845 - DNA, 22 bp, Homo sapiens
tcctggcagagggcggcctcga

SEQ ID NO: 9341846 - DNA, 22 bp, Homo sapiens
tcctggcagagagcatgaggcc

SEQ ID NO: 9341847 - DNA, 22 bp, Homo sapiens
tcctggcacccttgggttggag

SEQ ID NO: 9341848 - DNA, 22 bp, Homo sapiens
tcctggcactttgggggctcgc

SEQ ID NO: 9341849 - DNA, 22 bp, Homo sapiens
tcctggcactttgggggctcgc

SEQ ID NO: 9341850 - DNA, 22 bp, Homo sapiens
tcctggaggacagaggcatctc

SEQ ID NO: 9341851 - DNA, 22 bp, Homo sapiens
tcctggaggacagaggcatctc

SEQ ID NO: 9341852 - DNA, 18 bp, Homo sapiens
tcctggcagtcagagagg

SEQ ID NO: 9341853 - DNA, 22 bp, Homo sapiens
ccacaccatcgtttttacctta

SEQ ID NO: 9341854 - DNA, 17 bp, Homo sapiens
ccacaccctttccttcc

SEQ ID NO: 9341855 - DNA, 22 bp, Homo sapiens
ccacactgaccagctgtgagac

SEQ ID NO: 9341856 - DNA, 22 bp, Homo sapiens
ccacactttgagatgactagga

SEQ ID NO: 9341857 - DNA, 22 bp, Homo sapiens
ccacactttgagatgactagga

SEQ ID NO: 9341858 - DNA, 22 bp, Homo sapiens
ccacactgtctaacaaggcata

SEQ ID NO: 9341859 - DNA, 22 bp, Homo sapiens
ccacactgcctgttatctccca

SEQ ID NO: 9341860 - DNA, 22 bp, Homo sapiens
tcctggcagggtggcagcgggt

SEQ ID NO: 9341861 - DNA, 22 bp, Homo sapiens
tcctggcagggtctaggtctag

SEQ ID NO: 9341862 - DNA, 22 bp, Homo sapiens
tcctggcagggtctaggtctag

SEQ ID NO: 9341863 - DNA, 22 bp, Homo sapiens
tcctggcagggaacttgtcagc

SEQ ID NO: 9341864 - DNA, 22 bp, Homo sapiens
tcctggcagggaacttgtcagc

SEQ ID NO: 9341865 - DNA, 22 bp, Homo sapiens
tcctggcagcccgcaggtgctg

SEQ ID NO: 9341866 - DNA, 22 bp, Homo sapiens
tcctggcagcccgcaggtgctg

SEQ ID NO: 9341867 - DNA, 22 bp, Homo sapiens
tcctggcagcccgcaggtgctg

SEQ ID NO: 9341868 - DNA, 21 bp, Homo sapiens
tcctggcaggcccaggaccct

SEQ ID NO: 9341869 - DNA, 21 bp, Homo sapiens
tcctggcaggcccaggaccct

SEQ ID NO: 9341870 - DNA, 21 bp, Homo sapiens
tcctggcaggcccaggaccct

SEQ ID NO: 9341871 - DNA, 22 bp, Homo sapiens
tcctggcagcccgcaggtgctg

SEQ ID NO: 9341872 - DNA, 22 bp, Homo sapiens
tcctggcaggtcagcaggagca

SEQ ID NO: 9341873 - DNA, 22 bp, Homo sapiens
tcctggcagggtggcagcgggt

SEQ ID NO: 9341874 - DNA, 22 bp, Homo sapiens
tcctggcagggtggcagcgggt

SEQ ID NO: 9341875 - DNA, 22 bp, Homo sapiens
tcctggcagggtggcagcgggt

SEQ ID NO: 9341876 - DNA, 22 bp, Homo sapiens
tcctggcaggtcagcaggagca

SEQ ID NO: 9341877 - DNA, 22 bp, Homo sapiens
tcctggcaggtcagcaggagca

SEQ ID NO: 9341878 - DNA, 22 bp, Homo sapiens
tcctggcaggtgtattggctgt

SEQ ID NO: 9341879 - DNA, 22 bp, Homo sapiens
tcctggcaggtctgagaggtct

SEQ ID NO: 9341880 - DNA, 22 bp, Homo sapiens
tcctggcaggtctgagaggtct

SEQ ID NO: 9341881 - DNA, 22 bp, Homo sapiens
tcctggcaggtctgagaggtct

SEQ ID NO: 9341882 - DNA, 22 bp, Homo sapiens
tcctggcagtaatttgatgttg

SEQ ID NO: 9341883 - DNA, 22 bp, Homo sapiens
tcctggcagtaatttgatgttg

SEQ ID NO: 9341884 - DNA, 22 bp, Homo sapiens
tcctggcagtcaaataaccttg

SEQ ID NO: 9341885 - DNA, 22 bp, Homo sapiens
tcctggcagtcaaataaccttg

SEQ ID NO: 9341886 - DNA, 18 bp, Homo sapiens
tcctggcagtcagagagg

SEQ ID NO: 9341887 - DNA, 18 bp, Homo sapiens
tcctggcagtcagagagg

SEQ ID NO: 9341888 - DNA, 22 bp, Homo sapiens
tcctgggagcccttgctccacc

SEQ ID NO: 9341889 - DNA, 22 bp, Homo sapiens
tcctgggagcccttgctccacc

SEQ ID NO: 9341890 - DNA, 22 bp, Homo sapiens
tcctgggagcccttgctccacc

SEQ ID NO: 9341891 - DNA, 22 bp, Homo sapiens
tcctgggcttaagtgatcctcc

SEQ ID NO: 9341892 - DNA, 22 bp, Homo sapiens
tcctgggcttaagtgatcctcc

SEQ ID NO: 9341893 - DNA, 22 bp, Homo sapiens
tcctgggcttaagtgatcctcc

SEQ ID NO: 9341894 - DNA, 22 bp, Homo sapiens
tcctgggcttagtggctaggtc

SEQ ID NO: 9341895 - DNA, 22 bp, Homo sapiens
tcctgggcttagtggctaggtc

SEQ ID NO: 9341896 - DNA, 22 bp, Homo sapiens
tcctgggagcacatggtcctgc

SEQ ID NO: 9341897 - DNA, 22 bp, Homo sapiens
tcctgggagcacatggtcctgc

SEQ ID NO: 9341898 - DNA, 22 bp, Homo sapiens
tcctgggagcatggtgccgtga

SEQ ID NO: 9341899 - DNA, 22 bp, Homo sapiens
tcctgggagcatggtgccgtga

SEQ ID NO: 9341900 - DNA, 22 bp, Homo sapiens
tcctgggagagtgggactgtat

SEQ ID NO: 9341901 - DNA, 22 bp, Homo sapiens
tcctgggagacccagctgtgga

SEQ ID NO: 9341902 - DNA, 22 bp, Homo sapiens
tcctgggagagtgggactgtat

SEQ ID NO: 9341903 - DNA, 22 bp, Homo sapiens
tcctgggagagtgggactgtat

SEQ ID NO: 9341904 - DNA, 22 bp, Homo sapiens
tcctgggactttcaaggctagg

SEQ ID NO: 9341905 - DNA, 22 bp, Homo sapiens
tcctgggagacccagctgtgga

SEQ ID NO: 9341906 - DNA, 22 bp, Homo sapiens
tcctgggactctgcctcaggct

SEQ ID NO: 9341907 - DNA, 22 bp, Homo sapiens
tcctgggactctttatcagaga

SEQ ID NO: 9341908 - DNA, 22 bp, Homo sapiens
tcctggctccagcagctcttcc

SEQ ID NO: 9341909 - DNA, 22 bp, Homo sapiens
ccactgcctgacttagatgaca

SEQ ID NO: 9341910 - DNA, 22 bp, Homo sapiens
ccactgtaagtttgaaaataac

SEQ ID NO: 9341911 - DNA, 22 bp, Homo sapiens
ccactgtcttttccaggctgaa

SEQ ID NO: 9341912 - DNA, 22 bp, Homo sapiens
ccactgtctgcaggcctcagca

SEQ ID NO: 9341913 - DNA, 22 bp, Homo sapiens
tctaagaggcatcaagacaagc

SEQ ID NO: 9341914 - DNA, 22 bp, Homo sapiens
ccacttgaaacttagtggcata

SEQ ID NO: 9341915 - DNA, 22 bp, Homo sapiens
ccacttcatcccagctcagata

SEQ ID NO: 9341916 - DNA, 22 bp, Homo sapiens
ccactgtgcccagcctcatggg

SEQ ID NO: 9341917 - DNA, 22 bp, Homo sapiens
ccactgtggaaagcagttcaga

SEQ ID NO: 9341918 - DNA, 22 bp, Homo sapiens
ccactgtgtccaccaggaatgc

SEQ ID NO: 9341919 - DNA, 22 bp, Homo sapiens
tctaaggagccaggactattag

SEQ ID NO: 9341920 - DNA, 22 bp, Homo sapiens
tctaagtttggtgattaccaat

SEQ ID NO: 9341921 - DNA, 22 bp, Homo sapiens
tctaaggacaaggtcttggaga

SEQ ID NO: 9341922 - DNA, 22 bp, Homo sapiens
tctaaggacagttattactggg

SEQ ID NO: 9341923 - DNA, 22 bp, Homo sapiens
tctaaggacattggctttggag

SEQ ID NO: 9341924 - DNA, 22 bp, Homo sapiens
tctaataaataaatgctctagg

SEQ ID NO: 9341925 - DNA, 22 bp, Homo sapiens
tctaataaataaatgctctagg

SEQ ID NO: 9341926 - DNA, 22 bp, Homo sapiens
tctaataaataaatgctctagg

SEQ ID NO: 9341927 - DNA, 22 bp, Homo sapiens
tctaatccttgctacctgggtg

SEQ ID NO: 9341928 - DNA, 22 bp, Homo sapiens
ccagacagttccttgaggttca

SEQ ID NO: 9341929 - DNA, 22 bp, Homo sapiens
ccagagaaccttgagctgtgag

SEQ ID NO: 9341930 - DNA, 22 bp, Homo sapiens
ccagagaattttagacaaaaat

SEQ ID NO: 9341931 - DNA, 19 bp, Homo sapiens
ccagagacattggcatctt

SEQ ID NO: 9341932 - DNA, 22 bp, Homo sapiens
tccttcctgcaggccaagtcct

SEQ ID NO: 9341933 - DNA, 22 bp, Homo sapiens
tccttcctgcaggccaagtcct

SEQ ID NO: 9341934 - DNA, 23 bp, Homo sapiens
tccttgggcctgcccagagtggt

SEQ ID NO: 9341935 - DNA, 22 bp, Homo sapiens
tccttcctgctctaacattcag

SEQ ID NO: 9341936 - DNA, 22 bp, Homo sapiens
tccttcctgctctaacattcag

SEQ ID NO: 9341937 - DNA, 22 bp, Homo sapiens
tccttggggtaactccagcctg

SEQ ID NO: 9341938 - DNA, 22 bp, Homo sapiens
tccttggggtaactccagcctg

SEQ ID NO: 9341939 - DNA, 22 bp, Homo sapiens
tccttggggtaactccagcctg

SEQ ID NO: 9341940 - DNA, 22 bp, Homo sapiens
tccttgggtcagtgagtgaggt

SEQ ID NO: 9341941 - DNA, 22 bp, Homo sapiens
tccttggggacgctgacatcgt

SEQ ID NO: 9341942 - DNA, 23 bp, Homo sapiens
tccttgggcctgcccagagtggt

SEQ ID NO: 9341943 - DNA, 19 bp, Homo sapiens
tccttccccccagcacaga

SEQ ID NO: 9341944 - DNA, 19 bp, Homo sapiens
tccttccccccagcacaga

SEQ ID NO: 9341945 - DNA, 22 bp, Homo sapiens
tccttcctgcaggccaagtcct

SEQ ID NO: 9341946 - DNA, 22 bp, Homo sapiens
tccttcctcggggacccagatc

SEQ ID NO: 9341947 - DNA, 22 bp, Homo sapiens
tccttcctcggggacccagatc

SEQ ID NO: 9341948 - DNA, 22 bp, Homo sapiens
tccttcctccatggtcttggtt

SEQ ID NO: 9341949 - DNA, 22 bp, Homo sapiens
ccactgctaacttgctgcagct

SEQ ID NO: 9341950 - DNA, 23 bp, Homo sapiens
tcctttaagatatcttattcctt

SEQ ID NO: 9341951 - DNA, 23 bp, Homo sapiens
tcctttaatgctggaatggctag

SEQ ID NO: 9341952 - DNA, 20 bp, Homo sapiens
tcctttactgttggggttgg

SEQ ID NO: 9341953 - DNA, 22 bp, Homo sapiens
tcctttaaactcctttcaagtc

SEQ ID NO: 9341954 - DNA, 22 bp, Homo sapiens
tcctttaaagaactgtgctttt

SEQ ID NO: 9341955 - DNA, 22 bp, Homo sapiens
tcctttaactagttaccatgtt

SEQ ID NO: 9341956 - DNA, 22 bp, Homo sapiens
tcctttaacttgattattttca

SEQ ID NO: 9341957 - DNA, 22 bp, Homo sapiens
tccttgtaaaggagctctaaca

SEQ ID NO: 9341958 - DNA, 22 bp, Homo sapiens
tcctttaaacaaccagctctca

SEQ ID NO: 9341959 - DNA, 22 bp, Homo sapiens
tccttgggtcagtgagtgaggt

SEQ ID NO: 9341960 - DNA, 22 bp, Homo sapiens
tcctgggctttgtttctctcct

SEQ ID NO: 9341961 - DNA, 22 bp, Homo sapiens
tcctgggctttgtttctctcct

SEQ ID NO: 9341962 - DNA, 19 bp, Homo sapiens
tcctggggaggggcatggc

SEQ ID NO: 9341963 - DNA, 19 bp, Homo sapiens
tcctggggaggggcatggc

SEQ ID NO: 9341964 - DNA, 22 bp, Homo sapiens
tcctgggcttcacagactctgt

SEQ ID NO: 9341965 - DNA, 22 bp, Homo sapiens
tcctgggcttgctcctccagct

SEQ ID NO: 9341966 - DNA, 22 bp, Homo sapiens
tcctgggcttgctcctccagct

SEQ ID NO: 9341967 - DNA, 22 bp, Homo sapiens
tcctgggcttgctcctccagct

SEQ ID NO: 9341968 - DNA, 22 bp, Homo sapiens
tccttcagtgtcccgctcaggt

SEQ ID NO: 9341969 - DNA, 17 bp, Homo sapiens
tccttcagtgcctctgc

SEQ ID NO: 9341970 - DNA, 22 bp, Homo sapiens
tccttaaagttggggtgctgca

SEQ ID NO: 9341971 - DNA, 21 bp, Homo sapiens
tccttcagttctgcactttct

SEQ ID NO: 9341972 - DNA, 22 bp, Homo sapiens
tccttccaggtccagggatgtg

SEQ ID NO: 9341973 - DNA, 22 bp, Homo sapiens
tccttccatggtggggctgctt

SEQ ID NO: 9341974 - DNA, 22 bp, Homo sapiens
cattgttgttaaacatagtaat

SEQ ID NO: 9341975 - DNA, 22 bp, Homo sapiens
cattgttgtgagatcaagcagt

SEQ ID NO: 9341976 - DNA, 22 bp, Homo sapiens
cattgttggtcattgtcggttg

SEQ ID NO: 9341977 - DNA, 22 bp, Homo sapiens
catttaaaggttgtgggtaaaa

SEQ ID NO: 9341978 - DNA, 22 bp, Homo sapiens
catttaaaggttgtgggtaaaa

SEQ ID NO: 9341979 - DNA, 22 bp, Homo sapiens
catttaaaggttgtgggtaaaa

SEQ ID NO: 9341980 - DNA, 22 bp, Homo sapiens
cattgttaccatcttttaccta

SEQ ID NO: 9341981 - DNA, 22 bp, Homo sapiens
cattgttaattggtatcttaca

SEQ ID NO: 9341982 - DNA, 22 bp, Homo sapiens
cattgtgcagggataatgcagc

SEQ ID NO: 9341983 - DNA, 22 bp, Homo sapiens
cattgttatagcattacacacc

SEQ ID NO: 9341984 - DNA, 22 bp, Homo sapiens
cattgttatagcattacacacc

SEQ ID NO: 9341985 - DNA, 22 bp, Homo sapiens
cattgttgaacacctgctggat

SEQ ID NO: 9341986 - DNA, 22 bp, Homo sapiens
cattgttgctgcttcaagatat

SEQ ID NO: 9341987 - DNA, 22 bp, Homo sapiens
cattgttggtaatgctcagagg

SEQ ID NO: 9341988 - DNA, 22 bp, Homo sapiens
cattgttggcagagggacagag

SEQ ID NO: 9341989 - DNA, 22 bp, Homo sapiens
cattgtctggtaggaagtgggc

SEQ ID NO: 9341990 - DNA, 22 bp, Homo sapiens
cattgtattgaggatacttaag

SEQ ID NO: 9341991 - DNA, 22 bp, Homo sapiens
cattgtattgaggatacttaag

SEQ ID NO: 9341992 - DNA, 18 bp, Homo sapiens
cattgtacaatgctttat

SEQ ID NO: 9341993 - DNA, 22 bp, Homo sapiens
tcccactcactgtctctgacac

SEQ ID NO: 9341994 - DNA, 22 bp, Homo sapiens
cattgcacgggcgtctgtctgt

SEQ ID NO: 9341995 - DNA, 22 bp, Homo sapiens
tcccactcccaggcaggcctct

SEQ ID NO: 9341996 - DNA, 22 bp, Homo sapiens
tccctcctggccgtcaccgctg

SEQ ID NO: 9341997 - DNA, 22 bp, Homo sapiens
tccctcctggccgtcaccgctg

SEQ ID NO: 9341998 - DNA, 18 bp, Homo sapiens
tccctcctgcctgcttcc

SEQ ID NO: 9341999 - DNA, 18 bp, Homo sapiens
tccctcctgcctgcttcc

SEQ ID NO: 9342000 - DNA, 18 bp, Homo sapiens
tccctcctgcctgcttcc

SEQ ID NO: 9342001 - DNA, 22 bp, Homo sapiens
tccctcctggtgagcaggggct

SEQ ID NO: 9342002 - DNA, 22 bp, Homo sapiens
tccctcctggtgatgatgcaaa

SEQ ID NO: 9342003 - DNA, 22 bp, Homo sapiens
tccctccttaataagaggtctg

SEQ ID NO: 9342004 - DNA, 22 bp, Homo sapiens
tccctcagaaattctctctgaa

SEQ ID NO: 9342005 - DNA, 22 bp, Homo sapiens
tccctcctgcatgaggctcggc

SEQ ID NO: 9342006 - DNA, 22 bp, Homo sapiens
tccctcctgcatgaggctcggc

SEQ ID NO: 9342007 - DNA, 22 bp, Homo sapiens
tccctcagaaattctctctgaa

SEQ ID NO: 9342008 - DNA, 22 bp, Homo sapiens
tccctcagaaattctctctgaa

SEQ ID NO: 9342009 - DNA, 22 bp, Homo sapiens
catttacacttctaaccacaag

SEQ ID NO: 9342010 - DNA, 22 bp, Homo sapiens
catttaatagatgctgtttcag

SEQ ID NO: 9342011 - DNA, 22 bp, Homo sapiens
catttaatagatgctgtttcag

SEQ ID NO: 9342012 - DNA, 22 bp, Homo sapiens
catttaatgcacggatgtagcc

SEQ ID NO: 9342013 - DNA, 22 bp, Homo sapiens
catttacacacagaggtgtgct

SEQ ID NO: 9342014 - DNA, 22 bp, Homo sapiens
catttacacacagaggtgtgct

SEQ ID NO: 9342015 - DNA, 22 bp, Homo sapiens
catttacaatgtacaggttgtg

SEQ ID NO: 9342016 - DNA, 22 bp, Homo sapiens
catttacaatgtacaggttgtg

SEQ ID NO: 9342017 - DNA, 23 bp, Homo sapiens
tcctaactcaattcaggggtgtc

SEQ ID NO: 9342018 - DNA, 22 bp, Homo sapiens
tcctaactaatttgtagcaaaa

SEQ ID NO: 9342019 - DNA, 20 bp, Homo sapiens
tcctaactataaagtggctc

SEQ ID NO: 9342020 - DNA, 22 bp, Homo sapiens
tccctgggttcccgtggaagtg

SEQ ID NO: 9342021 - DNA, 23 bp, Homo sapiens
tcctaactgattctgcagtctct

SEQ ID NO: 9342022 - DNA, 23 bp, Homo sapiens
tcctaactgattctgcagtctct

SEQ ID NO: 9342023 - DNA, 22 bp, Homo sapiens
tcctaactccactagccttggg

SEQ ID NO: 9342024 - DNA, 16 bp, Homo sapiens
tcctaactggcagttc

SEQ ID NO: 9342025 - DNA, 18 bp, Homo sapiens
tcctaacttagatactcc

SEQ ID NO: 9342026 - DNA, 22 bp, Homo sapiens
tcctaactgccctgggcaaggt

SEQ ID NO: 9342027 - DNA, 22 bp, Homo sapiens
tccctgggtcattctctggcac

SEQ ID NO: 9342028 - DNA, 22 bp, Homo sapiens
tccctgggtcattctctggcac

SEQ ID NO: 9342029 - DNA, 22 bp, Homo sapiens
tccctgggtcctgcttgctctc

SEQ ID NO: 9342030 - DNA, 22 bp, Homo sapiens
tccctgggtcctgcttgctctc

SEQ ID NO: 9342031 - DNA, 22 bp, Homo sapiens
tccctgggtcctgcttgctctc

SEQ ID NO: 9342032 - DNA, 22 bp, Homo sapiens
tccctgggtcctgcttgctctc

SEQ ID NO: 9342033 - DNA, 22 bp, Homo sapiens
tccctgggttcccgtggaagtg

SEQ ID NO: 9342034 - DNA, 22 bp, Homo sapiens
tccctgggttacctttcaaggt

SEQ ID NO: 9342035 - DNA, 18 bp, Homo sapiens
tccctggggctgccaccc

SEQ ID NO: 9342036 - DNA, 18 bp, Homo sapiens
tccctggggctgccaccc

SEQ ID NO: 9342037 - DNA, 22 bp, Homo sapiens
tccctggggtaacattagaggg

SEQ ID NO: 9342038 - DNA, 22 bp, Homo sapiens
tccctgctttcttgtgagggga

SEQ ID NO: 9342039 - DNA, 22 bp, Homo sapiens
catttattgagtggccacagtg

SEQ ID NO: 9342040 - DNA, 22 bp, Homo sapiens
tccctgctttcttgtgagggga

SEQ ID NO: 9342041 - DNA, 22 bp, Homo sapiens
tccctggggtatcgctgaggca

SEQ ID NO: 9342042 - DNA, 22 bp, Homo sapiens
tccctggggtatcgctgaggca

SEQ ID NO: 9342043 - DNA, 22 bp, Homo sapiens
tccctgggtcattctctggcac

SEQ ID NO: 9342044 - DNA, 22 bp, Homo sapiens
tccctggggttcctccagccac

SEQ ID NO: 9342045 - DNA, 22 bp, Homo sapiens
tccctggggttcctccagccac

SEQ ID NO: 9342046 - DNA, 22 bp, Homo sapiens
tccctctccctattgcctggag

SEQ ID NO: 9342047 - DNA, 22 bp, Homo sapiens
tccctctccctattgcctggag

SEQ ID NO: 9342048 - DNA, 22 bp, Homo sapiens
tccctctccctattgcctggag

SEQ ID NO: 9342049 - DNA, 22 bp, Homo sapiens
tccctcctttatcaaaaagaga

SEQ ID NO: 9342050 - DNA, 22 bp, Homo sapiens
tccctcgaagagcttattcttt

SEQ ID NO: 9342051 - DNA, 22 bp, Homo sapiens
tccctctctagcctgttcagta

SEQ ID NO: 9342052 - DNA, 22 bp, Homo sapiens
catttattagttagttcgatgt

SEQ ID NO: 9342053 - DNA, 22 bp, Homo sapiens
tccctctcttgggcgtggctca

SEQ ID NO: 9342054 - DNA, 22 bp, Homo sapiens
tccctctctagcctgttcagta

SEQ ID NO: 9342055 - DNA, 22 bp, Homo sapiens
tccctctctggctggggtgcgg

SEQ ID NO: 9342056 - DNA, 22 bp, Homo sapiens
catttattcagctcagtcggtt

SEQ ID NO: 9342057 - DNA, 22 bp, Homo sapiens
catttattcagctcagtcggtt

SEQ ID NO: 9342058 - DNA, 22 bp, Homo sapiens
catttattcagctcagtcggtt

SEQ ID NO: 9342059 - DNA, 22 bp, Homo sapiens
catttattagttagttcgatgt

SEQ ID NO: 9342060 - DNA, 22 bp, Homo sapiens
catttattcatgatctgtagct

SEQ ID NO: 9342061 - DNA, 22 bp, Homo sapiens
catttattcatgatctgtagct

SEQ ID NO: 9342062 - DNA, 22 bp, Homo sapiens
catttattcatttgctagggct

SEQ ID NO: 9342063 - DNA, 22 bp, Homo sapiens
catttattcatgatctgtagct

SEQ ID NO: 9342064 - DNA, 22 bp, Homo sapiens
catttattcatgatctgtagct

SEQ ID NO: 9342065 - DNA, 22 bp, Homo sapiens
catttattgagtggccacagtg

SEQ ID NO: 9342066 - DNA, 22 bp, Homo sapiens
catttattctcagatccttgtc

SEQ ID NO: 9342067 - DNA, 22 bp, Homo sapiens
catttattctcagatccttgtc

SEQ ID NO: 9342068 - DNA, 22 bp, Homo sapiens
catttattctcagatccttgtc

SEQ ID NO: 9342069 - DNA, 22 bp, Homo sapiens
catttattctcagatccttgtc

SEQ ID NO: 9342070 - DNA, 22 bp, Homo sapiens
catttattcatttgctagggct

SEQ ID NO: 9342071 - DNA, 22 bp, Homo sapiens
catttattcatttgctagggct

SEQ ID NO: 9342072 - DNA, 22 bp, Homo sapiens
catttattctcagatccttgtc

SEQ ID NO: 9342073 - DNA, 22 bp, Homo sapiens
tccaggagatacactgcaccag

SEQ ID NO: 9342074 - DNA, 22 bp, Homo sapiens
tccaggagaggcctgaccaggt

SEQ ID NO: 9342075 - DNA, 22 bp, Homo sapiens
tccaggagaccagatgtaggcc

SEQ ID NO: 9342076 - DNA, 22 bp, Homo sapiens
tccaggagacacaaggtacata

SEQ ID NO: 9342077 - DNA, 17 bp, Homo sapiens
tccaggagaggcaatgg

SEQ ID NO: 9342078 - DNA, 22 bp, Homo sapiens
tccaggagaggcctgaccaggt

SEQ ID NO: 9342079 - DNA, 19 bp, Homo sapiens
tccaggagcaaagccagtt

SEQ ID NO: 9342080 - DNA, 22 bp, Homo sapiens
catgggaggcctgctgctggtg

SEQ ID NO: 9342081 - DNA, 21 bp, Homo sapiens
tccaggagcacgggactagga

SEQ ID NO: 9342082 - DNA, 22 bp, Homo sapiens
catgggcaccttaaaatgaggc

SEQ ID NO: 9342083 - DNA, 22 bp, Homo sapiens
catgggcaccttaaaatgaggc

SEQ ID NO: 9342084 - DNA, 23 bp, Homo sapiens
catgggagtgagaatgccagctc

SEQ ID NO: 9342085 - DNA, 22 bp, Homo sapiens
catgggaggtctgcaaggtgct

SEQ ID NO: 9342086 - DNA, 22 bp, Homo sapiens
catgggaggtctgcaaggtgct

SEQ ID NO: 9342087 - DNA, 22 bp, Homo sapiens
catgggctacagaagcatgctg

SEQ ID NO: 9342088 - DNA, 22 bp, Homo sapiens
catgggcagttggcagggctca

SEQ ID NO: 9342089 - DNA, 22 bp, Homo sapiens
catgggcagaagtggcatcatt

SEQ ID NO: 9342090 - DNA, 22 bp, Homo sapiens
catgggccagagctcctctggg

SEQ ID NO: 9342091 - DNA, 22 bp, Homo sapiens
catgggctctctgagctccagg

SEQ ID NO: 9342092 - DNA, 22 bp, Homo sapiens
tccatcaccacagaggacagag

SEQ ID NO: 9342093 - DNA, 22 bp, Homo sapiens
tccatcaccacagaggacagag

SEQ ID NO: 9342094 - DNA, 22 bp, Homo sapiens
tccattttagaagaaaatccac

SEQ ID NO: 9342095 - DNA, 22 bp, Homo sapiens
tccattttagaagaaaatccac

SEQ ID NO: 9342096 - DNA, 22 bp, Homo sapiens
tccatttttcatgactcctcaa

SEQ ID NO: 9342097 - DNA, 22 bp, Homo sapiens
tccatttttcatgactcctcaa

SEQ ID NO: 9342098 - DNA, 22 bp, Homo sapiens
tccattttgtaggtatgctaca

SEQ ID NO: 9342099 - DNA, 22 bp, Homo sapiens
tccattttgtaggtatgctaca

SEQ ID NO: 9342100 - DNA, 22 bp, Homo sapiens
tccattttctcttccggaggtg

SEQ ID NO: 9342101 - DNA, 22 bp, Homo sapiens
tccattttctaagtatcactta

SEQ ID NO: 9342102 - DNA, 22 bp, Homo sapiens
tccattttcttgctctaggtaa

SEQ ID NO: 9342103 - DNA, 22 bp, Homo sapiens
tccattttgtaggtatgctaca

SEQ ID NO: 9342104 - DNA, 22 bp, Homo sapiens
tccattttagagatgaagaaac

SEQ ID NO: 9342105 - DNA, 22 bp, Homo sapiens
tccattttagagatgaagaaac

SEQ ID NO: 9342106 - DNA, 22 bp, Homo sapiens
tccattttagagatgaagaaac

SEQ ID NO: 9342107 - DNA, 22 bp, Homo sapiens
tccattttagagatgaagaaac

SEQ ID NO: 9342108 - DNA, 22 bp, Homo sapiens
tccattttcatctcatgtataa

SEQ ID NO: 9342109 - DNA, 22 bp, Homo sapiens
tccattttcatctcatgtataa

SEQ ID NO: 9342110 - DNA, 22 bp, Homo sapiens
tccattttcatctcatgtataa

SEQ ID NO: 9342111 - DNA, 22 bp, Homo sapiens
tccattttctaagtatcactta

SEQ ID NO: 9342112 - DNA, 22 bp, Homo sapiens
cattctctacactcctgccctg

SEQ ID NO: 9342113 - DNA, 22 bp, Homo sapiens
cattctattgtagcaccctgta

SEQ ID NO: 9342114 - DNA, 22 bp, Homo sapiens
cattctatgaaaactaggcaat

SEQ ID NO: 9342115 - DNA, 22 bp, Homo sapiens
cattcatttatgaaatatctat

SEQ ID NO: 9342116 - DNA, 22 bp, Homo sapiens
cattagattggtgcaaaaataa

SEQ ID NO: 9342117 - DNA, 22 bp, Homo sapiens
cattacagaatatgtaatgatc

SEQ ID NO: 9342118 - DNA, 22 bp, Homo sapiens
cattacagtgtcagaggaactg

SEQ ID NO: 9342119 - DNA, 22 bp, Homo sapiens
cattacatctttgatgcagtat

SEQ ID NO: 9342120 - DNA, 22 bp, Homo sapiens
cattctgagctaatatgcttat

SEQ ID NO: 9342121 - DNA, 22 bp, Homo sapiens
cattctgagtcactctttagca

SEQ ID NO: 9342122 - DNA, 22 bp, Homo sapiens
cattctctctacttgttttcaa

SEQ ID NO: 9342123 - DNA, 22 bp, Homo sapiens
cattcttctcccttaccttcca

SEQ ID NO: 9342124 - DNA, 22 bp, Homo sapiens
cattcttctcccttaccttcca

SEQ ID NO: 9342125 - DNA, 22 bp, Homo sapiens
cattcttctggatagttagttg

SEQ ID NO: 9342126 - DNA, 22 bp, Homo sapiens
cattcttctggatagttagttg

SEQ ID NO: 9342127 - DNA, 17 bp, Homo sapiens
cattctgtaatctttct

SEQ ID NO: 9342128 - DNA, 22 bp, Homo sapiens
cattctgggtctggctcaggga

SEQ ID NO: 9342129 - DNA, 22 bp, Homo sapiens
tcccacccatcctgcatctctt

SEQ ID NO: 9342130 - DNA, 22 bp, Homo sapiens
tcccaccttccgtggaacccgt

SEQ ID NO: 9342131 - DNA, 22 bp, Homo sapiens
tcccaccccggtcaagggctga

SEQ ID NO: 9342132 - DNA, 22 bp, Homo sapiens
tcccaccccggtcaagggctga

SEQ ID NO: 9342133 - DNA, 22 bp, Homo sapiens
tcccaccccctccaaggaggaa

SEQ ID NO: 9342134 - DNA, 19 bp, Homo sapiens
tcttccctggctgtcagtc

SEQ ID NO: 9342135 - DNA, 19 bp, Homo sapiens
tcttccctggctgtcagtc

SEQ ID NO: 9342136 - DNA, 22 bp, Homo sapiens
tcttcctatggggctgcaggaa

SEQ ID NO: 9342137 - DNA, 22 bp, Homo sapiens
ccaggcagggagctgtttggcc

SEQ ID NO: 9342138 - DNA, 22 bp, Homo sapiens
ccaggcaggctagaatgtaaat

SEQ ID NO: 9342139 - DNA, 22 bp, Homo sapiens
ccaggcaggctagaatgtaaat

SEQ ID NO: 9342140 - DNA, 22 bp, Homo sapiens
tcttcccccgtgctccagtgca

SEQ ID NO: 9342141 - DNA, 22 bp, Homo sapiens
tcttcccccgtgctccagtgca

SEQ ID NO: 9342142 - DNA, 22 bp, Homo sapiens
tcttcccattagtaatgaagtg

SEQ ID NO: 9342143 - DNA, 22 bp, Homo sapiens
tcttcccattagtaatgaagtg

SEQ ID NO: 9342144 - DNA, 21 bp, Homo sapiens
tcttccctcaggatgtcctgc

SEQ ID NO: 9342145 - DNA, 21 bp, Homo sapiens
tcttccctcaggatgtcctgc

SEQ ID NO: 9342146 - DNA, 22 bp, Homo sapiens
tcttccctaatcaccatcttca

SEQ ID NO: 9342147 - DNA, 22 bp, Homo sapiens
ccaggccagcgctggctggagg

SEQ ID NO: 9342148 - DNA, 22 bp, Homo sapiens
ccaggccagcgctggctggagg

SEQ ID NO: 9342149 - DNA, 22 bp, Homo sapiens
ccaggccagcgctggctggagg

SEQ ID NO: 9342150 - DNA, 22 bp, Homo sapiens
ccaggccagagtgcagtggcac

SEQ ID NO: 9342151 - DNA, 22 bp, Homo sapiens
ccaggccagcctggagcatggc

SEQ ID NO: 9342152 - DNA, 22 bp, Homo sapiens
ccaggccagcaggcacacctgc

SEQ ID NO: 9342153 - DNA, 20 bp, Homo sapiens
tcttccaggtacagtctgca

SEQ ID NO: 9342154 - DNA, 20 bp, Homo sapiens
tcttccaggtacagtctgca

SEQ ID NO: 9342155 - DNA, 22 bp, Homo sapiens
tcttcccagaccttacatgtga

SEQ ID NO: 9342156 - DNA, 22 bp, Homo sapiens
tcttcccaatgcaaagtaggac

SEQ ID NO: 9342157 - DNA, 22 bp, Homo sapiens
tcttcagacccttagctgtgat

SEQ ID NO: 9342158 - DNA, 22 bp, Homo sapiens
ccaggagttggaagctgccatg

SEQ ID NO: 9342159 - DNA, 22 bp, Homo sapiens
ccaggagttggaagctgccatg

SEQ ID NO: 9342160 - DNA, 22 bp, Homo sapiens
ccaggagttggaggctgcagtg

SEQ ID NO: 9342161 - DNA, 22 bp, Homo sapiens
ccaggagttggaggctgcagtg

SEQ ID NO: 9342162 - DNA, 22 bp, Homo sapiens
ccaggagttggaggttgcagtg

SEQ ID NO: 9342163 - DNA, 22 bp, Homo sapiens
ccaggagttggaggctgcagtg

SEQ ID NO: 9342164 - DNA, 22 bp, Homo sapiens
ccaggagttggaggttgcagtg

SEQ ID NO: 9342165 - DNA, 22 bp, Homo sapiens
ccaggagtttgaggctgcagtg

SEQ ID NO: 9342166 - DNA, 22 bp, Homo sapiens
ccaggagtttgaggctgcagtg

SEQ ID NO: 9342167 - DNA, 22 bp, Homo sapiens
ccaggagtttgaggctgcagtg

SEQ ID NO: 9342168 - DNA, 22 bp, Homo sapiens
ccaggatctgatattgggctcc

SEQ ID NO: 9342169 - DNA, 22 bp, Homo sapiens
ccaggcaaatccctctggcaga

SEQ ID NO: 9342170 - DNA, 22 bp, Homo sapiens
ccaggcaaagcccatgcaagag

SEQ ID NO: 9342171 - DNA, 22 bp, Homo sapiens
ccaggatggggagcagatagaa

SEQ ID NO: 9342172 - DNA, 22 bp, Homo sapiens
tcttcacgccaagtgcccctca

SEQ ID NO: 9342173 - DNA, 22 bp, Homo sapiens
tcttcacattttagtggtttgt

SEQ ID NO: 9342174 - DNA, 22 bp, Homo sapiens
tcttcacattcacgtaacatag

SEQ ID NO: 9342175 - DNA, 22 bp, Homo sapiens
ccaggcaagagaggctctggca

SEQ ID NO: 9342176 - DNA, 22 bp, Homo sapiens
ccaggcaagagaggctctggca

SEQ ID NO: 9342177 - DNA, 22 bp, Homo sapiens
ccaggcaacggagcccactgcc

SEQ ID NO: 9342178 - DNA, 22 bp, Homo sapiens
ccaggcaagctctgctgtgccc

SEQ ID NO: 9342179 - DNA, 15 bp, Homo sapiens
ccaggcaagcaggaa

SEQ ID NO: 9342180 - DNA, 22 bp, Homo sapiens
tcttagaagtttatggcacgga

SEQ ID NO: 9342181 - DNA, 22 bp, Homo sapiens
ccaggcaaggtctcctagagag

SEQ ID NO: 9342182 - DNA, 22 bp, Homo sapiens
ccaggcaaggtctcctagagag

SEQ ID NO: 9342183 - DNA, 22 bp, Homo sapiens
tcttagaatgtcaactgatgtt

SEQ ID NO: 9342184 - DNA, 22 bp, Homo sapiens
tcttagaatgtcaactgatgtt

SEQ ID NO: 9342185 - DNA, 22 bp, Homo sapiens
ccaggaggttgaggctgcagtg

SEQ ID NO: 9342186 - DNA, 22 bp, Homo sapiens
ccaggagggaggagttcctgag

SEQ ID NO: 9342187 - DNA, 22 bp, Homo sapiens
ccaggaggttgaggctgcagtg

SEQ ID NO: 9342188 - DNA, 22 bp, Homo sapiens
ccaggagggaccgcggcatccc

SEQ ID NO: 9342189 - DNA, 17 bp, Homo sapiens
ccaggagagatgcttgt

SEQ ID NO: 9342190 - DNA, 22 bp, Homo sapiens
ccaggagacccagggaaggagc

SEQ ID NO: 9342191 - DNA, 22 bp, Homo sapiens
ccaggagactgtactgatattt

SEQ ID NO: 9342192 - DNA, 22 bp, Homo sapiens
ccaggagacaaagatgactgct

SEQ ID NO: 9342193 - DNA, 22 bp, Homo sapiens
ccaggagacccagggaaggagc

SEQ ID NO: 9342194 - DNA, 22 bp, Homo sapiens
ccaggagttggaagctgccatg

SEQ ID NO: 9342195 - DNA, 22 bp, Homo sapiens
ccaggagttggaagctgccatg

SEQ ID NO: 9342196 - DNA, 19 bp, Homo sapiens
ccaggagtggtggggtgag

SEQ ID NO: 9342197 - DNA, 22 bp, Homo sapiens
ccaggagtggctggtgaccttc

SEQ ID NO: 9342198 - DNA, 22 bp, Homo sapiens
ccaggagtggctggtgaccttc

SEQ ID NO: 9342199 - DNA, 22 bp, Homo sapiens
ccaggagtcaataaaggaagct

SEQ ID NO: 9342200 - DNA, 22 bp, Homo sapiens
ccaggagtctggatgaggtgtc

SEQ ID NO: 9342201 - DNA, 22 bp, Homo sapiens
ccaggagtctggatgaggtgtc

SEQ ID NO: 9342202 - DNA, 22 bp, Homo sapiens
ccaggagtgcagggatggtatc

SEQ ID NO: 9342203 - DNA, 22 bp, Homo sapiens
ccaggaggttgaggctgcagtg

SEQ ID NO: 9342204 - DNA, 22 bp, Homo sapiens
ccaggaggttgaggctgcagtg

SEQ ID NO: 9342205 - DNA, 22 bp, Homo sapiens
ccaggaggttgaggctgcagtg

SEQ ID NO: 9342206 - DNA, 22 bp, Homo sapiens
ccaggaggttgaggctgcagtg

SEQ ID NO: 9342207 - DNA, 22 bp, Homo sapiens
ccaggaggttgaggctgcagtg

SEQ ID NO: 9342208 - DNA, 22 bp, Homo sapiens
ccaggcctggacgggtggcctg

SEQ ID NO: 9342209 - DNA, 22 bp, Homo sapiens
ccaggcctggacgggtggcctg

SEQ ID NO: 9342210 - DNA, 22 bp, Homo sapiens
ccaggcctggccaggggatgcc

SEQ ID NO: 9342211 - DNA, 22 bp, Homo sapiens
ccaggcctggacgggtggcctg

SEQ ID NO: 9342212 - DNA, 22 bp, Homo sapiens
ccaggcctggaccatgccaggg

SEQ ID NO: 9342213 - DNA, 22 bp, Homo sapiens
ccaggcctggaccatgccaggg

SEQ ID NO: 9342214 - DNA, 22 bp, Homo sapiens
ccaggcctggacgggtggcctg

SEQ ID NO: 9342215 - DNA, 22 bp, Homo sapiens
ccaggcctggacgggtggcctg

SEQ ID NO: 9342216 - DNA, 22 bp, Homo sapiens
ccaggcctggacgggtggcctg

SEQ ID NO: 9342217 - DNA, 22 bp, Homo sapiens
ccaggctctgtctggtcagaag

SEQ ID NO: 9342218 - DNA, 22 bp, Homo sapiens
ccaggctctgtctggtcagaag

SEQ ID NO: 9342219 - DNA, 22 bp, Homo sapiens
ccaggctctgtgtgggctagag

SEQ ID NO: 9342220 - DNA, 22 bp, Homo sapiens
ccaggcctggccaggggatgcc

SEQ ID NO: 9342221 - DNA, 21 bp, Homo sapiens
ccaggctcctgaggctggtca

SEQ ID NO: 9342222 - DNA, 22 bp, Homo sapiens
ccaggctctgtgtgggctagag

SEQ ID NO: 9342223 - DNA, 22 bp, Homo sapiens
ccaggctctgtgtgggctagag

SEQ ID NO: 9342224 - DNA, 22 bp, Homo sapiens
ccaggctctgttccccgaggag

SEQ ID NO: 9342225 - DNA, 22 bp, Homo sapiens
ccaggctctgttccccgaggag

SEQ ID NO: 9342226 - DNA, 22 bp, Homo sapiens
ccaggctctgttccccgaggag

SEQ ID NO: 9342227 - DNA, 22 bp, Homo sapiens
ccaggctctgttccccgaggag

SEQ ID NO: 9342228 - DNA, 23 bp, Homo sapiens
ccaggctctttcacctgctattc

SEQ ID NO: 9342229 - DNA, 22 bp, Homo sapiens
ccaggctgaatatgttccaggg

SEQ ID NO: 9342230 - DNA, 23 bp, Homo sapiens
ccaggctctttcacctgctattc

SEQ ID NO: 9342231 - DNA, 23 bp, Homo sapiens
ccaggctctttcacctgctattc

SEQ ID NO: 9342232 - DNA, 23 bp, Homo sapiens
ccaggctctttcacctgctattc

SEQ ID NO: 9342233 - DNA, 22 bp, Homo sapiens
ccaggctgaatatgttccaggg

SEQ ID NO: 9342234 - DNA, 19 bp, Homo sapiens
tctttggcttctggatcag

SEQ ID NO: 9342235 - DNA, 22 bp, Homo sapiens
tctttggcatttaggagcagga

SEQ ID NO: 9342236 - DNA, 23 bp, Homo sapiens
tctttggtaaataaagtggggat

SEQ ID NO: 9342237 - DNA, 22 bp, Homo sapiens
tctttggtattcacttgtgaag

SEQ ID NO: 9342238 - DNA, 22 bp, Homo sapiens
ccaggctggagtgcaatggcgt

SEQ ID NO: 9342239 - DNA, 22 bp, Homo sapiens
ccaggctggagtgcaatggcgt

SEQ ID NO: 9342240 - DNA, 22 bp, Homo sapiens
ccaggctggagtgcaatggcgt

SEQ ID NO: 9342241 - DNA, 22 bp, Homo sapiens
ccaggctggagtgcaatggtgc

SEQ ID NO: 9342242 - DNA, 22 bp, Homo sapiens
ccaggctggagtgcaatggcat

SEQ ID NO: 9342243 - DNA, 22 bp, Homo sapiens
ccaggctggagtgcaatggcat

SEQ ID NO: 9342244 - DNA, 22 bp, Homo sapiens
tctttggtgatatctctttggt

SEQ ID NO: 9342245 - DNA, 22 bp, Homo sapiens
ccaggctgctgttggtgtccgc

SEQ ID NO: 9342246 - DNA, 22 bp, Homo sapiens
tctttcttcctggagcccaaca

SEQ ID NO: 9342247 - DNA, 22 bp, Homo sapiens
tctttcttcagccctgtaagat

SEQ ID NO: 9342248 - DNA, 22 bp, Homo sapiens
tctttcttcagccctgtaagat

SEQ ID NO: 9342249 - DNA, 22 bp, Homo sapiens
tctttcttattatgctcaatgt

SEQ ID NO: 9342250 - DNA, 22 bp, Homo sapiens
tctttcttggtattctgagcta

SEQ ID NO: 9342251 - DNA, 22 bp, Homo sapiens
tctttcttggtattctgagcta

SEQ ID NO: 9342252 - DNA, 22 bp, Homo sapiens
tctttcttggtattctgagcta

SEQ ID NO: 9342253 - DNA, 22 bp, Homo sapiens
tctttcttgtgggtgccctttt

SEQ ID NO: 9342254 - DNA, 22 bp, Homo sapiens
tctttcttgtgggtgccctttt

SEQ ID NO: 9342255 - DNA, 22 bp, Homo sapiens
tctttcttgcaaggatgcagga

SEQ ID NO: 9342256 - DNA, 22 bp, Homo sapiens
tctttcttggtataaagcaggg

SEQ ID NO: 9342257 - DNA, 22 bp, Homo sapiens
ccaggcctgcattccctctcag

SEQ ID NO: 9342258 - DNA, 19 bp, Homo sapiens
ccaggcctgcgggcgttgg

SEQ ID NO: 9342259 - DNA, 22 bp, Homo sapiens
ccaggcctgcattccctctcag

SEQ ID NO: 9342260 - DNA, 22 bp, Homo sapiens
ccaggcctgcattccctctcag

SEQ ID NO: 9342261 - DNA, 22 bp, Homo sapiens
ccaggcctgcattccctctcag

SEQ ID NO: 9342262 - DNA, 19 bp, Homo sapiens
ccaggcctgcgggcgttgg

SEQ ID NO: 9342263 - DNA, 22 bp, Homo sapiens
ccaggcctggaccatgccaggg

SEQ ID NO: 9342264 - DNA, 22 bp, Homo sapiens
ccaggcctggaccatgccaggg

SEQ ID NO: 9342265 - DNA, 22 bp, Homo sapiens
tctttctttatcacctgatatg

SEQ ID NO: 9342266 - DNA, 22 bp, Homo sapiens
ccaggcctgcatctgctgcgca

SEQ ID NO: 9342267 - DNA, 22 bp, Homo sapiens
ccaggccagggctgcagcgagc

SEQ ID NO: 9342268 - DNA, 21 bp, Homo sapiens
ccaggccaggcctacggggat

SEQ ID NO: 9342269 - DNA, 19 bp, Homo sapiens
ccaggccatcccagttccc

SEQ ID NO: 9342270 - DNA, 18 bp, Homo sapiens
ccaggccatgaacctctg

SEQ ID NO: 9342271 - DNA, 22 bp, Homo sapiens
ccaggccattcccagagttgct

SEQ ID NO: 9342272 - DNA, 22 bp, Homo sapiens
ccaggcccagggtactgaccaa

SEQ ID NO: 9342273 - DNA, 22 bp, Homo sapiens
ccaggccccagggctggctttc

SEQ ID NO: 9342274 - DNA, 22 bp, Homo sapiens
ccaggcccagggtactgaccaa

SEQ ID NO: 9342275 - DNA, 22 bp, Homo sapiens
ccaggcccaccttggccactta

SEQ ID NO: 9342276 - DNA, 22 bp, Homo sapiens
ccaggcccaccttggccactta

SEQ ID NO: 9342277 - DNA, 22 bp, Homo sapiens
ccaggcccaccttggccactta

SEQ ID NO: 9342278 - DNA, 22 bp, Homo sapiens
ccaggcccaccttggccactta

SEQ ID NO: 9342279 - DNA, 22 bp, Homo sapiens
tctttcttattagccattgttc

SEQ ID NO: 9342280 - DNA, 22 bp, Homo sapiens
tctttcttattagccattgttc

SEQ ID NO: 9342281 - DNA, 22 bp, Homo sapiens
ccaggcccccgagcagaagaca

SEQ ID NO: 9342282 - DNA, 22 bp, Homo sapiens
ccaggccccagggctggctttc

SEQ ID NO: 9342283 - DNA, 22 bp, Homo sapiens
ccaggccccagggctggctttc

SEQ ID NO: 9342284 - DNA, 22 bp, Homo sapiens
ccaggccccagggctggctttc

SEQ ID NO: 9342285 - DNA, 22 bp, Homo sapiens
tctggtcccttttcctgcagtc

SEQ ID NO: 9342286 - DNA, 22 bp, Homo sapiens
tctggtcccttttcctgcagtc

SEQ ID NO: 9342287 - DNA, 22 bp, Homo sapiens
tctggtcccttttcctgcagtc

SEQ ID NO: 9342288 - DNA, 22 bp, Homo sapiens
tctggtccccattccaggtggg

SEQ ID NO: 9342289 - DNA, 22 bp, Homo sapiens
tctggtcccttttcctgcagtc

SEQ ID NO: 9342290 - DNA, 22 bp, Homo sapiens
tctggtcctctctgtgatgcta

SEQ ID NO: 9342291 - DNA, 22 bp, Homo sapiens
tctggtcctgaagtcaacttca

SEQ ID NO: 9342292 - DNA, 22 bp, Homo sapiens
tctggtcctgaagtcaacttca

SEQ ID NO: 9342293 - DNA, 22 bp, Homo sapiens
tctggtgtcagtattctttgaa

SEQ ID NO: 9342294 - DNA, 22 bp, Homo sapiens
ccaggactttaagtccagcact

SEQ ID NO: 9342295 - DNA, 22 bp, Homo sapiens
ccaggacttcgaggctacagtg

SEQ ID NO: 9342296 - DNA, 22 bp, Homo sapiens
ccaggacttcgaggctacagtg

SEQ ID NO: 9342297 - DNA, 20 bp, Homo sapiens
ccaggactgctggggactct

SEQ ID NO: 9342298 - DNA, 22 bp, Homo sapiens
tctggttgtcgaccaccaatgc

SEQ ID NO: 9342299 - DNA, 22 bp, Homo sapiens
ccaggagaataatggcagatta

SEQ ID NO: 9342300 - DNA, 22 bp, Homo sapiens
ccaggagaataatggcagatta

SEQ ID NO: 9342301 - DNA, 22 bp, Homo sapiens
ccaggagaataatggcagatta

SEQ ID NO: 9342302 - DNA, 22 bp, Homo sapiens
ccaggagaagcatctgagtgta

SEQ ID NO: 9342303 - DNA, 22 bp, Homo sapiens
tctgggagctggctttgcctca

SEQ ID NO: 9342304 - DNA, 22 bp, Homo sapiens
tctgggagcctgaaagtgaatg

SEQ ID NO: 9342305 - DNA, 22 bp, Homo sapiens
tctgggagccatgccttggagt

SEQ ID NO: 9342306 - DNA, 22 bp, Homo sapiens
tctgggagcagctcagcagatt

SEQ ID NO: 9342307 - DNA, 22 bp, Homo sapiens
tctgggagcagctcagcagatt

SEQ ID NO: 9342308 - DNA, 22 bp, Homo sapiens
tctgggagcagctcagcagatt

SEQ ID NO: 9342309 - DNA, 22 bp, Homo sapiens
tctgggtttgaagtagagccca

SEQ ID NO: 9342310 - DNA, 22 bp, Homo sapiens
tctgggttttgtaccgtgctcg

SEQ ID NO: 9342311 - DNA, 22 bp, Homo sapiens
tctggggatgaggtccagtgat

SEQ ID NO: 9342312 - DNA, 22 bp, Homo sapiens
tctggggatgaggtccagtgat

SEQ ID NO: 9342313 - DNA, 22 bp, Homo sapiens
tctgggagctggctttgcctca

SEQ ID NO: 9342314 - DNA, 20 bp, Homo sapiens
tctggggatgaggtctagga

SEQ ID NO: 9342315 - DNA, 17 bp, Homo sapiens
tctgggtttaaatccca

SEQ ID NO: 9342316 - DNA, 22 bp, Homo sapiens
ccaggactcagtggggaaaggg

SEQ ID NO: 9342317 - DNA, 21 bp, Homo sapiens
ccaggactccatggggtctct

SEQ ID NO: 9342318 - DNA, 21 bp, Homo sapiens
ccaggactccatggggtctct

SEQ ID NO: 9342319 - DNA, 22 bp, Homo sapiens
ccaggactcaattaacctcact

SEQ ID NO: 9342320 - DNA, 22 bp, Homo sapiens
ccaggactcaatgaccacaggg

SEQ ID NO: 9342321 - DNA, 22 bp, Homo sapiens
tctgggagatccaagcagaact

SEQ ID NO: 9342322 - DNA, 19 bp, Homo sapiens
tctgggagagtgaatctga

SEQ ID NO: 9342323 - DNA, 22 bp, Homo sapiens
tctgggagagtctaacttgttt

SEQ ID NO: 9342324 - DNA, 22 bp, Homo sapiens
ccaggactgcagggggcgagga

SEQ ID NO: 9342325 - DNA, 22 bp, Homo sapiens
tctgggagcagatgatggtata

SEQ ID NO: 9342326 - DNA, 22 bp, Homo sapiens
tctgggagcagatgatggtata

SEQ ID NO: 9342327 - DNA, 22 bp, Homo sapiens
tctgggagcacacgcagtgatc

SEQ ID NO: 9342328 - DNA, 22 bp, Homo sapiens
tctgggagatccaagcagaact

SEQ ID NO: 9342329 - DNA, 22 bp, Homo sapiens
tctgggagatccaagcagaact

SEQ ID NO: 9342330 - DNA, 22 bp, Homo sapiens
tctgggagatccaagcagaact

SEQ ID NO: 9342331 - DNA, 17 bp, Homo sapiens
tctggccttcctgaact

SEQ ID NO: 9342332 - DNA, 22 bp, Homo sapiens
tctggctcaggagctgtgttca

SEQ ID NO: 9342333 - DNA, 22 bp, Homo sapiens
ccaggaaggatcgtttgggagt

SEQ ID NO: 9342334 - DNA, 22 bp, Homo sapiens
tctggctcaggtcagacaggga

SEQ ID NO: 9342335 - DNA, 22 bp, Homo sapiens
ccaggaccacacgacaggagag

SEQ ID NO: 9342336 - DNA, 19 bp, Homo sapiens
ccaggacctttccagggtc

SEQ ID NO: 9342337 - DNA, 22 bp, Homo sapiens
ccaggactcaatgaccacaggg

SEQ ID NO: 9342338 - DNA, 22 bp, Homo sapiens
ccaggacctggagctctatgaa

SEQ ID NO: 9342339 - DNA, 22 bp, Homo sapiens
ccaggacctggagctctatgaa

SEQ ID NO: 9342340 - DNA, 22 bp, Homo sapiens
ccaggacactgcttcacagcag

SEQ ID NO: 9342341 - DNA, 22 bp, Homo sapiens
ccaggacaggagttggcttcgc

SEQ ID NO: 9342342 - DNA, 18 bp, Homo sapiens
ccaggacaggcaaaaggt

SEQ ID NO: 9342343 - DNA, 22 bp, Homo sapiens
tctggcaggaccatgaagcgta

SEQ ID NO: 9342344 - DNA, 22 bp, Homo sapiens
tctggcaggatatcgaagtgaa

SEQ ID NO: 9342345 - DNA, 22 bp, Homo sapiens
tctggcaggatatcgaagtgaa

SEQ ID NO: 9342346 - DNA, 22 bp, Homo sapiens
tctggcaggacatgctgaccat

SEQ ID NO: 9342347 - DNA, 22 bp, Homo sapiens
tctggcaggaccatgaagcgta

SEQ ID NO: 9342348 - DNA, 22 bp, Homo sapiens
tctggcaggaccatgaagcgta

SEQ ID NO: 9342349 - DNA, 21 bp, Homo sapiens
tctggcaggcacgggcccagc

SEQ ID NO: 9342350 - DNA, 22 bp, Homo sapiens
tctggcaggccttgtcaatctg

SEQ ID NO: 9342351 - DNA, 22 bp, Homo sapiens
tctggcaggccttgtcaatctg

SEQ ID NO: 9342352 - DNA, 22 bp, Homo sapiens
tctggcaggcaatcggctctgg

SEQ ID NO: 9342353 - DNA, 21 bp, Homo sapiens
tctggcaggcacgggcccagc

SEQ ID NO: 9342354 - DNA, 22 bp, Homo sapiens
tctggcaggcaatcggctctgg

SEQ ID NO: 9342355 - DNA, 22 bp, Homo sapiens
tctggcaggcaatcggctctgg

SEQ ID NO: 9342356 - DNA, 22 bp, Homo sapiens
tctggcagctcagttcaggtct

SEQ ID NO: 9342357 - DNA, 22 bp, Homo sapiens
tctggcagctcagttcaggtct

SEQ ID NO: 9342358 - DNA, 22 bp, Homo sapiens
tctggcagctctcctcggcgga

SEQ ID NO: 9342359 - DNA, 22 bp, Homo sapiens
tctggcagctctcctcggcgga

SEQ ID NO: 9342360 - DNA, 22 bp, Homo sapiens
tctggcaggacatgctgaccat

SEQ ID NO: 9342361 - DNA, 21 bp, Homo sapiens
tctggcaggaagacggatggg

SEQ ID NO: 9342362 - DNA, 21 bp, Homo sapiens
tctggcaggaagacggatggg

SEQ ID NO: 9342363 - DNA, 21 bp, Homo sapiens
tctggcagcagtttgttgagt

SEQ ID NO: 9342364 - DNA, 21 bp, Homo sapiens
tctggcagcagtttgttgagt

SEQ ID NO: 9342365 - DNA, 22 bp, Homo sapiens
tctggcagcgaagcgtgtactt

SEQ ID NO: 9342366 - DNA, 22 bp, Homo sapiens
tctggcagcgaagcgtgtactt

SEQ ID NO: 9342367 - DNA, 22 bp, Homo sapiens
tctggcagctatcctctggcca

SEQ ID NO: 9342368 - DNA, 22 bp, Homo sapiens
tctggcagctatcctctggcca

SEQ ID NO: 9342369 - DNA, 22 bp, Homo sapiens
tctggcctcttgggatgctccc

SEQ ID NO: 9342370 - DNA, 22 bp, Homo sapiens
tctggcctgaaagtccatgctt

SEQ ID NO: 9342371 - DNA, 22 bp, Homo sapiens
tctggcaggggttctgcacttg

SEQ ID NO: 9342372 - DNA, 22 bp, Homo sapiens
tctggcaggggttctgcacttg

SEQ ID NO: 9342373 - DNA, 22 bp, Homo sapiens
tctggcaggggttctgcacttg

SEQ ID NO: 9342374 - DNA, 22 bp, Homo sapiens
ccagctgctctcttctccgcca

SEQ ID NO: 9342375 - DNA, 22 bp, Homo sapiens
ccagctgctgacatgggcaggt

SEQ ID NO: 9342376 - DNA, 22 bp, Homo sapiens
ccagctgctgacatgggcaggt

SEQ ID NO: 9342377 - DNA, 22 bp, Homo sapiens
ccagctgctgtgaggaccacag

SEQ ID NO: 9342378 - DNA, 22 bp, Homo sapiens
ccagctgctgcaccgtgcatgg

SEQ ID NO: 9342379 - DNA, 22 bp, Homo sapiens
tctggcagcagcatcagtggct

SEQ ID NO: 9342380 - DNA, 22 bp, Homo sapiens
tctggcagcagcatcagtggct

SEQ ID NO: 9342381 - DNA, 22 bp, Homo sapiens
tctggcagcagcatcagtggct

SEQ ID NO: 9342382 - DNA, 22 bp, Homo sapiens
tctggcagcaagtctgtttctc

SEQ ID NO: 9342383 - DNA, 22 bp, Homo sapiens
tctggcagcaagtctgtttctc

SEQ ID NO: 9342384 - DNA, 22 bp, Homo sapiens
tctggaggccatagggaaggat

SEQ ID NO: 9342385 - DNA, 22 bp, Homo sapiens
tctggaggccatagggaaggat

SEQ ID NO: 9342386 - DNA, 22 bp, Homo sapiens
ccagctgctgtgcagggaggct

SEQ ID NO: 9342387 - DNA, 22 bp, Homo sapiens
ccagctgctgtgcagggaggct

SEQ ID NO: 9342388 - DNA, 22 bp, Homo sapiens
tctggaggccatagggaaggat

SEQ ID NO: 9342389 - DNA, 17 bp, Homo sapiens
ccagctgctccctcaga

SEQ ID NO: 9342390 - DNA, 21 bp, Homo sapiens
ccagctgctccttgaggttcc

SEQ ID NO: 9342391 - DNA, 22 bp, Homo sapiens
ccagctgctatcatgccatttc

SEQ ID NO: 9342392 - DNA, 22 bp, Homo sapiens
ccagctgctaacacaaaggagt

SEQ ID NO: 9342393 - DNA, 22 bp, Homo sapiens
ccagctgctaacacaaaggagt

SEQ ID NO: 9342394 - DNA, 22 bp, Homo sapiens
ccagctgcggtctcccaaagtt

SEQ ID NO: 9342395 - DNA, 22 bp, Homo sapiens
ccagctgcgggcatcgagagtt

SEQ ID NO: 9342396 - DNA, 22 bp, Homo sapiens
ccagctgcccaagaggcatcct

SEQ ID NO: 9342397 - DNA, 22 bp, Homo sapiens
ccagctgcccactatgtgttct

SEQ ID NO: 9342398 - DNA, 22 bp, Homo sapiens
ccagctgcccaagaggcatcct

SEQ ID NO: 9342399 - DNA, 22 bp, Homo sapiens
ccagctgcgggcatcgagagtt

SEQ ID NO: 9342400 - DNA, 18 bp, Homo sapiens
ccagctgcgctgaaccga

SEQ ID NO: 9342401 - DNA, 22 bp, Homo sapiens
ccagctgcctaagcaatccata

SEQ ID NO: 9342402 - DNA, 21 bp, Homo sapiens
ccagctgcctgcactttggac

SEQ ID NO: 9342403 - DNA, 22 bp, Homo sapiens
ccagctctctgtcctccccaca

SEQ ID NO: 9342404 - DNA, 22 bp, Homo sapiens
ccagctctctttgaagcataaa

SEQ ID NO: 9342405 - DNA, 22 bp, Homo sapiens
ccagctctcttcaagcccactc

SEQ ID NO: 9342406 - DNA, 22 bp, Homo sapiens
ccagctctcttcaagcccactc

SEQ ID NO: 9342407 - DNA, 22 bp, Homo sapiens
ccagctctgccaagcgtcagct

SEQ ID NO: 9342408 - DNA, 22 bp, Homo sapiens
ccagctctgcagggcctggggt

SEQ ID NO: 9342409 - DNA, 22 bp, Homo sapiens
ccagctgcaggggagcagtgga

SEQ ID NO: 9342410 - DNA, 22 bp, Homo sapiens
ccagctgcaggtgttccagatg

SEQ ID NO: 9342411 - DNA, 22 bp, Homo sapiens
ccagctgcaggggagcagtgga

SEQ ID NO: 9342412 - DNA, 22 bp, Homo sapiens
ccagctgcaggtgttccagatg

SEQ ID NO: 9342413 - DNA, 22 bp, Homo sapiens
ccagctgcatcctattcactgc

SEQ ID NO: 9342414 - DNA, 20 bp, Homo sapiens
ccagctgcagttcttaatga

SEQ ID NO: 9342415 - DNA, 22 bp, Homo sapiens
ccagctgcccaagaggcatcct

SEQ ID NO: 9342416 - DNA, 22 bp, Homo sapiens
ccagctgcatgacattaggtga

SEQ ID NO: 9342417 - DNA, 22 bp, Homo sapiens
ccagctgcatcctattcactgc

SEQ ID NO: 9342418 - DNA, 22 bp, Homo sapiens
ccagctctgccaagcgtcagct

SEQ ID NO: 9342419 - DNA, 22 bp, Homo sapiens
ccagctgcaggggagcagtgga

SEQ ID NO: 9342420 - DNA, 22 bp, Homo sapiens
ccagctgcagaatgttggggaa

SEQ ID NO: 9342421 - DNA, 22 bp, Homo sapiens
tctgcttcacttccccaagctt

SEQ ID NO: 9342422 - DNA, 22 bp, Homo sapiens
tctgcttctcctacttcatggg

SEQ ID NO: 9342423 - DNA, 22 bp, Homo sapiens
tctgctcaatactgctcatgaa

SEQ ID NO: 9342424 - DNA, 22 bp, Homo sapiens
tctgctcacatggctccatgca

SEQ ID NO: 9342425 - DNA, 22 bp, Homo sapiens
tctgcttgcgttctgctccctc

SEQ ID NO: 9342426 - DNA, 22 bp, Homo sapiens
tctgcttctgtgaaggcagtct

SEQ ID NO: 9342427 - DNA, 23 bp, Homo sapiens
tctgcttctgtattttttcccat

SEQ ID NO: 9342428 - DNA, 22 bp, Homo sapiens
tctgctttgaccttcttgatgc

SEQ ID NO: 9342429 - DNA, 22 bp, Homo sapiens
tctggaaaagcgataaaccatt

SEQ ID NO: 9342430 - DNA, 22 bp, Homo sapiens
tctggaaataaaattatagttg

SEQ ID NO: 9342431 - DNA, 22 bp, Homo sapiens
ccagctctcagcgggagactca

SEQ ID NO: 9342432 - DNA, 21 bp, Homo sapiens
tctggaagaaaaaagtattat

SEQ ID NO: 9342433 - DNA, 22 bp, Homo sapiens
tctggaaatggaagtaactatg

SEQ ID NO: 9342434 - DNA, 22 bp, Homo sapiens
tctggaaatttcagttttagag

SEQ ID NO: 9342435 - DNA, 22 bp, Homo sapiens
tctcagagaacagttggtgctt

SEQ ID NO: 9342436 - DNA, 22 bp, Homo sapiens
tctcagagaaatgtgtcaccat

SEQ ID NO: 9342437 - DNA, 22 bp, Homo sapiens
tctgctcaatactgctcatgaa

SEQ ID NO: 9342438 - DNA, 23 bp, Homo sapiens
tctcagacccgaagccagaggaa

SEQ ID NO: 9342439 - DNA, 22 bp, Homo sapiens
tctcagactatagtagagattc

SEQ ID NO: 9342440 - DNA, 22 bp, Homo sapiens
tctcagactctttagtgaaggt

SEQ ID NO: 9342441 - DNA, 19 bp, Homo sapiens
tctcagactgtgcttctgt

SEQ ID NO: 9342442 - DNA, 22 bp, Homo sapiens
tctcagaatcaggacctacttc

SEQ ID NO: 9342443 - DNA, 22 bp, Homo sapiens
tctcagaatccttgcccaggtg

SEQ ID NO: 9342444 - DNA, 19 bp, Homo sapiens
tctcagaattaagagtgct

SEQ ID NO: 9342445 - DNA, 19 bp, Homo sapiens
tctcagaattggcaatcat

SEQ ID NO: 9342446 - DNA, 22 bp, Homo sapiens
tctcagaattgtgtccactggg

SEQ ID NO: 9342447 - DNA, 22 bp, Homo sapiens
tctcagacatgtaatctctacc

SEQ ID NO: 9342448 - DNA, 22 bp, Homo sapiens
tctcagaagggtggtgctggag

SEQ ID NO: 9342449 - DNA, 22 bp, Homo sapiens
tctcagaataaattcctaactt

SEQ ID NO: 9342450 - DNA, 22 bp, Homo sapiens
tctcagaagtgatcaggatgtt

SEQ ID NO: 9342451 - DNA, 22 bp, Homo sapiens
ccagagacgtcggtcagggcgc

SEQ ID NO: 9342452 - DNA, 22 bp, Homo sapiens
ccagagagaaaatggagggcca

SEQ ID NO: 9342453 - DNA, 22 bp, Homo sapiens
ccagagagaaaatggagggcca

SEQ ID NO: 9342454 - DNA, 19 bp, Homo sapiens
ccaggtggaactgaggtag

SEQ ID NO: 9342455 - DNA, 22 bp, Homo sapiens
ccaggtgctcttgccagggctg

SEQ ID NO: 9342456 - DNA, 22 bp, Homo sapiens
ccaggtgctcttgccagggctg

SEQ ID NO: 9342457 - DNA, 22 bp, Homo sapiens
ccaggtgctcttgccagggctg

SEQ ID NO: 9342458 - DNA, 22 bp, Homo sapiens
ccaggtgctcttgccagggctg

SEQ ID NO: 9342459 - DNA, 19 bp, Homo sapiens
ccaggtggaactgaggtag

SEQ ID NO: 9342460 - DNA, 19 bp, Homo sapiens
ccaggtggaactgaggtag

SEQ ID NO: 9342461 - DNA, 22 bp, Homo sapiens
ccaggtggaaggtctgtgctct

SEQ ID NO: 9342462 - DNA, 22 bp, Homo sapiens
ccaggtggaaggtctgtgctct

SEQ ID NO: 9342463 - DNA, 19 bp, Homo sapiens
ccaggtggaactgaggtag

SEQ ID NO: 9342464 - DNA, 22 bp, Homo sapiens
ccaggtggacggcgagtacagg

SEQ ID NO: 9342465 - DNA, 22 bp, Homo sapiens
ccaggtggacggcgagtacagg

SEQ ID NO: 9342466 - DNA, 22 bp, Homo sapiens
ccaggtggacaaggctttcaca

SEQ ID NO: 9342467 - DNA, 22 bp, Homo sapiens
ccaggtggacaaggctttcaca

SEQ ID NO: 9342468 - DNA, 22 bp, Homo sapiens
ccaggtggacaaggctttcaca

SEQ ID NO: 9342469 - DNA, 17 bp, Homo sapiens
ccaggtggaatcgtgga

SEQ ID NO: 9342470 - DNA, 22 bp, Homo sapiens
ccaggtggaaggtctgtgctct

SEQ ID NO: 9342471 - DNA, 17 bp, Homo sapiens
ccaggtggaatcgtgga

SEQ ID NO: 9342472 - DNA, 22 bp, Homo sapiens
ccaggtggaaggtctgtgctct

SEQ ID NO: 9342473 - DNA, 22 bp, Homo sapiens
ccaggggggcgtagatgctggg

SEQ ID NO: 9342474 - DNA, 21 bp, Homo sapiens
ccagggtccagctgccatggt

SEQ ID NO: 9342475 - DNA, 22 bp, Homo sapiens
ccagggtagctgagctaagcct

SEQ ID NO: 9342476 - DNA, 22 bp, Homo sapiens
ccagggtaccccaagggcaggt

SEQ ID NO: 9342477 - DNA, 22 bp, Homo sapiens
ccagggtcacaaataactgcag

SEQ ID NO: 9342478 - DNA, 22 bp, Homo sapiens
ccagggtcacaaataactgcag

SEQ ID NO: 9342479 - DNA, 21 bp, Homo sapiens
ccagggtccagctgccatggt

SEQ ID NO: 9342480 - DNA, 17 bp, Homo sapiens
ccaggtctccttgcttt

SEQ ID NO: 9342481 - DNA, 22 bp, Homo sapiens
ccaggtgctagcaatcactgtc

SEQ ID NO: 9342482 - DNA, 22 bp, Homo sapiens
ccaggtctcgggtctgctcgtg

SEQ ID NO: 9342483 - DNA, 22 bp, Homo sapiens
ccaggggctggtgctgagctgg

SEQ ID NO: 9342484 - DNA, 22 bp, Homo sapiens
ccaggggctgcagatccatggt

SEQ ID NO: 9342485 - DNA, 22 bp, Homo sapiens
ccaggggctggtgctgagctgg

SEQ ID NO: 9342486 - DNA, 22 bp, Homo sapiens
ccaggggctggtgctgagctgg

SEQ ID NO: 9342487 - DNA, 22 bp, Homo sapiens
tgagaatatttgaagatgttag

SEQ ID NO: 9342488 - DNA, 18 bp, Homo sapiens
tgagaatatttatcccac

SEQ ID NO: 9342489 - DNA, 20 bp, Homo sapiens
tgagaaggggtcagctgtac

SEQ ID NO: 9342490 - DNA, 19 bp, Homo sapiens
tgagaaggcagtggggagc

SEQ ID NO: 9342491 - DNA, 19 bp, Homo sapiens
tgagaaggcagtggggagc

SEQ ID NO: 9342492 - DNA, 19 bp, Homo sapiens
tgagaaggtttccgtgggt

SEQ ID NO: 9342493 - DNA, 22 bp, Homo sapiens
tgagaaggtgaaagtgtggaga

SEQ ID NO: 9342494 - DNA, 22 bp, Homo sapiens
tgagaataagagatagtttatt

SEQ ID NO: 9342495 - DNA, 22 bp, Homo sapiens
tgagacagttggtgaaatctaa

SEQ ID NO: 9342496 - DNA, 22 bp, Homo sapiens
tgagacagtttttctatttcca

SEQ ID NO: 9342497 - DNA, 22 bp, Homo sapiens
ccaggtggacggcgagtacagg

SEQ ID NO: 9342498 - DNA, 22 bp, Homo sapiens
ccaggtggacggcgagtacagg

SEQ ID NO: 9342499 - DNA, 22 bp, Homo sapiens
tgagacagttctgcagctgggt

SEQ ID NO: 9342500 - DNA, 22 bp, Homo sapiens
tgagacatgtgaatatttgtac

SEQ ID NO: 9342501 - DNA, 22 bp, Homo sapiens
tgagacatgtgaatatttgtac

SEQ ID NO: 9342502 - DNA, 17 bp, Homo sapiens
ccaggtgggaggtgggg

SEQ ID NO: 9342503 - DNA, 22 bp, Homo sapiens
tgagacgaagtcttgctctgtt

SEQ ID NO: 9342504 - DNA, 22 bp, Homo sapiens
tgagacgaagtcttgctctgtt

SEQ ID NO: 9342505 - DNA, 22 bp, Homo sapiens
ccaggtgtagcactgctcacag

SEQ ID NO: 9342506 - DNA, 22 bp, Homo sapiens
ccaggtgtagcactgctcacag

SEQ ID NO: 9342507 - DNA, 22 bp, Homo sapiens
ccaggtgtagcactgctcacag

SEQ ID NO: 9342508 - DNA, 22 bp, Homo sapiens
ccaggtgggcgtgtcttcacct

SEQ ID NO: 9342509 - DNA, 22 bp, Homo sapiens
ccaggtgggcgtgtcttcacct

SEQ ID NO: 9342510 - DNA, 22 bp, Homo sapiens
ccaggtgtaagacatggtccta

SEQ ID NO: 9342511 - DNA, 22 bp, Homo sapiens
ccaggtgtaagacatggtccta

SEQ ID NO: 9342512 - DNA, 22 bp, Homo sapiens
ccaggtgtccccgtcactgcag

SEQ ID NO: 9342513 - DNA, 22 bp, Homo sapiens
ccaggtgtccccgtcactgcag

SEQ ID NO: 9342514 - DNA, 22 bp, Homo sapiens
ccaggtgtctgtctctttttca

SEQ ID NO: 9342515 - DNA, 22 bp, Homo sapiens
ccaggtgtctgtctctttttca

SEQ ID NO: 9342516 - DNA, 22 bp, Homo sapiens
ccaggtgtccccgtcactgcag

SEQ ID NO: 9342517 - DNA, 22 bp, Homo sapiens
ccaggtgtgagcattctgtctt

SEQ ID NO: 9342518 - DNA, 22 bp, Homo sapiens
ccaggtgtctgtggccagccct

SEQ ID NO: 9342519 - DNA, 22 bp, Homo sapiens
ccaggtgtctgtctctttttca

SEQ ID NO: 9342520 - DNA, 22 bp, Homo sapiens
ccaggtgtctgtggccagccct

SEQ ID NO: 9342521 - DNA, 22 bp, Homo sapiens
ccaggtgtctgtggccagccct

SEQ ID NO: 9342522 - DNA, 22 bp, Homo sapiens
ccaggtgtcatggataatgggt

SEQ ID NO: 9342523 - DNA, 22 bp, Homo sapiens
ccaggtgtcatggataatgggt

SEQ ID NO: 9342524 - DNA, 22 bp, Homo sapiens
ccaggtgtcatggataatgggt

SEQ ID NO: 9342525 - DNA, 22 bp, Homo sapiens
ccaggtgtcatgcgtgtgaccc

SEQ ID NO: 9342526 - DNA, 22 bp, Homo sapiens
ccaggtgtcatgcgtgtgaccc

SEQ ID NO: 9342527 - DNA, 22 bp, Homo sapiens
ccaggtgtaggacaccaaggga

SEQ ID NO: 9342528 - DNA, 22 bp, Homo sapiens
ccaggtgtaggacaccaaggga

SEQ ID NO: 9342529 - DNA, 22 bp, Homo sapiens
ccaggtgtcatgcgtgtgaccc

SEQ ID NO: 9342530 - DNA, 22 bp, Homo sapiens
ccaggtgtaggacaccaaggga

SEQ ID NO: 9342531 - DNA, 22 bp, Homo sapiens
tgaggactacctggggtgggag

SEQ ID NO: 9342532 - DNA, 22 bp, Homo sapiens
ccaggtgtgtacagaacagcac

SEQ ID NO: 9342533 - DNA, 22 bp, Homo sapiens
tgaggacatttatcttggcgca

SEQ ID NO: 9342534 - DNA, 22 bp, Homo sapiens
ccaggtgtgtacagaacagcac

SEQ ID NO: 9342535 - DNA, 22 bp, Homo sapiens
ccaggtgtggtggcatacacct

SEQ ID NO: 9342536 - DNA, 22 bp, Homo sapiens
ccaggtgtggtggcatacacct

SEQ ID NO: 9342537 - DNA, 22 bp, Homo sapiens
ccaggtgtggtggcatacacct

SEQ ID NO: 9342538 - DNA, 22 bp, Homo sapiens
ccaggtgtggccacatggctgg

SEQ ID NO: 9342539 - DNA, 22 bp, Homo sapiens
ccaggtgtggccacatggctgg

SEQ ID NO: 9342540 - DNA, 22 bp, Homo sapiens
ccaggtgtgctctgcagtggat

SEQ ID NO: 9342541 - DNA, 22 bp, Homo sapiens
ccaggtgtggggaggactcaca

SEQ ID NO: 9342542 - DNA, 22 bp, Homo sapiens
ccaggtgtggggaggactcaca

SEQ ID NO: 9342543 - DNA, 22 bp, Homo sapiens
ccaggtgtggggaggactcaca

SEQ ID NO: 9342544 - DNA, 22 bp, Homo sapiens
ccaggtgtggccacatggctgg

SEQ ID NO: 9342545 - DNA, 22 bp, Homo sapiens
ccaggtgtgatttggcagtgtc

SEQ ID NO: 9342546 - DNA, 22 bp, Homo sapiens
ccaggtgtgatttggcagtgtc

SEQ ID NO: 9342547 - DNA, 22 bp, Homo sapiens
ccaggtgtgatttcatctgagg

SEQ ID NO: 9342548 - DNA, 22 bp, Homo sapiens
ccaggtgtgagcattctgtctt

SEQ ID NO: 9342549 - DNA, 22 bp, Homo sapiens
ccaggtgtgatttggcagtgtc

SEQ ID NO: 9342550 - DNA, 22 bp, Homo sapiens
ccaggtgtgatttcatctgagg

SEQ ID NO: 9342551 - DNA, 22 bp, Homo sapiens
ccaggtgtgatttcatctgagg

SEQ ID NO: 9342552 - DNA, 22 bp, Homo sapiens
ccaggtgtgagcattctgtctt

SEQ ID NO: 9342553 - DNA, 22 bp, Homo sapiens
ccaggtgtgctctgcagtggat

SEQ ID NO: 9342554 - DNA, 22 bp, Homo sapiens
ccaggtgtgctctgcagtggat

SEQ ID NO: 9342555 - DNA, 22 bp, Homo sapiens
ccaggtgtgctctgcagtggat

SEQ ID NO: 9342556 - DNA, 22 bp, Homo sapiens
ccaggtgtgccagcagggactg

SEQ ID NO: 9342557 - DNA, 22 bp, Homo sapiens
ccaggtgtgccagcagggactg

SEQ ID NO: 9342558 - DNA, 22 bp, Homo sapiens
ccaggtgtgccagcagggactg

SEQ ID NO: 9342559 - DNA, 22 bp, Homo sapiens
tgaggcagagtaagatacatga

SEQ ID NO: 9342560 - DNA, 22 bp, Homo sapiens
tgaggcagcaattgattattca

SEQ ID NO: 9342561 - DNA, 22 bp, Homo sapiens
tgaggactttccatgttaatgt

SEQ ID NO: 9342562 - DNA, 22 bp, Homo sapiens
tgaggactacctggggtgggag

SEQ ID NO: 9342563 - DNA, 22 bp, Homo sapiens
tgaggactacctggggtgggag

SEQ ID NO: 9342564 - DNA, 22 bp, Homo sapiens
tgaagttgttaaggttgccatt

SEQ ID NO: 9342565 - DNA, 22 bp, Homo sapiens
tgaagttgttaaggttgccatt

SEQ ID NO: 9342566 - DNA, 22 bp, Homo sapiens
tgaatgagtggattctgagtag

SEQ ID NO: 9342567 - DNA, 22 bp, Homo sapiens
tgaatgagtggattctgagtag

SEQ ID NO: 9342568 - DNA, 22 bp, Homo sapiens
tgaatgagtttggctgctgttc

SEQ ID NO: 9342569 - DNA, 22 bp, Homo sapiens
tgaatgagtttggctgctgttc

SEQ ID NO: 9342570 - DNA, 22 bp, Homo sapiens
tgaatgatacagaattatgtag

SEQ ID NO: 9342571 - DNA, 22 bp, Homo sapiens
tgaatgatctagttttgtagac

SEQ ID NO: 9342572 - DNA, 22 bp, Homo sapiens
tgaatgatctccgattagtcct

SEQ ID NO: 9342573 - DNA, 22 bp, Homo sapiens
tgaatgatggtgtgttcttgcc

SEQ ID NO: 9342574 - DNA, 22 bp, Homo sapiens
tgaatgatggtgtgttcttgcc

SEQ ID NO: 9342575 - DNA, 22 bp, Homo sapiens
tgaatgcactgctctcctagga

SEQ ID NO: 9342576 - DNA, 22 bp, Homo sapiens
tgacaacagccatcacttttag

SEQ ID NO: 9342577 - DNA, 22 bp, Homo sapiens
ccaggctggagtgcagtggcac

SEQ ID NO: 9342578 - DNA, 22 bp, Homo sapiens
ccaggctggagtgcagtggcac

SEQ ID NO: 9342579 - DNA, 22 bp, Homo sapiens
ccaggctggagtgcagtggcac

SEQ ID NO: 9342580 - DNA, 22 bp, Homo sapiens
ccaggctggagtgcagtggcac

SEQ ID NO: 9342581 - DNA, 22 bp, Homo sapiens
ccaggctggagtgcaatggtgc

SEQ ID NO: 9342582 - DNA, 22 bp, Homo sapiens
ccaggctggagtgcagtagtgt

SEQ ID NO: 9342583 - DNA, 22 bp, Homo sapiens
ccaggctggagtgcagtagtgt

SEQ ID NO: 9342584 - DNA, 21 bp, Homo sapiens
ccaggctggccatggtattga

SEQ ID NO: 9342585 - DNA, 21 bp, Homo sapiens
ccaggctggccatggtattga

SEQ ID NO: 9342586 - DNA, 20 bp, Homo sapiens
ccaggctggcaaatgggggc

SEQ ID NO: 9342587 - DNA, 22 bp, Homo sapiens
ccaggctggagtgtagtcgcat

SEQ ID NO: 9342588 - DNA, 22 bp, Homo sapiens
ccaggctggattttgcagttca

SEQ ID NO: 9342589 - DNA, 22 bp, Homo sapiens
ccaggctggattttgcagttca

SEQ ID NO: 9342590 - DNA, 22 bp, Homo sapiens
ccaggggaaacagggagcactc

SEQ ID NO: 9342591 - DNA, 22 bp, Homo sapiens
ccagggctttgccaaagtccag

SEQ ID NO: 9342592 - DNA, 22 bp, Homo sapiens
ccagggctttgccaaagtccag

SEQ ID NO: 9342593 - DNA, 22 bp, Homo sapiens
ccagggctttatctgcctttga

SEQ ID NO: 9342594 - DNA, 22 bp, Homo sapiens
ccagggctttatctgcctttga

SEQ ID NO: 9342595 - DNA, 22 bp, Homo sapiens
ccagggctttatctgcctttga

SEQ ID NO: 9342596 - DNA, 19 bp, Homo sapiens
ccagggctttaagttgagg

SEQ ID NO: 9342597 - DNA, 19 bp, Homo sapiens
ccagggctttaagttgagg

SEQ ID NO: 9342598 - DNA, 22 bp, Homo sapiens
ccagggcttggtggcttgtatc

SEQ ID NO: 9342599 - DNA, 22 bp, Homo sapiens
ccagggcttggtggcttgtatc

SEQ ID NO: 9342600 - DNA, 22 bp, Homo sapiens
ccagggcttcagttagtggtga

SEQ ID NO: 9342601 - DNA, 22 bp, Homo sapiens
ccagggcttcccacgtgccctg

SEQ ID NO: 9342602 - DNA, 22 bp, Homo sapiens
ccagggcttcccacgtgccctg

SEQ ID NO: 9342603 - DNA, 22 bp, Homo sapiens
ccagggcttcccacgtgccctg

SEQ ID NO: 9342604 - DNA, 22 bp, Homo sapiens
ccagggctgctgtgggactcca

SEQ ID NO: 9342605 - DNA, 22 bp, Homo sapiens
ccagggcttcagttagtggtga

SEQ ID NO: 9342606 - DNA, 22 bp, Homo sapiens
ccagggctggaccagtgcttgg

SEQ ID NO: 9342607 - DNA, 22 bp, Homo sapiens
tgacaagagcattcccacacct

SEQ ID NO: 9342608 - DNA, 22 bp, Homo sapiens
tgacaagagacccctccgcagg

SEQ ID NO: 9342609 - DNA, 22 bp, Homo sapiens
tgacaagaggcagaatcagctg

SEQ ID NO: 9342610 - DNA, 22 bp, Homo sapiens
tgacaagtcactgttcttcaat

SEQ ID NO: 9342611 - DNA, 22 bp, Homo sapiens
tgacaagtagggtgggatttgt

SEQ ID NO: 9342612 - DNA, 22 bp, Homo sapiens
tgacaagtacataatttcatgt

SEQ ID NO: 9342613 - DNA, 22 bp, Homo sapiens
tgacaagttggaaagcagtgca

SEQ ID NO: 9342614 - DNA, 22 bp, Homo sapiens
tgacaagttggaaagcagtgca

SEQ ID NO: 9342615 - DNA, 22 bp, Homo sapiens
tgacaagttctaataagaaatg

SEQ ID NO: 9342616 - DNA, 22 bp, Homo sapiens
tgacataataatccaaacatac

SEQ ID NO: 9342617 - DNA, 22 bp, Homo sapiens
tgacataataatccaaacatac

SEQ ID NO: 9342618 - DNA, 21 bp, Homo sapiens
tgacataatccatagtacaaa

SEQ ID NO: 9342619 - DNA, 22 bp, Homo sapiens
tgacatagctattaagtgatgc

SEQ ID NO: 9342620 - DNA, 20 bp, Homo sapiens
tgacatagctttgcagagtt

SEQ ID NO: 9342621 - DNA, 22 bp, Homo sapiens
ccaggggcctgtgaaggtgccc

SEQ ID NO: 9342622 - DNA, 22 bp, Homo sapiens
tgacagtgtttgcacttcaggt

SEQ ID NO: 9342623 - DNA, 22 bp, Homo sapiens
tgacataaaccagtgagcaaaa

SEQ ID NO: 9342624 - DNA, 23 bp, Homo sapiens
ccagtctctttccaaaatcacat

SEQ ID NO: 9342625 - DNA, 20 bp, Homo sapiens
ccagtctctggccagcatca

SEQ ID NO: 9342626 - DNA, 19 bp, Homo sapiens
ccagtctccttgcagcatc

SEQ ID NO: 9342627 - DNA, 23 bp, Homo sapiens
ccagtctcacgtatacaggattt

SEQ ID NO: 9342628 - DNA, 19 bp, Homo sapiens
ccagtcctctttgggcctg

SEQ ID NO: 9342629 - DNA, 22 bp, Homo sapiens
ccagtcctcagatggtctgtgc

SEQ ID NO: 9342630 - DNA, 22 bp, Homo sapiens
ccagtcctgctccctgaccacc

SEQ ID NO: 9342631 - DNA, 22 bp, Homo sapiens
ccagtcctgctccctgaccacc

SEQ ID NO: 9342632 - DNA, 22 bp, Homo sapiens
ccagtcctgtgtgaccctgcac

SEQ ID NO: 9342633 - DNA, 22 bp, Homo sapiens
ccagtcctgtgtgaccctgcac

SEQ ID NO: 9342634 - DNA, 22 bp, Homo sapiens
tgaggcagcaattgtattgtat

SEQ ID NO: 9342635 - DNA, 22 bp, Homo sapiens
tgaggcagcattcttcaagaca

SEQ ID NO: 9342636 - DNA, 22 bp, Homo sapiens
tgaggcagcattcttcaagaca

SEQ ID NO: 9342637 - DNA, 22 bp, Homo sapiens
tgaggcagcccactttccttag

SEQ ID NO: 9342638 - DNA, 22 bp, Homo sapiens
tgaggcagcccactttccttag

SEQ ID NO: 9342639 - DNA, 22 bp, Homo sapiens
ccagtcccgcatggtccagaat

SEQ ID NO: 9342640 - DNA, 22 bp, Homo sapiens
ccagtcctagaagaggagtcga

SEQ ID NO: 9342641 - DNA, 22 bp, Homo sapiens
ccagtcctagttctaccttaca

SEQ ID NO: 9342642 - DNA, 22 bp, Homo sapiens
tgagggctccccgctgctgtgt

SEQ ID NO: 9342643 - DNA, 22 bp, Homo sapiens
tgagggctgacaggaggacagc

SEQ ID NO: 9342644 - DNA, 22 bp, Homo sapiens
tgagggctgcttccagagctag

SEQ ID NO: 9342645 - DNA, 22 bp, Homo sapiens
tgagggctgcttccagagctag

SEQ ID NO: 9342646 - DNA, 22 bp, Homo sapiens
tgagggctgcttccagagctag

SEQ ID NO: 9342647 - DNA, 23 bp, Homo sapiens
tgaggctgattgatttttgctca

SEQ ID NO: 9342648 - DNA, 23 bp, Homo sapiens
tgaggctgattgatttttgctca

SEQ ID NO: 9342649 - DNA, 22 bp, Homo sapiens
tgagggcaaagtggtgctgagg

SEQ ID NO: 9342650 - DNA, 22 bp, Homo sapiens
tgagggcacctgggattaatgg

SEQ ID NO: 9342651 - DNA, 22 bp, Homo sapiens
tgagggatggtgagagtctgat

SEQ ID NO: 9342652 - DNA, 22 bp, Homo sapiens
tgagggattgatgtttgacatg

SEQ ID NO: 9342653 - DNA, 22 bp, Homo sapiens
tgagggatggtgagagtctgat

SEQ ID NO: 9342654 - DNA, 20 bp, Homo sapiens
tgagggctaaccagactctg

SEQ ID NO: 9342655 - DNA, 22 bp, Homo sapiens
tgagggctaaattgtggcaggt

SEQ ID NO: 9342656 - DNA, 22 bp, Homo sapiens
tgagggccgaggagctgtgggt

SEQ ID NO: 9342657 - DNA, 22 bp, Homo sapiens
tgagggcagagcactggggagc

SEQ ID NO: 9342658 - DNA, 22 bp, Homo sapiens
tgagggcagagcactggggagc

SEQ ID NO: 9342659 - DNA, 22 bp, Homo sapiens
ccatgcctggactccactctca

SEQ ID NO: 9342660 - DNA, 22 bp, Homo sapiens
ccatgccctaaaggactggcag

SEQ ID NO: 9342661 - DNA, 22 bp, Homo sapiens
ccatgctgtgacacagtagtta

SEQ ID NO: 9342662 - DNA, 22 bp, Homo sapiens
ccatgctccttaccactcactt

SEQ ID NO: 9342663 - DNA, 22 bp, Homo sapiens
ccatgcccacgttgtggctcag

SEQ ID NO: 9342664 - DNA, 22 bp, Homo sapiens
ccatgcatgcctgaaattgctg

SEQ ID NO: 9342665 - DNA, 22 bp, Homo sapiens
ccatgcatggcactggactggg

SEQ ID NO: 9342666 - DNA, 22 bp, Homo sapiens
ccatcctggccttgctgtccac

SEQ ID NO: 9342667 - DNA, 22 bp, Homo sapiens
ccatgcagtgctggagctgatt

SEQ ID NO: 9342668 - DNA, 22 bp, Homo sapiens
ccatcctggcctcgctgtccac

SEQ ID NO: 9342669 - DNA, 22 bp, Homo sapiens
tgaggtagtgtttagtccagtc

SEQ ID NO: 9342670 - DNA, 22 bp, Homo sapiens
tgaggtagtgtttagtccagtc

SEQ ID NO: 9342671 - DNA, 22 bp, Homo sapiens
tgaggtatacgttggttcagtc

SEQ ID NO: 9342672 - DNA, 22 bp, Homo sapiens
tgaggtaggtgtcgagagaggt

SEQ ID NO: 9342673 - DNA, 22 bp, Homo sapiens
tgaggtaggtggtaagagatac

SEQ ID NO: 9342674 - DNA, 22 bp, Homo sapiens
tgaggtaggtggtgaaaaatga

SEQ ID NO: 9342675 - DNA, 22 bp, Homo sapiens
tgaggtaggataagacaatgag

SEQ ID NO: 9342676 - DNA, 22 bp, Homo sapiens
tgaggtatgctgaactctgttt

SEQ ID NO: 9342677 - DNA, 22 bp, Homo sapiens
tgaggtatgaggttctatgatc

SEQ ID NO: 9342678 - DNA, 22 bp, Homo sapiens
tgaggtcacagctggggatgga

SEQ ID NO: 9342679 - DNA, 22 bp, Homo sapiens
ccatggcctgaaggagtgcatc

SEQ ID NO: 9342680 - DNA, 22 bp, Homo sapiens
ccatgtgggattttggtgtctg

SEQ ID NO: 9342681 - DNA, 22 bp, Homo sapiens
ccatgtggctgtgtggtttatt

SEQ ID NO: 9342682 - DNA, 22 bp, Homo sapiens
ccatgtgggattttggtgtctg

SEQ ID NO: 9342683 - DNA, 22 bp, Homo sapiens
ccatggctaagtatctgtagaa

SEQ ID NO: 9342684 - DNA, 22 bp, Homo sapiens
ccatggctaagtatctgtagaa

SEQ ID NO: 9342685 - DNA, 22 bp, Homo sapiens
ccatgtgtctcccctggaagta

SEQ ID NO: 9342686 - DNA, 22 bp, Homo sapiens
ccatgtgttcaataagggagtt

SEQ ID NO: 9342687 - DNA, 18 bp, Homo sapiens
ccatgtgttccttttggg

SEQ ID NO: 9342688 - DNA, 22 bp, Homo sapiens
ccatgtgtaaattagataactc

SEQ ID NO: 9342689 - DNA, 22 bp, Homo sapiens
ccatgtgtcgggcctgcagtgg

SEQ ID NO: 9342690 - DNA, 22 bp, Homo sapiens
ccatgtggtgggaaggagaatg

SEQ ID NO: 9342691 - DNA, 22 bp, Homo sapiens
tgcacacattctatggggctga

SEQ ID NO: 9342692 - DNA, 22 bp, Homo sapiens
tgcacacattaaggatacacag

SEQ ID NO: 9342693 - DNA, 22 bp, Homo sapiens
tgcacacattaaggatacacag

SEQ ID NO: 9342694 - DNA, 22 bp, Homo sapiens
tgcacacatgtttacaagcatc

SEQ ID NO: 9342695 - DNA, 22 bp, Homo sapiens
tgcacacatgtatgtatatgtg

SEQ ID NO: 9342696 - DNA, 22 bp, Homo sapiens
tgcacacatgtttacaagcatc

SEQ ID NO: 9342697 - DNA, 22 bp, Homo sapiens
tgcacacatgtttacaagcatc

SEQ ID NO: 9342698 - DNA, 22 bp, Homo sapiens
tgcacacatatgagcatgtgtg

SEQ ID NO: 9342699 - DNA, 22 bp, Homo sapiens
tgcacacatgtatgtatatgtg

SEQ ID NO: 9342700 - DNA, 22 bp, Homo sapiens
cccagactcatccctgggagct

SEQ ID NO: 9342701 - DNA, 22 bp, Homo sapiens
cccagaattattctcttctcct

SEQ ID NO: 9342702 - DNA, 22 bp, Homo sapiens
cccagacccagagggaggcagg

SEQ ID NO: 9342703 - DNA, 22 bp, Homo sapiens
cccagaaggctaagcgtggatt

SEQ ID NO: 9342704 - DNA, 22 bp, Homo sapiens
cccagaaggcttgccaggaagc

SEQ ID NO: 9342705 - DNA, 22 bp, Homo sapiens
cccagaaggtcgaggctgcagt

SEQ ID NO: 9342706 - DNA, 22 bp, Homo sapiens
cccagaaggtcgaggctgcagt

SEQ ID NO: 9342707 - DNA, 20 bp, Homo sapiens
cccagaagtcacctccactc

SEQ ID NO: 9342708 - DNA, 21 bp, Homo sapiens
cccagaagttccatggggggc

SEQ ID NO: 9342709 - DNA, 22 bp, Homo sapiens
tgcaaatacaaaatggtacagc

SEQ ID NO: 9342710 - DNA, 23 bp, Homo sapiens
tgcaaataacaaggagtttaagg

SEQ ID NO: 9342711 - DNA, 22 bp, Homo sapiens
tgcaaataaatttctgttcatt

SEQ ID NO: 9342712 - DNA, 22 bp, Homo sapiens
tgcaaataaatttctgttcatt

SEQ ID NO: 9342713 - DNA, 22 bp, Homo sapiens
tgcaaagcaatgtaggtcagct

SEQ ID NO: 9342714 - DNA, 22 bp, Homo sapiens
cccacccctggacaggtgagtg

SEQ ID NO: 9342715 - DNA, 22 bp, Homo sapiens
cccacccctggacaggtgagtg

SEQ ID NO: 9342716 - DNA, 22 bp, Homo sapiens
tgcaaatattagcattcgatat

SEQ ID NO: 9342717 - DNA, 22 bp, Homo sapiens
tgcaaataggggacaactcttt

SEQ ID NO: 9342718 - DNA, 22 bp, Homo sapiens
tgcaaatagcctatatttatag

SEQ ID NO: 9342719 - DNA, 22 bp, Homo sapiens
cccacttcatgggcaggaagga

SEQ ID NO: 9342720 - DNA, 20 bp, Homo sapiens
cccagaagcttaacagagca

SEQ ID NO: 9342721 - DNA, 22 bp, Homo sapiens
cccaccctcaagggtgtctata

SEQ ID NO: 9342722 - DNA, 22 bp, Homo sapiens
cccaccctcaagggtgtctata

SEQ ID NO: 9342723 - DNA, 23 bp, Homo sapiens
tgattttaaaaagtaagttatca

SEQ ID NO: 9342724 - DNA, 23 bp, Homo sapiens
tgattttaaaaagtaagttatca

SEQ ID NO: 9342725 - DNA, 22 bp, Homo sapiens
tgcaaagatttatctttctcca

SEQ ID NO: 9342726 - DNA, 22 bp, Homo sapiens
tgattttattggtgaggaaatt

SEQ ID NO: 9342727 - DNA, 22 bp, Homo sapiens
tgattttattgaaacttcactt

SEQ ID NO: 9342728 - DNA, 22 bp, Homo sapiens
tgatttgcatggagaataacag

SEQ ID NO: 9342729 - DNA, 22 bp, Homo sapiens
tgatttgaattttaaaacactg

SEQ ID NO: 9342730 - DNA, 22 bp, Homo sapiens
tgatttgaggtacataaatcca

SEQ ID NO: 9342731 - DNA, 22 bp, Homo sapiens
tgatttcttccttgtcattaga

SEQ ID NO: 9342732 - DNA, 22 bp, Homo sapiens
tgatttcttccttgtcattaga

SEQ ID NO: 9342733 - DNA, 22 bp, Homo sapiens
tgatttcttccttgtcattaga

SEQ ID NO: 9342734 - DNA, 22 bp, Homo sapiens
tgatttctcttggcaatatgtt

SEQ ID NO: 9342735 - DNA, 21 bp, Homo sapiens
tgatttctgccaagttcacta

SEQ ID NO: 9342736 - DNA, 22 bp, Homo sapiens
tgatttctctccgttatttcag

SEQ ID NO: 9342737 - DNA, 22 bp, Homo sapiens
tgatttctcttggcaatatgtt

SEQ ID NO: 9342738 - DNA, 20 bp, Homo sapiens
tgatttctcttctattcctt

SEQ ID NO: 9342739 - DNA, 20 bp, Homo sapiens
tgatttctcttctattcctt

SEQ ID NO: 9342740 - DNA, 22 bp, Homo sapiens
tgatttctcatattgttcaaaa

SEQ ID NO: 9342741 - DNA, 22 bp, Homo sapiens
tgattcaagattggttagctgt

SEQ ID NO: 9342742 - DNA, 21 bp, Homo sapiens
tgatttctagatattggccca

SEQ ID NO: 9342743 - DNA, 22 bp, Homo sapiens
ccattgtaaattctgtggaagt

SEQ ID NO: 9342744 - DNA, 22 bp, Homo sapiens
ccattggagccaagagttttac

SEQ ID NO: 9342745 - DNA, 22 bp, Homo sapiens
ccattaaacttgtggacccagt

SEQ ID NO: 9342746 - DNA, 22 bp, Homo sapiens
ccattaaaatggaatgtagtga

SEQ ID NO: 9342747 - DNA, 22 bp, Homo sapiens
ccattaaaatggaatgtagtga

SEQ ID NO: 9342748 - DNA, 22 bp, Homo sapiens
ccatgtgttgattctctgcaga

SEQ ID NO: 9342749 - DNA, 22 bp, Homo sapiens
ccatgtgttgagattccagcct

SEQ ID NO: 9342750 - DNA, 22 bp, Homo sapiens
ccatgtgttgagattccagcct

SEQ ID NO: 9342751 - DNA, 22 bp, Homo sapiens
ccatgtgttcaataagggagtt

SEQ ID NO: 9342752 - DNA, 22 bp, Homo sapiens
ccattcacttttgccctgtcct

SEQ ID NO: 9342753 - DNA, 22 bp, Homo sapiens
ccattaaagcaccactgtaata

SEQ ID NO: 9342754 - DNA, 22 bp, Homo sapiens
ccattatccacgggcttcctga

SEQ ID NO: 9342755 - DNA, 19 bp, Homo sapiens
ccattgtaaagaaaaatgt

SEQ ID NO: 9342756 - DNA, 19 bp, Homo sapiens
ccattctgtctctgccaca

SEQ ID NO: 9342757 - DNA, 22 bp, Homo sapiens
ccattctgtgtctctccacagc

SEQ ID NO: 9342758 - DNA, 23 bp, Homo sapiens
cccagggacacgatgacacctcc

SEQ ID NO: 9342759 - DNA, 22 bp, Homo sapiens
cccagggaagggctacctgagg

SEQ ID NO: 9342760 - DNA, 22 bp, Homo sapiens
cccagggaatgactctggcctt

SEQ ID NO: 9342761 - DNA, 22 bp, Homo sapiens
cccagggaatgactctggcctt

SEQ ID NO: 9342762 - DNA, 22 bp, Homo sapiens
cccaggctggggctcctccagc

SEQ ID NO: 9342763 - DNA, 22 bp, Homo sapiens
cccaggctggggctcctccagc

SEQ ID NO: 9342764 - DNA, 22 bp, Homo sapiens
cccaggctggtcctgaactcct

SEQ ID NO: 9342765 - DNA, 22 bp, Homo sapiens
cccaggctggtcctgaactcct

SEQ ID NO: 9342766 - DNA, 22 bp, Homo sapiens
cccaggctggtcctgaactcct

SEQ ID NO: 9342767 - DNA, 22 bp, Homo sapiens
cccaggctggcactgctgaagt

SEQ ID NO: 9342768 - DNA, 22 bp, Homo sapiens
cccaggctggcactgctgaagt

SEQ ID NO: 9342769 - DNA, 22 bp, Homo sapiens
cccaggctggagtgtaatggtg

SEQ ID NO: 9342770 - DNA, 22 bp, Homo sapiens
cccaggctggagtgtaatggtg

SEQ ID NO: 9342771 - DNA, 22 bp, Homo sapiens
cccaggctggatttcggtggca

SEQ ID NO: 9342772 - DNA, 22 bp, Homo sapiens
cccaggctggatttcggtggca

SEQ ID NO: 9342773 - DNA, 22 bp, Homo sapiens
cccaggctgggaacgattctag

SEQ ID NO: 9342774 - DNA, 22 bp, Homo sapiens
cccaggctggcctccgcagtgc

SEQ ID NO: 9342775 - DNA, 22 bp, Homo sapiens
cccaggctggcctccgcagtgc

SEQ ID NO: 9342776 - DNA, 22 bp, Homo sapiens
cccaggctggggctcctccagc

SEQ ID NO: 9342777 - DNA, 22 bp, Homo sapiens
cccaggctggggctcctccagc

SEQ ID NO: 9342778 - DNA, 22 bp, Homo sapiens
cccaggctggggctcctccagc

SEQ ID NO: 9342779 - DNA, 22 bp, Homo sapiens
cccaggctggagtgcagtggcg

SEQ ID NO: 9342780 - DNA, 22 bp, Homo sapiens
cccaggctggagtgcagtggcg

SEQ ID NO: 9342781 - DNA, 22 bp, Homo sapiens
cccaggctggagtgcaatggtg

SEQ ID NO: 9342782 - DNA, 22 bp, Homo sapiens
cccaggctggagtgcaatggca

SEQ ID NO: 9342783 - DNA, 22 bp, Homo sapiens
cccaggctggagggcagtgtca

SEQ ID NO: 9342784 - DNA, 22 bp, Homo sapiens
cccaggctggagggcagtgtca

SEQ ID NO: 9342785 - DNA, 22 bp, Homo sapiens
cccaggctggagggcagtgtca

SEQ ID NO: 9342786 - DNA, 22 bp, Homo sapiens
cccaggctgagttagaggtgtc

SEQ ID NO: 9342787 - DNA, 22 bp, Homo sapiens
tgccctggtagacacagactgt

SEQ ID NO: 9342788 - DNA, 22 bp, Homo sapiens
tgccctggtagacacagactgt

SEQ ID NO: 9342789 - DNA, 22 bp, Homo sapiens
tgccctggtgaagtgctctcct

SEQ ID NO: 9342790 - DNA, 22 bp, Homo sapiens
tgccttcctgctttgagttctg

SEQ ID NO: 9342791 - DNA, 22 bp, Homo sapiens
tgccttcctgctttgagttctg

SEQ ID NO: 9342792 - DNA, 22 bp, Homo sapiens
tgccttcctaatggtggggttt

SEQ ID NO: 9342793 - DNA, 22 bp, Homo sapiens
tgccttcctggagctgaaggct

SEQ ID NO: 9342794 - DNA, 22 bp, Homo sapiens
cccagggccctggacagctaca

SEQ ID NO: 9342795 - DNA, 22 bp, Homo sapiens
tgcctgttgcccacctgataaa

SEQ ID NO: 9342796 - DNA, 22 bp, Homo sapiens
tgcctgttgcccacctgataaa

SEQ ID NO: 9342797 - DNA, 22 bp, Homo sapiens
tgcctgttgcccacctgataaa

SEQ ID NO: 9342798 - DNA, 22 bp, Homo sapiens
tgcctgtgtggggtctgccgcc

SEQ ID NO: 9342799 - DNA, 22 bp, Homo sapiens
tgcctgtgttgattactttgtc

SEQ ID NO: 9342800 - DNA, 22 bp, Homo sapiens
tgcctgtgttgattactttgtc

SEQ ID NO: 9342801 - DNA, 17 bp, Homo sapiens
cccagggaccactgctt

SEQ ID NO: 9342802 - DNA, 22 bp, Homo sapiens
tgcctgtgtgaccacgggcaag

SEQ ID NO: 9342803 - DNA, 17 bp, Homo sapiens
cccagggaccactgctt

SEQ ID NO: 9342804 - DNA, 17 bp, Homo sapiens
cccagggaccactgctt

SEQ ID NO: 9342805 - DNA, 22 bp, Homo sapiens
cccagggacagatgggcagcta

SEQ ID NO: 9342806 - DNA, 22 bp, Homo sapiens
cccaggggttctgagcagcagc

SEQ ID NO: 9342807 - DNA, 20 bp, Homo sapiens
cccaggggttgtggtgagga

SEQ ID NO: 9342808 - DNA, 20 bp, Homo sapiens
cccaggggttgtggtgagga

SEQ ID NO: 9342809 - DNA, 22 bp, Homo sapiens
cccagggtagctgagctggcag

SEQ ID NO: 9342810 - DNA, 22 bp, Homo sapiens
cccagggtaatcatgtgaagcc

SEQ ID NO: 9342811 - DNA, 22 bp, Homo sapiens
cccaggggttcaaggctgcagt

SEQ ID NO: 9342812 - DNA, 22 bp, Homo sapiens
cccaggggttcaaggctgcagt

SEQ ID NO: 9342813 - DNA, 22 bp, Homo sapiens
cccaggggttcaaggctgcagt

SEQ ID NO: 9342814 - DNA, 22 bp, Homo sapiens
cccaggggttcaaggctgcagt

SEQ ID NO: 9342815 - DNA, 22 bp, Homo sapiens
cccaggggttctagaccagctt

SEQ ID NO: 9342816 - DNA, 22 bp, Homo sapiens
cccaggggttctagaccagctt

SEQ ID NO: 9342817 - DNA, 22 bp, Homo sapiens
cccagggtccctgctctctgtg

SEQ ID NO: 9342818 - DNA, 22 bp, Homo sapiens
cccagggtagctgagctggcag

SEQ ID NO: 9342819 - DNA, 22 bp, Homo sapiens
cccagggtgcggccctggctgg

SEQ ID NO: 9342820 - DNA, 22 bp, Homo sapiens
cccagggtccctgctctctgtg

SEQ ID NO: 9342821 - DNA, 23 bp, Homo sapiens
cccaggtagccctctagagcctg

SEQ ID NO: 9342822 - DNA, 23 bp, Homo sapiens
cccaggtagccctctagagcctg

SEQ ID NO: 9342823 - DNA, 22 bp, Homo sapiens
cccagggttgcctgcctctgct

SEQ ID NO: 9342824 - DNA, 22 bp, Homo sapiens
cccagggtggatgcaagcagca

SEQ ID NO: 9342825 - DNA, 22 bp, Homo sapiens
cccagggtggatgcaagcagca

SEQ ID NO: 9342826 - DNA, 22 bp, Homo sapiens
tgccagctgacagcagagacaa

SEQ ID NO: 9342827 - DNA, 22 bp, Homo sapiens
tgccagcttctaaggacccagg

SEQ ID NO: 9342828 - DNA, 22 bp, Homo sapiens
tgccagctgttcccacccaaaa

SEQ ID NO: 9342829 - DNA, 22 bp, Homo sapiens
tgccagctccgaggagctgcag

SEQ ID NO: 9342830 - DNA, 19 bp, Homo sapiens
tgccacagataaaaactga

SEQ ID NO: 9342831 - DNA, 22 bp, Homo sapiens
tgccacagaggtgaagcccact

SEQ ID NO: 9342832 - DNA, 22 bp, Homo sapiens
tgcacagagagatgagacacgt

SEQ ID NO: 9342833 - DNA, 22 bp, Homo sapiens
tgccaggctaagtggaggactt

SEQ ID NO: 9342834 - DNA, 22 bp, Homo sapiens
tgccaggctaagtggaggactt

SEQ ID NO: 9342835 - DNA, 22 bp, Homo sapiens
tgccagtgaaacatggaagaat

SEQ ID NO: 9342836 - DNA, 22 bp, Homo sapiens
tgccagtctcaccctgggtcct

SEQ ID NO: 9342837 - DNA, 22 bp, Homo sapiens
tgccaggctaagtggaggactt

SEQ ID NO: 9342838 - DNA, 22 bp, Homo sapiens
tgccagtgagccctgggatgtg

SEQ ID NO: 9342839 - DNA, 22 bp, Homo sapiens
tgccagtgaaacgtggtctcat

SEQ ID NO: 9342840 - DNA, 22 bp, Homo sapiens
tgccagtgaaacgtggtctcat

SEQ ID NO: 9342841 - DNA, 22 bp, Homo sapiens
tgccagtgcctgctgcccaata

SEQ ID NO: 9342842 - DNA, 22 bp, Homo sapiens
tgccagtgcttgtgtctgagca

SEQ ID NO: 9342843 - DNA, 22 bp, Homo sapiens
tgccagtgcttgtgtctgagca

SEQ ID NO: 9342844 - DNA, 22 bp, Homo sapiens
tgccagtgggtgtgcagagact

SEQ ID NO: 9342845 - DNA, 22 bp, Homo sapiens
cccaggagagaggccagttggc

SEQ ID NO: 9342846 - DNA, 22 bp, Homo sapiens
cccaggagacctagatctgttt

SEQ ID NO: 9342847 - DNA, 22 bp, Homo sapiens
cccaggagactgagctgtaacc

SEQ ID NO: 9342848 - DNA, 22 bp, Homo sapiens
cccaggagacctagatctgttt

SEQ ID NO: 9342849 - DNA, 22 bp, Homo sapiens
tgccaggagtcaggccaggcag

SEQ ID NO: 9342850 - DNA, 22 bp, Homo sapiens
tgcccagcctaaacttggcaag

SEQ ID NO: 9342851 - DNA, 22 bp, Homo sapiens
tgcccagcgcccacattctgtc

SEQ ID NO: 9342852 - DNA, 22 bp, Homo sapiens
cccaggcagtgtgtgcatgcgt

SEQ ID NO: 9342853 - DNA, 22 bp, Homo sapiens
tgcccagctgtcaaagtagata

SEQ ID NO: 9342854 - DNA, 22 bp, Homo sapiens
cccaggcatcccattaaggagc

SEQ ID NO: 9342855 - DNA, 22 bp, Homo sapiens
cccaggcatcccattaaggagc

SEQ ID NO: 9342856 - DNA, 19 bp, Homo sapiens
cccaggctacatggagagg

SEQ ID NO: 9342857 - DNA, 19 bp, Homo sapiens
cccaggctacatggagagg

SEQ ID NO: 9342858 - DNA, 20 bp, Homo sapiens
tgccagtgtgtcaatttata

SEQ ID NO: 9342859 - DNA, 22 bp, Homo sapiens
tgccagtgtgagtggagttctt

SEQ ID NO: 9342860 - DNA, 22 bp, Homo sapiens
tgccagtgtggaactaggaaga

SEQ ID NO: 9342861 - DNA, 22 bp, Homo sapiens
tgccagtgtgtgccttaagctc

SEQ ID NO: 9342862 - DNA, 22 bp, Homo sapiens
tgccatagcaatggtaagctga

SEQ ID NO: 9342863 - DNA, 22 bp, Homo sapiens
tgccagtgtctgctatctgaga

SEQ ID NO: 9342864 - DNA, 22 bp, Homo sapiens
tgccagtgtggaactaggaaga

SEQ ID NO: 9342865 - DNA, 22 bp, Homo sapiens
tgccagtgtggaactaggaaga

SEQ ID NO: 9342866 - DNA, 22 bp, Homo sapiens
tgccagtgtagtagctggttta

SEQ ID NO: 9342867 - DNA, 22 bp, Homo sapiens
tgccagtgggtgtgcagagact

SEQ ID NO: 9342868 - DNA, 22 bp, Homo sapiens
tgcccagcccctatccctggga

SEQ ID NO: 9342869 - DNA, 22 bp, Homo sapiens
tgccatattattgagcatatta

SEQ ID NO: 9342870 - DNA, 22 bp, Homo sapiens
tgccatattgatgtgctgtacc

SEQ ID NO: 9342871 - DNA, 22 bp, Homo sapiens
tgccatattgcaaagtgtctgc

SEQ ID NO: 9342872 - DNA, 22 bp, Homo sapiens
cccaggctagtatgatatcagt

SEQ ID NO: 9342873 - DNA, 22 bp, Homo sapiens
cccaggctagaaaggccaacaa

SEQ ID NO: 9342874 - DNA, 22 bp, Homo sapiens
cccaggctagaaaggccaacaa

SEQ ID NO: 9342875 - DNA, 22 bp, Homo sapiens
cccaggctcccaggtgggacaa

SEQ ID NO: 9342876 - DNA, 22 bp, Homo sapiens
cccaggctcccaggtgggacaa

SEQ ID NO: 9342877 - DNA, 22 bp, Homo sapiens
cccaggctcactgtccgcttcc

SEQ ID NO: 9342878 - DNA, 22 bp, Homo sapiens
cccaggctcactgtccgcttcc

SEQ ID NO: 9342879 - DNA, 22 bp, Homo sapiens
cccaggctcagactggcttgtt

SEQ ID NO: 9342880 - DNA, 22 bp, Homo sapiens
cccaggctcctactgtattctg

SEQ ID NO: 9342881 - DNA, 22 bp, Homo sapiens
tgccctgggctttgctatgact

SEQ ID NO: 9342882 - DNA, 22 bp, Homo sapiens
tgccctggggtctggagcagca

SEQ ID NO: 9342883 - DNA, 22 bp, Homo sapiens
tgccctggggagcccagccagg

SEQ ID NO: 9342884 - DNA, 18 bp, Homo sapiens
ccctctcctgctagtggg

SEQ ID NO: 9342885 - DNA, 22 bp, Homo sapiens
ccctctacagggaagcgctttc

SEQ ID NO: 9342886 - DNA, 22 bp, Homo sapiens
ccctctccctgcagaatgtggc

SEQ ID NO: 9342887 - DNA, 19 bp, Homo sapiens
ccctcttgcacaaagcaaa

SEQ ID NO: 9342888 - DNA, 22 bp, Homo sapiens
ccctctctcaggctgacagcct

SEQ ID NO: 9342889 - DNA, 19 bp, Homo sapiens
ccctcttgcacaaagcaaa

SEQ ID NO: 9342890 - DNA, 19 bp, Homo sapiens
ccctcttgcacaaagcaaa

SEQ ID NO: 9342891 - DNA, 19 bp, Homo sapiens
ccctcttgcacaaagcaaa

SEQ ID NO: 9342892 - DNA, 22 bp, Homo sapiens
ccctgaaagtacactgggacgg

SEQ ID NO: 9342893 - DNA, 22 bp, Homo sapiens
ccctgaaatcctgtgctctgtg

SEQ ID NO: 9342894 - DNA, 22 bp, Homo sapiens
ccctgagaggttgagtgtctgc

SEQ ID NO: 9342895 - DNA, 22 bp, Homo sapiens
ccctgagcacacctggcagaca

SEQ ID NO: 9342896 - DNA, 22 bp, Homo sapiens
ccctgagccgctgctccaacct

SEQ ID NO: 9342897 - DNA, 23 bp, Homo sapiens
ccctgagctggtccaggctcaac

SEQ ID NO: 9342898 - DNA, 23 bp, Homo sapiens
ccctgagctggtccaggctcaac

SEQ ID NO: 9342899 - DNA, 23 bp, Homo sapiens
ccctgagctggtccaggctcaac

SEQ ID NO: 9342900 - DNA, 22 bp, Homo sapiens
tggagcaaacccatggctgtgc

SEQ ID NO: 9342901 - DNA, 22 bp, Homo sapiens
tggagcaagctggagagaacat

SEQ ID NO: 9342902 - DNA, 22 bp, Homo sapiens
tggagcaggacggggagtggta

SEQ ID NO: 9342903 - DNA, 22 bp, Homo sapiens
tggagcaggacggggagtggta

SEQ ID NO: 9342904 - DNA, 22 bp, Homo sapiens
tggagcagaaatggcctcttgt

SEQ ID NO: 9342905 - DNA, 16 bp, Homo sapiens
tggagcaggcaggatg

SEQ ID NO: 9342906 - DNA, 16 bp, Homo sapiens
tggagcaggcaggatg

SEQ ID NO: 9342907 - DNA, 22 bp, Homo sapiens
tggagcaggactgctgccctca

SEQ ID NO: 9342908 - DNA, 22 bp, Homo sapiens
tggagcaggactgctgccctca

SEQ ID NO: 9342909 - DNA, 22 bp, Homo sapiens
ccctcctttctaggcttccagc

SEQ ID NO: 9342910 - DNA, 22 bp, Homo sapiens
ccctcctttctaggcttccagc

SEQ ID NO: 9342911 - DNA, 22 bp, Homo sapiens
ccctccttaccaccacagctcc

SEQ ID NO: 9342912 - DNA, 22 bp, Homo sapiens
ccctcctgtgcctgaggccagc

SEQ ID NO: 9342913 - DNA, 22 bp, Homo sapiens
ccctcgctctaggcagccctgt

SEQ ID NO: 9342914 - DNA, 22 bp, Homo sapiens
tggaatgttaaacctcaatgat

SEQ ID NO: 9342915 - DNA, 22 bp, Homo sapiens
tggaatgtgttctattttacag

SEQ ID NO: 9342916 - DNA, 22 bp, Homo sapiens
ccctcctggaggcggatgccca

SEQ ID NO: 9342917 - DNA, 22 bp, Homo sapiens
ccctcctggaggcggatgccca

SEQ ID NO: 9342918 - DNA, 22 bp, Homo sapiens
tggaatggaaacaaactgagga

SEQ ID NO: 9342919 - DNA, 22 bp, Homo sapiens
tggaatggggactttgggacat

SEQ ID NO: 9342920 - DNA, 22 bp, Homo sapiens
tggaatgtaaacctcaggtggg

SEQ ID NO: 9342921 - DNA, 22 bp, Homo sapiens
tggaatgtaaactctgtgaggg

SEQ ID NO: 9342922 - DNA, 22 bp, Homo sapiens
tggaatgtaaactctgtgaggg

SEQ ID NO: 9342923 - DNA, 22 bp, Homo sapiens
tggaatgtaaagcgtgtgataa

SEQ ID NO: 9342924 - DNA, 22 bp, Homo sapiens
tggaatgtaaagggtatgggat

SEQ ID NO: 9342925 - DNA, 22 bp, Homo sapiens
tggaatgtaatcatgtggtggt

SEQ ID NO: 9342926 - DNA, 22 bp, Homo sapiens
tggaatgtaatcagaatatgaa

SEQ ID NO: 9342927 - DNA, 22 bp, Homo sapiens
tggaatgtagtgtccatggaat

SEQ ID NO: 9342928 - DNA, 20 bp, Homo sapiens
tggaatgtagtcggtgagag

SEQ ID NO: 9342929 - DNA, 21 bp, Homo sapiens
tggaatgtacctccctctctt

SEQ ID NO: 9342930 - DNA, 22 bp, Homo sapiens
tggaatgtagcaagtgttgtca

SEQ ID NO: 9342931 - DNA, 22 bp, Homo sapiens
tggaatgtgctagggctgtggc

SEQ ID NO: 9342932 - DNA, 22 bp, Homo sapiens
tggaatgtggtatcagtagaaa

SEQ ID NO: 9342933 - DNA, 22 bp, Homo sapiens
tggaatgtggataagggtgtct

SEQ ID NO: 9342934 - DNA, 22 bp, Homo sapiens
tggaatgtgagaataccgtttt

SEQ ID NO: 9342935 - DNA, 22 bp, Homo sapiens
tggaatgtgctactgttgattt

SEQ ID NO: 9342936 - DNA, 22 bp, Homo sapiens
tggaatgtcttgatatagaggt

SEQ ID NO: 9342937 - DNA, 22 bp, Homo sapiens
tggaatgtgaacatacaaggta

SEQ ID NO: 9342938 - DNA, 22 bp, Homo sapiens
tggaatgtcagctacaagaggg

SEQ ID NO: 9342939 - DNA, 22 bp, Homo sapiens
tggaatgtcataccataaaaga

SEQ ID NO: 9342940 - DNA, 23 bp, Homo sapiens
tggaatgtctgattctgctctag

SEQ ID NO: 9342941 - DNA, 22 bp, Homo sapiens
tggaatgtatagatgttatgta

SEQ ID NO: 9342942 - DNA, 22 bp, Homo sapiens
tggaatgtattaagtattgagt

SEQ ID NO: 9342943 - DNA, 22 bp, Homo sapiens
tggaatgtcaaaagtctgctat

SEQ ID NO: 9342944 - DNA, 22 bp, Homo sapiens
tggaatgtcaagaagcagtaag

SEQ ID NO: 9342945 - DNA, 22 bp, Homo sapiens
tgctgtgttctcctgactcacc

SEQ ID NO: 9342946 - DNA, 22 bp, Homo sapiens
tggaatggaaacaaactgagga

SEQ ID NO: 9342947 - DNA, 22 bp, Homo sapiens
tggaatggaaacaaactgagga

SEQ ID NO: 9342948 - DNA, 22 bp, Homo sapiens
tggaagggagctggaatttgga

SEQ ID NO: 9342949 - DNA, 22 bp, Homo sapiens
tgctgtgttcaccaatatgtgt

SEQ ID NO: 9342950 - DNA, 22 bp, Homo sapiens
tgctgtgtggatgtgaagaatc

SEQ ID NO: 9342951 - DNA, 18 bp, Homo sapiens
cccggctaatttttggta

SEQ ID NO: 9342952 - DNA, 22 bp, Homo sapiens
tgctgtgctctttaaggtgctg

SEQ ID NO: 9342953 - DNA, 22 bp, Homo sapiens
tgctgtgctggcggcagaggcc

SEQ ID NO: 9342954 - DNA, 23 bp, Homo sapiens
tgctgtggatggcaggtccttgc

SEQ ID NO: 9342955 - DNA, 23 bp, Homo sapiens
tgctgtggatggcaggtccttgc

SEQ ID NO: 9342956 - DNA, 22 bp, Homo sapiens
tgctgtggttcccagagtggat

SEQ ID NO: 9342957 - DNA, 22 bp, Homo sapiens
tgctgtgtaaaaggtgattgaa

SEQ ID NO: 9342958 - DNA, 22 bp, Homo sapiens
tgctgtggcagtttatgtatag

SEQ ID NO: 9342959 - DNA, 22 bp, Homo sapiens
cccatttttgtgtgagtaatga

SEQ ID NO: 9342960 - DNA, 22 bp, Homo sapiens
cccattttgcttatgctgctgt

SEQ ID NO: 9342961 - DNA, 22 bp, Homo sapiens
cccatttttgtgtgagtaatga

SEQ ID NO: 9342962 - DNA, 22 bp, Homo sapiens
cccattttggaacgagtagcca

SEQ ID NO: 9342963 - DNA, 23 bp, Homo sapiens
cccattttcatgttaactcctgg

SEQ ID NO: 9342964 - DNA, 23 bp, Homo sapiens
cccattttcatgttaactcctgg

SEQ ID NO: 9342965 - DNA, 22 bp, Homo sapiens
cccattttagcaaggggtggcg

SEQ ID NO: 9342966 - DNA, 22 bp, Homo sapiens
cccattcatcctcgcttccttc

SEQ ID NO: 9342967 - DNA, 22 bp, Homo sapiens
cccaggtctatgccagctctga

SEQ ID NO: 9342968 - DNA, 22 bp, Homo sapiens
cccaggtctatgccagctctga

SEQ ID NO: 9342969 - DNA, 22 bp, Homo sapiens
cccaggtctatgccagctctga

SEQ ID NO: 9342970 - DNA, 22 bp, Homo sapiens
cccaggtctccctgcagccctg

SEQ ID NO: 9342971 - DNA, 22 bp, Homo sapiens
cccagttgttgccggctctgga

SEQ ID NO: 9342972 - DNA, 23 bp, Homo sapiens
cccaggtcaaaattcacaggcct

SEQ ID NO: 9342973 - DNA, 23 bp, Homo sapiens
cccaggtcaaaattcacaggcct

SEQ ID NO: 9342974 - DNA, 23 bp, Homo sapiens
cccaggtcaaaattcacaggcct

SEQ ID NO: 9342975 - DNA, 22 bp, Homo sapiens
cccaggtcccgccccagctcta

SEQ ID NO: 9342976 - DNA, 22 bp, Homo sapiens
cccaggtcccgccccagctcta

SEQ ID NO: 9342977 - DNA, 21 bp, Homo sapiens
cccaggtcgtggtcttcccag

SEQ ID NO: 9342978 - DNA, 22 bp, Homo sapiens
cccaggtcccggggccagctgc

SEQ ID NO: 9342979 - DNA, 22 bp, Homo sapiens
cccaggtcccggggccagctgc

SEQ ID NO: 9342980 - DNA, 22 bp, Homo sapiens
ccccaccaccaaggctcagttt

SEQ ID NO: 9342981 - DNA, 22 bp, Homo sapiens
ccccacccacctaagagaaact

SEQ ID NO: 9342982 - DNA, 22 bp, Homo sapiens
ccccaccctcgctccatttcgg

SEQ ID NO: 9342983 - DNA, 22 bp, Homo sapiens
tgctggccaatggcagaggcgg

SEQ ID NO: 9342984 - DNA, 22 bp, Homo sapiens
tgctggccaatggcagaggcgg

SEQ ID NO: 9342985 - DNA, 22 bp, Homo sapiens
tgctggccaagcagaggtcaat

SEQ ID NO: 9342986 - DNA, 22 bp, Homo sapiens
tgctggagcccaggcggccttt

SEQ ID NO: 9342987 - DNA, 22 bp, Homo sapiens
tgctggagcccaggcggccttt

SEQ ID NO: 9342988 - DNA, 20 bp, Homo sapiens
ccccacactattgagcactt

SEQ ID NO: 9342989 - DNA, 22 bp, Homo sapiens
ccccacacctgccgggcagcag

SEQ ID NO: 9342990 - DNA, 22 bp, Homo sapiens
ccccacaggtgtctgaggcagg

SEQ ID NO: 9342991 - DNA, 22 bp, Homo sapiens
ccccacagcttgtggagagaat

SEQ ID NO: 9342992 - DNA, 22 bp, Homo sapiens
ccccacagccgccagcagggag

SEQ ID NO: 9342993 - DNA, 22 bp, Homo sapiens
ccccacagtccgtgaggagcca

SEQ ID NO: 9342994 - DNA, 22 bp, Homo sapiens
ccccacagtccgtgaggagcca

SEQ ID NO: 9342995 - DNA, 22 bp, Homo sapiens
ccccacaggtgtctgaggcagg

SEQ ID NO: 9342996 - DNA, 21 bp, Homo sapiens
tgctggcctcaagggtgactt

SEQ ID NO: 9342997 - DNA, 22 bp, Homo sapiens
tgctggcctcggcgctgggcct

SEQ ID NO: 9342998 - DNA, 22 bp, Homo sapiens
tgctggcctgggctgcaccttg

SEQ ID NO: 9342999 - DNA, 22 bp, Homo sapiens
tgctggcctgggctgcaccttg

SEQ ID NO: 9343000 - DNA, 22 bp, Homo sapiens
tgctggcctggttagaaagggg

SEQ ID NO: 9343001 - DNA, 22 bp, Homo sapiens
tgctggcctggttagaaagggg

SEQ ID NO: 9343002 - DNA, 22 bp, Homo sapiens
tgctggcccatgaagacgcagt

SEQ ID NO: 9343003 - DNA, 22 bp, Homo sapiens
tgctggccggccaggtgctgag

SEQ ID NO: 9343004 - DNA, 22 bp, Homo sapiens
tgctggccctggctcagggaac

SEQ ID NO: 9343005 - DNA, 21 bp, Homo sapiens
tgctggccatgtgctgggcat

SEQ ID NO: 9343006 - DNA, 22 bp, Homo sapiens
tgctggcccagtactaatgtct

SEQ ID NO: 9343007 - DNA, 22 bp, Homo sapiens
tgctggcccagtatggactgca

SEQ ID NO: 9343008 - DNA, 22 bp, Homo sapiens
tgctggcccagtatggactgca

SEQ ID NO: 9343009 - DNA, 22 bp, Homo sapiens
tgctggcctgtccacgggctgt

SEQ ID NO: 9343010 - DNA, 22 bp, Homo sapiens
tgctggctaatggaaaccagat

SEQ ID NO: 9343011 - DNA, 22 bp, Homo sapiens
tgctggctttaaggttaaagtg

SEQ ID NO: 9343012 - DNA, 22 bp, Homo sapiens
tgctggctttagtgattggggt

SEQ ID NO: 9343013 - DNA, 23 bp, Homo sapiens
tgctggcttttatctggtcccta

SEQ ID NO: 9343014 - DNA, 22 bp, Homo sapiens
tgctggctttttgtgtcaaaga

SEQ ID NO: 9343015 - DNA, 22 bp, Homo sapiens
tgctggcttttccttcaggcag

SEQ ID NO: 9343016 - DNA, 22 bp, Homo sapiens
tgctgggatatagcttctaggg

SEQ ID NO: 9343017 - DNA, 22 bp, Homo sapiens
tgctgggatatagcttctaggg

SEQ ID NO: 9343018 - DNA, 23 bp, Homo sapiens
cccctctggtggctcagctcctg

SEQ ID NO: 9343019 - DNA, 22 bp, Homo sapiens
ccccttccaggaagcagaatcg

SEQ ID NO: 9343020 - DNA, 22 bp, Homo sapiens
ccccttccaggaagcagaatcg

SEQ ID NO: 9343021 - DNA, 22 bp, Homo sapiens
ccccttccttcctcagacagcc

SEQ ID NO: 9343022 - DNA, 22 bp, Homo sapiens
ccccttccttcctcagacagcc

SEQ ID NO: 9343023 - DNA, 22 bp, Homo sapiens
ccccttccttcctcagacagcc

SEQ ID NO: 9343024 - DNA, 22 bp, Homo sapiens
ccccttctgtgtcctgtcagcc

SEQ ID NO: 9343025 - DNA, 22 bp, Homo sapiens
ccccttggctgctctcaagtcc

SEQ ID NO: 9343026 - DNA, 22 bp, Homo sapiens
ccccttgaggggaatggctgga

SEQ ID NO: 9343027 - DNA, 22 bp, Homo sapiens
ccccttgacctgtgatagcttc

SEQ ID NO: 9343028 - DNA, 22 bp, Homo sapiens
ccccttctgtgtcctgtcagcc

SEQ ID NO: 9343029 - DNA, 19 bp, Homo sapiens
ccccttgtgtaactagcct

SEQ ID NO: 9343030 - DNA, 21 bp, Homo sapiens
cccgcatcttcctctccagca

SEQ ID NO: 9343031 - DNA, 21 bp, Homo sapiens
cccgcacagcggtaggccgcc

SEQ ID NO: 9343032 - DNA, 22 bp, Homo sapiens
cccgagggccgaaagctgcttt

SEQ ID NO: 9343033 - DNA, 22 bp, Homo sapiens
cccgacctcgcaaagcgcactc

SEQ ID NO: 9343034 - DNA, 22 bp, Homo sapiens
cccttctctttcactcactatt

SEQ ID NO: 9343035 - DNA, 19 bp, Homo sapiens
tggcagaggacaaggactt

SEQ ID NO: 9343036 - DNA, 19 bp, Homo sapiens
tggcagaggacaaggactt

SEQ ID NO: 9343037 - DNA, 19 bp, Homo sapiens
tggcagaggacaaggactt

SEQ ID NO: 9343038 - DNA, 19 bp, Homo sapiens
tggcagaggacaaggactt

SEQ ID NO: 9343039 - DNA, 19 bp, Homo sapiens
tggcagaggacaaggactt

SEQ ID NO: 9343040 - DNA, 22 bp, Homo sapiens
tggcagaggaaaaagtcactgg

SEQ ID NO: 9343041 - DNA, 22 bp, Homo sapiens
cccttccttgattttaactgga

SEQ ID NO: 9343042 - DNA, 22 bp, Homo sapiens
cccttcctgggtgtcccggagt

SEQ ID NO: 9343043 - DNA, 22 bp, Homo sapiens
cccttcctggagtaccctctgt

SEQ ID NO: 9343044 - DNA, 22 bp, Homo sapiens
cccttcctggagtaccctctgt

SEQ ID NO: 9343045 - DNA, 22 bp, Homo sapiens
cccttcctggagtaccctctgt

SEQ ID NO: 9343046 - DNA, 22 bp, Homo sapiens
cccttcctcctcgcctgtcaga

SEQ ID NO: 9343047 - DNA, 22 bp, Homo sapiens
cccttcctcccaggcttctgtg

SEQ ID NO: 9343048 - DNA, 22 bp, Homo sapiens
cccttcctcaaggagctgtgtt

SEQ ID NO: 9343049 - DNA, 22 bp, Homo sapiens
ccctgtggggtccgcctgtccg

SEQ ID NO: 9343050 - DNA, 22 bp, Homo sapiens
ccctgtggtgacaggcctgtct

SEQ ID NO: 9343051 - DNA, 22 bp, Homo sapiens
ccctgtggggtccgcctgtccg

SEQ ID NO: 9343052 - DNA, 22 bp, Homo sapiens
cccttcccttctgggagatcca

SEQ ID NO: 9343053 - DNA, 22 bp, Homo sapiens
ccctgtgggccatgtgtctaca

SEQ ID NO: 9343054 - DNA, 23 bp, Homo sapiens
ccctgcagtcagggtgagatggt

SEQ ID NO: 9343055 - DNA, 22 bp, Homo sapiens
ccctgcaggctcagactggagt

SEQ ID NO: 9343056 - DNA, 22 bp, Homo sapiens
ccctgcaggggacctgcagcct

SEQ ID NO: 9343057 - DNA, 22 bp, Homo sapiens
ccctgcaggctcagactggagt

SEQ ID NO: 9343058 - DNA, 22 bp, Homo sapiens
ccctgcagccttgcatgccttc

SEQ ID NO: 9343059 - DNA, 22 bp, Homo sapiens
ccctgcagcttttgcatagtca

SEQ ID NO: 9343060 - DNA, 22 bp, Homo sapiens
ccctgcagccttgcatgccttc

SEQ ID NO: 9343061 - DNA, 22 bp, Homo sapiens
ccctgcagccttgcatgccttc

SEQ ID NO: 9343062 - DNA, 21 bp, Homo sapiens
ccctgcaggccagggctgagc

SEQ ID NO: 9343063 - DNA, 22 bp, Homo sapiens
tggagcaggccggaagtggctt

SEQ ID NO: 9343064 - DNA, 22 bp, Homo sapiens
tggagcaggccggaagtggctt

SEQ ID NO: 9343065 - DNA, 22 bp, Homo sapiens
tggagcagggcatcactgtgcg

SEQ ID NO: 9343066 - DNA, 22 bp, Homo sapiens
tggagcagggcatcactgtgcg

SEQ ID NO: 9343067 - DNA, 22 bp, Homo sapiens
tggagcaggccggaagtggctt

SEQ ID NO: 9343068 - DNA, 22 bp, Homo sapiens
tggagcaggccggaagtggctt

SEQ ID NO: 9343069 - DNA, 22 bp, Homo sapiens
tggagcaggcatctttctctct

SEQ ID NO: 9343070 - DNA, 22 bp, Homo sapiens
tggagcaggcatctttctctct

SEQ ID NO: 9343071 - DNA, 18 bp, Homo sapiens
tggagcaggtaggcatga

SEQ ID NO: 9343072 - DNA, 18 bp, Homo sapiens
tggagcaggtaggcatga

SEQ ID NO: 9343073 - DNA, 19 bp, Homo sapiens
tggagcagggcccttgttt

SEQ ID NO: 9343074 - DNA, 19 bp, Homo sapiens
tggagcagggcccttgttt

SEQ ID NO: 9343075 - DNA, 22 bp, Homo sapiens
tggagcagggcatcactgtgcg

SEQ ID NO: 9343076 - DNA, 22 bp, Homo sapiens
tggagcagggcatcactgtgcg

SEQ ID NO: 9343077 - DNA, 18 bp, Homo sapiens
tggagcaggtaggcatga

SEQ ID NO: 9343078 - DNA, 22 bp, Homo sapiens
ccctgcagccttgcatgccttc

SEQ ID NO: 9343079 - DNA, 22 bp, Homo sapiens
cctagcagggagaggatacctg

SEQ ID NO: 9343080 - DNA, 22 bp, Homo sapiens
cctagcagggaagcagtgagga

SEQ ID NO: 9343081 - DNA, 22 bp, Homo sapiens
cctagccttcggcctacccatc

SEQ ID NO: 9343082 - DNA, 22 bp, Homo sapiens
cctagactagaggcagggagcc

SEQ ID NO: 9343083 - DNA, 22 bp, Homo sapiens
cctagagctctgctttatctaa

SEQ ID NO: 9343084 - DNA, 19 bp, Homo sapiens
cctagagggaaggcaggac

SEQ ID NO: 9343085 - DNA, 19 bp, Homo sapiens
tggcagaggcagtttgtac

SEQ ID NO: 9343086 - DNA, 22 bp, Homo sapiens
tggcagaggctctgtgatgttg

SEQ ID NO: 9343087 - DNA, 19 bp, Homo sapiens
tggcagaggcagtttgtac

SEQ ID NO: 9343088 - DNA, 22 bp, Homo sapiens
tggcagaggaggctcagattga

SEQ ID NO: 9343089 - DNA, 22 bp, Homo sapiens
tggcagaggagaattaagatta

SEQ ID NO: 9343090 - DNA, 22 bp, Homo sapiens
tggcagaggctctgtgatgttg

SEQ ID NO: 9343091 - DNA, 22 bp, Homo sapiens
tggcagaggctctgtgatgttg

SEQ ID NO: 9343092 - DNA, 22 bp, Homo sapiens
cctaaatagagtcagatgtaat

SEQ ID NO: 9343093 - DNA, 22 bp, Homo sapiens
cctcagaggtgaacatcagtgc

SEQ ID NO: 9343094 - DNA, 22 bp, Homo sapiens
cctcagaggttctgtgtgggaa

SEQ ID NO: 9343095 - DNA, 22 bp, Homo sapiens
cctcagaggtgtggcatctctg

SEQ ID NO: 9343096 - DNA, 22 bp, Homo sapiens
cctcagaggcagatggtaagaa

SEQ ID NO: 9343097 - DNA, 22 bp, Homo sapiens
cctcagaggcatggttagaata

SEQ ID NO: 9343098 - DNA, 23 bp, Homo sapiens
cctcagaggcctcatagtctggc

SEQ ID NO: 9343099 - DNA, 22 bp, Homo sapiens
cctcagaatagtcctcagatca

SEQ ID NO: 9343100 - DNA, 22 bp, Homo sapiens
tggcaggtacccattggctgta

SEQ ID NO: 9343101 - DNA, 18 bp, Homo sapiens
tggcaggtagactcaggt

SEQ ID NO: 9343102 - DNA, 22 bp, Homo sapiens
tggcaggtacccattggctgta

SEQ ID NO: 9343103 - DNA, 22 bp, Homo sapiens
tggcaggtacccattggctgta

SEQ ID NO: 9343104 - DNA, 22 bp, Homo sapiens
tggcaggtagagttctgagatg

SEQ ID NO: 9343105 - DNA, 18 bp, Homo sapiens
tggcaggtagactcaggt

SEQ ID NO: 9343106 - DNA, 18 bp, Homo sapiens
tggcaggtagactcaggt

SEQ ID NO: 9343107 - DNA, 22 bp, Homo sapiens
tggcaggtagagttctgagatg

SEQ ID NO: 9343108 - DNA, 22 bp, Homo sapiens
tggcaggtagagttctgagatg

SEQ ID NO: 9343109 - DNA, 22 bp, Homo sapiens
tggcaggtagtcagaggcgaca

SEQ ID NO: 9343110 - DNA, 22 bp, Homo sapiens
cctcagaaggacaagagacaaa

SEQ ID NO: 9343111 - DNA, 22 bp, Homo sapiens
cctaggcaagagttggtgtgga

SEQ ID NO: 9343112 - DNA, 22 bp, Homo sapiens
cctaggcacccgagttatgttc

SEQ ID NO: 9343113 - DNA, 22 bp, Homo sapiens
cctaggagttcgaagctgcagt

SEQ ID NO: 9343114 - DNA, 22 bp, Homo sapiens
cctaggagttgaggtggccaga

SEQ ID NO: 9343115 - DNA, 22 bp, Homo sapiens
cctaggagttcgaagctgcagt

SEQ ID NO: 9343116 - DNA, 22 bp, Homo sapiens
tggcagggttggccaccttacc

SEQ ID NO: 9343117 - DNA, 22 bp, Homo sapiens
tggcagggttggccaccttacc

SEQ ID NO: 9343118 - DNA, 22 bp, Homo sapiens
tggcagggtgggcttcagcccc

SEQ ID NO: 9343119 - DNA, 22 bp, Homo sapiens
tggcagggtgggcttcagcccc

SEQ ID NO: 9343120 - DNA, 22 bp, Homo sapiens
tggcagggtgggcttcagcccc

SEQ ID NO: 9343121 - DNA, 22 bp, Homo sapiens
tggcagggtgggcttcagcccc

SEQ ID NO: 9343122 - DNA, 22 bp, Homo sapiens
cctcattagctgttatttattg

SEQ ID NO: 9343123 - DNA, 22 bp, Homo sapiens
cctcatggccttgagctgaggg

SEQ ID NO: 9343124 - DNA, 22 bp, Homo sapiens
cctcatgctgcatctctgaggt

SEQ ID NO: 9343125 - DNA, 22 bp, Homo sapiens
cctcatggccttgagctgaggg

SEQ ID NO: 9343126 - DNA, 22 bp, Homo sapiens
cctccaaggtgagagaggatgg

SEQ ID NO: 9343127 - DNA, 22 bp, Homo sapiens
cctccaagctggtcctctgtgt

SEQ ID NO: 9343128 - DNA, 22 bp, Homo sapiens
tggcctggctgccctgtctgga

SEQ ID NO: 9343129 - DNA, 22 bp, Homo sapiens
tggcctggctcacagtgagatt

SEQ ID NO: 9343130 - DNA, 22 bp, Homo sapiens
tggcctggctgccctgtctgga

SEQ ID NO: 9343131 - DNA, 18 bp, Homo sapiens
cctcagggagagagacgc

SEQ ID NO: 9343132 - DNA, 18 bp, Homo sapiens
cctcagggagagagacgc

SEQ ID NO: 9343133 - DNA, 18 bp, Homo sapiens
cctcagggagagagacgc

SEQ ID NO: 9343134 - DNA, 22 bp, Homo sapiens
cctcagggactccatgctgcag

SEQ ID NO: 9343135 - DNA, 22 bp, Homo sapiens
cctcagttttctcatctgtaaa

SEQ ID NO: 9343136 - DNA, 22 bp, Homo sapiens
cctcagtttatcctctgtaaca

SEQ ID NO: 9343137 - DNA, 22 bp, Homo sapiens
cctcatctgtcatcctagggaa

SEQ ID NO: 9343138 - DNA, 22 bp, Homo sapiens
cctcagtgtgcagcagcatctg

SEQ ID NO: 9343139 - DNA, 22 bp, Homo sapiens
tggcctggggaagaccatgggc

SEQ ID NO: 9343140 - DNA, 22 bp, Homo sapiens
tggcctggggacctgtgagacc

SEQ ID NO: 9343141 - DNA, 22 bp, Homo sapiens
tggcctggggacctgtgagacc

SEQ ID NO: 9343142 - DNA, 22 bp, Homo sapiens
tggcctgggcctgccggtgcaa

SEQ ID NO: 9343143 - DNA, 22 bp, Homo sapiens
tggcctgggccggcagatatac

SEQ ID NO: 9343144 - DNA, 22 bp, Homo sapiens
tggcctgggcatgaagcatcgt

SEQ ID NO: 9343145 - DNA, 22 bp, Homo sapiens
tggctctgaccaggtagaggag

SEQ ID NO: 9343146 - DNA, 22 bp, Homo sapiens
tggctctgagacacaggctctc

SEQ ID NO: 9343147 - DNA, 21 bp, Homo sapiens
tggctctgggtaggagagtgc

SEQ ID NO: 9343148 - DNA, 22 bp, Homo sapiens
tggctctggggacagtaagtcc

SEQ ID NO: 9343149 - DNA, 22 bp, Homo sapiens
tggctctgagacacaggctctc

SEQ ID NO: 9343150 - DNA, 21 bp, Homo sapiens
tggctctgggtaggagagtgc

SEQ ID NO: 9343151 - DNA, 22 bp, Homo sapiens
tggctctggtaacattgggtag

SEQ ID NO: 9343152 - DNA, 21 bp, Homo sapiens
tggctctgggtaggagagtgc

SEQ ID NO: 9343153 - DNA, 21 bp, Homo sapiens
tggctctgggtaggagagtgc

SEQ ID NO: 9343154 - DNA, 22 bp, Homo sapiens
tggctctgtcaaactgcacaca

SEQ ID NO: 9343155 - DNA, 22 bp, Homo sapiens
tggctctgtcaaactgcacaca

SEQ ID NO: 9343156 - DNA, 22 bp, Homo sapiens
tggctctgtcactgtgagctat

SEQ ID NO: 9343157 - DNA, 22 bp, Homo sapiens
tggctctgtcaaactgcacaca

SEQ ID NO: 9343158 - DNA, 22 bp, Homo sapiens
tggctctggtgcgggctcctgc

SEQ ID NO: 9343159 - DNA, 22 bp, Homo sapiens
tggctctggtgcgggctcctgc

SEQ ID NO: 9343160 - DNA, 22 bp, Homo sapiens
cctcaggctagctactgtccct

SEQ ID NO: 9343161 - DNA, 22 bp, Homo sapiens
cctcaggctagctactgtccct

SEQ ID NO: 9343162 - DNA, 22 bp, Homo sapiens
cctcaggcctctgcctcattgg

SEQ ID NO: 9343163 - DNA, 22 bp, Homo sapiens
cctcaggcctctgcctcattgg

SEQ ID NO: 9343164 - DNA, 22 bp, Homo sapiens
cctcaggcctgccagagcccca

SEQ ID NO: 9343165 - DNA, 22 bp, Homo sapiens
cctcaggcctgccagagcccca

SEQ ID NO: 9343166 - DNA, 22 bp, Homo sapiens
cctcaggcctgccagagcccca

SEQ ID NO: 9343167 - DNA, 22 bp, Homo sapiens
cctcaggctgctcacacttgtc

SEQ ID NO: 9343168 - DNA, 22 bp, Homo sapiens
cctcaggctctgggtgcctacc

SEQ ID NO: 9343169 - DNA, 22 bp, Homo sapiens
cctcaggctctgggtgcctacc

SEQ ID NO: 9343170 - DNA, 22 bp, Homo sapiens
cctcaggctctgggtgcctacc

SEQ ID NO: 9343171 - DNA, 22 bp, Homo sapiens
cctcaggctgtcttccttctgg

SEQ ID NO: 9343172 - DNA, 22 bp, Homo sapiens
cctcaggctgggctgcccctgg

SEQ ID NO: 9343173 - DNA, 22 bp, Homo sapiens
cctcaggctgggctgcccctgg

SEQ ID NO: 9343174 - DNA, 22 bp, Homo sapiens
cctcaggcttaacttgtcttga

SEQ ID NO: 9343175 - DNA, 22 bp, Homo sapiens
cctcaggcttacgggcaatgga

SEQ ID NO: 9343176 - DNA, 22 bp, Homo sapiens
cctcaggcttaacttgtcttga

SEQ ID NO: 9343177 - DNA, 22 bp, Homo sapiens
cctcaggctgtcttccttctgg

SEQ ID NO: 9343178 - DNA, 22 bp, Homo sapiens
cctcaggcttctagttcagtga

SEQ ID NO: 9343179 - DNA, 22 bp, Homo sapiens
cctcaggcttcgtcttccaccc

SEQ ID NO: 9343180 - DNA, 22 bp, Homo sapiens
cctcaggcttcgtcttccaccc

SEQ ID NO: 9343181 - DNA, 22 bp, Homo sapiens
cctcaggcttacgggcaatgga

SEQ ID NO: 9343182 - DNA, 22 bp, Homo sapiens
cctcagggaatgggaggctggg

SEQ ID NO: 9343183 - DNA, 22 bp, Homo sapiens
cctcagggaatgggaggctggg

SEQ ID NO: 9343184 - DNA, 22 bp, Homo sapiens
cctcaggcttgtgagccttcag

SEQ ID NO: 9343185 - DNA, 22 bp, Homo sapiens
cctcaggcttctagttcagtga

SEQ ID NO: 9343186 - DNA, 17 bp, Homo sapiens
cctcagcttctttcctc

SEQ ID NO: 9343187 - DNA, 17 bp, Homo sapiens
cctcagcttctttcctc

SEQ ID NO: 9343188 - DNA, 20 bp, Homo sapiens
tggcccagcacgacgaggac

SEQ ID NO: 9343189 - DNA, 20 bp, Homo sapiens
tggcccagcacgacgaggac

SEQ ID NO: 9343190 - DNA, 22 bp, Homo sapiens
tggcccagatctctgaccttga

SEQ ID NO: 9343191 - DNA, 22 bp, Homo sapiens
tggcccagagcactgctgggca

SEQ ID NO: 9343192 - DNA, 19 bp, Homo sapiens
tggcccagatggtcctggg

SEQ ID NO: 9343193 - DNA, 19 bp, Homo sapiens
tggcccagatggtcctggg

SEQ ID NO: 9343194 - DNA, 22 bp, Homo sapiens
tggcccagatctctgaccttga

SEQ ID NO: 9343195 - DNA, 22 bp, Homo sapiens
cctcagagtttaagatgtcaga

SEQ ID NO: 9343196 - DNA, 22 bp, Homo sapiens
cctcagagtttaagatgtcaga

SEQ ID NO: 9343197 - DNA, 22 bp, Homo sapiens
cctcagcagacacgcttctcac

SEQ ID NO: 9343198 - DNA, 22 bp, Homo sapiens
cctcagcagacacgcttctcac

SEQ ID NO: 9343199 - DNA, 22 bp, Homo sapiens
cctcagcagacacgcttctcac

SEQ ID NO: 9343200 - DNA, 22 bp, Homo sapiens
cctcagcagacacgcttctcac

SEQ ID NO: 9343201 - DNA, 22 bp, Homo sapiens
cctcagcatcctcatgctcagt

SEQ ID NO: 9343202 - DNA, 22 bp, Homo sapiens
cctcagcatcctcctgctcagt

SEQ ID NO: 9343203 - DNA, 22 bp, Homo sapiens
cctcagcatcctcctgctcagt

SEQ ID NO: 9343204 - DNA, 22 bp, Homo sapiens
tggcccagagcactgctgggca

SEQ ID NO: 9343205 - DNA, 22 bp, Homo sapiens
cctcagagttggaatcacattt

SEQ ID NO: 9343206 - DNA, 22 bp, Homo sapiens
cctcagagttggccacgagagc

SEQ ID NO: 9343207 - DNA, 22 bp, Homo sapiens
cctcagagttggaatcacattt

SEQ ID NO: 9343208 - DNA, 22 bp, Homo sapiens
cctcagagttatttgaagtgaa

SEQ ID NO: 9343209 - DNA, 22 bp, Homo sapiens
cctcagagttatttgaagtgaa

SEQ ID NO: 9343210 - DNA, 22 bp, Homo sapiens
cctcagaggttttcattctgta

SEQ ID NO: 9343211 - DNA, 22 bp, Homo sapiens
cctcagagtctagtaaataata

SEQ ID NO: 9343212 - DNA, 22 bp, Homo sapiens
cctcagagtaggtctcagctgt

SEQ ID NO: 9343213 - DNA, 22 bp, Homo sapiens
cctcagagtaggtctcagctgt

SEQ ID NO: 9343214 - DNA, 20 bp, Homo sapiens
cctctgcctttctagtctga

SEQ ID NO: 9343215 - DNA, 20 bp, Homo sapiens
cctctgcctttctagtctga

SEQ ID NO: 9343216 - DNA, 19 bp, Homo sapiens
cctctgctccagtttcctt

SEQ ID NO: 9343217 - DNA, 21 bp, Homo sapiens
cctctgctcgggcatgcgttt

SEQ ID NO: 9343218 - DNA, 21 bp, Homo sapiens
cctctgctcgggcatgcgttt

SEQ ID NO: 9343219 - DNA, 22 bp, Homo sapiens
cctctgctctggtccatgtgct

SEQ ID NO: 9343220 - DNA, 22 bp, Homo sapiens
cctctgctctggtccatgtgct

SEQ ID NO: 9343221 - DNA, 22 bp, Homo sapiens
cctctgctctggtccatgtgct

SEQ ID NO: 9343222 - DNA, 22 bp, Homo sapiens
cctctgctctggtccatgtgct

SEQ ID NO: 9343223 - DNA, 22 bp, Homo sapiens
cctctgctctggtccatgtgct

SEQ ID NO: 9343224 - DNA, 19 bp, Homo sapiens
tggcttccatctctctcat

SEQ ID NO: 9343225 - DNA, 22 bp, Homo sapiens
tggcttccagagctgctccacc

SEQ ID NO: 9343226 - DNA, 22 bp, Homo sapiens
tggcttccagagctgctccacc

SEQ ID NO: 9343227 - DNA, 22 bp, Homo sapiens
cctctgcccttttcctgtatca

SEQ ID NO: 9343228 - DNA, 22 bp, Homo sapiens
cctctgcctgcacatcatcctg

SEQ ID NO: 9343229 - DNA, 22 bp, Homo sapiens
tgggaaggacgtgtcagtggca

SEQ ID NO: 9343230 - DNA, 22 bp, Homo sapiens
tgggaaggacgtgtcagtggca

SEQ ID NO: 9343231 - DNA, 22 bp, Homo sapiens
tgggaaggacgtgtcagtggca

SEQ ID NO: 9343232 - DNA, 22 bp, Homo sapiens
tgggaaggatacgttacaagat

SEQ ID NO: 9343233 - DNA, 22 bp, Homo sapiens
tgggaaggatacgttacaagat

SEQ ID NO: 9343234 - DNA, 22 bp, Homo sapiens
tgggaaggcagtcactgtccta

SEQ ID NO: 9343235 - DNA, 22 bp, Homo sapiens
tgggaaggataccttggaacat

SEQ ID NO: 9343236 - DNA, 22 bp, Homo sapiens
tgggaaggataccttggaacat

SEQ ID NO: 9343237 - DNA, 22 bp, Homo sapiens
tgggaaggataccttggaacat

SEQ ID NO: 9343238 - DNA, 22 bp, Homo sapiens
cctcttccagctgttgcttcca

SEQ ID NO: 9343239 - DNA, 19 bp, Homo sapiens
cctctgtgggagtcagtga

SEQ ID NO: 9343240 - DNA, 19 bp, Homo sapiens
cctctgtgggagtcagtga

SEQ ID NO: 9343241 - DNA, 19 bp, Homo sapiens
cctctgtgggagtcagtga

SEQ ID NO: 9343242 - DNA, 22 bp, Homo sapiens
cctctgtggccctgactctctt

SEQ ID NO: 9343243 - DNA, 22 bp, Homo sapiens
tgggaagctttaaatgggtgtc

SEQ ID NO: 9343244 - DNA, 22 bp, Homo sapiens
tgggaaggaactgcctttagct

SEQ ID NO: 9343245 - DNA, 22 bp, Homo sapiens
tgggaaggaactgcctttagct

SEQ ID NO: 9343246 - DNA, 22 bp, Homo sapiens
tgggaaggacagaacataattg

SEQ ID NO: 9343247 - DNA, 22 bp, Homo sapiens
tgggaaggacagaacataattg

SEQ ID NO: 9343248 - DNA, 22 bp, Homo sapiens
tgggaaggaatggtgattaata

SEQ ID NO: 9343249 - DNA, 22 bp, Homo sapiens
tgggaaggaatggtgattaata

SEQ ID NO: 9343250 - DNA, 22 bp, Homo sapiens
tgggaagctgcattttaacaag

SEQ ID NO: 9343251 - DNA, 22 bp, Homo sapiens
tgggaagctactcatgcaggca

SEQ ID NO: 9343252 - DNA, 22 bp, Homo sapiens
tgggaagctgcattttaacaag

SEQ ID NO: 9343253 - DNA, 22 bp, Homo sapiens
cctctggagtcagaccagcttg

SEQ ID NO: 9343254 - DNA, 22 bp, Homo sapiens
cctctggacttgggacagtgag

SEQ ID NO: 9343255 - DNA, 22 bp, Homo sapiens
tggctggctgtcagtaggctgt

SEQ ID NO: 9343256 - DNA, 22 bp, Homo sapiens
tggctggctgtcagtaggctgt

SEQ ID NO: 9343257 - DNA, 22 bp, Homo sapiens
tggctggctgtccagctgggca

SEQ ID NO: 9343258 - DNA, 22 bp, Homo sapiens
tggctggctgtccagctgggca

SEQ ID NO: 9343259 - DNA, 22 bp, Homo sapiens
tggctggctgtccagctgggca

SEQ ID NO: 9343260 - DNA, 22 bp, Homo sapiens
tggctggctgtcagtaggctgt

SEQ ID NO: 9343261 - DNA, 22 bp, Homo sapiens
tggctggctgtcaaggaaagcc

SEQ ID NO: 9343262 - DNA, 22 bp, Homo sapiens
tggctggctgtcaaggaaagcc

SEQ ID NO: 9343263 - DNA, 22 bp, Homo sapiens
tggctggctggaccacacctgc

SEQ ID NO: 9343264 - DNA, 20 bp, Homo sapiens
tggctggcttgtatttcctt

SEQ ID NO: 9343265 - DNA, 22 bp, Homo sapiens
tggctggctgtccagctgggca

SEQ ID NO: 9343266 - DNA, 22 bp, Homo sapiens
tggctggcttgttcactgactg

SEQ ID NO: 9343267 - DNA, 22 bp, Homo sapiens
tggctggcttgttcactgactg

SEQ ID NO: 9343268 - DNA, 22 bp, Homo sapiens
tggctggcttgttcactgactg

SEQ ID NO: 9343269 - DNA, 22 bp, Homo sapiens
tggctggcttgttcactgactg

SEQ ID NO: 9343270 - DNA, 22 bp, Homo sapiens
tggctgggagctggaactgggc

SEQ ID NO: 9343271 - DNA, 22 bp, Homo sapiens
tggctggctttcttgtatttac

SEQ ID NO: 9343272 - DNA, 22 bp, Homo sapiens
tggcttcatggctgtgcaatct

SEQ ID NO: 9343273 - DNA, 22 bp, Homo sapiens
tggcttcattattgtttttcct

SEQ ID NO: 9343274 - DNA, 22 bp, Homo sapiens
tggcttcatctgcagcactgcc

SEQ ID NO: 9343275 - DNA, 22 bp, Homo sapiens
tggcttcagggttgtcttcagc

SEQ ID NO: 9343276 - DNA, 17 bp, Homo sapiens
tggctctgtcctcagct

SEQ ID NO: 9343277 - DNA, 17 bp, Homo sapiens
tggctctgtcctcagct

SEQ ID NO: 9343278 - DNA, 22 bp, Homo sapiens
tggctctgtcactgtgagctat

SEQ ID NO: 9343279 - DNA, 17 bp, Homo sapiens
tggctctgtcctcagct

SEQ ID NO: 9343280 - DNA, 19 bp, Homo sapiens
tggctctgtcgaaggcaca

SEQ ID NO: 9343281 - DNA, 17 bp, Homo sapiens
tggctctgtcctcagct

SEQ ID NO: 9343282 - DNA, 17 bp, Homo sapiens
tggctctgtcctcagct

SEQ ID NO: 9343283 - DNA, 19 bp, Homo sapiens
tggctctgtcgaaggcaca

SEQ ID NO: 9343284 - DNA, 19 bp, Homo sapiens
tggctctgtcgaaggcaca

SEQ ID NO: 9343285 - DNA, 22 bp, Homo sapiens
tggctgagaatgggatgatgcc

SEQ ID NO: 9343286 - DNA, 22 bp, Homo sapiens
tggctgagaagttctggtggga

SEQ ID NO: 9343287 - DNA, 22 bp, Homo sapiens
tggctgagaccatcagggtgta

SEQ ID NO: 9343288 - DNA, 22 bp, Homo sapiens
tggctgagaccatcagggtgta

SEQ ID NO: 9343289 - DNA, 22 bp, Homo sapiens
tggctgagaatgggatgatgcc

SEQ ID NO: 9343290 - DNA, 22 bp, Homo sapiens
tggctgagaccatcagggtgta

SEQ ID NO: 9343291 - DNA, 18 bp, Homo sapiens
tggctggctctgtcatct

SEQ ID NO: 9343292 - DNA, 22 bp, Homo sapiens
tggctggctggaccacacctgc

SEQ ID NO: 9343293 - DNA, 18 bp, Homo sapiens
tggctggctctgtcatct

SEQ ID NO: 9343294 - DNA, 22 bp, Homo sapiens
tggctggctggaccacacctgc

SEQ ID NO: 9343295 - DNA, 22 bp, Homo sapiens
tggctgctcaagggaggaggct

SEQ ID NO: 9343296 - DNA, 22 bp, Homo sapiens
tggctggctagtgggcaggatt

SEQ ID NO: 9343297 - DNA, 16 bp, Homo sapiens
tggctgagagagggtt

SEQ ID NO: 9343298 - DNA, 22 bp, Homo sapiens
tggctgctagccagagcttcag

SEQ ID NO: 9343299 - DNA, 22 bp, Homo sapiens
tggctgagagaagacggggaag

SEQ ID NO: 9343300 - DNA, 22 bp, Homo sapiens
tggctgagagaagacggggaag

SEQ ID NO: 9343301 - DNA, 16 bp, Homo sapiens
tggctgagagagggtt

SEQ ID NO: 9343302 - DNA, 22 bp, Homo sapiens
tggctgagaccatcagggtgta

SEQ ID NO: 9343303 - DNA, 22 bp, Homo sapiens
tggctgagaccttcccaaattc

SEQ ID NO: 9343304 - DNA, 22 bp, Homo sapiens
tggctgagaccttcccaaattc

SEQ ID NO: 9343305 - DNA, 22 bp, Homo sapiens
tggctgagagaagacggggaag

SEQ ID NO: 9343306 - DNA, 22 bp, Homo sapiens
tggctgagaccttcccaaattc

SEQ ID NO: 9343307 - DNA, 22 bp, Homo sapiens
cctgagcctgcagccgagcaga

SEQ ID NO: 9343308 - DNA, 22 bp, Homo sapiens
tgggccagtttctcattgaaat

SEQ ID NO: 9343309 - DNA, 22 bp, Homo sapiens
cctgagcctggctcatgcactc

SEQ ID NO: 9343310 - DNA, 22 bp, Homo sapiens
cctgagcagctctgaggggcga

SEQ ID NO: 9343311 - DNA, 22 bp, Homo sapiens
cctgagcagggctctgcagggc

SEQ ID NO: 9343312 - DNA, 18 bp, Homo sapiens
cctgagccctgcttactt

SEQ ID NO: 9343313 - DNA, 22 bp, Homo sapiens
cctgagcctcttgcacgctcag

SEQ ID NO: 9343314 - DNA, 22 bp, Homo sapiens
cctgagccgagcgctctttctc

SEQ ID NO: 9343315 - DNA, 22 bp, Homo sapiens
cctgagatttgtaatttttgta

SEQ ID NO: 9343316 - DNA, 22 bp, Homo sapiens
cctgagatggccagtgctggga

SEQ ID NO: 9343317 - DNA, 22 bp, Homo sapiens
tgggagtttgttagaaatgcag

SEQ ID NO: 9343318 - DNA, 22 bp, Homo sapiens
cctgagatcagtgcatttggtg

SEQ ID NO: 9343319 - DNA, 22 bp, Homo sapiens
tgggagttaacattggtctctg

SEQ ID NO: 9343320 - DNA, 22 bp, Homo sapiens
tgggagtgttcttggcttgctt

SEQ ID NO: 9343321 - DNA, 23 bp, Homo sapiens
tgggagttgagtgaggttgcttt

SEQ ID NO: 9343322 - DNA, 22 bp, Homo sapiens
tgggagttgggtgggagacttc

SEQ ID NO: 9343323 - DNA, 22 bp, Homo sapiens
tgggagttgggcagaacaagtg

SEQ ID NO: 9343324 - DNA, 22 bp, Homo sapiens
tgggagttagttatactgtgac

SEQ ID NO: 9343325 - DNA, 22 bp, Homo sapiens
tgggagttcacgtgatattcac

SEQ ID NO: 9343326 - DNA, 22 bp, Homo sapiens
tgggagttgagacattttgccc

SEQ ID NO: 9343327 - DNA, 22 bp, Homo sapiens
cctcttctcaactccagccaga

SEQ ID NO: 9343328 - DNA, 22 bp, Homo sapiens
cctcttctcaactccagccaga

SEQ ID NO: 9343329 - DNA, 19 bp, Homo sapiens
cctcttctctggcagcaga

SEQ ID NO: 9343330 - DNA, 18 bp, Homo sapiens
tgggagtgggagtggata

SEQ ID NO: 9343331 - DNA, 19 bp, Homo sapiens
tgggagtggggaaggtcct

SEQ ID NO: 9343332 - DNA, 19 bp, Homo sapiens
tgggagtggggaaggtcct

SEQ ID NO: 9343333 - DNA, 22 bp, Homo sapiens
tgggagtggggcatagaaggta

SEQ ID NO: 9343334 - DNA, 22 bp, Homo sapiens
tgggagtggggcatagaaggta

SEQ ID NO: 9343335 - DNA, 19 bp, Homo sapiens
tgggagtggggaaggtcct

SEQ ID NO: 9343336 - DNA, 22 bp, Homo sapiens
tgggagtgttcttggcttgctt

SEQ ID NO: 9343337 - DNA, 22 bp, Homo sapiens
tgggagtgttcttggcttgctt

SEQ ID NO: 9343338 - DNA, 22 bp, Homo sapiens
tgggagtggggcatagaaggta

SEQ ID NO: 9343339 - DNA, 22 bp, Homo sapiens
cctcttctaggtttcagcctgc

SEQ ID NO: 9343340 - DNA, 22 bp, Homo sapiens
cctcttctcaactccagccaga

SEQ ID NO: 9343341 - DNA, 22 bp, Homo sapiens
cctcttctaggtttcagcctgc

SEQ ID NO: 9343342 - DNA, 22 bp, Homo sapiens
cctcttctaggtttcagcctgc

SEQ ID NO: 9343343 - DNA, 22 bp, Homo sapiens
cctcttctaggacgtccttgtg

SEQ ID NO: 9343344 - DNA, 22 bp, Homo sapiens
cctcttctaggacgtccttgtg

SEQ ID NO: 9343345 - DNA, 22 bp, Homo sapiens
cctcttctaggacgtccttgtg

SEQ ID NO: 9343346 - DNA, 22 bp, Homo sapiens
cctcttctaccatttacatttt

SEQ ID NO: 9343347 - DNA, 17 bp, Homo sapiens
cctcttcctctcagctg

SEQ ID NO: 9343348 - DNA, 17 bp, Homo sapiens
cctcttcctctcagctg

SEQ ID NO: 9343349 - DNA, 19 bp, Homo sapiens
cctcttcctctgacactat

SEQ ID NO: 9343350 - DNA, 22 bp, Homo sapiens
cctgagcctggctcatgcactc

SEQ ID NO: 9343351 - DNA, 21 bp, Homo sapiens
cctgagcctgtttatccagaa

SEQ ID NO: 9343352 - DNA, 21 bp, Homo sapiens
cctgagcctgtttatccagaa

SEQ ID NO: 9343353 - DNA, 22 bp, Homo sapiens
tgggctggcccaccacacctcg

SEQ ID NO: 9343354 - DNA, 22 bp, Homo sapiens
tgggctgcttcctcagctgaga

SEQ ID NO: 9343355 - DNA, 22 bp, Homo sapiens
tgggctgcttcctcagctgaga

SEQ ID NO: 9343356 - DNA, 22 bp, Homo sapiens
tgggctggagcttgttgcttcc

SEQ ID NO: 9343357 - DNA, 22 bp, Homo sapiens
tgggctggcccaccacacctcg

SEQ ID NO: 9343358 - DNA, 22 bp, Homo sapiens
tgggctggagcttgttgcttcc

SEQ ID NO: 9343359 - DNA, 22 bp, Homo sapiens
tgggctggagcttgttgcttcc

SEQ ID NO: 9343360 - DNA, 22 bp, Homo sapiens
tgggctggagcttgttgcttcc

SEQ ID NO: 9343361 - DNA, 22 bp, Homo sapiens
cctgagctcaaagggtgcctgg

SEQ ID NO: 9343362 - DNA, 22 bp, Homo sapiens
cctgagctcaagaaggtgacca

SEQ ID NO: 9343363 - DNA, 22 bp, Homo sapiens
cctgagctccagtagcagccag

SEQ ID NO: 9343364 - DNA, 22 bp, Homo sapiens
tggggagcccactcacctcccc

SEQ ID NO: 9343365 - DNA, 22 bp, Homo sapiens
cctgagctgcggggcagtgctc

SEQ ID NO: 9343366 - DNA, 22 bp, Homo sapiens
cctgagctgcggggcagtgctc

SEQ ID NO: 9343367 - DNA, 22 bp, Homo sapiens
tgggctgctgtctgcacatgct

SEQ ID NO: 9343368 - DNA, 22 bp, Homo sapiens
tgggctgctgagaatgagagag

SEQ ID NO: 9343369 - DNA, 22 bp, Homo sapiens
tgggctgctgagaatgagagag

SEQ ID NO: 9343370 - DNA, 22 bp, Homo sapiens
tgggctgctgtctgcacatgct

SEQ ID NO: 9343371 - DNA, 22 bp, Homo sapiens
tgggctgctgttacaggggctg

SEQ ID NO: 9343372 - DNA, 22 bp, Homo sapiens
tgggctctagactttagtgtgg

SEQ ID NO: 9343373 - DNA, 18 bp, Homo sapiens
tgggctgcctggcctctg

SEQ ID NO: 9343374 - DNA, 22 bp, Homo sapiens
tgggccctgcccttgtctgtcc

SEQ ID NO: 9343375 - DNA, 23 bp, Homo sapiens
tgggccctggagtcgccagtctg

SEQ ID NO: 9343376 - DNA, 22 bp, Homo sapiens
tgggccctggtggccatgcctc

SEQ ID NO: 9343377 - DNA, 22 bp, Homo sapiens
tgggccctgacttcaagcatcc

SEQ ID NO: 9343378 - DNA, 22 bp, Homo sapiens
tgggcccaagagagtctccaac

SEQ ID NO: 9343379 - DNA, 22 bp, Homo sapiens
ttgcaactaaaagaacttgaca

SEQ ID NO: 9343380 - DNA, 22 bp, Homo sapiens
ttgcaacacaaagtttgattcc

SEQ ID NO: 9343381 - DNA, 21 bp, Homo sapiens
ttgcaacaacctatatatttt

SEQ ID NO: 9343382 - DNA, 22 bp, Homo sapiens
ttgcaaggtgataaaagaatga

SEQ ID NO: 9343383 - DNA, 22 bp, Homo sapiens
ttgcaagttaaaaattattagt

SEQ ID NO: 9343384 - DNA, 22 bp, Homo sapiens
ttgcaaggtttctctctgccta

SEQ ID NO: 9343385 - DNA, 22 bp, Homo sapiens
ttgcaagttccttatgagaatc

SEQ ID NO: 9343386 - DNA, 22 bp, Homo sapiens
ttgcaatagccttatttccaaa

SEQ ID NO: 9343387 - DNA, 22 bp, Homo sapiens
ttgcaagttttacttacctgga

SEQ ID NO: 9343388 - DNA, 16 bp, Homo sapiens
ttgcaaggcgtttata

SEQ ID NO: 9343389 - DNA, 22 bp, Homo sapiens
ttgcaaggctaggttcacccac

SEQ ID NO: 9343390 - DNA, 22 bp, Homo sapiens
ttgcaagggcatgtgtgcgtgt

SEQ ID NO: 9343391 - DNA, 22 bp, Homo sapiens
ttgcaagggataccatactaag

SEQ ID NO: 9343392 - DNA, 22 bp, Homo sapiens
ttgcaagggtgttttgaggtgt

SEQ ID NO: 9343393 - DNA, 22 bp, Homo sapiens
ttgcaaggtcatcatgcattgg

SEQ ID NO: 9343394 - DNA, 22 bp, Homo sapiens
ttgcaaggagccactctgcctg

SEQ ID NO: 9343395 - DNA, 20 bp, Homo sapiens
ttgcaagctttcaagatagc

SEQ ID NO: 9343396 - DNA, 22 bp, Homo sapiens
ttgcaagacacttggaagcaca

SEQ ID NO: 9343397 - DNA, 22 bp, Homo sapiens
ttggggtgttcagggtacttct

SEQ ID NO: 9343398 - DNA, 22 bp, Homo sapiens
ttggggtgttggatggagcaag

SEQ ID NO: 9343399 - DNA, 22 bp, Homo sapiens
ttggggtggaagtgaggatcat

SEQ ID NO: 9343400 - DNA, 22 bp, Homo sapiens
ttggtcagtcagagaatggagt

SEQ ID NO: 9343401 - DNA, 22 bp, Homo sapiens
ttggtcctggtctaggcagagt

SEQ ID NO: 9343402 - DNA, 18 bp, Homo sapiens
ttggtctgggtggaaacc

SEQ ID NO: 9343403 - DNA, 22 bp, Homo sapiens
ttggtctgtagttttcttatgt

SEQ ID NO: 9343404 - DNA, 22 bp, Homo sapiens
ttggtctgtagttttcttatgt

SEQ ID NO: 9343405 - DNA, 22 bp, Homo sapiens
ttggtctgcagggagggctgga

SEQ ID NO: 9343406 - DNA, 22 bp, Homo sapiens
ttggtctgctctgatgttttct

SEQ ID NO: 9343407 - DNA, 22 bp, Homo sapiens
ttggtctggagtatgatgataa

SEQ ID NO: 9343408 - DNA, 22 bp, Homo sapiens
ttggtctgtgttacatcattta

SEQ ID NO: 9343409 - DNA, 22 bp, Homo sapiens
ttggtgtgccagagctgacatg

SEQ ID NO: 9343410 - DNA, 23 bp, Homo sapiens
ttggtgtcagggaactttggaat

SEQ ID NO: 9343411 - DNA, 22 bp, Homo sapiens
ttggtgggttaatgagtgactg

SEQ ID NO: 9343412 - DNA, 19 bp, Homo sapiens
ttggtgcacacatgggccc

SEQ ID NO: 9343413 - DNA, 22 bp, Homo sapiens
ttggtgagtatggacacagaga

SEQ ID NO: 9343414 - DNA, 22 bp, Homo sapiens
ttggtgagtgctatgtaccaca

SEQ ID NO: 9343415 - DNA, 22 bp, Homo sapiens
ttgtccttccagactcttccac

SEQ ID NO: 9343416 - DNA, 22 bp, Homo sapiens
ttgtccttagatgtggcctcca

SEQ ID NO: 9343417 - DNA, 17 bp, Homo sapiens
ttgtctacctagcagaa

SEQ ID NO: 9343418 - DNA, 22 bp, Homo sapiens
ttggtttagtacctgccagcgt

SEQ ID NO: 9343419 - DNA, 22 bp, Homo sapiens
ttggtttatttcttcctatgag

SEQ ID NO: 9343420 - DNA, 22 bp, Homo sapiens
ttggtttccttaacagcctaaa

SEQ ID NO: 9343421 - DNA, 22 bp, Homo sapiens
ttggttttatcttaagattctt

SEQ ID NO: 9343422 - DNA, 22 bp, Homo sapiens
ttggttgtgatacaagattttg

SEQ ID NO: 9343423 - DNA, 22 bp, Homo sapiens
ttggttgtgatgtcattgttac

SEQ ID NO: 9343424 - DNA, 22 bp, Homo sapiens
ttgtctctgggacatggtatta

SEQ ID NO: 9343425 - DNA, 22 bp, Homo sapiens
ttgtctctgccatgcttgaggg

SEQ ID NO: 9343426 - DNA, 22 bp, Homo sapiens
ttgtctctaagtgtgatcttca

SEQ ID NO: 9343427 - DNA, 22 bp, Homo sapiens
ttgtctctacagagagtagtag

SEQ ID NO: 9343428 - DNA, 22 bp, Homo sapiens
ttgtctatacatcaataatgat

SEQ ID NO: 9343429 - DNA, 22 bp, Homo sapiens
ttgtctatttgttcaggtaagg

SEQ ID NO: 9343430 - DNA, 22 bp, Homo sapiens
ttgtctgaatatgtatgtatcc

SEQ ID NO: 9343431 - DNA, 22 bp, Homo sapiens
ttgtgaatagtgccgcaataaa

SEQ ID NO: 9343432 - DNA, 22 bp, Homo sapiens
ttgtgaatagtgccgcaataaa

SEQ ID NO: 9343433 - DNA, 22 bp, Homo sapiens
ttgtgaatagtgccgctataaa

SEQ ID NO: 9343434 - DNA, 22 bp, Homo sapiens
ttgtgaatagtgccgctataaa

SEQ ID NO: 9343435 - DNA, 22 bp, Homo sapiens
ttgtgaaatgtttcaaaatagt

SEQ ID NO: 9343436 - DNA, 22 bp, Homo sapiens
ttgtctggtcaaatcacttgta

SEQ ID NO: 9343437 - DNA, 22 bp, Homo sapiens
ttgtgtgtgtaactttatgaga

SEQ ID NO: 9343438 - DNA, 22 bp, Homo sapiens
ttgtgtgtttgtagaaaatcca

SEQ ID NO: 9343439 - DNA, 22 bp, Homo sapiens
ttgtgttaaggtgcatctagtg

SEQ ID NO: 9343440 - DNA, 22 bp, Homo sapiens
ttgtgtgtgagccttcaccaca

SEQ ID NO: 9343441 - DNA, 22 bp, Homo sapiens
ttgtgtgtcttcttcactgccc

SEQ ID NO: 9343442 - DNA, 22 bp, Homo sapiens
ttgtgtgtcttcttcactgccc

SEQ ID NO: 9343443 - DNA, 22 bp, Homo sapiens
ttgtgaatggtgccgcaataaa

SEQ ID NO: 9343444 - DNA, 22 bp, Homo sapiens
ttgtgaatggtgccgcaataaa

SEQ ID NO: 9343445 - DNA, 19 bp, Homo sapiens
ttgtgtgtcagtcagagtt

SEQ ID NO: 9343446 - DNA, 19 bp, Homo sapiens
ttgtgtgtcagtcagagtt

SEQ ID NO: 9343447 - DNA, 22 bp, Homo sapiens
ttgttataaagactaaatatgt

SEQ ID NO: 9343448 - DNA, 22 bp, Homo sapiens
ttgttagtgcaatgtttggtga

SEQ ID NO: 9343449 - DNA, 22 bp, Homo sapiens
ttgtttaaaatgtagcaagaaa

SEQ ID NO: 9343450 - DNA, 22 bp, Homo sapiens
ttgtttaaagaacttctgactt

SEQ ID NO: 9343451 - DNA, 22 bp, Homo sapiens
ttgttatctgcgtgaagaaaat

SEQ ID NO: 9343452 - DNA, 20 bp, Homo sapiens
ttgtttaaaggtgaagaggc

SEQ ID NO: 9343453 - DNA, 22 bp, Homo sapiens
ttgtttaagccacccaatctgt

SEQ ID NO: 9343454 - DNA, 21 bp, Homo sapiens
ttgtttcccagagctcgctcc

SEQ ID NO: 9343455 - DNA, 22 bp, Homo sapiens
ttgtttccataattaagtgtga

SEQ ID NO: 9343456 - DNA, 22 bp, Homo sapiens
ttgttacagcagcaatagaaaa

SEQ ID NO: 9343457 - DNA, 22 bp, Homo sapiens
ttgttaaaaatagatttccagg

SEQ ID NO: 9343458 - DNA, 22 bp, Homo sapiens
ttgttaaaaatagatttccagg

SEQ ID NO: 9343459 - DNA, 22 bp, Homo sapiens
ttgttttaacgactcagcttgt

SEQ ID NO: 9343460 - DNA, 22 bp, Homo sapiens
ttgtttgtcataatatcattac

SEQ ID NO: 9343461 - DNA, 22 bp, Homo sapiens
ttgttttagtaggtacactgag

SEQ ID NO: 9343462 - DNA, 22 bp, Homo sapiens
ttgttttcagggtgtcattcac

SEQ ID NO: 9343463 - DNA, 22 bp, Homo sapiens
ttgttttcacagctttgcccgg

SEQ ID NO: 9343464 - DNA, 22 bp, Homo sapiens
ttgttttcctgggataccaacc

SEQ ID NO: 9343465 - DNA, 22 bp, Homo sapiens
ttgttttctccactgcatctta

SEQ ID NO: 9343466 - DNA, 22 bp, Homo sapiens
ttgtttttaaacatgtgactga

SEQ ID NO: 9343467 - DNA, 22 bp, Homo sapiens
ttgtttgaggtcactgatattt

SEQ ID NO: 9343468 - DNA, 22 bp, Homo sapiens
ttgtttgactaaattggtatca

SEQ ID NO: 9343469 - DNA, 23 bp, Homo sapiens
ttgtttctttgtattgtctctat

SEQ ID NO: 9343470 - DNA, 23 bp, Homo sapiens
ttgtttctttgtattgtctctat

SEQ ID NO: 9343471 - DNA, 22 bp, Homo sapiens
ttgtttgtaaggctcttagaat

SEQ ID NO: 9343472 - DNA, 22 bp, Homo sapiens
ttgtttctttgaagtttctaga

SEQ ID NO: 9343473 - DNA, 17 bp, Homo sapiens
ttgtttcttctctgtgg

SEQ ID NO: 9343474 - DNA, 17 bp, Homo sapiens
ttgtttcttctctgtgg

SEQ ID NO: 9343475 - DNA, 22 bp, Homo sapiens
ttgtttctgagttttcatgtat

SEQ ID NO: 9343476 - DNA, 20 bp, Homo sapiens
ttgtttctgctattttctaa

SEQ ID NO: 9343477 - DNA, 22 bp, Homo sapiens
ttgtttctccagtctaggaaaa

SEQ ID NO: 9343478 - DNA, 22 bp, Homo sapiens
ttgtttctccagtctaggaaaa

SEQ ID NO: 9343479 - DNA, 22 bp, Homo sapiens
ttgtttctccagtctaggaaaa

SEQ ID NO: 9343480 - DNA, 22 bp, Homo sapiens
ttgtttcctttctatacaggat

SEQ ID NO: 9343481 - DNA, 20 bp, Homo sapiens
ttgtttcctggctgttctgc

SEQ ID NO: 9343482 - DNA, 22 bp, Homo sapiens
tttaattttcctcttcctggag

SEQ ID NO: 9343483 - DNA, 22 bp, Homo sapiens
tttaattttcctggtaggcctg

SEQ ID NO: 9343484 - DNA, 22 bp, Homo sapiens
tttaattttctgggcccagcag

SEQ ID NO: 9343485 - DNA, 22 bp, Homo sapiens
tttacaacctcatattctgatg

SEQ ID NO: 9343486 - DNA, 22 bp, Homo sapiens
tttaatttgtatttctagaggg

SEQ ID NO: 9343487 - DNA, 22 bp, Homo sapiens
tttaatttgtatttctagaggg

SEQ ID NO: 9343488 - DNA, 21 bp, Homo sapiens
tttaatttgcatgtatgacgc

SEQ ID NO: 9343489 - DNA, 22 bp, Homo sapiens
tttaatttgaaatgagtaaccc

SEQ ID NO: 9343490 - DNA, 22 bp, Homo sapiens
tttaatttgaaatgagtaaccc

SEQ ID NO: 9343491 - DNA, 22 bp, Homo sapiens
tttaattgcatttaaagatgga

SEQ ID NO: 9343492 - DNA, 22 bp, Homo sapiens
tttaattagcaagccagagagc

SEQ ID NO: 9343493 - DNA, 22 bp, Homo sapiens
tttaattatatctgggcagtta

SEQ ID NO: 9343494 - DNA, 22 bp, Homo sapiens
tttaatgtttgagtcagtatat

SEQ ID NO: 9343495 - DNA, 22 bp, Homo sapiens
tttaattatgttaagccactga

SEQ ID NO: 9343496 - DNA, 22 bp, Homo sapiens
tttaattgattcacagtctgta

SEQ ID NO: 9343497 - DNA, 22 bp, Homo sapiens
tttaaaatttagacctctccac

SEQ ID NO: 9343498 - DNA, 22 bp, Homo sapiens
tttaaaatttagacctctccac

SEQ ID NO: 9343499 - DNA, 22 bp, Homo sapiens
tttaaaatcagatgggagttgg

SEQ ID NO: 9343500 - DNA, 22 bp, Homo sapiens
tttaaaatcagatgggagttgg

SEQ ID NO: 9343501 - DNA, 22 bp, Homo sapiens
tttaaaatcagatgggagttgg

SEQ ID NO: 9343502 - DNA, 22 bp, Homo sapiens
tttaaaatcagatgggagttgg

SEQ ID NO: 9343503 - DNA, 22 bp, Homo sapiens
tttaatgttaaatttgtagatg

SEQ ID NO: 9343504 - DNA, 19 bp, Homo sapiens
tttaatgtgtgctgcaatc

SEQ ID NO: 9343505 - DNA, 22 bp, Homo sapiens
tttaaacaaataggattgccta

SEQ ID NO: 9343506 - DNA, 22 bp, Homo sapiens
tttaaacatatctgttgaggga

SEQ ID NO: 9343507 - DNA, 22 bp, Homo sapiens
tttaaacatatctgttgaggga

SEQ ID NO: 9343508 - DNA, 22 bp, Homo sapiens
ttgtttttatgaacatccagga

SEQ ID NO: 9343509 - DNA, 22 bp, Homo sapiens
ttgtttttaaacatgtgactga

SEQ ID NO: 9343510 - DNA, 22 bp, Homo sapiens
ttgtttttagagaagccctgaa

SEQ ID NO: 9343511 - DNA, 22 bp, Homo sapiens
tttaaaaaactagtctgagtct

SEQ ID NO: 9343512 - DNA, 22 bp, Homo sapiens
tttacttgatatggagctgagg

SEQ ID NO: 9343513 - DNA, 22 bp, Homo sapiens
tttacttgatatggagctgagg

SEQ ID NO: 9343514 - DNA, 22 bp, Homo sapiens
tttactgagtgacctagaataa

SEQ ID NO: 9343515 - DNA, 22 bp, Homo sapiens
tttactgtctcagagagacaaa

SEQ ID NO: 9343516 - DNA, 22 bp, Homo sapiens
tttactgtgcattagaatcacc

SEQ ID NO: 9343517 - DNA, 22 bp, Homo sapiens
tttactcttgctacacaactgt

SEQ ID NO: 9343518 - DNA, 22 bp, Homo sapiens
tttactttgtgtcaagtcaaga

SEQ ID NO: 9343519 - DNA, 22 bp, Homo sapiens
tttactttgtgtcaagtcaaga

SEQ ID NO: 9343520 - DNA, 22 bp, Homo sapiens
tttactttctcaagtatatagg

SEQ ID NO: 9343521 - DNA, 22 bp, Homo sapiens
tttactttctcaagtatatagg

SEQ ID NO: 9343522 - DNA, 22 bp, Homo sapiens
tttactttctcaagtatatagg

SEQ ID NO: 9343523 - DNA, 22 bp, Homo sapiens
tttactttctcaagtatatagg

SEQ ID NO: 9343524 - DNA, 22 bp, Homo sapiens
tttacttgttctgctgaattct

SEQ ID NO: 9343525 - DNA, 22 bp, Homo sapiens
tttactttctcaagtatatagg

SEQ ID NO: 9343526 - DNA, 22 bp, Homo sapiens
tttagttattgttacagtatga

SEQ ID NO: 9343527 - DNA, 22 bp, Homo sapiens
tttacttttggtaaggtcattt

SEQ ID NO: 9343528 - DNA, 22 bp, Homo sapiens
tttacttttggtaaggtcattt

SEQ ID NO: 9343529 - DNA, 22 bp, Homo sapiens
tttacgagtgtgattaaggtaa

SEQ ID NO: 9343530 - DNA, 22 bp, Homo sapiens
tttacgagtgctaatgatattg

SEQ ID NO: 9343531 - DNA, 22 bp, Homo sapiens
tttaccatacatcaaaatattt

SEQ ID NO: 9343532 - DNA, 22 bp, Homo sapiens
tttactaacaccatacatgctg

SEQ ID NO: 9343533 - DNA, 22 bp, Homo sapiens
tttactaacaccatacatgctg

SEQ ID NO: 9343534 - DNA, 22 bp, Homo sapiens
tttactaacaccatacatgctg

SEQ ID NO: 9343535 - DNA, 22 bp, Homo sapiens
tttactaacaccatacatgctg

SEQ ID NO: 9343536 - DNA, 22 bp, Homo sapiens
tttactaagcccagttatatgc

SEQ ID NO: 9343537 - DNA, 22 bp, Homo sapiens
tttactaagcccagttatatgc

SEQ ID NO: 9343538 - DNA, 22 bp, Homo sapiens
tttactacttcattgacttacg

SEQ ID NO: 9343539 - DNA, 22 bp, Homo sapiens
tttactaagcccagttatatgc

SEQ ID NO: 9343540 - DNA, 22 bp, Homo sapiens
tttaccagtgttaaacaccagc

SEQ ID NO: 9343541 - DNA, 22 bp, Homo sapiens
tttaccaggagtcagaaggact

SEQ ID NO: 9343542 - DNA, 22 bp, Homo sapiens
tttacaaggcagttattttcct

SEQ ID NO: 9343543 - DNA, 22 bp, Homo sapiens
tttacaagtacacctaacagct

SEQ ID NO: 9343544 - DNA, 22 bp, Homo sapiens
tttaccagaattgccaccagaa

SEQ ID NO: 9343545 - DNA, 22 bp, Homo sapiens
tttacaaggcagttattttcct

SEQ ID NO: 9343546 - DNA, 22 bp, Homo sapiens
tttacaaggcagaactgattaa

SEQ ID NO: 9343547 - DNA, 22 bp, Homo sapiens
tttacaaggcagaactgattaa

SEQ ID NO: 9343548 - DNA, 22 bp, Homo sapiens
tttacaaggcagaactgattaa

SEQ ID NO: 9343549 - DNA, 22 bp, Homo sapiens
tttacaacctcatattctgatg

SEQ ID NO: 9343550 - DNA, 22 bp, Homo sapiens
tttacaacctcatattctgatg

SEQ ID NO: 9343551 - DNA, 22 bp, Homo sapiens
tttacaaggcagaactgattaa

SEQ ID NO: 9343552 - DNA, 22 bp, Homo sapiens
tttacaaggatcaagggatctc

SEQ ID NO: 9343553 - DNA, 22 bp, Homo sapiens
tttacaagaaatcatgatgcta

SEQ ID NO: 9343554 - DNA, 22 bp, Homo sapiens
tttacaaggatcaagggatctc

SEQ ID NO: 9343555 - DNA, 22 bp, Homo sapiens
tttatttgtcttgccatttagt

SEQ ID NO: 9343556 - DNA, 22 bp, Homo sapiens
tttcaaaagcgtacgtagtgaa

SEQ ID NO: 9343557 - DNA, 22 bp, Homo sapiens
tttcaaaattttgcagtggtaa

SEQ ID NO: 9343558 - DNA, 22 bp, Homo sapiens
tttcaaacatatcttcattact

SEQ ID NO: 9343559 - DNA, 22 bp, Homo sapiens
tttcaaacctacttgtatgttt

SEQ ID NO: 9343560 - DNA, 22 bp, Homo sapiens
tttcaaactgcccagcacacct

SEQ ID NO: 9343561 - DNA, 22 bp, Homo sapiens
tttatttggcatccagggagaa

SEQ ID NO: 9343562 - DNA, 22 bp, Homo sapiens
tttatttcttagtttgccacag

SEQ ID NO: 9343563 - DNA, 22 bp, Homo sapiens
tttatttgaatcaggggagaat

SEQ ID NO: 9343564 - DNA, 23 bp, Homo sapiens
tttatttatttaggctgagggat

SEQ ID NO: 9343565 - DNA, 23 bp, Homo sapiens
tttatttatttaggctgagggat

SEQ ID NO: 9343566 - DNA, 22 bp, Homo sapiens
tttatttcactctccggatact

SEQ ID NO: 9343567 - DNA, 23 bp, Homo sapiens
tttatttatttaggctgagggat

SEQ ID NO: 9343568 - DNA, 22 bp, Homo sapiens
tttatttcactctccggatact

SEQ ID NO: 9343569 - DNA, 22 bp, Homo sapiens
tttatttcttagtttgccacag

SEQ ID NO: 9343570 - DNA, 22 bp, Homo sapiens
tttatttcttagtttgccacag

SEQ ID NO: 9343571 - DNA, 22 bp, Homo sapiens
tttatttggcatctctgccaag

SEQ ID NO: 9343572 - DNA, 22 bp, Homo sapiens
tttatttgtcttgccatttagt

SEQ ID NO: 9343573 - DNA, 22 bp, Homo sapiens
tttatttggcatccagggagaa

SEQ ID NO: 9343574 - DNA, 22 bp, Homo sapiens
tttatttggcatccagggagaa

SEQ ID NO: 9343575 - DNA, 22 bp, Homo sapiens
tttattagtgcttgtatcactg

SEQ ID NO: 9343576 - DNA, 22 bp, Homo sapiens
tttattatccagtgttgtcatg

SEQ ID NO: 9343577 - DNA, 22 bp, Homo sapiens
tttattatccagtgttgtcatg

SEQ ID NO: 9343578 - DNA, 22 bp, Homo sapiens
tttattatccagtgttgtcatg

SEQ ID NO: 9343579 - DNA, 22 bp, Homo sapiens
tttattatccagtgttgtcatg

SEQ ID NO: 9343580 - DNA, 22 bp, Homo sapiens
tttattagattatcaaagaggt

SEQ ID NO: 9343581 - DNA, 22 bp, Homo sapiens
tttattacaccaggttaactca

SEQ ID NO: 9343582 - DNA, 22 bp, Homo sapiens
tttattacaccaggttaactca

SEQ ID NO: 9343583 - DNA, 22 bp, Homo sapiens
tttattaattagtgacccaatg

SEQ ID NO: 9343584 - DNA, 22 bp, Homo sapiens
tttattaatgtagcatccatgg

SEQ ID NO: 9343585 - DNA, 22 bp, Homo sapiens
tttattattctgttctctctac

SEQ ID NO: 9343586 - DNA, 22 bp, Homo sapiens
tttattattctctggagaatgt

SEQ ID NO: 9343587 - DNA, 22 bp, Homo sapiens
tttattattctctggagaatgt

SEQ ID NO: 9343588 - DNA, 22 bp, Homo sapiens
tttattatgatggacaccttcg

SEQ ID NO: 9343589 - DNA, 22 bp, Homo sapiens
tttattatgatggacaccttcg

SEQ ID NO: 9343590 - DNA, 22 bp, Homo sapiens
tttattatccagtgttgtcatg

SEQ ID NO: 9343591 - DNA, 22 bp, Homo sapiens
tttattatgatggacaccttcg

SEQ ID NO: 9343592 - DNA, 22 bp, Homo sapiens
tttatataacagagactgctat

SEQ ID NO: 9343593 - DNA, 22 bp, Homo sapiens
tttatataacagagactgctat

SEQ ID NO: 9343594 - DNA, 22 bp, Homo sapiens
tttatagtcgtctcagtaataa

SEQ ID NO: 9343595 - DNA, 20 bp, Homo sapiens
tttatagtgatcaatttata

SEQ ID NO: 9343596 - DNA, 22 bp, Homo sapiens
tttatagttatatacagatgtt

SEQ ID NO: 9343597 - DNA, 22 bp, Homo sapiens
tttatgtttgcattttcaaaga

SEQ ID NO: 9343598 - DNA, 22 bp, Homo sapiens
tttattaaaactgttggctctg

SEQ ID NO: 9343599 - DNA, 22 bp, Homo sapiens
tttataattatctctactctta

SEQ ID NO: 9343600 - DNA, 22 bp, Homo sapiens
tttataattatctctactctta

SEQ ID NO: 9343601 - DNA, 22 bp, Homo sapiens
tttataattatctctactctta

SEQ ID NO: 9343602 - DNA, 22 bp, Homo sapiens
tttataattatctctactctta

SEQ ID NO: 9343603 - DNA, 22 bp, Homo sapiens
tttataagtactttgtctgctt

SEQ ID NO: 9343604 - DNA, 22 bp, Homo sapiens
tttataagtactttgtctgctt

SEQ ID NO: 9343605 - DNA, 22 bp, Homo sapiens
tttataagaagcaatgtctgag

SEQ ID NO: 9343606 - DNA, 22 bp, Homo sapiens
tttatacatggagaatttttgc

SEQ ID NO: 9343607 - DNA, 17 bp, Homo sapiens
tttataattggcctctt

SEQ ID NO: 9343608 - DNA, 23 bp, Homo sapiens
tttatacaagaaaccgctggcct

SEQ ID NO: 9343609 - DNA, 22 bp, Homo sapiens
tttatactccactctgcaagcg

SEQ ID NO: 9343610 - DNA, 22 bp, Homo sapiens
tttatacttcataatgtctatt

SEQ ID NO: 9343611 - DNA, 22 bp, Homo sapiens
tttatagatgtctgtattataa

SEQ ID NO: 9343612 - DNA, 22 bp, Homo sapiens
tttagttattgttacagtatga

SEQ ID NO: 9343613 - DNA, 22 bp, Homo sapiens
tttagttattgttacagtatga

SEQ ID NO: 9343614 - DNA, 22 bp, Homo sapiens
tttagttattgttacagtatga

SEQ ID NO: 9343615 - DNA, 22 bp, Homo sapiens
tttctcctgctagaacaaggag

SEQ ID NO: 9343616 - DNA, 22 bp, Homo sapiens
tttctcctgtgaggtcagaagt

SEQ ID NO: 9343617 - DNA, 22 bp, Homo sapiens
tttctcctgcccagatgcctgg

SEQ ID NO: 9343618 - DNA, 22 bp, Homo sapiens
tttctcctgcccagatgcctgg

SEQ ID NO: 9343619 - DNA, 22 bp, Homo sapiens
tttctcctctccagagtgcagt

SEQ ID NO: 9343620 - DNA, 22 bp, Homo sapiens
tttctcctctccagagtgcagt

SEQ ID NO: 9343621 - DNA, 22 bp, Homo sapiens
tttctcctgagttccacgctac

SEQ ID NO: 9343622 - DNA, 22 bp, Homo sapiens
tttctcctgagttccacgctac

SEQ ID NO: 9343623 - DNA, 22 bp, Homo sapiens
tttctccttgtgtctcctttga

SEQ ID NO: 9343624 - DNA, 22 bp, Homo sapiens
tttctccttgtgtctcctttga

SEQ ID NO: 9343625 - DNA, 22 bp, Homo sapiens
tttctcctgtgtaagccgccca

SEQ ID NO: 9343626 - DNA, 17 bp, Homo sapiens
tttctccttccatctca

SEQ ID NO: 9343627 - DNA, 22 bp, Homo sapiens
tttctcctgtgaggtcagaagt

SEQ ID NO: 9343628 - DNA, 22 bp, Homo sapiens
tttctcctgtgaggtcagaagt

SEQ ID NO: 9343629 - DNA, 22 bp, Homo sapiens
tttctctagctattcattaaat

SEQ ID NO: 9343630 - DNA, 22 bp, Homo sapiens
tttctcggcagagatgatgggc

SEQ ID NO: 9343631 - DNA, 22 bp, Homo sapiens
tttctctgtgccatttccataa

SEQ ID NO: 9343632 - DNA, 18 bp, Homo sapiens
tttctctgtcgtcttctg

SEQ ID NO: 9343633 - DNA, 22 bp, Homo sapiens
tttctctgggcactctccaaac

SEQ ID NO: 9343634 - DNA, 22 bp, Homo sapiens
tttctcttaatgtctctgtgct

SEQ ID NO: 9343635 - DNA, 22 bp, Homo sapiens
tttctcttaatgtctctgtgct

SEQ ID NO: 9343636 - DNA, 22 bp, Homo sapiens
tttctctgtgggctttatgcat

SEQ ID NO: 9343637 - DNA, 22 bp, Homo sapiens
tttctctgtgggctttatgcat

SEQ ID NO: 9343638 - DNA, 22 bp, Homo sapiens
tttctctgttctctaactgtaa

SEQ ID NO: 9343639 - DNA, 22 bp, Homo sapiens
tttctctgttctctaactgtaa

SEQ ID NO: 9343640 - DNA, 22 bp, Homo sapiens
tttctctttcaatctgcagtac

SEQ ID NO: 9343641 - DNA, 22 bp, Homo sapiens
tttctctttgacaggaatcaga

SEQ ID NO: 9343642 - DNA, 22 bp, Homo sapiens
tttctctttgacaggaatcaga

SEQ ID NO: 9343643 - DNA, 22 bp, Homo sapiens
tttctcttgcgatatgctacac

SEQ ID NO: 9343644 - DNA, 22 bp, Homo sapiens
tttctgaaatctcttttgagga

SEQ ID NO: 9343645 - DNA, 22 bp, Homo sapiens
tttctgaagtcttctaacagat

SEQ ID NO: 9343646 - DNA, 22 bp, Homo sapiens
tttctgacacatcagttgtaaa

SEQ ID NO: 9343647 - DNA, 22 bp, Homo sapiens
tttctgacctgcaacagtttac

SEQ ID NO: 9343648 - DNA, 22 bp, Homo sapiens
tttctgactccagagaggaata

SEQ ID NO: 9343649 - DNA, 22 bp, Homo sapiens
tttctgacacatcagttgtaaa

SEQ ID NO: 9343650 - DNA, 22 bp, Homo sapiens
tttctgccttatctttgctgag

SEQ ID NO: 9343651 - DNA, 22 bp, Homo sapiens
tttctgccgttccctgctctgt

SEQ ID NO: 9343652 - DNA, 22 bp, Homo sapiens
tttctgccagtcactgctctag

SEQ ID NO: 9343653 - DNA, 22 bp, Homo sapiens
tttctgccaaccatttaaactc

SEQ ID NO: 9343654 - DNA, 22 bp, Homo sapiens
tttctgcatttacaaaatgagg

SEQ ID NO: 9343655 - DNA, 22 bp, Homo sapiens
tttctgccaggtttctggatga

SEQ ID NO: 9343656 - DNA, 22 bp, Homo sapiens
tttctgccaggtttctggatga

SEQ ID NO: 9343657 - DNA, 22 bp, Homo sapiens
tttctgaggaattaatacagaa

SEQ ID NO: 9343658 - DNA, 22 bp, Homo sapiens
tttctgagaaattaaacacttt

SEQ ID NO: 9343659 - DNA, 22 bp, Homo sapiens
tttctgagaaattaaacacttt

SEQ ID NO: 9343660 - DNA, 22 bp, Homo sapiens
tttctgacttttatatgcatat

SEQ ID NO: 9343661 - DNA, 22 bp, Homo sapiens
tttctgactggtgtataatagg

SEQ ID NO: 9343662 - DNA, 22 bp, Homo sapiens
tttctgataattttgtgaaatc

SEQ ID NO: 9343663 - DNA, 22 bp, Homo sapiens
tttctgcatcttgaaacagagc

SEQ ID NO: 9343664 - DNA, 22 bp, Homo sapiens
tttctgcatgcatttaattaaa

SEQ ID NO: 9343665 - DNA, 22 bp, Homo sapiens
tttctgggactggggagattct

SEQ ID NO: 9343666 - DNA, 22 bp, Homo sapiens
tttctgggtttatgtcacagct

SEQ ID NO: 9343667 - DNA, 20 bp, Homo sapiens
tttctgggtactctccctct

SEQ ID NO: 9343668 - DNA, 22 bp, Homo sapiens
tttctgtaaggacttaatgcaa

SEQ ID NO: 9343669 - DNA, 22 bp, Homo sapiens
tttctgggtttatgtcacagct

SEQ ID NO: 9343670 - DNA, 22 bp, Homo sapiens
tttctgtacacccactattcat

SEQ ID NO: 9343671 - DNA, 22 bp, Homo sapiens
tttctgtagggatttcacagtt

SEQ ID NO: 9343672 - DNA, 22 bp, Homo sapiens
tttctgtagggatttcacagtt

SEQ ID NO: 9343673 - DNA, 22 bp, Homo sapiens
tttctgtaagtggcaaataatg

SEQ ID NO: 9343674 - DNA, 22 bp, Homo sapiens
tttctgtaagtggcaaataatg

SEQ ID NO: 9343675 - DNA, 20 bp, Homo sapiens
tttctgtaaggcattaatct

SEQ ID NO: 9343676 - DNA, 22 bp, Homo sapiens
tttctgtacacccactattcat

SEQ ID NO: 9343677 - DNA, 22 bp, Homo sapiens
tttctgctgtgtaaaatgaggg

SEQ ID NO: 9343678 - DNA, 22 bp, Homo sapiens
tttctgcttgagagaattgctg

SEQ ID NO: 9343679 - DNA, 22 bp, Homo sapiens
tttctggaaacgggttcaagct

SEQ ID NO: 9343680 - DNA, 17 bp, Homo sapiens
tttctggaatgggcaaa

SEQ ID NO: 9343681 - DNA, 22 bp, Homo sapiens
tttctggaaccacaaaagtatg

SEQ ID NO: 9343682 - DNA, 22 bp, Homo sapiens
tttctggaaccacaaaagtatg

SEQ ID NO: 9343683 - DNA, 22 bp, Homo sapiens
tttctggacagcaagatcagtt

SEQ ID NO: 9343684 - DNA, 17 bp, Homo sapiens
tttctggaatgggcaaa

SEQ ID NO: 9343685 - DNA, 22 bp, Homo sapiens
tttctggattcatacagatgta

SEQ ID NO: 9343686 - DNA, 22 bp, Homo sapiens
tttctggattcatacagatgta

SEQ ID NO: 9343687 - DNA, 22 bp, Homo sapiens
tttctggacccttctgtgagtg

SEQ ID NO: 9343688 - DNA, 22 bp, Homo sapiens
tttctggaggcccaagggcaga

SEQ ID NO: 9343689 - DNA, 22 bp, Homo sapiens
tttctggaaactgtaaagagga

SEQ ID NO: 9343690 - DNA, 22 bp, Homo sapiens
tttctggaaactgtaaagagga

SEQ ID NO: 9343691 - DNA, 22 bp, Homo sapiens
tttctggaaacgggttcaagct

SEQ ID NO: 9343692 - DNA, 22 bp, Homo sapiens
tttctggaaagcaagatacatt

SEQ ID NO: 9343693 - DNA, 22 bp, Homo sapiens
tttctggaacagtaattgaaga

SEQ ID NO: 9343694 - DNA, 22 bp, Homo sapiens
tttctggaacagtaattgaaga

SEQ ID NO: 9343695 - DNA, 22 bp, Homo sapiens
tttctggaacagtaattgaaga

SEQ ID NO: 9343696 - DNA, 22 bp, Homo sapiens
tttctggaaccacaaaagtatg

SEQ ID NO: 9343697 - DNA, 22 bp, Homo sapiens
tttcttgtacactggaatttat

SEQ ID NO: 9343698 - DNA, 20 bp, Homo sapiens
tttcttgtacttggagaagg

SEQ ID NO: 9343699 - DNA, 22 bp, Homo sapiens
tttcttctgagatcagggagaa

SEQ ID NO: 9343700 - DNA, 20 bp, Homo sapiens
tttcttgtcggctgttgctg

SEQ ID NO: 9343701 - DNA, 20 bp, Homo sapiens
tttcttgtacttggagaagg

SEQ ID NO: 9343702 - DNA, 20 bp, Homo sapiens
tttcttgtcggctgttgctg

SEQ ID NO: 9343703 - DNA, 20 bp, Homo sapiens
tttcttgtcggctgttgctg

SEQ ID NO: 9343704 - DNA, 20 bp, Homo sapiens
tttcttgtcggctgttgctg

SEQ ID NO: 9343705 - DNA, 22 bp, Homo sapiens
tttcttctctgattaaggctca

SEQ ID NO: 9343706 - DNA, 22 bp, Homo sapiens
tttcttctctaatctcaatgat

SEQ ID NO: 9343707 - DNA, 22 bp, Homo sapiens
tttcttctctaatctcaatgat

SEQ ID NO: 9343708 - DNA, 22 bp, Homo sapiens
tttctttaattctcacagcaat

SEQ ID NO: 9343709 - DNA, 22 bp, Homo sapiens
tttctttatcctcctttgcaca

SEQ ID NO: 9343710 - DNA, 22 bp, Homo sapiens
tttctttatcatagcatctttg

SEQ ID NO: 9343711 - DNA, 22 bp, Homo sapiens
tttctttaaaggaactctgttt

SEQ ID NO: 9343712 - DNA, 22 bp, Homo sapiens
tttctttaattctcacagcaat

SEQ ID NO: 9343713 - DNA, 22 bp, Homo sapiens
tttcttgtttcatggtgtctca

SEQ ID NO: 9343714 - DNA, 22 bp, Homo sapiens
tttcttgtttcatggtgtctca

SEQ ID NO: 9343715 - DNA, 22 bp, Homo sapiens
tttcttgtctttagtatctggc

SEQ ID NO: 9343716 - DNA, 22 bp, Homo sapiens
tttcttctaggactaataagag

SEQ ID NO: 9343717 - DNA, 22 bp, Homo sapiens
tttcttctaggactaataagag

SEQ ID NO: 9343718 - DNA, 22 bp, Homo sapiens
tttcttctaggactaataagag

SEQ ID NO: 9343719 - DNA, 22 bp, Homo sapiens
tttcttctaggactaataagag

SEQ ID NO: 9343720 - DNA, 22 bp, Homo sapiens
tttcttctaagatttcaaacta

SEQ ID NO: 9343721 - DNA, 22 bp, Homo sapiens
tttcttctaagatttcaaacta

SEQ ID NO: 9343722 - DNA, 22 bp, Homo sapiens
tttcttccttaccttactagag

SEQ ID NO: 9343723 - DNA, 22 bp, Homo sapiens
tttcttctcatccctgaaatca

SEQ ID NO: 9343724 - DNA, 22 bp, Homo sapiens
tttcttctcatccctgaaatca

SEQ ID NO: 9343725 - DNA, 22 bp, Homo sapiens
tttcttctcatccctgaaatca

SEQ ID NO: 9343726 - DNA, 22 bp, Homo sapiens
tttcttctcgacaccttatccc

SEQ ID NO: 9343727 - DNA, 22 bp, Homo sapiens
tttcttctaggactaataagag

SEQ ID NO: 9343728 - DNA, 22 bp, Homo sapiens
tttcttcagagagagctttccc

SEQ ID NO: 9343729 - DNA, 22 bp, Homo sapiens
tttcttcagccactccaaactg

SEQ ID NO: 9343730 - DNA, 22 bp, Homo sapiens
tttcttatgagcaagactctat

SEQ ID NO: 9343731 - DNA, 22 bp, Homo sapiens
tttcttatggggtagtccttta

SEQ ID NO: 9343732 - DNA, 22 bp, Homo sapiens
tttcttatggggtagtccttta

SEQ ID NO: 9343733 - DNA, 22 bp, Homo sapiens
tttcttatggggtagtccttta

SEQ ID NO: 9343734 - DNA, 22 bp, Homo sapiens
tttcttatgtgcagagtgagta

SEQ ID NO: 9343735 - DNA, 22 bp, Homo sapiens
tttcttcaattgctaacaagga

SEQ ID NO: 9343736 - DNA, 22 bp, Homo sapiens
tttcttcaattgctaacaagga

SEQ ID NO: 9343737 - DNA, 22 bp, Homo sapiens
tttcttcattgacaaggaaaaa

SEQ ID NO: 9343738 - DNA, 22 bp, Homo sapiens
tttcttcattgacaaggaaaaa

SEQ ID NO: 9343739 - DNA, 22 bp, Homo sapiens
tttcttcattcaccttcacccc

SEQ ID NO: 9343740 - DNA, 22 bp, Homo sapiens
tttcttcagccttcacaacctg

SEQ ID NO: 9343741 - DNA, 22 bp, Homo sapiens
tttcttcagtaacacaaaccat

SEQ ID NO: 9343742 - DNA, 22 bp, Homo sapiens
tttcttcctaaatatgatttcc

SEQ ID NO: 9343743 - DNA, 22 bp, Homo sapiens
tttcttcattgatgtcaggtgg

SEQ ID NO: 9343744 - DNA, 22 bp, Homo sapiens
tttctgtggtgggtagttcaga

SEQ ID NO: 9343745 - DNA, 19 bp, Homo sapiens
tttctgttagaaggataca

SEQ ID NO: 9343746 - DNA, 22 bp, Homo sapiens
tttctgttaggcatcattttaa

SEQ ID NO: 9343747 - DNA, 22 bp, Homo sapiens
tttctgttaggcatcattttaa

SEQ ID NO: 9343748 - DNA, 22 bp, Homo sapiens
tttctgttaggcatcattttaa

SEQ ID NO: 9343749 - DNA, 22 bp, Homo sapiens
tttctgttgtacttaaactagg

SEQ ID NO: 9343750 - DNA, 23 bp, Homo sapiens
tttctgttgggtatatatccaag

SEQ ID NO: 9343751 - DNA, 23 bp, Homo sapiens
tttctgttgggtatatatccaag

SEQ ID NO: 9343752 - DNA, 23 bp, Homo sapiens
tttctgttgggtatatatccaag

SEQ ID NO: 9343753 - DNA, 22 bp, Homo sapiens
tttctgtattttgtcataacct

SEQ ID NO: 9343754 - DNA, 22 bp, Homo sapiens
tttctgtcattactttcctccc

SEQ ID NO: 9343755 - DNA, 22 bp, Homo sapiens
tttctgtagtgtggtatgtagg

SEQ ID NO: 9343756 - DNA, 22 bp, Homo sapiens
tttctgtatttaggacaggtgg

SEQ ID NO: 9343757 - DNA, 22 bp, Homo sapiens
tttctgtatttaaaagatctgg

SEQ ID NO: 9343758 - DNA, 22 bp, Homo sapiens
tttctgtaggggatatctttga

SEQ ID NO: 9343759 - DNA, 19 bp, Homo sapiens
tttctgtctgtgttttgcc

SEQ ID NO: 9343760 - DNA, 22 bp, Homo sapiens
tttctgtctgacatccctgcct

SEQ ID NO: 9343761 - DNA, 22 bp, Homo sapiens
tttctgtctgacatccctgcct

SEQ ID NO: 9343762 - DNA, 20 bp, Homo sapiens
tttctgtgcccaggtctgtt

SEQ ID NO: 9343763 - DNA, 20 bp, Homo sapiens
tttctgtgagaaacactgtt

SEQ ID NO: 9343764 - DNA, 20 bp, Homo sapiens
tttctgtgatagagaggtgt

SEQ ID NO: 9343765 - DNA, 22 bp, Homo sapiens
tttctcctccagagagacacag

SEQ ID NO: 9343766 - DNA, 22 bp, Homo sapiens
tttctcctccagagagacacag

SEQ ID NO: 9343767 - DNA, 22 bp, Homo sapiens
tttctcctcatgactggttgtg

SEQ ID NO: 9343768 - DNA, 22 bp, Homo sapiens
tttctcctctccagagtgcagt

SEQ ID NO: 9343769 - DNA, 22 bp, Homo sapiens
tttctcctctccagagtgcagt

SEQ ID NO: 9343770 - DNA, 22 bp, Homo sapiens
tttctcctcatgactggttgtg

SEQ ID NO: 9343771 - DNA, 22 bp, Homo sapiens
tttctcctaactcaaatttaag

SEQ ID NO: 9343772 - DNA, 22 bp, Homo sapiens
tttctcctaactcaaatttaag

SEQ ID NO: 9343773 - DNA, 22 bp, Homo sapiens
tttctccctttataagactgta

SEQ ID NO: 9343774 - DNA, 22 bp, Homo sapiens
tttctccctccactacaggctc

SEQ ID NO: 9343775 - DNA, 22 bp, Homo sapiens
tttctccccagtctaatctgga

SEQ ID NO: 9343776 - DNA, 22 bp, Homo sapiens
tttctcccccatgataatttct

SEQ ID NO: 9343777 - DNA, 22 bp, Homo sapiens
tttctcccagtctcctgagaca

SEQ ID NO: 9343778 - DNA, 20 bp, Homo sapiens
tttctcccaagtgcaagggt

SEQ ID NO: 9343779 - DNA, 22 bp, Homo sapiens
tttctcccaactctggaagcca

SEQ ID NO: 9343780 - DNA, 22 bp, Homo sapiens
tttctcccaaagtgcaaccaca

SEQ ID NO: 9343781 - DNA, 23 bp, Homo sapiens
tttctcatccagagagtcagtcc

SEQ ID NO: 9343782 - DNA, 22 bp, Homo sapiens
tttctcatggacccttcatgat

SEQ ID NO: 9343783 - DNA, 22 bp, Homo sapiens
tttctcagttactagctgtggt

SEQ ID NO: 9343784 - DNA, 22 bp, Homo sapiens
tttctcagttctctgcaaggag

SEQ ID NO: 9343785 - DNA, 22 bp, Homo sapiens
tttctcagttactagctgtggt

SEQ ID NO: 9343786 - DNA, 22 bp, Homo sapiens
tttctcagttactagctgtggt

SEQ ID NO: 9343787 - DNA, 21 bp, Homo sapiens
tttctcataaaatactcatta

SEQ ID NO: 9343788 - DNA, 22 bp, Homo sapiens
tttctcagttgtgcgagcagca

SEQ ID NO: 9343789 - DNA, 22 bp, Homo sapiens
tttctcagtaatgtcctggaat

SEQ ID NO: 9343790 - DNA, 22 bp, Homo sapiens
tttctcagtcacatgaaccaat

SEQ ID NO: 9343791 - DNA, 19 bp, Homo sapiens
tttctcaggaagtttgtgt

SEQ ID NO: 9343792 - DNA, 22 bp, Homo sapiens
tttctcagctcagcatctgggt

SEQ ID NO: 9343793 - DNA, 22 bp, Homo sapiens
tttctagaagatggctaataag

SEQ ID NO: 9343794 - DNA, 22 bp, Homo sapiens
tttctagaaagttcatgtgttt

SEQ ID NO: 9343795 - DNA, 22 bp, Homo sapiens
tttctagaaacattatctctat

SEQ ID NO: 9343796 - DNA, 22 bp, Homo sapiens
tttctacttctcctgaatgtct

SEQ ID NO: 9343797 - DNA, 22 bp, Homo sapiens
tttctacttctcctgaatgtct

SEQ ID NO: 9343798 - DNA, 22 bp, Homo sapiens
tttctattttaaaggcatatgg

SEQ ID NO: 9343799 - DNA, 22 bp, Homo sapiens
tttctatttacagtgctaggta

SEQ ID NO: 9343800 - DNA, 22 bp, Homo sapiens
tttctattttaaaggcatatgg

SEQ ID NO: 9343801 - DNA, 22 bp, Homo sapiens
tttctattgtaagtctcctata

SEQ ID NO: 9343802 - DNA, 22 bp, Homo sapiens
tttctattgtaagtctcctata

SEQ ID NO: 9343803 - DNA, 22 bp, Homo sapiens
tttctagaatgactcatctgag

SEQ ID NO: 9343804 - DNA, 22 bp, Homo sapiens
tttctaaggtgatcctttctta

SEQ ID NO: 9343805 - DNA, 22 bp, Homo sapiens
tttccttcttagcggtgttctt

SEQ ID NO: 9343806 - DNA, 22 bp, Homo sapiens
tttccttctcagggagcttcaa

SEQ ID NO: 9343807 - DNA, 22 bp, Homo sapiens
tttccttctcagggagcttcaa

SEQ ID NO: 9343808 - DNA, 22 bp, Homo sapiens
tttccttcctaaggtgaagcaa

SEQ ID NO: 9343809 - DNA, 22 bp, Homo sapiens
tttccttcctaaggtgaagcaa

SEQ ID NO: 9343810 - DNA, 22 bp, Homo sapiens
tttccttcctaaggtgaagcaa

SEQ ID NO: 9343811 - DNA, 22 bp, Homo sapiens
tttccttccctggatgagaagt

SEQ ID NO: 9343812 - DNA, 22 bp, Homo sapiens
tttccttccttgctagcctgag

SEQ ID NO: 9343813 - DNA, 22 bp, Homo sapiens
tttccttccttgctagcctgag

SEQ ID NO: 9343814 - DNA, 22 bp, Homo sapiens
tttccttccaggttcctaaggc

SEQ ID NO: 9343815 - DNA, 22 bp, Homo sapiens
tttccttccaggttcctaaggc

SEQ ID NO: 9343816 - DNA, 22 bp, Homo sapiens
tttccttccaggttcctaaggc

SEQ ID NO: 9343817 - DNA, 22 bp, Homo sapiens
tttccttccctggatgagaagt

SEQ ID NO: 9343818 - DNA, 22 bp, Homo sapiens
tttccttccatgttgggcaaaa

SEQ ID NO: 9343819 - DNA, 22 bp, Homo sapiens
tttccttccatgttgggcaaaa

SEQ ID NO: 9343820 - DNA, 22 bp, Homo sapiens
tttccttcatcatctgagagct

SEQ ID NO: 9343821 - DNA, 22 bp, Homo sapiens
tttccttccaaatgcccgggag

SEQ ID NO: 9343822 - DNA, 22 bp, Homo sapiens
tttccttccaaatgcccgggag

SEQ ID NO: 9343823 - DNA, 22 bp, Homo sapiens
tttccttcatcatctgagagct

SEQ ID NO: 9343824 - DNA, 22 bp, Homo sapiens
tttcctctttgtaccttgacta

SEQ ID NO: 9343825 - DNA, 22 bp, Homo sapiens
tttcctgcacccgctgatgcca

SEQ ID NO: 9343826 - DNA, 22 bp, Homo sapiens
tttcctgcctggacctctgctt

SEQ ID NO: 9343827 - DNA, 22 bp, Homo sapiens
tttcctgcctggacctctgctt

SEQ ID NO: 9343828 - DNA, 22 bp, Homo sapiens
tttcctgttgccatcaagaatg

SEQ ID NO: 9343829 - DNA, 22 bp, Homo sapiens
tttcctgttgccatcaagaatg

SEQ ID NO: 9343830 - DNA, 22 bp, Homo sapiens
tttcctgtcttttgtgaaggat

SEQ ID NO: 9343831 - DNA, 22 bp, Homo sapiens
tttcctgtgactaatctggaca

SEQ ID NO: 9343832 - DNA, 22 bp, Homo sapiens
tttcctggaccaactgagattg

SEQ ID NO: 9343833 - DNA, 22 bp, Homo sapiens
tttctacattcaaaaactacca

SEQ ID NO: 9343834 - DNA, 22 bp, Homo sapiens
tttctacatttgtaaccagatt

SEQ ID NO: 9343835 - DNA, 22 bp, Homo sapiens
tttctacattcaaaaactacca

SEQ ID NO: 9343836 - DNA, 22 bp, Homo sapiens
tttctacattcaaaaactacca

SEQ ID NO: 9343837 - DNA, 22 bp, Homo sapiens
tttctactaagaaagttgatta

SEQ ID NO: 9343838 - DNA, 22 bp, Homo sapiens
tttctacatttgtaaccagatt

SEQ ID NO: 9343839 - DNA, 22 bp, Homo sapiens
tttctactaagaaagttgatta

SEQ ID NO: 9343840 - DNA, 22 bp, Homo sapiens
tttctacatgttttctattgaa

SEQ ID NO: 9343841 - DNA, 22 bp, Homo sapiens
tttctacatgttttctattgaa

SEQ ID NO: 9343842 - DNA, 22 bp, Homo sapiens
tttctaattctaactggcagag

SEQ ID NO: 9343843 - DNA, 22 bp, Homo sapiens
tttctaatgttctcagggattg

SEQ ID NO: 9343844 - DNA, 19 bp, Homo sapiens
tttctaatgtgtttttctt

SEQ ID NO: 9343845 - DNA, 22 bp, Homo sapiens
tttctaatctttagttacaaaa

SEQ ID NO: 9343846 - DNA, 22 bp, Homo sapiens
tttctaatctgattctcctacc

SEQ ID NO: 9343847 - DNA, 22 bp, Homo sapiens
tttctaatctttagttacaaaa

SEQ ID NO: 9343848 - DNA, 22 bp, Homo sapiens
tttctaatctttagttacaaaa

SEQ ID NO: 9343849 - DNA, 22 bp, Homo sapiens
tttctaatctgattctcctacc

SEQ ID NO: 9343850 - DNA, 22 bp, Homo sapiens
tttctaagtgtgattttagatt

SEQ ID NO: 9343851 - DNA, 22 bp, Homo sapiens
tttctaatatcacttccagctg

SEQ ID NO: 9343852 - DNA, 22 bp, Homo sapiens
tttctaatagttgagtcagcta

SEQ ID NO: 9343853 - DNA, 22 bp, Homo sapiens
tttctaatatcacttccagctg

SEQ ID NO: 9343854 - DNA, 22 bp, Homo sapiens
tttctaatatcacttccagctg

SEQ ID NO: 9343855 - DNA, 22 bp, Homo sapiens
tttctaatatgctctaagtcaa

SEQ ID NO: 9343856 - DNA, 22 bp, Homo sapiens
tttctaatatgctctaagtcaa

SEQ ID NO: 9343857 - DNA, 22 bp, Homo sapiens
tttctaagtatcttgcagtttt

SEQ ID NO: 9343858 - DNA, 22 bp, Homo sapiens
tttctaagtatcttgcagtttt

SEQ ID NO: 9343859 - DNA, 22 bp, Homo sapiens
tttctaagtaaacacagcatac

SEQ ID NO: 9343860 - DNA, 23 bp, Homo sapiens
tttctaaggtttttatctgctac

SEQ ID NO: 9343861 - DNA, 22 bp, Homo sapiens
tttcagatggaggtttaggaca

SEQ ID NO: 9343862 - DNA, 22 bp, Homo sapiens
tttcagatgatgcatgcgctca

SEQ ID NO: 9343863 - DNA, 22 bp, Homo sapiens
tttcagatcactttcaggaaag

SEQ ID NO: 9343864 - DNA, 22 bp, Homo sapiens
tttcagatcattttttaagtac

SEQ ID NO: 9343865 - DNA, 22 bp, Homo sapiens
tttcagatcactttcaggaaag

SEQ ID NO: 9343866 - DNA, 22 bp, Homo sapiens
tttcagatcactttcaggaaag

SEQ ID NO: 9343867 - DNA, 22 bp, Homo sapiens
tttcagatggtatatacagtag

SEQ ID NO: 9343868 - DNA, 20 bp, Homo sapiens
tttcagatttacagaaatgt

SEQ ID NO: 9343869 - DNA, 20 bp, Homo sapiens
tttcagatttacagaaatgt

SEQ ID NO: 9343870 - DNA, 22 bp, Homo sapiens
tttcagggagcctagaagagct

SEQ ID NO: 9343871 - DNA, 22 bp, Homo sapiens
tttcagtcaggaggatctctca

SEQ ID NO: 9343872 - DNA, 22 bp, Homo sapiens
tttcagtcagttaagtcatgaa

SEQ ID NO: 9343873 - DNA, 22 bp, Homo sapiens
tttcagggtcagcctgtatgtg

SEQ ID NO: 9343874 - DNA, 22 bp, Homo sapiens
tttcagtgcacgtagtttattt

SEQ ID NO: 9343875 - DNA, 22 bp, Homo sapiens
tttcagtgcccagagctttgca

SEQ ID NO: 9343876 - DNA, 22 bp, Homo sapiens
tttcagtgaaagctactgttag

SEQ ID NO: 9343877 - DNA, 22 bp, Homo sapiens
tttcagtcatgagttgttttca

SEQ ID NO: 9343878 - DNA, 22 bp, Homo sapiens
tttcagtctgtaaaggtgagga

SEQ ID NO: 9343879 - DNA, 22 bp, Homo sapiens
tttcagtgaaagctactgttag

SEQ ID NO: 9343880 - DNA, 22 bp, Homo sapiens
tttcagctggtaaaggagtagc

SEQ ID NO: 9343881 - DNA, 22 bp, Homo sapiens
tttcaggcaggtggaatgagta

SEQ ID NO: 9343882 - DNA, 22 bp, Homo sapiens
tttcaaagacagccatatttgt

SEQ ID NO: 9343883 - DNA, 22 bp, Homo sapiens
tttcaaagagttgtaaattact

SEQ ID NO: 9343884 - DNA, 17 bp, Homo sapiens
tttcaaagcagtcagga

SEQ ID NO: 9343885 - DNA, 22 bp, Homo sapiens
tttcagagtctggctgcagcct

SEQ ID NO: 9343886 - DNA, 22 bp, Homo sapiens
tttcagaggaggaaggcagtta

SEQ ID NO: 9343887 - DNA, 22 bp, Homo sapiens
tttcattgtccccaggcaagac

SEQ ID NO: 9343888 - DNA, 22 bp, Homo sapiens
tttcattgtccccaggcaagac

SEQ ID NO: 9343889 - DNA, 22 bp, Homo sapiens
tttcattgtcaataaactgtat

SEQ ID NO: 9343890 - DNA, 22 bp, Homo sapiens
tttcattggctccctgatgaat

SEQ ID NO: 9343891 - DNA, 22 bp, Homo sapiens
tttcagtggagtgacatgatct

SEQ ID NO: 9343892 - DNA, 22 bp, Homo sapiens
tttcattgccataaggtgggat

SEQ ID NO: 9343893 - DNA, 22 bp, Homo sapiens
tttcagtggaccacagtttgat

SEQ ID NO: 9343894 - DNA, 22 bp, Homo sapiens
tttcagtggaccacagtttgat

SEQ ID NO: 9343895 - DNA, 22 bp, Homo sapiens
tttcagtgcttctgtttaccgg

SEQ ID NO: 9343896 - DNA, 22 bp, Homo sapiens
tttccaaagctgagttgagcaa

SEQ ID NO: 9343897 - DNA, 22 bp, Homo sapiens
tttccaaacccagcgagctaca

SEQ ID NO: 9343898 - DNA, 22 bp, Homo sapiens
tttcattttggttatgccataa

SEQ ID NO: 9343899 - DNA, 22 bp, Homo sapiens
tttccaaaagtttgttctgtgc

SEQ ID NO: 9343900 - DNA, 22 bp, Homo sapiens
tttccaaaatgaatctaatgca

SEQ ID NO: 9343901 - DNA, 22 bp, Homo sapiens
tttcattttggttatgccataa

SEQ ID NO: 9343902 - DNA, 22 bp, Homo sapiens
tttcattttggttatgccataa

SEQ ID NO: 9343903 - DNA, 22 bp, Homo sapiens
tttcattttggttatgccataa

SEQ ID NO: 9343904 - DNA, 22 bp, Homo sapiens
tttcatttcatagaattgtgtt

SEQ ID NO: 9343905 - DNA, 22 bp, Homo sapiens
tttcatttcatagaattgtgtt

SEQ ID NO: 9343906 - DNA, 22 bp, Homo sapiens
tttcctctgggccctgccaccc

SEQ ID NO: 9343907 - DNA, 22 bp, Homo sapiens
tttcctctgctgccattgcccc

SEQ ID NO: 9343908 - DNA, 22 bp, Homo sapiens
tttcctctgtcatgacagctga

SEQ ID NO: 9343909 - DNA, 22 bp, Homo sapiens
tttcctcttcttcccatgtcat

SEQ ID NO: 9343910 - DNA, 22 bp, Homo sapiens
tttcctcttctggcaggcaggg

SEQ ID NO: 9343911 - DNA, 22 bp, Homo sapiens
tttcctcttcttcccatgtcat

SEQ ID NO: 9343912 - DNA, 22 bp, Homo sapiens
tttcctcttcgattaagtttgg

SEQ ID NO: 9343913 - DNA, 22 bp, Homo sapiens
tttcctcttatacagtgtttat

SEQ ID NO: 9343914 - DNA, 22 bp, Homo sapiens
tttccaaagttgccataagctt

SEQ ID NO: 9343915 - DNA, 22 bp, Homo sapiens
tttccaaaggtggcaggaacaa

SEQ ID NO: 9343916 - DNA, 22 bp, Homo sapiens
tttccaaataaggtcacactca

SEQ ID NO: 9343917 - DNA, 22 bp, Homo sapiens
tttccaaaggctaaactcagtt

SEQ ID NO: 9343918 - DNA, 16 bp, Homo sapiens
tttccaaagggcagct

SEQ ID NO: 9343919 - DNA, 22 bp, Homo sapiens
tttccaaaggaggaaccagttt

SEQ ID NO: 9343920 - DNA, 22 bp, Homo sapiens
tttccaaaggagtaccacgcat

SEQ ID NO: 9343921 - DNA, 22 bp, Homo sapiens
tttgttttgaactagctcagaa

SEQ ID NO: 9343922 - DNA, 22 bp, Homo sapiens
tttgttttctgtaggcctttcc

SEQ ID NO: 9343923 - DNA, 22 bp, Homo sapiens
tttgttttcaatgtgtcattca

SEQ ID NO: 9343924 - DNA, 22 bp, Homo sapiens
tttgtttagatggtaaatcagt

SEQ ID NO: 9343925 - DNA, 22 bp, Homo sapiens
tttgtttcgcagcctctctctg

SEQ ID NO: 9343926 - DNA, 22 bp, Homo sapiens
tttgtttactcattcattgatg

SEQ ID NO: 9343927 - DNA, 22 bp, Homo sapiens
tttgtttagaaagagattggtg

SEQ ID NO: 9343928 - DNA, 22 bp, Homo sapiens
tttgttttcaatgtgtcattca

SEQ ID NO: 9343929 - DNA, 22 bp, Homo sapiens
tttgttttcaatgtgtcattca

SEQ ID NO: 9343930 - DNA, 22 bp, Homo sapiens
tttgttttcaatgtgtcattca

SEQ ID NO: 9343931 - DNA, 22 bp, Homo sapiens
ttttataagcaagaaagggaaa

SEQ ID NO: 9343932 - DNA, 22 bp, Homo sapiens
ttttatacttaagacagagttt

SEQ ID NO: 9343933 - DNA, 22 bp, Homo sapiens
ttttatagctgaatagtattcc

SEQ ID NO: 9343934 - DNA, 22 bp, Homo sapiens
ttttataaagagagtcagttgg

SEQ ID NO: 9343935 - DNA, 22 bp, Homo sapiens
ttttagtttggatttctaaagc

SEQ ID NO: 9343936 - DNA, 22 bp, Homo sapiens
ttttatatggcacattggttgg

SEQ ID NO: 9343937 - DNA, 22 bp, Homo sapiens
ttttatatggcacattggttgg

SEQ ID NO: 9343938 - DNA, 22 bp, Homo sapiens
ttttatattgagtgagagttcc

SEQ ID NO: 9343939 - DNA, 20 bp, Homo sapiens
ttttatatgtagggtatatg

SEQ ID NO: 9343940 - DNA, 22 bp, Homo sapiens
ttttatcaatcattaagacatt

SEQ ID NO: 9343941 - DNA, 22 bp, Homo sapiens
ttttatcaatcattaagacatt

SEQ ID NO: 9343942 - DNA, 22 bp, Homo sapiens
tttgtagaataatatctttctg

SEQ ID NO: 9343943 - DNA, 22 bp, Homo sapiens
tttgtagagggtaattgacaga

SEQ ID NO: 9343944 - DNA, 23 bp, Homo sapiens
tttgtacattgaggaggcagaat

SEQ ID NO: 9343945 - DNA, 22 bp, Homo sapiens
tttgtactagtcagtaaatagt

SEQ ID NO: 9343946 - DNA, 22 bp, Homo sapiens
tttgtactgaagattgtaaact

SEQ ID NO: 9343947 - DNA, 22 bp, Homo sapiens
tttgtataagaacattctagca

SEQ ID NO: 9343948 - DNA, 22 bp, Homo sapiens
tttgtatgaactggtatgtagg

SEQ ID NO: 9343949 - DNA, 22 bp, Homo sapiens
tttgtattacaaagtcacagta

SEQ ID NO: 9343950 - DNA, 22 bp, Homo sapiens
tttgtatgtgataagactattc

SEQ ID NO: 9343951 - DNA, 22 bp, Homo sapiens
tttgtagcagcatgatttataa

SEQ ID NO: 9343952 - DNA, 22 bp, Homo sapiens
tttgtagcagcatgatttataa

SEQ ID NO: 9343953 - DNA, 22 bp, Homo sapiens
tttgtataaatgaagatgctgg

SEQ ID NO: 9343954 - DNA, 22 bp, Homo sapiens
tttgtataaattttgaggtgag

SEQ ID NO: 9343955 - DNA, 22 bp, Homo sapiens
tttgttggttgcactggtgggt

SEQ ID NO: 9343956 - DNA, 22 bp, Homo sapiens
tttgttgtactgggattagact

SEQ ID NO: 9343957 - DNA, 22 bp, Homo sapiens
tttgttgtcatcagtgatgagt

SEQ ID NO: 9343958 - DNA, 22 bp, Homo sapiens
tttgttgtctagcatgaggtgc

SEQ ID NO: 9343959 - DNA, 22 bp, Homo sapiens
tttgttgtgaacagaataatat

SEQ ID NO: 9343960 - DNA, 22 bp, Homo sapiens
tttgttgtgaacagaataatat

SEQ ID NO: 9343961 - DNA, 22 bp, Homo sapiens
tttgttgtgataatggtctgca

SEQ ID NO: 9343962 - DNA, 22 bp, Homo sapiens
tttgttgttagagtatgtgaaa

SEQ ID NO: 9343963 - DNA, 22 bp, Homo sapiens
tttgtttacaaaaataagcagt

SEQ ID NO: 9343964 - DNA, 22 bp, Homo sapiens
tttgttctgcatcacagaaaaa

SEQ ID NO: 9343965 - DNA, 22 bp, Homo sapiens
tttgttcttagtatctgtgtgc

SEQ ID NO: 9343966 - DNA, 22 bp, Homo sapiens
tttgttctgcatcacagaaaaa

SEQ ID NO: 9343967 - DNA, 22 bp, Homo sapiens
tttgttcttagtatctgtgtgc

SEQ ID NO: 9343968 - DNA, 22 bp, Homo sapiens
tttgttcttgcaacagttatta

SEQ ID NO: 9343969 - DNA, 22 bp, Homo sapiens
tttgttggttgcactggtgggt

SEQ ID NO: 9343970 - DNA, 22 bp, Homo sapiens
tttgtatttttcccagctagct

SEQ ID NO: 9343971 - DNA, 22 bp, Homo sapiens
tttgtattccatatcatgccat

SEQ ID NO: 9343972 - DNA, 22 bp, Homo sapiens
tttgtcaatcccttgaaaacct

SEQ ID NO: 9343973 - DNA, 22 bp, Homo sapiens
tttgtcagggatcagatcggta

SEQ ID NO: 9343974 - DNA, 22 bp, Homo sapiens
tttgtcaggaattgaaaagttt

SEQ ID NO: 9343975 - DNA, 22 bp, Homo sapiens
tttgatttactggatattctca

SEQ ID NO: 9343976 - DNA, 22 bp, Homo sapiens
tttgattttcagcaatagtggc

SEQ ID NO: 9343977 - DNA, 22 bp, Homo sapiens
tttgattttcagcaatagtggc

SEQ ID NO: 9343978 - DNA, 22 bp, Homo sapiens
tttctttccatgagcctatgta

SEQ ID NO: 9343979 - DNA, 22 bp, Homo sapiens
tttctttccatgagcctatgta

SEQ ID NO: 9343980 - DNA, 22 bp, Homo sapiens
tttctttctcgtaaacttagtt

SEQ ID NO: 9343981 - DNA, 18 bp, Homo sapiens
tttctttctgcctggggc

SEQ ID NO: 9343982 - DNA, 22 bp, Homo sapiens
tttctttccatgagcctatgta

SEQ ID NO: 9343983 - DNA, 22 bp, Homo sapiens
tttctttctcgtaaacttagtt

SEQ ID NO: 9343984 - DNA, 22 bp, Homo sapiens
tttctttatcctcctttgcaca

SEQ ID NO: 9343985 - DNA, 22 bp, Homo sapiens
tttctttcaattctcctaatgc

SEQ ID NO: 9343986 - DNA, 22 bp, Homo sapiens
tttctttccagagtgattggca

SEQ ID NO: 9343987 - DNA, 22 bp, Homo sapiens
tttctttccagagtgattggca

SEQ ID NO: 9343988 - DNA, 22 bp, Homo sapiens
tttctttccatacatattgcta

SEQ ID NO: 9343989 - DNA, 22 bp, Homo sapiens
tttgcagtcaaatttgctaaat

SEQ ID NO: 9343990 - DNA, 22 bp, Homo sapiens
tttgcagtagacatcttatttt

SEQ ID NO: 9343991 - DNA, 22 bp, Homo sapiens
tttgcagcctccctggcagaag

SEQ ID NO: 9343992 - DNA, 22 bp, Homo sapiens
tttgcacacacaataacaaatg

SEQ ID NO: 9343993 - DNA, 22 bp, Homo sapiens
tttgcacacattcttagaaatg

SEQ ID NO: 9343994 - DNA, 22 bp, Homo sapiens
tttgcacacattcttagaaatg

SEQ ID NO: 9343995 - DNA, 22 bp, Homo sapiens
tttgcacttcctaatgtgtttt

SEQ ID NO: 9343996 - DNA, 22 bp, Homo sapiens
tttgcactagcatttgtccatg

SEQ ID NO: 9343997 - DNA, 22 bp, Homo sapiens
tttgcacttaaatttacaacac

SEQ ID NO: 9343998 - DNA, 22 bp, Homo sapiens
tttgcaatttgtgctgcaaatg

SEQ ID NO: 9343999 - DNA, 22 bp, Homo sapiens
tttgcaagtatcaaacatgtca

SEQ ID NO: 9344000 - DNA, 22 bp, Homo sapiens
tttgcaagatgaaaaagttcta

SEQ ID NO: 9344001 - DNA, 22 bp, Homo sapiens
tttgcaacagactcatcattga

SEQ ID NO: 9344002 - DNA, 22 bp, Homo sapiens
tttggagagagttaaatatgtt

SEQ ID NO: 9344003 - DNA, 22 bp, Homo sapiens
tttggagaagttgctaaagtgt

SEQ ID NO: 9344004 - DNA, 20 bp, Homo sapiens
tttggagagaaagaagtagt

SEQ ID NO: 9344005 - DNA, 22 bp, Homo sapiens
tttggaagggaaagaaagtact

SEQ ID NO: 9344006 - DNA, 22 bp, Homo sapiens
tttgcagtctggcctgctttgg

SEQ ID NO: 9344007 - DNA, 22 bp, Homo sapiens
tttgcagtcaaatttgctaaat

SEQ ID NO: 9344008 - DNA, 22 bp, Homo sapiens
tttgcagtgattcttgcagtga

SEQ ID NO: 9344009 - DNA, 22 bp, Homo sapiens
tttggaacaagacaaaacatta

SEQ ID NO: 9344010 - DNA, 22 bp, Homo sapiens
tttggacaaatgtctgactttc

SEQ ID NO: 9344011 - DNA, 22 bp, Homo sapiens
tttggacaagttactggtttcc

SEQ ID NO: 9344012 - DNA, 22 bp, Homo sapiens
tttggacttagcctgcagaatt

SEQ ID NO: 9344013 - DNA, 22 bp, Homo sapiens
tttgtacatcctaattctgagt

SEQ ID NO: 9344014 - DNA, 22 bp, Homo sapiens
tttgtacatcctaattctgagt

SEQ ID NO: 9344015 - DNA, 23 bp, Homo sapiens
tttgtacattgaggaggcagaat

SEQ ID NO: 9344016 - DNA, 22 bp, Homo sapiens
tttgtacaattagcagaggcta

SEQ ID NO: 9344017 - DNA, 22 bp, Homo sapiens
tttgtacacaacctgtggtagt

SEQ ID NO: 9344018 - DNA, 19 bp, Homo sapiens
tttggcaggagataggatg

SEQ ID NO: 9344019 - DNA, 22 bp, Homo sapiens
tttgtaatgataatgttaaatt

SEQ ID NO: 9344020 - DNA, 22 bp, Homo sapiens
tttggcactgttctaggtgcaa

SEQ ID NO: 9344021 - DNA, 22 bp, Homo sapiens
ttttcttcggtgctgggttgat

SEQ ID NO: 9344022 - DNA, 22 bp, Homo sapiens
ttttctttaatctggtggggtg

SEQ ID NO: 9344023 - DNA, 22 bp, Homo sapiens
ttttctagggtgctaaatgaac

SEQ ID NO: 9344024 - DNA, 22 bp, Homo sapiens
ttttctatctcctagaactgcc

SEQ ID NO: 9344025 - DNA, 22 bp, Homo sapiens
ttttctaactttacactcgaaa

SEQ ID NO: 9344026 - DNA, 22 bp, Homo sapiens
ttttctatctcctagaactgcc

SEQ ID NO: 9344027 - DNA, 22 bp, Homo sapiens
ttttctatctcctagaactgcc

SEQ ID NO: 9344028 - DNA, 22 bp, Homo sapiens
ttttctattaactcattttgca

SEQ ID NO: 9344029 - DNA, 22 bp, Homo sapiens
ttttctaaaagaagtcactgat

SEQ ID NO: 9344030 - DNA, 23 bp, Homo sapiens
ttttcctttggacaggctgtatt

SEQ ID NO: 9344031 - DNA, 22 bp, Homo sapiens
ttttcctttggaagatgcatat

SEQ ID NO: 9344032 - DNA, 22 bp, Homo sapiens
ttttcctttggaagatgcatat

SEQ ID NO: 9344033 - DNA, 22 bp, Homo sapiens
ttttctaacatctagtaatttg

SEQ ID NO: 9344034 - DNA, 22 bp, Homo sapiens
ttttctaacatctagtaatttg

SEQ ID NO: 9344035 - DNA, 22 bp, Homo sapiens
ttttctaacatctagtaatttg

SEQ ID NO: 9344036 - DNA, 22 bp, Homo sapiens
ttttctaaaatatccaggacag

SEQ ID NO: 9344037 - DNA, 22 bp, Homo sapiens
ttttcctttcatcaggacaaag

SEQ ID NO: 9344038 - DNA, 20 bp, Homo sapiens
ttttccttgttgccgctgct

SEQ ID NO: 9344039 - DNA, 22 bp, Homo sapiens
ttttcctttgaaaggtgagggc

SEQ ID NO: 9344040 - DNA, 22 bp, Homo sapiens
ttttcctttgattcccagatgt

SEQ ID NO: 9344041 - DNA, 22 bp, Homo sapiens
ttttccttctgatactccattt

SEQ ID NO: 9344042 - DNA, 22 bp, Homo sapiens
ttttccttctgatactccattt

SEQ ID NO: 9344043 - DNA, 20 bp, Homo sapiens
ttttccttctgagtatgttg

SEQ ID NO: 9344044 - DNA, 20 bp, Homo sapiens
ttttccttctgagtatgttg

SEQ ID NO: 9344045 - DNA, 22 bp, Homo sapiens
ttttatgaagataattttctga

SEQ ID NO: 9344046 - DNA, 22 bp, Homo sapiens
ttttatgaagataattttctga

SEQ ID NO: 9344047 - DNA, 22 bp, Homo sapiens
ttttatcttcattcctatctac

SEQ ID NO: 9344048 - DNA, 19 bp, Homo sapiens
ttttccttctcctcttaat

SEQ ID NO: 9344049 - DNA, 19 bp, Homo sapiens
ttttccttctcctcttaat

SEQ ID NO: 9344050 - DNA, 22 bp, Homo sapiens
ttttatctacctatgctcattt

SEQ ID NO: 9344051 - DNA, 22 bp, Homo sapiens
ttttggcaaaggcattctcttt

SEQ ID NO: 9344052 - DNA, 22 bp, Homo sapiens
ttttgcctaagaatctctctga

SEQ ID NO: 9344053 - DNA, 22 bp, Homo sapiens
ttttgaaagggtgatttggctt

SEQ ID NO: 9344054 - DNA, 20 bp, Homo sapiens
ttttgatagcaaagacggta

SEQ ID NO: 9344055 - DNA, 22 bp, Homo sapiens
ttttgaataattcagaaacagc

SEQ ID NO: 9344056 - DNA, 23 bp, Homo sapiens
ttttgacaggaggaaggtgttga

SEQ ID NO: 9344057 - DNA, 19 bp, Homo sapiens
ttttgaagtatgagacagg

SEQ ID NO: 9344058 - DNA, 22 bp, Homo sapiens
tttttcatgagactagaagtca

SEQ ID NO: 9344059 - DNA, 22 bp, Homo sapiens
ttttggcagattacttaatatg

SEQ ID NO: 9344060 - DNA, 22 bp, Homo sapiens
ttttggcactttgtctgattct

SEQ ID NO: 9344061 - DNA, 22 bp, Homo sapiens
ttttggcactgcgtctacatgg

SEQ ID NO: 9344062 - DNA, 22 bp, Homo sapiens
ttttggccacatccttttgagt

SEQ ID NO: 9344063 - DNA, 22 bp, Homo sapiens
tttttcctagcgatttgtcagc

SEQ ID NO: 9344064 - DNA, 22 bp, Homo sapiens
tttttcctagcgatttgtcagc

SEQ ID NO: 9344065 - DNA, 20 bp, Homo sapiens
tttttccttctctacaggca

SEQ ID NO: 9344066 - DNA, 22 bp, Homo sapiens
tttttccttaggggttactcac

SEQ ID NO: 9344067 - DNA, 22 bp, Homo sapiens
tttttccttaggggttactcac

SEQ ID NO: 9344068 - DNA, 22 bp, Homo sapiens
tttttcctagtgctttctggta

SEQ ID NO: 9344069 - DNA, 22 bp, Homo sapiens
tttttcctagtgctttctggta

SEQ ID NO: 9344070 - DNA, 22 bp, Homo sapiens
tttttccagggttagatgttta

SEQ ID NO: 9344071 - DNA, 22 bp, Homo sapiens
tttttccagggttagatgttta

SEQ ID NO: 9344072 - DNA, 22 bp, Homo sapiens
tttttccagggttagatgttta

SEQ ID NO: 9344073 - DNA, 22 bp, Homo sapiens
tttttccacataccctaggcca

SEQ ID NO: 9344074 - DNA, 22 bp, Homo sapiens
tttttccaccgtacttcctgag

SEQ ID NO: 9344075 - DNA, 22 bp, Homo sapiens
tttttgcaccaacctaatagaa

SEQ ID NO: 9344076 - DNA, 22 bp, Homo sapiens
tttttgattcctagtctaggca

SEQ ID NO: 9344077 - DNA, 22 bp, Homo sapiens
tttttgctccacaactttgaag

SEQ ID NO: 9344078 - DNA, 22 bp, Homo sapiens
tttttgggtccaggctgtatct

SEQ ID NO: 9344079 - DNA, 22 bp, Homo sapiens
tttttgggtccaggctgtatct

SEQ ID NO: 9344080 - DNA, 22 bp, Homo sapiens
ttttttgtcttgaagaaatggt

SEQ ID NO: 9344081 - DNA, 22 bp, Homo sapiens
ttttttgtcttgaagaaatggt

SEQ ID NO: 9344082 - DNA, 22 bp, Homo sapiens
ttttttgtcttgaagaaatggt

SEQ ID NO: 9344083 - DNA, 20 bp, Homo sapiens
tttttccttctctacaggca

SEQ ID NO: 9344084 - DNA, 20 bp, Homo sapiens
tttttccttctctacaggca

SEQ ID NO: 9344085 - DNA, 22 bp, Homo sapiens
tttttccttggatgtgtctctc

SEQ ID NO: 9344086 - DNA, 22 bp, Homo sapiens
tttttctaatggcttaggatgt

SEQ ID NO: 9344087 - DNA, 22 bp, Homo sapiens
tttttgatactcaagaggggta

SEQ ID NO: 9344088 - DNA, 22 bp, Homo sapiens
tttttgatctgagcagttggag

SEQ ID NO: 9344089 - DNA, 22 bp, Homo sapiens
tttttgattcctagtctaggca

SEQ ID NO: 9344090 - DNA, 22 bp, Homo sapiens
tttttgaaggctgatgtgatta

SEQ ID NO: 9344091 - DNA, 22 bp, Homo sapiens
ttcctaactggcctttatggat

SEQ ID NO: 9344092 - DNA, 22 bp, Homo sapiens
ttcctaactctggcacctagtc

SEQ ID NO: 9344093 - DNA, 22 bp, Homo sapiens
ttcctaacctctagctgcatat

SEQ ID NO: 9344094 - DNA, 22 bp, Homo sapiens
ttcctaacgccagtattttcat

SEQ ID NO: 9344095 - DNA, 22 bp, Homo sapiens
ttcctaacacagtgtaagcaag

SEQ ID NO: 9344096 - DNA, 20 bp, Homo sapiens
ttccctggaaggagaagcag

SEQ ID NO: 9344097 - DNA, 20 bp, Homo sapiens
ttccctggaaggagaagcag

SEQ ID NO: 9344098 - DNA, 22 bp, Homo sapiens
ttcctaacaagtctatctttga

SEQ ID NO: 9344099 - DNA, 22 bp, Homo sapiens
ttcctaacaaggggtattcatc

SEQ ID NO: 9344100 - DNA, 22 bp, Homo sapiens
ttccctggccctggcacgctct

SEQ ID NO: 9344101 - DNA, 22 bp, Homo sapiens
ttccagaatagatggagctcta

SEQ ID NO: 9344102 - DNA, 22 bp, Homo sapiens
ttccagaagcctccatattact

SEQ ID NO: 9344103 - DNA, 22 bp, Homo sapiens
ttccagaaggaagccggggagc

SEQ ID NO: 9344104 - DNA, 22 bp, Homo sapiens
ttccagaagatggcagcaaagg

SEQ ID NO: 9344105 - DNA, 22 bp, Homo sapiens
ttccagaacttttgttaatttc

SEQ ID NO: 9344106 - DNA, 22 bp, Homo sapiens
ttccagaattttgttctgcttg

SEQ ID NO: 9344107 - DNA, 22 bp, Homo sapiens
ttccagaattgggagccttgag

SEQ ID NO: 9344108 - DNA, 22 bp, Homo sapiens
ttccagagagagaaaatttgat

SEQ ID NO: 9344109 - DNA, 22 bp, Homo sapiens
ttccagagcctagaatcttgat

SEQ ID NO: 9344110 - DNA, 21 bp, Homo sapiens
ttccagagattgtttcacctg

SEQ ID NO: 9344111 - DNA, 22 bp, Homo sapiens
ttccagagcagttttcagatca

SEQ ID NO: 9344112 - DNA, 22 bp, Homo sapiens
ttccagagagttattcccctgg

SEQ ID NO: 9344113 - DNA, 22 bp, Homo sapiens
ttccagagaggctcatgttccc

SEQ ID NO: 9344114 - DNA, 22 bp, Homo sapiens
ttccagagaggctcatgttccc

SEQ ID NO: 9344115 - DNA, 20 bp, Homo sapiens
ttccagagatctgcatttta

SEQ ID NO: 9344116 - DNA, 22 bp, Homo sapiens
ttccagaaatctttcagctcaa

SEQ ID NO: 9344117 - DNA, 22 bp, Homo sapiens
ttccacattccttacattcata

SEQ ID NO: 9344118 - DNA, 22 bp, Homo sapiens
ttccagaactcaagaaatgccc

SEQ ID NO: 9344119 - DNA, 22 bp, Homo sapiens
ttccagaacaatgtggacgtat

SEQ ID NO: 9344120 - DNA, 22 bp, Homo sapiens
ttccagaaccttcctgctggaa

SEQ ID NO: 9344121 - DNA, 21 bp, Homo sapiens
ttccacagtgagaactgcaag

SEQ ID NO: 9344122 - DNA, 21 bp, Homo sapiens
ttccacagtgagaactgcaag

SEQ ID NO: 9344123 - DNA, 21 bp, Homo sapiens
ttccacagtgagaactgcaag

SEQ ID NO: 9344124 - DNA, 22 bp, Homo sapiens
ttccacagcccaagctggtggc

SEQ ID NO: 9344125 - DNA, 22 bp, Homo sapiens
ttccacaatgccaggggcatca

SEQ ID NO: 9344126 - DNA, 23 bp, Homo sapiens
ttccacaatgaaaataaagcagg

SEQ ID NO: 9344127 - DNA, 22 bp, Homo sapiens
ttccacaattcagattgttgcc

SEQ ID NO: 9344128 - DNA, 22 bp, Homo sapiens
ttccacaagtgatatctagctg

SEQ ID NO: 9344129 - DNA, 22 bp, Homo sapiens
ttccacaagatgtttcttagaa

SEQ ID NO: 9344130 - DNA, 22 bp, Homo sapiens
ttccacaaacacatcctgagca

SEQ ID NO: 9344131 - DNA, 22 bp, Homo sapiens
ttccacaaatacactccacatt

SEQ ID NO: 9344132 - DNA, 22 bp, Homo sapiens
ttccacaaatcaattctgctga

SEQ ID NO: 9344133 - DNA, 22 bp, Homo sapiens
ttccacaacaaccaagcatata

SEQ ID NO: 9344134 - DNA, 22 bp, Homo sapiens
ttcctccagcctggagcacttc

SEQ ID NO: 9344135 - DNA, 22 bp, Homo sapiens
ttcctctgtagttgctgatgaa

SEQ ID NO: 9344136 - DNA, 22 bp, Homo sapiens
ttcctctggaggctctaggaga

SEQ ID NO: 9344137 - DNA, 22 bp, Homo sapiens
ttcctctgtagttgctgatgaa

SEQ ID NO: 9344138 - DNA, 22 bp, Homo sapiens
ttcctcatggggttccttcaga

SEQ ID NO: 9344139 - DNA, 22 bp, Homo sapiens
ttcctcagttagtgcctgaggc

SEQ ID NO: 9344140 - DNA, 22 bp, Homo sapiens
ttcctccacgtgacaggagcca

SEQ ID NO: 9344141 - DNA, 22 bp, Homo sapiens
ttcctccagaagctgtagggga

SEQ ID NO: 9344142 - DNA, 22 bp, Homo sapiens
ttcctcaggcttccctttgtcc

SEQ ID NO: 9344143 - DNA, 22 bp, Homo sapiens
ttcctcaggcttccctttgtcc

SEQ ID NO: 9344144 - DNA, 22 bp, Homo sapiens
ttcctcagggaggctagcagta

SEQ ID NO: 9344145 - DNA, 22 bp, Homo sapiens
ttcctcagggcggatgggcagg

SEQ ID NO: 9344146 - DNA, 22 bp, Homo sapiens
ttcctcagttagtgcctgaggc

SEQ ID NO: 9344147 - DNA, 22 bp, Homo sapiens
ttcctcagttagtgcctgaggc

SEQ ID NO: 9344148 - DNA, 22 bp, Homo sapiens
ttcctcagctgtttgggctcat

SEQ ID NO: 9344149 - DNA, 22 bp, Homo sapiens
ttcctcagctggcctgattggg

SEQ ID NO: 9344150 - DNA, 22 bp, Homo sapiens
ttcctcagctgtgtcctggcga

SEQ ID NO: 9344151 - DNA, 22 bp, Homo sapiens
ttcctcagctttagactatgaa

SEQ ID NO: 9344152 - DNA, 20 bp, Homo sapiens
ttcctcaggagaggatgtta

SEQ ID NO: 9344153 - DNA, 22 bp, Homo sapiens
ttcctcagaccctcattgtgag

SEQ ID NO: 9344154 - DNA, 22 bp, Homo sapiens
ttcctcagaaaatactgtccaa

SEQ ID NO: 9344155 - DNA, 22 bp, Homo sapiens
ttcctcagaaaatactgtccaa

SEQ ID NO: 9344156 - DNA, 22 bp, Homo sapiens
ttcctcagagagacagaaacta

SEQ ID NO: 9344157 - DNA, 22 bp, Homo sapiens
ttcctcagaccctcattgtgag

SEQ ID NO: 9344158 - DNA, 22 bp, Homo sapiens
ttcctcagagggcgctggggaa

SEQ ID NO: 9344159 - DNA, 22 bp, Homo sapiens
ttcctcagagggcgctggggaa

SEQ ID NO: 9344160 - DNA, 22 bp, Homo sapiens
ttcctcagccagcacttagggg

SEQ ID NO: 9344161 - DNA, 22 bp, Homo sapiens
ttcctcagctcagcgagagaga

SEQ ID NO: 9344162 - DNA, 22 bp, Homo sapiens
ttcctcagccagcacttagggg

SEQ ID NO: 9344163 - DNA, 22 bp, Homo sapiens
ttcctcagctggcctgattggg

SEQ ID NO: 9344164 - DNA, 22 bp, Homo sapiens
ttcctcagctggcctgattggg

SEQ ID NO: 9344165 - DNA, 22 bp, Homo sapiens
ttcctcagccaaggctgggatc

SEQ ID NO: 9344166 - DNA, 22 bp, Homo sapiens
ttcctcagcacaaagccaagat

SEQ ID NO: 9344167 - DNA, 22 bp, Homo sapiens
ttcctacaattagagcctcttt

SEQ ID NO: 9344168 - DNA, 22 bp, Homo sapiens
ttcctacatttgtacaataaga

SEQ ID NO: 9344169 - DNA, 22 bp, Homo sapiens
ttcctagctataaagctcttcc

SEQ ID NO: 9344170 - DNA, 22 bp, Homo sapiens
ttcctagctataaagctcttcc

SEQ ID NO: 9344171 - DNA, 22 bp, Homo sapiens
ttcctagggcagagccgctggg

SEQ ID NO: 9344172 - DNA, 22 bp, Homo sapiens
ttcctagggcagagccgctggg

SEQ ID NO: 9344173 - DNA, 20 bp, Homo sapiens
ttcctcacaagtccctcggc

SEQ ID NO: 9344174 - DNA, 22 bp, Homo sapiens
ttcctcaacaacttccctacag

SEQ ID NO: 9344175 - DNA, 22 bp, Homo sapiens
ttcctatggctcagttgcattt

SEQ ID NO: 9344176 - DNA, 19 bp, Homo sapiens
ttctagaactgttctctca

SEQ ID NO: 9344177 - DNA, 22 bp, Homo sapiens
ttctagaagtgtctatgtctgt

SEQ ID NO: 9344178 - DNA, 22 bp, Homo sapiens
ttctaggaccctgcgtgagaac

SEQ ID NO: 9344179 - DNA, 22 bp, Homo sapiens
ttctagctgttgctgtttatag

SEQ ID NO: 9344180 - DNA, 22 bp, Homo sapiens
ttctaggggagaggaagaagtg

SEQ ID NO: 9344181 - DNA, 22 bp, Homo sapiens
ttctagatagagtgcaaattat

SEQ ID NO: 9344182 - DNA, 22 bp, Homo sapiens
ttctagattgacagagagcaca

SEQ ID NO: 9344183 - DNA, 22 bp, Homo sapiens
ttctacaatatgaataatgaag

SEQ ID NO: 9344184 - DNA, 22 bp, Homo sapiens
ttctacaaatatttactgttcc

SEQ ID NO: 9344185 - DNA, 20 bp, Homo sapiens
ttctacaaaactgattctga

SEQ ID NO: 9344186 - DNA, 22 bp, Homo sapiens
ttctacaatatgaataatgaag

SEQ ID NO: 9344187 - DNA, 22 bp, Homo sapiens
ttctacaaatatttactgttcc

SEQ ID NO: 9344188 - DNA, 22 bp, Homo sapiens
ttctacttctgacactgtttgt

SEQ ID NO: 9344189 - DNA, 19 bp, Homo sapiens
ttctactttgtttccccct

SEQ ID NO: 9344190 - DNA, 19 bp, Homo sapiens
ttctaatgttacattttgg

SEQ ID NO: 9344191 - DNA, 22 bp, Homo sapiens
ttctaatgatttcattcaaagc

SEQ ID NO: 9344192 - DNA, 22 bp, Homo sapiens
ttctaattattcccttgtccca

SEQ ID NO: 9344193 - DNA, 22 bp, Homo sapiens
ttctaattaaatctacgctagg

SEQ ID NO: 9344194 - DNA, 22 bp, Homo sapiens
ttctaattgtgtttgcatatct

SEQ ID NO: 9344195 - DNA, 22 bp, Homo sapiens
ttctaattgtgtttgcatatct

SEQ ID NO: 9344196 - DNA, 20 bp, Homo sapiens
ttctaatttgatggagtagc

SEQ ID NO: 9344197 - DNA, 22 bp, Homo sapiens
ttctaagtttctcagtttcagt

SEQ ID NO: 9344198 - DNA, 22 bp, Homo sapiens
ttctaatacacggtatgacttt

SEQ ID NO: 9344199 - DNA, 22 bp, Homo sapiens
ttctaatagctgcctatgtatt

SEQ ID NO: 9344200 - DNA, 22 bp, Homo sapiens
ttctaatgaaatctgtacagta

SEQ ID NO: 9344201 - DNA, 22 bp, Homo sapiens
ttctaatgaaagtggaccatgg

SEQ ID NO: 9344202 - DNA, 19 bp, Homo sapiens
ttcctgtgctgctgtgtcc

SEQ ID NO: 9344203 - DNA, 22 bp, Homo sapiens
ttcctgtgcttattcttctctg

SEQ ID NO: 9344204 - DNA, 22 bp, Homo sapiens
ttcctgtgcttattcttctctg

SEQ ID NO: 9344205 - DNA, 22 bp, Homo sapiens
ttcctgtggccttacatctgtg

SEQ ID NO: 9344206 - DNA, 22 bp, Homo sapiens
ttcctgtggtccagagtcatcc

SEQ ID NO: 9344207 - DNA, 22 bp, Homo sapiens
ttcctgtgtgaccgagacagtg

SEQ ID NO: 9344208 - DNA, 22 bp, Homo sapiens
ttcctctttagggctggccagg

SEQ ID NO: 9344209 - DNA, 22 bp, Homo sapiens
ttcctcttccatcttcccaggg

SEQ ID NO: 9344210 - DNA, 22 bp, Homo sapiens
ttcctgaaaatacagggagaga

SEQ ID NO: 9344211 - DNA, 22 bp, Homo sapiens
ttcctgaaaatacagggagacc

SEQ ID NO: 9344212 - DNA, 22 bp, Homo sapiens
ttcctctttgcatcctcaactc

SEQ ID NO: 9344213 - DNA, 22 bp, Homo sapiens
ttcctctttctctgtgctatgt

SEQ ID NO: 9344214 - DNA, 22 bp, Homo sapiens
ttcctgaacatttctaagttga

SEQ ID NO: 9344215 - DNA, 22 bp, Homo sapiens
ttcctgaagtcaaagatctaaa

SEQ ID NO: 9344216 - DNA, 22 bp, Homo sapiens
ttcctgaagtcaaagatctaaa

SEQ ID NO: 9344217 - DNA, 20 bp, Homo sapiens
ttcctgtcctctctttcagg

SEQ ID NO: 9344218 - DNA, 22 bp, Homo sapiens
ttcctgtccgcaatggcctggg

SEQ ID NO: 9344219 - DNA, 22 bp, Homo sapiens
ttccttctcagccctcgaggat

SEQ ID NO: 9344220 - DNA, 22 bp, Homo sapiens
ttccttctattcagctccaaga

SEQ ID NO: 9344221 - DNA, 22 bp, Homo sapiens
ttccttctagcccaagtattgg

SEQ ID NO: 9344222 - DNA, 22 bp, Homo sapiens
ttccttctagcccaagtattgg

SEQ ID NO: 9344223 - DNA, 22 bp, Homo sapiens
ttccttctattcagctccaaga

SEQ ID NO: 9344224 - DNA, 22 bp, Homo sapiens
ttccttctctgtggggaaggca

SEQ ID NO: 9344225 - DNA, 22 bp, Homo sapiens
ttccttctccagaacttctagg

SEQ ID NO: 9344226 - DNA, 22 bp, Homo sapiens
ttccttctccagaacttctagg

SEQ ID NO: 9344227 - DNA, 22 bp, Homo sapiens
ttccttctcagccctcgaggat

SEQ ID NO: 9344228 - DNA, 22 bp, Homo sapiens
ttccttctgaagcctttgtgtt

SEQ ID NO: 9344229 - DNA, 22 bp, Homo sapiens
ttccttctctgtggggaaggca

SEQ ID NO: 9344230 - DNA, 22 bp, Homo sapiens
ttccttctgaagcctttgtgtt

SEQ ID NO: 9344231 - DNA, 22 bp, Homo sapiens
ttccttaggctgtttgcagtgc

SEQ ID NO: 9344232 - DNA, 22 bp, Homo sapiens
ttccttaatgaatcaggccatt

SEQ ID NO: 9344233 - DNA, 22 bp, Homo sapiens
ttccttagtgttagattctgtg

SEQ ID NO: 9344234 - DNA, 22 bp, Homo sapiens
ttccttagttgactgtcttagt

SEQ ID NO: 9344235 - DNA, 22 bp, Homo sapiens
ttccttagtgttagattctgtg

SEQ ID NO: 9344236 - DNA, 22 bp, Homo sapiens
ttccttctagagcttgtttagg

SEQ ID NO: 9344237 - DNA, 22 bp, Homo sapiens
ttccttctagagcttgtttagg

SEQ ID NO: 9344238 - DNA, 22 bp, Homo sapiens
ttccttcaaacgcctcctgcac

SEQ ID NO: 9344239 - DNA, 22 bp, Homo sapiens
ttcacagtggctgacaggctgg

SEQ ID NO: 9344240 - DNA, 22 bp, Homo sapiens
ttcacagtggctgtgccatttg

SEQ ID NO: 9344241 - DNA, 22 bp, Homo sapiens
ttcacagtggctaagttctgca

SEQ ID NO: 9344242 - DNA, 22 bp, Homo sapiens
ttcacagtgctgcacctggctt

SEQ ID NO: 9344243 - DNA, 22 bp, Homo sapiens
ttcacagtggctaagttctgca

SEQ ID NO: 9344244 - DNA, 22 bp, Homo sapiens
ttcacattataatcagttctgc

SEQ ID NO: 9344245 - DNA, 22 bp, Homo sapiens
ttcagtatgtagaacaagtgtt

SEQ ID NO: 9344246 - DNA, 22 bp, Homo sapiens
ttcagtccatcaggcgtggcat

SEQ ID NO: 9344247 - DNA, 22 bp, Homo sapiens
ttcagtctcaagtgctgctcac

SEQ ID NO: 9344248 - DNA, 20 bp, Homo sapiens
ttcagggctttggggacacc

SEQ ID NO: 9344249 - DNA, 22 bp, Homo sapiens
ttcaggtgtggccagaggagaa

SEQ ID NO: 9344250 - DNA, 22 bp, Homo sapiens
ttcaggtgtggccagaggagaa

SEQ ID NO: 9344251 - DNA, 22 bp, Homo sapiens
ttcaggtgggccttttgagcat

SEQ ID NO: 9344252 - DNA, 21 bp, Homo sapiens
ttcaggtgagatcatgttgac

SEQ ID NO: 9344253 - DNA, 22 bp, Homo sapiens
ttcaggtagtttaactgttcca

SEQ ID NO: 9344254 - DNA, 22 bp, Homo sapiens
ttcaggtagacgcagcagaaca

SEQ ID NO: 9344255 - DNA, 22 bp, Homo sapiens
ttcagtgccgtgctgggtcgct

SEQ ID NO: 9344256 - DNA, 22 bp, Homo sapiens
ttcagtgccgtgctgggtcgct

SEQ ID NO: 9344257 - DNA, 22 bp, Homo sapiens
ttcagtgcctgtccacagcttc

SEQ ID NO: 9344258 - DNA, 22 bp, Homo sapiens
ttcagtgcctgtccacagcttc

SEQ ID NO: 9344259 - DNA, 22 bp, Homo sapiens
ttcagtgctaaaaagtctcaag

SEQ ID NO: 9344260 - DNA, 22 bp, Homo sapiens
ttcagtgctaaaaagtctcaag

SEQ ID NO: 9344261 - DNA, 22 bp, Homo sapiens
ttcagtgcttacaggtttcttt

SEQ ID NO: 9344262 - DNA, 22 bp, Homo sapiens
ttcagtgcttacaggtttcttt

SEQ ID NO: 9344263 - DNA, 22 bp, Homo sapiens
ttcagtgcacagtactgagact

SEQ ID NO: 9344264 - DNA, 22 bp, Homo sapiens
ttcagtgcagacgccgaagccc

SEQ ID NO: 9344265 - DNA, 22 bp, Homo sapiens
ttcagtgcagacgccgaagccc

SEQ ID NO: 9344266 - DNA, 22 bp, Homo sapiens
ttcagtgcacagtactgagact

SEQ ID NO: 9344267 - DNA, 22 bp, Homo sapiens
ttcagtgcagtcggaactactg

SEQ ID NO: 9344268 - DNA, 22 bp, Homo sapiens
ttcagtgtacagtgaagggatt

SEQ ID NO: 9344269 - DNA, 22 bp, Homo sapiens
ttcatcatcagaactgttcact

SEQ ID NO: 9344270 - DNA, 18 bp, Homo sapiens
ttcatcatgactctgtgg

SEQ ID NO: 9344271 - DNA, 22 bp, Homo sapiens
ttcatcatctacaaccaggacc

SEQ ID NO: 9344272 - DNA, 19 bp, Homo sapiens
ttcatgcccaatttgctac

SEQ ID NO: 9344273 - DNA, 22 bp, Homo sapiens
ttcatggatcatgccttttgtg

SEQ ID NO: 9344274 - DNA, 22 bp, Homo sapiens
ttcatgcactatttcttctagc

SEQ ID NO: 9344275 - DNA, 22 bp, Homo sapiens
ttcatgatagtattttttgtga

SEQ ID NO: 9344276 - DNA, 22 bp, Homo sapiens
ttcatcattgccagtctttaaa

SEQ ID NO: 9344277 - DNA, 22 bp, Homo sapiens
ttcatcattacagtcatgttat

SEQ ID NO: 9344278 - DNA, 22 bp, Homo sapiens
ttcatcatgatgttcccctcta

SEQ ID NO: 9344279 - DNA, 20 bp, Homo sapiens
ttcatgggagcaaagaggcc

SEQ ID NO: 9344280 - DNA, 20 bp, Homo sapiens
ttcatgggagcaaagaggcc

SEQ ID NO: 9344281 - DNA, 20 bp, Homo sapiens
ttcatggtgtatttctttct

SEQ ID NO: 9344282 - DNA, 22 bp, Homo sapiens
ttcatgtaattccataaggtaa

SEQ ID NO: 9344283 - DNA, 22 bp, Homo sapiens
ttcatgtctgccttttcaagtg

SEQ ID NO: 9344284 - DNA, 22 bp, Homo sapiens
ttcatgtgaatatatttgtctt

SEQ ID NO: 9344285 - DNA, 22 bp, Homo sapiens
ttcatgtatgaggccaatcttt

SEQ ID NO: 9344286 - DNA, 22 bp, Homo sapiens
ttcatgtggaaaagggctttca

SEQ ID NO: 9344287 - DNA, 22 bp, Homo sapiens
ttcatgtgataaatgtgtgact

SEQ ID NO: 9344288 - DNA, 22 bp, Homo sapiens
ttcatgttgtagtatgtatcag

SEQ ID NO: 9344289 - DNA, 22 bp, Homo sapiens
ttccaatttgtggtgagttaat

SEQ ID NO: 9344290 - DNA, 22 bp, Homo sapiens
ttccaattgttctttggaatct

SEQ ID NO: 9344291 - DNA, 22 bp, Homo sapiens
ttcacaaaaatgctgaacagtt

SEQ ID NO: 9344292 - DNA, 22 bp, Homo sapiens
ttcacaaaatggtttgttgatg

SEQ ID NO: 9344293 - DNA, 22 bp, Homo sapiens
ttcaatttcataatatctagct

SEQ ID NO: 9344294 - DNA, 22 bp, Homo sapiens
ttcaatttgtgctaaggcaccg

SEQ ID NO: 9344295 - DNA, 22 bp, Homo sapiens
ttcaattttgcagaggaatgca

SEQ ID NO: 9344296 - DNA, 22 bp, Homo sapiens
ttcaagaagcccaaagactagc

SEQ ID NO: 9344297 - DNA, 22 bp, Homo sapiens
ttcaagaaagagtggctattcc

SEQ ID NO: 9344298 - DNA, 22 bp, Homo sapiens
ttcaactttggagatttaataa

SEQ ID NO: 9344299 - DNA, 22 bp, Homo sapiens
ttcaatgcatatagatatagaa

SEQ ID NO: 9344300 - DNA, 22 bp, Homo sapiens
ttcaatttagtgatgttgttgg

SEQ ID NO: 9344301 - DNA, 22 bp, Homo sapiens
ttcacaggttgaagcctaatcc

SEQ ID NO: 9344302 - DNA, 22 bp, Homo sapiens
ttcacagtaatgtgcccaggta

SEQ ID NO: 9344303 - DNA, 22 bp, Homo sapiens
ttcacagtaagtaggatagttg

SEQ ID NO: 9344304 - DNA, 22 bp, Homo sapiens
ttcacagtcacccttctccatg

SEQ ID NO: 9344305 - DNA, 22 bp, Homo sapiens
ttcacagtcacccttctccatg

SEQ ID NO: 9344306 - DNA, 22 bp, Homo sapiens
ttcacagtataggtttccagcg

SEQ ID NO: 9344307 - DNA, 22 bp, Homo sapiens
ttcacagtataggtttccagcg

SEQ ID NO: 9344308 - DNA, 22 bp, Homo sapiens
ttcacagtgctcacagttcagt

SEQ ID NO: 9344309 - DNA, 22 bp, Homo sapiens
ttcacagtgagctatgtcttgt

SEQ ID NO: 9344310 - DNA, 22 bp, Homo sapiens
ttcacagtctatcttggttttt

SEQ ID NO: 9344311 - DNA, 22 bp, Homo sapiens
ttcacaaagctggagcatttcc

SEQ ID NO: 9344312 - DNA, 21 bp, Homo sapiens
ttcacaacctgctttagtggg

SEQ ID NO: 9344313 - DNA, 22 bp, Homo sapiens
ttcacaaagctggagcatttcc

SEQ ID NO: 9344314 - DNA, 22 bp, Homo sapiens
ttcacaagtgtgaaggcagagc

SEQ ID NO: 9344315 - DNA, 22 bp, Homo sapiens
ttcacaagtcattagctgcata

SEQ ID NO: 9344316 - DNA, 19 bp, Homo sapiens
ttcacaagtgatgtctctc

SEQ ID NO: 9344317 - DNA, 22 bp, Homo sapiens
ttcaactcttcaagatcacatc

SEQ ID NO: 9344318 - DNA, 22 bp, Homo sapiens
ttcaactttatgcatatgtatt

SEQ ID NO: 9344319 - DNA, 22 bp, Homo sapiens
ttcaacccaagttctccatttt

SEQ ID NO: 9344320 - DNA, 22 bp, Homo sapiens
ttcaacacaggaacatgatata

SEQ ID NO: 9344321 - DNA, 17 bp, Homo sapiens
ttcaaagcttatcaagg

SEQ ID NO: 9344322 - DNA, 22 bp, Homo sapiens
ttcaacaagtagtacacacagt

SEQ ID NO: 9344323 - DNA, 22 bp, Homo sapiens
ttagagtgtagcaggaagaggc

SEQ ID NO: 9344324 - DNA, 22 bp, Homo sapiens
ttagagtcaaaatggcatgtta

SEQ ID NO: 9344325 - DNA, 22 bp, Homo sapiens
ttagagtagagccatttctgtt

SEQ ID NO: 9344326 - DNA, 22 bp, Homo sapiens
ttagagtcaagctgcatgttct

SEQ ID NO: 9344327 - DNA, 22 bp, Homo sapiens
ttagagtgtagcaggaagaggc

SEQ ID NO: 9344328 - DNA, 23 bp, Homo sapiens
ttctttcaagaagttcacagtgc

SEQ ID NO: 9344329 - DNA, 23 bp, Homo sapiens
ttctttcaagaagttcacagtgc

SEQ ID NO: 9344330 - DNA, 23 bp, Homo sapiens
ttctttcaagaagttcacagtgc

SEQ ID NO: 9344331 - DNA, 22 bp, Homo sapiens
ttctttcagaacacaagtgatt

SEQ ID NO: 9344332 - DNA, 22 bp, Homo sapiens
ttctttcagaacacaagtgatt

SEQ ID NO: 9344333 - DNA, 20 bp, Homo sapiens
ttctttcatctacacgttgt

SEQ ID NO: 9344334 - DNA, 19 bp, Homo sapiens
ttctttccacatcttctct

SEQ ID NO: 9344335 - DNA, 19 bp, Homo sapiens
ttctttccacatcttctct

SEQ ID NO: 9344336 - DNA, 22 bp, Homo sapiens
ttctttatcctatttgtaggtg

SEQ ID NO: 9344337 - DNA, 22 bp, Homo sapiens
ttctttatgcttctgtttaggc

SEQ ID NO: 9344338 - DNA, 22 bp, Homo sapiens
ttctttatgcttctgtttaggc

SEQ ID NO: 9344339 - DNA, 22 bp, Homo sapiens
ttctttatgcttctgtttaggc

SEQ ID NO: 9344340 - DNA, 22 bp, Homo sapiens
ttctttatggaatggtgatagt

SEQ ID NO: 9344341 - DNA, 22 bp, Homo sapiens
ttctttatggaatggtgatagt

SEQ ID NO: 9344342 - DNA, 22 bp, Homo sapiens
ttctttattagtttagtgagct

SEQ ID NO: 9344343 - DNA, 22 bp, Homo sapiens
ttctttatgttaatgaatctat

SEQ ID NO: 9344344 - DNA, 22 bp, Homo sapiens
ttctttcccttccagcagctcc

SEQ ID NO: 9344345 - DNA, 22 bp, Homo sapiens
ttctttctcaacatgaatgttt

SEQ ID NO: 9344346 - DNA, 22 bp, Homo sapiens
ttctttccttgcctcagtgaag

SEQ ID NO: 9344347 - DNA, 22 bp, Homo sapiens
ttgaagaaattattttatatag

SEQ ID NO: 9344348 - DNA, 22 bp, Homo sapiens
ttctttctcaacatgaatgttt

SEQ ID NO: 9344349 - DNA, 22 bp, Homo sapiens
ttgaagattctttttgttagta

SEQ ID NO: 9344350 - DNA, 22 bp, Homo sapiens
ttgaagatggatcgccactctc

SEQ ID NO: 9344351 - DNA, 22 bp, Homo sapiens
ttgaatgaatggtccatataga

SEQ ID NO: 9344352 - DNA, 20 bp, Homo sapiens
ttgaatgaatgtctggctca

SEQ ID NO: 9344353 - DNA, 22 bp, Homo sapiens
ttgaatgaatggtccatataga

SEQ ID NO: 9344354 - DNA, 22 bp, Homo sapiens
ttgaatgaagtccctttttact

SEQ ID NO: 9344355 - DNA, 22 bp, Homo sapiens
ttgaatgaatagttgctagaag

SEQ ID NO: 9344356 - DNA, 22 bp, Homo sapiens
ttgaagctgtgctttttgtagg

SEQ ID NO: 9344357 - DNA, 22 bp, Homo sapiens
ttgaagctgtgctttttgtagg

SEQ ID NO: 9344358 - DNA, 22 bp, Homo sapiens
ttgaagctgtctttcagaatca

SEQ ID NO: 9344359 - DNA, 22 bp, Homo sapiens
ttgaagctctaacttccaatac

SEQ ID NO: 9344360 - DNA, 22 bp, Homo sapiens
ttgaagctctaacttccaatac

SEQ ID NO: 9344361 - DNA, 22 bp, Homo sapiens
ttgaagctgccgtttttctcca

SEQ ID NO: 9344362 - DNA, 22 bp, Homo sapiens
ttgaagctaggctgtgcatatg

SEQ ID NO: 9344363 - DNA, 22 bp, Homo sapiens
ttgaagctccggtgtataggaa

SEQ ID NO: 9344364 - DNA, 22 bp, Homo sapiens
ttgagatgacttaaatttggga

SEQ ID NO: 9344365 - DNA, 22 bp, Homo sapiens
ttgagatggagcctcagtcttg

SEQ ID NO: 9344366 - DNA, 22 bp, Homo sapiens
ttgaatgatcctatctagcaca

SEQ ID NO: 9344367 - DNA, 22 bp, Homo sapiens
ttgaatgattaaagtcatctga

SEQ ID NO: 9344368 - DNA, 16 bp, Homo sapiens
ttgaatgactgtgtgc

SEQ ID NO: 9344369 - DNA, 22 bp, Homo sapiens
ttgaatgagaagttattgccat

SEQ ID NO: 9344370 - DNA, 22 bp, Homo sapiens
ttgagatgtcttttggcattat

SEQ ID NO: 9344371 - DNA, 22 bp, Homo sapiens
ttgagatgtcttttggcattat

SEQ ID NO: 9344372 - DNA, 22 bp, Homo sapiens
ttgagatggagtcttgctctct

SEQ ID NO: 9344373 - DNA, 22 bp, Homo sapiens
ttgagcaaaggagtaaaatgca

SEQ ID NO: 9344374 - DNA, 22 bp, Homo sapiens
ttgagcaaatcagaagtttaga

SEQ ID NO: 9344375 - DNA, 22 bp, Homo sapiens
ttgagcaaatcagattgtaatt

SEQ ID NO: 9344376 - DNA, 22 bp, Homo sapiens
ttgagcaagagtaggaactgaa

SEQ ID NO: 9344377 - DNA, 20 bp, Homo sapiens
ttgagcaatcagtaaaggat

SEQ ID NO: 9344378 - DNA, 22 bp, Homo sapiens
ttgagcaatgctgcaaagagat

SEQ ID NO: 9344379 - DNA, 22 bp, Homo sapiens
ttgagcaattaggaaataaaga

SEQ ID NO: 9344380 - DNA, 22 bp, Homo sapiens
ttgagcaggatggctatgcaca

SEQ ID NO: 9344381 - DNA, 19 bp, Homo sapiens
ttgagcagtgcttagcacc

SEQ ID NO: 9344382 - DNA, 22 bp, Homo sapiens
ttgaggagtgtgaggtctccca

SEQ ID NO: 9344383 - DNA, 22 bp, Homo sapiens
ttgaggcacagattttagtggc

SEQ ID NO: 9344384 - DNA, 22 bp, Homo sapiens
ttgaggcacacacaggttgcat

SEQ ID NO: 9344385 - DNA, 23 bp, Homo sapiens
ttgaggcaaacatgtaagtagga

SEQ ID NO: 9344386 - DNA, 22 bp, Homo sapiens
ttgaggcaaaatcaacgggaag

SEQ ID NO: 9344387 - DNA, 22 bp, Homo sapiens
ttgatttatagaatgttcaagc

SEQ ID NO: 9344388 - DNA, 21 bp, Homo sapiens
ttgatttagcagatctagctg

SEQ ID NO: 9344389 - DNA, 21 bp, Homo sapiens
ttgatttagcagatctagctg

SEQ ID NO: 9344390 - DNA, 22 bp, Homo sapiens
ttgattcttctgaatttgcaga

SEQ ID NO: 9344391 - DNA, 23 bp, Homo sapiens
ttgatttagctgggattgcatgc

SEQ ID NO: 9344392 - DNA, 23 bp, Homo sapiens
ttgatttagctgggattgcatgc

SEQ ID NO: 9344393 - DNA, 22 bp, Homo sapiens
ttgattttaaaatagtgacact

SEQ ID NO: 9344394 - DNA, 22 bp, Homo sapiens
ttgatttcactctctgtccaat

SEQ ID NO: 9344395 - DNA, 22 bp, Homo sapiens
ttgatttctattcagatgtaga

SEQ ID NO: 9344396 - DNA, 22 bp, Homo sapiens
ttgatttcttactcttccaagg

SEQ ID NO: 9344397 - DNA, 21 bp, Homo sapiens
ttgattttaggaagtttgtca

SEQ ID NO: 9344398 - DNA, 22 bp, Homo sapiens
ttgattttgcctgatctgagag

SEQ ID NO: 9344399 - DNA, 22 bp, Homo sapiens
ttgcaaagcctttctaatcgtc

SEQ ID NO: 9344400 - DNA, 22 bp, Homo sapiens
ttgatcttcatttgttctgtat

SEQ ID NO: 9344401 - DNA, 22 bp, Homo sapiens
ttgatcttcatcgaaatattgt

SEQ ID NO: 9344402 - DNA, 22 bp, Homo sapiens
ttgatcttacagtgttcttcca

SEQ ID NO: 9344403 - DNA, 22 bp, Homo sapiens
ttgatgaaggtagatttgaaat

SEQ ID NO: 9344404 - DNA, 22 bp, Homo sapiens
ttgatcttcatttgttctgtat

SEQ ID NO: 9344405 - DNA, 22 bp, Homo sapiens
ttgatgaaggtagatttgaaat

SEQ ID NO: 9344406 - DNA, 22 bp, Homo sapiens
ttgatctttataatagttttga

SEQ ID NO: 9344407 - DNA, 22 bp, Homo sapiens
ttgatgatcttacggcagagga

SEQ ID NO: 9344408 - DNA, 22 bp, Homo sapiens
ttgatgatgcacatttataatt

SEQ ID NO: 9344409 - DNA, 17 bp, Homo sapiens
ttgagtctggggtctac

SEQ ID NO: 9344410 - DNA, 22 bp, Homo sapiens
ttgagtggttcctcagttgact

SEQ ID NO: 9344411 - DNA, 22 bp, Homo sapiens
ttgaggcagggcatggtggccc

SEQ ID NO: 9344412 - DNA, 22 bp, Homo sapiens
ttgaggcaggtccgggtccttc

SEQ ID NO: 9344413 - DNA, 20 bp, Homo sapiens
ttgaggcatgtctagaagta

SEQ ID NO: 9344414 - DNA, 22 bp, Homo sapiens
ttgaggccaaaaagtcctatga

SEQ ID NO: 9344415 - DNA, 22 bp, Homo sapiens
ttgaggccaaaaagtcctatga

SEQ ID NO: 9344416 - DNA, 22 bp, Homo sapiens
ttgatgttcataaatgatacag

SEQ ID NO: 9344417 - DNA, 22 bp, Homo sapiens
ttgatgttcataaatgatacag

SEQ ID NO: 9344418 - DNA, 22 bp, Homo sapiens
ttgatgtctaagtcattggcct

SEQ ID NO: 9344419 - DNA, 22 bp, Homo sapiens
ttgatgttgctcttaacagtat

SEQ ID NO: 9344420 - DNA, 20 bp, Homo sapiens
ttgattcaagggctgatgga

SEQ ID NO: 9344421 - DNA, 22 bp, Homo sapiens
ttctgctctaatgtacaccagc

SEQ ID NO: 9344422 - DNA, 22 bp, Homo sapiens
ttctgctccaccacttccagca

SEQ ID NO: 9344423 - DNA, 22 bp, Homo sapiens
ttctgctgctgctgcacccaat

SEQ ID NO: 9344424 - DNA, 17 bp, Homo sapiens
ttctgctgtcgtcctct

SEQ ID NO: 9344425 - DNA, 21 bp, Homo sapiens
ttctgctgtgccatgcctctg

SEQ ID NO: 9344426 - DNA, 19 bp, Homo sapiens
ttctgctgttcctaggctg

SEQ ID NO: 9344427 - DNA, 21 bp, Homo sapiens
ttctgctaagaaaacattatt

SEQ ID NO: 9344428 - DNA, 22 bp, Homo sapiens
ttctgctatgaaaaaagtgctg

SEQ ID NO: 9344429 - DNA, 21 bp, Homo sapiens
ttctgccttcccctagctggg

SEQ ID NO: 9344430 - DNA, 22 bp, Homo sapiens
ttctgccttcagtcctctgact

SEQ ID NO: 9344431 - DNA, 22 bp, Homo sapiens
ttctgcttggttcttggtatga

SEQ ID NO: 9344432 - DNA, 22 bp, Homo sapiens
ttctggaaaagaaagttaagat

SEQ ID NO: 9344433 - DNA, 22 bp, Homo sapiens
ttctggaaagaaggctaaggtc

SEQ ID NO: 9344434 - DNA, 22 bp, Homo sapiens
ttctggaaaccctcagccagtg

SEQ ID NO: 9344435 - DNA, 19 bp, Homo sapiens
ttctggaaacccaggtaat

SEQ ID NO: 9344436 - DNA, 22 bp, Homo sapiens
ttctggaaatcagcagagggtg

SEQ ID NO: 9344437 - DNA, 22 bp, Homo sapiens
ttctggaaagcatttgaggccc

SEQ ID NO: 9344438 - DNA, 22 bp, Homo sapiens
ttctggaaagatttgcgtgtaa

SEQ ID NO: 9344439 - DNA, 22 bp, Homo sapiens
ttctgaatcctcgaaacatagc

SEQ ID NO: 9344440 - DNA, 22 bp, Homo sapiens
ttctataaatgaatgtgtatat

SEQ ID NO: 9344441 - DNA, 22 bp, Homo sapiens
ttctagttttcagtccaccagg

SEQ ID NO: 9344442 - DNA, 22 bp, Homo sapiens
ttctagtgtccttggacttgct

SEQ ID NO: 9344443 - DNA, 22 bp, Homo sapiens
ttctagtgtccttggacttgct

SEQ ID NO: 9344444 - DNA, 22 bp, Homo sapiens
ttctagttaatgtagcatcttg

SEQ ID NO: 9344445 - DNA, 22 bp, Homo sapiens
ttctagttaatgtagcatcttg

SEQ ID NO: 9344446 - DNA, 22 bp, Homo sapiens
ttctagttaaagtatgtattag

SEQ ID NO: 9344447 - DNA, 22 bp, Homo sapiens
ttctagttaatgtagcatcttg

SEQ ID NO: 9344448 - DNA, 22 bp, Homo sapiens
ttctagtttagggctcttcaac

SEQ ID NO: 9344449 - DNA, 22 bp, Homo sapiens
ttctagttcccacatagttgcc

SEQ ID NO: 9344450 - DNA, 22 bp, Homo sapiens
ttctgacatttgtcaaaatgat

SEQ ID NO: 9344451 - DNA, 22 bp, Homo sapiens
ttctgacagtaatcagtttgct

SEQ ID NO: 9344452 - DNA, 22 bp, Homo sapiens
ttctgacagcaaaactcagcct

SEQ ID NO: 9344453 - DNA, 22 bp, Homo sapiens
ttctgagaagtaaaatggcgtt

SEQ ID NO: 9344454 - DNA, 22 bp, Homo sapiens
ttctgaattcatgagatttggg

SEQ ID NO: 9344455 - DNA, 22 bp, Homo sapiens
ttctgaatggcaagcattaggc

SEQ ID NO: 9344456 - DNA, 22 bp, Homo sapiens
ttctgaatgatagtcttgaact

SEQ ID NO: 9344457 - DNA, 22 bp, Homo sapiens
ttctgaatgatagtcttgaact

SEQ ID NO: 9344458 - DNA, 22 bp, Homo sapiens
ttctgacacattactacatgga

SEQ ID NO: 9344459 - DNA, 22 bp, Homo sapiens
ttctgacaattcagtaacagca

SEQ ID NO: 9344460 - DNA, 22 bp, Homo sapiens
ttctgaatttctgtgtatctta

SEQ ID NO: 9344461 - DNA, 22 bp, Homo sapiens
ttctgaatttctgtgtatctta

SEQ ID NO: 9344462 - DNA, 22 bp, Homo sapiens
ttctgagacttgagattaattt

SEQ ID NO: 9344463 - DNA, 22 bp, Homo sapiens
ttctgagacaattgagagtcta

SEQ ID NO: 9344464 - DNA, 22 bp, Homo sapiens
ttctgagaggtttgcattttca

SEQ ID NO: 9344465 - DNA, 22 bp, Homo sapiens
ttctgagatgcgttagaaattt

SEQ ID NO: 9344466 - DNA, 22 bp, Homo sapiens
ttctgggcccaaccctagagtg

SEQ ID NO: 9344467 - DNA, 22 bp, Homo sapiens
ttctgggcccaaccctagagtg

SEQ ID NO: 9344468 - DNA, 22 bp, Homo sapiens
ttctgggcctcctaggacaggc

SEQ ID NO: 9344469 - DNA, 22 bp, Homo sapiens
ttctgggcctcctaggacaggc

SEQ ID NO: 9344470 - DNA, 22 bp, Homo sapiens
ttctggggccaattgccactgc

SEQ ID NO: 9344471 - DNA, 22 bp, Homo sapiens
ttctgggggccaggacagtggt

SEQ ID NO: 9344472 - DNA, 22 bp, Homo sapiens
ttctggggctaatacagaggtc

SEQ ID NO: 9344473 - DNA, 22 bp, Homo sapiens
ttctgggtgactcacgctcccc

SEQ ID NO: 9344474 - DNA, 17 bp, Homo sapiens
ttctgggtcccagggcc

SEQ ID NO: 9344475 - DNA, 22 bp, Homo sapiens
ttctgggtgcaactctgttctg

SEQ ID NO: 9344476 - DNA, 22 bp, Homo sapiens
ttctgggtcacccttctgctca

SEQ ID NO: 9344477 - DNA, 22 bp, Homo sapiens
ttctgggtagtatggttagttt

SEQ ID NO: 9344478 - DNA, 22 bp, Homo sapiens
ttctgggtaacaaggcaagaat

SEQ ID NO: 9344479 - DNA, 19 bp, Homo sapiens
ttctggtctggaatcaagg

SEQ ID NO: 9344480 - DNA, 19 bp, Homo sapiens
ttctggtctggaatcaagg

SEQ ID NO: 9344481 - DNA, 22 bp, Homo sapiens
ttctggtggccagaagtctgaa

SEQ ID NO: 9344482 - DNA, 22 bp, Homo sapiens
ttctggtaccgtgtcagaaacc

SEQ ID NO: 9344483 - DNA, 22 bp, Homo sapiens
ttctggtaatcggatttcacag

SEQ ID NO: 9344484 - DNA, 22 bp, Homo sapiens
ttctggtatgggaaatttcaag

SEQ ID NO: 9344485 - DNA, 23 bp, Homo sapiens
ttctgggttgctgtgcttggaat

SEQ ID NO: 9344486 - DNA, 22 bp, Homo sapiens
ttctgggtttacatctgacttc

SEQ ID NO: 9344487 - DNA, 21 bp, Homo sapiens
ttctgggttgttaatctgaac

SEQ ID NO: 9344488 - DNA, 18 bp, Homo sapiens
ttctgggtgttatgttta

SEQ ID NO: 9344489 - DNA, 22 bp, Homo sapiens
ttctgggtggccagtatttaga

SEQ ID NO: 9344490 - DNA, 22 bp, Homo sapiens
ttctgggtgccacctaagacat

SEQ ID NO: 9344491 - DNA, 22 bp, Homo sapiens
ttcttaaaacttatggacaggt

SEQ ID NO: 9344492 - DNA, 22 bp, Homo sapiens
ttctgtttgccatatatagtag

SEQ ID NO: 9344493 - DNA, 22 bp, Homo sapiens
ttctgtttctggggtctctgac

SEQ ID NO: 9344494 - DNA, 22 bp, Homo sapiens
ttctgtttgccatatatagtag

SEQ ID NO: 9344495 - DNA, 22 bp, Homo sapiens
ttctgtttgccatatatagtag

SEQ ID NO: 9344496 - DNA, 22 bp, Homo sapiens
ttctgttttagaaataagtagt

SEQ ID NO: 9344497 - DNA, 22 bp, Homo sapiens
ttctgttttagaaataagtagt

SEQ ID NO: 9344498 - DNA, 22 bp, Homo sapiens
ttctgttacaagtgaaaaaatg

SEQ ID NO: 9344499 - DNA, 22 bp, Homo sapiens
ttctggttctcaggaatgctaa

SEQ ID NO: 9344500 - DNA, 22 bp, Homo sapiens
ttctggtgtgttctctctaggc

SEQ ID NO: 9344501 - DNA, 22 bp, Homo sapiens
ttctgttatcattaagcattat

SEQ ID NO: 9344502 - DNA, 22 bp, Homo sapiens
ttctgttacttgcaaccacagg

SEQ ID NO: 9344503 - DNA, 22 bp, Homo sapiens
ttctgttacttgcaaccacagg

SEQ ID NO: 9344504 - DNA, 22 bp, Homo sapiens
ttctgttctgatacttgtttct

SEQ ID NO: 9344505 - DNA, 22 bp, Homo sapiens
ttctgttctgatacttgtttct

SEQ ID NO: 9344506 - DNA, 22 bp, Homo sapiens
ttctgttctttatttaccatat

SEQ ID NO: 9344507 - DNA, 22 bp, Homo sapiens
ttctgtttactcagaaatacaa

SEQ ID NO: 9344508 - DNA, 22 bp, Homo sapiens
ttctgtttataatttgcagttg

SEQ ID NO: 9344509 - DNA, 22 bp, Homo sapiens
ttctttaccagtgaaatgttat

SEQ ID NO: 9344510 - DNA, 22 bp, Homo sapiens
ttctttacagtgggttttgaat

SEQ ID NO: 9344511 - DNA, 18 bp, Homo sapiens
ttctttaattcagtttga

SEQ ID NO: 9344512 - DNA, 18 bp, Homo sapiens
ttctttaattcagtttga

SEQ ID NO: 9344513 - DNA, 22 bp, Homo sapiens
ttctttatcagttactcatagg

SEQ ID NO: 9344514 - DNA, 22 bp, Homo sapiens
ttctttatagctattggatgag

SEQ ID NO: 9344515 - DNA, 22 bp, Homo sapiens
ttctttatatctgctagtgggt

SEQ ID NO: 9344516 - DNA, 22 bp, Homo sapiens
ttctttaaatgaattctctgta

SEQ ID NO: 9344517 - DNA, 22 bp, Homo sapiens
ttcttgatgaatgctaagaact

SEQ ID NO: 9344518 - DNA, 22 bp, Homo sapiens
ttcttgatgcttgtttaaaggt

SEQ ID NO: 9344519 - DNA, 22 bp, Homo sapiens
ttcttgcctgcttcaggagaaa

SEQ ID NO: 9344520 - DNA, 22 bp, Homo sapiens
ttcttgccatatttcagccctt

SEQ ID NO: 9344521 - DNA, 22 bp, Homo sapiens
ttcttgcctgccctgtgtcgta

SEQ ID NO: 9344522 - DNA, 22 bp, Homo sapiens
ttcttacatattttcatatggt

SEQ ID NO: 9344523 - DNA, 22 bp, Homo sapiens
ttcttacagccctattactaaa

SEQ ID NO: 9344524 - DNA, 22 bp, Homo sapiens
ttcttgaccatgtatgtggtcc

SEQ ID NO: 9344525 - DNA, 22 bp, Homo sapiens
ttcttgagtatctgcacagtgc

SEQ ID NO: 9344526 - DNA, 22 bp, Homo sapiens
ttcttctttcctataattaatt

SEQ ID NO: 9344527 - DNA, 22 bp, Homo sapiens
ttcttctttccaattacatggt

SEQ ID NO: 9344528 - DNA, 22 bp, Homo sapiens
ttactgaaaattcttcaggatt

SEQ ID NO: 9344529 - DNA, 22 bp, Homo sapiens
ttactagtatatgtcaagcaac

SEQ ID NO: 9344530 - DNA, 19 bp, Homo sapiens
ttactagtctcagttatgg

SEQ ID NO: 9344531 - DNA, 19 bp, Homo sapiens
ttactagtctcagttatgg

SEQ ID NO: 9344532 - DNA, 22 bp, Homo sapiens
ttactagtggagaaactgaggc

SEQ ID NO: 9344533 - DNA, 19 bp, Homo sapiens
ttactatgtgacaagcact

SEQ ID NO: 9344534 - DNA, 22 bp, Homo sapiens
ttactagttgcttcactttgct

SEQ ID NO: 9344535 - DNA, 22 bp, Homo sapiens
ttaccaaatgaaatagagattt

SEQ ID NO: 9344536 - DNA, 23 bp, Homo sapiens
ttactacacaagtaacgattccc

SEQ ID NO: 9344537 - DNA, 22 bp, Homo sapiens
ttactacattgtaacacagtac

SEQ ID NO: 9344538 - DNA, 22 bp, Homo sapiens
ttactacattgtaacacagtac

SEQ ID NO: 9344539 - DNA, 22 bp, Homo sapiens
ttactgctaattctgtaggttt

SEQ ID NO: 9344540 - DNA, 22 bp, Homo sapiens
ttactgctgttaggatattttt

SEQ ID NO: 9344541 - DNA, 22 bp, Homo sapiens
ttactgcacgtgggacatatat

SEQ ID NO: 9344542 - DNA, 22 bp, Homo sapiens
ttactgtactagtgagactagg

SEQ ID NO: 9344543 - DNA, 22 bp, Homo sapiens
ttactgtaaaggtcacatggtg

SEQ ID NO: 9344544 - DNA, 22 bp, Homo sapiens
ttactgtagcttgacatatgtc

SEQ ID NO: 9344545 - DNA, 22 bp, Homo sapiens
ttactgtatacacaagtggtga

SEQ ID NO: 9344546 - DNA, 20 bp, Homo sapiens
ttactgtagtactacatttt

SEQ ID NO: 9344547 - DNA, 22 bp, Homo sapiens
ttactgtgtttggctttagatg

SEQ ID NO: 9344548 - DNA, 22 bp, Homo sapiens
ttacttcttacaaaagaaatat

SEQ ID NO: 9344549 - DNA, 22 bp, Homo sapiens
ttacttacagacagtagactct

SEQ ID NO: 9344550 - DNA, 22 bp, Homo sapiens
ttactgttttggtacctcattg

SEQ ID NO: 9344551 - DNA, 22 bp, Homo sapiens
ttactgttcatgttgtacactt

SEQ ID NO: 9344552 - DNA, 22 bp, Homo sapiens
ttactgtatgagtgtggtagtc

SEQ ID NO: 9344553 - DNA, 22 bp, Homo sapiens
ttactgttggtgtatccatagc

SEQ ID NO: 9344554 - DNA, 22 bp, Homo sapiens
ttactgttggtgtatccatagc

SEQ ID NO: 9344555 - DNA, 22 bp, Homo sapiens
ttactgttcctctctcaaagag

SEQ ID NO: 9344556 - DNA, 22 bp, Homo sapiens
ttactgtttgaaaaatgaatgt

SEQ ID NO: 9344557 - DNA, 22 bp, Homo sapiens
ttactttagaaatagtcatcaa

SEQ ID NO: 9344558 - DNA, 22 bp, Homo sapiens
ttactttagatcatactgtgtg

SEQ ID NO: 9344559 - DNA, 22 bp, Homo sapiens
ttactttaagggtgtcttatta

SEQ ID NO: 9344560 - DNA, 19 bp, Homo sapiens
ttacttggcaaagtcagtc

SEQ ID NO: 9344561 - DNA, 22 bp, Homo sapiens
ttacttggaggcctgttaccag

SEQ ID NO: 9344562 - DNA, 22 bp, Homo sapiens
ttactttatctcctagattcca

SEQ ID NO: 9344563 - DNA, 22 bp, Homo sapiens
ttactttagggatgttttgctt

SEQ ID NO: 9344564 - DNA, 22 bp, Homo sapiens
ttactttatgtgatggattagt

SEQ ID NO: 9344565 - DNA, 22 bp, Homo sapiens
ttactttcaaaaactacgtggg

SEQ ID NO: 9344566 - DNA, 22 bp, Homo sapiens
ttactttcaagtggctgggggt

SEQ ID NO: 9344567 - DNA, 22 bp, Homo sapiens
ttactttgatgatcaatgagcg

SEQ ID NO: 9344568 - DNA, 22 bp, Homo sapiens
ttactttgaatgtcacaagcaa

SEQ ID NO: 9344569 - DNA, 22 bp, Homo sapiens
ttactttcagttaggcaggagc

SEQ ID NO: 9344570 - DNA, 22 bp, Homo sapiens
ttactttgctttctcattacag

SEQ ID NO: 9344571 - DNA, 22 bp, Homo sapiens
ttactttggatggtcaagaaag

SEQ ID NO: 9344572 - DNA, 22 bp, Homo sapiens
ttactttgcagatgtgtatgtc

SEQ ID NO: 9344573 - DNA, 22 bp, Homo sapiens
ttactttgcatttgtggtagtc

SEQ ID NO: 9344574 - DNA, 22 bp, Homo sapiens
ttactttgccttttagtgtagg

SEQ ID NO: 9344575 - DNA, 22 bp, Homo sapiens
ttactttgcatttgtggtagtc

SEQ ID NO: 9344576 - DNA, 22 bp, Homo sapiens
ttactttgcttcaggaagagga

SEQ ID NO: 9344577 - DNA, 22 bp, Homo sapiens
ttactttgctttctcattacag

SEQ ID NO: 9344578 - DNA, 18 bp, Homo sapiens
ttactttgtatagcctag

SEQ ID NO: 9344579 - DNA, 22 bp, Homo sapiens
ttactttgttctcaagatatgt

SEQ ID NO: 9344580 - DNA, 22 bp, Homo sapiens
ttactttgggtcctgcttataa

SEQ ID NO: 9344581 - DNA, 22 bp, Homo sapiens
ttactttgggtcctgcttataa

SEQ ID NO: 9344582 - DNA, 22 bp, Homo sapiens
ttactttggcaaactcctgccc

SEQ ID NO: 9344583 - DNA, 22 bp, Homo sapiens
ttagaaagaactttagatatca

SEQ ID NO: 9344584 - DNA, 22 bp, Homo sapiens
ttactttgtttgcacttcacct

SEQ ID NO: 9344585 - DNA, 22 bp, Homo sapiens
ttactttgtttgcacttcacct

SEQ ID NO: 9344586 - DNA, 20 bp, Homo sapiens
ttactttgtttggatgacat

SEQ ID NO: 9344587 - DNA, 22 bp, Homo sapiens
ttagaaaatttgcttctttgga

SEQ ID NO: 9344588 - DNA, 22 bp, Homo sapiens
ttagaaaatttgcttctttgga

SEQ ID NO: 9344589 - DNA, 22 bp, Homo sapiens
ttagaagtaaggtcagatttct

SEQ ID NO: 9344590 - DNA, 22 bp, Homo sapiens
ttagaagtaaggtcagatttct

SEQ ID NO: 9344591 - DNA, 22 bp, Homo sapiens
ttagaagtaaggtcagatttct

SEQ ID NO: 9344592 - DNA, 22 bp, Homo sapiens
ttagagaaaagcttgcttgctt

SEQ ID NO: 9344593 - DNA, 22 bp, Homo sapiens
ttagagaaccaatgaatagtct

SEQ ID NO: 9344594 - DNA, 22 bp, Homo sapiens
ttagagaagatgaaccatcgtt

SEQ ID NO: 9344595 - DNA, 23 bp, Homo sapiens
ttagagatgattaaaaaatcttg

SEQ ID NO: 9344596 - DNA, 22 bp, Homo sapiens
ttagagattggttgacagattt

SEQ ID NO: 9344597 - DNA, 22 bp, Homo sapiens
ttagaggacaagaggcctggct

SEQ ID NO: 9344598 - DNA, 22 bp, Homo sapiens
ttacatccttcaaagtcactca

SEQ ID NO: 9344599 - DNA, 22 bp, Homo sapiens
ttacatcattgagacatacata

SEQ ID NO: 9344600 - DNA, 22 bp, Homo sapiens
ttacatcatggagggtattgaa

SEQ ID NO: 9344601 - DNA, 22 bp, Homo sapiens
ttacatgaatacataaccattc

SEQ ID NO: 9344602 - DNA, 22 bp, Homo sapiens
ttacattttggggtaaggataa

SEQ ID NO: 9344603 - DNA, 22 bp, Homo sapiens
ttacatattatccaaaactgct

SEQ ID NO: 9344604 - DNA, 22 bp, Homo sapiens
ttacatattgtctattgttcaa

SEQ ID NO: 9344605 - DNA, 22 bp, Homo sapiens
ttacatattgtctattgttcaa

SEQ ID NO: 9344606 - DNA, 22 bp, Homo sapiens
ttacatcagcaagagtgtatgt

SEQ ID NO: 9344607 - DNA, 22 bp, Homo sapiens
ttacatagttaaatagtacagc

SEQ ID NO: 9344608 - DNA, 22 bp, Homo sapiens
ttacatagttaaatagtacagc

SEQ ID NO: 9344609 - DNA, 22 bp, Homo sapiens
ttacagtgctcttcaagacttc

SEQ ID NO: 9344610 - DNA, 22 bp, Homo sapiens
ttacagtgactcacattaacaa

SEQ ID NO: 9344611 - DNA, 22 bp, Homo sapiens
ttacagtattgttaaactcttt

SEQ ID NO: 9344612 - DNA, 22 bp, Homo sapiens
ttacagtctggattaggaaaca

SEQ ID NO: 9344613 - DNA, 22 bp, Homo sapiens
ttacagtcttaaactcctgggc

SEQ ID NO: 9344614 - DNA, 22 bp, Homo sapiens
ttacagtgaagattcaggttcc

SEQ ID NO: 9344615 - DNA, 22 bp, Homo sapiens
ttacagtcttaaactcctgggc

SEQ ID NO: 9344616 - DNA, 22 bp, Homo sapiens
ttacagtatgatcaacttttca

SEQ ID NO: 9344617 - DNA, 23 bp, Homo sapiens
ttacagtaggagttggaaaacca

SEQ ID NO: 9344618 - DNA, 22 bp, Homo sapiens
ttacagtattggtcacgtttgt

SEQ ID NO: 9344619 - DNA, 22 bp, Homo sapiens
ttacactttaaatccagcttgt

SEQ ID NO: 9344620 - DNA, 22 bp, Homo sapiens
ttacactttggcaagctattaa

SEQ ID NO: 9344621 - DNA, 22 bp, Homo sapiens
ttacactttggcaagctattaa

SEQ ID NO: 9344622 - DNA, 22 bp, Homo sapiens
ttacactttggcaagctattaa

SEQ ID NO: 9344623 - DNA, 22 bp, Homo sapiens
ttacagcttcgacagaggcagt

SEQ ID NO: 9344624 - DNA, 22 bp, Homo sapiens
ttacagggaaccaatccagtgt

SEQ ID NO: 9344625 - DNA, 22 bp, Homo sapiens
ttacacttctaaaaaaagcagg

SEQ ID NO: 9344626 - DNA, 22 bp, Homo sapiens
ttacacttctaaaaaaagcagg

SEQ ID NO: 9344627 - DNA, 22 bp, Homo sapiens
ttacacttgggtgtggatttta

SEQ ID NO: 9344628 - DNA, 22 bp, Homo sapiens
ttacacttgaaaacaggattta

SEQ ID NO: 9344629 - DNA, 22 bp, Homo sapiens
ttacagtaatgtattatttaac

SEQ ID NO: 9344630 - DNA, 22 bp, Homo sapiens
ttacagtaatcgagtgttgtgg

SEQ ID NO: 9344631 - DNA, 22 bp, Homo sapiens
ttacagtacagaaaataacaga

SEQ ID NO: 9344632 - DNA, 22 bp, Homo sapiens
ttacagtagattttgaatgtgg

SEQ ID NO: 9344633 - DNA, 22 bp, Homo sapiens
ttacagtagatacaatgagtaa

SEQ ID NO: 9344634 - DNA, 22 bp, Homo sapiens
ttacagtacctgtatggccact

SEQ ID NO: 9344635 - DNA, 22 bp, Homo sapiens
ttacagtacctgtatggccact

SEQ ID NO: 9344636 - DNA, 22 bp, Homo sapiens
ttacaggtgagaaaactgaggc

SEQ ID NO: 9344637 - DNA, 21 bp, Homo sapiens
ttacaggtcatccaagtcacc

SEQ ID NO: 9344638 - DNA, 22 bp, Homo sapiens
ttacaggtattttattgagcag

SEQ ID NO: 9344639 - DNA, 22 bp, Homo sapiens
ttacaggtggagaagtaaggct

SEQ ID NO: 9344640 - DNA, 22 bp, Homo sapiens
ttacaggtgagaaaactgaggc

SEQ ID NO: 9344641 - DNA, 22 bp, Homo sapiens
ttacaggttgtgtattcagtga

SEQ ID NO: 9344642 - DNA, 22 bp, Homo sapiens
ttacaggttaagtgacacttaa

SEQ ID NO: 9344643 - DNA, 22 bp, Homo sapiens
ttacaggttgtgtattcagtga

SEQ ID NO: 9344644 - DNA, 22 bp, Homo sapiens
ttacagtaacattttcagtctg

SEQ ID NO: 9344645 - DNA, 22 bp, Homo sapiens
ttacaggtgtggaaattgagta

SEQ ID NO: 9344646 - DNA, 22 bp, Homo sapiens
ttacaggtgggaaaactaagct

SEQ ID NO: 9344647 - DNA, 22 bp, Homo sapiens
ttacaaactgtcatatagtatt

SEQ ID NO: 9344648 - DNA, 22 bp, Homo sapiens
ttacaaactgtcatatagtatt

SEQ ID NO: 9344649 - DNA, 22 bp, Homo sapiens
ttacaaacaacagacatttatt

SEQ ID NO: 9344650 - DNA, 22 bp, Homo sapiens
ttacaaacaacagacatttatt

SEQ ID NO: 9344651 - DNA, 22 bp, Homo sapiens
ttaatttttatgtatagtgtgt

SEQ ID NO: 9344652 - DNA, 22 bp, Homo sapiens
ttaatttttatgtatagtgtgt

SEQ ID NO: 9344653 - DNA, 21 bp, Homo sapiens
ttaatttattcatgatagcta

SEQ ID NO: 9344654 - DNA, 22 bp, Homo sapiens
ttaattttaacctgtttgtgtc

SEQ ID NO: 9344655 - DNA, 22 bp, Homo sapiens
ttacacagtgaatttactcaag

SEQ ID NO: 9344656 - DNA, 22 bp, Homo sapiens
ttacacaggcacttaaaatgca

SEQ ID NO: 9344657 - DNA, 22 bp, Homo sapiens
ttacacagatggttagtagagg

SEQ ID NO: 9344658 - DNA, 22 bp, Homo sapiens
ttacacagcttctatccttgaa

SEQ ID NO: 9344659 - DNA, 22 bp, Homo sapiens
ttacacagatggttagtagagg

SEQ ID NO: 9344660 - DNA, 22 bp, Homo sapiens
ttacacagaaattttattgcct

SEQ ID NO: 9344661 - DNA, 22 bp, Homo sapiens
ttacacactctgccctgctgtt

SEQ ID NO: 9344662 - DNA, 21 bp, Homo sapiens
ttacacactgcttctagaatg

SEQ ID NO: 9344663 - DNA, 22 bp, Homo sapiens
ttacacacagagctgggcctgg

SEQ ID NO: 9344664 - DNA, 22 bp, Homo sapiens
ttacacacaattagcatagtaa

SEQ ID NO: 9344665 - DNA, 22 bp, Homo sapiens
ttacacatgtctcagtggaaat

SEQ ID NO: 9344666 - DNA, 22 bp, Homo sapiens
ttacactaagctacttctatat

SEQ ID NO: 9344667 - DNA, 22 bp, Homo sapiens
ttacacctcagtgagaagatct

SEQ ID NO: 9344668 - DNA, 22 bp, Homo sapiens
ttacacgtgtgtgtatctgtat

SEQ ID NO: 9344669 - DNA, 22 bp, Homo sapiens
ttacacagtggttaagtctggg

SEQ ID NO: 9344670 - DNA, 22 bp, Homo sapiens
tgtttttaaataatgatagaaa

SEQ ID NO: 9344671 - DNA, 22 bp, Homo sapiens
tgtttttaaataatgatagaaa

SEQ ID NO: 9344672 - DNA, 22 bp, Homo sapiens
tgtttttaaataatgatagaaa

SEQ ID NO: 9344673 - DNA, 22 bp, Homo sapiens
tgtttttaaataatgatagaaa

SEQ ID NO: 9344674 - DNA, 22 bp, Homo sapiens
tgtttttactgtgatccagaaa

SEQ ID NO: 9344675 - DNA, 22 bp, Homo sapiens
tgtttttactgtgatccagaaa

SEQ ID NO: 9344676 - DNA, 22 bp, Homo sapiens
ttaaagccatctagattttgag

SEQ ID NO: 9344677 - DNA, 22 bp, Homo sapiens
ttaaatattatgttgtctgcaa

SEQ ID NO: 9344678 - DNA, 22 bp, Homo sapiens
ttaaatattttcagcagggtca

SEQ ID NO: 9344679 - DNA, 22 bp, Homo sapiens
ttaaatattatgttgtctgcaa

SEQ ID NO: 9344680 - DNA, 22 bp, Homo sapiens
ttaaatattatgttgtctgcaa

SEQ ID NO: 9344681 - DNA, 22 bp, Homo sapiens
ttaaatattatgttgtctgcaa

SEQ ID NO: 9344682 - DNA, 22 bp, Homo sapiens
ttaaatattatgttgtctgcaa

SEQ ID NO: 9344683 - DNA, 21 bp, Homo sapiens
ttaaagcctccctcataagga

SEQ ID NO: 9344684 - DNA, 22 bp, Homo sapiens
ttaaatagtcaaatcagtggca

SEQ ID NO: 9344685 - DNA, 23 bp, Homo sapiens
tgttttcttgtcctggtataatt

SEQ ID NO: 9344686 - DNA, 22 bp, Homo sapiens
tgttttggttttcaccgagtcc

SEQ ID NO: 9344687 - DNA, 22 bp, Homo sapiens
tgttttgttcactgcattgtcc

SEQ ID NO: 9344688 - DNA, 22 bp, Homo sapiens
tgttttgtgcatttacaacatg

SEQ ID NO: 9344689 - DNA, 22 bp, Homo sapiens
ttaaattaggactctagttctg

SEQ ID NO: 9344690 - DNA, 22 bp, Homo sapiens
ttaaattaggactctagttctg

SEQ ID NO: 9344691 - DNA, 22 bp, Homo sapiens
ttaaatgtttaatctaacttga

SEQ ID NO: 9344692 - DNA, 22 bp, Homo sapiens
ttaaatgtgatttcatttatgt

SEQ ID NO: 9344693 - DNA, 22 bp, Homo sapiens
ttaaatgtgatcctggtatgca

SEQ ID NO: 9344694 - DNA, 22 bp, Homo sapiens
ttaaatgtctgtagatgtgctg

SEQ ID NO: 9344695 - DNA, 22 bp, Homo sapiens
ttaaatgtctgtagatgtgctg

SEQ ID NO: 9344696 - DNA, 22 bp, Homo sapiens
ttaaatgtctgtagatgtgctg

SEQ ID NO: 9344697 - DNA, 22 bp, Homo sapiens
ttaacaaggtgactgcattaaa

SEQ ID NO: 9344698 - DNA, 22 bp, Homo sapiens
ttaacaatagagtttcttcagg

SEQ ID NO: 9344699 - DNA, 22 bp, Homo sapiens
ttaacaaagtaacgggaaaaga

SEQ ID NO: 9344700 - DNA, 22 bp, Homo sapiens
ttaacaaagtaacgggaaaaga

SEQ ID NO: 9344701 - DNA, 22 bp, Homo sapiens
ttaacaaagctctgttcctttt

SEQ ID NO: 9344702 - DNA, 22 bp, Homo sapiens
ttaacacatatttatcaattgc

SEQ ID NO: 9344703 - DNA, 22 bp, Homo sapiens
ttaacacatatttatcaattgc

SEQ ID NO: 9344704 - DNA, 22 bp, Homo sapiens
ttaacaatagagtttcttcagg

SEQ ID NO: 9344705 - DNA, 22 bp, Homo sapiens
ttaaatgagatgttcagatatt

SEQ ID NO: 9344706 - DNA, 22 bp, Homo sapiens
ttaaatgaggctgatgtagatt

SEQ ID NO: 9344707 - DNA, 22 bp, Homo sapiens
ttaaatgaggctgatgtagatt

SEQ ID NO: 9344708 - DNA, 22 bp, Homo sapiens
ttaaatgaggctgatgtagatt

SEQ ID NO: 9344709 - DNA, 22 bp, Homo sapiens
ttaaatgatgcatatcatttag

SEQ ID NO: 9344710 - DNA, 22 bp, Homo sapiens
ttaaatgctcacataaaggtag

SEQ ID NO: 9344711 - DNA, 22 bp, Homo sapiens
ttaaatgtcaatagattgcttg

SEQ ID NO: 9344712 - DNA, 22 bp, Homo sapiens
ttaaatcagtaggctactcctt

SEQ ID NO: 9344713 - DNA, 22 bp, Homo sapiens
ttaaatcagtaggctactcctt

SEQ ID NO: 9344714 - DNA, 22 bp, Homo sapiens
ttaaatgaacgagatatgcaac

SEQ ID NO: 9344715 - DNA, 22 bp, Homo sapiens
ttaaatcaggcatcatttcagt

SEQ ID NO: 9344716 - DNA, 22 bp, Homo sapiens
ttaaatcaggcatcatttcagt

SEQ ID NO: 9344717 - DNA, 22 bp, Homo sapiens
ttaaatattttcagcagggtca

SEQ ID NO: 9344718 - DNA, 22 bp, Homo sapiens
ttaaatattttcagcagggtca

SEQ ID NO: 9344719 - DNA, 22 bp, Homo sapiens
ttaaatgacgggactgggtttt

SEQ ID NO: 9344720 - DNA, 22 bp, Homo sapiens
ttaaatgacttttattattctc

SEQ ID NO: 9344721 - DNA, 22 bp, Homo sapiens
ttaaatgacttttattattctc

SEQ ID NO: 9344722 - DNA, 22 bp, Homo sapiens
ttaaatgacttttattattctc

SEQ ID NO: 9344723 - DNA, 22 bp, Homo sapiens
ttaaatgacttttattattctc

SEQ ID NO: 9344724 - DNA, 22 bp, Homo sapiens
ttaaatgagatgttcagatatt

SEQ ID NO: 9344725 - DNA, 19 bp, Homo sapiens
ttaacagtcaccaaggaga

SEQ ID NO: 9344726 - DNA, 22 bp, Homo sapiens
ttaacatacatcatgaacaatg

SEQ ID NO: 9344727 - DNA, 22 bp, Homo sapiens
ttaacacttgaactctacatgt

SEQ ID NO: 9344728 - DNA, 22 bp, Homo sapiens
ttaacagagtgcctggcatgta

SEQ ID NO: 9344729 - DNA, 22 bp, Homo sapiens
ttaacagacatatatatttgta

SEQ ID NO: 9344730 - DNA, 22 bp, Homo sapiens
ttaacagacttgggattttcta

SEQ ID NO: 9344731 - DNA, 22 bp, Homo sapiens
ttaacagagaacatagaagtag

SEQ ID NO: 9344732 - DNA, 22 bp, Homo sapiens
ttaacatgtcttgacttcatct

SEQ ID NO: 9344733 - DNA, 22 bp, Homo sapiens
ttaacatgtcttgacttcatct

SEQ ID NO: 9344734 - DNA, 22 bp, Homo sapiens
ttaacatcctgtttaaatttgg

SEQ ID NO: 9344735 - DNA, 20 bp, Homo sapiens
ttaagaaaagcacatcctgc

SEQ ID NO: 9344736 - DNA, 22 bp, Homo sapiens
ttaagaatgtgccttttggttg

SEQ ID NO: 9344737 - DNA, 22 bp, Homo sapiens
ttaagaatggaatgaggaattt

SEQ ID NO: 9344738 - DNA, 22 bp, Homo sapiens
ttaagagaagagtatctagaac

SEQ ID NO: 9344739 - DNA, 22 bp, Homo sapiens
ttaaggatgttgtgatttatta

SEQ ID NO: 9344740 - DNA, 22 bp, Homo sapiens
ttaaggattactttgtgtaccc

SEQ ID NO: 9344741 - DNA, 17 bp, Homo sapiens
ttaaggtggatcagcac

SEQ ID NO: 9344742 - DNA, 22 bp, Homo sapiens
ttaaggttgagctcacttttat

SEQ ID NO: 9344743 - DNA, 22 bp, Homo sapiens
ttaaggctggtcccctctgcgt

SEQ ID NO: 9344744 - DNA, 22 bp, Homo sapiens
ttaagtgagcttgaataatctt

SEQ ID NO: 9344745 - DNA, 22 bp, Homo sapiens
ttaataaacaggtgcagctgaa

SEQ ID NO: 9344746 - DNA, 22 bp, Homo sapiens
ttaataaacaggtgcagctgaa

SEQ ID NO: 9344747 - DNA, 22 bp, Homo sapiens
ttaataaagtatgaattggaaa

SEQ ID NO: 9344748 - DNA, 22 bp, Homo sapiens
ttaatttatacataatcacagg

SEQ ID NO: 9344749 - DNA, 22 bp, Homo sapiens
ttaatttatgtccaaaccagat

SEQ ID NO: 9344750 - DNA, 22 bp, Homo sapiens
ttaatttatacataatcacagg

SEQ ID NO: 9344751 - DNA, 22 bp, Homo sapiens
ttaatttatacataatcacagg

SEQ ID NO: 9344752 - DNA, 22 bp, Homo sapiens
ttaatttatacataatcacagg

SEQ ID NO: 9344753 - DNA, 22 bp, Homo sapiens
ttaattctagtttaacacttag

SEQ ID NO: 9344754 - DNA, 22 bp, Homo sapiens
ttaattctagtttaacacttag

SEQ ID NO: 9344755 - DNA, 22 bp, Homo sapiens
tgttctaaattgctagctggaa

SEQ ID NO: 9344756 - DNA, 21 bp, Homo sapiens
tgttcctgttctctaggatcc

SEQ ID NO: 9344757 - DNA, 22 bp, Homo sapiens
tgttctaagtgttttgttcatg

SEQ ID NO: 9344758 - DNA, 22 bp, Homo sapiens
tgttctcactggatgcttcaca

SEQ ID NO: 9344759 - DNA, 17 bp, Homo sapiens
tgttctcttcagaaatc

SEQ ID NO: 9344760 - DNA, 22 bp, Homo sapiens
tgttctcttctcattgaacatg

SEQ ID NO: 9344761 - DNA, 22 bp, Homo sapiens
tgttctctctggctgccagtac

SEQ ID NO: 9344762 - DNA, 22 bp, Homo sapiens
tgttctgtgcatctagccagta

SEQ ID NO: 9344763 - DNA, 22 bp, Homo sapiens
tgtttaataattctatgatagt

SEQ ID NO: 9344764 - DNA, 22 bp, Homo sapiens
tgttctggggacagcgtcccat

SEQ ID NO: 9344765 - DNA, 22 bp, Homo sapiens
tgttctggtgaggccatggggt

SEQ ID NO: 9344766 - DNA, 22 bp, Homo sapiens
tgtttacacttcaaggttaagg

SEQ ID NO: 9344767 - DNA, 22 bp, Homo sapiens
tgtttacagggtgattttacct

SEQ ID NO: 9344768 - DNA, 22 bp, Homo sapiens
tgtttacagggtgattttacct

SEQ ID NO: 9344769 - DNA, 22 bp, Homo sapiens
tgtttacaaggagaatttgagg

SEQ ID NO: 9344770 - DNA, 22 bp, Homo sapiens
tgtttacaagccacttgttaag

SEQ ID NO: 9344771 - DNA, 22 bp, Homo sapiens
tgtttacaaaaccgtggtactg

SEQ ID NO: 9344772 - DNA, 22 bp, Homo sapiens
tgtttacaaggagaatttgagg

SEQ ID NO: 9344773 - DNA, 22 bp, Homo sapiens
tgtttacaaggagtttatattg

SEQ ID NO: 9344774 - DNA, 22 bp, Homo sapiens
tgtttacaaggagtttatattg

SEQ ID NO: 9344775 - DNA, 22 bp, Homo sapiens
tgtttaatctataaaatggaga

SEQ ID NO: 9344776 - DNA, 22 bp, Homo sapiens
tgtttaatgaagatggtttttc

SEQ ID NO: 9344777 - DNA, 22 bp, Homo sapiens
tgtttaatcttcaggacagtct

SEQ ID NO: 9344778 - DNA, 21 bp, Homo sapiens
tgtttaatacatatttgtgga

SEQ ID NO: 9344779 - DNA, 22 bp, Homo sapiens
tgtttaataattctatgatagt

SEQ ID NO: 9344780 - DNA, 22 bp, Homo sapiens
tgtttaattgggccaacagcgg

SEQ ID NO: 9344781 - DNA, 22 bp, Homo sapiens
tgtttaatttttcatgagccaa

SEQ ID NO: 9344782 - DNA, 22 bp, Homo sapiens
tgtttaatttcacaaagttgac

SEQ ID NO: 9344783 - DNA, 22 bp, Homo sapiens
tgtttaattcaccatcatgttc

SEQ ID NO: 9344784 - DNA, 22 bp, Homo sapiens
tgtttaattcaccatcatgttc

SEQ ID NO: 9344785 - DNA, 22 bp, Homo sapiens
tgtttaatgcattgaccttggg

SEQ ID NO: 9344786 - DNA, 20 bp, Homo sapiens
tgtttctttaaggtgagaca

SEQ ID NO: 9344787 - DNA, 22 bp, Homo sapiens
tgtttctttgtagatattcttt

SEQ ID NO: 9344788 - DNA, 22 bp, Homo sapiens
tgtttctttgtagatattcttt

SEQ ID NO: 9344789 - DNA, 20 bp, Homo sapiens
tgtttcttttaatgagcggc

SEQ ID NO: 9344790 - DNA, 22 bp, Homo sapiens
tgtttccttctgtctctttgga

SEQ ID NO: 9344791 - DNA, 18 bp, Homo sapiens
tgtttcctcctggaggct

SEQ ID NO: 9344792 - DNA, 22 bp, Homo sapiens
tgtttcctaagtgtctctgaag

SEQ ID NO: 9344793 - DNA, 22 bp, Homo sapiens
tgtttcttgataaagcagaaaa

SEQ ID NO: 9344794 - DNA, 22 bp, Homo sapiens
tgtttcttgagagtattaccct

SEQ ID NO: 9344795 - DNA, 22 bp, Homo sapiens
tgtttcttgagagtattaccct

SEQ ID NO: 9344796 - DNA, 22 bp, Homo sapiens
tgtttgatgacgacattgtaga

SEQ ID NO: 9344797 - DNA, 22 bp, Homo sapiens
tgtttgaataacttggatatat

SEQ ID NO: 9344798 - DNA, 22 bp, Homo sapiens
tgttttctcttgaaaagcagtc

SEQ ID NO: 9344799 - DNA, 22 bp, Homo sapiens
tgttttcagtcatatagcaggt

SEQ ID NO: 9344800 - DNA, 22 bp, Homo sapiens
tgtttcactaagcagaaatata

SEQ ID NO: 9344801 - DNA, 22 bp, Homo sapiens
tgtttactcactgtatccacaa

SEQ ID NO: 9344802 - DNA, 22 bp, Homo sapiens
tgtttactccagctgatggaac

SEQ ID NO: 9344803 - DNA, 22 bp, Homo sapiens
tgtttactatgatgtaacctat

SEQ ID NO: 9344804 - DNA, 22 bp, Homo sapiens
tgtttacatggaggttttcagc

SEQ ID NO: 9344805 - DNA, 22 bp, Homo sapiens
tgtttacatgcataagcttaag

SEQ ID NO: 9344806 - DNA, 22 bp, Homo sapiens
tgtttactagccaacatggaga

SEQ ID NO: 9344807 - DNA, 22 bp, Homo sapiens
tgtttacatatttggtctcaga

SEQ ID NO: 9344808 - DNA, 22 bp, Homo sapiens
tgtttacatgcataagcttaag

SEQ ID NO: 9344809 - DNA, 22 bp, Homo sapiens
tgtttcagtccctgtgttcaat

SEQ ID NO: 9344810 - DNA, 20 bp, Homo sapiens
tgtttcataagctgtcctat

SEQ ID NO: 9344811 - DNA, 22 bp, Homo sapiens
tgtttcatgaaacatgtttagg

SEQ ID NO: 9344812 - DNA, 21 bp, Homo sapiens
tgtttcatgctattttcttgt

SEQ ID NO: 9344813 - DNA, 22 bp, Homo sapiens
tgtttcatgtggacatagttgt

SEQ ID NO: 9344814 - DNA, 22 bp, Homo sapiens
tgtttcatgattgctgtcattt

SEQ ID NO: 9344815 - DNA, 22 bp, Homo sapiens
tgtttccatggtgacagcagct

SEQ ID NO: 9344816 - DNA, 22 bp, Homo sapiens
tgtttccagaatgtagctgctt

SEQ ID NO: 9344817 - DNA, 22 bp, Homo sapiens
tgtttccaactgtgatcttact

SEQ ID NO: 9344818 - DNA, 22 bp, Homo sapiens
tgtgttttatctattgtatctt

SEQ ID NO: 9344819 - DNA, 22 bp, Homo sapiens
tgtgttttaaatggaaatttga

SEQ ID NO: 9344820 - DNA, 21 bp, Homo sapiens
tgtgtttgagactatgtttcc

SEQ ID NO: 9344821 - DNA, 21 bp, Homo sapiens
tgtgtttgagactatgtttcc

SEQ ID NO: 9344822 - DNA, 22 bp, Homo sapiens
tgtgtttatagtgtatcttcca

SEQ ID NO: 9344823 - DNA, 22 bp, Homo sapiens
tgtgttgttttaagctgctgca

SEQ ID NO: 9344824 - DNA, 22 bp, Homo sapiens
tgtgtttacttctatgcagttt

SEQ ID NO: 9344825 - DNA, 23 bp, Homo sapiens
tgtgtttacctgaggatcttgtt

SEQ ID NO: 9344826 - DNA, 23 bp, Homo sapiens
tgtgtttacctgaggatcttgtt

SEQ ID NO: 9344827 - DNA, 22 bp, Homo sapiens
tgtgtttagagagcacattcag

SEQ ID NO: 9344828 - DNA, 22 bp, Homo sapiens
tgtgtttagagagcacattcag

SEQ ID NO: 9344829 - DNA, 22 bp, Homo sapiens
tgtgtttatagtgtatcttcca

SEQ ID NO: 9344830 - DNA, 22 bp, Homo sapiens
tgtgtgcacaggagtgtttgaa

SEQ ID NO: 9344831 - DNA, 22 bp, Homo sapiens
tgtgttgtgacattcttggatg

SEQ ID NO: 9344832 - DNA, 22 bp, Homo sapiens
tgtgttggtagatctgaggtct

SEQ ID NO: 9344833 - DNA, 21 bp, Homo sapiens
tgtgttcttctaggtcagcta

SEQ ID NO: 9344834 - DNA, 21 bp, Homo sapiens
tgtgttcttctaggtcagcta

SEQ ID NO: 9344835 - DNA, 22 bp, Homo sapiens
tgtgttctggaaagctcactga

SEQ ID NO: 9344836 - DNA, 22 bp, Homo sapiens
tgtgttcaagattagttctagt

SEQ ID NO: 9344837 - DNA, 22 bp, Homo sapiens
tgtgttaattccacaaacattc

SEQ ID NO: 9344838 - DNA, 22 bp, Homo sapiens
tgttcagaacaaaggtaaatga

SEQ ID NO: 9344839 - DNA, 22 bp, Homo sapiens
tgttcagaaaacagataactaa

SEQ ID NO: 9344840 - DNA, 20 bp, Homo sapiens
tgttcagaaatgcagagagg

SEQ ID NO: 9344841 - DNA, 22 bp, Homo sapiens
tgttcctgaatgcctggctggc

SEQ ID NO: 9344842 - DNA, 22 bp, Homo sapiens
tgttcagaacaaaggtaaatga

SEQ ID NO: 9344843 - DNA, 22 bp, Homo sapiens
tgttcctgacggccaaagaggt

SEQ ID NO: 9344844 - DNA, 22 bp, Homo sapiens
tgttcctgaggcatgtgtcaat

SEQ ID NO: 9344845 - DNA, 22 bp, Homo sapiens
tgttcctgaggcatgtgtcaat

SEQ ID NO: 9344846 - DNA, 22 bp, Homo sapiens
tgttcctgctatggtttgttgc

SEQ ID NO: 9344847 - DNA, 22 bp, Homo sapiens
tgttcctgtactgctgtggctt

SEQ ID NO: 9344848 - DNA, 22 bp, Homo sapiens
tgttatttgggaaagttgtaca

SEQ ID NO: 9344849 - DNA, 22 bp, Homo sapiens
tgttatttgggaaagttgtaca

SEQ ID NO: 9344850 - DNA, 22 bp, Homo sapiens
tgttatttgggaaagttgtaca

SEQ ID NO: 9344851 - DNA, 22 bp, Homo sapiens
tgttcaaatcttttgcttattt

SEQ ID NO: 9344852 - DNA, 22 bp, Homo sapiens
tgttatcacttagacatgctag

SEQ ID NO: 9344853 - DNA, 22 bp, Homo sapiens
tgttagttgttcatgttaagag

SEQ ID NO: 9344854 - DNA, 22 bp, Homo sapiens
tgttaaaaatgcagattcctat

SEQ ID NO: 9344855 - DNA, 18 bp, Homo sapiens
tgttatgagactctagga

SEQ ID NO: 9344856 - DNA, 22 bp, Homo sapiens
tgttatgagaaagacattaggt

SEQ ID NO: 9344857 - DNA, 22 bp, Homo sapiens
tgttatgatctcactatgacta

SEQ ID NO: 9344858 - DNA, 22 bp, Homo sapiens
tgttatctgagcaacgtcgacg

SEQ ID NO: 9344859 - DNA, 22 bp, Homo sapiens
tgttatctggttgtctgattac

SEQ ID NO: 9344860 - DNA, 19 bp, Homo sapiens
tgttatgactttgcctttt

SEQ ID NO: 9344861 - DNA, 22 bp, Homo sapiens
tgttatgaactgcctatggact

SEQ ID NO: 9344862 - DNA, 22 bp, Homo sapiens
tgttatgaactgcctatggaga

SEQ ID NO: 9344863 - DNA, 22 bp, Homo sapiens
tgttattgggtcccaactaggt

SEQ ID NO: 9344864 - DNA, 22 bp, Homo sapiens
tgttattgatatctaatgctct

SEQ ID NO: 9344865 - DNA, 22 bp, Homo sapiens
tgttatttatttcacctccaga

SEQ ID NO: 9344866 - DNA, 22 bp, Homo sapiens
tgttatttatctgagcatttat

SEQ ID NO: 9344867 - DNA, 22 bp, Homo sapiens
tgttatttatctgagcatttat

SEQ ID NO: 9344868 - DNA, 22 bp, Homo sapiens
tgttatttctttgccatatctt

SEQ ID NO: 9344869 - DNA, 22 bp, Homo sapiens
tgtgtctgttttgctcaccatt

SEQ ID NO: 9344870 - DNA, 20 bp, Homo sapiens
tgtgtgaacacggactctgt

SEQ ID NO: 9344871 - DNA, 22 bp, Homo sapiens
tgtgtctttggcgatgtctgga

SEQ ID NO: 9344872 - DNA, 22 bp, Homo sapiens
tgtgtgaatggattattctatt

SEQ ID NO: 9344873 - DNA, 22 bp, Homo sapiens
tgtgtgaaggaatatatactca

SEQ ID NO: 9344874 - DNA, 22 bp, Homo sapiens
tgtgtgagtaaggctgagagag

SEQ ID NO: 9344875 - DNA, 22 bp, Homo sapiens
tgtgtgattccacttatatggg

SEQ ID NO: 9344876 - DNA, 22 bp, Homo sapiens
tgtgtgattgcacttatatgag

SEQ ID NO: 9344877 - DNA, 22 bp, Homo sapiens
tgtgtgaggtggttctgagaag

SEQ ID NO: 9344878 - DNA, 22 bp, Homo sapiens
tgtgtgagtaaggctgagagag

SEQ ID NO: 9344879 - DNA, 22 bp, Homo sapiens
tgtgtgaggtggttctgagaag

SEQ ID NO: 9344880 - DNA, 22 bp, Homo sapiens
tgtgtgattgcaggagatgtgg

SEQ ID NO: 9344881 - DNA, 20 bp, Homo sapiens
tgtgtgaatttcagagccgc

SEQ ID NO: 9344882 - DNA, 22 bp, Homo sapiens
tgtgtgaattctgagcagttta

SEQ ID NO: 9344883 - DNA, 22 bp, Homo sapiens
tgtgtgacccccagtgaagcct

SEQ ID NO: 9344884 - DNA, 22 bp, Homo sapiens
tgtgtgagacaattggctgtgg

SEQ ID NO: 9344885 - DNA, 22 bp, Homo sapiens
tgtgtgaggactcagtgaaaca

SEQ ID NO: 9344886 - DNA, 22 bp, Homo sapiens
tgtgtcctccagggagatgtaa

SEQ ID NO: 9344887 - DNA, 22 bp, Homo sapiens
tgtgtcctcttacctctgaccc

SEQ ID NO: 9344888 - DNA, 22 bp, Homo sapiens
tgtgtcctcatgtggcagagag

SEQ ID NO: 9344889 - DNA, 22 bp, Homo sapiens
tgtgtcctgcagacagactcag

SEQ ID NO: 9344890 - DNA, 22 bp, Homo sapiens
tgtgtcctcatgtggcagagag

SEQ ID NO: 9344891 - DNA, 22 bp, Homo sapiens
tgtgtcctccagggagatgtaa

SEQ ID NO: 9344892 - DNA, 22 bp, Homo sapiens
tgtgtcctcttacctctgaccc

SEQ ID NO: 9344893 - DNA, 22 bp, Homo sapiens
tgtgtcctgcaggtgctgcctg

SEQ ID NO: 9344894 - DNA, 22 bp, Homo sapiens
tgtgtcctgcagacagactcag

SEQ ID NO: 9344895 - DNA, 22 bp, Homo sapiens
tgtgtcctgtccccttgctgct

SEQ ID NO: 9344896 - DNA, 22 bp, Homo sapiens
tgtgtcctggtgttaattttat

SEQ ID NO: 9344897 - DNA, 22 bp, Homo sapiens
tgtgtcctgtccccttgctgct

SEQ ID NO: 9344898 - DNA, 22 bp, Homo sapiens
tgtgtcctggtgttaattttat

SEQ ID NO: 9344899 - DNA, 22 bp, Homo sapiens
tgtgtcctgcaggtgctgcctg

SEQ ID NO: 9344900 - DNA, 22 bp, Homo sapiens
tgtgtcctgtgcaaggggatga

SEQ ID NO: 9344901 - DNA, 22 bp, Homo sapiens
tgtgtcctgtgcaaggggatga

SEQ ID NO: 9344902 - DNA, 22 bp, Homo sapiens
tgtgtcctgtgatctctagggt

SEQ ID NO: 9344903 - DNA, 22 bp, Homo sapiens
tgtgtcctgtgatctctagggt

SEQ ID NO: 9344904 - DNA, 22 bp, Homo sapiens
tgtgtcctttcttaagagtgag

SEQ ID NO: 9344905 - DNA, 22 bp, Homo sapiens
tgtgtcctttctaatgcccaga

SEQ ID NO: 9344906 - DNA, 22 bp, Homo sapiens
tgtgtcctttggaggatcagcg

SEQ ID NO: 9344907 - DNA, 22 bp, Homo sapiens
tgtgtcctttcttaagagtgag

SEQ ID NO: 9344908 - DNA, 22 bp, Homo sapiens
tgtgtccttctgggagtcccag

SEQ ID NO: 9344909 - DNA, 22 bp, Homo sapiens
tgtgtcctttggaggatcagcg

SEQ ID NO: 9344910 - DNA, 23 bp, Homo sapiens
tgtgtctgtttagggaggatgtg

SEQ ID NO: 9344911 - DNA, 23 bp, Homo sapiens
tgtgtccttaactgtatatacta

SEQ ID NO: 9344912 - DNA, 23 bp, Homo sapiens
tgtgtccttaactgtatatacta

SEQ ID NO: 9344913 - DNA, 22 bp, Homo sapiens
tgtgtccttatgaaaatactgt

SEQ ID NO: 9344914 - DNA, 22 bp, Homo sapiens
tgtgtccttccagtttttcctg

SEQ ID NO: 9344915 - DNA, 22 bp, Homo sapiens
tgtgtcctttctaatgcccaga

SEQ ID NO: 9344916 - DNA, 22 bp, Homo sapiens
tgtgtccttctgggagtcccag

SEQ ID NO: 9344917 - DNA, 22 bp, Homo sapiens
tgtgtccttccagtttttcctg

SEQ ID NO: 9344918 - DNA, 22 bp, Homo sapiens
tgtgtccttatgaaaatactgt

SEQ ID NO: 9344919 - DNA, 22 bp, Homo sapiens
tgtgtcctcatgaggtttgcag

SEQ ID NO: 9344920 - DNA, 22 bp, Homo sapiens
tgtgtcctcatgaggtttgcag

SEQ ID NO: 9344921 - DNA, 22 bp, Homo sapiens
tgtgtcctcatgaggtttgcag

SEQ ID NO: 9344922 - DNA, 22 bp, Homo sapiens
tgtgtcctcagggaagcagaga

SEQ ID NO: 9344923 - DNA, 22 bp, Homo sapiens
tgtgtcctcagggaagcagaga

SEQ ID NO: 9344924 - DNA, 22 bp, Homo sapiens
tgtgtcctcactgtatgcaagg

SEQ ID NO: 9344925 - DNA, 22 bp, Homo sapiens
tgtgtcctcactgtatgcaagg

SEQ ID NO: 9344926 - DNA, 22 bp, Homo sapiens
tgtgtcctatgaaagagggtta

SEQ ID NO: 9344927 - DNA, 22 bp, Homo sapiens
tgtgtcctatgaaagagggtta

SEQ ID NO: 9344928 - DNA, 19 bp, Homo sapiens
tgtgtcctagcagccagtc

SEQ ID NO: 9344929 - DNA, 19 bp, Homo sapiens
tgtgtcctagcagccagtc

SEQ ID NO: 9344930 - DNA, 22 bp, Homo sapiens
tgtgtcctactgaggagctcct

SEQ ID NO: 9344931 - DNA, 22 bp, Homo sapiens
tgtgtcctactgaggagctcct

SEQ ID NO: 9344932 - DNA, 22 bp, Homo sapiens
tgtgtccattcaggcactgacc

SEQ ID NO: 9344933 - DNA, 20 bp, Homo sapiens
tgtgtccatcatctgggcac

SEQ ID NO: 9344934 - DNA, 22 bp, Homo sapiens
tgtgtccaacccagggacaagt

SEQ ID NO: 9344935 - DNA, 22 bp, Homo sapiens
tgtgtcattgccatgaaaaggc

SEQ ID NO: 9344936 - DNA, 22 bp, Homo sapiens
tgtgtccaacccagggacaagt

SEQ ID NO: 9344937 - DNA, 22 bp, Homo sapiens
tgtgtccacgcactggcatgat

SEQ ID NO: 9344938 - DNA, 22 bp, Homo sapiens
tgtgtcatagagagcacaaatc

SEQ ID NO: 9344939 - DNA, 21 bp, Homo sapiens
tgtgtcagtctttggaagcaa

SEQ ID NO: 9344940 - DNA, 23 bp, Homo sapiens
tgtgtcataaaattaaaacttca

SEQ ID NO: 9344941 - DNA, 21 bp, Homo sapiens
tgtgtcagtctttggaagcaa

SEQ ID NO: 9344942 - DNA, 22 bp, Homo sapiens
tgtgtcaggccttatcggtggc

SEQ ID NO: 9344943 - DNA, 22 bp, Homo sapiens
tgtgtcaggccttatcggtggc

SEQ ID NO: 9344944 - DNA, 22 bp, Homo sapiens
tgtgtcatattagtattgagag

SEQ ID NO: 9344945 - DNA, 22 bp, Homo sapiens
tgtgtcatctgtgttacataat

SEQ ID NO: 9344946 - DNA, 22 bp, Homo sapiens
tgtgtaaatggcatctctcagc

SEQ ID NO: 9344947 - DNA, 22 bp, Homo sapiens
tgtgtaaatggactgtgaatta

SEQ ID NO: 9344948 - DNA, 22 bp, Homo sapiens
tgtgtaaatggactgtgaatta

SEQ ID NO: 9344949 - DNA, 22 bp, Homo sapiens
tgtgtaaattatttttaatgat

SEQ ID NO: 9344950 - DNA, 22 bp, Homo sapiens
tgtgtcaggagatagcaaaggg

SEQ ID NO: 9344951 - DNA, 22 bp, Homo sapiens
tgtgtcaggagatagcaaaggg

SEQ ID NO: 9344952 - DNA, 22 bp, Homo sapiens
tgtgtcagcatcctttgggaca

SEQ ID NO: 9344953 - DNA, 20 bp, Homo sapiens
tgtgtcaggccctgattaaa

SEQ ID NO: 9344954 - DNA, 20 bp, Homo sapiens
tgtgtcaggccctgattaaa

SEQ ID NO: 9344955 - DNA, 22 bp, Homo sapiens
tgtgtcagcaggggagggaact

SEQ ID NO: 9344956 - DNA, 19 bp, Homo sapiens
tgtgtcagcagggggcttc

SEQ ID NO: 9344957 - DNA, 19 bp, Homo sapiens
tgtgtcagcagggggcttc

SEQ ID NO: 9344958 - DNA, 22 bp, Homo sapiens
tgtgtcagcaggggagggaact

SEQ ID NO: 9344959 - DNA, 22 bp, Homo sapiens
tgtgtcagcacagtatcaatta

SEQ ID NO: 9344960 - DNA, 22 bp, Homo sapiens
tgtgtcagcacagtatcaatta

SEQ ID NO: 9344961 - DNA, 19 bp, Homo sapiens
tgtgtcagatttgctcctt

SEQ ID NO: 9344962 - DNA, 19 bp, Homo sapiens
tgtgtcagatttgctcctt

SEQ ID NO: 9344963 - DNA, 22 bp, Homo sapiens
tgtgtcagatttaggctcaaac

SEQ ID NO: 9344964 - DNA, 22 bp, Homo sapiens
tgtgtcagatttaggctcaaac

SEQ ID NO: 9344965 - DNA, 22 bp, Homo sapiens
tgtgtaaagcttgttccagaaa

SEQ ID NO: 9344966 - DNA, 22 bp, Homo sapiens
tgtgtaaaagattagtttacta

SEQ ID NO: 9344967 - DNA, 22 bp, Homo sapiens
tgtgtaaaatctgattaatact

SEQ ID NO: 9344968 - DNA, 22 bp, Homo sapiens
tgtgtaaaatctgattaatact

SEQ ID NO: 9344969 - DNA, 22 bp, Homo sapiens
tgtggttgaaggttattactta

SEQ ID NO: 9344970 - DNA, 22 bp, Homo sapiens
tgtggtggctattctggtctca

SEQ ID NO: 9344971 - DNA, 22 bp, Homo sapiens
tgtggtggggtctggtattcca

SEQ ID NO: 9344972 - DNA, 22 bp, Homo sapiens
tgtggtggctattctggtctca

SEQ ID NO: 9344973 - DNA, 21 bp, Homo sapiens
tgtggtcttttagttccatca

SEQ ID NO: 9344974 - DNA, 21 bp, Homo sapiens
tgtggtcttttagttccatca

SEQ ID NO: 9344975 - DNA, 22 bp, Homo sapiens
tgtggtcttggaagaagttgct

SEQ ID NO: 9344976 - DNA, 22 bp, Homo sapiens
tgtggtgccgagagtctggacg

SEQ ID NO: 9344977 - DNA, 19 bp, Homo sapiens
tgtggtctctgttctcagg

SEQ ID NO: 9344978 - DNA, 22 bp, Homo sapiens
tgtggtctggccattcagggac

SEQ ID NO: 9344979 - DNA, 22 bp, Homo sapiens
tgtggtctcctgtcttggcctt

SEQ ID NO: 9344980 - DNA, 22 bp, Homo sapiens
tgtggtctcgttatgttgccca

SEQ ID NO: 9344981 - DNA, 22 bp, Homo sapiens
tgtggtctccccagtgccagct

SEQ ID NO: 9344982 - DNA, 22 bp, Homo sapiens
tgtggtctccccagtgccagct

SEQ ID NO: 9344983 - DNA, 22 bp, Homo sapiens
tgtgggtggagtgatattagct

SEQ ID NO: 9344984 - DNA, 22 bp, Homo sapiens
tgtgggtggcatcgtcctggcc

SEQ ID NO: 9344985 - DNA, 22 bp, Homo sapiens
tgtgggtggcatcgtcctggcc

SEQ ID NO: 9344986 - DNA, 22 bp, Homo sapiens
tgtggtagagggcagatgggca

SEQ ID NO: 9344987 - DNA, 22 bp, Homo sapiens
tgtggtcagctactggtcatct

SEQ ID NO: 9344988 - DNA, 18 bp, Homo sapiens
tgtgggttgggcagacca

SEQ ID NO: 9344989 - DNA, 22 bp, Homo sapiens
tgtgggtttaagaggcagcatg

SEQ ID NO: 9344990 - DNA, 22 bp, Homo sapiens
tgtgggtggtaaaatacaatga

SEQ ID NO: 9344991 - DNA, 22 bp, Homo sapiens
tgtgggtgttctcacttagata

SEQ ID NO: 9344992 - DNA, 22 bp, Homo sapiens
tgtggggactttcaaagccaat

SEQ ID NO: 9344993 - DNA, 17 bp, Homo sapiens
tgtggccttctgagctt

SEQ ID NO: 9344994 - DNA, 19 bp, Homo sapiens
tgtggcctggggacaggcc

SEQ ID NO: 9344995 - DNA, 19 bp, Homo sapiens
tgtggcctggggacaggcc

SEQ ID NO: 9344996 - DNA, 17 bp, Homo sapiens
tgtggccttctgagctt

SEQ ID NO: 9344997 - DNA, 22 bp, Homo sapiens
tgtggcctgggagctgaggtct

SEQ ID NO: 9344998 - DNA, 20 bp, Homo sapiens
tgtggcctctagagacagcc

SEQ ID NO: 9344999 - DNA, 22 bp, Homo sapiens
tcccctgagacccctcagcact

SEQ ID NO: 9345000 - DNA, 22 bp, Homo sapiens
tcccctctggaggctgcagggg

SEQ ID NO: 9345001 - DNA, 22 bp, Homo sapiens
tcccctctggaggctgcagggg

SEQ ID NO: 9345002 - DNA, 22 bp, Homo sapiens
tcccctctctgcgctcccaggt

SEQ ID NO: 9345003 - DNA, 22 bp, Homo sapiens
tcccctctctgcgctcccaggt

SEQ ID NO: 9345004 - DNA, 22 bp, Homo sapiens
tcccctcctgcctttgcggtgg

SEQ ID NO: 9345005 - DNA, 22 bp, Homo sapiens
tcccctgcagcgcctgcttcta

SEQ ID NO: 9345006 - DNA, 22 bp, Homo sapiens
tcccctgcagcgcctgcttcta

SEQ ID NO: 9345007 - DNA, 22 bp, Homo sapiens
tgtggacagagccctggtttgg

SEQ ID NO: 9345008 - DNA, 22 bp, Homo sapiens
tgtggaggattctgatgccagc

SEQ ID NO: 9345009 - DNA, 22 bp, Homo sapiens
tgtggagccaggaggtggggac

SEQ ID NO: 9345010 - DNA, 22 bp, Homo sapiens
tgtggagcccccaggagtgggg

SEQ ID NO: 9345011 - DNA, 22 bp, Homo sapiens
tgtggagaagaaggccactgca

SEQ ID NO: 9345012 - DNA, 22 bp, Homo sapiens
tgtggacattttttgtcagtag

SEQ ID NO: 9345013 - DNA, 22 bp, Homo sapiens
tccccatgaggctgaattgggc

SEQ ID NO: 9345014 - DNA, 22 bp, Homo sapiens
tccccatgtctgcagggagggt

SEQ ID NO: 9345015 - DNA, 22 bp, Homo sapiens
tccccatgggtggggacacata

SEQ ID NO: 9345016 - DNA, 22 bp, Homo sapiens
tccccatggaaggatgatggaa

SEQ ID NO: 9345017 - DNA, 22 bp, Homo sapiens
tccccatggaaggatgatggaa

SEQ ID NO: 9345018 - DNA, 22 bp, Homo sapiens
tccccagggtccctgcttccat

SEQ ID NO: 9345019 - DNA, 22 bp, Homo sapiens
tccccagggtccctgcttccat

SEQ ID NO: 9345020 - DNA, 22 bp, Homo sapiens
tcccccaggctggagtgcagtg

SEQ ID NO: 9345021 - DNA, 22 bp, Homo sapiens
tccccctcattacctcattcaa

SEQ ID NO: 9345022 - DNA, 22 bp, Homo sapiens
tcccccatcccaaggaggtcat

SEQ ID NO: 9345023 - DNA, 22 bp, Homo sapiens
tccccctccaattgccatgtta

SEQ ID NO: 9345024 - DNA, 22 bp, Homo sapiens
tccccctcctgtggttttctgc

SEQ ID NO: 9345025 - DNA, 22 bp, Homo sapiens
tccccctcctgtggttttctgc

SEQ ID NO: 9345026 - DNA, 22 bp, Homo sapiens
tccccccagcctttcacatgag

SEQ ID NO: 9345027 - DNA, 22 bp, Homo sapiens
tccccccagcctttcacatgag

SEQ ID NO: 9345028 - DNA, 22 bp, Homo sapiens
tccccccagcctttcacatgag

SEQ ID NO: 9345029 - DNA, 23 bp, Homo sapiens
tcccctcaggcagccagtgccct

SEQ ID NO: 9345030 - DNA, 22 bp, Homo sapiens
tcccctccaactccaactatgg

SEQ ID NO: 9345031 - DNA, 22 bp, Homo sapiens
tcccctcctctcctgatatggg

SEQ ID NO: 9345032 - DNA, 22 bp, Homo sapiens
tcccctcctgcctttgcggtgg

SEQ ID NO: 9345033 - DNA, 22 bp, Homo sapiens
tgtggaggtttaagtaatggga

SEQ ID NO: 9345034 - DNA, 22 bp, Homo sapiens
tgtggaggattctgatgccagc

SEQ ID NO: 9345035 - DNA, 22 bp, Homo sapiens
tgtggaggattctgatgccagc

SEQ ID NO: 9345036 - DNA, 22 bp, Homo sapiens
tgtggagtggtctgaaggctcc

SEQ ID NO: 9345037 - DNA, 22 bp, Homo sapiens
tgtggatgagggagtgaacaaa

SEQ ID NO: 9345038 - DNA, 20 bp, Homo sapiens
tgtggatgaggtaaggatag

SEQ ID NO: 9345039 - DNA, 22 bp, Homo sapiens
tgtggcacagaaagatgaaggg

SEQ ID NO: 9345040 - DNA, 22 bp, Homo sapiens
tgtggcacttctctccttgtaa

SEQ ID NO: 9345041 - DNA, 22 bp, Homo sapiens
tgtggcacttgcaaatattttg

SEQ ID NO: 9345042 - DNA, 22 bp, Homo sapiens
tgtggcacttacatcctagttt

SEQ ID NO: 9345043 - DNA, 22 bp, Homo sapiens
tgtggcacagaagaaagagagg

SEQ ID NO: 9345044 - DNA, 22 bp, Homo sapiens
tgtggcacatacacaggagggc

SEQ ID NO: 9345045 - DNA, 22 bp, Homo sapiens
tgtggcagaaccagaattcaaa

SEQ ID NO: 9345046 - DNA, 22 bp, Homo sapiens
tgtggcagagagagcttccttg

SEQ ID NO: 9345047 - DNA, 22 bp, Homo sapiens
tgtggcagaggaggcagcgtcc

SEQ ID NO: 9345048 - DNA, 22 bp, Homo sapiens
tgtggcagaggaggcagcgtcc

SEQ ID NO: 9345049 - DNA, 22 bp, Homo sapiens
tgtggcagaggaggcagcgtcc

SEQ ID NO: 9345050 - DNA, 22 bp, Homo sapiens
tgtggcagaggaggcagcgtcc

SEQ ID NO: 9345051 - DNA, 22 bp, Homo sapiens
tgtggcagagtaaggacccagt

SEQ ID NO: 9345052 - DNA, 22 bp, Homo sapiens
tgtggcagctgctgcaggagct

SEQ ID NO: 9345053 - DNA, 22 bp, Homo sapiens
tgtggcagctgctgcaggagct

SEQ ID NO: 9345054 - DNA, 21 bp, Homo sapiens
tgtggcagatgttgggaggca

SEQ ID NO: 9345055 - DNA, 21 bp, Homo sapiens
tgtggcagatgttgggaggca

SEQ ID NO: 9345056 - DNA, 22 bp, Homo sapiens
tgtggccagccacaggcatggt

SEQ ID NO: 9345057 - DNA, 22 bp, Homo sapiens
tgtggccagccacaggcatggt

SEQ ID NO: 9345058 - DNA, 22 bp, Homo sapiens
tgtggccagccacaggcatggt

SEQ ID NO: 9345059 - DNA, 20 bp, Homo sapiens
tgtggccagctctctactgg

SEQ ID NO: 9345060 - DNA, 22 bp, Homo sapiens
tgtggccagggggccatgtccc

SEQ ID NO: 9345061 - DNA, 22 bp, Homo sapiens
tgtggccaggcccctgatggtg

SEQ ID NO: 9345062 - DNA, 22 bp, Homo sapiens
tgtggccaggaaaaggagatgg

SEQ ID NO: 9345063 - DNA, 22 bp, Homo sapiens
tgtggccaggaaaaggagatgg

SEQ ID NO: 9345064 - DNA, 22 bp, Homo sapiens
tgtggccaggaaaaggagatgg

SEQ ID NO: 9345065 - DNA, 20 bp, Homo sapiens
tgtggccagctctctactgg

SEQ ID NO: 9345066 - DNA, 22 bp, Homo sapiens
tgtggcctagttaaggacgcct

SEQ ID NO: 9345067 - DNA, 22 bp, Homo sapiens
tgtggccattcttgaggtcgac

SEQ ID NO: 9345068 - DNA, 22 bp, Homo sapiens
tgtggccattcttgaggtcgac

SEQ ID NO: 9345069 - DNA, 20 bp, Homo sapiens
tgtggccatgttccaactca

SEQ ID NO: 9345070 - DNA, 22 bp, Homo sapiens
tgtggccatggtcagaatattg

SEQ ID NO: 9345071 - DNA, 19 bp, Homo sapiens
tgtggccatggttcagctg

SEQ ID NO: 9345072 - DNA, 22 bp, Homo sapiens
tgtggccatggtcagaatattg

SEQ ID NO: 9345073 - DNA, 22 bp, Homo sapiens
tgtggccatatactttgttgtg

SEQ ID NO: 9345074 - DNA, 22 bp, Homo sapiens
tgtggccataaagcttaaaatg

SEQ ID NO: 9345075 - DNA, 22 bp, Homo sapiens
tgtggcagtataagagctagaa

SEQ ID NO: 9345076 - DNA, 18 bp, Homo sapiens
tgtggcaggggtgggaga

SEQ ID NO: 9345077 - DNA, 22 bp, Homo sapiens
tgtggcagctgctgcaggagct

SEQ ID NO: 9345078 - DNA, 22 bp, Homo sapiens
tgtggccaaaataaaatgaggt

SEQ ID NO: 9345079 - DNA, 22 bp, Homo sapiens
tgtggccaccagagctgctatt

SEQ ID NO: 9345080 - DNA, 22 bp, Homo sapiens
tgtggccactgtttcttttcct

SEQ ID NO: 9345081 - DNA, 22 bp, Homo sapiens
tgtggccagaggtactatttta

SEQ ID NO: 9345082 - DNA, 22 bp, Homo sapiens
tgtggccagcaggtggctgtgt

SEQ ID NO: 9345083 - DNA, 23 bp, Homo sapiens
atatcacacccagtacagtctcc

SEQ ID NO: 9345084 - DNA, 22 bp, Homo sapiens
atatattttttgagacagagtc

SEQ ID NO: 9345085 - DNA, 22 bp, Homo sapiens
atatcactagagaagttgttaa

SEQ ID NO: 9345086 - DNA, 22 bp, Homo sapiens
atatcatgttctctgtgtgtca

SEQ ID NO: 9345087 - DNA, 22 bp, Homo sapiens
atatcattatgttatgagcaca

SEQ ID NO: 9345088 - DNA, 22 bp, Homo sapiens
atatcattatgttatgagcaca

SEQ ID NO: 9345089 - DNA, 22 bp, Homo sapiens
atatcataaatcggtgcatgaa

SEQ ID NO: 9345090 - DNA, 22 bp, Homo sapiens
atatcacagtagttgtttagtt

SEQ ID NO: 9345091 - DNA, 22 bp, Homo sapiens
atatcacagctctttcattgct

SEQ ID NO: 9345092 - DNA, 22 bp, Homo sapiens
atatcacagctctttcattgct

SEQ ID NO: 9345093 - DNA, 22 bp, Homo sapiens
atagtcttagatcagataaagt

SEQ ID NO: 9345094 - DNA, 22 bp, Homo sapiens
atagtcttcagcactttgatca

SEQ ID NO: 9345095 - DNA, 22 bp, Homo sapiens
atagtatgaattaaatcatgag

SEQ ID NO: 9345096 - DNA, 20 bp, Homo sapiens
atagtattcaggccacttgt

SEQ ID NO: 9345097 - DNA, 20 bp, Homo sapiens
atagtattcaggccacttgt

SEQ ID NO: 9345098 - DNA, 22 bp, Homo sapiens
atagtatgtgtgtttatgtaca

SEQ ID NO: 9345099 - DNA, 22 bp, Homo sapiens
atatattttgcggtcacgtggc

SEQ ID NO: 9345100 - DNA, 22 bp, Homo sapiens
atatattttgcggtcacgtggc

SEQ ID NO: 9345101 - DNA, 22 bp, Homo sapiens
atatattttgaatagcctctgt

SEQ ID NO: 9345102 - DNA, 22 bp, Homo sapiens
atatattttttgagacagagtc

SEQ ID NO: 9345103 - DNA, 22 bp, Homo sapiens
atatattttttgagacagagtc

SEQ ID NO: 9345104 - DNA, 22 bp, Homo sapiens
atatattttttgagacagagtc

SEQ ID NO: 9345105 - DNA, 19 bp, Homo sapiens
atatatgtatacaatgtgg

SEQ ID NO: 9345106 - DNA, 19 bp, Homo sapiens
atatatgtatacaatgtgg

SEQ ID NO: 9345107 - DNA, 20 bp, Homo sapiens
atatatgtatgcgtgtggtt

SEQ ID NO: 9345108 - DNA, 22 bp, Homo sapiens
atatatgtgcaggctcacacat

SEQ ID NO: 9345109 - DNA, 22 bp, Homo sapiens
atatattttgaatagcctctgt

SEQ ID NO: 9345110 - DNA, 22 bp, Homo sapiens
atatattttgaatagcctctgt

SEQ ID NO: 9345111 - DNA, 22 bp, Homo sapiens
ctgggcctgccaccatcttagg

SEQ ID NO: 9345112 - DNA, 22 bp, Homo sapiens
ctgggcctggacgggcagatct

SEQ ID NO: 9345113 - DNA, 22 bp, Homo sapiens
ctgggcctgagctctgaagagt

SEQ ID NO: 9345114 - DNA, 22 bp, Homo sapiens
ctgggcctgggaggccaggtct

SEQ ID NO: 9345115 - DNA, 22 bp, Homo sapiens
ctgggcctgggaggccaggtct

SEQ ID NO: 9345116 - DNA, 22 bp, Homo sapiens
ctgggcctggagcccacgagcc

SEQ ID NO: 9345117 - DNA, 22 bp, Homo sapiens
ctgggctgatttagtcacgttt

SEQ ID NO: 9345118 - DNA, 22 bp, Homo sapiens
ctgggctgatttagtcacgttt

SEQ ID NO: 9345119 - DNA, 22 bp, Homo sapiens
ctgggctgcagcgggagcgacg

SEQ ID NO: 9345120 - DNA, 22 bp, Homo sapiens
ctgggctggcgcatccgacacg

SEQ ID NO: 9345121 - DNA, 22 bp, Homo sapiens
ctgggctgatttagtcacgttt

SEQ ID NO: 9345122 - DNA, 22 bp, Homo sapiens
ctgggctgtaatgtggcactga

SEQ ID NO: 9345123 - DNA, 22 bp, Homo sapiens
ctgggctgtaatgtggcactga

SEQ ID NO: 9345124 - DNA, 22 bp, Homo sapiens
ctgggctgtaatgtggcactga

SEQ ID NO: 9345125 - DNA, 22 bp, Homo sapiens
ctgggctgggtttaccctcttc

SEQ ID NO: 9345126 - DNA, 22 bp, Homo sapiens
ctgggctgtaatgtggcactga

SEQ ID NO: 9345127 - DNA, 22 bp, Homo sapiens
ctgggctgtaatgtggcactga

SEQ ID NO: 9345128 - DNA, 20 bp, Homo sapiens
ctgggctgggctacagggtc

SEQ ID NO: 9345129 - DNA, 20 bp, Homo sapiens
ctgggctgggctacagggtc

SEQ ID NO: 9345130 - DNA, 22 bp, Homo sapiens
ctgggccatctctctgcaagtg

SEQ ID NO: 9345131 - DNA, 22 bp, Homo sapiens
ctgggccatggaagtctctgcc

SEQ ID NO: 9345132 - DNA, 22 bp, Homo sapiens
ctgggccatgggccagcgaggc

SEQ ID NO: 9345133 - DNA, 17 bp, Homo sapiens
ctgggcctctgcccttt

SEQ ID NO: 9345134 - DNA, 22 bp, Homo sapiens
ctgggccatgggccagcgaggc

SEQ ID NO: 9345135 - DNA, 22 bp, Homo sapiens
ctgggctgtcaatggccctctg

SEQ ID NO: 9345136 - DNA, 22 bp, Homo sapiens
ctgggctgtcaatggccctctg

SEQ ID NO: 9345137 - DNA, 22 bp, Homo sapiens
ctgggctgtcagttttgtttta

SEQ ID NO: 9345138 - DNA, 22 bp, Homo sapiens
ctgggctgtcagttttgtttta

SEQ ID NO: 9345139 - DNA, 22 bp, Homo sapiens
ctgggctgtcagttttgtttta

SEQ ID NO: 9345140 - DNA, 22 bp, Homo sapiens
ctgggctgtcaatggccctctg

SEQ ID NO: 9345141 - DNA, 22 bp, Homo sapiens
ctgggctgtcccagggcggcag

SEQ ID NO: 9345142 - DNA, 22 bp, Homo sapiens
ctgggctgtcccagggcggcag

SEQ ID NO: 9345143 - DNA, 22 bp, Homo sapiens
ctgggctgtcccagggcggcag

SEQ ID NO: 9345144 - DNA, 22 bp, Homo sapiens
ctgggctgtcccaaccccatcc

SEQ ID NO: 9345145 - DNA, 23 bp, Homo sapiens
ctgggctgtcctgaggtcacctc

SEQ ID NO: 9345146 - DNA, 23 bp, Homo sapiens
ctgggctgtcctgaggtcacctc

SEQ ID NO: 9345147 - DNA, 22 bp, Homo sapiens
ctgggctgtcccagggcggcag

SEQ ID NO: 9345148 - DNA, 23 bp, Homo sapiens
ctgggctgtcctgaggtcacctc

SEQ ID NO: 9345149 - DNA, 22 bp, Homo sapiens
ctgggctgtggtgtggcccaaa

SEQ ID NO: 9345150 - DNA, 22 bp, Homo sapiens
ctgggctgtggtgtggcccaaa

SEQ ID NO: 9345151 - DNA, 22 bp, Homo sapiens
ctgggctgtggtgtggcccaaa

SEQ ID NO: 9345152 - DNA, 22 bp, Homo sapiens
ctgggctgttctgcccctgggt

SEQ ID NO: 9345153 - DNA, 22 bp, Homo sapiens
ctgggctgttctgcccctgggt

SEQ ID NO: 9345154 - DNA, 22 bp, Homo sapiens
ctggggatgggacctggcataa

SEQ ID NO: 9345155 - DNA, 22 bp, Homo sapiens
ctggggatgggacctggcataa

SEQ ID NO: 9345156 - DNA, 22 bp, Homo sapiens
ctggggatgggacctggcataa

SEQ ID NO: 9345157 - DNA, 22 bp, Homo sapiens
ctggggaggcagggctgcccct

SEQ ID NO: 9345158 - DNA, 22 bp, Homo sapiens
ctggggcagagcccagcaattt

SEQ ID NO: 9345159 - DNA, 22 bp, Homo sapiens
ctggggcatcatccattctttc

SEQ ID NO: 9345160 - DNA, 22 bp, Homo sapiens
ctggggcagagcctttagcaaa

SEQ ID NO: 9345161 - DNA, 22 bp, Homo sapiens
ctggtggagagtgggctctgga

SEQ ID NO: 9345162 - DNA, 19 bp, Homo sapiens
ctggtgcttgagtgagtca

SEQ ID NO: 9345163 - DNA, 22 bp, Homo sapiens
ctggtgctgggcagggctcagg

SEQ ID NO: 9345164 - DNA, 22 bp, Homo sapiens
ctggtgctggcaacagagtagg

SEQ ID NO: 9345165 - DNA, 22 bp, Homo sapiens
ctggtgctggcaacagagtagg

SEQ ID NO: 9345166 - DNA, 22 bp, Homo sapiens
atatttgttagagtctatgtgt

SEQ ID NO: 9345167 - DNA, 22 bp, Homo sapiens
ctggtgggagcagcaggcagct

SEQ ID NO: 9345168 - DNA, 22 bp, Homo sapiens
ctggtggagatgcctggcccct

SEQ ID NO: 9345169 - DNA, 22 bp, Homo sapiens
ctggtggagagtgggctctgga

SEQ ID NO: 9345170 - DNA, 22 bp, Homo sapiens
ctggtggcatcttgagacggtt

SEQ ID NO: 9345171 - DNA, 22 bp, Homo sapiens
ctggtggcatcttgagatggtt

SEQ ID NO: 9345172 - DNA, 22 bp, Homo sapiens
ctggtggcatcttgagatggtt

SEQ ID NO: 9345173 - DNA, 22 bp, Homo sapiens
ctgtccagctgaccagagcagc

SEQ ID NO: 9345174 - DNA, 22 bp, Homo sapiens
ctgtccagaaagggggcaacaa

SEQ ID NO: 9345175 - DNA, 22 bp, Homo sapiens
ctgtccagctgaccagagcagc

SEQ ID NO: 9345176 - DNA, 22 bp, Homo sapiens
ctgtccagcttggctcctgggg

SEQ ID NO: 9345177 - DNA, 22 bp, Homo sapiens
ctgtccagctgaccagagcagc

SEQ ID NO: 9345178 - DNA, 22 bp, Homo sapiens
ctgtcatttgtctgctccctct

SEQ ID NO: 9345179 - DNA, 22 bp, Homo sapiens
ctgtccacatggagaacctggt

SEQ ID NO: 9345180 - DNA, 22 bp, Homo sapiens
ctgtatttcccacattctctat

SEQ ID NO: 9345181 - DNA, 22 bp, Homo sapiens
ctgtatttcttggacagttgct

SEQ ID NO: 9345182 - DNA, 22 bp, Homo sapiens
ctgtcattgtacatgttataca

SEQ ID NO: 9345183 - DNA, 22 bp, Homo sapiens
ctgtatttagttaaaatgctaa

SEQ ID NO: 9345184 - DNA, 22 bp, Homo sapiens
ctgtattcaagcttctgcccaa

SEQ ID NO: 9345185 - DNA, 22 bp, Homo sapiens
ctgtatgtttctatgaatgtga

SEQ ID NO: 9345186 - DNA, 22 bp, Homo sapiens
ctgtatgttttctcctttggtt

SEQ ID NO: 9345187 - DNA, 22 bp, Homo sapiens
ctgtattaaaggcagtgatctt

SEQ ID NO: 9345188 - DNA, 22 bp, Homo sapiens
ctgtattagccaggtgcacaag

SEQ ID NO: 9345189 - DNA, 22 bp, Homo sapiens
ctgtatgtcttgtgaattgtag

SEQ ID NO: 9345190 - DNA, 22 bp, Homo sapiens
ctgtatgtgaaaatgtcaagtg

SEQ ID NO: 9345191 - DNA, 22 bp, Homo sapiens
ctgtatgtagaatagctgacaa

SEQ ID NO: 9345192 - DNA, 22 bp, Homo sapiens
ctgtatgttgggtaagcattgc

SEQ ID NO: 9345193 - DNA, 22 bp, Homo sapiens
ctgtatgttccgttttgtcact

SEQ ID NO: 9345194 - DNA, 22 bp, Homo sapiens
ctgtatatgtgcatacacacac

SEQ ID NO: 9345195 - DNA, 22 bp, Homo sapiens
ctgtatctgtgttggatgagtt

SEQ ID NO: 9345196 - DNA, 22 bp, Homo sapiens
ctgtatctgtcagctggtctcg

SEQ ID NO: 9345197 - DNA, 22 bp, Homo sapiens
ctgtaatcccagctactcggga

SEQ ID NO: 9345198 - DNA, 22 bp, Homo sapiens
atattttgaagttaataatgtg

SEQ ID NO: 9345199 - DNA, 22 bp, Homo sapiens
atattttgaagttaataatgtg

SEQ ID NO: 9345200 - DNA, 22 bp, Homo sapiens
atattttgaagttaataatgtg

SEQ ID NO: 9345201 - DNA, 22 bp, Homo sapiens
atatttgttgagttcttatgat

SEQ ID NO: 9345202 - DNA, 22 bp, Homo sapiens
atattttcacagaacttgcaaa

SEQ ID NO: 9345203 - DNA, 22 bp, Homo sapiens
ctgtccagggtgtgcaggggct

SEQ ID NO: 9345204 - DNA, 22 bp, Homo sapiens
ctgtgcagtaggtcagggctgg

SEQ ID NO: 9345205 - DNA, 19 bp, Homo sapiens
ctgtgcaggccgggctgag

SEQ ID NO: 9345206 - DNA, 22 bp, Homo sapiens
ctgtgcctaagatgcatgtctc

SEQ ID NO: 9345207 - DNA, 22 bp, Homo sapiens
ctgtgcctccaagtggtctctg

SEQ ID NO: 9345208 - DNA, 22 bp, Homo sapiens
ctgtgccctttcgctgcactgt

SEQ ID NO: 9345209 - DNA, 20 bp, Homo sapiens
ctgtgcctaaacctccgggt

SEQ ID NO: 9345210 - DNA, 22 bp, Homo sapiens
ctgtgccctttgtcctcgtctc

SEQ ID NO: 9345211 - DNA, 22 bp, Homo sapiens
ctgtgccttggcgctgtgccac

SEQ ID NO: 9345212 - DNA, 22 bp, Homo sapiens
ctgtgcctttgtagctgtgcct

SEQ ID NO: 9345213 - DNA, 22 bp, Homo sapiens
ctgtgccttctacttcactcta

SEQ ID NO: 9345214 - DNA, 22 bp, Homo sapiens
ctgtgctccctctggcgccccg

SEQ ID NO: 9345215 - DNA, 20 bp, Homo sapiens
ctgtgcctcctgctagtcct

SEQ ID NO: 9345216 - DNA, 22 bp, Homo sapiens
ctgtgcctccctttactttgag

SEQ ID NO: 9345217 - DNA, 22 bp, Homo sapiens
ctgtgccttagtattctcattt

SEQ ID NO: 9345218 - DNA, 22 bp, Homo sapiens
ctgtgtccaatggccttagcag

SEQ ID NO: 9345219 - DNA, 22 bp, Homo sapiens
ctgtgtccaatggccttagcag

SEQ ID NO: 9345220 - DNA, 22 bp, Homo sapiens
ctgtgtccaatggccttagcag

SEQ ID NO: 9345221 - DNA, 22 bp, Homo sapiens
ctgtgtcactcactgcgttatg

SEQ ID NO: 9345222 - DNA, 22 bp, Homo sapiens
ctgtgtccatttatcattgtca

SEQ ID NO: 9345223 - DNA, 22 bp, Homo sapiens
ctgtgtcccacacgaggtgtat

SEQ ID NO: 9345224 - DNA, 22 bp, Homo sapiens
ctgtgtccatgttctaatttgg

SEQ ID NO: 9345225 - DNA, 22 bp, Homo sapiens
ctgtgggagcacatgacagata

SEQ ID NO: 9345226 - DNA, 22 bp, Homo sapiens
ctgtgtattgaaaaagggttaa

SEQ ID NO: 9345227 - DNA, 19 bp, Homo sapiens
ctgtgtcacatttatgaaa

SEQ ID NO: 9345228 - DNA, 22 bp, Homo sapiens
ctgtgggagcacatgacagata

SEQ ID NO: 9345229 - DNA, 22 bp, Homo sapiens
atcaggccagcaatccctgggc

SEQ ID NO: 9345230 - DNA, 22 bp, Homo sapiens
atcaggaagaagaatgtgttgg

SEQ ID NO: 9345231 - DNA, 22 bp, Homo sapiens
atcaggaacgttcatggactgt

SEQ ID NO: 9345232 - DNA, 20 bp, Homo sapiens
atcaggaagagagactgacc

SEQ ID NO: 9345233 - DNA, 22 bp, Homo sapiens
atcaggaagaattggatgctac

SEQ ID NO: 9345234 - DNA, 20 bp, Homo sapiens
ctgtgctccgggttcctgga

SEQ ID NO: 9345235 - DNA, 22 bp, Homo sapiens
atcaggaaatacttatttataa

SEQ ID NO: 9345236 - DNA, 19 bp, Homo sapiens
atcaggaacaaggctgatc

SEQ ID NO: 9345237 - DNA, 22 bp, Homo sapiens
atcaggaatgaatacttttgga

SEQ ID NO: 9345238 - DNA, 22 bp, Homo sapiens
atcaggaatgaatacttttgga

SEQ ID NO: 9345239 - DNA, 22 bp, Homo sapiens
atcaggaattaggtgagatgga

SEQ ID NO: 9345240 - DNA, 22 bp, Homo sapiens
atcaggaagccagtctaatgga

SEQ ID NO: 9345241 - DNA, 22 bp, Homo sapiens
atcaggaagccagtctaatgga

SEQ ID NO: 9345242 - DNA, 22 bp, Homo sapiens
ctgtgtcccttgtcccagagcc

SEQ ID NO: 9345243 - DNA, 22 bp, Homo sapiens
ctgtgtcccttgtcccagagcc

SEQ ID NO: 9345244 - DNA, 22 bp, Homo sapiens
ctgtgtccccctcagccaggtg

SEQ ID NO: 9345245 - DNA, 22 bp, Homo sapiens
ctgtgtccccctcagccaggtg

SEQ ID NO: 9345246 - DNA, 22 bp, Homo sapiens
ctgtgtccccctcagccaggtg

SEQ ID NO: 9345247 - DNA, 22 bp, Homo sapiens
ctgtgtcccagccaggataatg

SEQ ID NO: 9345248 - DNA, 22 bp, Homo sapiens
ctgtgtcccagtaccttgggta

SEQ ID NO: 9345249 - DNA, 22 bp, Homo sapiens
ctgtgtcccagtaccttgggta

SEQ ID NO: 9345250 - DNA, 22 bp, Homo sapiens
ctgtgtcctccccatcacttct

SEQ ID NO: 9345251 - DNA, 22 bp, Homo sapiens
atcattaaatataagcttcaca

SEQ ID NO: 9345252 - DNA, 22 bp, Homo sapiens
ctgtgtcccttgtcccagagcc

SEQ ID NO: 9345253 - DNA, 21 bp, Homo sapiens
atcattaattgctgagtgaca

SEQ ID NO: 9345254 - DNA, 22 bp, Homo sapiens
atcattaacccttgatgctggg

SEQ ID NO: 9345255 - DNA, 21 bp, Homo sapiens
atcattaattgctgagtgaca

SEQ ID NO: 9345256 - DNA, 23 bp, Homo sapiens
atcattaacagtgcaggggtagg

SEQ ID NO: 9345257 - DNA, 22 bp, Homo sapiens
atcattccacatgtaccactag

SEQ ID NO: 9345258 - DNA, 22 bp, Homo sapiens
atcattccacatgtaccactag

SEQ ID NO: 9345259 - DNA, 22 bp, Homo sapiens
atcattcatcttattgccagtc

SEQ ID NO: 9345260 - DNA, 22 bp, Homo sapiens
atcattctagctgttgtgttga

SEQ ID NO: 9345261 - DNA, 22 bp, Homo sapiens
atcattcagtgaccacttccca

SEQ ID NO: 9345262 - DNA, 22 bp, Homo sapiens
atcattcagcctaagcaagtac

SEQ ID NO: 9345263 - DNA, 22 bp, Homo sapiens
atcattagcaattttcaataag

SEQ ID NO: 9345264 - DNA, 22 bp, Homo sapiens
atcattagaccaaactagagct

SEQ ID NO: 9345265 - DNA, 22 bp, Homo sapiens
ctgtttatctctaacctgttta

SEQ ID NO: 9345266 - DNA, 22 bp, Homo sapiens
ctgttactggacgcacgcagct

SEQ ID NO: 9345267 - DNA, 22 bp, Homo sapiens
atctccaggattttcacactca

SEQ ID NO: 9345268 - DNA, 22 bp, Homo sapiens
atctcataactcatttgaagac

SEQ ID NO: 9345269 - DNA, 22 bp, Homo sapiens
atctatttctgctaataacaat

SEQ ID NO: 9345270 - DNA, 22 bp, Homo sapiens
cttcagttctaaagtagaatgt

SEQ ID NO: 9345271 - DNA, 22 bp, Homo sapiens
cttcagttatgtgccaaggaca

SEQ ID NO: 9345272 - DNA, 22 bp, Homo sapiens
atctcccagccacagcattctt

SEQ ID NO: 9345273 - DNA, 22 bp, Homo sapiens
atctcccacaggctgctacttc

SEQ ID NO: 9345274 - DNA, 22 bp, Homo sapiens
atctcccaaattagcctcttga

SEQ ID NO: 9345275 - DNA, 22 bp, Homo sapiens
atctccagtcctggtttcctgg

SEQ ID NO: 9345276 - DNA, 22 bp, Homo sapiens
atctccagttagcagtactgat

SEQ ID NO: 9345277 - DNA, 22 bp, Homo sapiens
atctcccaaactcatttcttca

SEQ ID NO: 9345278 - DNA, 22 bp, Homo sapiens
cttcatggtaaatctgccttta

SEQ ID NO: 9345279 - DNA, 22 bp, Homo sapiens
cttcattaaccaaaatgcaata

SEQ ID NO: 9345280 - DNA, 22 bp, Homo sapiens
atctgcatttacattgcttgta

SEQ ID NO: 9345281 - DNA, 17 bp, Homo sapiens
atctgcatttctaatga

SEQ ID NO: 9345282 - DNA, 22 bp, Homo sapiens
atctggaaataaatacgagttc

SEQ ID NO: 9345283 - DNA, 22 bp, Homo sapiens
atctggaaaacacagtgtagac

SEQ ID NO: 9345284 - DNA, 22 bp, Homo sapiens
atctggaaataaatacgagttc

SEQ ID NO: 9345285 - DNA, 21 bp, Homo sapiens
atctggaaattctgccagaga

SEQ ID NO: 9345286 - DNA, 21 bp, Homo sapiens
atctggaaattctgccagaga

SEQ ID NO: 9345287 - DNA, 22 bp, Homo sapiens
atctggaacaaagcttaggaat

SEQ ID NO: 9345288 - DNA, 19 bp, Homo sapiens
atctggaactcgtttgttt

SEQ ID NO: 9345289 - DNA, 19 bp, Homo sapiens
atctggaactcgtttgttt

SEQ ID NO: 9345290 - DNA, 22 bp, Homo sapiens
atctggaagccagatactcagt

SEQ ID NO: 9345291 - DNA, 22 bp, Homo sapiens
atctggaagccagatactcagt

SEQ ID NO: 9345292 - DNA, 21 bp, Homo sapiens
atctggaagaactggtaagtg

SEQ ID NO: 9345293 - DNA, 22 bp, Homo sapiens
atctggaagattgaaggggagt

SEQ ID NO: 9345294 - DNA, 22 bp, Homo sapiens
cttcataagattgttgtgagga

SEQ ID NO: 9345295 - DNA, 22 bp, Homo sapiens
cttcatgagactccactgccat

SEQ ID NO: 9345296 - DNA, 22 bp, Homo sapiens
cttcatctttctgagcctcagt

SEQ ID NO: 9345297 - DNA, 22 bp, Homo sapiens
cttcatgagggtaatctacaaa

SEQ ID NO: 9345298 - DNA, 22 bp, Homo sapiens
cttcagcacctcagctggagag

SEQ ID NO: 9345299 - DNA, 22 bp, Homo sapiens
cttcagcagcctcttgcataaa

SEQ ID NO: 9345300 - DNA, 23 bp, Homo sapiens
cttcagcagaaacataaattctc

SEQ ID NO: 9345301 - DNA, 22 bp, Homo sapiens
cttcagcagatgcaaaacccct

SEQ ID NO: 9345302 - DNA, 22 bp, Homo sapiens
atccttcagctgccctgttacc

SEQ ID NO: 9345303 - DNA, 22 bp, Homo sapiens
cttcagcatctttttcttgggg

SEQ ID NO: 9345304 - DNA, 19 bp, Homo sapiens
cttcagcatctccggagct

SEQ ID NO: 9345305 - DNA, 22 bp, Homo sapiens
atccttcagtggaagacagtag

SEQ ID NO: 9345306 - DNA, 22 bp, Homo sapiens
atccttcaggaaaccatcctca

SEQ ID NO: 9345307 - DNA, 22 bp, Homo sapiens
atccttcaggaaaccatcctca

SEQ ID NO: 9345308 - DNA, 22 bp, Homo sapiens
atccttctacctaggactattt

SEQ ID NO: 9345309 - DNA, 22 bp, Homo sapiens
atccttctaagagggacgtatg

SEQ ID NO: 9345310 - DNA, 22 bp, Homo sapiens
atccttctccagtcgtattttt

SEQ ID NO: 9345311 - DNA, 22 bp, Homo sapiens
atccttctccaaaactggctcc

SEQ ID NO: 9345312 - DNA, 22 bp, Homo sapiens
atccttcttcaaagagggaaaa

SEQ ID NO: 9345313 - DNA, 17 bp, Homo sapiens
atccttctgttctttct

SEQ ID NO: 9345314 - DNA, 22 bp, Homo sapiens
atccttcttctgctagtgtcta

SEQ ID NO: 9345315 - DNA, 22 bp, Homo sapiens
atccttggcacagtggaattca

SEQ ID NO: 9345316 - DNA, 22 bp, Homo sapiens
atccttggatcctgtgttcctg

SEQ ID NO: 9345317 - DNA, 18 bp, Homo sapiens
atccttggggctgctgct

SEQ ID NO: 9345318 - DNA, 22 bp, Homo sapiens
atccttggtaagagagttggat

SEQ ID NO: 9345319 - DNA, 22 bp, Homo sapiens
ctgtttcaagtgaagtcagaca

SEQ ID NO: 9345320 - DNA, 22 bp, Homo sapiens
ctgtttctaaagggagcagatt

SEQ ID NO: 9345321 - DNA, 22 bp, Homo sapiens
ctgtttctaaagggagcagatt

SEQ ID NO: 9345322 - DNA, 22 bp, Homo sapiens
cttcagaatgggactgtgtttg

SEQ ID NO: 9345323 - DNA, 22 bp, Homo sapiens
cttcagaattcctcagcctcag

SEQ ID NO: 9345324 - DNA, 22 bp, Homo sapiens
cttcagaagcctgcagcctttg

SEQ ID NO: 9345325 - DNA, 22 bp, Homo sapiens
cttcagaagcctgcagcctttg

SEQ ID NO: 9345326 - DNA, 22 bp, Homo sapiens
cttcagaatgggactgtgtttg

SEQ ID NO: 9345327 - DNA, 22 bp, Homo sapiens
cttcagaatgggactgtgtttg

SEQ ID NO: 9345328 - DNA, 22 bp, Homo sapiens
cttcagaggggactcaaagtca

SEQ ID NO: 9345329 - DNA, 21 bp, Homo sapiens
cttcagcaaatacttggcagg

SEQ ID NO: 9345330 - DNA, 22 bp, Homo sapiens
ctgccctctagggatgcactgg

SEQ ID NO: 9345331 - DNA, 22 bp, Homo sapiens
ctgccctctagaggaggactga

SEQ ID NO: 9345332 - DNA, 22 bp, Homo sapiens
ctgccctgacctgcctcagagt

SEQ ID NO: 9345333 - DNA, 22 bp, Homo sapiens
ctgccctctagggatgcactgg

SEQ ID NO: 9345334 - DNA, 21 bp, Homo sapiens
ctgccctagatggctctggaa

SEQ ID NO: 9345335 - DNA, 21 bp, Homo sapiens
ctgccctagatggctctggaa

SEQ ID NO: 9345336 - DNA, 22 bp, Homo sapiens
ctgcccgctgctagagaggccg

SEQ ID NO: 9345337 - DNA, 22 bp, Homo sapiens
ctgccctcgggccctcccatag

SEQ ID NO: 9345338 - DNA, 22 bp, Homo sapiens
ctgccctctagaggaggactga

SEQ ID NO: 9345339 - DNA, 22 bp, Homo sapiens
ctgccctcgggccctcccatag

SEQ ID NO: 9345340 - DNA, 22 bp, Homo sapiens
ctgccctcgggccctcccatag

SEQ ID NO: 9345341 - DNA, 18 bp, Homo sapiens
ctgcccagagcatttcat

SEQ ID NO: 9345342 - DNA, 18 bp, Homo sapiens
ctgccccttctctgagat

SEQ ID NO: 9345343 - DNA, 21 bp, Homo sapiens
agttttgagagtgggtagtgt

SEQ ID NO: 9345344 - DNA, 22 bp, Homo sapiens
agttttctcacatcaaaaatga

SEQ ID NO: 9345345 - DNA, 22 bp, Homo sapiens
agttttctcacatcaaaaatga

SEQ ID NO: 9345346 - DNA, 22 bp, Homo sapiens
agttttctgttctacaatttga

SEQ ID NO: 9345347 - DNA, 19 bp, Homo sapiens
agttttctgtgatccattt

SEQ ID NO: 9345348 - DNA, 22 bp, Homo sapiens
agttttgaaatgaaatgtagtt

SEQ ID NO: 9345349 - DNA, 22 bp, Homo sapiens
agttttgaaatgaaatgtagtt

SEQ ID NO: 9345350 - DNA, 22 bp, Homo sapiens
agttttctttcgcaaaggtaca

SEQ ID NO: 9345351 - DNA, 22 bp, Homo sapiens
agttttctttcatctatcagca

SEQ ID NO: 9345352 - DNA, 21 bp, Homo sapiens
agttttctgagttataaaata

SEQ ID NO: 9345353 - DNA, 21 bp, Homo sapiens
agttttctgagttataaaata

SEQ ID NO: 9345354 - DNA, 22 bp, Homo sapiens
agttttctgggatcactggaat

SEQ ID NO: 9345355 - DNA, 19 bp, Homo sapiens
agttttctgtgatccattt

SEQ ID NO: 9345356 - DNA, 18 bp, Homo sapiens
ctgcctgctctccagctt

SEQ ID NO: 9345357 - DNA, 18 bp, Homo sapiens
ctgcctgctctccagctt

SEQ ID NO: 9345358 - DNA, 23 bp, Homo sapiens
ataataattatggcagcaaagtg

SEQ ID NO: 9345359 - DNA, 23 bp, Homo sapiens
ataataattatggcagcaaagtg

SEQ ID NO: 9345360 - DNA, 22 bp, Homo sapiens
ataataatactgtgcaatggat

SEQ ID NO: 9345361 - DNA, 22 bp, Homo sapiens
ataataactcctgttgaagaac

SEQ ID NO: 9345362 - DNA, 22 bp, Homo sapiens
ataataatactgtgcaatggat

SEQ ID NO: 9345363 - DNA, 22 bp, Homo sapiens
ctgcctgcttaccatgcatcag

SEQ ID NO: 9345364 - DNA, 23 bp, Homo sapiens
ctgcctgctggggagacagatct

SEQ ID NO: 9345365 - DNA, 22 bp, Homo sapiens
ctgcctgctgccctccagagcc

SEQ ID NO: 9345366 - DNA, 22 bp, Homo sapiens
ctgcctgctgccctccagagcc

SEQ ID NO: 9345367 - DNA, 22 bp, Homo sapiens
ctgcctgctgattagtattgtc

SEQ ID NO: 9345368 - DNA, 22 bp, Homo sapiens
ctgccctgtatcttctcccaat

SEQ ID NO: 9345369 - DNA, 22 bp, Homo sapiens
ctgccctgtggctctgagtcat

SEQ ID NO: 9345370 - DNA, 22 bp, Homo sapiens
ctgccctgtggctctgagtcat

SEQ ID NO: 9345371 - DNA, 22 bp, Homo sapiens
ctgccctgtgcacaggaaactg

SEQ ID NO: 9345372 - DNA, 22 bp, Homo sapiens
ctgccctgtgagggtccttggg

SEQ ID NO: 9345373 - DNA, 22 bp, Homo sapiens
ctgccctgtgagggtccttggg

SEQ ID NO: 9345374 - DNA, 22 bp, Homo sapiens
ataagccaaagaggcctcaatc

SEQ ID NO: 9345375 - DNA, 22 bp, Homo sapiens
ataagccataatttctgccttt

SEQ ID NO: 9345376 - DNA, 22 bp, Homo sapiens
ataagtgatatttagctataga

SEQ ID NO: 9345377 - DNA, 22 bp, Homo sapiens
ataagcatgttagaatatttga

SEQ ID NO: 9345378 - DNA, 22 bp, Homo sapiens
ataagcatttcacaggtgtgtt

SEQ ID NO: 9345379 - DNA, 22 bp, Homo sapiens
ataataaaccaggatgggtctg

SEQ ID NO: 9345380 - DNA, 22 bp, Homo sapiens
ataagtttgtctttgtaaagat

SEQ ID NO: 9345381 - DNA, 22 bp, Homo sapiens
ataagtttgtctttgtaaagat

SEQ ID NO: 9345382 - DNA, 22 bp, Homo sapiens
agtttacaacagtagctatgga

SEQ ID NO: 9345383 - DNA, 21 bp, Homo sapiens
agtttacaactgtccagcccc

SEQ ID NO: 9345384 - DNA, 19 bp, Homo sapiens
agtttattataggtgattc

SEQ ID NO: 9345385 - DNA, 19 bp, Homo sapiens
agtttattataggtgattc

SEQ ID NO: 9345386 - DNA, 19 bp, Homo sapiens
agtttattataggtgattc

SEQ ID NO: 9345387 - DNA, 19 bp, Homo sapiens
agtttattataggtgattc

SEQ ID NO: 9345388 - DNA, 22 bp, Homo sapiens
agtgttactcagttttgtccag

SEQ ID NO: 9345389 - DNA, 22 bp, Homo sapiens
agtgttatttattgtttcataa

SEQ ID NO: 9345390 - DNA, 22 bp, Homo sapiens
agtttattgtatatggtagttt

SEQ ID NO: 9345391 - DNA, 22 bp, Homo sapiens
agtttattgtatatggtagttt

SEQ ID NO: 9345392 - DNA, 22 bp, Homo sapiens
agtttattgtatatggtagttt

SEQ ID NO: 9345393 - DNA, 17 bp, Homo sapiens
agtttatttagccttct

SEQ ID NO: 9345394 - DNA, 22 bp, Homo sapiens
agtttattctgcttggccctcc

SEQ ID NO: 9345395 - DNA, 22 bp, Homo sapiens
agtttattctgcttggccctcc

SEQ ID NO: 9345396 - DNA, 22 bp, Homo sapiens
agtttattgtatatggtagttt

SEQ ID NO: 9345397 - DNA, 22 bp, Homo sapiens
agtttattctgcttggccctcc

SEQ ID NO: 9345398 - DNA, 22 bp, Homo sapiens
agtttattctctggtcttagta

SEQ ID NO: 9345399 - DNA, 20 bp, Homo sapiens
agtttattccaggagaactg

SEQ ID NO: 9345400 - DNA, 20 bp, Homo sapiens
agtttattccaggagaactg

SEQ ID NO: 9345401 - DNA, 20 bp, Homo sapiens
agtttattccaggagaactg

SEQ ID NO: 9345402 - DNA, 22 bp, Homo sapiens
agtttattctgcttggccctcc

SEQ ID NO: 9345403 - DNA, 22 bp, Homo sapiens
agtttattctgcttggccctcc

SEQ ID NO: 9345404 - DNA, 22 bp, Homo sapiens
agtttattctctggtcttagta

SEQ ID NO: 9345405 - DNA, 22 bp, Homo sapiens
agtttattctctggtcttagta

SEQ ID NO: 9345406 - DNA, 22 bp, Homo sapiens
agtttatttttgataagtcttg

SEQ ID NO: 9345407 - DNA, 22 bp, Homo sapiens
agtttatttttgataagtcttg

SEQ ID NO: 9345408 - DNA, 22 bp, Homo sapiens
agtttatttttgataagtcttg

SEQ ID NO: 9345409 - DNA, 22 bp, Homo sapiens
agtttatttttgataagtcttg

SEQ ID NO: 9345410 - DNA, 22 bp, Homo sapiens
agtttatttttgataagtcttg

SEQ ID NO: 9345411 - DNA, 22 bp, Homo sapiens
agtttcaaattactgcccatgg

SEQ ID NO: 9345412 - DNA, 22 bp, Homo sapiens
agtttcacagaatatgaaggtt

SEQ ID NO: 9345413 - DNA, 22 bp, Homo sapiens
agtttatttctccatttaccta

SEQ ID NO: 9345414 - DNA, 17 bp, Homo sapiens
agtttatttagccttct

SEQ ID NO: 9345415 - DNA, 17 bp, Homo sapiens
agtttatttagccttct

SEQ ID NO: 9345416 - DNA, 22 bp, Homo sapiens
agtttatttctccatttaccta

SEQ ID NO: 9345417 - DNA, 22 bp, Homo sapiens
agtttatttctccatttaccta

SEQ ID NO: 9345418 - DNA, 22 bp, Homo sapiens
agtttatttctccatttaccta

SEQ ID NO: 9345419 - DNA, 22 bp, Homo sapiens
agtttcttattcttagttatgt

SEQ ID NO: 9345420 - DNA, 22 bp, Homo sapiens
agtttcttattcttagttatgt

SEQ ID NO: 9345421 - DNA, 22 bp, Homo sapiens
ctgagtctcccggcagtggagg

SEQ ID NO: 9345422 - DNA, 22 bp, Homo sapiens
agtttcttggtcacagttttca

SEQ ID NO: 9345423 - DNA, 22 bp, Homo sapiens
agtttcttggtcacagttttca

SEQ ID NO: 9345424 - DNA, 22 bp, Homo sapiens
agtttcatgagacagattttca

SEQ ID NO: 9345425 - DNA, 22 bp, Homo sapiens
agtttcacatgcatggatgtgt

SEQ ID NO: 9345426 - DNA, 22 bp, Homo sapiens
agttttattaaatccacagaag

SEQ ID NO: 9345427 - DNA, 22 bp, Homo sapiens
agtttgtatgccaacagcaaag

SEQ ID NO: 9345428 - DNA, 22 bp, Homo sapiens
agttttatgttcacagaaggat

SEQ ID NO: 9345429 - DNA, 22 bp, Homo sapiens
agtttgtgcaatggtgtcacct

SEQ ID NO: 9345430 - DNA, 22 bp, Homo sapiens
agttttattgtcccagaggtga

SEQ ID NO: 9345431 - DNA, 22 bp, Homo sapiens
agttttattccaatgtgcagca

SEQ ID NO: 9345432 - DNA, 22 bp, Homo sapiens
agttttattccaatgtgcagca

SEQ ID NO: 9345433 - DNA, 22 bp, Homo sapiens
agttttattccaatgtgcagca

SEQ ID NO: 9345434 - DNA, 22 bp, Homo sapiens
ctgatagacaatcaccatggga

SEQ ID NO: 9345435 - DNA, 22 bp, Homo sapiens
ctgatacactccctaaaatata

SEQ ID NO: 9345436 - DNA, 22 bp, Homo sapiens
ctgagtggaacataggatgata

SEQ ID NO: 9345437 - DNA, 22 bp, Homo sapiens
ctgagtgatagcgatggggaac

SEQ ID NO: 9345438 - DNA, 22 bp, Homo sapiens
ctgagtgaggggagcttgatgg

SEQ ID NO: 9345439 - DNA, 22 bp, Homo sapiens
ctgagtgaggggagcttgatgg

SEQ ID NO: 9345440 - DNA, 22 bp, Homo sapiens
ctgagtgaggggagcttgatgg

SEQ ID NO: 9345441 - DNA, 22 bp, Homo sapiens
ctgataatgtcctgcagtaaat

SEQ ID NO: 9345442 - DNA, 21 bp, Homo sapiens
ctgataattgttaaattattt

SEQ ID NO: 9345443 - DNA, 22 bp, Homo sapiens
ataattatctcagacacttgtt

SEQ ID NO: 9345444 - DNA, 22 bp, Homo sapiens
ataattcaggttttctggcaca

SEQ ID NO: 9345445 - DNA, 20 bp, Homo sapiens
ataattatttacttttgtgc

SEQ ID NO: 9345446 - DNA, 20 bp, Homo sapiens
ataattatttacttttgtgc

SEQ ID NO: 9345447 - DNA, 22 bp, Homo sapiens
ataattatctcagacacttgtt

SEQ ID NO: 9345448 - DNA, 22 bp, Homo sapiens
ataatggtagatgtccacgcag

SEQ ID NO: 9345449 - DNA, 22 bp, Homo sapiens
ataatcattcacataaggtgct

SEQ ID NO: 9345450 - DNA, 22 bp, Homo sapiens
ataatgtttcagtactgtctgt

SEQ ID NO: 9345451 - DNA, 22 bp, Homo sapiens
ataatgtttcagtactgtctgt

SEQ ID NO: 9345452 - DNA, 22 bp, Homo sapiens
ataatgtttcagtactgtctgt

SEQ ID NO: 9345453 - DNA, 22 bp, Homo sapiens
ataatgttgatgattgtctttg

SEQ ID NO: 9345454 - DNA, 22 bp, Homo sapiens
atacagaaaatgatgcagagtt

SEQ ID NO: 9345455 - DNA, 22 bp, Homo sapiens
atacagaaaatgatgcagagtt

SEQ ID NO: 9345456 - DNA, 22 bp, Homo sapiens
atacagaaaatgatgcagagtt

SEQ ID NO: 9345457 - DNA, 22 bp, Homo sapiens
atacagaactctcagttgtata

SEQ ID NO: 9345458 - DNA, 22 bp, Homo sapiens
ataatttaaattagtatgtgat

SEQ ID NO: 9345459 - DNA, 22 bp, Homo sapiens
ataatttaattttcacagtggt

SEQ ID NO: 9345460 - DNA, 20 bp, Homo sapiens
ataatttaccctgcaccact

SEQ ID NO: 9345461 - DNA, 20 bp, Homo sapiens
ataatttaccctgcaccact

SEQ ID NO: 9345462 - DNA, 20 bp, Homo sapiens
atacacattcatagaaaaat

SEQ ID NO: 9345463 - DNA, 22 bp, Homo sapiens
ctggagctgccagggctgccgc

SEQ ID NO: 9345464 - DNA, 22 bp, Homo sapiens
ctggagctggcccaggctggcc

SEQ ID NO: 9345465 - DNA, 22 bp, Homo sapiens
ctggagctggcccaggctggcc

SEQ ID NO: 9345466 - DNA, 22 bp, Homo sapiens
ctggagctggcccaggctggcc

SEQ ID NO: 9345467 - DNA, 22 bp, Homo sapiens
atacatgatacttagtacgtag

SEQ ID NO: 9345468 - DNA, 22 bp, Homo sapiens
ctggagctgccagggctgccgc

SEQ ID NO: 9345469 - DNA, 22 bp, Homo sapiens
ctggagctgccagacgggcaca

SEQ ID NO: 9345470 - DNA, 22 bp, Homo sapiens
atacatgatcactgtattataa

SEQ ID NO: 9345471 - DNA, 22 bp, Homo sapiens
ctggagctggtatagggacaaa

SEQ ID NO: 9345472 - DNA, 22 bp, Homo sapiens
ctggagctgtcttcacaggcct

SEQ ID NO: 9345473 - DNA, 22 bp, Homo sapiens
ctggagctggtatagggacaaa

SEQ ID NO: 9345474 - DNA, 22 bp, Homo sapiens
ctggagctggcttccttccact

SEQ ID NO: 9345475 - DNA, 22 bp, Homo sapiens
ctggagctgggctagggtagga

SEQ ID NO: 9345476 - DNA, 22 bp, Homo sapiens
ctggagctgggctagggtagga

SEQ ID NO: 9345477 - DNA, 22 bp, Homo sapiens
ctggagctggtatagggacaaa

SEQ ID NO: 9345478 - DNA, 22 bp, Homo sapiens
atacatgactcacacattctgc

SEQ ID NO: 9345479 - DNA, 22 bp, Homo sapiens
atacatgactcacacattctgc

SEQ ID NO: 9345480 - DNA, 22 bp, Homo sapiens
atacatgaggaggctggaaaca

SEQ ID NO: 9345481 - DNA, 22 bp, Homo sapiens
atacatatatggtacttcctgg

SEQ ID NO: 9345482 - DNA, 22 bp, Homo sapiens
ctggaagactcaatggcctgcc

SEQ ID NO: 9345483 - DNA, 22 bp, Homo sapiens
ctggaagacgtttgaagccatg

SEQ ID NO: 9345484 - DNA, 22 bp, Homo sapiens
ctggaagacgtttgaagccatg

SEQ ID NO: 9345485 - DNA, 21 bp, Homo sapiens
ctggaagaagcagcaggattc

SEQ ID NO: 9345486 - DNA, 22 bp, Homo sapiens
ctggaactcctggggagctggt

SEQ ID NO: 9345487 - DNA, 22 bp, Homo sapiens
ctggaacccaggcctggaagcc

SEQ ID NO: 9345488 - DNA, 22 bp, Homo sapiens
ctggaagaactccagttctgtg

SEQ ID NO: 9345489 - DNA, 22 bp, Homo sapiens
ctggaagaactccagttctgtg

SEQ ID NO: 9345490 - DNA, 22 bp, Homo sapiens
ctggaaatcactactagtcaat

SEQ ID NO: 9345491 - DNA, 22 bp, Homo sapiens
ctggaaagttcaagataaagct

SEQ ID NO: 9345492 - DNA, 19 bp, Homo sapiens
ctggaaagttggcagtgag

SEQ ID NO: 9345493 - DNA, 22 bp, Homo sapiens
atacagaagcctgtatttctgg

SEQ ID NO: 9345494 - DNA, 22 bp, Homo sapiens
ctggccaggctctcacgtggtc

SEQ ID NO: 9345495 - DNA, 22 bp, Homo sapiens
ctggccaggctctcacgtggtc

SEQ ID NO: 9345496 - DNA, 22 bp, Homo sapiens
ctggccagaggttcctctgccc

SEQ ID NO: 9345497 - DNA, 22 bp, Homo sapiens
ctggccaggcttgggacagaca

SEQ ID NO: 9345498 - DNA, 22 bp, Homo sapiens
ctggccaggcttgggacagaca

SEQ ID NO: 9345499 - DNA, 22 bp, Homo sapiens
ctggccaggctctcacgtggtc

SEQ ID NO: 9345500 - DNA, 22 bp, Homo sapiens
ctggaggaaaacaactgcagac

SEQ ID NO: 9345501 - DNA, 21 bp, Homo sapiens
ctggagcttggtgagaagtgt

SEQ ID NO: 9345502 - DNA, 21 bp, Homo sapiens
ctggagcttggtgagaagtgt

SEQ ID NO: 9345503 - DNA, 22 bp, Homo sapiens
ctggagcttattgggagcagaa

SEQ ID NO: 9345504 - DNA, 22 bp, Homo sapiens
ctggagcttattgggagcagaa

SEQ ID NO: 9345505 - DNA, 22 bp, Homo sapiens
ctggagctgttttttcaggaaa

SEQ ID NO: 9345506 - DNA, 17 bp, Homo sapiens
ctggagctgtgtaacct

SEQ ID NO: 9345507 - DNA, 22 bp, Homo sapiens
ctggagctgttttttcaggaaa

SEQ ID NO: 9345508 - DNA, 22 bp, Homo sapiens
ctggagcttattgggagcagaa

SEQ ID NO: 9345509 - DNA, 22 bp, Homo sapiens
ctggagctgtcttcacaggcct

SEQ ID NO: 9345510 - DNA, 22 bp, Homo sapiens
ctggagctgtcttcacaggcct

SEQ ID NO: 9345511 - DNA, 22 bp, Homo sapiens
ctggccagtgactgctcacccg

SEQ ID NO: 9345512 - DNA, 22 bp, Homo sapiens
ctggccagtgcctgtgggcccc

SEQ ID NO: 9345513 - DNA, 22 bp, Homo sapiens
ctggccagtgactgctcacccg

SEQ ID NO: 9345514 - DNA, 22 bp, Homo sapiens
ctggccagtgactgctcacccg

SEQ ID NO: 9345515 - DNA, 22 bp, Homo sapiens
ctggccagtgactgctcacccg

SEQ ID NO: 9345516 - DNA, 22 bp, Homo sapiens
ctggccaggttttgaacagttg

SEQ ID NO: 9345517 - DNA, 22 bp, Homo sapiens
ctggccagggtgcgatcgtggt

SEQ ID NO: 9345518 - DNA, 22 bp, Homo sapiens
ctggccaggttttgaacagttg

SEQ ID NO: 9345519 - DNA, 22 bp, Homo sapiens
ctggccaggttttgaacagttg

SEQ ID NO: 9345520 - DNA, 22 bp, Homo sapiens
ctggccagggtgcgatcgtggt

SEQ ID NO: 9345521 - DNA, 22 bp, Homo sapiens
ctggccagggtgcgatcgtggt

SEQ ID NO: 9345522 - DNA, 22 bp, Homo sapiens
ctggccaggcttgggacagaca

SEQ ID NO: 9345523 - DNA, 22 bp, Homo sapiens
ctggccaggcttgggacagaca

SEQ ID NO: 9345524 - DNA, 22 bp, Homo sapiens
atagaaaacagatgtccttaaa

SEQ ID NO: 9345525 - DNA, 22 bp, Homo sapiens
atagaaaacagatgtccttaaa

SEQ ID NO: 9345526 - DNA, 21 bp, Homo sapiens
atactttgaattacagccttg

SEQ ID NO: 9345527 - DNA, 22 bp, Homo sapiens
atactttgctagtatcagtgtg

SEQ ID NO: 9345528 - DNA, 22 bp, Homo sapiens
atactttggtcactattattgg

SEQ ID NO: 9345529 - DNA, 22 bp, Homo sapiens
atagaaaacagatgtccttaaa

SEQ ID NO: 9345530 - DNA, 22 bp, Homo sapiens
atagaaaggtctttggcagaca

SEQ ID NO: 9345531 - DNA, 22 bp, Homo sapiens
atagaatatgacttttagatcc

SEQ ID NO: 9345532 - DNA, 22 bp, Homo sapiens
atagaatagcatagaaaattga

SEQ ID NO: 9345533 - DNA, 22 bp, Homo sapiens
atagacagctacatagaatata

SEQ ID NO: 9345534 - DNA, 22 bp, Homo sapiens
atagacatagccgtaatttatt

SEQ ID NO: 9345535 - DNA, 22 bp, Homo sapiens
atagacattataacacagagct

SEQ ID NO: 9345536 - DNA, 22 bp, Homo sapiens
atagacatggtcttttgtcatt

SEQ ID NO: 9345537 - DNA, 22 bp, Homo sapiens
atagacacagatctatatatgt

SEQ ID NO: 9345538 - DNA, 22 bp, Homo sapiens
atagacacagatctatatatgt

SEQ ID NO: 9345539 - DNA, 22 bp, Homo sapiens
atagacacatgttattatactt

SEQ ID NO: 9345540 - DNA, 22 bp, Homo sapiens
atagacacatgttattatactt

SEQ ID NO: 9345541 - DNA, 22 bp, Homo sapiens
atagaatttgtacttgtagaac

SEQ ID NO: 9345542 - DNA, 22 bp, Homo sapiens
atagaattctttgaaatttatg

SEQ ID NO: 9345543 - DNA, 22 bp, Homo sapiens
atagaatttgcactaaatctgc

SEQ ID NO: 9345544 - DNA, 22 bp, Homo sapiens
atagaattctttgaaatttatg

SEQ ID NO: 9345545 - DNA, 22 bp, Homo sapiens
atagtacacatcctacaatgtt

SEQ ID NO: 9345546 - DNA, 22 bp, Homo sapiens
atagtacacatcctacaatgtt

SEQ ID NO: 9345547 - DNA, 22 bp, Homo sapiens
atagggcctaaaaagtattgct

SEQ ID NO: 9345548 - DNA, 22 bp, Homo sapiens
atagtaactggcatgtttatga

SEQ ID NO: 9345549 - DNA, 20 bp, Homo sapiens
atagtaatgaagtcttgttc

SEQ ID NO: 9345550 - DNA, 22 bp, Homo sapiens
atagggcccccgtgggtgctca

SEQ ID NO: 9345551 - DNA, 22 bp, Homo sapiens
atagggcagtcaggccgccact

SEQ ID NO: 9345552 - DNA, 22 bp, Homo sapiens
atagggaggaactgagtcagga

SEQ ID NO: 9345553 - DNA, 22 bp, Homo sapiens
ataggctttgtgttttgttatc

SEQ ID NO: 9345554 - DNA, 22 bp, Homo sapiens
ataggctggagtgcagtggcat

SEQ ID NO: 9345555 - DNA, 22 bp, Homo sapiens
atagcatagtcagcttcgctga

SEQ ID NO: 9345556 - DNA, 22 bp, Homo sapiens
ataggcaagggatacaatatac

SEQ ID NO: 9345557 - DNA, 22 bp, Homo sapiens
ataggcacattaggaacttttg

SEQ ID NO: 9345558 - DNA, 22 bp, Homo sapiens
ataggcagaaatgctccctatt

SEQ ID NO: 9345559 - DNA, 22 bp, Homo sapiens
atagcatataagttataaaact

SEQ ID NO: 9345560 - DNA, 22 bp, Homo sapiens
ctcccaggttacatctgagcct

SEQ ID NO: 9345561 - DNA, 22 bp, Homo sapiens
ctcccaggtgtcccttctgcca

SEQ ID NO: 9345562 - DNA, 21 bp, Homo sapiens
ctcccagggtgactgttcaac

SEQ ID NO: 9345563 - DNA, 21 bp, Homo sapiens
ctcccagggtgactgttcaac

SEQ ID NO: 9345564 - DNA, 22 bp, Homo sapiens
ctcccaggttccgacgcctctt

SEQ ID NO: 9345565 - DNA, 22 bp, Homo sapiens
ctcccaggttccgacgcctctt

SEQ ID NO: 9345566 - DNA, 22 bp, Homo sapiens
ctcctcagagagcagcttgggg

SEQ ID NO: 9345567 - DNA, 22 bp, Homo sapiens
ctcctcccacggtctcaggaag

SEQ ID NO: 9345568 - DNA, 22 bp, Homo sapiens
ctcctcccacggtctcaggaag

SEQ ID NO: 9345569 - DNA, 22 bp, Homo sapiens
ctcccagggtctaggctgctgg

SEQ ID NO: 9345570 - DNA, 22 bp, Homo sapiens
ctcccagggtctaggctgctgg

SEQ ID NO: 9345571 - DNA, 22 bp, Homo sapiens
ctcccagggtagggagagacta

SEQ ID NO: 9345572 - DNA, 22 bp, Homo sapiens
ctcccagggtagggagagacta

SEQ ID NO: 9345573 - DNA, 22 bp, Homo sapiens
agtgcagccgagatcaggtgct

SEQ ID NO: 9345574 - DNA, 22 bp, Homo sapiens
agtgcagccttctgggccgctt

SEQ ID NO: 9345575 - DNA, 22 bp, Homo sapiens
agtgcagcaccatgttacagag

SEQ ID NO: 9345576 - DNA, 22 bp, Homo sapiens
ctcctccttcctgtgttgtgca

SEQ ID NO: 9345577 - DNA, 22 bp, Homo sapiens
ctcctcctggacacaggctgtg

SEQ ID NO: 9345578 - DNA, 22 bp, Homo sapiens
agtgcaggagcctggccagagc

SEQ ID NO: 9345579 - DNA, 22 bp, Homo sapiens
agtgcaggagcctggccagagc

SEQ ID NO: 9345580 - DNA, 22 bp, Homo sapiens
agtgcaggagcctggccagagc

SEQ ID NO: 9345581 - DNA, 22 bp, Homo sapiens
agtgcagctaagtggctctgtg

SEQ ID NO: 9345582 - DNA, 22 bp, Homo sapiens
agtgcagctgggactgtagggt

SEQ ID NO: 9345583 - DNA, 22 bp, Homo sapiens
ctcctcccacggtctcaggaag

SEQ ID NO: 9345584 - DNA, 22 bp, Homo sapiens
ctcctcccacggtctcaggaag

SEQ ID NO: 9345585 - DNA, 22 bp, Homo sapiens
ctcctccccttgagtctgggat

SEQ ID NO: 9345586 - DNA, 22 bp, Homo sapiens
ctcctcccacggtctcaggaag

SEQ ID NO: 9345587 - DNA, 18 bp, Homo sapiens
ctcctccctaagggctca

SEQ ID NO: 9345588 - DNA, 22 bp, Homo sapiens
ctcctccctctttgccacacat

SEQ ID NO: 9345589 - DNA, 22 bp, Homo sapiens
ctcctccctctttgccacacat

SEQ ID NO: 9345590 - DNA, 22 bp, Homo sapiens
ctcctccctgcgattgctctgc

SEQ ID NO: 9345591 - DNA, 22 bp, Homo sapiens
ctcctccctgcgattgctctgc

SEQ ID NO: 9345592 - DNA, 22 bp, Homo sapiens
ctcctccctctttgccacacat

SEQ ID NO: 9345593 - DNA, 22 bp, Homo sapiens
ctcctcctggacacaggctgtg

SEQ ID NO: 9345594 - DNA, 22 bp, Homo sapiens
ctcctcctggacacaggctgtg

SEQ ID NO: 9345595 - DNA, 22 bp, Homo sapiens
ctcctccctgggaggctggcat

SEQ ID NO: 9345596 - DNA, 22 bp, Homo sapiens
ctcctcctaaatgattcttcct

SEQ ID NO: 9345597 - DNA, 22 bp, Homo sapiens
ctcctcctaaatgattcttcct

SEQ ID NO: 9345598 - DNA, 22 bp, Homo sapiens
ctccagtgggggtgagcctaga

SEQ ID NO: 9345599 - DNA, 22 bp, Homo sapiens
ctccagtgggggtgagcctaga

SEQ ID NO: 9345600 - DNA, 22 bp, Homo sapiens
ctccagtggtgatggggaagaa

SEQ ID NO: 9345601 - DNA, 22 bp, Homo sapiens
ctccagggagctgcgggagcca

SEQ ID NO: 9345602 - DNA, 22 bp, Homo sapiens
ctccagtgtctcagagcagatg

SEQ ID NO: 9345603 - DNA, 20 bp, Homo sapiens
ctccagtgttcaggggagtg

SEQ ID NO: 9345604 - DNA, 22 bp, Homo sapiens
ctccagttggccccagttggtt

SEQ ID NO: 9345605 - DNA, 22 bp, Homo sapiens
ctccagttggccccagttggtt

SEQ ID NO: 9345606 - DNA, 22 bp, Homo sapiens
ctccatcagctgttggttgagg

SEQ ID NO: 9345607 - DNA, 22 bp, Homo sapiens
ctccatggaaaaggctgttgtt

SEQ ID NO: 9345608 - DNA, 22 bp, Homo sapiens
ctccatcatgtttgatcctgag

SEQ ID NO: 9345609 - DNA, 22 bp, Homo sapiens
ctccatggaaaaggctgttgtt

SEQ ID NO: 9345610 - DNA, 22 bp, Homo sapiens
agtgacatttaaaaccacagct

SEQ ID NO: 9345611 - DNA, 22 bp, Homo sapiens
agtgacatttgcaccagctgct

SEQ ID NO: 9345612 - DNA, 22 bp, Homo sapiens
agtgacatgctctcaggcataa

SEQ ID NO: 9345613 - DNA, 22 bp, Homo sapiens
agtgacatcatgtcagcaaagt

SEQ ID NO: 9345614 - DNA, 22 bp, Homo sapiens
agtgcagagagcaatactctac

SEQ ID NO: 9345615 - DNA, 22 bp, Homo sapiens
agtgcagagacctggtcaggca

SEQ ID NO: 9345616 - DNA, 22 bp, Homo sapiens
agtgcagagacctggtcaggca

SEQ ID NO: 9345617 - DNA, 22 bp, Homo sapiens
agtgcagagacctggtcaggca

SEQ ID NO: 9345618 - DNA, 22 bp, Homo sapiens
agtgcagagtacatttgtggca

SEQ ID NO: 9345619 - DNA, 22 bp, Homo sapiens
agtgatttgcagtatttactaa

SEQ ID NO: 9345620 - DNA, 22 bp, Homo sapiens
agtgcacaccttagtacaaagt

SEQ ID NO: 9345621 - DNA, 22 bp, Homo sapiens
agtgatttgaggattattgctc

SEQ ID NO: 9345622 - DNA, 22 bp, Homo sapiens
agtgcagactgaaatgaccttc

SEQ ID NO: 9345623 - DNA, 22 bp, Homo sapiens
agtgcactggcaccatctcagc

SEQ ID NO: 9345624 - DNA, 22 bp, Homo sapiens
agtgaccatgttatttatttga

SEQ ID NO: 9345625 - DNA, 22 bp, Homo sapiens
agtgaccatatatcatttttgt

SEQ ID NO: 9345626 - DNA, 22 bp, Homo sapiens
agtgaccaagcctgaccaatca

SEQ ID NO: 9345627 - DNA, 22 bp, Homo sapiens
agtgatttgactcttttattgt

SEQ ID NO: 9345628 - DNA, 22 bp, Homo sapiens
agtgatttcctggcaccctaca

SEQ ID NO: 9345629 - DNA, 21 bp, Homo sapiens
agtctggaaaacacattcatg

SEQ ID NO: 9345630 - DNA, 22 bp, Homo sapiens
agtctggaaaatgcatgtttca

SEQ ID NO: 9345631 - DNA, 20 bp, Homo sapiens
agtctgcctgctccttctcc

SEQ ID NO: 9345632 - DNA, 22 bp, Homo sapiens
agtctggaatttggcctgagca

SEQ ID NO: 9345633 - DNA, 22 bp, Homo sapiens
agtctggacctgctgggtctcc

SEQ ID NO: 9345634 - DNA, 22 bp, Homo sapiens
agtctggacatgctgaacttgg

SEQ ID NO: 9345635 - DNA, 23 bp, Homo sapiens
agtctggaagtgcagtggctgga

SEQ ID NO: 9345636 - DNA, 22 bp, Homo sapiens
agtctggaataaaactacttac

SEQ ID NO: 9345637 - DNA, 22 bp, Homo sapiens
agtctggagtgcggcggcagga

SEQ ID NO: 9345638 - DNA, 22 bp, Homo sapiens
agtctggagtgattatgtggga

SEQ ID NO: 9345639 - DNA, 22 bp, Homo sapiens
agtctggagtagagcctagaaa

SEQ ID NO: 9345640 - DNA, 19 bp, Homo sapiens
agtctggagtaaaaggaat

SEQ ID NO: 9345641 - DNA, 22 bp, Homo sapiens
agtctggacctgctgggtctcc

SEQ ID NO: 9345642 - DNA, 22 bp, Homo sapiens
agtctggagcagcagtattggt

SEQ ID NO: 9345643 - DNA, 22 bp, Homo sapiens
agtctggagctcagacttggga

SEQ ID NO: 9345644 - DNA, 22 bp, Homo sapiens
agtctggaggtggcaggtgtgt

SEQ ID NO: 9345645 - DNA, 22 bp, Homo sapiens
agtctggaggtggcaggtgtgt

SEQ ID NO: 9345646 - DNA, 22 bp, Homo sapiens
agtctgtctgtcacttctgcag

SEQ ID NO: 9345647 - DNA, 22 bp, Homo sapiens
agtctggagtgttttgtagcaa

SEQ ID NO: 9345648 - DNA, 22 bp, Homo sapiens
agtctggagtttgctactggac

SEQ ID NO: 9345649 - DNA, 22 bp, Homo sapiens
agtctggattagttgggggcaa

SEQ ID NO: 9345650 - DNA, 22 bp, Homo sapiens
agtctggatttagaggtgggcc

SEQ ID NO: 9345651 - DNA, 22 bp, Homo sapiens
agtctgtctacttaaagtctgt

SEQ ID NO: 9345652 - DNA, 22 bp, Homo sapiens
agtctggatttagaggtgggcc

SEQ ID NO: 9345653 - DNA, 22 bp, Homo sapiens
ctcaggcacgggtcagtgagcg

SEQ ID NO: 9345654 - DNA, 18 bp, Homo sapiens
ctcaggcagagaagcttt

SEQ ID NO: 9345655 - DNA, 22 bp, Homo sapiens
ctcaggcagttctgtagcctcc

SEQ ID NO: 9345656 - DNA, 22 bp, Homo sapiens
ctcaggcagttctgtagcctcc

SEQ ID NO: 9345657 - DNA, 22 bp, Homo sapiens
ctcaggcagtgccctctggccg

SEQ ID NO: 9345658 - DNA, 22 bp, Homo sapiens
ctcaggcagtgccctctggccg

SEQ ID NO: 9345659 - DNA, 18 bp, Homo sapiens
ctcaggcagagaagcttt

SEQ ID NO: 9345660 - DNA, 22 bp, Homo sapiens
ctcaggcacgggtcagtgagcg

SEQ ID NO: 9345661 - DNA, 22 bp, Homo sapiens
ctcaggcaaggcccgcattctc

SEQ ID NO: 9345662 - DNA, 23 bp, Homo sapiens
agtcttactgtcccagaacaggg

SEQ ID NO: 9345663 - DNA, 22 bp, Homo sapiens
ctcaggagttggaggctacagt

SEQ ID NO: 9345664 - DNA, 22 bp, Homo sapiens
agtcttacatgagaaagaacct

SEQ ID NO: 9345665 - DNA, 22 bp, Homo sapiens
agtcttaatagagaaaaactgt

SEQ ID NO: 9345666 - DNA, 23 bp, Homo sapiens
agtcttaatacagctcttttcta

SEQ ID NO: 9345667 - DNA, 21 bp, Homo sapiens
agtctgttaggatgactctga

SEQ ID NO: 9345668 - DNA, 22 bp, Homo sapiens
agtcattttgccagtcttcagg

SEQ ID NO: 9345669 - DNA, 22 bp, Homo sapiens
agtcattttctgcctgtaatct

SEQ ID NO: 9345670 - DNA, 22 bp, Homo sapiens
agtccaagaccaaggtgtcacc

SEQ ID NO: 9345671 - DNA, 22 bp, Homo sapiens
agtccaagatcaaggtgtcaac

SEQ ID NO: 9345672 - DNA, 22 bp, Homo sapiens
agtccaagatcaaggtgtcagg

SEQ ID NO: 9345673 - DNA, 22 bp, Homo sapiens
agtccaaagcagatgagggcca

SEQ ID NO: 9345674 - DNA, 22 bp, Homo sapiens
agtcattattatttgtcaaagg

SEQ ID NO: 9345675 - DNA, 22 bp, Homo sapiens
agtcatgctacttcatcttctg

SEQ ID NO: 9345676 - DNA, 22 bp, Homo sapiens
agtcatctggttttgcatggca

SEQ ID NO: 9345677 - DNA, 22 bp, Homo sapiens
agtcatatctgaggaggaatcc

SEQ ID NO: 9345678 - DNA, 22 bp, Homo sapiens
agtcatcatctgccctcactgg

SEQ ID NO: 9345679 - DNA, 21 bp, Homo sapiens
agtctctctaataaatgcttg

SEQ ID NO: 9345680 - DNA, 20 bp, Homo sapiens
agtctctcccagaatgagca

SEQ ID NO: 9345681 - DNA, 22 bp, Homo sapiens
agtctctcacagaggattctcc

SEQ ID NO: 9345682 - DNA, 22 bp, Homo sapiens
agtctctccacattgttataaa

SEQ ID NO: 9345683 - DNA, 22 bp, Homo sapiens
agtccaaggccatacagttgtg

SEQ ID NO: 9345684 - DNA, 22 bp, Homo sapiens
agtccaagattagggtgacagc

SEQ ID NO: 9345685 - DNA, 22 bp, Homo sapiens
agtccaaggagagacagcattt

SEQ ID NO: 9345686 - DNA, 22 bp, Homo sapiens
agtctctttaatcacagtgtct

SEQ ID NO: 9345687 - DNA, 22 bp, Homo sapiens
agtctcttttgcgaagagtgtt

SEQ ID NO: 9345688 - DNA, 22 bp, Homo sapiens
agtctctttgtggactctgcct

SEQ ID NO: 9345689 - DNA, 22 bp, Homo sapiens
agtctcttttggttccaaaaat

SEQ ID NO: 9345690 - DNA, 22 bp, Homo sapiens
agtctgaaagtatgttgtaatg

SEQ ID NO: 9345691 - DNA, 22 bp, Homo sapiens
agtctgaagactcatgtctgaa

SEQ ID NO: 9345692 - DNA, 22 bp, Homo sapiens
agtctgaaggcaatctgctgac

SEQ ID NO: 9345693 - DNA, 22 bp, Homo sapiens
agtctgaagatattcttgcagg

SEQ ID NO: 9345694 - DNA, 22 bp, Homo sapiens
agtctgagttagtggaaatgta

SEQ ID NO: 9345695 - DNA, 22 bp, Homo sapiens
agtggggacaatgagagcaggt

SEQ ID NO: 9345696 - DNA, 22 bp, Homo sapiens
agtggggacttatgccagcatt

SEQ ID NO: 9345697 - DNA, 23 bp, Homo sapiens
agtggggaatcaacagattcttt

SEQ ID NO: 9345698 - DNA, 20 bp, Homo sapiens
agtggggagtcaggagtgcc

SEQ ID NO: 9345699 - DNA, 20 bp, Homo sapiens
agtggggagtcaggagtgcc

SEQ ID NO: 9345700 - DNA, 22 bp, Homo sapiens
agtggggacttatgccagcatt

SEQ ID NO: 9345701 - DNA, 22 bp, Homo sapiens
agtgtcctctattatgacttta

SEQ ID NO: 9345702 - DNA, 22 bp, Homo sapiens
agtgtcctctattatgacttta

SEQ ID NO: 9345703 - DNA, 22 bp, Homo sapiens
agtgtcctctattatgacttta

SEQ ID NO: 9345704 - DNA, 22 bp, Homo sapiens
agtgtctgatcagttgactaga

SEQ ID NO: 9345705 - DNA, 21 bp, Homo sapiens
agtgtctgagcgctgcttctg

SEQ ID NO: 9345706 - DNA, 22 bp, Homo sapiens
ctctgtttttcaatagttcttg

SEQ ID NO: 9345707 - DNA, 22 bp, Homo sapiens
ctctgtttggcgctgctccttc

SEQ ID NO: 9345708 - DNA, 22 bp, Homo sapiens
ctctgtttggcgctgctccttc

SEQ ID NO: 9345709 - DNA, 22 bp, Homo sapiens
agtgtctgccaactgcatggtc

SEQ ID NO: 9345710 - DNA, 19 bp, Homo sapiens
ctcttacagaatagacaca

SEQ ID NO: 9345711 - DNA, 22 bp, Homo sapiens
ctcttaatgttttatagattga

SEQ ID NO: 9345712 - DNA, 22 bp, Homo sapiens
ctcttaatgttttatagattga

SEQ ID NO: 9345713 - DNA, 22 bp, Homo sapiens
ctcttagaaagaaacacactgg

SEQ ID NO: 9345714 - DNA, 22 bp, Homo sapiens
ctcttagagagttgttgatcag

SEQ ID NO: 9345715 - DNA, 22 bp, Homo sapiens
ctcttagaaactatagagatta

SEQ ID NO: 9345716 - DNA, 20 bp, Homo sapiens
ctcttaaatgtaaagtaggc

SEQ ID NO: 9345717 - DNA, 19 bp, Homo sapiens
ctcttaaattgtctcttgc

SEQ ID NO: 9345718 - DNA, 22 bp, Homo sapiens
agtgtgtgtttgggcggtttat

SEQ ID NO: 9345719 - DNA, 23 bp, Homo sapiens
ctgaagcaatatcccctcacttc

SEQ ID NO: 9345720 - DNA, 19 bp, Homo sapiens
agtgttaacccagtgttgg

SEQ ID NO: 9345721 - DNA, 19 bp, Homo sapiens
agtgttaacccagtgttgg

SEQ ID NO: 9345722 - DNA, 22 bp, Homo sapiens
agtgtgggggctttggtgtcac

SEQ ID NO: 9345723 - DNA, 22 bp, Homo sapiens
agtgtgggggctttggtgtcac

SEQ ID NO: 9345724 - DNA, 22 bp, Homo sapiens
agtgtgtgcatgcattcgtgca

SEQ ID NO: 9345725 - DNA, 21 bp, Homo sapiens
agtgtgtgtggaatgagaata

SEQ ID NO: 9345726 - DNA, 22 bp, Homo sapiens
agtgtgtgctgttccccggagg

SEQ ID NO: 9345727 - DNA, 22 bp, Homo sapiens
agtgtgtgcctttggatacctg

SEQ ID NO: 9345728 - DNA, 18 bp, Homo sapiens
agtgtgtgccctttcagg

SEQ ID NO: 9345729 - DNA, 22 bp, Homo sapiens
ctgaagctgggcacttcctttt

SEQ ID NO: 9345730 - DNA, 22 bp, Homo sapiens
ctgagaaaggacctcaaacagg

SEQ ID NO: 9345731 - DNA, 22 bp, Homo sapiens
ctgaagctctccagtttgtttc

SEQ ID NO: 9345732 - DNA, 22 bp, Homo sapiens
ctgagagatggtgtgtttataa

SEQ ID NO: 9345733 - DNA, 22 bp, Homo sapiens
ctgagagatggtgtgtttataa

SEQ ID NO: 9345734 - DNA, 22 bp, Homo sapiens
ctgagagcatcgctggagatag

SEQ ID NO: 9345735 - DNA, 22 bp, Homo sapiens
ctgagaggcagccagagaaaat

SEQ ID NO: 9345736 - DNA, 22 bp, Homo sapiens
ctgagaggcggagcttgcagtg

SEQ ID NO: 9345737 - DNA, 22 bp, Homo sapiens
agtgggagagaagcaagtagta

SEQ ID NO: 9345738 - DNA, 21 bp, Homo sapiens
agtgggatactggaaggtaga

SEQ ID NO: 9345739 - DNA, 20 bp, Homo sapiens
agtgggagagggcagactgc

SEQ ID NO: 9345740 - DNA, 22 bp, Homo sapiens
agtgggcaggcagggtgcgcag

SEQ ID NO: 9345741 - DNA, 22 bp, Homo sapiens
agtgggcagcccaggaggtctt

SEQ ID NO: 9345742 - DNA, 22 bp, Homo sapiens
agtgggcaggcagggtgcgcag

SEQ ID NO: 9345743 - DNA, 22 bp, Homo sapiens
agtgggctggtggcagggagaa

SEQ ID NO: 9345744 - DNA, 22 bp, Homo sapiens
agtgggctggtggcagggagaa

SEQ ID NO: 9345745 - DNA, 22 bp, Homo sapiens
agtgggctgagcttgctgggtg

SEQ ID NO: 9345746 - DNA, 22 bp, Homo sapiens
agtgggcttactgagggagtgt

SEQ ID NO: 9345747 - DNA, 22 bp, Homo sapiens
agtgggcttttttccgttccat

SEQ ID NO: 9345748 - DNA, 22 bp, Homo sapiens
agtgggccttagaaggttccct

SEQ ID NO: 9345749 - DNA, 22 bp, Homo sapiens
ctctgactgacctggaatgaat

SEQ ID NO: 9345750 - DNA, 22 bp, Homo sapiens
ctctgacttatcggagaagtcc

SEQ ID NO: 9345751 - DNA, 22 bp, Homo sapiens
agtggctgtactattttttcat

SEQ ID NO: 9345752 - DNA, 22 bp, Homo sapiens
agtggctggtagttactgagca

SEQ ID NO: 9345753 - DNA, 19 bp, Homo sapiens
agtggctgggcagaagcaa

SEQ ID NO: 9345754 - DNA, 22 bp, Homo sapiens
agtggctggtctaaggtcacag

SEQ ID NO: 9345755 - DNA, 22 bp, Homo sapiens
agtggctggtctaaggtcacag

SEQ ID NO: 9345756 - DNA, 22 bp, Homo sapiens
ctctgagaagccttgatgggga

SEQ ID NO: 9345757 - DNA, 22 bp, Homo sapiens
ctctgagaggtgagaagcagca

SEQ ID NO: 9345758 - DNA, 22 bp, Homo sapiens
ctctgagagtgctcagagggta

SEQ ID NO: 9345759 - DNA, 22 bp, Homo sapiens
ctctgagacttttcacctccca

SEQ ID NO: 9345760 - DNA, 22 bp, Homo sapiens
ctctgagagcggtctgtggctt

SEQ ID NO: 9345761 - DNA, 22 bp, Homo sapiens
ctctgagagcggtctgtggctt

SEQ ID NO: 9345762 - DNA, 22 bp, Homo sapiens
ctctgagagcggtctgtggctt

SEQ ID NO: 9345763 - DNA, 22 bp, Homo sapiens
ctctctgggtcctcttttatag

SEQ ID NO: 9345764 - DNA, 22 bp, Homo sapiens
ctctctggggttccagacgtgg

SEQ ID NO: 9345765 - DNA, 18 bp, Homo sapiens
ctctctgggtgaggacaa

SEQ ID NO: 9345766 - DNA, 18 bp, Homo sapiens
ctctctgggtgaggacaa

SEQ ID NO: 9345767 - DNA, 18 bp, Homo sapiens
ctctctgggtgaggacaa

SEQ ID NO: 9345768 - DNA, 22 bp, Homo sapiens
ctctctggtacatagagtttgg

SEQ ID NO: 9345769 - DNA, 18 bp, Homo sapiens
ctctctgggtgaggacaa

SEQ ID NO: 9345770 - DNA, 22 bp, Homo sapiens
ctctctgggcccagttggcacc

SEQ ID NO: 9345771 - DNA, 22 bp, Homo sapiens
ctctctggggttccagacgtgg

SEQ ID NO: 9345772 - DNA, 22 bp, Homo sapiens
ctctctgggggccatgccaaga

SEQ ID NO: 9345773 - DNA, 22 bp, Homo sapiens
agtgcagggcctgcccagcagg

SEQ ID NO: 9345774 - DNA, 19 bp, Homo sapiens
agtgcagggagcaccctca

SEQ ID NO: 9345775 - DNA, 23 bp, Homo sapiens
ctctctctaccatgtgaggacac

SEQ ID NO: 9345776 - DNA, 22 bp, Homo sapiens
ctctctggcttggcacggagat

SEQ ID NO: 9345777 - DNA, 22 bp, Homo sapiens
agtgcaggccccaggccaggcc

SEQ ID NO: 9345778 - DNA, 22 bp, Homo sapiens
agtgcaggccccaggccaggcc

SEQ ID NO: 9345779 - DNA, 22 bp, Homo sapiens
agtgcaggccccaggccaggcc

SEQ ID NO: 9345780 - DNA, 22 bp, Homo sapiens
agtgcaggccccaggccaggcc

SEQ ID NO: 9345781 - DNA, 22 bp, Homo sapiens
agtgcaggagcctggccagagc

SEQ ID NO: 9345782 - DNA, 22 bp, Homo sapiens
agtgcaggccccaggccaggcc

SEQ ID NO: 9345783 - DNA, 22 bp, Homo sapiens
agtggctggacgacaagggtga

SEQ ID NO: 9345784 - DNA, 22 bp, Homo sapiens
agtggctggagccccaggctgg

SEQ ID NO: 9345785 - DNA, 22 bp, Homo sapiens
agtggctggagccccaggctgg

SEQ ID NO: 9345786 - DNA, 22 bp, Homo sapiens
agtggctggagccccaggctgg

SEQ ID NO: 9345787 - DNA, 22 bp, Homo sapiens
agtggctggcataggaacagac

SEQ ID NO: 9345788 - DNA, 22 bp, Homo sapiens
agtggctggcataggaacagac

SEQ ID NO: 9345789 - DNA, 22 bp, Homo sapiens
agtggctggcataggaacagac

SEQ ID NO: 9345790 - DNA, 19 bp, Homo sapiens
agtggctgggcagaagcaa

SEQ ID NO: 9345791 - DNA, 19 bp, Homo sapiens
agtggctgggcagaagcaa

SEQ ID NO: 9345792 - DNA, 19 bp, Homo sapiens
agtggctgggcagaagcaa

SEQ ID NO: 9345793 - DNA, 22 bp, Homo sapiens
agtggctgaagcatcaaaggca

SEQ ID NO: 9345794 - DNA, 22 bp, Homo sapiens
agtggctgacaactgggttaac

SEQ ID NO: 9345795 - DNA, 22 bp, Homo sapiens
agtggctggacgacaagggtga

SEQ ID NO: 9345796 - DNA, 22 bp, Homo sapiens
agtggcaggcggagatgtagga

SEQ ID NO: 9345797 - DNA, 22 bp, Homo sapiens
agtggcaggcggagatgtagga

SEQ ID NO: 9345798 - DNA, 17 bp, Homo sapiens
agtggcaggcagatggg

SEQ ID NO: 9345799 - DNA, 17 bp, Homo sapiens
agtggcaggcagatggg

SEQ ID NO: 9345800 - DNA, 17 bp, Homo sapiens
agtggcaggcagatggg

SEQ ID NO: 9345801 - DNA, 17 bp, Homo sapiens
agtggcaggcagatggg

SEQ ID NO: 9345802 - DNA, 17 bp, Homo sapiens
agtggcaggcagatggg

SEQ ID NO: 9345803 - DNA, 22 bp, Homo sapiens
agtggcaggcagaagcttctca

SEQ ID NO: 9345804 - DNA, 22 bp, Homo sapiens
agtggcaggaaagtggaagaga

SEQ ID NO: 9345805 - DNA, 22 bp, Homo sapiens
agtggcagctgtcatgccctag

SEQ ID NO: 9345806 - DNA, 22 bp, Homo sapiens
agtggcagctgtcatgccctag

SEQ ID NO: 9345807 - DNA, 22 bp, Homo sapiens
ctctctggtcccagattccaga

SEQ ID NO: 9345808 - DNA, 22 bp, Homo sapiens
agtggcagccgagcaggagatg

SEQ ID NO: 9345809 - DNA, 22 bp, Homo sapiens
cctggctcagcagctctttctc

SEQ ID NO: 9345810 - DNA, 22 bp, Homo sapiens
cctggctcagaccccagttctg

SEQ ID NO: 9345811 - DNA, 22 bp, Homo sapiens
cctggctaggagagctgggctc

SEQ ID NO: 9345812 - DNA, 22 bp, Homo sapiens
cctggccttaagggcagggagc

SEQ ID NO: 9345813 - DNA, 23 bp, Homo sapiens
cctggctcaccccttatgtccag

SEQ ID NO: 9345814 - DNA, 22 bp, Homo sapiens
cctggctcaaggcgaggactcc

SEQ ID NO: 9345815 - DNA, 22 bp, Homo sapiens
aggtatattttgtatatactct

SEQ ID NO: 9345816 - DNA, 22 bp, Homo sapiens
aggtatatgttcatgtatgtgt

SEQ ID NO: 9345817 - DNA, 22 bp, Homo sapiens
aggtatatgctattacttctgc

SEQ ID NO: 9345818 - DNA, 22 bp, Homo sapiens
aggtatatgctattacttctgc

SEQ ID NO: 9345819 - DNA, 22 bp, Homo sapiens
aggtataagaagattatttata

SEQ ID NO: 9345820 - DNA, 18 bp, Homo sapiens
aggtataagtgatctgct

SEQ ID NO: 9345821 - DNA, 18 bp, Homo sapiens
aggtatatgaatctcttt

SEQ ID NO: 9345822 - DNA, 22 bp, Homo sapiens
aggtatatgaagatgaaataac

SEQ ID NO: 9345823 - DNA, 17 bp, Homo sapiens
aggtataaaatggtagc

SEQ ID NO: 9345824 - DNA, 22 bp, Homo sapiens
aggtataagaagattatttata

SEQ ID NO: 9345825 - DNA, 20 bp, Homo sapiens
aggtataagaaatgtgattt

SEQ ID NO: 9345826 - DNA, 22 bp, Homo sapiens
aggtagtgtagctgagtgggat

SEQ ID NO: 9345827 - DNA, 22 bp, Homo sapiens
cctggctcagtgttgaaggggt

SEQ ID NO: 9345828 - DNA, 22 bp, Homo sapiens
cctggccttaagggcagggagc

SEQ ID NO: 9345829 - DNA, 23 bp, Homo sapiens
agggtggcttgctttgcttcctt

SEQ ID NO: 9345830 - DNA, 23 bp, Homo sapiens
agggtggcttgctttgcttcctt

SEQ ID NO: 9345831 - DNA, 22 bp, Homo sapiens
agggtggcttaattccaaaggg

SEQ ID NO: 9345832 - DNA, 22 bp, Homo sapiens
cctggccagcagccccttcctc

SEQ ID NO: 9345833 - DNA, 22 bp, Homo sapiens
agggtggctgtgaagtgcttgg

SEQ ID NO: 9345834 - DNA, 22 bp, Homo sapiens
agggtggctgtgaagtgcttgg

SEQ ID NO: 9345835 - DNA, 22 bp, Homo sapiens
agggtggcttaattccaaaggg

SEQ ID NO: 9345836 - DNA, 22 bp, Homo sapiens
agggtggcttaattccaaaggg

SEQ ID NO: 9345837 - DNA, 22 bp, Homo sapiens
agggtggcttaattccaaaggg

SEQ ID NO: 9345838 - DNA, 21 bp, Homo sapiens
agggtggctctgggtcagaac

SEQ ID NO: 9345839 - DNA, 21 bp, Homo sapiens
agggtggctctgggtcagaac

SEQ ID NO: 9345840 - DNA, 21 bp, Homo sapiens
agggtggctctgggtcagaac

SEQ ID NO: 9345841 - DNA, 21 bp, Homo sapiens
agggtggctctgggtcagaac

SEQ ID NO: 9345842 - DNA, 22 bp, Homo sapiens
agggtggctgagtagatggaag

SEQ ID NO: 9345843 - DNA, 22 bp, Homo sapiens
agggtggctgagtagatggaag

SEQ ID NO: 9345844 - DNA, 22 bp, Homo sapiens
agggtggctgagtagatggaag

SEQ ID NO: 9345845 - DNA, 22 bp, Homo sapiens
agggtggctggaggaatcagaa

SEQ ID NO: 9345846 - DNA, 22 bp, Homo sapiens
agggtggctgtgaagtgcttgg

SEQ ID NO: 9345847 - DNA, 22 bp, Homo sapiens
cctggagcccctctggccagcc

SEQ ID NO: 9345848 - DNA, 22 bp, Homo sapiens
cctggagcccctctggccagcc

SEQ ID NO: 9345849 - DNA, 22 bp, Homo sapiens
cctggagctcactgggagccgg

SEQ ID NO: 9345850 - DNA, 22 bp, Homo sapiens
cctggagctcactgggagccgg

SEQ ID NO: 9345851 - DNA, 22 bp, Homo sapiens
cctggagctcactgggagccgg

SEQ ID NO: 9345852 - DNA, 22 bp, Homo sapiens
agggtggccaccaagtatgtca

SEQ ID NO: 9345853 - DNA, 22 bp, Homo sapiens
agggtggccatgagggagagat

SEQ ID NO: 9345854 - DNA, 22 bp, Homo sapiens
agggtggccatgagggagagat

SEQ ID NO: 9345855 - DNA, 22 bp, Homo sapiens
agggtggccccactttggttgg

SEQ ID NO: 9345856 - DNA, 22 bp, Homo sapiens
agggtggccccactttggttgg

SEQ ID NO: 9345857 - DNA, 22 bp, Homo sapiens
aggggctgtggaaaccaactct

SEQ ID NO: 9345858 - DNA, 22 bp, Homo sapiens
aggggcttgtggagttgctggt

SEQ ID NO: 9345859 - DNA, 22 bp, Homo sapiens
aggggcttatgtttctccaggc

SEQ ID NO: 9345860 - DNA, 23 bp, Homo sapiens
agggtgagcaagctatggagacc

SEQ ID NO: 9345861 - DNA, 23 bp, Homo sapiens
agggtgagcaagctatggagacc

SEQ ID NO: 9345862 - DNA, 23 bp, Homo sapiens
agggtgagcaagctatggagacc

SEQ ID NO: 9345863 - DNA, 22 bp, Homo sapiens
aggggctttggtgctggtcctg

SEQ ID NO: 9345864 - DNA, 19 bp, Homo sapiens
agggtggcaaaggagggtg

SEQ ID NO: 9345865 - DNA, 22 bp, Homo sapiens
agggtgctaatctcattcacat

SEQ ID NO: 9345866 - DNA, 22 bp, Homo sapiens
agggtggaagatggcactatct

SEQ ID NO: 9345867 - DNA, 22 bp, Homo sapiens
agggtgctgccggacaggtggg

SEQ ID NO: 9345868 - DNA, 22 bp, Homo sapiens
agggtgctctggaaaatgtagt

SEQ ID NO: 9345869 - DNA, 22 bp, Homo sapiens
agggtggcagttactggagcaa

SEQ ID NO: 9345870 - DNA, 22 bp, Homo sapiens
agggtggcagttactggagcaa

SEQ ID NO: 9345871 - DNA, 22 bp, Homo sapiens
agggtggcactggtggctctat

SEQ ID NO: 9345872 - DNA, 22 bp, Homo sapiens
agggtggcactggtggctctat

SEQ ID NO: 9345873 - DNA, 22 bp, Homo sapiens
agggtggcactggtggctctat

SEQ ID NO: 9345874 - DNA, 22 bp, Homo sapiens
agggtggcagttactggagcaa

SEQ ID NO: 9345875 - DNA, 20 bp, Homo sapiens
agggtggcaagttagtgaca

SEQ ID NO: 9345876 - DNA, 19 bp, Homo sapiens
agggtggcaaaggagggtg

SEQ ID NO: 9345877 - DNA, 19 bp, Homo sapiens
agggtggcaaaggagggtg

SEQ ID NO: 9345878 - DNA, 19 bp, Homo sapiens
agggtggcaaaggagggtg

SEQ ID NO: 9345879 - DNA, 19 bp, Homo sapiens
agggtggcaaaggagggtg

SEQ ID NO: 9345880 - DNA, 22 bp, Homo sapiens
agggtggcaccacatatcatag

SEQ ID NO: 9345881 - DNA, 22 bp, Homo sapiens
agggtggcaccacatatcatag

SEQ ID NO: 9345882 - DNA, 22 bp, Homo sapiens
agggtggcacctggaagggatg

SEQ ID NO: 9345883 - DNA, 18 bp, Homo sapiens
cctggacctgtctccttt

SEQ ID NO: 9345884 - DNA, 22 bp, Homo sapiens
cctggagcaggagctgcagagg

SEQ ID NO: 9345885 - DNA, 22 bp, Homo sapiens
cctggagcatcaggaggaaggg

SEQ ID NO: 9345886 - DNA, 22 bp, Homo sapiens
cctggagcccaaggcagtgaga

SEQ ID NO: 9345887 - DNA, 22 bp, Homo sapiens
cctggagcccaaggcagtgaga

SEQ ID NO: 9345888 - DNA, 22 bp, Homo sapiens
cctggagcccaaggcagtgaga

SEQ ID NO: 9345889 - DNA, 22 bp, Homo sapiens
cctgcctggctgtcagcagagc

SEQ ID NO: 9345890 - DNA, 22 bp, Homo sapiens
cctgcctggctgtcagcagagc

SEQ ID NO: 9345891 - DNA, 22 bp, Homo sapiens
cctgcctggctgtcagcagagc

SEQ ID NO: 9345892 - DNA, 22 bp, Homo sapiens
cctgcctggcccaccttgccac

SEQ ID NO: 9345893 - DNA, 22 bp, Homo sapiens
cctgcctggcacatagtactct

SEQ ID NO: 9345894 - DNA, 22 bp, Homo sapiens
cctgcctggatcagccatcctg

SEQ ID NO: 9345895 - DNA, 22 bp, Homo sapiens
cctgcctgctttctgctttgca

SEQ ID NO: 9345896 - DNA, 22 bp, Homo sapiens
cctggtcccattgcggctgcct

SEQ ID NO: 9345897 - DNA, 22 bp, Homo sapiens
cctggtcccattgcggctgcct

SEQ ID NO: 9345898 - DNA, 22 bp, Homo sapiens
cctggtcaggtaactgggctga

SEQ ID NO: 9345899 - DNA, 22 bp, Homo sapiens
cctggtcaggtaactgggctga

SEQ ID NO: 9345900 - DNA, 22 bp, Homo sapiens
cctgggttccagcaccctctag

SEQ ID NO: 9345901 - DNA, 22 bp, Homo sapiens
cctggtcacccctctctctgca

SEQ ID NO: 9345902 - DNA, 22 bp, Homo sapiens
cctggtcacccctctctctgca

SEQ ID NO: 9345903 - DNA, 22 bp, Homo sapiens
cctggtcacccctctctctgca

SEQ ID NO: 9345904 - DNA, 22 bp, Homo sapiens
cctgggtttggagcctgcagaa

SEQ ID NO: 9345905 - DNA, 22 bp, Homo sapiens
cctgggttattttggtctagtg

SEQ ID NO: 9345906 - DNA, 22 bp, Homo sapiens
aggtggatcatatactagacca

SEQ ID NO: 9345907 - DNA, 22 bp, Homo sapiens
aggtggatctcagctcatctaa

SEQ ID NO: 9345908 - DNA, 22 bp, Homo sapiens
aggtggagttggctgtagttca

SEQ ID NO: 9345909 - DNA, 22 bp, Homo sapiens
aggtggagttaagtgtgaactg

SEQ ID NO: 9345910 - DNA, 22 bp, Homo sapiens
aggtggagtgtgcagggagagc

SEQ ID NO: 9345911 - DNA, 22 bp, Homo sapiens
aggtggagtgtgcagggagagc

SEQ ID NO: 9345912 - DNA, 22 bp, Homo sapiens
aggtggagtgtgcagggagagc

SEQ ID NO: 9345913 - DNA, 22 bp, Homo sapiens
aggtggagtgtgcagggagagc

SEQ ID NO: 9345914 - DNA, 22 bp, Homo sapiens
aggtggagtgtgcagggagagc

SEQ ID NO: 9345915 - DNA, 22 bp, Homo sapiens
aggtggagtgaaggaaaggcag

SEQ ID NO: 9345916 - DNA, 22 bp, Homo sapiens
aggtggagtgaaggaaaggcag

SEQ ID NO: 9345917 - DNA, 22 bp, Homo sapiens
aggtggagtgaaggaaaggcag

SEQ ID NO: 9345918 - DNA, 23 bp, Homo sapiens
aggtggagctgtgcagccggggc

SEQ ID NO: 9345919 - DNA, 22 bp, Homo sapiens
aggtggagtgaaggaaaggcag

SEQ ID NO: 9345920 - DNA, 22 bp, Homo sapiens
aggtggagtgaaggaaaggcag

SEQ ID NO: 9345921 - DNA, 22 bp, Homo sapiens
aggtgcttggctcgtgcacaca

SEQ ID NO: 9345922 - DNA, 22 bp, Homo sapiens
aggtgcttggctcgtgcacaca

SEQ ID NO: 9345923 - DNA, 23 bp, Homo sapiens
aggtggagctgtgcagccggggc

SEQ ID NO: 9345924 - DNA, 22 bp, Homo sapiens
cctgggcagggctggactctca

SEQ ID NO: 9345925 - DNA, 22 bp, Homo sapiens
cctgggcaggtgtggcttcccc

SEQ ID NO: 9345926 - DNA, 22 bp, Homo sapiens
cctgggcagggctggactctca

SEQ ID NO: 9345927 - DNA, 22 bp, Homo sapiens
aggtgctgtttgtcagcagttt

SEQ ID NO: 9345928 - DNA, 22 bp, Homo sapiens
cctgggcagtgctggagttgaa

SEQ ID NO: 9345929 - DNA, 22 bp, Homo sapiens
cctgggcagtgctggagttgaa

SEQ ID NO: 9345930 - DNA, 22 bp, Homo sapiens
cctgggcaggtgtggcttcccc

SEQ ID NO: 9345931 - DNA, 22 bp, Homo sapiens
cctgggcagggagaccaggctc

SEQ ID NO: 9345932 - DNA, 22 bp, Homo sapiens
cctgggcagggagaccaggctc

SEQ ID NO: 9345933 - DNA, 22 bp, Homo sapiens
cctgggcagggctggactctca

SEQ ID NO: 9345934 - DNA, 22 bp, Homo sapiens
cctgggcagggctggactctca

SEQ ID NO: 9345935 - DNA, 22 bp, Homo sapiens
cctgggcaggccggacgctggg

SEQ ID NO: 9345936 - DNA, 22 bp, Homo sapiens
cctgggcaggccggacgctggg

SEQ ID NO: 9345937 - DNA, 22 bp, Homo sapiens
aggtgagtcctgggcacaggta

SEQ ID NO: 9345938 - DNA, 22 bp, Homo sapiens
aggtgagtcctgggcacaggta

SEQ ID NO: 9345939 - DNA, 22 bp, Homo sapiens
aggtgagttacaggaggaggtc

SEQ ID NO: 9345940 - DNA, 19 bp, Homo sapiens
aggtgagtgtgggaaaggg

SEQ ID NO: 9345941 - DNA, 22 bp, Homo sapiens
aggtgagtgtgactgcaagaga

SEQ ID NO: 9345942 - DNA, 22 bp, Homo sapiens
aggtgagttggtaggaagtttg

SEQ ID NO: 9345943 - DNA, 22 bp, Homo sapiens
aggtgataagtgttaaataaag

SEQ ID NO: 9345944 - DNA, 22 bp, Homo sapiens
aggtgattagcttgaaatcctt

SEQ ID NO: 9345945 - DNA, 22 bp, Homo sapiens
aggtgattttctccttacgatt

SEQ ID NO: 9345946 - DNA, 22 bp, Homo sapiens
aggtgattctaatgtgcagtca

SEQ ID NO: 9345947 - DNA, 22 bp, Homo sapiens
aggtgattcaactgtgcagtga

SEQ ID NO: 9345948 - DNA, 23 bp, Homo sapiens
aggtgcactgtggtggcagtggc

SEQ ID NO: 9345949 - DNA, 22 bp, Homo sapiens
aggtgcactgtctaattaggtc

SEQ ID NO: 9345950 - DNA, 21 bp, Homo sapiens
aggtgcagagccagggaccag

SEQ ID NO: 9345951 - DNA, 21 bp, Homo sapiens
aggtgcagagccagggaccag

SEQ ID NO: 9345952 - DNA, 22 bp, Homo sapiens
aggtgcagaaaaaagtccttta

SEQ ID NO: 9345953 - DNA, 22 bp, Homo sapiens
cctgggcaggatgggcccggtg

SEQ ID NO: 9345954 - DNA, 22 bp, Homo sapiens
aggtctggtgttgatgaattcc

SEQ ID NO: 9345955 - DNA, 22 bp, Homo sapiens
aggtctggtgttgggcctgaaa

SEQ ID NO: 9345956 - DNA, 19 bp, Homo sapiens
aggtgaggggcaccatgtc

SEQ ID NO: 9345957 - DNA, 19 bp, Homo sapiens
aggtgaggggcaccatgtc

SEQ ID NO: 9345958 - DNA, 19 bp, Homo sapiens
aggtgaggggcaccatgtc

SEQ ID NO: 9345959 - DNA, 22 bp, Homo sapiens
aggtctggaggcggagtcagga

SEQ ID NO: 9345960 - DNA, 22 bp, Homo sapiens
aggtctggaggcggagtcagga

SEQ ID NO: 9345961 - DNA, 22 bp, Homo sapiens
aggtctggaggcggagtcagga

SEQ ID NO: 9345962 - DNA, 23 bp, Homo sapiens
aggtctggacccttggcccctgc

SEQ ID NO: 9345963 - DNA, 23 bp, Homo sapiens
aggtctggacccttggcccctgc

SEQ ID NO: 9345964 - DNA, 22 bp, Homo sapiens
aggtctgggagttcattccctg

SEQ ID NO: 9345965 - DNA, 22 bp, Homo sapiens
aggtctgggagttcattccctg

SEQ ID NO: 9345966 - DNA, 22 bp, Homo sapiens
aggtctggctcttctccacaga

SEQ ID NO: 9345967 - DNA, 22 bp, Homo sapiens
aggtctggagtgggatctgaga

SEQ ID NO: 9345968 - DNA, 22 bp, Homo sapiens
aggtctggagtgggatctgaga

SEQ ID NO: 9345969 - DNA, 22 bp, Homo sapiens
aggtctggctcttctccacaga

SEQ ID NO: 9345970 - DNA, 22 bp, Homo sapiens
aggtctggtgagagcaggtgct

SEQ ID NO: 9345971 - DNA, 22 bp, Homo sapiens
aggtctggtgagagcaggtgct

SEQ ID NO: 9345972 - DNA, 22 bp, Homo sapiens
aggtctggtgagagcaggtgct

SEQ ID NO: 9345973 - DNA, 22 bp, Homo sapiens
aggtctggtgagagcaggtgct

SEQ ID NO: 9345974 - DNA, 22 bp, Homo sapiens
aggtctggtgggctttagattg

SEQ ID NO: 9345975 - DNA, 22 bp, Homo sapiens
aggtctgggattgaagacatca

SEQ ID NO: 9345976 - DNA, 22 bp, Homo sapiens
aggtctgggcaccactggctgc

SEQ ID NO: 9345977 - DNA, 22 bp, Homo sapiens
aggtctggtatttttctatact

SEQ ID NO: 9345978 - DNA, 22 bp, Homo sapiens
aggtattagaagagtcatggga

SEQ ID NO: 9345979 - DNA, 21 bp, Homo sapiens
aggtatgttgagaactgagga

SEQ ID NO: 9345980 - DNA, 22 bp, Homo sapiens
aggtatgtggttccatgatgag

SEQ ID NO: 9345981 - DNA, 22 bp, Homo sapiens
aggtatggcataaatcacaggg

SEQ ID NO: 9345982 - DNA, 22 bp, Homo sapiens
aggtatgtatgtgtgtatattt

SEQ ID NO: 9345983 - DNA, 22 bp, Homo sapiens
aggtatgtgctattgttatatt

SEQ ID NO: 9345984 - DNA, 22 bp, Homo sapiens
aggtatgtgggtgagaggagga

SEQ ID NO: 9345985 - DNA, 20 bp, Homo sapiens
aggtctgaatgtcagggctg

SEQ ID NO: 9345986 - DNA, 22 bp, Homo sapiens
aggtctgacttcaagcctgtgg

SEQ ID NO: 9345987 - DNA, 17 bp, Homo sapiens
aggtctgagagtatctg

SEQ ID NO: 9345988 - DNA, 17 bp, Homo sapiens
aggtctgagagtatctg

SEQ ID NO: 9345989 - DNA, 22 bp, Homo sapiens
aggtcctgtccttggtctctga

SEQ ID NO: 9345990 - DNA, 22 bp, Homo sapiens
aggtcctgtccttggtctctga

SEQ ID NO: 9345991 - DNA, 22 bp, Homo sapiens
aggtctcttgctgtctctgggc

SEQ ID NO: 9345992 - DNA, 22 bp, Homo sapiens
aggtctggaaacagcagggaga

SEQ ID NO: 9345993 - DNA, 22 bp, Homo sapiens
aggtctggaaacagcagggaga

SEQ ID NO: 9345994 - DNA, 22 bp, Homo sapiens
aggtctgcctcactcacttctg

SEQ ID NO: 9345995 - DNA, 22 bp, Homo sapiens
aggtctgagtcccaggggtacc

SEQ ID NO: 9345996 - DNA, 22 bp, Homo sapiens
aggtctgagtttgttgttggct

SEQ ID NO: 9345997 - DNA, 20 bp, Homo sapiens
aggtctgattccagaatcag

SEQ ID NO: 9345998 - DNA, 22 bp, Homo sapiens
aggtctgagcaggggagaacag

SEQ ID NO: 9345999 - DNA, 22 bp, Homo sapiens
aggtctgagcaggggagaacag

SEQ ID NO: 9346000 - DNA, 18 bp, Homo sapiens
aggtctgaggaagagcct

SEQ ID NO: 9346001 - DNA, 22 bp, Homo sapiens
aggtctgagtatggcctgagaa

SEQ ID NO: 9346002 - DNA, 22 bp, Homo sapiens
aggtctgagtatggcctgagaa

SEQ ID NO: 9346003 - DNA, 22 bp, Homo sapiens
aggtctgagtagagaaaaggca

SEQ ID NO: 9346004 - DNA, 18 bp, Homo sapiens
aggtctgaggaagagcct

SEQ ID NO: 9346005 - DNA, 22 bp, Homo sapiens
cctggtccccatcggcccagcg

SEQ ID NO: 9346006 - DNA, 22 bp, Homo sapiens
cctggtgcaccaagtaagggtg

SEQ ID NO: 9346007 - DNA, 22 bp, Homo sapiens
aggtggggttcagtctcagccg

SEQ ID NO: 9346008 - DNA, 22 bp, Homo sapiens
cctggtgcccccaagccagctg

SEQ ID NO: 9346009 - DNA, 22 bp, Homo sapiens
cctggtgccactagagaatgtc

SEQ ID NO: 9346010 - DNA, 22 bp, Homo sapiens
aggtgtcttcagggtgagacag

SEQ ID NO: 9346011 - DNA, 22 bp, Homo sapiens
aggtgtctttgcggcccgccgc

SEQ ID NO: 9346012 - DNA, 22 bp, Homo sapiens
aggtgtctgtgatgggagcgat

SEQ ID NO: 9346013 - DNA, 22 bp, Homo sapiens
aggtgtcttcagggtgagacag

SEQ ID NO: 9346014 - DNA, 22 bp, Homo sapiens
aggtgtctgtgatgggagcgat

SEQ ID NO: 9346015 - DNA, 22 bp, Homo sapiens
aggtgtctggatgggtgtcctt

SEQ ID NO: 9346016 - DNA, 22 bp, Homo sapiens
aggtgtctgggctttggagtca

SEQ ID NO: 9346017 - DNA, 22 bp, Homo sapiens
cctggtgcccccaagccagctg

SEQ ID NO: 9346018 - DNA, 22 bp, Homo sapiens
aggtggggttcagtctcagccg

SEQ ID NO: 9346019 - DNA, 22 bp, Homo sapiens
aggtgtggctggggcagaggcc

SEQ ID NO: 9346020 - DNA, 22 bp, Homo sapiens
aggtgtggcttgaagtctctat

SEQ ID NO: 9346021 - DNA, 22 bp, Homo sapiens
aggtgtggctggggcagaggcc

SEQ ID NO: 9346022 - DNA, 22 bp, Homo sapiens
aggtgtggctggggcagaggcc

SEQ ID NO: 9346023 - DNA, 19 bp, Homo sapiens
aggtgtgggggctgcagac

SEQ ID NO: 9346024 - DNA, 19 bp, Homo sapiens
aggtgtgggggctgcagac

SEQ ID NO: 9346025 - DNA, 19 bp, Homo sapiens
aggtgtgggggctgcagac

SEQ ID NO: 9346026 - DNA, 22 bp, Homo sapiens
aggtttataggaaatttgttcc

SEQ ID NO: 9346027 - DNA, 22 bp, Homo sapiens
aggtttactgagggtgctggtt

SEQ ID NO: 9346028 - DNA, 22 bp, Homo sapiens
aggttccaagaaatcatcagtg

SEQ ID NO: 9346029 - DNA, 22 bp, Homo sapiens
aggttggcctcagggaggctct

SEQ ID NO: 9346030 - DNA, 22 bp, Homo sapiens
aggttggctgctcttttcctaa

SEQ ID NO: 9346031 - DNA, 22 bp, Homo sapiens
aggttacagtgattataggttt

SEQ ID NO: 9346032 - DNA, 22 bp, Homo sapiens
aggttaaaaaggattcagttaa

SEQ ID NO: 9346033 - DNA, 17 bp, Homo sapiens
aggtgtggtcaagggag

SEQ ID NO: 9346034 - DNA, 22 bp, Homo sapiens
aggttattaaagtgtatttttg

SEQ ID NO: 9346035 - DNA, 21 bp, Homo sapiens
aggttattacaatttttctac

SEQ ID NO: 9346036 - DNA, 23 bp, Homo sapiens
aggttatgattatagagcgagga

SEQ ID NO: 9346037 - DNA, 22 bp, Homo sapiens
cgcctgcttaacgaattgtgtt

SEQ ID NO: 9346038 - DNA, 22 bp, Homo sapiens
cgcctggaacctctaggaccag

SEQ ID NO: 9346039 - DNA, 22 bp, Homo sapiens
cgcctggaacctctaggaccag

SEQ ID NO: 9346040 - DNA, 22 bp, Homo sapiens
cgcctggagaggaggcgacgcg

SEQ ID NO: 9346041 - DNA, 22 bp, Homo sapiens
cgcctgctctgtttccatgtgg

SEQ ID NO: 9346042 - DNA, 22 bp, Homo sapiens
cgcctgctctcactggacagct

SEQ ID NO: 9346043 - DNA, 22 bp, Homo sapiens
agtacaaagtgctcctggttct

SEQ ID NO: 9346044 - DNA, 22 bp, Homo sapiens
agtacaaaggcccttgattact

SEQ ID NO: 9346045 - DNA, 22 bp, Homo sapiens
agtacaaagtgctcctggttct

SEQ ID NO: 9346046 - DNA, 22 bp, Homo sapiens
agtacaaactgtttcaaagtag

SEQ ID NO: 9346047 - DNA, 22 bp, Homo sapiens
agtacaaactgtttcaaagtag

SEQ ID NO: 9346048 - DNA, 22 bp, Homo sapiens
agtaatagagattttaatgtcc

SEQ ID NO: 9346049 - DNA, 22 bp, Homo sapiens
agtaatcaatttttcggtggat

SEQ ID NO: 9346050 - DNA, 22 bp, Homo sapiens
agtaatttgttataaagcaata

SEQ ID NO: 9346051 - DNA, 22 bp, Homo sapiens
agtaatttgttataaagcaata

SEQ ID NO: 9346052 - DNA, 17 bp, Homo sapiens
aggtttatggtatttga

SEQ ID NO: 9346053 - DNA, 22 bp, Homo sapiens
aggtttccagcaggccatagat

SEQ ID NO: 9346054 - DNA, 21 bp, Homo sapiens
aggtttatttcaacttcagga

SEQ ID NO: 9346055 - DNA, 22 bp, Homo sapiens
aggtttattatgtagcattatt

SEQ ID NO: 9346056 - DNA, 22 bp, Homo sapiens
aggtttctcctttaaagcatgg

SEQ ID NO: 9346057 - DNA, 22 bp, Homo sapiens
cctttagaatacagactttcta

SEQ ID NO: 9346058 - DNA, 22 bp, Homo sapiens
cctttagaaagtcagtagttgc

SEQ ID NO: 9346059 - DNA, 22 bp, Homo sapiens
aggtttctactgtgttaagaaa

SEQ ID NO: 9346060 - DNA, 20 bp, Homo sapiens
cctttattatttgtatgatg

SEQ ID NO: 9346061 - DNA, 22 bp, Homo sapiens
cctttattcaattagtcctaat

SEQ ID NO: 9346062 - DNA, 22 bp, Homo sapiens
cctttatactaaggcatacaat

SEQ ID NO: 9346063 - DNA, 21 bp, Homo sapiens
cctttagatttctatgcagtt

SEQ ID NO: 9346064 - DNA, 22 bp, Homo sapiens
cctttagaattctgcccctcct

SEQ ID NO: 9346065 - DNA, 22 bp, Homo sapiens
cctttagagcaaacgccaccta

SEQ ID NO: 9346066 - DNA, 22 bp, Homo sapiens
cctttagatgatctcttggaca

SEQ ID NO: 9346067 - DNA, 22 bp, Homo sapiens
ctacaagtggagttctgacgca

SEQ ID NO: 9346068 - DNA, 22 bp, Homo sapiens
ctacaagtgcaacctgtgcgac

SEQ ID NO: 9346069 - DNA, 22 bp, Homo sapiens
ctacaagtcattccaggtactt

SEQ ID NO: 9346070 - DNA, 21 bp, Homo sapiens
ctacaagtaaagtattgggac

SEQ ID NO: 9346071 - DNA, 22 bp, Homo sapiens
ctacaagtatgggggctccaaa

SEQ ID NO: 9346072 - DNA, 22 bp, Homo sapiens
ctacaagcatctatgtttcaag

SEQ ID NO: 9346073 - DNA, 22 bp, Homo sapiens
agtcactttctacttggtttct

SEQ ID NO: 9346074 - DNA, 22 bp, Homo sapiens
agtcactttatgagagaaccat

SEQ ID NO: 9346075 - DNA, 22 bp, Homo sapiens
agtcaccaacatggttcccagg

SEQ ID NO: 9346076 - DNA, 22 bp, Homo sapiens
agtcagaagccggcctaaggga

SEQ ID NO: 9346077 - DNA, 22 bp, Homo sapiens
agtcactttgctactctgcctt

SEQ ID NO: 9346078 - DNA, 22 bp, Homo sapiens
agtcagaagggcccttccttcc

SEQ ID NO: 9346079 - DNA, 22 bp, Homo sapiens
agtcagaattcgatcccaggtc

SEQ ID NO: 9346080 - DNA, 22 bp, Homo sapiens
agtcagaattcgatcccaggtc

SEQ ID NO: 9346081 - DNA, 23 bp, Homo sapiens
agtcagagagtgtgagacaactg

SEQ ID NO: 9346082 - DNA, 22 bp, Homo sapiens
agtcagagaatgttttcatgga

SEQ ID NO: 9346083 - DNA, 22 bp, Homo sapiens
ctacacagagcctacttctgca

SEQ ID NO: 9346084 - DNA, 21 bp, Homo sapiens
ctacacagctttctataggaa

SEQ ID NO: 9346085 - DNA, 22 bp, Homo sapiens
ctacaccggagcctggaaggta

SEQ ID NO: 9346086 - DNA, 22 bp, Homo sapiens
agtcagtgtagaaagcccaggc

SEQ ID NO: 9346087 - DNA, 22 bp, Homo sapiens
agtcataattataaacatcagt

SEQ ID NO: 9346088 - DNA, 22 bp, Homo sapiens
agtcagttgtggagatttaact

SEQ ID NO: 9346089 - DNA, 18 bp, Homo sapiens
agtcagttgatggggacc

SEQ ID NO: 9346090 - DNA, 17 bp, Homo sapiens
cgtgagcagcaggtgcc

SEQ ID NO: 9346091 - DNA, 22 bp, Homo sapiens
cgtgagggcatggcagtgagga

SEQ ID NO: 9346092 - DNA, 22 bp, Homo sapiens
cgtgaggggggtaaggcgtccg

SEQ ID NO: 9346093 - DNA, 22 bp, Homo sapiens
cgtgccactgcactctagcctg

SEQ ID NO: 9346094 - DNA, 22 bp, Homo sapiens
cgtgccactgcactctagcctg

SEQ ID NO: 9346095 - DNA, 22 bp, Homo sapiens
cgtgccctgcgcaagtgctgct

SEQ ID NO: 9346096 - DNA, 22 bp, Homo sapiens
cgtgatttgcaaattgaggcag

SEQ ID NO: 9346097 - DNA, 22 bp, Homo sapiens
cgtgattttgttgactggggcc

SEQ ID NO: 9346098 - DNA, 22 bp, Homo sapiens
cgtgatttatggtctggtggcg

SEQ ID NO: 9346099 - DNA, 22 bp, Homo sapiens
cgtgatttctggctttctatat

SEQ ID NO: 9346100 - DNA, 22 bp, Homo sapiens
cgtgccactgcactctagcctg

SEQ ID NO: 9346101 - DNA, 22 bp, Homo sapiens
cgcggtggcggcctccagcgcc

SEQ ID NO: 9346102 - DNA, 22 bp, Homo sapiens
cgcggtggcggcctccagcgcc

SEQ ID NO: 9346103 - DNA, 22 bp, Homo sapiens
cgcgctgcagacagcggaggcc

SEQ ID NO: 9346104 - DNA, 22 bp, Homo sapiens
cgcgaggtggaggttgcagtga

SEQ ID NO: 9346105 - DNA, 22 bp, Homo sapiens
cgcctgggagtccacacctgct

SEQ ID NO: 9346106 - DNA, 22 bp, Homo sapiens
cgcctgggagtccacacctgct

SEQ ID NO: 9346107 - DNA, 22 bp, Homo sapiens
cgcctggatgttcacgggcagc

SEQ ID NO: 9346108 - DNA, 22 bp, Homo sapiens
ctaaacatcttgcaatgcacag

SEQ ID NO: 9346109 - DNA, 22 bp, Homo sapiens
ctaaacaagggattataattga

SEQ ID NO: 9346110 - DNA, 22 bp, Homo sapiens
ctaaacatgttggtgctttaaa

SEQ ID NO: 9346111 - DNA, 22 bp, Homo sapiens
ctaaacatgttggtgctttaaa

SEQ ID NO: 9346112 - DNA, 22 bp, Homo sapiens
ctaaacatgtagcttttgtggt

SEQ ID NO: 9346113 - DNA, 22 bp, Homo sapiens
ctaaacatgtagcttttgtggt

SEQ ID NO: 9346114 - DNA, 22 bp, Homo sapiens
ctaaacatgcaagagcttctgg

SEQ ID NO: 9346115 - DNA, 22 bp, Homo sapiens
ctaaacatggcttagaacactc

SEQ ID NO: 9346116 - DNA, 22 bp, Homo sapiens
ctaaacatgaactacatttagg

SEQ ID NO: 9346117 - DNA, 22 bp, Homo sapiens
ctaaacatgaactacatttagg

SEQ ID NO: 9346118 - DNA, 22 bp, Homo sapiens
ctaaacatcttgcaatgcacag

SEQ ID NO: 9346119 - DNA, 22 bp, Homo sapiens
ctaaaattatcaagataattcc

SEQ ID NO: 9346120 - DNA, 22 bp, Homo sapiens
ctaaaattatcaagataattcc

SEQ ID NO: 9346121 - DNA, 20 bp, Homo sapiens
cgtgctgtgaccttgagcat

SEQ ID NO: 9346122 - DNA, 19 bp, Homo sapiens
cgtggagctggcaggcagg

SEQ ID NO: 9346123 - DNA, 22 bp, Homo sapiens
cgtggccacccagtggtgcgtg

SEQ ID NO: 9346124 - DNA, 22 bp, Homo sapiens
cgtggccacccagtggtgcgtg

SEQ ID NO: 9346125 - DNA, 22 bp, Homo sapiens
cgtggccagcacaaggcagtga

SEQ ID NO: 9346126 - DNA, 22 bp, Homo sapiens
cgtggccagccatttcctggaa

SEQ ID NO: 9346127 - DNA, 22 bp, Homo sapiens
cgtggccagtttcaagctacca

SEQ ID NO: 9346128 - DNA, 22 bp, Homo sapiens
cgtggccagccatttcctggaa

SEQ ID NO: 9346129 - DNA, 19 bp, Homo sapiens
ccatgcagcctgggggcag

SEQ ID NO: 9346130 - DNA, 18 bp, Homo sapiens
ccatggctccctcctgcc

SEQ ID NO: 9346131 - DNA, 22 bp, Homo sapiens
ccatggctccttgccctgtagc

SEQ ID NO: 9346132 - DNA, 22 bp, Homo sapiens
ccatggcttctttctctgccag

SEQ ID NO: 9346133 - DNA, 22 bp, Homo sapiens
ccatggctgcaattcttctgga

SEQ ID NO: 9346134 - DNA, 22 bp, Homo sapiens
ccatggcttacagatggagcat

SEQ ID NO: 9346135 - DNA, 22 bp, Homo sapiens
ccatggcttttgagtctcaaga

SEQ ID NO: 9346136 - DNA, 22 bp, Homo sapiens
ccatggcttttgagtctcaaga

SEQ ID NO: 9346137 - DNA, 22 bp, Homo sapiens
ccatggcttggaaagggaggtg

SEQ ID NO: 9346138 - DNA, 22 bp, Homo sapiens
aggctgaggtaggaggatcgct

SEQ ID NO: 9346139 - DNA, 22 bp, Homo sapiens
aggctgaggtaggaggatcgct

SEQ ID NO: 9346140 - DNA, 22 bp, Homo sapiens
aggctgaggtgtgctgtgatcg

SEQ ID NO: 9346141 - DNA, 22 bp, Homo sapiens
aggctgaggtgtgctgtgatcg

SEQ ID NO: 9346142 - DNA, 22 bp, Homo sapiens
aggctgaggtgtgctgtgatcg

SEQ ID NO: 9346143 - DNA, 22 bp, Homo sapiens
aggctgagtcgggaggatcact

SEQ ID NO: 9346144 - DNA, 22 bp, Homo sapiens
aggctgagtcgggaggatcact

SEQ ID NO: 9346145 - DNA, 22 bp, Homo sapiens
aggctgagtcgggaggatcact

SEQ ID NO: 9346146 - DNA, 22 bp, Homo sapiens
aggctgagtcaagttagggtga

SEQ ID NO: 9346147 - DNA, 22 bp, Homo sapiens
aggctgagtcgggaggatcact

SEQ ID NO: 9346148 - DNA, 22 bp, Homo sapiens
aggctgaggtgtgctgtgatcg

SEQ ID NO: 9346149 - DNA, 22 bp, Homo sapiens
aggctgaggtgtgctgtgatcg

SEQ ID NO: 9346150 - DNA, 22 bp, Homo sapiens
aggctgagtcaagttagggtga

SEQ ID NO: 9346151 - DNA, 22 bp, Homo sapiens
aggctgagtcaagttagggtga

SEQ ID NO: 9346152 - DNA, 20 bp, Homo sapiens
aggctgagggtgattgtgtc

SEQ ID NO: 9346153 - DNA, 22 bp, Homo sapiens
aggctgaggggcgagggaccct

SEQ ID NO: 9346154 - DNA, 20 bp, Homo sapiens
aggctgagggtgattgtgtc

SEQ ID NO: 9346155 - DNA, 20 bp, Homo sapiens
aggctgagggtgattgtgtc

SEQ ID NO: 9346156 - DNA, 20 bp, Homo sapiens
aggctgagggtgattgtgtc

SEQ ID NO: 9346157 - DNA, 20 bp, Homo sapiens
aggctgagggtgattgtgtc

SEQ ID NO: 9346158 - DNA, 22 bp, Homo sapiens
aggctgaggtaggaggatcgct

SEQ ID NO: 9346159 - DNA, 22 bp, Homo sapiens
aggctgaggtaggaggatcgct

SEQ ID NO: 9346160 - DNA, 22 bp, Homo sapiens
aggctctgtgcatcctccccaa

SEQ ID NO: 9346161 - DNA, 22 bp, Homo sapiens
aggctctgtgcatcctccccaa

SEQ ID NO: 9346162 - DNA, 22 bp, Homo sapiens
aggctctgttattctagagggc

SEQ ID NO: 9346163 - DNA, 22 bp, Homo sapiens
aggctctgtgcagcctgcatct

SEQ ID NO: 9346164 - DNA, 22 bp, Homo sapiens
aggctgaggggcgagggaccct

SEQ ID NO: 9346165 - DNA, 22 bp, Homo sapiens
aggctgaggggcgagggaccct

SEQ ID NO: 9346166 - DNA, 22 bp, Homo sapiens
aggctgaggcgggtagatcacc

SEQ ID NO: 9346167 - DNA, 22 bp, Homo sapiens
aggctgaggcgggtagatcacc

SEQ ID NO: 9346168 - DNA, 22 bp, Homo sapiens
aggctctgtgactaaagaggat

SEQ ID NO: 9346169 - DNA, 22 bp, Homo sapiens
aggctctgtgactaaagaggat

SEQ ID NO: 9346170 - DNA, 22 bp, Homo sapiens
aggctctgtgactaaagaggat

SEQ ID NO: 9346171 - DNA, 22 bp, Homo sapiens
aggctctgtgacaatcaagctg

SEQ ID NO: 9346172 - DNA, 22 bp, Homo sapiens
aggctctgtgacaatcaagctg

SEQ ID NO: 9346173 - DNA, 22 bp, Homo sapiens
aggctctgtgacaatcaagctg

SEQ ID NO: 9346174 - DNA, 22 bp, Homo sapiens
aggctctgtgacaatcaagctg

SEQ ID NO: 9346175 - DNA, 22 bp, Homo sapiens
aggctctgtgacaatcaagctg

SEQ ID NO: 9346176 - DNA, 22 bp, Homo sapiens
ccagggtgctctgtggcgtcgc

SEQ ID NO: 9346177 - DNA, 22 bp, Homo sapiens
aggctctgtcaggcggagcagc

SEQ ID NO: 9346178 - DNA, 21 bp, Homo sapiens
aggctctgtgaatatgtttcc

SEQ ID NO: 9346179 - DNA, 22 bp, Homo sapiens
aggctctgtgcagcctgcatct

SEQ ID NO: 9346180 - DNA, 22 bp, Homo sapiens
aggctctgtgcagcctgcatct

SEQ ID NO: 9346181 - DNA, 22 bp, Homo sapiens
aggctctgtgcagcctgcatct

SEQ ID NO: 9346182 - DNA, 22 bp, Homo sapiens
aggctctgtgatgtgccaggca

SEQ ID NO: 9346183 - DNA, 22 bp, Homo sapiens
aggctctgtgatgtgccaggca

SEQ ID NO: 9346184 - DNA, 22 bp, Homo sapiens
aggctctgtgatgtgccaggca

SEQ ID NO: 9346185 - DNA, 22 bp, Homo sapiens
aggctctgtgatccacaatgag

SEQ ID NO: 9346186 - DNA, 22 bp, Homo sapiens
aggctctgtgatgtgccaggca

SEQ ID NO: 9346187 - DNA, 22 bp, Homo sapiens
aggctctgtgatgtgccaggca

SEQ ID NO: 9346188 - DNA, 22 bp, Homo sapiens
aggctctgtgatccacaatgag

SEQ ID NO: 9346189 - DNA, 22 bp, Homo sapiens
aggctctgtgatccacaatgag

SEQ ID NO: 9346190 - DNA, 20 bp, Homo sapiens
aggctgcctaaggctctgca

SEQ ID NO: 9346191 - DNA, 22 bp, Homo sapiens
ccatgtacatgaacacggcggc

SEQ ID NO: 9346192 - DNA, 19 bp, Homo sapiens
aggctgcctcaccctccct

SEQ ID NO: 9346193 - DNA, 22 bp, Homo sapiens
aggctgcctcgtgagctcgctg

SEQ ID NO: 9346194 - DNA, 22 bp, Homo sapiens
aggctgcctaggttcaacacct

SEQ ID NO: 9346195 - DNA, 22 bp, Homo sapiens
aggctgcctaggttcaacacct

SEQ ID NO: 9346196 - DNA, 20 bp, Homo sapiens
aggctgcctaaggctctgca

SEQ ID NO: 9346197 - DNA, 20 bp, Homo sapiens
aggctgcctaaggctctgca

SEQ ID NO: 9346198 - DNA, 22 bp, Homo sapiens
ccatgggcactgggtggaggta

SEQ ID NO: 9346199 - DNA, 22 bp, Homo sapiens
ccatgggaattgggaggtccca

SEQ ID NO: 9346200 - DNA, 22 bp, Homo sapiens
aggctgcgttagcctcactccc

SEQ ID NO: 9346201 - DNA, 22 bp, Homo sapiens
aggctgctataaacattcccgt

SEQ ID NO: 9346202 - DNA, 22 bp, Homo sapiens
aggctgctataaacattcccgt

SEQ ID NO: 9346203 - DNA, 22 bp, Homo sapiens
aggctgctcacctccctgtctg

SEQ ID NO: 9346204 - DNA, 22 bp, Homo sapiens
aggctgcctgttccaatctcct

SEQ ID NO: 9346205 - DNA, 22 bp, Homo sapiens
aggctgcctgttccaatctcct

SEQ ID NO: 9346206 - DNA, 22 bp, Homo sapiens
aggctgcctcttttgagagggt

SEQ ID NO: 9346207 - DNA, 22 bp, Homo sapiens
aggctgcctcttttgagagggt

SEQ ID NO: 9346208 - DNA, 22 bp, Homo sapiens
aggctgcctggctgtgagtgaa

SEQ ID NO: 9346209 - DNA, 22 bp, Homo sapiens
aggctgcctcgtgagctcgctg

SEQ ID NO: 9346210 - DNA, 22 bp, Homo sapiens
aggctgcctcgtgagctcgctg

SEQ ID NO: 9346211 - DNA, 22 bp, Homo sapiens
aggctgcctctgcaggatccct

SEQ ID NO: 9346212 - DNA, 22 bp, Homo sapiens
aggctgcctctgcaggatccct

SEQ ID NO: 9346213 - DNA, 22 bp, Homo sapiens
aggctgcctctgcaggatccct

SEQ ID NO: 9346214 - DNA, 22 bp, Homo sapiens
cccagagccgctcccctacttc

SEQ ID NO: 9346215 - DNA, 20 bp, Homo sapiens
cccagagccatagccagaca

SEQ ID NO: 9346216 - DNA, 22 bp, Homo sapiens
cccagagccgctcccctacttc

SEQ ID NO: 9346217 - DNA, 22 bp, Homo sapiens
cccagagcatgtgctgcctttg

SEQ ID NO: 9346218 - DNA, 22 bp, Homo sapiens
cccagagcatgtgctgcctttg

SEQ ID NO: 9346219 - DNA, 20 bp, Homo sapiens
cccagagccatagccagaca

SEQ ID NO: 9346220 - DNA, 20 bp, Homo sapiens
cccagagccatagccagaca

SEQ ID NO: 9346221 - DNA, 20 bp, Homo sapiens
cccagagccatagccagaca

SEQ ID NO: 9346222 - DNA, 20 bp, Homo sapiens
cccagagccatagccagaca

SEQ ID NO: 9346223 - DNA, 22 bp, Homo sapiens
cccagagcataacgtatcttga

SEQ ID NO: 9346224 - DNA, 20 bp, Homo sapiens
cccagagcactttttcatgt

SEQ ID NO: 9346225 - DNA, 22 bp, Homo sapiens
cccagagcatgtgctgcctttg

SEQ ID NO: 9346226 - DNA, 19 bp, Homo sapiens
cccagagcatcctgaactt

SEQ ID NO: 9346227 - DNA, 23 bp, Homo sapiens
cccagagcacagcctccagatgc

SEQ ID NO: 9346228 - DNA, 23 bp, Homo sapiens
cccagagcacagcctccagatgc

SEQ ID NO: 9346229 - DNA, 23 bp, Homo sapiens
cccagagcacagcctccagatgc

SEQ ID NO: 9346230 - DNA, 22 bp, Homo sapiens
aggctggctcggcttttctgtc

SEQ ID NO: 9346231 - DNA, 22 bp, Homo sapiens
aggctggctcggcttttctgtc

SEQ ID NO: 9346232 - DNA, 22 bp, Homo sapiens
aggctggctcggcttttctgtc

SEQ ID NO: 9346233 - DNA, 22 bp, Homo sapiens
aggctggctgacttctgaagca

SEQ ID NO: 9346234 - DNA, 22 bp, Homo sapiens
aggctggctgaaaaacaccctt

SEQ ID NO: 9346235 - DNA, 22 bp, Homo sapiens
aggctggctgaaaaacaccctt

SEQ ID NO: 9346236 - DNA, 17 bp, Homo sapiens
aggctggctcacaggga

SEQ ID NO: 9346237 - DNA, 17 bp, Homo sapiens
aggctggctcacaggga

SEQ ID NO: 9346238 - DNA, 17 bp, Homo sapiens
aggctggctcacaggga

SEQ ID NO: 9346239 - DNA, 17 bp, Homo sapiens
aggctggctcacaggga

SEQ ID NO: 9346240 - DNA, 22 bp, Homo sapiens
aggctggcgtcaggggctgtac

SEQ ID NO: 9346241 - DNA, 21 bp, Homo sapiens
cccagagcctagggagggcac

SEQ ID NO: 9346242 - DNA, 21 bp, Homo sapiens
cccagagcctagggagggcac

SEQ ID NO: 9346243 - DNA, 22 bp, Homo sapiens
cccagagccggtggtgctcaca

SEQ ID NO: 9346244 - DNA, 21 bp, Homo sapiens
cccagagcctagggagggcac

SEQ ID NO: 9346245 - DNA, 22 bp, Homo sapiens
cccagagccggtggtgctcaca

SEQ ID NO: 9346246 - DNA, 22 bp, Homo sapiens
cccagagccggtggtgctcaca

SEQ ID NO: 9346247 - DNA, 23 bp, Homo sapiens
aggctccacatgggcactttgca

SEQ ID NO: 9346248 - DNA, 22 bp, Homo sapiens
aggctccaccagtcaggtgcat

SEQ ID NO: 9346249 - DNA, 22 bp, Homo sapiens
aggctccaccagtcaggtgcat

SEQ ID NO: 9346250 - DNA, 22 bp, Homo sapiens
aggctccaccctacagagctcc

SEQ ID NO: 9346251 - DNA, 22 bp, Homo sapiens
aggctccaccccgccagacctt

SEQ ID NO: 9346252 - DNA, 22 bp, Homo sapiens
aggctccaccctacagagctcc

SEQ ID NO: 9346253 - DNA, 22 bp, Homo sapiens
aggctccaccctacagagctcc

SEQ ID NO: 9346254 - DNA, 22 bp, Homo sapiens
ccagggaaggctctgcctgctt

SEQ ID NO: 9346255 - DNA, 22 bp, Homo sapiens
aggctcagttcacgtcaacttt

SEQ ID NO: 9346256 - DNA, 22 bp, Homo sapiens
aggctcagttcacgtcaacttt

SEQ ID NO: 9346257 - DNA, 22 bp, Homo sapiens
aggctcagttctgtggtgagcc

SEQ ID NO: 9346258 - DNA, 22 bp, Homo sapiens
aggctcagttctgtggtgagcc

SEQ ID NO: 9346259 - DNA, 22 bp, Homo sapiens
aggctccaaattaccaagctct

SEQ ID NO: 9346260 - DNA, 22 bp, Homo sapiens
aggctcagtttggtttccattg

SEQ ID NO: 9346261 - DNA, 22 bp, Homo sapiens
aggctcagtatagctggcaagt

SEQ ID NO: 9346262 - DNA, 22 bp, Homo sapiens
aggctcaggtgcctcattcaca

SEQ ID NO: 9346263 - DNA, 22 bp, Homo sapiens
aggctcagtatagctggcaagt

SEQ ID NO: 9346264 - DNA, 22 bp, Homo sapiens
aggctcagtcccggcccgcgcc

SEQ ID NO: 9346265 - DNA, 22 bp, Homo sapiens
aggctcagtctgttcatgcact

SEQ ID NO: 9346266 - DNA, 22 bp, Homo sapiens
aggctcagtcccggcccgcgcc

SEQ ID NO: 9346267 - DNA, 22 bp, Homo sapiens
aggctcagtgcaaatcattctg

SEQ ID NO: 9346268 - DNA, 22 bp, Homo sapiens
aggctcagtgatgtaaaatata

SEQ ID NO: 9346269 - DNA, 22 bp, Homo sapiens
aggctcagtctgttcatgcact

SEQ ID NO: 9346270 - DNA, 22 bp, Homo sapiens
aggctcagtctgttcatgcact

SEQ ID NO: 9346271 - DNA, 22 bp, Homo sapiens
ccaggagctggagggtgcagtg

SEQ ID NO: 9346272 - DNA, 22 bp, Homo sapiens
ccaggagctggcatgtggagag

SEQ ID NO: 9346273 - DNA, 22 bp, Homo sapiens
ccaggaggaaattctaaaggta

SEQ ID NO: 9346274 - DNA, 22 bp, Homo sapiens
ccagggtcttggagaggagtgc

SEQ ID NO: 9346275 - DNA, 22 bp, Homo sapiens
ccagggtcttcgaggcagcaat

SEQ ID NO: 9346276 - DNA, 22 bp, Homo sapiens
ccagggtgaccagctggcctag

SEQ ID NO: 9346277 - DNA, 22 bp, Homo sapiens
ccagggtgaccctcccggtggc

SEQ ID NO: 9346278 - DNA, 22 bp, Homo sapiens
ccagggtgagaaaaggctggat

SEQ ID NO: 9346279 - DNA, 22 bp, Homo sapiens
ccagggtgaccctcccggtggc

SEQ ID NO: 9346280 - DNA, 22 bp, Homo sapiens
ccagggtgagtgtcatgggtta

SEQ ID NO: 9346281 - DNA, 22 bp, Homo sapiens
ccagggtgagtgtcatgggtta

SEQ ID NO: 9346282 - DNA, 22 bp, Homo sapiens
ccagggtgctctgtggcgtcgc

SEQ ID NO: 9346283 - DNA, 22 bp, Homo sapiens
ccagggtgaggaggctcccacg

SEQ ID NO: 9346284 - DNA, 22 bp, Homo sapiens
ccagggtgagtgtcatgggtta

SEQ ID NO: 9346285 - DNA, 22 bp, Homo sapiens
ccagggtgaggaggctcccacg

SEQ ID NO: 9346286 - DNA, 22 bp, Homo sapiens
ccagggtgaggaggctcccacg

SEQ ID NO: 9346287 - DNA, 22 bp, Homo sapiens
aggctccttcacagcactcgcc

SEQ ID NO: 9346288 - DNA, 22 bp, Homo sapiens
aggctccttgctcacaggctca

SEQ ID NO: 9346289 - DNA, 22 bp, Homo sapiens
aggctccttgctcacaggctca

SEQ ID NO: 9346290 - DNA, 22 bp, Homo sapiens
ccagggcttaacttttcaggag

SEQ ID NO: 9346291 - DNA, 22 bp, Homo sapiens
ccagggcttcagaggttttggc

SEQ ID NO: 9346292 - DNA, 22 bp, Homo sapiens
aggctcctgcaggccttgtagg

SEQ ID NO: 9346293 - DNA, 22 bp, Homo sapiens
aggctcctgagaggcagaggct

SEQ ID NO: 9346294 - DNA, 22 bp, Homo sapiens
aggctcctgggtgtggccgcca

SEQ ID NO: 9346295 - DNA, 22 bp, Homo sapiens
aggctcctgcaggtgaggtgct

SEQ ID NO: 9346296 - DNA, 20 bp, Homo sapiens
aggctcctgtacctgaggaa

SEQ ID NO: 9346297 - DNA, 20 bp, Homo sapiens
aggctcctgtacctgaggaa

SEQ ID NO: 9346298 - DNA, 22 bp, Homo sapiens
ccagggaaggctgctggctgtg

SEQ ID NO: 9346299 - DNA, 22 bp, Homo sapiens
ccagggaagtcacattgtctag

SEQ ID NO: 9346300 - DNA, 22 bp, Homo sapiens
ccagggaatgtgggatgactct

SEQ ID NO: 9346301 - DNA, 22 bp, Homo sapiens
ccagggaatcaggcagaagtca

SEQ ID NO: 9346302 - DNA, 22 bp, Homo sapiens
ccagggaatctctgagtgtgtt

SEQ ID NO: 9346303 - DNA, 22 bp, Homo sapiens
ccagggagcctggtgtgtcagc

SEQ ID NO: 9346304 - DNA, 22 bp, Homo sapiens
ccagggagcggggctgggtctc

SEQ ID NO: 9346305 - DNA, 22 bp, Homo sapiens
ccagggagcccacaggacaatg

SEQ ID NO: 9346306 - DNA, 22 bp, Homo sapiens
ccagggagcccacaggacaatg

SEQ ID NO: 9346307 - DNA, 22 bp, Homo sapiens
ccagggagcccacaggacaatg

SEQ ID NO: 9346308 - DNA, 17 bp, Homo sapiens
aggctcctcctaaggtc

SEQ ID NO: 9346309 - DNA, 22 bp, Homo sapiens
aggctcctcggggctgacggcg

SEQ ID NO: 9346310 - DNA, 22 bp, Homo sapiens
aggctcctgagaggcagaggct

SEQ ID NO: 9346311 - DNA, 22 bp, Homo sapiens
aggctcctgagaggcagaggct

SEQ ID NO: 9346312 - DNA, 20 bp, Homo sapiens
aggctcctccaggatgtgtg

SEQ ID NO: 9346313 - DNA, 22 bp, Homo sapiens
aggctcctagcctgtggctggt

SEQ ID NO: 9346314 - DNA, 22 bp, Homo sapiens
aggctcctagcctgtggctggt

SEQ ID NO: 9346315 - DNA, 17 bp, Homo sapiens
ccagggaggggccgcgc

SEQ ID NO: 9346316 - DNA, 17 bp, Homo sapiens
ccagggaggggccgcgc

SEQ ID NO: 9346317 - DNA, 22 bp, Homo sapiens
ccagggagcggggctgggtctc

SEQ ID NO: 9346318 - DNA, 22 bp, Homo sapiens
aggcaggggagctggaagggta

SEQ ID NO: 9346319 - DNA, 22 bp, Homo sapiens
aggcaggggagctggaagggta

SEQ ID NO: 9346320 - DNA, 22 bp, Homo sapiens
aggcaggggagctggaagggta

SEQ ID NO: 9346321 - DNA, 22 bp, Homo sapiens
aggcagggtgatgataatgatt

SEQ ID NO: 9346322 - DNA, 22 bp, Homo sapiens
aggcagggtgatgataatgatt

SEQ ID NO: 9346323 - DNA, 22 bp, Homo sapiens
aggcagggtgatgataatgatt

SEQ ID NO: 9346324 - DNA, 22 bp, Homo sapiens
aggcagggtcttgctatgttgc

SEQ ID NO: 9346325 - DNA, 17 bp, Homo sapiens
aggcaggtaagagttat

SEQ ID NO: 9346326 - DNA, 17 bp, Homo sapiens
ccacagctgggtgcctt

SEQ ID NO: 9346327 - DNA, 22 bp, Homo sapiens
aggcagggtgatgataatgatt

SEQ ID NO: 9346328 - DNA, 17 bp, Homo sapiens
aggcaggtaagagttat

SEQ ID NO: 9346329 - DNA, 22 bp, Homo sapiens
aggcagggtgatgataatgatt

SEQ ID NO: 9346330 - DNA, 21 bp, Homo sapiens
ccacagctggtctctgagccc

SEQ ID NO: 9346331 - DNA, 22 bp, Homo sapiens
ccacagcttcttatatcactgg

SEQ ID NO: 9346332 - DNA, 22 bp, Homo sapiens
ccacaggacacaactgctgacc

SEQ ID NO: 9346333 - DNA, 22 bp, Homo sapiens
ccacaggacacaactgctgacc

SEQ ID NO: 9346334 - DNA, 22 bp, Homo sapiens
ccagagagtatcatggagagta

SEQ ID NO: 9346335 - DNA, 22 bp, Homo sapiens
ccagagagtaggaggcattatt

SEQ ID NO: 9346336 - DNA, 22 bp, Homo sapiens
ccacaggacggaggtctggccg

SEQ ID NO: 9346337 - DNA, 22 bp, Homo sapiens
ccacaggatccaagggaaggca

SEQ ID NO: 9346338 - DNA, 23 bp, Homo sapiens
ccacaggcacagaggcttgcatc

SEQ ID NO: 9346339 - DNA, 22 bp, Homo sapiens
ccagagaaagtgaagcaaatgt

SEQ ID NO: 9346340 - DNA, 22 bp, Homo sapiens
ccagcactgctctcagactgag

SEQ ID NO: 9346341 - DNA, 22 bp, Homo sapiens
ccagcactgctctcagactgag

SEQ ID NO: 9346342 - DNA, 22 bp, Homo sapiens
ccagcactgttctaaggaaaca

SEQ ID NO: 9346343 - DNA, 22 bp, Homo sapiens
ccagcagaagctcccgctgggt

SEQ ID NO: 9346344 - DNA, 22 bp, Homo sapiens
ccagcagagcatggggaggaag

SEQ ID NO: 9346345 - DNA, 22 bp, Homo sapiens
aggccagaaatttggagtatgt

SEQ ID NO: 9346346 - DNA, 22 bp, Homo sapiens
aggccagaaatttggagtatgt

SEQ ID NO: 9346347 - DNA, 22 bp, Homo sapiens
aggccagaaatgtcagggagtg

SEQ ID NO: 9346348 - DNA, 22 bp, Homo sapiens
ccagcagaggggcggagtgcag

SEQ ID NO: 9346349 - DNA, 22 bp, Homo sapiens
aggccagaagccagaaatgctt

SEQ ID NO: 9346350 - DNA, 22 bp, Homo sapiens
aggccagaagtcaaaaactcta

SEQ ID NO: 9346351 - DNA, 22 bp, Homo sapiens
aggccagaacagctctgcacca

SEQ ID NO: 9346352 - DNA, 22 bp, Homo sapiens
aggccagaacagctctgcacca

SEQ ID NO: 9346353 - DNA, 22 bp, Homo sapiens
aggccagacagctagaaacagg

SEQ ID NO: 9346354 - DNA, 22 bp, Homo sapiens
aggccagactttggccaaatcc

SEQ ID NO: 9346355 - DNA, 22 bp, Homo sapiens
aggccagactttggccaaatcc

SEQ ID NO: 9346356 - DNA, 22 bp, Homo sapiens
aggccagagaggggaccagcct

SEQ ID NO: 9346357 - DNA, 22 bp, Homo sapiens
aggccagagaggggaccagcct

SEQ ID NO: 9346358 - DNA, 22 bp, Homo sapiens
ccagagcagaaccggaacacca

SEQ ID NO: 9346359 - DNA, 22 bp, Homo sapiens
ccagagcagaaccggaacacca

SEQ ID NO: 9346360 - DNA, 22 bp, Homo sapiens
ccagagcagaaccggaacacca

SEQ ID NO: 9346361 - DNA, 22 bp, Homo sapiens
ccagagcagatgtggccttggt

SEQ ID NO: 9346362 - DNA, 22 bp, Homo sapiens
ccagagcagatgtggccttggt

SEQ ID NO: 9346363 - DNA, 22 bp, Homo sapiens
ccagagcagatgtggccttggt

SEQ ID NO: 9346364 - DNA, 17 bp, Homo sapiens
ccagagatgcctcaggc

SEQ ID NO: 9346365 - DNA, 22 bp, Homo sapiens
aggcatggacatttcggcagct

SEQ ID NO: 9346366 - DNA, 22 bp, Homo sapiens
aggcatggacatttcggcagct

SEQ ID NO: 9346367 - DNA, 22 bp, Homo sapiens
aggcatggacatttcggcagct

SEQ ID NO: 9346368 - DNA, 22 bp, Homo sapiens
aggcatggatggatccagggct

SEQ ID NO: 9346369 - DNA, 22 bp, Homo sapiens
aggcatggatggatccagggct

SEQ ID NO: 9346370 - DNA, 21 bp, Homo sapiens
aggcatggaaatggcacactg

SEQ ID NO: 9346371 - DNA, 21 bp, Homo sapiens
aggcatggaaatggcacactg

SEQ ID NO: 9346372 - DNA, 23 bp, Homo sapiens
aggcatggcatggatggtggctc

SEQ ID NO: 9346373 - DNA, 23 bp, Homo sapiens
aggcatggcatggatggtggctc

SEQ ID NO: 9346374 - DNA, 22 bp, Homo sapiens
aggcatggatgtagcagtgacc

SEQ ID NO: 9346375 - DNA, 22 bp, Homo sapiens
aggcatggatgtagcagtgacc

SEQ ID NO: 9346376 - DNA, 22 bp, Homo sapiens
aggcatggatgtagcagtgacc

SEQ ID NO: 9346377 - DNA, 22 bp, Homo sapiens
aggcatggcactgagcagcttc

SEQ ID NO: 9346378 - DNA, 17 bp, Homo sapiens
aggccagatgaggcaag

SEQ ID NO: 9346379 - DNA, 17 bp, Homo sapiens
aggccagatgaggcaag

SEQ ID NO: 9346380 - DNA, 22 bp, Homo sapiens
aggccagatattgtgctaccca

SEQ ID NO: 9346381 - DNA, 22 bp, Homo sapiens
aggccagatattgtgctaccca

SEQ ID NO: 9346382 - DNA, 22 bp, Homo sapiens
aggccagagttaaggagaacag

SEQ ID NO: 9346383 - DNA, 22 bp, Homo sapiens
aggccagagttaaggagaacag

SEQ ID NO: 9346384 - DNA, 22 bp, Homo sapiens
aggccagagttaaggagaacag

SEQ ID NO: 9346385 - DNA, 22 bp, Homo sapiens
ccagccctgccagagagagctg

SEQ ID NO: 9346386 - DNA, 22 bp, Homo sapiens
aggccagatgtcgggctagaag

SEQ ID NO: 9346387 - DNA, 22 bp, Homo sapiens
aggccagatgtcgggctagaag

SEQ ID NO: 9346388 - DNA, 22 bp, Homo sapiens
ccagcctcatcgcctgcctgtc

SEQ ID NO: 9346389 - DNA, 23 bp, Homo sapiens
ccagcctctgggtcttcatccag

SEQ ID NO: 9346390 - DNA, 22 bp, Homo sapiens
ccagcctgaaatgcctcatcct

SEQ ID NO: 9346391 - DNA, 22 bp, Homo sapiens
ccagcctgaaatgcctcatcct

SEQ ID NO: 9346392 - DNA, 19 bp, Homo sapiens
ccagcctctcttccacccc

SEQ ID NO: 9346393 - DNA, 22 bp, Homo sapiens
ccagcctccatgtagatagctg

SEQ ID NO: 9346394 - DNA, 22 bp, Homo sapiens
ccagcctccatgtagatagctg

SEQ ID NO: 9346395 - DNA, 22 bp, Homo sapiens
ccagcctccatgtagatagctg

SEQ ID NO: 9346396 - DNA, 22 bp, Homo sapiens
ccagcctccatgtagatagctg

SEQ ID NO: 9346397 - DNA, 22 bp, Homo sapiens
ccagcctcatcgcctgcctgtc

SEQ ID NO: 9346398 - DNA, 22 bp, Homo sapiens
ccagcctcatcgcctgcctgtc

SEQ ID NO: 9346399 - DNA, 22 bp, Homo sapiens
ccagcttctctgttccagcccc

SEQ ID NO: 9346400 - DNA, 22 bp, Homo sapiens
ccagcttctctgttccagcccc

SEQ ID NO: 9346401 - DNA, 22 bp, Homo sapiens
ccagcttctctctgatgcagct

SEQ ID NO: 9346402 - DNA, 19 bp, Homo sapiens
ccagctggcctgggacctc

SEQ ID NO: 9346403 - DNA, 22 bp, Homo sapiens
ccagcttctctctgatgcagct

SEQ ID NO: 9346404 - DNA, 19 bp, Homo sapiens
ccagctggcctgggacctc

SEQ ID NO: 9346405 - DNA, 22 bp, Homo sapiens
ccagctggcccagctgtgctcc

SEQ ID NO: 9346406 - DNA, 22 bp, Homo sapiens
aggcccagctggacaaactgct

SEQ ID NO: 9346407 - DNA, 22 bp, Homo sapiens
ccagctttaggttgcctgccag

SEQ ID NO: 9346408 - DNA, 22 bp, Homo sapiens
ccagctttccagggttgactgg

SEQ ID NO: 9346409 - DNA, 21 bp, Homo sapiens
ccagctttcccaagtcccttt

SEQ ID NO: 9346410 - DNA, 22 bp, Homo sapiens
ccagctttatcaagtctgagct

SEQ ID NO: 9346411 - DNA, 22 bp, Homo sapiens
ccagctttcatatcatgaggta

SEQ ID NO: 9346412 - DNA, 22 bp, Homo sapiens
ccagctttatagcttcaaagga

SEQ ID NO: 9346413 - DNA, 19 bp, Homo sapiens
aggcccagcgctgggggct

SEQ ID NO: 9346414 - DNA, 22 bp, Homo sapiens
aggcccagctggacaaactgct

SEQ ID NO: 9346415 - DNA, 19 bp, Homo sapiens
aggcccagcgctgggggct

SEQ ID NO: 9346416 - DNA, 19 bp, Homo sapiens
aggcccagcgctgggggct

SEQ ID NO: 9346417 - DNA, 22 bp, Homo sapiens
aggcccagcccgtcctcgtgct

SEQ ID NO: 9346418 - DNA, 22 bp, Homo sapiens
aggcccagcccgtcctcgtgct

SEQ ID NO: 9346419 - DNA, 22 bp, Homo sapiens
aggcccagcccgtcctcgtgct

SEQ ID NO: 9346420 - DNA, 22 bp, Homo sapiens
ccagcctggactgggtcttgtg

SEQ ID NO: 9346421 - DNA, 22 bp, Homo sapiens
aggcccagagagccagttagtg

SEQ ID NO: 9346422 - DNA, 22 bp, Homo sapiens
aggcccagagagccagttagtg

SEQ ID NO: 9346423 - DNA, 21 bp, Homo sapiens
aggcccagagtcttgggggga

SEQ ID NO: 9346424 - DNA, 22 bp, Homo sapiens
aggcccagagcaggaaagggtt

SEQ ID NO: 9346425 - DNA, 22 bp, Homo sapiens
aggcccagagcaggaaagggtt

SEQ ID NO: 9346426 - DNA, 22 bp, Homo sapiens
ccaggagcgggaaaaggaagaa

SEQ ID NO: 9346427 - DNA, 22 bp, Homo sapiens
ccaggagcgcgtgaacaggctg

SEQ ID NO: 9346428 - DNA, 17 bp, Homo sapiens
ccaggagcgtgggtctc

SEQ ID NO: 9346429 - DNA, 22 bp, Homo sapiens
ccaggagcgggaaaaggaagaa

SEQ ID NO: 9346430 - DNA, 22 bp, Homo sapiens
ccaggagcaaagatcactggga

SEQ ID NO: 9346431 - DNA, 22 bp, Homo sapiens
ccaggagcaaagatcactggga

SEQ ID NO: 9346432 - DNA, 22 bp, Homo sapiens
ccaggagatttttccatagcac

SEQ ID NO: 9346433 - DNA, 22 bp, Homo sapiens
ccaggagatgggaaagtagcag

SEQ ID NO: 9346434 - DNA, 22 bp, Homo sapiens
ccaggagagcaggcgtgcagct

SEQ ID NO: 9346435 - DNA, 22 bp, Homo sapiens
ccaggagagcagaagcccaggc

SEQ ID NO: 9346436 - DNA, 22 bp, Homo sapiens
ccaggagagcagaagcccaggc

SEQ ID NO: 9346437 - DNA, 22 bp, Homo sapiens
ccaggagagcattgcacagagg

SEQ ID NO: 9346438 - DNA, 22 bp, Homo sapiens
ccaggagagctctaaatggctg

SEQ ID NO: 9346439 - DNA, 22 bp, Homo sapiens
ccaggacaagtgtggccatggc

SEQ ID NO: 9346440 - DNA, 22 bp, Homo sapiens
aggccctgggttagggcccact

SEQ ID NO: 9346441 - DNA, 22 bp, Homo sapiens
aggccctgggcagttctgtagc

SEQ ID NO: 9346442 - DNA, 22 bp, Homo sapiens
aggccctgggcagttctgtagc

SEQ ID NO: 9346443 - DNA, 22 bp, Homo sapiens
aggccctgggagcagagatgca

SEQ ID NO: 9346444 - DNA, 22 bp, Homo sapiens
aggccctgggagcagagatgca

SEQ ID NO: 9346445 - DNA, 22 bp, Homo sapiens
aggccctgggagcagagatgca

SEQ ID NO: 9346446 - DNA, 18 bp, Homo sapiens
aggccctggcctcgaaca

SEQ ID NO: 9346447 - DNA, 22 bp, Homo sapiens
aggccctggcccccagagattc

SEQ ID NO: 9346448 - DNA, 22 bp, Homo sapiens
aggccctggcccccagagattc

SEQ ID NO: 9346449 - DNA, 22 bp, Homo sapiens
aggccctggcccccagagattc

SEQ ID NO: 9346450 - DNA, 22 bp, Homo sapiens
aggccctggcactgcctgggag

SEQ ID NO: 9346451 - DNA, 22 bp, Homo sapiens
aggccctggcactgcctgggag

SEQ ID NO: 9346452 - DNA, 22 bp, Homo sapiens
aggccctggcactgcctgggag

SEQ ID NO: 9346453 - DNA, 22 bp, Homo sapiens
ccagcttttcctctcattgctt

SEQ ID NO: 9346454 - DNA, 22 bp, Homo sapiens
ccagcttttcagaatctgcctg

SEQ ID NO: 9346455 - DNA, 22 bp, Homo sapiens
ccagcttttcttatcattataa

SEQ ID NO: 9346456 - DNA, 22 bp, Homo sapiens
ccagcttttggggtgacaattt

SEQ ID NO: 9346457 - DNA, 22 bp, Homo sapiens
ccagcttttgcactggactggg

SEQ ID NO: 9346458 - DNA, 20 bp, Homo sapiens
ccagctttccctgcagcatc

SEQ ID NO: 9346459 - DNA, 22 bp, Homo sapiens
ccagctttcctgcgagttgatt

SEQ ID NO: 9346460 - DNA, 22 bp, Homo sapiens
ccagctttctcagaggcttcta

SEQ ID NO: 9346461 - DNA, 22 bp, Homo sapiens
ccagctttctcagaggcttcta

SEQ ID NO: 9346462 - DNA, 22 bp, Homo sapiens
ccagctttctgggtggtttctg

SEQ ID NO: 9346463 - DNA, 22 bp, Homo sapiens
ccagcttttagtgggcttatta

SEQ ID NO: 9346464 - DNA, 22 bp, Homo sapiens
ccagctttggagtgttgttgct

SEQ ID NO: 9346465 - DNA, 18 bp, Homo sapiens
aggcttcttggctcagtc

SEQ ID NO: 9346466 - DNA, 22 bp, Homo sapiens
aggcttcttgataaaatgcaga

SEQ ID NO: 9346467 - DNA, 22 bp, Homo sapiens
aggcttcttgagccccacaggc

SEQ ID NO: 9346468 - DNA, 22 bp, Homo sapiens
aggcttgcagaatttatgtaat

SEQ ID NO: 9346469 - DNA, 22 bp, Homo sapiens
aggcttgccacttgttagtcta

SEQ ID NO: 9346470 - DNA, 22 bp, Homo sapiens
aggcttgcaatggacacatgtg

SEQ ID NO: 9346471 - DNA, 22 bp, Homo sapiens
aggcttgccacttgttagtcta

SEQ ID NO: 9346472 - DNA, 22 bp, Homo sapiens
aggcttgaaatgaaatctgtaa

SEQ ID NO: 9346473 - DNA, 22 bp, Homo sapiens
aggcttgaaatgaaatctgtaa

SEQ ID NO: 9346474 - DNA, 22 bp, Homo sapiens
aggcttgactgctgattttgcc

SEQ ID NO: 9346475 - DNA, 22 bp, Homo sapiens
cccaggagttggaggctacggt

SEQ ID NO: 9346476 - DNA, 22 bp, Homo sapiens
cccaggagttggaggctacggt

SEQ ID NO: 9346477 - DNA, 22 bp, Homo sapiens
cccaggagttggaggctgcagt

SEQ ID NO: 9346478 - DNA, 22 bp, Homo sapiens
cccaggagttggaggctgcagt

SEQ ID NO: 9346479 - DNA, 22 bp, Homo sapiens
cccaggagttggaggctacggt

SEQ ID NO: 9346480 - DNA, 21 bp, Homo sapiens
aggcttggatctagacaggcc

SEQ ID NO: 9346481 - DNA, 21 bp, Homo sapiens
aggcttggatctagacaggcc

SEQ ID NO: 9346482 - DNA, 22 bp, Homo sapiens
aggcttggaggttctgtagcca

SEQ ID NO: 9346483 - DNA, 21 bp, Homo sapiens
aggcttggatctagacaggcc

SEQ ID NO: 9346484 - DNA, 21 bp, Homo sapiens
aggcttggatctagacaggcc

SEQ ID NO: 9346485 - DNA, 21 bp, Homo sapiens
aggcttggatctagacaggcc

SEQ ID NO: 9346486 - DNA, 22 bp, Homo sapiens
aggctggctggcaggggacaca

SEQ ID NO: 9346487 - DNA, 22 bp, Homo sapiens
aggcttcctcgtgccttagata

SEQ ID NO: 9346488 - DNA, 22 bp, Homo sapiens
aggcttcctggaggaagaggta

SEQ ID NO: 9346489 - DNA, 19 bp, Homo sapiens
aggcttctaccctgtccag

SEQ ID NO: 9346490 - DNA, 22 bp, Homo sapiens
aggctggctgacttctgaagca

SEQ ID NO: 9346491 - DNA, 22 bp, Homo sapiens
aggctggctgagctgcagcctg

SEQ ID NO: 9346492 - DNA, 22 bp, Homo sapiens
aggctggctgagctgcagcctg

SEQ ID NO: 9346493 - DNA, 22 bp, Homo sapiens
aggctggctgacttctgaagca

SEQ ID NO: 9346494 - DNA, 22 bp, Homo sapiens
aggctggctgacttctgaagca

SEQ ID NO: 9346495 - DNA, 22 bp, Homo sapiens
aggctggctgagctgcagcctg

SEQ ID NO: 9346496 - DNA, 22 bp, Homo sapiens
aggctggctgagctgcagcctg

SEQ ID NO: 9346497 - DNA, 22 bp, Homo sapiens
aggctggctggcaggggacaca

SEQ ID NO: 9346498 - DNA, 22 bp, Homo sapiens
aggctggctggcaggggacaca

SEQ ID NO: 9346499 - DNA, 22 bp, Homo sapiens
aggcttctacgtggtcccaggg

SEQ ID NO: 9346500 - DNA, 22 bp, Homo sapiens
aggcttctccttcctaccttcc

SEQ ID NO: 9346501 - DNA, 22 bp, Homo sapiens
aggcttctagggttggcagcgg

SEQ ID NO: 9346502 - DNA, 22 bp, Homo sapiens
aggcttctggaatccagtttct

SEQ ID NO: 9346503 - DNA, 22 bp, Homo sapiens
cccagggcttttctcactagac

SEQ ID NO: 9346504 - DNA, 22 bp, Homo sapiens
cccagggcttttctcactagac

SEQ ID NO: 9346505 - DNA, 22 bp, Homo sapiens
cccagggctgtagaatgtccaa

SEQ ID NO: 9346506 - DNA, 22 bp, Homo sapiens
cccagggctgcagatggaggct

SEQ ID NO: 9346507 - DNA, 19 bp, Homo sapiens
cccaggggacccagcccta

SEQ ID NO: 9346508 - DNA, 22 bp, Homo sapiens
cccaggggtaaggcgcagcgtg

SEQ ID NO: 9346509 - DNA, 22 bp, Homo sapiens
cccagggccctggacagctaca

SEQ ID NO: 9346510 - DNA, 22 bp, Homo sapiens
cccagggctgcagatggaggct

SEQ ID NO: 9346511 - DNA, 23 bp, Homo sapiens
agggaagaaacatgaagggctgt

SEQ ID NO: 9346512 - DNA, 23 bp, Homo sapiens
agggaagaaacatgaagggctgt

SEQ ID NO: 9346513 - DNA, 23 bp, Homo sapiens
agggaagaaacatgaagggctgt

SEQ ID NO: 9346514 - DNA, 21 bp, Homo sapiens
cccagggaagccgcagtcacc

SEQ ID NO: 9346515 - DNA, 22 bp, Homo sapiens
cccaggatggggctgcagttat

SEQ ID NO: 9346516 - DNA, 20 bp, Homo sapiens
agggaacaatggacgctgtc

SEQ ID NO: 9346517 - DNA, 23 bp, Homo sapiens
agggaacaagcaagctgctagtc

SEQ ID NO: 9346518 - DNA, 22 bp, Homo sapiens
agggaacatttgcactgttggt

SEQ ID NO: 9346519 - DNA, 22 bp, Homo sapiens
cccaggagttggaggctgcagt

SEQ ID NO: 9346520 - DNA, 23 bp, Homo sapiens
cccaggagtttcactgcaaaggt

SEQ ID NO: 9346521 - DNA, 22 bp, Homo sapiens
cccaggatgatcgagagtggga

SEQ ID NO: 9346522 - DNA, 22 bp, Homo sapiens
agggagaacagttgcagcagac

SEQ ID NO: 9346523 - DNA, 22 bp, Homo sapiens
agggagaaaattggatgcacaa

SEQ ID NO: 9346524 - DNA, 22 bp, Homo sapiens
agggactcggttgagtgcccct

SEQ ID NO: 9346525 - DNA, 22 bp, Homo sapiens
agggagaaaattggatgcacaa

SEQ ID NO: 9346526 - DNA, 22 bp, Homo sapiens
agggactggctctctgagcagg

SEQ ID NO: 9346527 - DNA, 22 bp, Homo sapiens
agggactggctctctgagcagg

SEQ ID NO: 9346528 - DNA, 22 bp, Homo sapiens
agggaggagtcctcaaagtcat

SEQ ID NO: 9346529 - DNA, 22 bp, Homo sapiens
agggaggagtcctcaaagtcat

SEQ ID NO: 9346530 - DNA, 22 bp, Homo sapiens
agggaggagtcctcaaagtcat

SEQ ID NO: 9346531 - DNA, 22 bp, Homo sapiens
agggagaaggtccatgcctgtc

SEQ ID NO: 9346532 - DNA, 22 bp, Homo sapiens
agggagaaggtttagctgtgag

SEQ ID NO: 9346533 - DNA, 22 bp, Homo sapiens
agggagtggttaagaaggtgca

SEQ ID NO: 9346534 - DNA, 17 bp, Homo sapiens
agggagtcagaggatcg

SEQ ID NO: 9346535 - DNA, 17 bp, Homo sapiens
agggagtcagtaggagc

SEQ ID NO: 9346536 - DNA, 22 bp, Homo sapiens
agggagtccattttagaggtgg

SEQ ID NO: 9346537 - DNA, 22 bp, Homo sapiens
agggatcagtagggacggcagc

SEQ ID NO: 9346538 - DNA, 22 bp, Homo sapiens
agggatcagcagagggtgtggt

SEQ ID NO: 9346539 - DNA, 22 bp, Homo sapiens
agggatcagaatttcctccttt

SEQ ID NO: 9346540 - DNA, 18 bp, Homo sapiens
agggatctagatggagtc

SEQ ID NO: 9346541 - DNA, 22 bp, Homo sapiens
agggatcatcctgcaagtgcct

SEQ ID NO: 9346542 - DNA, 18 bp, Homo sapiens
agggatcatcactgcagc

SEQ ID NO: 9346543 - DNA, 22 bp, Homo sapiens
agggatgatcagggtagaggct

SEQ ID NO: 9346544 - DNA, 22 bp, Homo sapiens
agggatgatcagggtagaggct

SEQ ID NO: 9346545 - DNA, 22 bp, Homo sapiens
agggatgactcttggctgattc

SEQ ID NO: 9346546 - DNA, 22 bp, Homo sapiens
agggatgactcttggctgattc

SEQ ID NO: 9346547 - DNA, 22 bp, Homo sapiens
agggagtgtaaatggtgctcag

SEQ ID NO: 9346548 - DNA, 22 bp, Homo sapiens
agggagttagaaatccaggata

SEQ ID NO: 9346549 - DNA, 22 bp, Homo sapiens
agggagtgttatattccatcag

SEQ ID NO: 9346550 - DNA, 18 bp, Homo sapiens
agggagttttagggaagg

SEQ ID NO: 9346551 - DNA, 22 bp, Homo sapiens
agggatcacggtggacttggat

SEQ ID NO: 9346552 - DNA, 22 bp, Homo sapiens
agggatcaaaaaatgtacatgc

SEQ ID NO: 9346553 - DNA, 22 bp, Homo sapiens
agggagttagtgatgtggtctc

SEQ ID NO: 9346554 - DNA, 22 bp, Homo sapiens
agggagttccgatctgtgcacc

SEQ ID NO: 9346555 - DNA, 22 bp, Homo sapiens
agggagttcagaggctggtttg

SEQ ID NO: 9346556 - DNA, 19 bp, Homo sapiens
agggagtttatatttgcac

SEQ ID NO: 9346557 - DNA, 22 bp, Homo sapiens
agggatgatttcagtgtctgcc

SEQ ID NO: 9346558 - DNA, 22 bp, Homo sapiens
agggatgatggaaagaagcagg

SEQ ID NO: 9346559 - DNA, 22 bp, Homo sapiens
agggatggaagctcgtctgcaa

SEQ ID NO: 9346560 - DNA, 22 bp, Homo sapiens
agggatggagtgcggcccggac

SEQ ID NO: 9346561 - DNA, 22 bp, Homo sapiens
agggatggatcttggccctgga

SEQ ID NO: 9346562 - DNA, 22 bp, Homo sapiens
agggatggatcttggccctgga

SEQ ID NO: 9346563 - DNA, 22 bp, Homo sapiens
agggatggatcttggccctgga

SEQ ID NO: 9346564 - DNA, 22 bp, Homo sapiens
ccctggaggagcttagagcttg

SEQ ID NO: 9346565 - DNA, 22 bp, Homo sapiens
ccctggaggagcttagagcttg

SEQ ID NO: 9346566 - DNA, 19 bp, Homo sapiens
ccctggaggagtgttggct

SEQ ID NO: 9346567 - DNA, 19 bp, Homo sapiens
ccctggaggagtgttggct

SEQ ID NO: 9346568 - DNA, 22 bp, Homo sapiens
ccctggaggaccccaatgtggc

SEQ ID NO: 9346569 - DNA, 22 bp, Homo sapiens
ccctggaggaccccaatgtggc

SEQ ID NO: 9346570 - DNA, 22 bp, Homo sapiens
ccctggaggaccccaatgtggc

SEQ ID NO: 9346571 - DNA, 22 bp, Homo sapiens
agggcagaggcggacacggaag

SEQ ID NO: 9346572 - DNA, 22 bp, Homo sapiens
agggcagaggcggacacggaag

SEQ ID NO: 9346573 - DNA, 21 bp, Homo sapiens
ccctggaatcctgagtgccag

SEQ ID NO: 9346574 - DNA, 22 bp, Homo sapiens
agggcagagacatgcttcctga

SEQ ID NO: 9346575 - DNA, 18 bp, Homo sapiens
ccctcttgcacaaagcaa

SEQ ID NO: 9346576 - DNA, 18 bp, Homo sapiens
ccctcttgcacaaagcaa

SEQ ID NO: 9346577 - DNA, 22 bp, Homo sapiens
agggcagagatctgagtgggca

SEQ ID NO: 9346578 - DNA, 22 bp, Homo sapiens
agggcagagagatgaatgggat

SEQ ID NO: 9346579 - DNA, 22 bp, Homo sapiens
agggcagagagatgaatgggat

SEQ ID NO: 9346580 - DNA, 22 bp, Homo sapiens
agggcagagagatgaatgggat

SEQ ID NO: 9346581 - DNA, 22 bp, Homo sapiens
agggcagagatctgagtgggca

SEQ ID NO: 9346582 - DNA, 22 bp, Homo sapiens
agggcagagatctgagtgggca

SEQ ID NO: 9346583 - DNA, 22 bp, Homo sapiens
agggcagagattaattaagaca

SEQ ID NO: 9346584 - DNA, 22 bp, Homo sapiens
agggcagagcactgaattggga

SEQ ID NO: 9346585 - DNA, 22 bp, Homo sapiens
ccctctctcggttgctgtggtt

SEQ ID NO: 9346586 - DNA, 22 bp, Homo sapiens
ccctctctcggttgctgtggtt

SEQ ID NO: 9346587 - DNA, 22 bp, Homo sapiens
ccctcccaggagtggccagaga

SEQ ID NO: 9346588 - DNA, 22 bp, Homo sapiens
agggatgggtctaacccagaac

SEQ ID NO: 9346589 - DNA, 22 bp, Homo sapiens
ccctctctctatcgggccccag

SEQ ID NO: 9346590 - DNA, 22 bp, Homo sapiens
ccctctctgacttctgaacttg

SEQ ID NO: 9346591 - DNA, 22 bp, Homo sapiens
ccctctctgacttctgaacttg

SEQ ID NO: 9346592 - DNA, 22 bp, Homo sapiens
ccctctctgctgcatagaggaa

SEQ ID NO: 9346593 - DNA, 17 bp, Homo sapiens
ccctctggggagggagg

SEQ ID NO: 9346594 - DNA, 22 bp, Homo sapiens
ccctctggctgtgtgttcttag

SEQ ID NO: 9346595 - DNA, 22 bp, Homo sapiens
ccctctggtttgcccttgggtg

SEQ ID NO: 9346596 - DNA, 22 bp, Homo sapiens
ccctctggctcttctcaggccg

SEQ ID NO: 9346597 - DNA, 22 bp, Homo sapiens
ccctctggctcttctcaggccg

SEQ ID NO: 9346598 - DNA, 22 bp, Homo sapiens
ccctctggctcttctcaggccg

SEQ ID NO: 9346599 - DNA, 20 bp, Homo sapiens
ccctctgctacactgggagc

SEQ ID NO: 9346600 - DNA, 22 bp, Homo sapiens
ccctctgcctctgagtaggaca

SEQ ID NO: 9346601 - DNA, 22 bp, Homo sapiens
cctgaggagattgtggctgggg

SEQ ID NO: 9346602 - DNA, 22 bp, Homo sapiens
cctgaggagattgtggctgggg

SEQ ID NO: 9346603 - DNA, 22 bp, Homo sapiens
cctgaggagattgtggctgggg

SEQ ID NO: 9346604 - DNA, 22 bp, Homo sapiens
cctgaggatattcaccagcatg

SEQ ID NO: 9346605 - DNA, 22 bp, Homo sapiens
cctgaggatgccagcatgggtg

SEQ ID NO: 9346606 - DNA, 22 bp, Homo sapiens
cctgaggattgttggtgcttcc

SEQ ID NO: 9346607 - DNA, 22 bp, Homo sapiens
cctgaggcaaggacttggtggc

SEQ ID NO: 9346608 - DNA, 22 bp, Homo sapiens
cctgaggcaaggacttggtggc

SEQ ID NO: 9346609 - DNA, 22 bp, Homo sapiens
cctgaggcccctgaggatagca

SEQ ID NO: 9346610 - DNA, 22 bp, Homo sapiens
cctgaggccctggctgtgctga

SEQ ID NO: 9346611 - DNA, 22 bp, Homo sapiens
cctgaggccctggctgtgctga

SEQ ID NO: 9346612 - DNA, 22 bp, Homo sapiens
aggggctggcttatctgagagt

SEQ ID NO: 9346613 - DNA, 22 bp, Homo sapiens
aggggctggcttatctgagagt

SEQ ID NO: 9346614 - DNA, 22 bp, Homo sapiens
aggggctgggacagagccaagc

SEQ ID NO: 9346615 - DNA, 22 bp, Homo sapiens
aggggctgggacagagccaagc

SEQ ID NO: 9346616 - DNA, 22 bp, Homo sapiens
aggggctggagttcgaggttac

SEQ ID NO: 9346617 - DNA, 22 bp, Homo sapiens
aggggctggcttatctgagagt

SEQ ID NO: 9346618 - DNA, 22 bp, Homo sapiens
aggggctgcctggcttggcact

SEQ ID NO: 9346619 - DNA, 22 bp, Homo sapiens
cctgaggacacacgctgcagga

SEQ ID NO: 9346620 - DNA, 22 bp, Homo sapiens
cctgaggacacacgctgcagga

SEQ ID NO: 9346621 - DNA, 22 bp, Homo sapiens
cctgagctttaaaagccatgta

SEQ ID NO: 9346622 - DNA, 22 bp, Homo sapiens
cctgagagtggtgtacaggaga

SEQ ID NO: 9346623 - DNA, 17 bp, Homo sapiens
aggggagagtgggaaga

SEQ ID NO: 9346624 - DNA, 21 bp, Homo sapiens
aggggacagagtagctccagg

SEQ ID NO: 9346625 - DNA, 21 bp, Homo sapiens
aggggacagagtagctccagg

SEQ ID NO: 9346626 - DNA, 22 bp, Homo sapiens
aggggagagaacataaggaagt

SEQ ID NO: 9346627 - DNA, 21 bp, Homo sapiens
cctcctgcccgcaagctaggg

SEQ ID NO: 9346628 - DNA, 21 bp, Homo sapiens
cctcctgcccgcaagctaggg

SEQ ID NO: 9346629 - DNA, 22 bp, Homo sapiens
cctcctgcggcgtccgcgctct

SEQ ID NO: 9346630 - DNA, 22 bp, Homo sapiens
cctcctgcggcgtccgcgctct

SEQ ID NO: 9346631 - DNA, 19 bp, Homo sapiens
cctcctgctagatatgcaa

SEQ ID NO: 9346632 - DNA, 19 bp, Homo sapiens
cctcctgctagatatgcaa

SEQ ID NO: 9346633 - DNA, 22 bp, Homo sapiens
cctcctgcacttgctttccttc

SEQ ID NO: 9346634 - DNA, 22 bp, Homo sapiens
cctcctgcacttgctttccttc

SEQ ID NO: 9346635 - DNA, 22 bp, Homo sapiens
cctcctgcacctccaggaactc

SEQ ID NO: 9346636 - DNA, 22 bp, Homo sapiens
cctcctgcactgcaagcttgag

SEQ ID NO: 9346637 - DNA, 22 bp, Homo sapiens
cctcctggaaaaattccctggc

SEQ ID NO: 9346638 - DNA, 22 bp, Homo sapiens
cctcctggaaaaattccctggc

SEQ ID NO: 9346639 - DNA, 22 bp, Homo sapiens
cctcctggagcattggtgagga

SEQ ID NO: 9346640 - DNA, 22 bp, Homo sapiens
cctcctggagcattggtgagga

SEQ ID NO: 9346641 - DNA, 22 bp, Homo sapiens
cctcctggaaaaattccctggc

SEQ ID NO: 9346642 - DNA, 22 bp, Homo sapiens
cctcctggaggctctaagggag

SEQ ID NO: 9346643 - DNA, 22 bp, Homo sapiens
cctcctggaggctctaagggag

SEQ ID NO: 9346644 - DNA, 18 bp, Homo sapiens
agggctgatgagtttggg

SEQ ID NO: 9346645 - DNA, 22 bp, Homo sapiens
agggctgatgcaccatgtagcc

SEQ ID NO: 9346646 - DNA, 22 bp, Homo sapiens
agggctgatgcaccatgtagcc

SEQ ID NO: 9346647 - DNA, 22 bp, Homo sapiens
agggctgcaatgggagataact

SEQ ID NO: 9346648 - DNA, 23 bp, Homo sapiens
agggctgatgccattgcagctct

SEQ ID NO: 9346649 - DNA, 23 bp, Homo sapiens
agggctgatgccattgcagctct

SEQ ID NO: 9346650 - DNA, 22 bp, Homo sapiens
cctcctggaggctctagggaaa

SEQ ID NO: 9346651 - DNA, 22 bp, Homo sapiens
cctcctggaggctctagggaaa

SEQ ID NO: 9346652 - DNA, 22 bp, Homo sapiens
cctcctggatggatttggtgga

SEQ ID NO: 9346653 - DNA, 22 bp, Homo sapiens
cctcctggaggctctagggaaa

SEQ ID NO: 9346654 - DNA, 22 bp, Homo sapiens
agggctgagtggtgcagtcaaa

SEQ ID NO: 9346655 - DNA, 22 bp, Homo sapiens
agggctgagtggtgcagtcaaa

SEQ ID NO: 9346656 - DNA, 22 bp, Homo sapiens
agggctgagtgggagagagttg

SEQ ID NO: 9346657 - DNA, 22 bp, Homo sapiens
agggctgagtgggagagagttg

SEQ ID NO: 9346658 - DNA, 22 bp, Homo sapiens
cctcctggccctgggcctggaa

SEQ ID NO: 9346659 - DNA, 22 bp, Homo sapiens
cctcctggatggatttggtgga

SEQ ID NO: 9346660 - DNA, 22 bp, Homo sapiens
cctctgggcaggtagcagcagc

SEQ ID NO: 9346661 - DNA, 22 bp, Homo sapiens
cctctgggcaggtagcagcagc

SEQ ID NO: 9346662 - DNA, 16 bp, Homo sapiens
cctctgggcctgcaag

SEQ ID NO: 9346663 - DNA, 22 bp, Homo sapiens
cctctgggccagcctggaccct

SEQ ID NO: 9346664 - DNA, 22 bp, Homo sapiens
cctctgggcctggaagggcagt

SEQ ID NO: 9346665 - DNA, 22 bp, Homo sapiens
cctctgggcctggaagggcagt

SEQ ID NO: 9346666 - DNA, 22 bp, Homo sapiens
cctctgggcggagatctgctgc

SEQ ID NO: 9346667 - DNA, 22 bp, Homo sapiens
cctctgggcggagatctgctgc

SEQ ID NO: 9346668 - DNA, 22 bp, Homo sapiens
cctctgggcggagatctgctgc

SEQ ID NO: 9346669 - DNA, 19 bp, Homo sapiens
cctctgccagcccgcctct

SEQ ID NO: 9346670 - DNA, 18 bp, Homo sapiens
cctctgccatagccagca

SEQ ID NO: 9346671 - DNA, 19 bp, Homo sapiens
cctctgccagcccgcctct

SEQ ID NO: 9346672 - DNA, 22 bp, Homo sapiens
agggctgcaggcaagatatggc

SEQ ID NO: 9346673 - DNA, 22 bp, Homo sapiens
agggctgcaccggggcttcgcg

SEQ ID NO: 9346674 - DNA, 22 bp, Homo sapiens
cctctgggagactgctactgag

SEQ ID NO: 9346675 - DNA, 22 bp, Homo sapiens
cctctgggagactgctactgag

SEQ ID NO: 9346676 - DNA, 22 bp, Homo sapiens
cctctgggaagccagtcctgct

SEQ ID NO: 9346677 - DNA, 21 bp, Homo sapiens
cctctggcttgtgctgtgccc

SEQ ID NO: 9346678 - DNA, 16 bp, Homo sapiens
agggccagaagcatca

SEQ ID NO: 9346679 - DNA, 23 bp, Homo sapiens
agggccactgggaaggattactg

SEQ ID NO: 9346680 - DNA, 22 bp, Homo sapiens
ccctggagggacagctgctcta

SEQ ID NO: 9346681 - DNA, 22 bp, Homo sapiens
ccctggagggacagctgctcta

SEQ ID NO: 9346682 - DNA, 22 bp, Homo sapiens
ccctggagggacagctgctcta

SEQ ID NO: 9346683 - DNA, 22 bp, Homo sapiens
ccctggagggacagctgctcta

SEQ ID NO: 9346684 - DNA, 22 bp, Homo sapiens
ccctggaggctggaggcagtag

SEQ ID NO: 9346685 - DNA, 22 bp, Homo sapiens
ccctggaggctggaggcagtag

SEQ ID NO: 9346686 - DNA, 22 bp, Homo sapiens
ccctggaggcggatgttgcagt

SEQ ID NO: 9346687 - DNA, 22 bp, Homo sapiens
ccctggaggcaaaggttgcagt

SEQ ID NO: 9346688 - DNA, 22 bp, Homo sapiens
ccctggaggcaaaggttgcagt

SEQ ID NO: 9346689 - DNA, 22 bp, Homo sapiens
ccctggaggcaaaggttgcagt

SEQ ID NO: 9346690 - DNA, 22 bp, Homo sapiens
ccctggaggcaaaggttgcagt

SEQ ID NO: 9346691 - DNA, 22 bp, Homo sapiens
ccctggaggcggatgttgcagt

SEQ ID NO: 9346692 - DNA, 22 bp, Homo sapiens
ccctggaggcggatgttgcagt

SEQ ID NO: 9346693 - DNA, 22 bp, Homo sapiens
ccctggaggcggagcttgcagt

SEQ ID NO: 9346694 - DNA, 22 bp, Homo sapiens
ccctggaggcggagcttgcagt

SEQ ID NO: 9346695 - DNA, 22 bp, Homo sapiens
ccctggaggcggagcttgcagt

SEQ ID NO: 9346696 - DNA, 22 bp, Homo sapiens
ccctggaggcggagcttgcagt

SEQ ID NO: 9346697 - DNA, 22 bp, Homo sapiens
agggccagagtctgtgtagata

SEQ ID NO: 9346698 - DNA, 22 bp, Homo sapiens
agggccagagtacatcagggct

SEQ ID NO: 9346699 - DNA, 22 bp, Homo sapiens
agggccagagtacatcagggct

SEQ ID NO: 9346700 - DNA, 22 bp, Homo sapiens
agggccagagtacatcagggct

SEQ ID NO: 9346701 - DNA, 22 bp, Homo sapiens
agggccagagtacatcagggct

SEQ ID NO: 9346702 - DNA, 22 bp, Homo sapiens
agggccagagtacatcagggct

SEQ ID NO: 9346703 - DNA, 22 bp, Homo sapiens
agggccagagtacatcagggct

SEQ ID NO: 9346704 - DNA, 22 bp, Homo sapiens
agggccagaatccctcagtcta

SEQ ID NO: 9346705 - DNA, 22 bp, Homo sapiens
agggccagaatccctcagtcta

SEQ ID NO: 9346706 - DNA, 22 bp, Homo sapiens
agggccagaatccctcagtcta

SEQ ID NO: 9346707 - DNA, 22 bp, Homo sapiens
agggccagaatccctcagtcta

SEQ ID NO: 9346708 - DNA, 22 bp, Homo sapiens
agggccagaggcaccttgcagc

SEQ ID NO: 9346709 - DNA, 22 bp, Homo sapiens
cccttcccttctgggagatcca

SEQ ID NO: 9346710 - DNA, 22 bp, Homo sapiens
agggccagagtctgtgtagata

SEQ ID NO: 9346711 - DNA, 22 bp, Homo sapiens
agggccagagtctgtgtagata

SEQ ID NO: 9346712 - DNA, 20 bp, Homo sapiens
cccttttcacgaaaaggaga

SEQ ID NO: 9346713 - DNA, 22 bp, Homo sapiens
ccctttctccagaactgtctga

SEQ ID NO: 9346714 - DNA, 21 bp, Homo sapiens
ccctttctccatacttcatcc

SEQ ID NO: 9346715 - DNA, 22 bp, Homo sapiens
ccctttcttccgtgacttctgc

SEQ ID NO: 9346716 - DNA, 22 bp, Homo sapiens
ccctttctgggacccctgtctc

SEQ ID NO: 9346717 - DNA, 22 bp, Homo sapiens
ccgaggctggagtgcagtggcg

SEQ ID NO: 9346718 - DNA, 22 bp, Homo sapiens
ccgaggctggcctcagggctgt

SEQ ID NO: 9346719 - DNA, 22 bp, Homo sapiens
ccgaggctcctccccgagtctg

SEQ ID NO: 9346720 - DNA, 22 bp, Homo sapiens
ccgagaacttttcctgaaaagt

SEQ ID NO: 9346721 - DNA, 22 bp, Homo sapiens
ccgagatgggctcgcctgggaa

SEQ ID NO: 9346722 - DNA, 22 bp, Homo sapiens
ccgcatttccaatgaggcaaag

SEQ ID NO: 9346723 - DNA, 22 bp, Homo sapiens
ccgccaggatattgtggctttt

SEQ ID NO: 9346724 - DNA, 22 bp, Homo sapiens
agggccctaaggaaggcacaca

SEQ ID NO: 9346725 - DNA, 22 bp, Homo sapiens
agggccctaaggaaggcacaca

SEQ ID NO: 9346726 - DNA, 21 bp, Homo sapiens
ccgccgctgatagctctgggc

SEQ ID NO: 9346727 - DNA, 22 bp, Homo sapiens
agggctcataattcctgacttc

SEQ ID NO: 9346728 - DNA, 22 bp, Homo sapiens
agggctcataattcctgacttc

SEQ ID NO: 9346729 - DNA, 22 bp, Homo sapiens
agggctatgattaatgatggtg

SEQ ID NO: 9346730 - DNA, 22 bp, Homo sapiens
agggctcataattcctgacttc

SEQ ID NO: 9346731 - DNA, 22 bp, Homo sapiens
agggctcatctgagactgacat

SEQ ID NO: 9346732 - DNA, 22 bp, Homo sapiens
agggctcattgacatggaaaag

SEQ ID NO: 9346733 - DNA, 22 bp, Homo sapiens
agggctcatctgagactgacat

SEQ ID NO: 9346734 - DNA, 22 bp, Homo sapiens
agggctccaggggctgggtgac

SEQ ID NO: 9346735 - DNA, 22 bp, Homo sapiens
agggctcccgcggtgtccggga

SEQ ID NO: 9346736 - DNA, 22 bp, Homo sapiens
agggcccttacgcaggcccttc

SEQ ID NO: 9346737 - DNA, 22 bp, Homo sapiens
agggcccttacgcaggcccttc

SEQ ID NO: 9346738 - DNA, 22 bp, Homo sapiens
agggccctggggtgcactgaca

SEQ ID NO: 9346739 - DNA, 18 bp, Homo sapiens
agggccctggtggccatt

SEQ ID NO: 9346740 - DNA, 23 bp, Homo sapiens
agggcctcaggagggctgcatgg

SEQ ID NO: 9346741 - DNA, 23 bp, Homo sapiens
agggcctcaggagggctgcatgg

SEQ ID NO: 9346742 - DNA, 23 bp, Homo sapiens
agggcctcaggagggctgcatgg

SEQ ID NO: 9346743 - DNA, 22 bp, Homo sapiens
agggctaggaatggaactggag

SEQ ID NO: 9346744 - DNA, 19 bp, Homo sapiens
agggctaggcacatagggc

SEQ ID NO: 9346745 - DNA, 19 bp, Homo sapiens
agggctaggcacatagggc

SEQ ID NO: 9346746 - DNA, 22 bp, Homo sapiens
agggctaggaatggaactggag

SEQ ID NO: 9346747 - DNA, 22 bp, Homo sapiens
agggccctccccgctcagggca

SEQ ID NO: 9346748 - DNA, 22 bp, Homo sapiens
agggccctctggcaggccaggc

SEQ ID NO: 9346749 - DNA, 22 bp, Homo sapiens
agggccctagggaatgagacat

SEQ ID NO: 9346750 - DNA, 22 bp, Homo sapiens
agggccctctggcaggccaggc

SEQ ID NO: 9346751 - DNA, 22 bp, Homo sapiens
agggccctctgggcactgtggc

SEQ ID NO: 9346752 - DNA, 22 bp, Homo sapiens
agggccctgagttgcagccctg

SEQ ID NO: 9346753 - DNA, 22 bp, Homo sapiens
agggccctgagttgcagccctg

SEQ ID NO: 9346754 - DNA, 22 bp, Homo sapiens
agggctcctatgatgctctgcc

SEQ ID NO: 9346755 - DNA, 18 bp, Homo sapiens
agggctctctgctgggtt

SEQ ID NO: 9346756 - DNA, 22 bp, Homo sapiens
agggctcctccccggcctccac

SEQ ID NO: 9346757 - DNA, 22 bp, Homo sapiens
agggctctgagctggaccacct

SEQ ID NO: 9346758 - DNA, 22 bp, Homo sapiens
agggctctgagctggaccacct

SEQ ID NO: 9346759 - DNA, 22 bp, Homo sapiens
agggctctcttggacaactgct

SEQ ID NO: 9346760 - DNA, 22 bp, Homo sapiens
agggctctcttggacaactgct

SEQ ID NO: 9346761 - DNA, 22 bp, Homo sapiens
agggctctcttcttggtttgca

SEQ ID NO: 9346762 - DNA, 22 bp, Homo sapiens
agggctctcttcttggtttgca

SEQ ID NO: 9346763 - DNA, 22 bp, Homo sapiens
agggctctgttggggtcagcac

SEQ ID NO: 9346764 - DNA, 22 bp, Homo sapiens
agggctctgttggggtcagcac

SEQ ID NO: 9346765 - DNA, 22 bp, Homo sapiens
agggctctgttggggtcagcac

SEQ ID NO: 9346766 - DNA, 22 bp, Homo sapiens
agggctcttcctttgcctctca

SEQ ID NO: 9346767 - DNA, 22 bp, Homo sapiens
agggctcttcctttgcctctca

SEQ ID NO: 9346768 - DNA, 22 bp, Homo sapiens
cctccccacgggcagccggcgc

SEQ ID NO: 9346769 - DNA, 22 bp, Homo sapiens
cctccccacgggcagccggcgc

SEQ ID NO: 9346770 - DNA, 22 bp, Homo sapiens
cctccccatgacccggtgctgg

SEQ ID NO: 9346771 - DNA, 22 bp, Homo sapiens
cctccccatgacccggtgctgg

SEQ ID NO: 9346772 - DNA, 22 bp, Homo sapiens
agggctctggggtggcagagat

SEQ ID NO: 9346773 - DNA, 22 bp, Homo sapiens
agggctctggggtggcagagat

SEQ ID NO: 9346774 - DNA, 20 bp, Homo sapiens
agggctctgccttgctgatg

SEQ ID NO: 9346775 - DNA, 22 bp, Homo sapiens
agggctctgagtgggaaagagg

SEQ ID NO: 9346776 - DNA, 22 bp, Homo sapiens
agggctctgagtgggaaagagg

SEQ ID NO: 9346777 - DNA, 20 bp, Homo sapiens
agggctctgccttgctgatg

SEQ ID NO: 9346778 - DNA, 22 bp, Homo sapiens
agggctctgtccccagaggccc

SEQ ID NO: 9346779 - DNA, 22 bp, Homo sapiens
agggctctgtccccagaggccc

SEQ ID NO: 9346780 - DNA, 22 bp, Homo sapiens
agggctctgtccccagaggccc

SEQ ID NO: 9346781 - DNA, 22 bp, Homo sapiens
agggctctgtgactatcactgc

SEQ ID NO: 9346782 - DNA, 22 bp, Homo sapiens
caggaggacatactggctcaca

SEQ ID NO: 9346783 - DNA, 22 bp, Homo sapiens
caggaggacatactggctcaca

SEQ ID NO: 9346784 - DNA, 22 bp, Homo sapiens
caggaggacatactggctcaca

SEQ ID NO: 9346785 - DNA, 22 bp, Homo sapiens
caggaggagccagcgcccttca

SEQ ID NO: 9346786 - DNA, 22 bp, Homo sapiens
caggaggagcattagcgtctca

SEQ ID NO: 9346787 - DNA, 22 bp, Homo sapiens
caggaggagcattagcgtctca

SEQ ID NO: 9346788 - DNA, 23 bp, Homo sapiens
caggaggagaaggcttggttggc

SEQ ID NO: 9346789 - DNA, 22 bp, Homo sapiens
caggaggagcattagcgtctca

SEQ ID NO: 9346790 - DNA, 23 bp, Homo sapiens
caggaggagaaggcttggttggc

SEQ ID NO: 9346791 - DNA, 21 bp, Homo sapiens
agctgccaccctagcttctga

SEQ ID NO: 9346792 - DNA, 21 bp, Homo sapiens
agctgccaccctagcttctga

SEQ ID NO: 9346793 - DNA, 22 bp, Homo sapiens
agctgccactgagggtgcacag

SEQ ID NO: 9346794 - DNA, 22 bp, Homo sapiens
agctgccacctctgcctttggg

SEQ ID NO: 9346795 - DNA, 22 bp, Homo sapiens
caggaggacatactggctcaca

SEQ ID NO: 9346796 - DNA, 22 bp, Homo sapiens
caggaggaggtgaggtagaact

SEQ ID NO: 9346797 - DNA, 22 bp, Homo sapiens
caggaggagggtacaccatcag

SEQ ID NO: 9346798 - DNA, 22 bp, Homo sapiens
caggaggagggtacaccatcag

SEQ ID NO: 9346799 - DNA, 22 bp, Homo sapiens
caggaggagggtacaccatcag

SEQ ID NO: 9346800 - DNA, 22 bp, Homo sapiens
caggaggagggcagccgcctcc

SEQ ID NO: 9346801 - DNA, 22 bp, Homo sapiens
caggaggagggcagccgcctcc

SEQ ID NO: 9346802 - DNA, 22 bp, Homo sapiens
caggaggagggtacaccatcag

SEQ ID NO: 9346803 - DNA, 22 bp, Homo sapiens
caggaggagggcagccgcctcc

SEQ ID NO: 9346804 - DNA, 22 bp, Homo sapiens
caggaggagctggccgcctcat

SEQ ID NO: 9346805 - DNA, 22 bp, Homo sapiens
caggaggagccagcgcccttca

SEQ ID NO: 9346806 - DNA, 22 bp, Homo sapiens
caggaggagctggccgcctcat

SEQ ID NO: 9346807 - DNA, 22 bp, Homo sapiens
caggaggagctggccgcctcat

SEQ ID NO: 9346808 - DNA, 19 bp, Homo sapiens
agctgctgattggtggagg

SEQ ID NO: 9346809 - DNA, 22 bp, Homo sapiens
agctgctgagccatgtcctgct

SEQ ID NO: 9346810 - DNA, 22 bp, Homo sapiens
agctgctgagccatgtcctgct

SEQ ID NO: 9346811 - DNA, 22 bp, Homo sapiens
agctgctgagccatgtcctgct

SEQ ID NO: 9346812 - DNA, 22 bp, Homo sapiens
caggaggattgcttgaggccag

SEQ ID NO: 9346813 - DNA, 22 bp, Homo sapiens
caggaggattgcttgaggccag

SEQ ID NO: 9346814 - DNA, 22 bp, Homo sapiens
caggcactggggatgctgggat

SEQ ID NO: 9346815 - DNA, 22 bp, Homo sapiens
caggcactgtgctagatccttg

SEQ ID NO: 9346816 - DNA, 22 bp, Homo sapiens
caggcactgcactaccactttt

SEQ ID NO: 9346817 - DNA, 22 bp, Homo sapiens
caggcacactgtctacactgag

SEQ ID NO: 9346818 - DNA, 22 bp, Homo sapiens
caggcactcattcagagaggtg

SEQ ID NO: 9346819 - DNA, 22 bp, Homo sapiens
agctgctgccggtggccaccct

SEQ ID NO: 9346820 - DNA, 22 bp, Homo sapiens
agctgctgccggtggccaccct

SEQ ID NO: 9346821 - DNA, 22 bp, Homo sapiens
agctgctgccggtggccaccct

SEQ ID NO: 9346822 - DNA, 22 bp, Homo sapiens
agctgctgcctcactggtctgt

SEQ ID NO: 9346823 - DNA, 22 bp, Homo sapiens
agctgctgcgcctcaccctggc

SEQ ID NO: 9346824 - DNA, 22 bp, Homo sapiens
agctgctgcgcctcaccctggc

SEQ ID NO: 9346825 - DNA, 22 bp, Homo sapiens
agctgctgcccataggtgacat

SEQ ID NO: 9346826 - DNA, 22 bp, Homo sapiens
agctgctgccggtggccaccct

SEQ ID NO: 9346827 - DNA, 22 bp, Homo sapiens
agctgctgcccataggtgacat

SEQ ID NO: 9346828 - DNA, 22 bp, Homo sapiens
agctgctgcccataggtgacat

SEQ ID NO: 9346829 - DNA, 22 bp, Homo sapiens
agctgctgcccataggtgacat

SEQ ID NO: 9346830 - DNA, 22 bp, Homo sapiens
agctgctgcggaaagatgccac

SEQ ID NO: 9346831 - DNA, 22 bp, Homo sapiens
agctgctgcggaaagatgccac

SEQ ID NO: 9346832 - DNA, 22 bp, Homo sapiens
agctgctgcgcctcaccctggc

SEQ ID NO: 9346833 - DNA, 22 bp, Homo sapiens
agctgctgcggaaagatgccac

SEQ ID NO: 9346834 - DNA, 19 bp, Homo sapiens
agctgctggcccagggacc

SEQ ID NO: 9346835 - DNA, 19 bp, Homo sapiens
agctgctggcccagggacc

SEQ ID NO: 9346836 - DNA, 19 bp, Homo sapiens
agctgctggcccagggacc

SEQ ID NO: 9346837 - DNA, 22 bp, Homo sapiens
caggcacactgtctacactgag

SEQ ID NO: 9346838 - DNA, 19 bp, Homo sapiens
agctgctggcccagggacc

SEQ ID NO: 9346839 - DNA, 19 bp, Homo sapiens
agctgctggcccagggacc

SEQ ID NO: 9346840 - DNA, 22 bp, Homo sapiens
caggccagcagggcctccgtgg

SEQ ID NO: 9346841 - DNA, 22 bp, Homo sapiens
caggccagcagggcctccgtgg

SEQ ID NO: 9346842 - DNA, 22 bp, Homo sapiens
caggccagcggcccgcgcgttc

SEQ ID NO: 9346843 - DNA, 22 bp, Homo sapiens
caggccagagtccaactccaga

SEQ ID NO: 9346844 - DNA, 20 bp, Homo sapiens
caggccagaggtttgatggc

SEQ ID NO: 9346845 - DNA, 22 bp, Homo sapiens
caggccagagtccaactccaga

SEQ ID NO: 9346846 - DNA, 22 bp, Homo sapiens
caggccagcagggcctccgtgg

SEQ ID NO: 9346847 - DNA, 22 bp, Homo sapiens
caggccagagtccaactccaga

SEQ ID NO: 9346848 - DNA, 22 bp, Homo sapiens
caggccagcgtccagaacaagc

SEQ ID NO: 9346849 - DNA, 22 bp, Homo sapiens
caggccagcgtccagaacaagc

SEQ ID NO: 9346850 - DNA, 22 bp, Homo sapiens
caggccagcgtccagaacaagc

SEQ ID NO: 9346851 - DNA, 22 bp, Homo sapiens
caggccagcgtccagaacaagc

SEQ ID NO: 9346852 - DNA, 22 bp, Homo sapiens
caggccagcgtccagaacaagc

SEQ ID NO: 9346853 - DNA, 22 bp, Homo sapiens
caggccaggctgcatttgcccc

SEQ ID NO: 9346854 - DNA, 22 bp, Homo sapiens
caggccaggctgcatttgcccc

SEQ ID NO: 9346855 - DNA, 22 bp, Homo sapiens
caggccagcttcctgacatcct

SEQ ID NO: 9346856 - DNA, 22 bp, Homo sapiens
caggccagcttcctgacatcct

SEQ ID NO: 9346857 - DNA, 22 bp, Homo sapiens
caggccagcttcctgacatcct

SEQ ID NO: 9346858 - DNA, 22 bp, Homo sapiens
caggccaggctgcatttgcccc

SEQ ID NO: 9346859 - DNA, 22 bp, Homo sapiens
caggccagggagaatatgaagc

SEQ ID NO: 9346860 - DNA, 22 bp, Homo sapiens
caggccagggagaatatgaagc

SEQ ID NO: 9346861 - DNA, 22 bp, Homo sapiens
agctgggctgggctgagctgag

SEQ ID NO: 9346862 - DNA, 22 bp, Homo sapiens
agctgggctgggctgagctgag

SEQ ID NO: 9346863 - DNA, 22 bp, Homo sapiens
agctgggctgggctgagctgag

SEQ ID NO: 9346864 - DNA, 19 bp, Homo sapiens
agctgggctgtcacagtga

SEQ ID NO: 9346865 - DNA, 22 bp, Homo sapiens
agctgggcttggccaggtcgct

SEQ ID NO: 9346866 - DNA, 20 bp, Homo sapiens
agctggcccccggtggcctg

SEQ ID NO: 9346867 - DNA, 22 bp, Homo sapiens
agctggcccactgtgtggtcca

SEQ ID NO: 9346868 - DNA, 22 bp, Homo sapiens
agctggcccactgtgtggtcca

SEQ ID NO: 9346869 - DNA, 22 bp, Homo sapiens
agctggccattgtgagtggcct

SEQ ID NO: 9346870 - DNA, 22 bp, Homo sapiens
agctggccattgtgagtggcct

SEQ ID NO: 9346871 - DNA, 22 bp, Homo sapiens
agctggcccactgtgtggtcca

SEQ ID NO: 9346872 - DNA, 20 bp, Homo sapiens
agctggcccacaggtgtggg

SEQ ID NO: 9346873 - DNA, 22 bp, Homo sapiens
agctggccattgtgagtggcct

SEQ ID NO: 9346874 - DNA, 22 bp, Homo sapiens
caggcactttgctgggggcgca

SEQ ID NO: 9346875 - DNA, 22 bp, Homo sapiens
caggcacttctgctgcttgtct

SEQ ID NO: 9346876 - DNA, 22 bp, Homo sapiens
caggcactgtgttaggcactgt

SEQ ID NO: 9346877 - DNA, 22 bp, Homo sapiens
agctggcctccgggtgcctggg

SEQ ID NO: 9346878 - DNA, 22 bp, Homo sapiens
agctggcctcactgcagaatgc

SEQ ID NO: 9346879 - DNA, 20 bp, Homo sapiens
caggcagtttgtggttaggg

SEQ ID NO: 9346880 - DNA, 20 bp, Homo sapiens
caggcagtttgtggttaggg

SEQ ID NO: 9346881 - DNA, 22 bp, Homo sapiens
caggccagaggctgttgttgcg

SEQ ID NO: 9346882 - DNA, 18 bp, Homo sapiens
agctggccctggctgccg

SEQ ID NO: 9346883 - DNA, 22 bp, Homo sapiens
agctggccggcctccaggtgga

SEQ ID NO: 9346884 - DNA, 18 bp, Homo sapiens
agctggccctggctgccg

SEQ ID NO: 9346885 - DNA, 22 bp, Homo sapiens
agctggccggcctccaggtgga

SEQ ID NO: 9346886 - DNA, 18 bp, Homo sapiens
agctggccctggctgccg

SEQ ID NO: 9346887 - DNA, 20 bp, Homo sapiens
agctggcccccggtggcctg

SEQ ID NO: 9346888 - DNA, 22 bp, Homo sapiens
caggaagagaacatggaggctg

SEQ ID NO: 9346889 - DNA, 22 bp, Homo sapiens
caggaaggaccgtccagatcag

SEQ ID NO: 9346890 - DNA, 22 bp, Homo sapiens
caggaaggaccgtccagatcag

SEQ ID NO: 9346891 - DNA, 22 bp, Homo sapiens
caggaaggaccgtccagatcag

SEQ ID NO: 9346892 - DNA, 22 bp, Homo sapiens
agctgcagcactccagtagccg

SEQ ID NO: 9346893 - DNA, 22 bp, Homo sapiens
agctgcagcactccagtagccg

SEQ ID NO: 9346894 - DNA, 22 bp, Homo sapiens
agctgcagattctatctagaag

SEQ ID NO: 9346895 - DNA, 22 bp, Homo sapiens
agctgcagattctctacttcat

SEQ ID NO: 9346896 - DNA, 22 bp, Homo sapiens
agctgcagcactccagtagccg

SEQ ID NO: 9346897 - DNA, 22 bp, Homo sapiens
agctgcagattctctacttcat

SEQ ID NO: 9346898 - DNA, 23 bp, Homo sapiens
agctgcagatgctcagcgggcag

SEQ ID NO: 9346899 - DNA, 17 bp, Homo sapiens
agctgcagatgaagttg

SEQ ID NO: 9346900 - DNA, 22 bp, Homo sapiens
agctgcagagaaaagaggctgg

SEQ ID NO: 9346901 - DNA, 22 bp, Homo sapiens
agctgcagagaaaagaggctgg

SEQ ID NO: 9346902 - DNA, 22 bp, Homo sapiens
agctgcagagaaaagaggctgg

SEQ ID NO: 9346903 - DNA, 22 bp, Homo sapiens
agctgcagaggtttgtgcaaca

SEQ ID NO: 9346904 - DNA, 22 bp, Homo sapiens
agctgcagataggatgttattt

SEQ ID NO: 9346905 - DNA, 22 bp, Homo sapiens
agctgcagatcaataggctcac

SEQ ID NO: 9346906 - DNA, 22 bp, Homo sapiens
agctgcagatcaataggctcac

SEQ ID NO: 9346907 - DNA, 19 bp, Homo sapiens
agctgcagaccagaagtgc

SEQ ID NO: 9346908 - DNA, 20 bp, Homo sapiens
agctgcagaacccactggac

SEQ ID NO: 9346909 - DNA, 20 bp, Homo sapiens
agctgcagaacccactggac

SEQ ID NO: 9346910 - DNA, 22 bp, Homo sapiens
agctgcagaaaggacaactaat

SEQ ID NO: 9346911 - DNA, 22 bp, Homo sapiens
agctgcagaaaggacaactaat

SEQ ID NO: 9346912 - DNA, 18 bp, Homo sapiens
agctgcagaccaggaggt

SEQ ID NO: 9346913 - DNA, 18 bp, Homo sapiens
agctgcagaccaggaggt

SEQ ID NO: 9346914 - DNA, 19 bp, Homo sapiens
agctgcagaccagaagtgc

SEQ ID NO: 9346915 - DNA, 22 bp, Homo sapiens
caggaaggcgcggctgtgcctg

SEQ ID NO: 9346916 - DNA, 22 bp, Homo sapiens
caggaaggcgcggctgtgcctg

SEQ ID NO: 9346917 - DNA, 22 bp, Homo sapiens
caggaaggcgcggctgtgcctg

SEQ ID NO: 9346918 - DNA, 22 bp, Homo sapiens
caggaaggcgcggctgtgcctg

SEQ ID NO: 9346919 - DNA, 22 bp, Homo sapiens
caggaaggggctcactctggcc

SEQ ID NO: 9346920 - DNA, 19 bp, Homo sapiens
caggaaggggcgaatctgg

SEQ ID NO: 9346921 - DNA, 19 bp, Homo sapiens
caggaaggggcgaatctgg

SEQ ID NO: 9346922 - DNA, 22 bp, Homo sapiens
caggaaggcgcggctgtgcctg

SEQ ID NO: 9346923 - DNA, 22 bp, Homo sapiens
caggaaggcccacctgtcctgt

SEQ ID NO: 9346924 - DNA, 22 bp, Homo sapiens
caggaaggcccacctgtcctgt

SEQ ID NO: 9346925 - DNA, 22 bp, Homo sapiens
caggaaggcccacctgtcctgt

SEQ ID NO: 9346926 - DNA, 22 bp, Homo sapiens
caggaaggcgcggctgtgcctg

SEQ ID NO: 9346927 - DNA, 22 bp, Homo sapiens
caggaaggcccacctgtcctgt

SEQ ID NO: 9346928 - DNA, 22 bp, Homo sapiens
agctgccaagtttctcagttta

SEQ ID NO: 9346929 - DNA, 22 bp, Homo sapiens
agctgccacagagcctggccag

SEQ ID NO: 9346930 - DNA, 22 bp, Homo sapiens
agctgccacatgcccaagggca

SEQ ID NO: 9346931 - DNA, 22 bp, Homo sapiens
agctgccacagagcctggccag

SEQ ID NO: 9346932 - DNA, 22 bp, Homo sapiens
agctgcatttcagtgaaatatt

SEQ ID NO: 9346933 - DNA, 22 bp, Homo sapiens
agctgccaagttggagtagcaa

SEQ ID NO: 9346934 - DNA, 22 bp, Homo sapiens
agctgcagttcgttccagctct

SEQ ID NO: 9346935 - DNA, 22 bp, Homo sapiens
caggaaggggctcactctggcc

SEQ ID NO: 9346936 - DNA, 22 bp, Homo sapiens
agctgcagttagccccagatga

SEQ ID NO: 9346937 - DNA, 22 bp, Homo sapiens
agctgcagttcgttccagctct

SEQ ID NO: 9346938 - DNA, 22 bp, Homo sapiens
agctgcagtgaactgttttgtc

SEQ ID NO: 9346939 - DNA, 22 bp, Homo sapiens
agctgcagttagccccagatga

SEQ ID NO: 9346940 - DNA, 22 bp, Homo sapiens
agctgcagtgaattcgctaact

SEQ ID NO: 9346941 - DNA, 22 bp, Homo sapiens
cagctgagaaaggcaggctcac

SEQ ID NO: 9346942 - DNA, 22 bp, Homo sapiens
cagctgagaaatggggaaaggg

SEQ ID NO: 9346943 - DNA, 22 bp, Homo sapiens
cagctgagaagtgatagctgca

SEQ ID NO: 9346944 - DNA, 22 bp, Homo sapiens
cagctgagaagtgatagctgca

SEQ ID NO: 9346945 - DNA, 22 bp, Homo sapiens
cagctgagaccagaatgcaggt

SEQ ID NO: 9346946 - DNA, 22 bp, Homo sapiens
cagctgagagacaatgagtcat

SEQ ID NO: 9346947 - DNA, 22 bp, Homo sapiens
cagctgagagacaatgagtcat

SEQ ID NO: 9346948 - DNA, 22 bp, Homo sapiens
agctgattccactttttcccca

SEQ ID NO: 9346949 - DNA, 22 bp, Homo sapiens
agctgagggcaggatggggtga

SEQ ID NO: 9346950 - DNA, 22 bp, Homo sapiens
agctgcaaagatgatttgttgt

SEQ ID NO: 9346951 - DNA, 20 bp, Homo sapiens
agctgcaacagactgtatgg

SEQ ID NO: 9346952 - DNA, 22 bp, Homo sapiens
agctgcaaaggcacacttgggc

SEQ ID NO: 9346953 - DNA, 19 bp, Homo sapiens
agctgcaaaaggtggaact

SEQ ID NO: 9346954 - DNA, 21 bp, Homo sapiens
agctgcaaaaacatacagttc

SEQ ID NO: 9346955 - DNA, 22 bp, Homo sapiens
agctgcaaagatctgtcagtca

SEQ ID NO: 9346956 - DNA, 22 bp, Homo sapiens
agctgcaaaccaggccggcgcg

SEQ ID NO: 9346957 - DNA, 21 bp, Homo sapiens
agctgcaagagcaacatcttt

SEQ ID NO: 9346958 - DNA, 22 bp, Homo sapiens
agctgcaagaagaggtccctga

SEQ ID NO: 9346959 - DNA, 23 bp, Homo sapiens
agctgcaagactccctgtctgag

SEQ ID NO: 9346960 - DNA, 22 bp, Homo sapiens
agctgcaacatctgcttgtccc

SEQ ID NO: 9346961 - DNA, 22 bp, Homo sapiens
agctgcaactgtccttgccttg

SEQ ID NO: 9346962 - DNA, 22 bp, Homo sapiens
agctgcaaccttagctataggc

SEQ ID NO: 9346963 - DNA, 22 bp, Homo sapiens
agctgcaagtctgtgtggggag

SEQ ID NO: 9346964 - DNA, 22 bp, Homo sapiens
agctgcaagtccaaaggaatta

SEQ ID NO: 9346965 - DNA, 22 bp, Homo sapiens
agctgcaagtaagcttgctcct

SEQ ID NO: 9346966 - DNA, 22 bp, Homo sapiens
agctgcaagatttcttttgtat

SEQ ID NO: 9346967 - DNA, 14 bp, Homo sapiens
agctgcaagcatcc

SEQ ID NO: 9346968 - DNA, 22 bp, Homo sapiens
agctgcaagataaaagtgatgt

SEQ ID NO: 9346969 - DNA, 22 bp, Homo sapiens
agctgcaagtgttgcctcctac

SEQ ID NO: 9346970 - DNA, 22 bp, Homo sapiens
agctgcaatacccttcttcctt

SEQ ID NO: 9346971 - DNA, 22 bp, Homo sapiens
agctgcaattaaagactgtgaa

SEQ ID NO: 9346972 - DNA, 22 bp, Homo sapiens
agctgcaattctggacatagtc

SEQ ID NO: 9346973 - DNA, 22 bp, Homo sapiens
agctgcactgacctgtatgaag

SEQ ID NO: 9346974 - DNA, 22 bp, Homo sapiens
cagctgaattcttcagactcca

SEQ ID NO: 9346975 - DNA, 22 bp, Homo sapiens
cagctgaattcttcagactcca

SEQ ID NO: 9346976 - DNA, 22 bp, Homo sapiens
cagctgacatggtatttgtgcc

SEQ ID NO: 9346977 - DNA, 22 bp, Homo sapiens
cagctgacttcataggaagaca

SEQ ID NO: 9346978 - DNA, 22 bp, Homo sapiens
cagctgacgccagagtggaatt

SEQ ID NO: 9346979 - DNA, 22 bp, Homo sapiens
cagctgacctggctaagggagc

SEQ ID NO: 9346980 - DNA, 22 bp, Homo sapiens
cagctgaaggtaggaaccagga

SEQ ID NO: 9346981 - DNA, 22 bp, Homo sapiens
cagctctgtctgtagaaacttc

SEQ ID NO: 9346982 - DNA, 22 bp, Homo sapiens
cagctctgtaaattccttcatc

SEQ ID NO: 9346983 - DNA, 22 bp, Homo sapiens
cagctctggttcctgggcccag

SEQ ID NO: 9346984 - DNA, 22 bp, Homo sapiens
cagctctgtaaattccttcatc

SEQ ID NO: 9346985 - DNA, 22 bp, Homo sapiens
cagctctgtaaattccttcatc

SEQ ID NO: 9346986 - DNA, 22 bp, Homo sapiens
cagctctggggcagagtgacta

SEQ ID NO: 9346987 - DNA, 22 bp, Homo sapiens
cagctctggggcagagtgacta

SEQ ID NO: 9346988 - DNA, 20 bp, Homo sapiens
cagctctgggcaggtcgagg

SEQ ID NO: 9346989 - DNA, 22 bp, Homo sapiens
cagctctgggtaggaggaatct

SEQ ID NO: 9346990 - DNA, 22 bp, Homo sapiens
cagctctggggcagagtgacta

SEQ ID NO: 9346991 - DNA, 22 bp, Homo sapiens
cagctctggttcctgggcccag

SEQ ID NO: 9346992 - DNA, 22 bp, Homo sapiens
cagctctgggtgacaggagggc

SEQ ID NO: 9346993 - DNA, 22 bp, Homo sapiens
caggtgagtttgctattgtaca

SEQ ID NO: 9346994 - DNA, 22 bp, Homo sapiens
caggtgattctaaagtctagcc

SEQ ID NO: 9346995 - DNA, 20 bp, Homo sapiens
caggtgattccctggggaat

SEQ ID NO: 9346996 - DNA, 22 bp, Homo sapiens
caggtgataccctttaacaggc

SEQ ID NO: 9346997 - DNA, 22 bp, Homo sapiens
caggtgaggctgaacagatgaa

SEQ ID NO: 9346998 - DNA, 22 bp, Homo sapiens
caggtgagctctatctagggag

SEQ ID NO: 9346999 - DNA, 22 bp, Homo sapiens
caggtgagaggcggtcctgcat

SEQ ID NO: 9347000 - DNA, 22 bp, Homo sapiens
cagggtgcgggagatgtgcacc

SEQ ID NO: 9347001 - DNA, 22 bp, Homo sapiens
cagggtgcgccactcagatgta

SEQ ID NO: 9347002 - DNA, 22 bp, Homo sapiens
cagggtgcctgtcctcagcaaa

SEQ ID NO: 9347003 - DNA, 22 bp, Homo sapiens
cagggtgcctcccgctcgccgg

SEQ ID NO: 9347004 - DNA, 22 bp, Homo sapiens
cagggtgcctgtcctcagcaaa

SEQ ID NO: 9347005 - DNA, 22 bp, Homo sapiens
cagggtgcctctgctcccacca

SEQ ID NO: 9347006 - DNA, 22 bp, Homo sapiens
caggggctctaatgcatgatca

SEQ ID NO: 9347007 - DNA, 22 bp, Homo sapiens
caggggctctaatgcatgatca

SEQ ID NO: 9347008 - DNA, 22 bp, Homo sapiens
caggggctctgggtgatgtgag

SEQ ID NO: 9347009 - DNA, 22 bp, Homo sapiens
caggggctgagaaggaacgtcc

SEQ ID NO: 9347010 - DNA, 22 bp, Homo sapiens
caggggctgtggcacatggtgt

SEQ ID NO: 9347011 - DNA, 22 bp, Homo sapiens
caggggctgtggcacatggtgt

SEQ ID NO: 9347012 - DNA, 22 bp, Homo sapiens
cagggtcttggcgccatcaccc

SEQ ID NO: 9347013 - DNA, 22 bp, Homo sapiens
cagggtcttggcgccatcaccc

SEQ ID NO: 9347014 - DNA, 23 bp, Homo sapiens
cagggtgaccaatgtggccatca

SEQ ID NO: 9347015 - DNA, 22 bp, Homo sapiens
caggggctgtgggcggagcctc

SEQ ID NO: 9347016 - DNA, 22 bp, Homo sapiens
caggggctgtttgcctcaggcc

SEQ ID NO: 9347017 - DNA, 22 bp, Homo sapiens
caggggctgtttgcctcaggcc

SEQ ID NO: 9347018 - DNA, 22 bp, Homo sapiens
cagggtgcagtgtcgctgctag

SEQ ID NO: 9347019 - DNA, 22 bp, Homo sapiens
cagggtgagcctctggagccct

SEQ ID NO: 9347020 - DNA, 22 bp, Homo sapiens
cagggtgagcctctggagccct

SEQ ID NO: 9347021 - DNA, 22 bp, Homo sapiens
cagggctccctgcagcctctgt

SEQ ID NO: 9347022 - DNA, 22 bp, Homo sapiens
cagggctccctgcagcctctgt

SEQ ID NO: 9347023 - DNA, 22 bp, Homo sapiens
cagggctccccgcaccgcagcc

SEQ ID NO: 9347024 - DNA, 22 bp, Homo sapiens
cagggctccctctggctcccag

SEQ ID NO: 9347025 - DNA, 22 bp, Homo sapiens
cagggctccccagagagcctct

SEQ ID NO: 9347026 - DNA, 22 bp, Homo sapiens
cagggctccccagagagcctct

SEQ ID NO: 9347027 - DNA, 22 bp, Homo sapiens
cagggctccccagagagcctct

SEQ ID NO: 9347028 - DNA, 22 bp, Homo sapiens
cagggctcccaaatatctcttc

SEQ ID NO: 9347029 - DNA, 22 bp, Homo sapiens
cagggcctgcctggttcctgga

SEQ ID NO: 9347030 - DNA, 22 bp, Homo sapiens
cagggcctgcctggttcctgga

SEQ ID NO: 9347031 - DNA, 22 bp, Homo sapiens
cagggctccatgcagggactcc

SEQ ID NO: 9347032 - DNA, 22 bp, Homo sapiens
cagggctcgctgccagcttcag

SEQ ID NO: 9347033 - DNA, 22 bp, Homo sapiens
cagggctcgctcgctcgctcgc

SEQ ID NO: 9347034 - DNA, 22 bp, Homo sapiens
cagggctcgctcgctcgctcgc

SEQ ID NO: 9347035 - DNA, 22 bp, Homo sapiens
cagggcttggatctgtggtcag

SEQ ID NO: 9347036 - DNA, 22 bp, Homo sapiens
cagggcttgatctgcatcctgc

SEQ ID NO: 9347037 - DNA, 22 bp, Homo sapiens
cagggcttgatctgcatcctgc

SEQ ID NO: 9347038 - DNA, 22 bp, Homo sapiens
caggggctccctgggtgccagt

SEQ ID NO: 9347039 - DNA, 22 bp, Homo sapiens
caggggctccctgggtgccagt

SEQ ID NO: 9347040 - DNA, 22 bp, Homo sapiens
cagggcctcctaaggcatctaa

SEQ ID NO: 9347041 - DNA, 22 bp, Homo sapiens
cagggcctcctaaggcatctaa

SEQ ID NO: 9347042 - DNA, 23 bp, Homo sapiens
cagggccaggcagcagctgtcac

SEQ ID NO: 9347043 - DNA, 22 bp, Homo sapiens
cagggcctccccggcagtcttt

SEQ ID NO: 9347044 - DNA, 22 bp, Homo sapiens
cagggatgtgatgagctgagcc

SEQ ID NO: 9347045 - DNA, 22 bp, Homo sapiens
cagggatgtgatgagctgagcc

SEQ ID NO: 9347046 - DNA, 22 bp, Homo sapiens
cagggatgtctctggaagggag

SEQ ID NO: 9347047 - DNA, 22 bp, Homo sapiens
cagggatggttgagaattggta

SEQ ID NO: 9347048 - DNA, 22 bp, Homo sapiens
cagggatgtctctggaagggag

SEQ ID NO: 9347049 - DNA, 22 bp, Homo sapiens
cagggatgtctctggaagggag

SEQ ID NO: 9347050 - DNA, 22 bp, Homo sapiens
cagggcctctgtgggctctctc

SEQ ID NO: 9347051 - DNA, 22 bp, Homo sapiens
cagggcctctgtgggctctctc

SEQ ID NO: 9347052 - DNA, 22 bp, Homo sapiens
cagggcctgagggctgctctgc

SEQ ID NO: 9347053 - DNA, 22 bp, Homo sapiens
cagggcctgagggctgctctgc

SEQ ID NO: 9347054 - DNA, 22 bp, Homo sapiens
cagggcctgcaagagacctggg

SEQ ID NO: 9347055 - DNA, 22 bp, Homo sapiens
cagggcctgcaagagacctggg

SEQ ID NO: 9347056 - DNA, 22 bp, Homo sapiens
cagggcctcgaagcctctgggc

SEQ ID NO: 9347057 - DNA, 22 bp, Homo sapiens
cagggcctcgaagcctctgggc

SEQ ID NO: 9347058 - DNA, 22 bp, Homo sapiens
cagggcctcctaaggcatctaa

SEQ ID NO: 9347059 - DNA, 22 bp, Homo sapiens
cagggcctcgaagcctctgggc

SEQ ID NO: 9347060 - DNA, 22 bp, Homo sapiens
cagggcctctcatcccacgggc

SEQ ID NO: 9347061 - DNA, 22 bp, Homo sapiens
cagggcctctcctccaggaact

SEQ ID NO: 9347062 - DNA, 22 bp, Homo sapiens
cagggcctctcctccaggaact

SEQ ID NO: 9347063 - DNA, 22 bp, Homo sapiens
caggctcagatgccctgcgctg

SEQ ID NO: 9347064 - DNA, 22 bp, Homo sapiens
caggctcagatgccctgcgctg

SEQ ID NO: 9347065 - DNA, 22 bp, Homo sapiens
caggctcagatgccctgcgctg

SEQ ID NO: 9347066 - DNA, 22 bp, Homo sapiens
caggctcagcaggagcctgacc

SEQ ID NO: 9347067 - DNA, 22 bp, Homo sapiens
caggctcagcaggagcctgacc

SEQ ID NO: 9347068 - DNA, 22 bp, Homo sapiens
caggctcagctctggccagtgc

SEQ ID NO: 9347069 - DNA, 22 bp, Homo sapiens
caggctcagctctggccagtgc

SEQ ID NO: 9347070 - DNA, 22 bp, Homo sapiens
caggctcagctctggccagtgc

SEQ ID NO: 9347071 - DNA, 22 bp, Homo sapiens
agctgtgattatccactggaat

SEQ ID NO: 9347072 - DNA, 22 bp, Homo sapiens
caggctccactgtaggcagctc

SEQ ID NO: 9347073 - DNA, 22 bp, Homo sapiens
caggctccactgtaggcagctc

SEQ ID NO: 9347074 - DNA, 22 bp, Homo sapiens
caggctccaagccctctgatgt

SEQ ID NO: 9347075 - DNA, 22 bp, Homo sapiens
caggctccacaggggaatccgg

SEQ ID NO: 9347076 - DNA, 22 bp, Homo sapiens
caggctcactttctcagtcaca

SEQ ID NO: 9347077 - DNA, 22 bp, Homo sapiens
caggctcactttctcagtcaca

SEQ ID NO: 9347078 - DNA, 22 bp, Homo sapiens
caggctcactttctcagtcaca

SEQ ID NO: 9347079 - DNA, 22 bp, Homo sapiens
caggctcactgtaaggtcagct

SEQ ID NO: 9347080 - DNA, 22 bp, Homo sapiens
caggctcactgtaaggtcagct

SEQ ID NO: 9347081 - DNA, 22 bp, Homo sapiens
caggcctgtctgcacatgaggc

SEQ ID NO: 9347082 - DNA, 22 bp, Homo sapiens
caggcctgtctgcacatgaggc

SEQ ID NO: 9347083 - DNA, 22 bp, Homo sapiens
caggctcactgtaaggtcagct

SEQ ID NO: 9347084 - DNA, 22 bp, Homo sapiens
caggcctgtctgcacatgaggc

SEQ ID NO: 9347085 - DNA, 18 bp, Homo sapiens
agctggggcctctggtcc

SEQ ID NO: 9347086 - DNA, 18 bp, Homo sapiens
agctggggcctctggtcc

SEQ ID NO: 9347087 - DNA, 19 bp, Homo sapiens
agctggggcggtgtgtgtt

SEQ ID NO: 9347088 - DNA, 22 bp, Homo sapiens
agctggggcatttatccactaa

SEQ ID NO: 9347089 - DNA, 22 bp, Homo sapiens
agctggggcatttatccactaa

SEQ ID NO: 9347090 - DNA, 22 bp, Homo sapiens
agctggggcatttatccactaa

SEQ ID NO: 9347091 - DNA, 22 bp, Homo sapiens
caggctgcggccgtgtgagcat

SEQ ID NO: 9347092 - DNA, 22 bp, Homo sapiens
caggctgcggtcggctctggtc

SEQ ID NO: 9347093 - DNA, 22 bp, Homo sapiens
caggctgcggtcggctctggtc

SEQ ID NO: 9347094 - DNA, 22 bp, Homo sapiens
caggctgcggccgtgtgagcat

SEQ ID NO: 9347095 - DNA, 22 bp, Homo sapiens
caggctgcgtttgtgaaaggta

SEQ ID NO: 9347096 - DNA, 22 bp, Homo sapiens
caggctgcgtttgtgaaaggta

SEQ ID NO: 9347097 - DNA, 22 bp, Homo sapiens
caggctgctccagggtaggaaa

SEQ ID NO: 9347098 - DNA, 22 bp, Homo sapiens
caggctgcggtcggctctggtc

SEQ ID NO: 9347099 - DNA, 22 bp, Homo sapiens
caggctgcggtcggctctggtc

SEQ ID NO: 9347100 - DNA, 22 bp, Homo sapiens
caggctgcggtcggctctggtc

SEQ ID NO: 9347101 - DNA, 22 bp, Homo sapiens
agctgtggcagcactttggagt

SEQ ID NO: 9347102 - DNA, 22 bp, Homo sapiens
agctgtggcagcactttggagt

SEQ ID NO: 9347103 - DNA, 19 bp, Homo sapiens
agctgtggatgtgggattt

SEQ ID NO: 9347104 - DNA, 22 bp, Homo sapiens
agctgtggaaatcaggcaatga

SEQ ID NO: 9347105 - DNA, 22 bp, Homo sapiens
agctgtggaaatcaggcaatga

SEQ ID NO: 9347106 - DNA, 22 bp, Homo sapiens
agctgtgctgccaagttgctga

SEQ ID NO: 9347107 - DNA, 22 bp, Homo sapiens
agctgtgctgccaagttgctga

SEQ ID NO: 9347108 - DNA, 22 bp, Homo sapiens
agctgtgcctattcgtggcaag

SEQ ID NO: 9347109 - DNA, 22 bp, Homo sapiens
agctgtgcacactgtgaagtag

SEQ ID NO: 9347110 - DNA, 22 bp, Homo sapiens
agctgtgccttgctgcacggtg

SEQ ID NO: 9347111 - DNA, 22 bp, Homo sapiens
caggctggagtgcagtgtcgcc

SEQ ID NO: 9347112 - DNA, 22 bp, Homo sapiens
caggctggacattagatacata

SEQ ID NO: 9347113 - DNA, 22 bp, Homo sapiens
caggctggagtacaattgtgtg

SEQ ID NO: 9347114 - DNA, 22 bp, Homo sapiens
caggctgctgcctagaatgaca

SEQ ID NO: 9347115 - DNA, 22 bp, Homo sapiens
caggctggacattagatacata

SEQ ID NO: 9347116 - DNA, 22 bp, Homo sapiens
caggctgctgtccacaaagcat

SEQ ID NO: 9347117 - DNA, 22 bp, Homo sapiens
caggctgctgtccacaaagcat

SEQ ID NO: 9347118 - DNA, 22 bp, Homo sapiens
caggctggagttacctttaggg

SEQ ID NO: 9347119 - DNA, 22 bp, Homo sapiens
caggctggagttacctttaggg

SEQ ID NO: 9347120 - DNA, 22 bp, Homo sapiens
caggctggagtgcagttgtgca

SEQ ID NO: 9347121 - DNA, 22 bp, Homo sapiens
caggctggagtgcagttgtgca

SEQ ID NO: 9347122 - DNA, 22 bp, Homo sapiens
caggctggagttacctttaggg

SEQ ID NO: 9347123 - DNA, 22 bp, Homo sapiens
cagggagaaatctccaggaggt

SEQ ID NO: 9347124 - DNA, 22 bp, Homo sapiens
caggctggagttacctttaggg

SEQ ID NO: 9347125 - DNA, 22 bp, Homo sapiens
cagggagaaatctccaggaggt

SEQ ID NO: 9347126 - DNA, 22 bp, Homo sapiens
cagggagctattagggttagtg

SEQ ID NO: 9347127 - DNA, 22 bp, Homo sapiens
cagggagaaatctccaggaggt

SEQ ID NO: 9347128 - DNA, 22 bp, Homo sapiens
cagggagaaatctccaggaggt

SEQ ID NO: 9347129 - DNA, 22 bp, Homo sapiens
cagggagcggagtcccatgcct

SEQ ID NO: 9347130 - DNA, 22 bp, Homo sapiens
cagggatgggatggagtcagtt

SEQ ID NO: 9347131 - DNA, 22 bp, Homo sapiens
cagggatgggatggagtcagtt

SEQ ID NO: 9347132 - DNA, 22 bp, Homo sapiens
cagggatggttgagaattggta

SEQ ID NO: 9347133 - DNA, 19 bp, Homo sapiens
cagggatgggtagggactc

SEQ ID NO: 9347134 - DNA, 19 bp, Homo sapiens
cagggatgggtagggactc

SEQ ID NO: 9347135 - DNA, 19 bp, Homo sapiens
cagggatgggtagggactc

SEQ ID NO: 9347136 - DNA, 22 bp, Homo sapiens
cagggatggcgctggctgcccg

SEQ ID NO: 9347137 - DNA, 22 bp, Homo sapiens
cagggatggcgctggctgcccg

SEQ ID NO: 9347138 - DNA, 22 bp, Homo sapiens
cagggatgggatggagtcagtt

SEQ ID NO: 9347139 - DNA, 22 bp, Homo sapiens
cagggagctttcccaggaccct

SEQ ID NO: 9347140 - DNA, 22 bp, Homo sapiens
cagggagctggagttggagtac

SEQ ID NO: 9347141 - DNA, 22 bp, Homo sapiens
cagggagctgacaaccaaggag

SEQ ID NO: 9347142 - DNA, 22 bp, Homo sapiens
cagggagctggctggctgtgcc

SEQ ID NO: 9347143 - DNA, 22 bp, Homo sapiens
cagggagctggctggcgtgagt

SEQ ID NO: 9347144 - DNA, 22 bp, Homo sapiens
cagggagctggctggctgtgcc

SEQ ID NO: 9347145 - DNA, 22 bp, Homo sapiens
aggagaagtaaggctagatgat

SEQ ID NO: 9347146 - DNA, 22 bp, Homo sapiens
aggagaagtaaggctagatgat

SEQ ID NO: 9347147 - DNA, 22 bp, Homo sapiens
aggagaaggaggcccctcacac

SEQ ID NO: 9347148 - DNA, 19 bp, Homo sapiens
aggagaagtagcagaaatt

SEQ ID NO: 9347149 - DNA, 19 bp, Homo sapiens
aggagaagtagcagaaatt

SEQ ID NO: 9347150 - DNA, 22 bp, Homo sapiens
cagtggagagacttttactctt

SEQ ID NO: 9347151 - DNA, 19 bp, Homo sapiens
aggagaagtagcagaaatt

SEQ ID NO: 9347152 - DNA, 19 bp, Homo sapiens
aggagaagtagcagaaatt

SEQ ID NO: 9347153 - DNA, 22 bp, Homo sapiens
cagtggccttgatgcctcattc

SEQ ID NO: 9347154 - DNA, 19 bp, Homo sapiens
cagtggcctggaggtctct

SEQ ID NO: 9347155 - DNA, 22 bp, Homo sapiens
cagtggccgcggggctgtgggt

SEQ ID NO: 9347156 - DNA, 22 bp, Homo sapiens
cagtggcctctggctttgctgt

SEQ ID NO: 9347157 - DNA, 22 bp, Homo sapiens
cagtggcctgagccaggcttcc

SEQ ID NO: 9347158 - DNA, 18 bp, Homo sapiens
cagtggcatagttgagta

SEQ ID NO: 9347159 - DNA, 22 bp, Homo sapiens
cagtggcatggttgactgcagt

SEQ ID NO: 9347160 - DNA, 22 bp, Homo sapiens
cagtggcatggttgactgcagt

SEQ ID NO: 9347161 - DNA, 22 bp, Homo sapiens
cagtggccatggtggcaggggt

SEQ ID NO: 9347162 - DNA, 22 bp, Homo sapiens
cagtggccaacttcctgcctct

SEQ ID NO: 9347163 - DNA, 22 bp, Homo sapiens
cagtggcatacttggctgatat

SEQ ID NO: 9347164 - DNA, 22 bp, Homo sapiens
cagtggcatacttggctgatat

SEQ ID NO: 9347165 - DNA, 22 bp, Homo sapiens
cagtggagaggcatgcttggca

SEQ ID NO: 9347166 - DNA, 22 bp, Homo sapiens
cagtggcatacttggctgatat

SEQ ID NO: 9347167 - DNA, 22 bp, Homo sapiens
cagtgcaggtggcagaggacag

SEQ ID NO: 9347168 - DNA, 21 bp, Homo sapiens
cagtgcaggggttagcgtgta

SEQ ID NO: 9347169 - DNA, 21 bp, Homo sapiens
cagtgcaggggttagcgtgta

SEQ ID NO: 9347170 - DNA, 22 bp, Homo sapiens
aggacgctctcgctgaacttct

SEQ ID NO: 9347171 - DNA, 22 bp, Homo sapiens
cagtgcctcaggccagcctgca

SEQ ID NO: 9347172 - DNA, 22 bp, Homo sapiens
cagtgcctcaggccagcctgca

SEQ ID NO: 9347173 - DNA, 22 bp, Homo sapiens
cagtgcctcttaagtgtcaccc

SEQ ID NO: 9347174 - DNA, 19 bp, Homo sapiens
aggactctggaggcatgag

SEQ ID NO: 9347175 - DNA, 22 bp, Homo sapiens
cagtgcccttccaggactgcag

SEQ ID NO: 9347176 - DNA, 22 bp, Homo sapiens
cagtgctagggcagagcactcc

SEQ ID NO: 9347177 - DNA, 22 bp, Homo sapiens
cagtgctataatccagtgtcgt

SEQ ID NO: 9347178 - DNA, 22 bp, Homo sapiens
cagtgctcatagctgttcctcc

SEQ ID NO: 9347179 - DNA, 22 bp, Homo sapiens
cagtgctcccgctgccgctgtg

SEQ ID NO: 9347180 - DNA, 22 bp, Homo sapiens
cagtgctcatagctgttcctcc

SEQ ID NO: 9347181 - DNA, 21 bp, Homo sapiens
cagtgctcaggaatagagaga

SEQ ID NO: 9347182 - DNA, 22 bp, Homo sapiens
aggagaaggaagtgcatcacta

SEQ ID NO: 9347183 - DNA, 20 bp, Homo sapiens
cagtgcctgccccttgggtt

SEQ ID NO: 9347184 - DNA, 22 bp, Homo sapiens
cagtgcctggatagcaacatga

SEQ ID NO: 9347185 - DNA, 22 bp, Homo sapiens
cagtgctaccccggaagttggt

SEQ ID NO: 9347186 - DNA, 22 bp, Homo sapiens
cagtgcctggcatagaggcggc

SEQ ID NO: 9347187 - DNA, 22 bp, Homo sapiens
cagtgcctggccggcttccatt

SEQ ID NO: 9347188 - DNA, 22 bp, Homo sapiens
aggaccattatgcttgctgaaa

SEQ ID NO: 9347189 - DNA, 22 bp, Homo sapiens
aggaccagtgagtctggcaagt

SEQ ID NO: 9347190 - DNA, 23 bp, Homo sapiens
aggaccaggttcccaaaagtcaa

SEQ ID NO: 9347191 - DNA, 22 bp, Homo sapiens
aggaccagtatgagagcatctg

SEQ ID NO: 9347192 - DNA, 22 bp, Homo sapiens
aggaccagtgagtctggcaagt

SEQ ID NO: 9347193 - DNA, 22 bp, Homo sapiens
aggaccagtgagtctggcaagt

SEQ ID NO: 9347194 - DNA, 22 bp, Homo sapiens
aggaccagtatgagagcatctg

SEQ ID NO: 9347195 - DNA, 22 bp, Homo sapiens
aggaccagaccgaactagctaa

SEQ ID NO: 9347196 - DNA, 22 bp, Homo sapiens
aggacctgactggctcctgctt

SEQ ID NO: 9347197 - DNA, 22 bp, Homo sapiens
aggacctgtagggcctgcatcc

SEQ ID NO: 9347198 - DNA, 22 bp, Homo sapiens
aggacgctctcgctgaacttct

SEQ ID NO: 9347199 - DNA, 22 bp, Homo sapiens
aggacctgacattgtgttttct

SEQ ID NO: 9347200 - DNA, 22 bp, Homo sapiens
aggacccacgcacaggaacccc

SEQ ID NO: 9347201 - DNA, 22 bp, Homo sapiens
caggtggcttctccctaggcca

SEQ ID NO: 9347202 - DNA, 22 bp, Homo sapiens
caggtggcttctccctaggcca

SEQ ID NO: 9347203 - DNA, 22 bp, Homo sapiens
caggtggcttctccctaggcca

SEQ ID NO: 9347204 - DNA, 22 bp, Homo sapiens
caggtggcttctccctaggcca

SEQ ID NO: 9347205 - DNA, 22 bp, Homo sapiens
caggtggcttctccctaggcca

SEQ ID NO: 9347206 - DNA, 22 bp, Homo sapiens
caggtggcttctccctaggcca

SEQ ID NO: 9347207 - DNA, 22 bp, Homo sapiens
caggtgccatagacgggcctgg

SEQ ID NO: 9347208 - DNA, 22 bp, Homo sapiens
caggtgcagctggatggaagcc

SEQ ID NO: 9347209 - DNA, 22 bp, Homo sapiens
caggtgggagccacagcgtaca

SEQ ID NO: 9347210 - DNA, 22 bp, Homo sapiens
caggtggcttctctgcagcctt

SEQ ID NO: 9347211 - DNA, 22 bp, Homo sapiens
caggtggcttctctgcagcctt

SEQ ID NO: 9347212 - DNA, 22 bp, Homo sapiens
caggtggcttctctgcagcctt

SEQ ID NO: 9347213 - DNA, 22 bp, Homo sapiens
caggtgggagcgaggagctact

SEQ ID NO: 9347214 - DNA, 22 bp, Homo sapiens
caggtgggagcgaggagctact

SEQ ID NO: 9347215 - DNA, 22 bp, Homo sapiens
caggtgggagcggagactgatt

SEQ ID NO: 9347216 - DNA, 22 bp, Homo sapiens
caggtgggagcgaggagctact

SEQ ID NO: 9347217 - DNA, 22 bp, Homo sapiens
aggacaggattgagctgaactg

SEQ ID NO: 9347218 - DNA, 22 bp, Homo sapiens
aggacaggattgagctgaactg

SEQ ID NO: 9347219 - DNA, 22 bp, Homo sapiens
aggacatgtttgtatcttcctt

SEQ ID NO: 9347220 - DNA, 22 bp, Homo sapiens
aggacatgtgcctccagggcag

SEQ ID NO: 9347221 - DNA, 22 bp, Homo sapiens
aggacattcatttcaaggagga

SEQ ID NO: 9347222 - DNA, 22 bp, Homo sapiens
aggagggagcttaagccaggca

SEQ ID NO: 9347223 - DNA, 22 bp, Homo sapiens
aggagggagcttaagccaggca

SEQ ID NO: 9347224 - DNA, 22 bp, Homo sapiens
aggagggagcttaagccaggca

SEQ ID NO: 9347225 - DNA, 22 bp, Homo sapiens
aggagggagcactatatgggga

SEQ ID NO: 9347226 - DNA, 22 bp, Homo sapiens
aggagggagcactatatgggga

SEQ ID NO: 9347227 - DNA, 21 bp, Homo sapiens
aggaggctgtctctttcagct

SEQ ID NO: 9347228 - DNA, 21 bp, Homo sapiens
aggaggctgtctctttcagct

SEQ ID NO: 9347229 - DNA, 22 bp, Homo sapiens
catatttattcttctgccagtg

SEQ ID NO: 9347230 - DNA, 22 bp, Homo sapiens
catatttcagtctaagatgtgt

SEQ ID NO: 9347231 - DNA, 22 bp, Homo sapiens
catatttagtgtttggagatcg

SEQ ID NO: 9347232 - DNA, 22 bp, Homo sapiens
catatttagtgtttggagatcg

SEQ ID NO: 9347233 - DNA, 22 bp, Homo sapiens
catattagcctccactgggaca

SEQ ID NO: 9347234 - DNA, 22 bp, Homo sapiens
catattagacacttatgtccac

SEQ ID NO: 9347235 - DNA, 22 bp, Homo sapiens
catattaaggtctgtaaggggt

SEQ ID NO: 9347236 - DNA, 22 bp, Homo sapiens
catagagtgatgtaaggtatgt

SEQ ID NO: 9347237 - DNA, 22 bp, Homo sapiens
catagcaacagcatcaagtcaa

SEQ ID NO: 9347238 - DNA, 22 bp, Homo sapiens
catagcaaggtgctttccacat

SEQ ID NO: 9347239 - DNA, 22 bp, Homo sapiens
catagcaagatcacattctgta

SEQ ID NO: 9347240 - DNA, 22 bp, Homo sapiens
catagcaacagcatcaagtcaa

SEQ ID NO: 9347241 - DNA, 22 bp, Homo sapiens
catacattacctaacttaatgc

SEQ ID NO: 9347242 - DNA, 22 bp, Homo sapiens
catacattacctaacttaatgc

SEQ ID NO: 9347243 - DNA, 22 bp, Homo sapiens
catacatatgtggatgtcatat

SEQ ID NO: 9347244 - DNA, 22 bp, Homo sapiens
catacatatgtggatgtcatat

SEQ ID NO: 9347245 - DNA, 22 bp, Homo sapiens
catacatatgtggatgtcatat

SEQ ID NO: 9347246 - DNA, 22 bp, Homo sapiens
cagttttatgaatgcttattag

SEQ ID NO: 9347247 - DNA, 22 bp, Homo sapiens
cagttttatacactgcagctcc

SEQ ID NO: 9347248 - DNA, 22 bp, Homo sapiens
catagcggtattccacgtggtt

SEQ ID NO: 9347249 - DNA, 22 bp, Homo sapiens
catagtgactcatgcctataat

SEQ ID NO: 9347250 - DNA, 22 bp, Homo sapiens
cataggaatgaggacaattagc

SEQ ID NO: 9347251 - DNA, 22 bp, Homo sapiens
cataggtcactgtacaggttaa

SEQ ID NO: 9347252 - DNA, 22 bp, Homo sapiens
catataaatacaacatgtgtta

SEQ ID NO: 9347253 - DNA, 22 bp, Homo sapiens
catataaatacaacatgtgtta

SEQ ID NO: 9347254 - DNA, 22 bp, Homo sapiens
catagtgtctggtaacatagta

SEQ ID NO: 9347255 - DNA, 22 bp, Homo sapiens
cagtggtatttgagagaatgga

SEQ ID NO: 9347256 - DNA, 22 bp, Homo sapiens
cagtgggtgcctctcattatat

SEQ ID NO: 9347257 - DNA, 22 bp, Homo sapiens
cagtgggtgccatcgtgccctt

SEQ ID NO: 9347258 - DNA, 22 bp, Homo sapiens
cagtgggtggcctcttgagtca

SEQ ID NO: 9347259 - DNA, 22 bp, Homo sapiens
cagtgggtggctaagtggctga

SEQ ID NO: 9347260 - DNA, 22 bp, Homo sapiens
cagtgggtggctaagtggctga

SEQ ID NO: 9347261 - DNA, 22 bp, Homo sapiens
cagtgggtgatgagtcctgggg

SEQ ID NO: 9347262 - DNA, 22 bp, Homo sapiens
cagtggctgagagtggacactg

SEQ ID NO: 9347263 - DNA, 22 bp, Homo sapiens
cagtggcgtgatctctgctcac

SEQ ID NO: 9347264 - DNA, 22 bp, Homo sapiens
cagtggcgtgatctctgctcac

SEQ ID NO: 9347265 - DNA, 22 bp, Homo sapiens
cagtggtgaagagcaggggctc

SEQ ID NO: 9347266 - DNA, 18 bp, Homo sapiens
cagtggtgctgggatgtg

SEQ ID NO: 9347267 - DNA, 22 bp, Homo sapiens
cagtggttatacttactgtttc

SEQ ID NO: 9347268 - DNA, 22 bp, Homo sapiens
cagtggttatacttactgtttc

SEQ ID NO: 9347269 - DNA, 22 bp, Homo sapiens
cagtttatatgtcagagctgta

SEQ ID NO: 9347270 - DNA, 22 bp, Homo sapiens
cagtttatattctagtgctgtt

SEQ ID NO: 9347271 - DNA, 20 bp, Homo sapiens
cagtttatctttccggagct

SEQ ID NO: 9347272 - DNA, 22 bp, Homo sapiens
cagtttatgcagctggaataga

SEQ ID NO: 9347273 - DNA, 22 bp, Homo sapiens
cagtttatgcagctggaataga

SEQ ID NO: 9347274 - DNA, 22 bp, Homo sapiens
cagtttatgcagctggaataga

SEQ ID NO: 9347275 - DNA, 22 bp, Homo sapiens
cagtttccctgcttgaaaacgt

SEQ ID NO: 9347276 - DNA, 22 bp, Homo sapiens
cagtttcagctcaagcactcag

SEQ ID NO: 9347277 - DNA, 22 bp, Homo sapiens
cagtttatttccaagatgacaa

SEQ ID NO: 9347278 - DNA, 22 bp, Homo sapiens
cagtttatttccaagatgacaa

SEQ ID NO: 9347279 - DNA, 19 bp, Homo sapiens
cagtttatgctttggggac

SEQ ID NO: 9347280 - DNA, 22 bp, Homo sapiens
cagtttattgttgcgttcacat

SEQ ID NO: 9347281 - DNA, 22 bp, Homo sapiens
cagtttattgttgcgttcacat

SEQ ID NO: 9347282 - DNA, 22 bp, Homo sapiens
cagtttctacgacttaagcaca

SEQ ID NO: 9347283 - DNA, 22 bp, Homo sapiens
cagtttctacgacttaagcaca

SEQ ID NO: 9347284 - DNA, 22 bp, Homo sapiens
cagtttctacgaaggtcaaccc

SEQ ID NO: 9347285 - DNA, 22 bp, Homo sapiens
cagtttctctcaataagcatcg

SEQ ID NO: 9347286 - DNA, 22 bp, Homo sapiens
cagtttctccaaacgcaggctg

SEQ ID NO: 9347287 - DNA, 22 bp, Homo sapiens
cagtttctctcaataagcatcg

SEQ ID NO: 9347288 - DNA, 22 bp, Homo sapiens
cagttttacccaagcttatttt

SEQ ID NO: 9347289 - DNA, 22 bp, Homo sapiens
cagttttagctagagcaaacca

SEQ ID NO: 9347290 - DNA, 22 bp, Homo sapiens
cagttttaggacatgtggatgt

SEQ ID NO: 9347291 - DNA, 22 bp, Homo sapiens
ccaagcagtctgctaggagttt

SEQ ID NO: 9347292 - DNA, 22 bp, Homo sapiens
ccaagctgagcaccatctgatc

SEQ ID NO: 9347293 - DNA, 22 bp, Homo sapiens
ccaagctgactgtgctgttgtg

SEQ ID NO: 9347294 - DNA, 22 bp, Homo sapiens
ccaagctggacagcagcaagga

SEQ ID NO: 9347295 - DNA, 22 bp, Homo sapiens
ccaagctggacagcagcaagga

SEQ ID NO: 9347296 - DNA, 22 bp, Homo sapiens
ccaagctacttaggagtctgag

SEQ ID NO: 9347297 - DNA, 22 bp, Homo sapiens
ccaagctacttaggagtctgag

SEQ ID NO: 9347298 - DNA, 22 bp, Homo sapiens
ccaagctacttaggagtctgag

SEQ ID NO: 9347299 - DNA, 22 bp, Homo sapiens
ccaagcagaaccattcaggcac

SEQ ID NO: 9347300 - DNA, 17 bp, Homo sapiens
ccaagatgatagaggga

SEQ ID NO: 9347301 - DNA, 16 bp, Homo sapiens
ccaagcagcagcagct

SEQ ID NO: 9347302 - DNA, 22 bp, Homo sapiens
ccaagcagagcagcctctctgg

SEQ ID NO: 9347303 - DNA, 23 bp, Homo sapiens
aggcagcaggttgtccagggtga

SEQ ID NO: 9347304 - DNA, 23 bp, Homo sapiens
aggcagcaggttgtccagggtga

SEQ ID NO: 9347305 - DNA, 23 bp, Homo sapiens
aggcagcaggttgtccagggtga

SEQ ID NO: 9347306 - DNA, 22 bp, Homo sapiens
aggcagcagggccactggctga

SEQ ID NO: 9347307 - DNA, 22 bp, Homo sapiens
ccaaaggccaggcactgaggtt

SEQ ID NO: 9347308 - DNA, 22 bp, Homo sapiens
ccaaggtttattttgatacatt

SEQ ID NO: 9347309 - DNA, 22 bp, Homo sapiens
ccaaggttttctggcactattt

SEQ ID NO: 9347310 - DNA, 19 bp, Homo sapiens
ccaaggttggcagctgggc

SEQ ID NO: 9347311 - DNA, 20 bp, Homo sapiens
ccaaggttggaggcagggtg

SEQ ID NO: 9347312 - DNA, 22 bp, Homo sapiens
ccaagtcctgctgccactctac

SEQ ID NO: 9347313 - DNA, 18 bp, Homo sapiens
ccaagtatggcagaggct

SEQ ID NO: 9347314 - DNA, 22 bp, Homo sapiens
ccaagtcttggttctgtatctt

SEQ ID NO: 9347315 - DNA, 22 bp, Homo sapiens
ccaagtgatttctaagtttatt

SEQ ID NO: 9347316 - DNA, 22 bp, Homo sapiens
ccaagtgatacacccgcctcgg

SEQ ID NO: 9347317 - DNA, 22 bp, Homo sapiens
ccaagtgagttgcgtaaatgga

SEQ ID NO: 9347318 - DNA, 20 bp, Homo sapiens
ccaataaagctctataggga

SEQ ID NO: 9347319 - DNA, 18 bp, Homo sapiens
aggcaggctggagtgact

SEQ ID NO: 9347320 - DNA, 18 bp, Homo sapiens
aggcaggctggagtgact

SEQ ID NO: 9347321 - DNA, 22 bp, Homo sapiens
aggcaggctggtctgaagagtg

SEQ ID NO: 9347322 - DNA, 18 bp, Homo sapiens
aggcaggctggagtgact

SEQ ID NO: 9347323 - DNA, 22 bp, Homo sapiens
ccaataactgtaactttctgtg

SEQ ID NO: 9347324 - DNA, 22 bp, Homo sapiens
ccaagggctgctgaggtgtcca

SEQ ID NO: 9347325 - DNA, 22 bp, Homo sapiens
ccaaggttagaaaaggtacttt

SEQ ID NO: 9347326 - DNA, 22 bp, Homo sapiens
ccaaggttgagaaactgtagga

SEQ ID NO: 9347327 - DNA, 22 bp, Homo sapiens
ccaaggttgcaggcctcagaga

SEQ ID NO: 9347328 - DNA, 22 bp, Homo sapiens
ccaaggtgggaggattgcttga

SEQ ID NO: 9347329 - DNA, 22 bp, Homo sapiens
ccaaggagaaatgctgtgcttt

SEQ ID NO: 9347330 - DNA, 22 bp, Homo sapiens
ccaagggctctgacttgcctgc

SEQ ID NO: 9347331 - DNA, 15 bp, Homo sapiens
aggcactgtgggacc

SEQ ID NO: 9347332 - DNA, 22 bp, Homo sapiens
aggcactgtggaagacatggtt

SEQ ID NO: 9347333 - DNA, 22 bp, Homo sapiens
aggcactgtgcttcttatatgt

SEQ ID NO: 9347334 - DNA, 22 bp, Homo sapiens
aggcactgtggaagacatggtt

SEQ ID NO: 9347335 - DNA, 22 bp, Homo sapiens
aggcactgtggaagacatggtt

SEQ ID NO: 9347336 - DNA, 22 bp, Homo sapiens
aggcactgtactaggtacaggg

SEQ ID NO: 9347337 - DNA, 22 bp, Homo sapiens
aggcactgtactaggtacaggg

SEQ ID NO: 9347338 - DNA, 22 bp, Homo sapiens
aggcactgtactaggtacaggg

SEQ ID NO: 9347339 - DNA, 22 bp, Homo sapiens
aggcactgtgctgatgtcttat

SEQ ID NO: 9347340 - DNA, 22 bp, Homo sapiens
aggcactgtgcagtcccaagca

SEQ ID NO: 9347341 - DNA, 23 bp, Homo sapiens
catgtttttctatctcagcgtgt

SEQ ID NO: 9347342 - DNA, 22 bp, Homo sapiens
cattaaaatatctcatggtgtt

SEQ ID NO: 9347343 - DNA, 22 bp, Homo sapiens
cattaaattccttgttctcaaa

SEQ ID NO: 9347344 - DNA, 22 bp, Homo sapiens
cattaaacaaccttgaatcaat

SEQ ID NO: 9347345 - DNA, 22 bp, Homo sapiens
cattaaacaaccttgaatcaat

SEQ ID NO: 9347346 - DNA, 22 bp, Homo sapiens
cattaaatatcaacctagacta

SEQ ID NO: 9347347 - DNA, 22 bp, Homo sapiens
cattaaatcttccagacctcac

SEQ ID NO: 9347348 - DNA, 19 bp, Homo sapiens
aggcagcaggccagggatg

SEQ ID NO: 9347349 - DNA, 21 bp, Homo sapiens
aggcagcaggatccagggaca

SEQ ID NO: 9347350 - DNA, 22 bp, Homo sapiens
cattttaaatgatttaagccaa

SEQ ID NO: 9347351 - DNA, 22 bp, Homo sapiens
catttgttaagaaggaaaaagg

SEQ ID NO: 9347352 - DNA, 22 bp, Homo sapiens
catttgttaatgctgcttttaa

SEQ ID NO: 9347353 - DNA, 22 bp, Homo sapiens
catttgttaatgctgcttttaa

SEQ ID NO: 9347354 - DNA, 20 bp, Homo sapiens
catttgttagctttctactg

SEQ ID NO: 9347355 - DNA, 21 bp, Homo sapiens
aggagggcacaaggccaggaa

SEQ ID NO: 9347356 - DNA, 21 bp, Homo sapiens
aggagggcacaaggccaggaa

SEQ ID NO: 9347357 - DNA, 21 bp, Homo sapiens
aggagggcacaaggccaggaa

SEQ ID NO: 9347358 - DNA, 22 bp, Homo sapiens
aggagggcaggctggctgccta

SEQ ID NO: 9347359 - DNA, 22 bp, Homo sapiens
aggagggctaggaaaaccagga

SEQ ID NO: 9347360 - DNA, 22 bp, Homo sapiens
aggagggctaggaaaaccagga

SEQ ID NO: 9347361 - DNA, 22 bp, Homo sapiens
aggagggctaggaaaaccagga

SEQ ID NO: 9347362 - DNA, 22 bp, Homo sapiens
aggagggcaggctggctgccta

SEQ ID NO: 9347363 - DNA, 22 bp, Homo sapiens
aggagggcaggctggctgccta

SEQ ID NO: 9347364 - DNA, 22 bp, Homo sapiens
aggagggcaggctggctgccta

SEQ ID NO: 9347365 - DNA, 22 bp, Homo sapiens
aggagggctaggaaaaccagga

SEQ ID NO: 9347366 - DNA, 16 bp, Homo sapiens
aggaggggaattagga

SEQ ID NO: 9347367 - DNA, 20 bp, Homo sapiens
aggaggggatagaatcaaag

SEQ ID NO: 9347368 - DNA, 20 bp, Homo sapiens
aggaggggatagaatcaaag

SEQ ID NO: 9347369 - DNA, 22 bp, Homo sapiens
catgcggctctttccaaaccgg

SEQ ID NO: 9347370 - DNA, 22 bp, Homo sapiens
catgctaaaccagaacatagga

SEQ ID NO: 9347371 - DNA, 22 bp, Homo sapiens
catgctaaaatatctgaagatt

SEQ ID NO: 9347372 - DNA, 22 bp, Homo sapiens
aggaggggcaatgatagtctgg

SEQ ID NO: 9347373 - DNA, 22 bp, Homo sapiens
catggaggaccctcagggagct

SEQ ID NO: 9347374 - DNA, 22 bp, Homo sapiens
catggaggaggaagggcgttgt

SEQ ID NO: 9347375 - DNA, 22 bp, Homo sapiens
catggattgaatataaattaga

SEQ ID NO: 9347376 - DNA, 22 bp, Homo sapiens
catggattcgggaaggtcagta

SEQ ID NO: 9347377 - DNA, 22 bp, Homo sapiens
catgctaaccagagacataaag

SEQ ID NO: 9347378 - DNA, 22 bp, Homo sapiens
catggaggaccctcagggagct

SEQ ID NO: 9347379 - DNA, 22 bp, Homo sapiens
catggcactgagcaggtatgca

SEQ ID NO: 9347380 - DNA, 22 bp, Homo sapiens
catggcagaaacctgagctgct

SEQ ID NO: 9347381 - DNA, 22 bp, Homo sapiens
aggatgtgttcatagctgacgc

SEQ ID NO: 9347382 - DNA, 22 bp, Homo sapiens
catggcagagaaggggaactgg

SEQ ID NO: 9347383 - DNA, 22 bp, Homo sapiens
aggatgtgttcatagctgacgc

SEQ ID NO: 9347384 - DNA, 22 bp, Homo sapiens
aggatgtgttttgagctgacta

SEQ ID NO: 9347385 - DNA, 22 bp, Homo sapiens
aggatgtgttttgagctgacta

SEQ ID NO: 9347386 - DNA, 22 bp, Homo sapiens
aggattaactgacctagtgttt

SEQ ID NO: 9347387 - DNA, 22 bp, Homo sapiens
aggattcagaatgtatgcagtg

SEQ ID NO: 9347388 - DNA, 22 bp, Homo sapiens
aggattaaagtatatttttgag

SEQ ID NO: 9347389 - DNA, 22 bp, Homo sapiens
aggattaaaacagtgggatttg

SEQ ID NO: 9347390 - DNA, 22 bp, Homo sapiens
aggattctgtaatctgtgaaat

SEQ ID NO: 9347391 - DNA, 22 bp, Homo sapiens
aggattgtatacctaagtgtta

SEQ ID NO: 9347392 - DNA, 22 bp, Homo sapiens
aggattgtgcctccagtcagaa

SEQ ID NO: 9347393 - DNA, 22 bp, Homo sapiens
aggcactggtctaccccttagt

SEQ ID NO: 9347394 - DNA, 22 bp, Homo sapiens
catgtcagggaagagagtcagt

SEQ ID NO: 9347395 - DNA, 22 bp, Homo sapiens
catgtcagggcttcctcctctc

SEQ ID NO: 9347396 - DNA, 22 bp, Homo sapiens
catgtcagggaagagagtcagt

SEQ ID NO: 9347397 - DNA, 22 bp, Homo sapiens
catgtcaagcttatctctgtgg

SEQ ID NO: 9347398 - DNA, 22 bp, Homo sapiens
catgtcaataaatataactgca

SEQ ID NO: 9347399 - DNA, 22 bp, Homo sapiens
catgtatatttctgtatgtgca

SEQ ID NO: 9347400 - DNA, 22 bp, Homo sapiens
catgtatatttctgtatgtgca

SEQ ID NO: 9347401 - DNA, 22 bp, Homo sapiens
catgtatagttggaactacatc

SEQ ID NO: 9347402 - DNA, 22 bp, Homo sapiens
catgtatagttggaactacatc

SEQ ID NO: 9347403 - DNA, 22 bp, Homo sapiens
catgtatattttatgtggagag

SEQ ID NO: 9347404 - DNA, 22 bp, Homo sapiens
catgtatatttctgtatgtgca

SEQ ID NO: 9347405 - DNA, 22 bp, Homo sapiens
catgtatagacactcatacagt

SEQ ID NO: 9347406 - DNA, 22 bp, Homo sapiens
catgtatagcaaatatttgttc

SEQ ID NO: 9347407 - DNA, 22 bp, Homo sapiens
catgtatagcaaatatttgttc

SEQ ID NO: 9347408 - DNA, 22 bp, Homo sapiens
catgtatacagtagaatactat

SEQ ID NO: 9347409 - DNA, 22 bp, Homo sapiens
catgtatagacactcatacagt

SEQ ID NO: 9347410 - DNA, 22 bp, Homo sapiens
catgtataggtccatagtgaat

SEQ ID NO: 9347411 - DNA, 22 bp, Homo sapiens
catgtataggtccatagtgaat

SEQ ID NO: 9347412 - DNA, 22 bp, Homo sapiens
catgtatagttggaactacatc

SEQ ID NO: 9347413 - DNA, 22 bp, Homo sapiens
catgtatagttggaactacatc

SEQ ID NO: 9347414 - DNA, 22 bp, Homo sapiens
catgtataagcgctaggagtgc

SEQ ID NO: 9347415 - DNA, 22 bp, Homo sapiens
catgtagtcctaatgctggtga

SEQ ID NO: 9347416 - DNA, 22 bp, Homo sapiens
catgtatacagtagaatactat

SEQ ID NO: 9347417 - DNA, 22 bp, Homo sapiens
catgtatagacactcatacagt

SEQ ID NO: 9347418 - DNA, 22 bp, Homo sapiens
catgtacattctgtagatggag

SEQ ID NO: 9347419 - DNA, 22 bp, Homo sapiens
catgtacccctgagagtcttgc

SEQ ID NO: 9347420 - DNA, 22 bp, Homo sapiens
catgtacattctgtagatggag

SEQ ID NO: 9347421 - DNA, 18 bp, Homo sapiens
catgggtgacaggtggat

SEQ ID NO: 9347422 - DNA, 21 bp, Homo sapiens
catggggttgctatagcaaaa

SEQ ID NO: 9347423 - DNA, 18 bp, Homo sapiens
catgggtgacaggtggat

SEQ ID NO: 9347424 - DNA, 22 bp, Homo sapiens
catggtcatgctgagctacaaa

SEQ ID NO: 9347425 - DNA, 21 bp, Homo sapiens
aggatttctgtcatttcagat

SEQ ID NO: 9347426 - DNA, 22 bp, Homo sapiens
aggatttctgtgcctggaaaat

SEQ ID NO: 9347427 - DNA, 22 bp, Homo sapiens
aggatttctgtgcctggaaaat

SEQ ID NO: 9347428 - DNA, 22 bp, Homo sapiens
catggctgaaattcttcgcttg

SEQ ID NO: 9347429 - DNA, 22 bp, Homo sapiens
catggctgaacactcagtgact

SEQ ID NO: 9347430 - DNA, 22 bp, Homo sapiens
catggctgaaattcttcgcttg

SEQ ID NO: 9347431 - DNA, 22 bp, Homo sapiens
aggatttacaatgattctaggt

SEQ ID NO: 9347432 - DNA, 22 bp, Homo sapiens
aggatttacaatgattctaggt

SEQ ID NO: 9347433 - DNA, 22 bp, Homo sapiens
aggatttaaatccttaaccact

SEQ ID NO: 9347434 - DNA, 22 bp, Homo sapiens
aggattgtgcctccagtcagaa

SEQ ID NO: 9347435 - DNA, 22 bp, Homo sapiens
aggattgttgcagggcttcgtt

SEQ ID NO: 9347436 - DNA, 22 bp, Homo sapiens
aggatttactagcaaggattct

SEQ ID NO: 9347437 - DNA, 22 bp, Homo sapiens
aggatttacctccagctaggct

SEQ ID NO: 9347438 - DNA, 22 bp, Homo sapiens
aggatttatcaggaactctctt

SEQ ID NO: 9347439 - DNA, 22 bp, Homo sapiens
aggatttagcatgaaatgtgaa

SEQ ID NO: 9347440 - DNA, 19 bp, Homo sapiens
aggatttattatgtgctca

SEQ ID NO: 9347441 - DNA, 22 bp, Homo sapiens
aggatttattccagaaatgcaa

SEQ ID NO: 9347442 - DNA, 22 bp, Homo sapiens
catggggcccatgtgctccaag

SEQ ID NO: 9347443 - DNA, 22 bp, Homo sapiens
catgggggctgaggctgctgta

SEQ ID NO: 9347444 - DNA, 22 bp, Homo sapiens
catggggatgaggctgagactt

SEQ ID NO: 9347445 - DNA, 22 bp, Homo sapiens
catgggctttggaggctggagg

SEQ ID NO: 9347446 - DNA, 22 bp, Homo sapiens
catgggcttgctctctgagctc

SEQ ID NO: 9347447 - DNA, 22 bp, Homo sapiens
catgggctgctgacaggggctc

SEQ ID NO: 9347448 - DNA, 22 bp, Homo sapiens
catgggctgctgacaggggctc

SEQ ID NO: 9347449 - DNA, 22 bp, Homo sapiens
catgggctttggaggctggagg

SEQ ID NO: 9347450 - DNA, 22 bp, Homo sapiens
catggggagacacctagggaaa

SEQ ID NO: 9347451 - DNA, 22 bp, Homo sapiens
cagattccagtttgtggctccc

SEQ ID NO: 9347452 - DNA, 22 bp, Homo sapiens
cagattctccaggggctgcaga

SEQ ID NO: 9347453 - DNA, 22 bp, Homo sapiens
cagattctcactgtattcaggt

SEQ ID NO: 9347454 - DNA, 22 bp, Homo sapiens
cagattctcactgtattcaggt

SEQ ID NO: 9347455 - DNA, 22 bp, Homo sapiens
cagattcttcattgccccattc

SEQ ID NO: 9347456 - DNA, 22 bp, Homo sapiens
cagatttaagagataaacagtg

SEQ ID NO: 9347457 - DNA, 22 bp, Homo sapiens
cagattcttaatttatgggatt

SEQ ID NO: 9347458 - DNA, 22 bp, Homo sapiens
cagattctgggcccagcttgtc

SEQ ID NO: 9347459 - DNA, 22 bp, Homo sapiens
cagatttacctaactccaagtt

SEQ ID NO: 9347460 - DNA, 22 bp, Homo sapiens
cagatttaagatatttgtattg

SEQ ID NO: 9347461 - DNA, 22 bp, Homo sapiens
cagatttaggcttagtccaagc

SEQ ID NO: 9347462 - DNA, 22 bp, Homo sapiens
cagatttattttacatccttca

SEQ ID NO: 9347463 - DNA, 22 bp, Homo sapiens
cagatttcaaggaggcactcca

SEQ ID NO: 9347464 - DNA, 22 bp, Homo sapiens
cagatttcagctcatatattat

SEQ ID NO: 9347465 - DNA, 22 bp, Homo sapiens
cagatttcagctcatatattat

SEQ ID NO: 9347466 - DNA, 22 bp, Homo sapiens
cagatttcatgcgaaatggggt

SEQ ID NO: 9347467 - DNA, 22 bp, Homo sapiens
cagatttctatttcaaatacat

SEQ ID NO: 9347468 - DNA, 22 bp, Homo sapiens
cagatttctatttcaaatacat

SEQ ID NO: 9347469 - DNA, 22 bp, Homo sapiens
cagatttctttagcaagctaag

SEQ ID NO: 9347470 - DNA, 22 bp, Homo sapiens
cagatttctttagcaagctaag

SEQ ID NO: 9347471 - DNA, 22 bp, Homo sapiens
cagcagcccacgcgtgctgtcc

SEQ ID NO: 9347472 - DNA, 22 bp, Homo sapiens
cagcagccgagagggggctctg

SEQ ID NO: 9347473 - DNA, 22 bp, Homo sapiens
cagcagcctacaatgcacagaa

SEQ ID NO: 9347474 - DNA, 22 bp, Homo sapiens
cagcagcctagaagctctacca

SEQ ID NO: 9347475 - DNA, 22 bp, Homo sapiens
cagcagcccacgcgtgctgtcc

SEQ ID NO: 9347476 - DNA, 22 bp, Homo sapiens
cagcagcccacgcgtgctgtcc

SEQ ID NO: 9347477 - DNA, 20 bp, Homo sapiens
cagcagccattctagtagta

SEQ ID NO: 9347478 - DNA, 22 bp, Homo sapiens
cagcagccatgtaccacactca

SEQ ID NO: 9347479 - DNA, 19 bp, Homo sapiens
cagcagccagggggcccct

SEQ ID NO: 9347480 - DNA, 19 bp, Homo sapiens
cagcagccagggggcccct

SEQ ID NO: 9347481 - DNA, 22 bp, Homo sapiens
cagcagcagattcagcgtctgg

SEQ ID NO: 9347482 - DNA, 22 bp, Homo sapiens
cagcagcagccccaggaaggtt

SEQ ID NO: 9347483 - DNA, 22 bp, Homo sapiens
cagcaaaggtagaagcacagga

SEQ ID NO: 9347484 - DNA, 22 bp, Homo sapiens
cagcagccactagagggctcac

SEQ ID NO: 9347485 - DNA, 22 bp, Homo sapiens
cagcagccactagagggctcac

SEQ ID NO: 9347486 - DNA, 22 bp, Homo sapiens
cagcaaaggggatgcgtcctaa

SEQ ID NO: 9347487 - DNA, 22 bp, Homo sapiens
cagcaaaggtagaagcacagga

SEQ ID NO: 9347488 - DNA, 22 bp, Homo sapiens
cagcaaagcaggctcctagaac

SEQ ID NO: 9347489 - DNA, 22 bp, Homo sapiens
gtaggcagtggttggaagagaa

SEQ ID NO: 9347490 - DNA, 22 bp, Homo sapiens
gtaggcagtgcttgattttcca

SEQ ID NO: 9347491 - DNA, 22 bp, Homo sapiens
gtaggctgtgtgaggctagaga

SEQ ID NO: 9347492 - DNA, 22 bp, Homo sapiens
gtaggccatggtggttgtctct

SEQ ID NO: 9347493 - DNA, 22 bp, Homo sapiens
gtaggcagtggttggaagagaa

SEQ ID NO: 9347494 - DNA, 22 bp, Homo sapiens
gtaggcagggctgtggggagaa

SEQ ID NO: 9347495 - DNA, 22 bp, Homo sapiens
gtaggcaggtggaggagtgaag

SEQ ID NO: 9347496 - DNA, 22 bp, Homo sapiens
gtaggcaggtggaggagtgaag

SEQ ID NO: 9347497 - DNA, 22 bp, Homo sapiens
gtaggcagtctctcaggtgatc

SEQ ID NO: 9347498 - DNA, 22 bp, Homo sapiens
gtagaaaattaggatgaggctt

SEQ ID NO: 9347499 - DNA, 22 bp, Homo sapiens
gtagaaatagtggttgacagga

SEQ ID NO: 9347500 - DNA, 22 bp, Homo sapiens
gtagaaaaagcagtaagtctca

SEQ ID NO: 9347501 - DNA, 22 bp, Homo sapiens
gtagaaaaagcagtaagtctca

SEQ ID NO: 9347502 - DNA, 22 bp, Homo sapiens
gtactttagagtaaaatagacc

SEQ ID NO: 9347503 - DNA, 22 bp, Homo sapiens
gtactataggtaatgtagacca

SEQ ID NO: 9347504 - DNA, 22 bp, Homo sapiens
gtactgctgtaaatattcttca

SEQ ID NO: 9347505 - DNA, 22 bp, Homo sapiens
gtactaaaaaatgatcagtttg

SEQ ID NO: 9347506 - DNA, 22 bp, Homo sapiens
gtactaaaaaatgatcagtttg

SEQ ID NO: 9347507 - DNA, 22 bp, Homo sapiens
cagcagcctagggttccatcat

SEQ ID NO: 9347508 - DNA, 22 bp, Homo sapiens
cagcagcctagggttccatcat

SEQ ID NO: 9347509 - DNA, 22 bp, Homo sapiens
gtacacactatttaaagtgttt

SEQ ID NO: 9347510 - DNA, 22 bp, Homo sapiens
gtacacactatgtattgtacac

SEQ ID NO: 9347511 - DNA, 22 bp, Homo sapiens
gtacacactatgtattgtacac

SEQ ID NO: 9347512 - DNA, 22 bp, Homo sapiens
gtacacactgtttgatcatttc

SEQ ID NO: 9347513 - DNA, 22 bp, Homo sapiens
gtcagcagtgtcagctctgggg

SEQ ID NO: 9347514 - DNA, 22 bp, Homo sapiens
gtcagcagtggcagctcccggg

SEQ ID NO: 9347515 - DNA, 22 bp, Homo sapiens
gtcagcagggtccccttgagtg

SEQ ID NO: 9347516 - DNA, 22 bp, Homo sapiens
gtcagcagggtccccttgagtg

SEQ ID NO: 9347517 - DNA, 22 bp, Homo sapiens
gtcagcagggtccccttgagtg

SEQ ID NO: 9347518 - DNA, 22 bp, Homo sapiens
gtcagcagggctccctggcagg

SEQ ID NO: 9347519 - DNA, 21 bp, Homo sapiens
gtcagcagatccagcacttgt

SEQ ID NO: 9347520 - DNA, 22 bp, Homo sapiens
gtcagcacctctttggggagct

SEQ ID NO: 9347521 - DNA, 22 bp, Homo sapiens
gtcagcacttttccgaggcaga

SEQ ID NO: 9347522 - DNA, 19 bp, Homo sapiens
gtcagcaccatggacaggg

SEQ ID NO: 9347523 - DNA, 22 bp, Homo sapiens
gtcagcaaaaaatttatgtgag

SEQ ID NO: 9347524 - DNA, 22 bp, Homo sapiens
gtcagattttcaagacgagagg

SEQ ID NO: 9347525 - DNA, 22 bp, Homo sapiens
gtcagatgatacactgttgtca

SEQ ID NO: 9347526 - DNA, 22 bp, Homo sapiens
cagcagtgtctccagcatcaca

SEQ ID NO: 9347527 - DNA, 22 bp, Homo sapiens
gtcagcagtgtcagctctgggg

SEQ ID NO: 9347528 - DNA, 22 bp, Homo sapiens
cagcagtgtctccagcatcaca

SEQ ID NO: 9347529 - DNA, 22 bp, Homo sapiens
cagcatccctcaggggcctctg

SEQ ID NO: 9347530 - DNA, 22 bp, Homo sapiens
cagcatccggcagcccgggcct

SEQ ID NO: 9347531 - DNA, 22 bp, Homo sapiens
cagcatctaatcttcatgccgg

SEQ ID NO: 9347532 - DNA, 22 bp, Homo sapiens
cagcatctccatggctttggag

SEQ ID NO: 9347533 - DNA, 22 bp, Homo sapiens
gtcagatctttggggatgctgt

SEQ ID NO: 9347534 - DNA, 22 bp, Homo sapiens
gtcacaggcagtaactaggacc

SEQ ID NO: 9347535 - DNA, 22 bp, Homo sapiens
gtcacaggaagcagcaggcact

SEQ ID NO: 9347536 - DNA, 22 bp, Homo sapiens
gtcacaggaaagggtgtaaggg

SEQ ID NO: 9347537 - DNA, 22 bp, Homo sapiens
gtcacactagggccaagtggag

SEQ ID NO: 9347538 - DNA, 22 bp, Homo sapiens
gtcacacacatttctttggtgc

SEQ ID NO: 9347539 - DNA, 22 bp, Homo sapiens
gtagggaagggagcactggaca

SEQ ID NO: 9347540 - DNA, 21 bp, Homo sapiens
gtagggacagagagttggtga

SEQ ID NO: 9347541 - DNA, 20 bp, Homo sapiens
gtagggaaggaatctgcagg

SEQ ID NO: 9347542 - DNA, 19 bp, Homo sapiens
gtagggacagtggttctga

SEQ ID NO: 9347543 - DNA, 22 bp, Homo sapiens
gtagggacccacagtctatatt

SEQ ID NO: 9347544 - DNA, 22 bp, Homo sapiens
gtagggacttgttttactagta

SEQ ID NO: 9347545 - DNA, 22 bp, Homo sapiens
gtattttacttacgcatgactt

SEQ ID NO: 9347546 - DNA, 22 bp, Homo sapiens
gtccagagctggcacactgtca

SEQ ID NO: 9347547 - DNA, 22 bp, Homo sapiens
gtccagagggctgcaggatgct

SEQ ID NO: 9347548 - DNA, 22 bp, Homo sapiens
gtccagagggtcaagtttcttg

SEQ ID NO: 9347549 - DNA, 20 bp, Homo sapiens
gtccagagtaatgtgctgac

SEQ ID NO: 9347550 - DNA, 22 bp, Homo sapiens
gtccagagccggaagagtgaca

SEQ ID NO: 9347551 - DNA, 22 bp, Homo sapiens
gtccagagaggcaggaggctac

SEQ ID NO: 9347552 - DNA, 22 bp, Homo sapiens
cagcatctggggaacattcaag

SEQ ID NO: 9347553 - DNA, 22 bp, Homo sapiens
cagcatctggatttcctccact

SEQ ID NO: 9347554 - DNA, 22 bp, Homo sapiens
cagcatctggatttcctccact

SEQ ID NO: 9347555 - DNA, 22 bp, Homo sapiens
cagcatctctgggagaagcatc

SEQ ID NO: 9347556 - DNA, 22 bp, Homo sapiens
cagcatctgaccaatatctaca

SEQ ID NO: 9347557 - DNA, 22 bp, Homo sapiens
cagcatctctgcctgcctgcaa

SEQ ID NO: 9347558 - DNA, 22 bp, Homo sapiens
cagccaggactcccatttagga

SEQ ID NO: 9347559 - DNA, 22 bp, Homo sapiens
cagccaggagcctctgcaacta

SEQ ID NO: 9347560 - DNA, 22 bp, Homo sapiens
cagccaggagctccccctgctc

SEQ ID NO: 9347561 - DNA, 22 bp, Homo sapiens
cagccaggagctccccctgctc

SEQ ID NO: 9347562 - DNA, 22 bp, Homo sapiens
cagccaggcccagatcatgctg

SEQ ID NO: 9347563 - DNA, 22 bp, Homo sapiens
cagccaggcccccgagtcgttg

SEQ ID NO: 9347564 - DNA, 22 bp, Homo sapiens
cagccaggcccccgagtcgttg

SEQ ID NO: 9347565 - DNA, 22 bp, Homo sapiens
cagccaggcccagatcatgctg

SEQ ID NO: 9347566 - DNA, 22 bp, Homo sapiens
cagccaggatggagaactgttg

SEQ ID NO: 9347567 - DNA, 22 bp, Homo sapiens
cagccagctggtgcggcagagc

SEQ ID NO: 9347568 - DNA, 22 bp, Homo sapiens
cagccagctgtcccaagtgcct

SEQ ID NO: 9347569 - DNA, 22 bp, Homo sapiens
cagccagctgtcccaagtgcct

SEQ ID NO: 9347570 - DNA, 22 bp, Homo sapiens
gtccagagtattcaagtaactt

SEQ ID NO: 9347571 - DNA, 22 bp, Homo sapiens
cagccagaacctaggatgagct

SEQ ID NO: 9347572 - DNA, 22 bp, Homo sapiens
cagccctggccccaggtggtct

SEQ ID NO: 9347573 - DNA, 22 bp, Homo sapiens
cagccctggtgccaaggttccc

SEQ ID NO: 9347574 - DNA, 22 bp, Homo sapiens
cagccctgtccaatgtctgctc

SEQ ID NO: 9347575 - DNA, 22 bp, Homo sapiens
cagccctgtccagcagagggtg

SEQ ID NO: 9347576 - DNA, 22 bp, Homo sapiens
cagccctgtccagcagagggtg

SEQ ID NO: 9347577 - DNA, 22 bp, Homo sapiens
cagccctgtccctgagggacct

SEQ ID NO: 9347578 - DNA, 22 bp, Homo sapiens
cagccctgtctatgactgatga

SEQ ID NO: 9347579 - DNA, 22 bp, Homo sapiens
cagccctgtctatgactgatga

SEQ ID NO: 9347580 - DNA, 22 bp, Homo sapiens
cagccctgtctatgactgatga

SEQ ID NO: 9347581 - DNA, 22 bp, Homo sapiens
gtcctggttttcacagaccttt

SEQ ID NO: 9347582 - DNA, 22 bp, Homo sapiens
gtcctgtgacctgcatcctgag

SEQ ID NO: 9347583 - DNA, 22 bp, Homo sapiens
gtcctgtcccccaaggctgtgg

SEQ ID NO: 9347584 - DNA, 22 bp, Homo sapiens
gtcctgtgagattcatgctcaa

SEQ ID NO: 9347585 - DNA, 22 bp, Homo sapiens
gtcctgtgatgagtaccaggtg

SEQ ID NO: 9347586 - DNA, 22 bp, Homo sapiens
gtcctgtgcaccgtgggatgtt

SEQ ID NO: 9347587 - DNA, 22 bp, Homo sapiens
gtcctggtgccacctgcgggat

SEQ ID NO: 9347588 - DNA, 17 bp, Homo sapiens
gtcctggtgtgtgagga

SEQ ID NO: 9347589 - DNA, 22 bp, Homo sapiens
gtcctggtgaggtagtgggagg

SEQ ID NO: 9347590 - DNA, 22 bp, Homo sapiens
gtcctggtataattgtttaaaa

SEQ ID NO: 9347591 - DNA, 22 bp, Homo sapiens
cagccaggcccccgagtcgttg

SEQ ID NO: 9347592 - DNA, 22 bp, Homo sapiens
gtgagagggctgggctcatgat

SEQ ID NO: 9347593 - DNA, 22 bp, Homo sapiens
gtgagagattgattgtagcggc

SEQ ID NO: 9347594 - DNA, 22 bp, Homo sapiens
gtgagagattgattgtagcggc

SEQ ID NO: 9347595 - DNA, 22 bp, Homo sapiens
gtcctgtgccctgggtggcgct

SEQ ID NO: 9347596 - DNA, 22 bp, Homo sapiens
gtcctgtgcaccgtgggatgtt

SEQ ID NO: 9347597 - DNA, 22 bp, Homo sapiens
gtcctgtgccgaggtgggaagc

SEQ ID NO: 9347598 - DNA, 22 bp, Homo sapiens
gtcctgtgccctgggtggcgct

SEQ ID NO: 9347599 - DNA, 22 bp, Homo sapiens
gtcctgtgctcagacatggggg

SEQ ID NO: 9347600 - DNA, 22 bp, Homo sapiens
gtgaatttagtttgtaagaagg

SEQ ID NO: 9347601 - DNA, 22 bp, Homo sapiens
gtgagagtgtttggaaatagaa

SEQ ID NO: 9347602 - DNA, 22 bp, Homo sapiens
gtgagatggagttggtgtcttt

SEQ ID NO: 9347603 - DNA, 22 bp, Homo sapiens
gtgagcaatgttatcaggttga

SEQ ID NO: 9347604 - DNA, 18 bp, Homo sapiens
gtgagcagagagcatcac

SEQ ID NO: 9347605 - DNA, 22 bp, Homo sapiens
cagccctcatcccgcctgcgtt

SEQ ID NO: 9347606 - DNA, 18 bp, Homo sapiens
gtgagcagagagcatcac

SEQ ID NO: 9347607 - DNA, 22 bp, Homo sapiens
gtgagcagagatcgcgtgattg

SEQ ID NO: 9347608 - DNA, 22 bp, Homo sapiens
cagccctgaaacaacctcctct

SEQ ID NO: 9347609 - DNA, 19 bp, Homo sapiens
cagccctcttaccactgtg

SEQ ID NO: 9347610 - DNA, 19 bp, Homo sapiens
cagccctcttaccactgtg

SEQ ID NO: 9347611 - DNA, 22 bp, Homo sapiens
cagccctctgaagaggcgcttg

SEQ ID NO: 9347612 - DNA, 22 bp, Homo sapiens
cagccctcctaccctgccaggc

SEQ ID NO: 9347613 - DNA, 22 bp, Homo sapiens
cagccctcctaccctgccaggc

SEQ ID NO: 9347614 - DNA, 22 bp, Homo sapiens
cagccctcctaccctgccaggc

SEQ ID NO: 9347615 - DNA, 22 bp, Homo sapiens
gggttcagtccctcttgctact

SEQ ID NO: 9347616 - DNA, 22 bp, Homo sapiens
gggttcagtgatgccttcagga

SEQ ID NO: 9347617 - DNA, 22 bp, Homo sapiens
gggttcagtccctcttgctact

SEQ ID NO: 9347618 - DNA, 22 bp, Homo sapiens
gggttccctgcctggccactct

SEQ ID NO: 9347619 - DNA, 22 bp, Homo sapiens
gggttcctggctcctgtgtggt

SEQ ID NO: 9347620 - DNA, 22 bp, Homo sapiens
ggtatggatcagatgggctcaa

SEQ ID NO: 9347621 - DNA, 22 bp, Homo sapiens
ggtatgggcctgagaatctgtc

SEQ ID NO: 9347622 - DNA, 22 bp, Homo sapiens
ggtatggagtctgagtttctag

SEQ ID NO: 9347623 - DNA, 22 bp, Homo sapiens
ggtagtgaggtgaaagagaggt

SEQ ID NO: 9347624 - DNA, 22 bp, Homo sapiens
ggtagtgaggtgaaagagaggt

SEQ ID NO: 9347625 - DNA, 22 bp, Homo sapiens
ggtataaatgatcagatcgctg

SEQ ID NO: 9347626 - DNA, 22 bp, Homo sapiens
ggtataaatgatcagatcgctg

SEQ ID NO: 9347627 - DNA, 22 bp, Homo sapiens
gggtgggatctgtggagcctca

SEQ ID NO: 9347628 - DNA, 20 bp, Homo sapiens
gggtgtggcctgggaatttg

SEQ ID NO: 9347629 - DNA, 21 bp, Homo sapiens
gggtgtggaaattacatcctg

SEQ ID NO: 9347630 - DNA, 20 bp, Homo sapiens
gggtgtgggcccggccaggc

SEQ ID NO: 9347631 - DNA, 22 bp, Homo sapiens
gggtgtgtcttttgctcctgga

SEQ ID NO: 9347632 - DNA, 22 bp, Homo sapiens
gggtgtggctgcgtgccaataa

SEQ ID NO: 9347633 - DNA, 22 bp, Homo sapiens
gggtgtggctgcgtgccaataa

SEQ ID NO: 9347634 - DNA, 22 bp, Homo sapiens
gggtgtgttacaatgatgccga

SEQ ID NO: 9347635 - DNA, 22 bp, Homo sapiens
gggtgttgattttacactaaaa

SEQ ID NO: 9347636 - DNA, 22 bp, Homo sapiens
gggtgtttatgtattatgatgt

SEQ ID NO: 9347637 - DNA, 20 bp, Homo sapiens
gggtgtgtgcagggcctggt

SEQ ID NO: 9347638 - DNA, 22 bp, Homo sapiens
gggttaggttctagaggcacaa

SEQ ID NO: 9347639 - DNA, 22 bp, Homo sapiens
gggttaggtccctcccttctgg

SEQ ID NO: 9347640 - DNA, 22 bp, Homo sapiens
gggtgggatctgtggagcctca

SEQ ID NO: 9347641 - DNA, 20 bp, Homo sapiens
gggtcctgacttggtctcct

SEQ ID NO: 9347642 - DNA, 22 bp, Homo sapiens
gggtcctgcgtgggcccaggac

SEQ ID NO: 9347643 - DNA, 19 bp, Homo sapiens
gggtccatggtgtcaagga

SEQ ID NO: 9347644 - DNA, 19 bp, Homo sapiens
gggtcccaaaagatgtgct

SEQ ID NO: 9347645 - DNA, 22 bp, Homo sapiens
gggtcccagaggcaaaggacta

SEQ ID NO: 9347646 - DNA, 22 bp, Homo sapiens
gggtccaggtttagtcatttgt

SEQ ID NO: 9347647 - DNA, 22 bp, Homo sapiens
gggtccagtagttggtggccgt

SEQ ID NO: 9347648 - DNA, 22 bp, Homo sapiens
gggtaggaaatccagaggtggc

SEQ ID NO: 9347649 - DNA, 22 bp, Homo sapiens
gggtaggaaatccagaggtggc

SEQ ID NO: 9347650 - DNA, 21 bp, Homo sapiens
gggtagcgtgtggaagatccg

SEQ ID NO: 9347651 - DNA, 22 bp, Homo sapiens
gggtagcatgtgtcagagtttg

SEQ ID NO: 9347652 - DNA, 22 bp, Homo sapiens
gggtacagttcttccagtgtca

SEQ ID NO: 9347653 - DNA, 22 bp, Homo sapiens
cagatgaccaggctccacccag

SEQ ID NO: 9347654 - DNA, 22 bp, Homo sapiens
cagatgagagtggccagggttc

SEQ ID NO: 9347655 - DNA, 19 bp, Homo sapiens
cagatgagaaaagtgaggt

SEQ ID NO: 9347656 - DNA, 22 bp, Homo sapiens
cagatgagcatgggcacaagca

SEQ ID NO: 9347657 - DNA, 22 bp, Homo sapiens
cagatgaggacagatgactggg

SEQ ID NO: 9347658 - DNA, 23 bp, Homo sapiens
cagatgaggttggcagcatggtc

SEQ ID NO: 9347659 - DNA, 23 bp, Homo sapiens
cagatgaggttggcagcatggtc

SEQ ID NO: 9347660 - DNA, 22 bp, Homo sapiens
ggtatttatatgtctgaagctg

SEQ ID NO: 9347661 - DNA, 22 bp, Homo sapiens
ggtatttatagtggtgcttagt

SEQ ID NO: 9347662 - DNA, 22 bp, Homo sapiens
ggtatttactgagagccactct

SEQ ID NO: 9347663 - DNA, 22 bp, Homo sapiens
ggtatttactgagagccactct

SEQ ID NO: 9347664 - DNA, 22 bp, Homo sapiens
ggtcctggcagtctttggttgt

SEQ ID NO: 9347665 - DNA, 22 bp, Homo sapiens
cagatggcaacagctctgtgac

SEQ ID NO: 9347666 - DNA, 22 bp, Homo sapiens
ggtcctggcagtctttggttgt

SEQ ID NO: 9347667 - DNA, 20 bp, Homo sapiens
cagatggcacgtcagggcat

SEQ ID NO: 9347668 - DNA, 22 bp, Homo sapiens
cagatgtggttaacatgtacat

SEQ ID NO: 9347669 - DNA, 22 bp, Homo sapiens
ggtcctggaaattgacggaaag

SEQ ID NO: 9347670 - DNA, 22 bp, Homo sapiens
ggtcctggaagtgtaagtggca

SEQ ID NO: 9347671 - DNA, 22 bp, Homo sapiens
ggtcctggaaattgacggaaag

SEQ ID NO: 9347672 - DNA, 22 bp, Homo sapiens
ggtcctggaaattgacggaaag

SEQ ID NO: 9347673 - DNA, 22 bp, Homo sapiens
ggtcctggaaattgacggaaag

SEQ ID NO: 9347674 - DNA, 22 bp, Homo sapiens
ggtcctggcagctctgtgtcca

SEQ ID NO: 9347675 - DNA, 22 bp, Homo sapiens
ggtcctggcagctctgtgtcca

SEQ ID NO: 9347676 - DNA, 22 bp, Homo sapiens
ggtcctggatgagacaggtagt

SEQ ID NO: 9347677 - DNA, 22 bp, Homo sapiens
ggtcctggcagctctgtgtcca

SEQ ID NO: 9347678 - DNA, 22 bp, Homo sapiens
ggtcctggatgagacaggtagt

SEQ ID NO: 9347679 - DNA, 22 bp, Homo sapiens
ggtcctggatgagacaggtagt

SEQ ID NO: 9347680 - DNA, 22 bp, Homo sapiens
ggtcctggatgagacaggtagt

SEQ ID NO: 9347681 - DNA, 22 bp, Homo sapiens
ggtcctggaagtgtaagtggca

SEQ ID NO: 9347682 - DNA, 22 bp, Homo sapiens
ggtcctgaggggagctgaaggt

SEQ ID NO: 9347683 - DNA, 22 bp, Homo sapiens
ggtcctgagtacctatgtttat

SEQ ID NO: 9347684 - DNA, 22 bp, Homo sapiens
ggtcctgcctgctgtccttcaa

SEQ ID NO: 9347685 - DNA, 22 bp, Homo sapiens
ggtcctcaatcccaacaaggca

SEQ ID NO: 9347686 - DNA, 22 bp, Homo sapiens
ggtcctcaatcccaacaaggca

SEQ ID NO: 9347687 - DNA, 19 bp, Homo sapiens
ggtcctcagcagagcatgc

SEQ ID NO: 9347688 - DNA, 22 bp, Homo sapiens
ggtcctctccagcgccacagtg

SEQ ID NO: 9347689 - DNA, 18 bp, Homo sapiens
ggtcctgaatgcctgcta

SEQ ID NO: 9347690 - DNA, 19 bp, Homo sapiens
ggtcctcagcagagcatgc

SEQ ID NO: 9347691 - DNA, 22 bp, Homo sapiens
ggtcctctccagcgccacagtg

SEQ ID NO: 9347692 - DNA, 22 bp, Homo sapiens
cagatgcacattctcatcagca

SEQ ID NO: 9347693 - DNA, 22 bp, Homo sapiens
cagatgctaagttatcagcagg

SEQ ID NO: 9347694 - DNA, 22 bp, Homo sapiens
cagatgcatgtacagtgttgct

SEQ ID NO: 9347695 - DNA, 22 bp, Homo sapiens
ggggccttttctgaatgtggaa

SEQ ID NO: 9347696 - DNA, 22 bp, Homo sapiens
ggggccttggatctgtgccccg

SEQ ID NO: 9347697 - DNA, 22 bp, Homo sapiens
ggggtgagtgctcagccccgga

SEQ ID NO: 9347698 - DNA, 19 bp, Homo sapiens
ggggcctgtgatggtcaca

SEQ ID NO: 9347699 - DNA, 22 bp, Homo sapiens
ggggccttggatctgtgccccg

SEQ ID NO: 9347700 - DNA, 22 bp, Homo sapiens
ggggcctgtagagcttcaggga

SEQ ID NO: 9347701 - DNA, 22 bp, Homo sapiens
ggggcctgtagagcttcaggga

SEQ ID NO: 9347702 - DNA, 22 bp, Homo sapiens
ggggcctgtagagcttcaggga

SEQ ID NO: 9347703 - DNA, 22 bp, Homo sapiens
gggtacagagagatgaggtaac

SEQ ID NO: 9347704 - DNA, 22 bp, Homo sapiens
gggtacaaagatttcataagat

SEQ ID NO: 9347705 - DNA, 22 bp, Homo sapiens
gggtacagaaactgaggcttag

SEQ ID NO: 9347706 - DNA, 20 bp, Homo sapiens
gggtacagttctgcagttac

SEQ ID NO: 9347707 - DNA, 22 bp, Homo sapiens
gggtacagttcttccagtgtca

SEQ ID NO: 9347708 - DNA, 22 bp, Homo sapiens
gggtaaggtcagccagaagttc

SEQ ID NO: 9347709 - DNA, 21 bp, Homo sapiens
gggtaaggaaaatgattcttc

SEQ ID NO: 9347710 - DNA, 22 bp, Homo sapiens
gggtaattggggccttgcagtg

SEQ ID NO: 9347711 - DNA, 20 bp, Homo sapiens
ggggttggctggcacaggga

SEQ ID NO: 9347712 - DNA, 20 bp, Homo sapiens
ggggttggctggcacaggga

SEQ ID NO: 9347713 - DNA, 20 bp, Homo sapiens
ggggttggctggcacaggga

SEQ ID NO: 9347714 - DNA, 20 bp, Homo sapiens
ggggttggctggcacaggga

SEQ ID NO: 9347715 - DNA, 22 bp, Homo sapiens
gggtaaatctcttttcatggct

SEQ ID NO: 9347716 - DNA, 22 bp, Homo sapiens
gggtaaatctcttttcatggct

SEQ ID NO: 9347717 - DNA, 22 bp, Homo sapiens
ggggttggtttaaatgcttgag

SEQ ID NO: 9347718 - DNA, 22 bp, Homo sapiens
ggggcctcgccgccgcctctgc

SEQ ID NO: 9347719 - DNA, 21 bp, Homo sapiens
ggggcctctccacacagccgg

SEQ ID NO: 9347720 - DNA, 21 bp, Homo sapiens
ggggcctctccacacagccgg

SEQ ID NO: 9347721 - DNA, 22 bp, Homo sapiens
ggggcctctgcagtcacgctgg

SEQ ID NO: 9347722 - DNA, 22 bp, Homo sapiens
ggggcctctgcagtcacgctgg

SEQ ID NO: 9347723 - DNA, 22 bp, Homo sapiens
ggggcctctgcagtcacgctgg

SEQ ID NO: 9347724 - DNA, 23 bp, Homo sapiens
ggggcctgcaccggtctgcgcgg

SEQ ID NO: 9347725 - DNA, 22 bp, Homo sapiens
ggggcctctgggaacccctgtg

SEQ ID NO: 9347726 - DNA, 22 bp, Homo sapiens
ggggcagatggaacagagcaca

SEQ ID NO: 9347727 - DNA, 22 bp, Homo sapiens
ggggcagcctccaggaaagctg

SEQ ID NO: 9347728 - DNA, 22 bp, Homo sapiens
ggggcagctaccggaagtaggg

SEQ ID NO: 9347729 - DNA, 22 bp, Homo sapiens
ggggcagaagtagtgcccctga

SEQ ID NO: 9347730 - DNA, 22 bp, Homo sapiens
ggggaggaagctctcagttcca

SEQ ID NO: 9347731 - DNA, 21 bp, Homo sapiens
ggggcagagctaggccctgca

SEQ ID NO: 9347732 - DNA, 22 bp, Homo sapiens
ggggcagagtagctggggtgtg

SEQ ID NO: 9347733 - DNA, 21 bp, Homo sapiens
gggctggaggatgggaagccc

SEQ ID NO: 9347734 - DNA, 22 bp, Homo sapiens
gggctggaggagatccagaggc

SEQ ID NO: 9347735 - DNA, 22 bp, Homo sapiens
gggctggaggcctgcctggtta

SEQ ID NO: 9347736 - DNA, 22 bp, Homo sapiens
gggctggaggcctgcctggtta

SEQ ID NO: 9347737 - DNA, 22 bp, Homo sapiens
gggctggaggtgagcaggacag

SEQ ID NO: 9347738 - DNA, 22 bp, Homo sapiens
gggctggaggtgagcaggacag

SEQ ID NO: 9347739 - DNA, 22 bp, Homo sapiens
gggctggaggtgagcaggacag

SEQ ID NO: 9347740 - DNA, 22 bp, Homo sapiens
gggctggaggtgagcaggacag

SEQ ID NO: 9347741 - DNA, 19 bp, Homo sapiens
gggctggagggatagagcc

SEQ ID NO: 9347742 - DNA, 22 bp, Homo sapiens
gggctggagtcttctgaaagcc

SEQ ID NO: 9347743 - DNA, 22 bp, Homo sapiens
gggctggaggaccggcctcgga

SEQ ID NO: 9347744 - DNA, 22 bp, Homo sapiens
gggctgagtgggcctcttactt

SEQ ID NO: 9347745 - DNA, 22 bp, Homo sapiens
cagagccacttggagatgagaa

SEQ ID NO: 9347746 - DNA, 22 bp, Homo sapiens
cagagccactgtctgccaggca

SEQ ID NO: 9347747 - DNA, 22 bp, Homo sapiens
cagagccacttggagatgagaa

SEQ ID NO: 9347748 - DNA, 22 bp, Homo sapiens
cagagccagaactagaccttgt

SEQ ID NO: 9347749 - DNA, 21 bp, Homo sapiens
cagagccagactgctgaattt

SEQ ID NO: 9347750 - DNA, 22 bp, Homo sapiens
cagagccagagacctgctgtgc

SEQ ID NO: 9347751 - DNA, 22 bp, Homo sapiens
cagagccagagacctgctgtgc

SEQ ID NO: 9347752 - DNA, 22 bp, Homo sapiens
gggctggatctcacgtgagacc

SEQ ID NO: 9347753 - DNA, 22 bp, Homo sapiens
gggctgtaggagctggaatggg

SEQ ID NO: 9347754 - DNA, 22 bp, Homo sapiens
gggctgtaggagctggaatggg

SEQ ID NO: 9347755 - DNA, 22 bp, Homo sapiens
gggctggagttgggaagacaaa

SEQ ID NO: 9347756 - DNA, 21 bp, Homo sapiens
gggctggatattggaaagagg

SEQ ID NO: 9347757 - DNA, 21 bp, Homo sapiens
gggctggatattggaaagagg

SEQ ID NO: 9347758 - DNA, 20 bp, Homo sapiens
gggctggataattctttgct

SEQ ID NO: 9347759 - DNA, 22 bp, Homo sapiens
gggctgtcacgcccctgcacct

SEQ ID NO: 9347760 - DNA, 22 bp, Homo sapiens
gggctgtcatgtgtcagtgacc

SEQ ID NO: 9347761 - DNA, 22 bp, Homo sapiens
gggctgtcacgcccctgcacct

SEQ ID NO: 9347762 - DNA, 22 bp, Homo sapiens
gggctgtgctgagtaggaggtg

SEQ ID NO: 9347763 - DNA, 18 bp, Homo sapiens
gggctgtgagatgggaag

SEQ ID NO: 9347764 - DNA, 22 bp, Homo sapiens
gggctgtgtactatgaggaggg

SEQ ID NO: 9347765 - DNA, 22 bp, Homo sapiens
cagacaactggactaagatcac

SEQ ID NO: 9347766 - DNA, 22 bp, Homo sapiens
cagacaactggactaagatcac

SEQ ID NO: 9347767 - DNA, 22 bp, Homo sapiens
cagaatttttcgaatgtactgt

SEQ ID NO: 9347768 - DNA, 22 bp, Homo sapiens
cagaatttttcgaatgtactgt

SEQ ID NO: 9347769 - DNA, 22 bp, Homo sapiens
cagaatttgaagtaatattcca

SEQ ID NO: 9347770 - DNA, 22 bp, Homo sapiens
cagaatttttcactcaatcttc

SEQ ID NO: 9347771 - DNA, 22 bp, Homo sapiens
cagaatttgaagtaatattcca

SEQ ID NO: 9347772 - DNA, 22 bp, Homo sapiens
cagaatttgaagtaatattcca

SEQ ID NO: 9347773 - DNA, 22 bp, Homo sapiens
cagaatttagaaaacaacataa

SEQ ID NO: 9347774 - DNA, 22 bp, Homo sapiens
cagaatttagaaaacaacataa

SEQ ID NO: 9347775 - DNA, 22 bp, Homo sapiens
cagaatttagcacaatgtatgg

SEQ ID NO: 9347776 - DNA, 22 bp, Homo sapiens
cagaatttagcacaatgtatgg

SEQ ID NO: 9347777 - DNA, 22 bp, Homo sapiens
cagaatttaagtggattattct

SEQ ID NO: 9347778 - DNA, 22 bp, Homo sapiens
cagaatttaagtggattattct

SEQ ID NO: 9347779 - DNA, 22 bp, Homo sapiens
cagaataaaggtacaattgagt

SEQ ID NO: 9347780 - DNA, 22 bp, Homo sapiens
cagaaacagagaaatattggct

SEQ ID NO: 9347781 - DNA, 22 bp, Homo sapiens
cagaaacaggcaacgtgtgcac

SEQ ID NO: 9347782 - DNA, 22 bp, Homo sapiens
cagaaacagacatgacgcagta

SEQ ID NO: 9347783 - DNA, 22 bp, Homo sapiens
cagaaacagacatgacgcagta

SEQ ID NO: 9347784 - DNA, 22 bp, Homo sapiens
cagaaacacttgtagagaagtt

SEQ ID NO: 9347785 - DNA, 22 bp, Homo sapiens
cagaaacactgtatttagggaa

SEQ ID NO: 9347786 - DNA, 22 bp, Homo sapiens
cagaaacactgtatttagggaa

SEQ ID NO: 9347787 - DNA, 22 bp, Homo sapiens
ggctggcactgaggagagctct

SEQ ID NO: 9347788 - DNA, 22 bp, Homo sapiens
ggctggcactgaggagagctct

SEQ ID NO: 9347789 - DNA, 22 bp, Homo sapiens
ggctggcactgaggagagctct

SEQ ID NO: 9347790 - DNA, 22 bp, Homo sapiens
ggctggcactgaggagagctct

SEQ ID NO: 9347791 - DNA, 22 bp, Homo sapiens
ggctggcacgaagccctgctgg

SEQ ID NO: 9347792 - DNA, 22 bp, Homo sapiens
ggctggcactctgtccagtgtc

SEQ ID NO: 9347793 - DNA, 22 bp, Homo sapiens
ggctggcactctgtccagtgtc

SEQ ID NO: 9347794 - DNA, 22 bp, Homo sapiens
ggctggcacctgccctccgctg

SEQ ID NO: 9347795 - DNA, 22 bp, Homo sapiens
ggctggcacgaagccctgctgg

SEQ ID NO: 9347796 - DNA, 22 bp, Homo sapiens
ggctggcacagagggctggtgt

SEQ ID NO: 9347797 - DNA, 22 bp, Homo sapiens
ggctggcacccttggggatagg

SEQ ID NO: 9347798 - DNA, 22 bp, Homo sapiens
ggctggcacctgccctccgctg

SEQ ID NO: 9347799 - DNA, 22 bp, Homo sapiens
ggctggcacccttggggatagg

SEQ ID NO: 9347800 - DNA, 22 bp, Homo sapiens
ggctggcacagagggctggtgt

SEQ ID NO: 9347801 - DNA, 22 bp, Homo sapiens
ggctggcacagagggctggtgt

SEQ ID NO: 9347802 - DNA, 22 bp, Homo sapiens
ggctggcaagtgtctgctcatg

SEQ ID NO: 9347803 - DNA, 22 bp, Homo sapiens
ggctggcaagtgtctgctcatg

SEQ ID NO: 9347804 - DNA, 22 bp, Homo sapiens
ggctggcacaaagctccaaatc

SEQ ID NO: 9347805 - DNA, 22 bp, Homo sapiens
ggctggcacagagggctggtgt

SEQ ID NO: 9347806 - DNA, 22 bp, Homo sapiens
ggctggcaagtgtctgctcatg

SEQ ID NO: 9347807 - DNA, 22 bp, Homo sapiens
ggctggcaagtgtctgctcatg

SEQ ID NO: 9347808 - DNA, 19 bp, Homo sapiens
ggctggcaagtgacagtgt

SEQ ID NO: 9347809 - DNA, 19 bp, Homo sapiens
ggctggcaagtgacagtgt

SEQ ID NO: 9347810 - DNA, 19 bp, Homo sapiens
ggctggcaagtgacagtgt

SEQ ID NO: 9347811 - DNA, 22 bp, Homo sapiens
gggagccaaggagagaggcctt

SEQ ID NO: 9347812 - DNA, 22 bp, Homo sapiens
gggagctgatcaggtggattca

SEQ ID NO: 9347813 - DNA, 22 bp, Homo sapiens
gggagctgatgatgtaagtccc

SEQ ID NO: 9347814 - DNA, 22 bp, Homo sapiens
gggagctgatgatgtaagtccc

SEQ ID NO: 9347815 - DNA, 22 bp, Homo sapiens
gggagctgcacacgccccggaa

SEQ ID NO: 9347816 - DNA, 22 bp, Homo sapiens
cagacagaaggctccttgaggt

SEQ ID NO: 9347817 - DNA, 22 bp, Homo sapiens
cagacacagatatgcatatggc

SEQ ID NO: 9347818 - DNA, 22 bp, Homo sapiens
cagacacacaagcaatctaagt

SEQ ID NO: 9347819 - DNA, 22 bp, Homo sapiens
gggaggcagtgctggaggctgg

SEQ ID NO: 9347820 - DNA, 22 bp, Homo sapiens
gggaggcagtgctggaggctgg

SEQ ID NO: 9347821 - DNA, 22 bp, Homo sapiens
gggaggcagtgctggaggctgg

SEQ ID NO: 9347822 - DNA, 22 bp, Homo sapiens
gggaggcagtgctggaggctgg

SEQ ID NO: 9347823 - DNA, 22 bp, Homo sapiens
gggaggcatgtgttatccactt

SEQ ID NO: 9347824 - DNA, 22 bp, Homo sapiens
gggaggcacgaggcgcgcagtg

SEQ ID NO: 9347825 - DNA, 22 bp, Homo sapiens
gggaggcacgaggcgcgcagtg

SEQ ID NO: 9347826 - DNA, 22 bp, Homo sapiens
gggaggcacgaggcgcgcagtg

SEQ ID NO: 9347827 - DNA, 22 bp, Homo sapiens
gggaggcagtgctggaggctgg

SEQ ID NO: 9347828 - DNA, 22 bp, Homo sapiens
gggaggagtgaagattcacctg

SEQ ID NO: 9347829 - DNA, 22 bp, Homo sapiens
gggaggagggtgctggctaaac

SEQ ID NO: 9347830 - DNA, 22 bp, Homo sapiens
gggaggcacgaggcgcgcagtg

SEQ ID NO: 9347831 - DNA, 22 bp, Homo sapiens
gggaggagtgaagattcacctg

SEQ ID NO: 9347832 - DNA, 22 bp, Homo sapiens
gggagctgctgaacacaagggt

SEQ ID NO: 9347833 - DNA, 21 bp, Homo sapiens
gggagctggaaactgggtgac

SEQ ID NO: 9347834 - DNA, 21 bp, Homo sapiens
gggagctggaaactgggtgac

SEQ ID NO: 9347835 - DNA, 21 bp, Homo sapiens
gggagctggaaactgggtgac

SEQ ID NO: 9347836 - DNA, 22 bp, Homo sapiens
gggaggagggtgctggctaaac

SEQ ID NO: 9347837 - DNA, 20 bp, Homo sapiens
gggagctggaattgtcttag

SEQ ID NO: 9347838 - DNA, 22 bp, Homo sapiens
gggagctgcggtcttgcgaaga

SEQ ID NO: 9347839 - DNA, 22 bp, Homo sapiens
gggagctgctgaacacaagggt

SEQ ID NO: 9347840 - DNA, 22 bp, Homo sapiens
gggagctgccaccacccctggg

SEQ ID NO: 9347841 - DNA, 22 bp, Homo sapiens
gggagctgccttagaccggagg

SEQ ID NO: 9347842 - DNA, 23 bp, Homo sapiens
gggatctgtaagttgaagacaaa

SEQ ID NO: 9347843 - DNA, 23 bp, Homo sapiens
gggatctgtaaacctggagaacc

SEQ ID NO: 9347844 - DNA, 22 bp, Homo sapiens
gggatctgctccagagggaaaa

SEQ ID NO: 9347845 - DNA, 22 bp, Homo sapiens
gggatgagagctgggacagaag

SEQ ID NO: 9347846 - DNA, 22 bp, Homo sapiens
gggatgacaaagtgtctgtccc

SEQ ID NO: 9347847 - DNA, 22 bp, Homo sapiens
gggatgagagtagggtgtgaaa

SEQ ID NO: 9347848 - DNA, 22 bp, Homo sapiens
cagagcagaagcggtcctcaca

SEQ ID NO: 9347849 - DNA, 22 bp, Homo sapiens
cagagcagaagcggtcctcaca

SEQ ID NO: 9347850 - DNA, 22 bp, Homo sapiens
cagagcagaagcggtcctcaca

SEQ ID NO: 9347851 - DNA, 22 bp, Homo sapiens
cagagcagaaacctgggtgatt

SEQ ID NO: 9347852 - DNA, 22 bp, Homo sapiens
cagagcagaaacctgggtgatt

SEQ ID NO: 9347853 - DNA, 22 bp, Homo sapiens
cagagcagaaacctgggtgatt

SEQ ID NO: 9347854 - DNA, 22 bp, Homo sapiens
cagagcagaaacctgggtgatt

SEQ ID NO: 9347855 - DNA, 22 bp, Homo sapiens
cagagaggaggctatatgcaaa

SEQ ID NO: 9347856 - DNA, 22 bp, Homo sapiens
cagagaggaggctatatgcaaa

SEQ ID NO: 9347857 - DNA, 22 bp, Homo sapiens
cagagcactgcttggaggattt

SEQ ID NO: 9347858 - DNA, 22 bp, Homo sapiens
cagagacaacctggtagagaaa

SEQ ID NO: 9347859 - DNA, 22 bp, Homo sapiens
cagagacaatgtctctgcttgt

SEQ ID NO: 9347860 - DNA, 22 bp, Homo sapiens
cagagacacttaacaggaatgg

SEQ ID NO: 9347861 - DNA, 22 bp, Homo sapiens
cagagaataaaagggcattcct

SEQ ID NO: 9347862 - DNA, 22 bp, Homo sapiens
cagagacaacaagtttaactat

SEQ ID NO: 9347863 - DNA, 22 bp, Homo sapiens
cagagcagtggagagtaggtct

SEQ ID NO: 9347864 - DNA, 20 bp, Homo sapiens
cagagcagtgcccaggcggc

SEQ ID NO: 9347865 - DNA, 22 bp, Homo sapiens
cagagcagtgaggagttgtgta

SEQ ID NO: 9347866 - DNA, 22 bp, Homo sapiens
cagagcagtgaggagttgtgta

SEQ ID NO: 9347867 - DNA, 22 bp, Homo sapiens
cagagcagtggagagtaggtct

SEQ ID NO: 9347868 - DNA, 19 bp, Homo sapiens
cagagcagtggttcctgaa

SEQ ID NO: 9347869 - DNA, 19 bp, Homo sapiens
cagagcagtggttcctgaa

SEQ ID NO: 9347870 - DNA, 22 bp, Homo sapiens
cagagcataattgacatgaggt

SEQ ID NO: 9347871 - DNA, 22 bp, Homo sapiens
cagagcataattgacatgaggt

SEQ ID NO: 9347872 - DNA, 22 bp, Homo sapiens
cagagccaaacctcagggcccg

SEQ ID NO: 9347873 - DNA, 22 bp, Homo sapiens
cagagccaaacctcagggcccg

SEQ ID NO: 9347874 - DNA, 22 bp, Homo sapiens
cagagccaaacctcagggcccg

SEQ ID NO: 9347875 - DNA, 22 bp, Homo sapiens
cagagccaaacctcagggcccg

SEQ ID NO: 9347876 - DNA, 22 bp, Homo sapiens
cagagcatgtcaactagcttta

SEQ ID NO: 9347877 - DNA, 22 bp, Homo sapiens
cagagcattaaaaccagctctg

SEQ ID NO: 9347878 - DNA, 22 bp, Homo sapiens
cagagcattgagggtctgccaa

SEQ ID NO: 9347879 - DNA, 22 bp, Homo sapiens
cagagccaacgccacctgccca

SEQ ID NO: 9347880 - DNA, 22 bp, Homo sapiens
gggcaggggtcagtggccccaa

SEQ ID NO: 9347881 - DNA, 22 bp, Homo sapiens
gggcaggggtcagtggccccaa

SEQ ID NO: 9347882 - DNA, 22 bp, Homo sapiens
gggcaggtacaagatgcttctt

SEQ ID NO: 9347883 - DNA, 22 bp, Homo sapiens
gggcaggtactgggtggtgagc

SEQ ID NO: 9347884 - DNA, 22 bp, Homo sapiens
gggcaggtacaagatgcttctt

SEQ ID NO: 9347885 - DNA, 22 bp, Homo sapiens
gggcaggtacaagatgcttctt

SEQ ID NO: 9347886 - DNA, 22 bp, Homo sapiens
gggcaggtactgggtggtgagc

SEQ ID NO: 9347887 - DNA, 22 bp, Homo sapiens
gggcaggtaggtgaaataatga

SEQ ID NO: 9347888 - DNA, 22 bp, Homo sapiens
cagagcagtgaggagttgtgta

SEQ ID NO: 9347889 - DNA, 22 bp, Homo sapiens
cagagcaggggtttcccaggtt

SEQ ID NO: 9347890 - DNA, 22 bp, Homo sapiens
cagagcagtgaggagttgtgta

SEQ ID NO: 9347891 - DNA, 22 bp, Homo sapiens
cagagcagaaggtccaagcctg

SEQ ID NO: 9347892 - DNA, 22 bp, Homo sapiens
cagagcagaaggtccaagcctg

SEQ ID NO: 9347893 - DNA, 22 bp, Homo sapiens
cagagcagaaggtccaagcctg

SEQ ID NO: 9347894 - DNA, 18 bp, Homo sapiens
cagagcagaggtggagcg

SEQ ID NO: 9347895 - DNA, 18 bp, Homo sapiens
cagagcagaggtggagcg

SEQ ID NO: 9347896 - DNA, 22 bp, Homo sapiens
cagagcagacgttgagattaag

SEQ ID NO: 9347897 - DNA, 22 bp, Homo sapiens
gggcaggggtcagtggccccaa

SEQ ID NO: 9347898 - DNA, 22 bp, Homo sapiens
gggcaggggtcagtggccccaa

SEQ ID NO: 9347899 - DNA, 22 bp, Homo sapiens
gggcaggggtagcattccaagt

SEQ ID NO: 9347900 - DNA, 18 bp, Homo sapiens
cagagcagaggtggagcg

SEQ ID NO: 9347901 - DNA, 22 bp, Homo sapiens
caatatataatgagtactttcc

SEQ ID NO: 9347902 - DNA, 22 bp, Homo sapiens
caatatataatgagtactttcc

SEQ ID NO: 9347903 - DNA, 22 bp, Homo sapiens
caatatataggaacaacttagg

SEQ ID NO: 9347904 - DNA, 22 bp, Homo sapiens
caatatataggaacaacttagg

SEQ ID NO: 9347905 - DNA, 22 bp, Homo sapiens
caatatagagagaaaattatgt

SEQ ID NO: 9347906 - DNA, 22 bp, Homo sapiens
caatagtaaattacggaggaga

SEQ ID NO: 9347907 - DNA, 20 bp, Homo sapiens
caatagaatgtggagataag

SEQ ID NO: 9347908 - DNA, 22 bp, Homo sapiens
caatagatacctttgtcccaat

SEQ ID NO: 9347909 - DNA, 22 bp, Homo sapiens
caatagaaaactcaatacttaa

SEQ ID NO: 9347910 - DNA, 18 bp, Homo sapiens
caatagaaacagtaggaa

SEQ ID NO: 9347911 - DNA, 22 bp, Homo sapiens
caatagaaggcacagataggta

SEQ ID NO: 9347912 - DNA, 22 bp, Homo sapiens
gctggggaggcagcagagaaca

SEQ ID NO: 9347913 - DNA, 22 bp, Homo sapiens
gctggggagctagacctcagca

SEQ ID NO: 9347914 - DNA, 22 bp, Homo sapiens
caaggccttcttgggagagatt

SEQ ID NO: 9347915 - DNA, 22 bp, Homo sapiens
caaggctgagaaattctgccct

SEQ ID NO: 9347916 - DNA, 22 bp, Homo sapiens
caaggctgtgcagggtccatat

SEQ ID NO: 9347917 - DNA, 22 bp, Homo sapiens
caaggctgcttcagactagtga

SEQ ID NO: 9347918 - DNA, 22 bp, Homo sapiens
caaggctgcttcagactagtga

SEQ ID NO: 9347919 - DNA, 22 bp, Homo sapiens
caataactttgatattttgcgg

SEQ ID NO: 9347920 - DNA, 22 bp, Homo sapiens
caattgtgaagacaacagctta

SEQ ID NO: 9347921 - DNA, 19 bp, Homo sapiens
caattctgcaacactgtcc

SEQ ID NO: 9347922 - DNA, 22 bp, Homo sapiens
caattcccagctgccgggctgc

SEQ ID NO: 9347923 - DNA, 22 bp, Homo sapiens
caatcacaaagagacaagtgtc

SEQ ID NO: 9347924 - DNA, 22 bp, Homo sapiens
caatcatggtataattcctttt

SEQ ID NO: 9347925 - DNA, 22 bp, Homo sapiens
caatgttttcaactgacaagta

SEQ ID NO: 9347926 - DNA, 22 bp, Homo sapiens
caatttcattaatagatataga

SEQ ID NO: 9347927 - DNA, 22 bp, Homo sapiens
caatttcatgccatgtattgct

SEQ ID NO: 9347928 - DNA, 22 bp, Homo sapiens
caatttcatgccatgtattgct

SEQ ID NO: 9347929 - DNA, 22 bp, Homo sapiens
caatttcatgccatgtattgct

SEQ ID NO: 9347930 - DNA, 22 bp, Homo sapiens
caatttcactaataatatttac

SEQ ID NO: 9347931 - DNA, 22 bp, Homo sapiens
caatttcactaataatatttac

SEQ ID NO: 9347932 - DNA, 22 bp, Homo sapiens
caatttcaggtggataggtttt

SEQ ID NO: 9347933 - DNA, 23 bp, Homo sapiens
caatttcatatgattctacctaa

SEQ ID NO: 9347934 - DNA, 22 bp, Homo sapiens
ggaagctggacaggctttgagt

SEQ ID NO: 9347935 - DNA, 22 bp, Homo sapiens
ggaagctggctcttataaatat

SEQ ID NO: 9347936 - DNA, 22 bp, Homo sapiens
ggaagctggcatatgtaatcct

SEQ ID NO: 9347937 - DNA, 22 bp, Homo sapiens
ggaagctgggatctctctcccg

SEQ ID NO: 9347938 - DNA, 22 bp, Homo sapiens
ggaagctggggagctttggaga

SEQ ID NO: 9347939 - DNA, 22 bp, Homo sapiens
ggaagctggtaattgttgggac

SEQ ID NO: 9347940 - DNA, 22 bp, Homo sapiens
ggaagctgtgctctcaggcctc

SEQ ID NO: 9347941 - DNA, 22 bp, Homo sapiens
ggaagctgtgctctcaggcctc

SEQ ID NO: 9347942 - DNA, 22 bp, Homo sapiens
cacaaataccagtttcctaaca

SEQ ID NO: 9347943 - DNA, 20 bp, Homo sapiens
ggaagctgtgggtccccagg

SEQ ID NO: 9347944 - DNA, 22 bp, Homo sapiens
cacaaatgactgaaacgactgt

SEQ ID NO: 9347945 - DNA, 22 bp, Homo sapiens
ggaagctgcataactagcgtgg

SEQ ID NO: 9347946 - DNA, 22 bp, Homo sapiens
ggaagctgaggcccagtgaagg

SEQ ID NO: 9347947 - DNA, 22 bp, Homo sapiens
ggaagctgaggcccagtgaagg

SEQ ID NO: 9347948 - DNA, 22 bp, Homo sapiens
ggaagctgcagtcccccccaag

SEQ ID NO: 9347949 - DNA, 22 bp, Homo sapiens
ggaagctgcttagctaatgtag

SEQ ID NO: 9347950 - DNA, 22 bp, Homo sapiens
ggaagctgccagtccaccagct

SEQ ID NO: 9347951 - DNA, 22 bp, Homo sapiens
ggaagctgccagtccaccagct

SEQ ID NO: 9347952 - DNA, 22 bp, Homo sapiens
ggaagctgaatccagagacagg

SEQ ID NO: 9347953 - DNA, 22 bp, Homo sapiens
ggaagctagttgtgtttcagga

SEQ ID NO: 9347954 - DNA, 22 bp, Homo sapiens
ggaagctaagataatttaagta

SEQ ID NO: 9347955 - DNA, 22 bp, Homo sapiens
ggaagaggaggagccaggcttt

SEQ ID NO: 9347956 - DNA, 22 bp, Homo sapiens
ggaagctgaacttagcaaggaa

SEQ ID NO: 9347957 - DNA, 22 bp, Homo sapiens
ggaagctgaacttagcaaggaa

SEQ ID NO: 9347958 - DNA, 23 bp, Homo sapiens
ggaagctcacgtagtcctgcact

SEQ ID NO: 9347959 - DNA, 22 bp, Homo sapiens
ggacatggagctccatggaggc

SEQ ID NO: 9347960 - DNA, 23 bp, Homo sapiens
ggacatgtctctgggtattttga

SEQ ID NO: 9347961 - DNA, 22 bp, Homo sapiens
ggacatggaagtatggagtgga

SEQ ID NO: 9347962 - DNA, 22 bp, Homo sapiens
ggacatggaagtatggagtgga

SEQ ID NO: 9347963 - DNA, 18 bp, Homo sapiens
ggacaggagacatgggtg

SEQ ID NO: 9347964 - DNA, 22 bp, Homo sapiens
ggacatggagcatgtagagaaa

SEQ ID NO: 9347965 - DNA, 22 bp, Homo sapiens
ggacatgtgcaacttctttgga

SEQ ID NO: 9347966 - DNA, 22 bp, Homo sapiens
ggacatgttccttttcatcttt

SEQ ID NO: 9347967 - DNA, 22 bp, Homo sapiens
ggacatttgcacctacctcagc

SEQ ID NO: 9347968 - DNA, 22 bp, Homo sapiens
ggacatttgcacctacctcagc

SEQ ID NO: 9347969 - DNA, 19 bp, Homo sapiens
ggacatttgagttgtttat

SEQ ID NO: 9347970 - DNA, 22 bp, Homo sapiens
ggaccacaatatttgtgaggtt

SEQ ID NO: 9347971 - DNA, 22 bp, Homo sapiens
ggacatttttcttcctacaatg

SEQ ID NO: 9347972 - DNA, 22 bp, Homo sapiens
ggaccagagaagtgagcacctg

SEQ ID NO: 9347973 - DNA, 22 bp, Homo sapiens
ggacagcttgcctggtaatgca

SEQ ID NO: 9347974 - DNA, 18 bp, Homo sapiens
ggacaggagacatgggtg

SEQ ID NO: 9347975 - DNA, 22 bp, Homo sapiens
ggacatggaagtatggagtgga

SEQ ID NO: 9347976 - DNA, 22 bp, Homo sapiens
cacaaatgtgcagaaatgtgag

SEQ ID NO: 9347977 - DNA, 22 bp, Homo sapiens
cacaaatgtagtagcttaaaac

SEQ ID NO: 9347978 - DNA, 21 bp, Homo sapiens
cacacagtgatctatccacat

SEQ ID NO: 9347979 - DNA, 22 bp, Homo sapiens
ggactgggtaggagcccagggc

SEQ ID NO: 9347980 - DNA, 22 bp, Homo sapiens
ggactgggtaggagcccagggc

SEQ ID NO: 9347981 - DNA, 22 bp, Homo sapiens
ggagaagggacagactcagctt

SEQ ID NO: 9347982 - DNA, 22 bp, Homo sapiens
cacacaggatgaagcagcagaa

SEQ ID NO: 9347983 - DNA, 22 bp, Homo sapiens
cacacaggatgaagcagcagaa

SEQ ID NO: 9347984 - DNA, 22 bp, Homo sapiens
cacacaggagagtgctggaggt

SEQ ID NO: 9347985 - DNA, 22 bp, Homo sapiens
cacacaggagagtgctggaggt

SEQ ID NO: 9347986 - DNA, 22 bp, Homo sapiens
cacacaggatgaagcagcagaa

SEQ ID NO: 9347987 - DNA, 22 bp, Homo sapiens
ggaccagcaatcaagaacctac

SEQ ID NO: 9347988 - DNA, 22 bp, Homo sapiens
ggaccagagctcgggcttctca

SEQ ID NO: 9347989 - DNA, 22 bp, Homo sapiens
ggagagaggagcccactgctgt

SEQ ID NO: 9347990 - DNA, 22 bp, Homo sapiens
ggagagaggagcccactgctgt

SEQ ID NO: 9347991 - DNA, 22 bp, Homo sapiens
ggagagaggctggccgtgatga

SEQ ID NO: 9347992 - DNA, 22 bp, Homo sapiens
ggagagcagggtcctgagatac

SEQ ID NO: 9347993 - DNA, 22 bp, Homo sapiens
ggagagcagggaggctgctctg

SEQ ID NO: 9347994 - DNA, 22 bp, Homo sapiens
ggagagcagggaggctgctctg

SEQ ID NO: 9347995 - DNA, 22 bp, Homo sapiens
ggagagcagggaggctgctctg

SEQ ID NO: 9347996 - DNA, 22 bp, Homo sapiens
ggagagcagggaggctgctctg

SEQ ID NO: 9347997 - DNA, 22 bp, Homo sapiens
ggagagcagggtcctgagatac

SEQ ID NO: 9347998 - DNA, 22 bp, Homo sapiens
ggagagcagggtcctgagatac

SEQ ID NO: 9347999 - DNA, 20 bp, Homo sapiens
ggagagccacatagtctccc

SEQ ID NO: 9348000 - DNA, 22 bp, Homo sapiens
ggagagcattcttagtctgttt

SEQ ID NO: 9348001 - DNA, 22 bp, Homo sapiens
ggagagcattcttagtctgttt

SEQ ID NO: 9348002 - DNA, 22 bp, Homo sapiens
ggagaagggacagactcagctt

SEQ ID NO: 9348003 - DNA, 22 bp, Homo sapiens
ggagaagggacagactcagctt

SEQ ID NO: 9348004 - DNA, 22 bp, Homo sapiens
ggagaagggccaattccatgta

SEQ ID NO: 9348005 - DNA, 22 bp, Homo sapiens
ggagaagggtatgtgtggcgga

SEQ ID NO: 9348006 - DNA, 22 bp, Homo sapiens
ggagaagggtatgtgtggcgga

SEQ ID NO: 9348007 - DNA, 22 bp, Homo sapiens
gctgggcttgtggccagctggg

SEQ ID NO: 9348008 - DNA, 20 bp, Homo sapiens
gctgggctttgactgacaca

SEQ ID NO: 9348009 - DNA, 19 bp, Homo sapiens
gctggggaatggatattga

SEQ ID NO: 9348010 - DNA, 20 bp, Homo sapiens
gctgggctttgactgacaca

SEQ ID NO: 9348011 - DNA, 20 bp, Homo sapiens
gctgggctttgactgacaca

SEQ ID NO: 9348012 - DNA, 22 bp, Homo sapiens
gctggggaccagctgtctctga

SEQ ID NO: 9348013 - DNA, 22 bp, Homo sapiens
gctggggaccagctgtctctga

SEQ ID NO: 9348014 - DNA, 22 bp, Homo sapiens
gctggggagcaagagtagtgag

SEQ ID NO: 9348015 - DNA, 22 bp, Homo sapiens
gctggggagaattgggttatct

SEQ ID NO: 9348016 - DNA, 22 bp, Homo sapiens
gctggggagcaagagtagtgag

SEQ ID NO: 9348017 - DNA, 23 bp, Homo sapiens
caagctgcagtttggttggtggg

SEQ ID NO: 9348018 - DNA, 22 bp, Homo sapiens
caagctgcagcgcctgcgccgg

SEQ ID NO: 9348019 - DNA, 22 bp, Homo sapiens
gctgggctcaccaggccactag

SEQ ID NO: 9348020 - DNA, 22 bp, Homo sapiens
gctgggcttggtttccctgctt

SEQ ID NO: 9348021 - DNA, 22 bp, Homo sapiens
gctgggcttgtggccagctggg

SEQ ID NO: 9348022 - DNA, 22 bp, Homo sapiens
gctgggcttgtggccagctggg

SEQ ID NO: 9348023 - DNA, 22 bp, Homo sapiens
caagcgtctaattgggggttgc

SEQ ID NO: 9348024 - DNA, 22 bp, Homo sapiens
caagcgtggctgctctgatgga

SEQ ID NO: 9348025 - DNA, 22 bp, Homo sapiens
caagctccttacatccacaggg

SEQ ID NO: 9348026 - DNA, 22 bp, Homo sapiens
caagctccttacatccacaggg

SEQ ID NO: 9348027 - DNA, 22 bp, Homo sapiens
caagctctgcgggctccaagat

SEQ ID NO: 9348028 - DNA, 22 bp, Homo sapiens
gctggctgagcactggtttata

SEQ ID NO: 9348029 - DNA, 22 bp, Homo sapiens
gctggctgagatctgttttcct

SEQ ID NO: 9348030 - DNA, 22 bp, Homo sapiens
gctggctgaggtctagctcttt

SEQ ID NO: 9348031 - DNA, 22 bp, Homo sapiens
gctggctgaggtctagctcttt

SEQ ID NO: 9348032 - DNA, 22 bp, Homo sapiens
gctggctgaggtctagctcttt

SEQ ID NO: 9348033 - DNA, 20 bp, Homo sapiens
caagccctctttagcctgcc

SEQ ID NO: 9348034 - DNA, 22 bp, Homo sapiens
caagcctgtctcaccagtgcta

SEQ ID NO: 9348035 - DNA, 22 bp, Homo sapiens
caagccgcggctccagatgtgg

SEQ ID NO: 9348036 - DNA, 22 bp, Homo sapiens
caagcccagatcctgcgtgtct

SEQ ID NO: 9348037 - DNA, 22 bp, Homo sapiens
caagcccaggattccccagtta

SEQ ID NO: 9348038 - DNA, 22 bp, Homo sapiens
caagcccactgctcagagccaa

SEQ ID NO: 9348039 - DNA, 20 bp, Homo sapiens
gctggctgaactgaaagcaa

SEQ ID NO: 9348040 - DNA, 20 bp, Homo sapiens
gctggctgaactgaaagcaa

SEQ ID NO: 9348041 - DNA, 22 bp, Homo sapiens
gctggctgaatcttctgcaata

SEQ ID NO: 9348042 - DNA, 22 bp, Homo sapiens
gctggctctttttgccgggctc

SEQ ID NO: 9348043 - DNA, 22 bp, Homo sapiens
gctggcccagcgtggggccgtg

SEQ ID NO: 9348044 - DNA, 22 bp, Homo sapiens
gctggctctttttgccgggctc

SEQ ID NO: 9348045 - DNA, 22 bp, Homo sapiens
gctggctgacagagatttaaaa

SEQ ID NO: 9348046 - DNA, 22 bp, Homo sapiens
gctggctgaatcttctgcaata

SEQ ID NO: 9348047 - DNA, 17 bp, Homo sapiens
gctggctgacccatgcc

SEQ ID NO: 9348048 - DNA, 22 bp, Homo sapiens
gctggctgacagatttggggtg

SEQ ID NO: 9348049 - DNA, 22 bp, Homo sapiens
gctggctgagcactggtttata

SEQ ID NO: 9348050 - DNA, 17 bp, Homo sapiens
gctggctgacccatgcc

SEQ ID NO: 9348051 - DNA, 22 bp, Homo sapiens
gctggagaaacaggaggaggaa

SEQ ID NO: 9348052 - DNA, 22 bp, Homo sapiens
caagaaggctatatgggccagg

SEQ ID NO: 9348053 - DNA, 22 bp, Homo sapiens
gctggaagtaaaaacttactag

SEQ ID NO: 9348054 - DNA, 22 bp, Homo sapiens
gctggacatccatcctgtagaa

SEQ ID NO: 9348055 - DNA, 22 bp, Homo sapiens
gctggacccggcccctcacctc

SEQ ID NO: 9348056 - DNA, 22 bp, Homo sapiens
gctggacccggcccctcacctc

SEQ ID NO: 9348057 - DNA, 22 bp, Homo sapiens
gctggactagaagcagggctca

SEQ ID NO: 9348058 - DNA, 22 bp, Homo sapiens
gctggacttagaggtggaaaag

SEQ ID NO: 9348059 - DNA, 19 bp, Homo sapiens
caagacaaagcccatcttc

SEQ ID NO: 9348060 - DNA, 22 bp, Homo sapiens
caagaattaagaattttgatgt

SEQ ID NO: 9348061 - DNA, 22 bp, Homo sapiens
caagaatataaatactttcaaa

SEQ ID NO: 9348062 - DNA, 21 bp, Homo sapiens
gctgcctgcccctcgggggct

SEQ ID NO: 9348063 - DNA, 22 bp, Homo sapiens
gctgcctgccctgggtcatctg

SEQ ID NO: 9348064 - DNA, 22 bp, Homo sapiens
gctgcctgccttgcctggagga

SEQ ID NO: 9348065 - DNA, 22 bp, Homo sapiens
gctgctggccccacatgctcca

SEQ ID NO: 9348066 - DNA, 22 bp, Homo sapiens
gctgctggcgctgggcgtccgg

SEQ ID NO: 9348067 - DNA, 22 bp, Homo sapiens
gctgctggccgcccagcttctc

SEQ ID NO: 9348068 - DNA, 22 bp, Homo sapiens
gctgctttgtctgtaaaatgga

SEQ ID NO: 9348069 - DNA, 22 bp, Homo sapiens
gctgcttttgagttaaagtcat

SEQ ID NO: 9348070 - DNA, 22 bp, Homo sapiens
gctggaaggctaggctcagttg

SEQ ID NO: 9348071 - DNA, 22 bp, Homo sapiens
gctggaaggctaggctcagttg

SEQ ID NO: 9348072 - DNA, 22 bp, Homo sapiens
gctggaagaatgagtgcctcgt

SEQ ID NO: 9348073 - DNA, 22 bp, Homo sapiens
gctggaagggaggcccagccgg

SEQ ID NO: 9348074 - DNA, 20 bp, Homo sapiens
gctggaagggctagagggct

SEQ ID NO: 9348075 - DNA, 20 bp, Homo sapiens
gctggaagggctagagggct

SEQ ID NO: 9348076 - DNA, 22 bp, Homo sapiens
gctgccctccagttcccacagt

SEQ ID NO: 9348077 - DNA, 22 bp, Homo sapiens
gctgccctccagttcccacagt

SEQ ID NO: 9348078 - DNA, 18 bp, Homo sapiens
gctgccctagctcccctc

SEQ ID NO: 9348079 - DNA, 22 bp, Homo sapiens
gctgccctgacaagctactccc

SEQ ID NO: 9348080 - DNA, 22 bp, Homo sapiens
gctgccctgacaagctactccc

SEQ ID NO: 9348081 - DNA, 22 bp, Homo sapiens
gctgccctgactccagcagcct

SEQ ID NO: 9348082 - DNA, 22 bp, Homo sapiens
gctgccctctctggccccacac

SEQ ID NO: 9348083 - DNA, 22 bp, Homo sapiens
gctgccctctctggccccacac

SEQ ID NO: 9348084 - DNA, 22 bp, Homo sapiens
gctgccctctgtgacccggccc

SEQ ID NO: 9348085 - DNA, 22 bp, Homo sapiens
gctgccctgactccagcagcct

SEQ ID NO: 9348086 - DNA, 21 bp, Homo sapiens
gctgccctggctcagcattca

SEQ ID NO: 9348087 - DNA, 22 bp, Homo sapiens
caaagtcagggaagagtggctg

SEQ ID NO: 9348088 - DNA, 22 bp, Homo sapiens
caaagtcatggggatgcaggtc

SEQ ID NO: 9348089 - DNA, 22 bp, Homo sapiens
caaagtcagccagctagtaggt

SEQ ID NO: 9348090 - DNA, 17 bp, Homo sapiens
gctctggcacaggattg

SEQ ID NO: 9348091 - DNA, 17 bp, Homo sapiens
gctctggcacaggattg

SEQ ID NO: 9348092 - DNA, 22 bp, Homo sapiens
gctctggatccggctgggtctg

SEQ ID NO: 9348093 - DNA, 18 bp, Homo sapiens
gctctggaggtagcatta

SEQ ID NO: 9348094 - DNA, 23 bp, Homo sapiens
gctctggagctgggcctggcagg

SEQ ID NO: 9348095 - DNA, 22 bp, Homo sapiens
gctctggaagcatctgagagga

SEQ ID NO: 9348096 - DNA, 22 bp, Homo sapiens
gctctggaacctgccaggatgc

SEQ ID NO: 9348097 - DNA, 22 bp, Homo sapiens
gctctggaacctgccaggatgc

SEQ ID NO: 9348098 - DNA, 22 bp, Homo sapiens
gctctggaacctgccaggatgc

SEQ ID NO: 9348099 - DNA, 22 bp, Homo sapiens
gctctgctgtgtttgttcagca

SEQ ID NO: 9348100 - DNA, 22 bp, Homo sapiens
gctctgcttgcatcatgactgc

SEQ ID NO: 9348101 - DNA, 22 bp, Homo sapiens
gctctggagatggagccttgag

SEQ ID NO: 9348102 - DNA, 22 bp, Homo sapiens
gctctggagcactggaaacact

SEQ ID NO: 9348103 - DNA, 22 bp, Homo sapiens
gctctggagatggagccttgag

SEQ ID NO: 9348104 - DNA, 22 bp, Homo sapiens
gctctggaccctgccagcctta

SEQ ID NO: 9348105 - DNA, 22 bp, Homo sapiens
gctctggaccctgccagcctta

SEQ ID NO: 9348106 - DNA, 22 bp, Homo sapiens
gctctggaccctgccagcctta

SEQ ID NO: 9348107 - DNA, 22 bp, Homo sapiens
gctctggaccctggagtggctg

SEQ ID NO: 9348108 - DNA, 22 bp, Homo sapiens
gctctggaccctggagtggctg

SEQ ID NO: 9348109 - DNA, 22 bp, Homo sapiens
gctctggactggggcctgagaa

SEQ ID NO: 9348110 - DNA, 22 bp, Homo sapiens
gctctggactggggcctgagaa

SEQ ID NO: 9348111 - DNA, 22 bp, Homo sapiens
gctgccctgtctgcagcaggac

SEQ ID NO: 9348112 - DNA, 22 bp, Homo sapiens
gctgccctgtccggctctcctg

SEQ ID NO: 9348113 - DNA, 21 bp, Homo sapiens
gctgccctggctcagcattca

SEQ ID NO: 9348114 - DNA, 22 bp, Homo sapiens
gctgccctgtccggctctcctg

SEQ ID NO: 9348115 - DNA, 22 bp, Homo sapiens
gctgccctgtccggctctcctg

SEQ ID NO: 9348116 - DNA, 22 bp, Homo sapiens
caacaacatgggattcatttct

SEQ ID NO: 9348117 - DNA, 22 bp, Homo sapiens
caacaagcgctcagagcaaagc

SEQ ID NO: 9348118 - DNA, 22 bp, Homo sapiens
caactacatccacactttgtta

SEQ ID NO: 9348119 - DNA, 22 bp, Homo sapiens
caactagttttaatgttcatgg

SEQ ID NO: 9348120 - DNA, 22 bp, Homo sapiens
caactttagcaatgttagtata

SEQ ID NO: 9348121 - DNA, 22 bp, Homo sapiens
caacacattgaagctatgatga

SEQ ID NO: 9348122 - DNA, 22 bp, Homo sapiens
caacacattgaagctatgatga

SEQ ID NO: 9348123 - DNA, 22 bp, Homo sapiens
caacacagccattcccctagaa

SEQ ID NO: 9348124 - DNA, 22 bp, Homo sapiens
caagaacattgtgatcacttca

SEQ ID NO: 9348125 - DNA, 22 bp, Homo sapiens
gctgcctgatgtccagcaggac

SEQ ID NO: 9348126 - DNA, 22 bp, Homo sapiens
gctgcctgatgtccagcaggac

SEQ ID NO: 9348127 - DNA, 22 bp, Homo sapiens
gctgcctgcacagagctgcttt

SEQ ID NO: 9348128 - DNA, 22 bp, Homo sapiens
gctgcctgcacagagctgcttt

SEQ ID NO: 9348129 - DNA, 17 bp, Homo sapiens
gctgcctgcaactgact

SEQ ID NO: 9348130 - DNA, 22 bp, Homo sapiens
caactttctccaagtacaagaa

SEQ ID NO: 9348131 - DNA, 22 bp, Homo sapiens
caagaaacaccaatgactgctg

SEQ ID NO: 9348132 - DNA, 22 bp, Homo sapiens
caagaaatgggatttgactgcc

SEQ ID NO: 9348133 - DNA, 22 bp, Homo sapiens
cacctgggctttctctggaact

SEQ ID NO: 9348134 - DNA, 22 bp, Homo sapiens
ggccaggctgccctgggagcag

SEQ ID NO: 9348135 - DNA, 22 bp, Homo sapiens
ggccaggctgccctgggagcag

SEQ ID NO: 9348136 - DNA, 22 bp, Homo sapiens
cacctgggctttctctgggact

SEQ ID NO: 9348137 - DNA, 22 bp, Homo sapiens
ggccaggctgccctgggagcag

SEQ ID NO: 9348138 - DNA, 22 bp, Homo sapiens
ggccaggctggtctcagacttc

SEQ ID NO: 9348139 - DNA, 22 bp, Homo sapiens
ggccaggctgctgggaccccgc

SEQ ID NO: 9348140 - DNA, 22 bp, Homo sapiens
ggccaggctgctgggaccccgc

SEQ ID NO: 9348141 - DNA, 22 bp, Homo sapiens
ggccaggctggtctcagacttc

SEQ ID NO: 9348142 - DNA, 22 bp, Homo sapiens
ggccaggctggtctcagacttc

SEQ ID NO: 9348143 - DNA, 22 bp, Homo sapiens
ggccaggctggtctcagacttc

SEQ ID NO: 9348144 - DNA, 22 bp, Homo sapiens
ggccaggctggttccttgacct

SEQ ID NO: 9348145 - DNA, 22 bp, Homo sapiens
ggccaggctggttccttgacct

SEQ ID NO: 9348146 - DNA, 22 bp, Homo sapiens
ggccaggctggttccttgacct

SEQ ID NO: 9348147 - DNA, 22 bp, Homo sapiens
cacctgcctggtccttagggct

SEQ ID NO: 9348148 - DNA, 22 bp, Homo sapiens
cacctgcctggtccttagggct

SEQ ID NO: 9348149 - DNA, 22 bp, Homo sapiens
cacctggaccctgggaggaggg

SEQ ID NO: 9348150 - DNA, 22 bp, Homo sapiens
cacctggcccagctccagtgct

SEQ ID NO: 9348151 - DNA, 22 bp, Homo sapiens
cacctgggctaaactatgcagg

SEQ ID NO: 9348152 - DNA, 22 bp, Homo sapiens
cacctgggctaaactatgcagg

SEQ ID NO: 9348153 - DNA, 23 bp, Homo sapiens
cacctggcttgagttggtgggtc

SEQ ID NO: 9348154 - DNA, 23 bp, Homo sapiens
cacctggcttgagttggtgggtc

SEQ ID NO: 9348155 - DNA, 22 bp, Homo sapiens
cacctggcctacagggaccagc

SEQ ID NO: 9348156 - DNA, 20 bp, Homo sapiens
cacctggctgactgtctcca

SEQ ID NO: 9348157 - DNA, 22 bp, Homo sapiens
cacctggctgtgaagcctgggt

SEQ ID NO: 9348158 - DNA, 22 bp, Homo sapiens
caccaggctgaaccagagggga

SEQ ID NO: 9348159 - DNA, 20 bp, Homo sapiens
caccaggcgctctgagaaca

SEQ ID NO: 9348160 - DNA, 22 bp, Homo sapiens
caccaggcacagctctcctgct

SEQ ID NO: 9348161 - DNA, 22 bp, Homo sapiens
caccaggcacatagtaggcact

SEQ ID NO: 9348162 - DNA, 22 bp, Homo sapiens
caccaggcacatagtaggcact

SEQ ID NO: 9348163 - DNA, 22 bp, Homo sapiens
caccaggatgggcaggtaggtc

SEQ ID NO: 9348164 - DNA, 22 bp, Homo sapiens
caccaggcacagctctcctgct

SEQ ID NO: 9348165 - DNA, 22 bp, Homo sapiens
caccaggctgaaccagagggga

SEQ ID NO: 9348166 - DNA, 22 bp, Homo sapiens
caccaggctgagcctctcatct

SEQ ID NO: 9348167 - DNA, 22 bp, Homo sapiens
caccaggctgagcctctcatct

SEQ ID NO: 9348168 - DNA, 22 bp, Homo sapiens
caccaggctgaaccagagggga

SEQ ID NO: 9348169 - DNA, 22 bp, Homo sapiens
caccaggctgaaccagagggga

SEQ ID NO: 9348170 - DNA, 20 bp, Homo sapiens
caccaggcgctctgagaaca

SEQ ID NO: 9348171 - DNA, 22 bp, Homo sapiens
caccaggctgcccaggacaggg

SEQ ID NO: 9348172 - DNA, 22 bp, Homo sapiens
caccaggctgcccaggacaggg

SEQ ID NO: 9348173 - DNA, 22 bp, Homo sapiens
caccaggctgcccaggacaggg

SEQ ID NO: 9348174 - DNA, 22 bp, Homo sapiens
caccaggctgcccaggacaggg

SEQ ID NO: 9348175 - DNA, 22 bp, Homo sapiens
caccaggctgcccaggacaggg

SEQ ID NO: 9348176 - DNA, 22 bp, Homo sapiens
cacctgcctgcaggggctccac

SEQ ID NO: 9348177 - DNA, 22 bp, Homo sapiens
cacctgcctgcaggggctccac

SEQ ID NO: 9348178 - DNA, 22 bp, Homo sapiens
cacctgcctgctagagcctgac

SEQ ID NO: 9348179 - DNA, 22 bp, Homo sapiens
cacctgcctcatttgtccctgc

SEQ ID NO: 9348180 - DNA, 22 bp, Homo sapiens
cacctgccccagtcttggagct

SEQ ID NO: 9348181 - DNA, 22 bp, Homo sapiens
cacctgccctttcttgctccac

SEQ ID NO: 9348182 - DNA, 22 bp, Homo sapiens
cacctgccccagtcttggagct

SEQ ID NO: 9348183 - DNA, 22 bp, Homo sapiens
caccaggctggagtgcagaggt

SEQ ID NO: 9348184 - DNA, 22 bp, Homo sapiens
caccaggctggagtgcagaggt

SEQ ID NO: 9348185 - DNA, 22 bp, Homo sapiens
caccaggctggagtgcagaggt

SEQ ID NO: 9348186 - DNA, 22 bp, Homo sapiens
caccaggctggagtgcagaggt

SEQ ID NO: 9348187 - DNA, 22 bp, Homo sapiens
caccaggctggagtgcagaggt

SEQ ID NO: 9348188 - DNA, 22 bp, Homo sapiens
caccaggctggagtgcagaggt

SEQ ID NO: 9348189 - DNA, 22 bp, Homo sapiens
caccctgggctgggcctgttaa

SEQ ID NO: 9348190 - DNA, 22 bp, Homo sapiens
cacctgccaaatggggatgctg

SEQ ID NO: 9348191 - DNA, 22 bp, Homo sapiens
cacctgcccagcacctgggatc

SEQ ID NO: 9348192 - DNA, 22 bp, Homo sapiens
caccctgggctgggcctgttaa

SEQ ID NO: 9348193 - DNA, 22 bp, Homo sapiens
caccctgggctgggcctgttaa

SEQ ID NO: 9348194 - DNA, 22 bp, Homo sapiens
caccctgggctgggcctgttaa

SEQ ID NO: 9348195 - DNA, 22 bp, Homo sapiens
ggccagggaggagaggcccctg

SEQ ID NO: 9348196 - DNA, 22 bp, Homo sapiens
ggccagggccaaggctttccca

SEQ ID NO: 9348197 - DNA, 22 bp, Homo sapiens
cacgccagccggacactgggcc

SEQ ID NO: 9348198 - DNA, 22 bp, Homo sapiens
cacgcttggcttatacagagaa

SEQ ID NO: 9348199 - DNA, 22 bp, Homo sapiens
cacgctggtcattgtagtccag

SEQ ID NO: 9348200 - DNA, 22 bp, Homo sapiens
cactagtggccccatgtggttg

SEQ ID NO: 9348201 - DNA, 22 bp, Homo sapiens
cactataatcctgttttagaac

SEQ ID NO: 9348202 - DNA, 22 bp, Homo sapiens
cactatatgcctttgaaataca

SEQ ID NO: 9348203 - DNA, 22 bp, Homo sapiens
cactatatgcctttgaaataca

SEQ ID NO: 9348204 - DNA, 22 bp, Homo sapiens
cactcagcccacccatgtttgt

SEQ ID NO: 9348205 - DNA, 22 bp, Homo sapiens
cactcagcccacccatgtttgt

SEQ ID NO: 9348206 - DNA, 22 bp, Homo sapiens
cactcagctgagccctcagccc

SEQ ID NO: 9348207 - DNA, 21 bp, Homo sapiens
cactccacttagaacagggtt

SEQ ID NO: 9348208 - DNA, 21 bp, Homo sapiens
cactccacttagaacagggtt

SEQ ID NO: 9348209 - DNA, 21 bp, Homo sapiens
cactccacttagaacagggtt

SEQ ID NO: 9348210 - DNA, 22 bp, Homo sapiens
cactcagggatcaggtaaattc

SEQ ID NO: 9348211 - DNA, 22 bp, Homo sapiens
cactcagggtacaatggagggc

SEQ ID NO: 9348212 - DNA, 22 bp, Homo sapiens
cactctccagcacaccccattt

SEQ ID NO: 9348213 - DNA, 21 bp, Homo sapiens
cactctcccaatccttgctga

SEQ ID NO: 9348214 - DNA, 21 bp, Homo sapiens
cactctcccaatccttgctga

SEQ ID NO: 9348215 - DNA, 22 bp, Homo sapiens
cactctcacatgccctgtcagt

SEQ ID NO: 9348216 - DNA, 23 bp, Homo sapiens
cactcctgtttctaagccagcat

SEQ ID NO: 9348217 - DNA, 22 bp, Homo sapiens
cactccctctagttgcattctg

SEQ ID NO: 9348218 - DNA, 22 bp, Homo sapiens
cactccctctagttgcattctg

SEQ ID NO: 9348219 - DNA, 22 bp, Homo sapiens
cactccaggtcccagttcctgg

SEQ ID NO: 9348220 - DNA, 22 bp, Homo sapiens
cactccagcctcagtgacagag

SEQ ID NO: 9348221 - DNA, 22 bp, Homo sapiens
cactctctcaggctttccttgt

SEQ ID NO: 9348222 - DNA, 22 bp, Homo sapiens
cactctgaactattaacttggg

SEQ ID NO: 9348223 - DNA, 22 bp, Homo sapiens
cactgcaacctccacctcctgg

SEQ ID NO: 9348224 - DNA, 22 bp, Homo sapiens
cactctgacacatgaacttgat

SEQ ID NO: 9348225 - DNA, 22 bp, Homo sapiens
cactctgactggccctgcagga

SEQ ID NO: 9348226 - DNA, 22 bp, Homo sapiens
cactgcactccagcctgcgcaa

SEQ ID NO: 9348227 - DNA, 22 bp, Homo sapiens
cactgcactccagcctgggaga

SEQ ID NO: 9348228 - DNA, 22 bp, Homo sapiens
cactgcactccagcctgggaga

SEQ ID NO: 9348229 - DNA, 22 bp, Homo sapiens
cactgcactccagcctgggaga

SEQ ID NO: 9348230 - DNA, 22 bp, Homo sapiens
cactgcactccagcctgggaga

SEQ ID NO: 9348231 - DNA, 22 bp, Homo sapiens
cactgcactccagcctgggtca

SEQ ID NO: 9348232 - DNA, 22 bp, Homo sapiens
cactgcactccagcctgggcaa

SEQ ID NO: 9348233 - DNA, 22 bp, Homo sapiens
cactgcactccagcctgggtca

SEQ ID NO: 9348234 - DNA, 22 bp, Homo sapiens
cactgcactccagcctgggtca

SEQ ID NO: 9348235 - DNA, 22 bp, Homo sapiens
cactgcactccagcctgggtga

SEQ ID NO: 9348236 - DNA, 22 bp, Homo sapiens
cactgcactccagcctgggtca

SEQ ID NO: 9348237 - DNA, 22 bp, Homo sapiens
cactgcactccagcctgggtga

SEQ ID NO: 9348238 - DNA, 22 bp, Homo sapiens
cactgcactccagcctgggtga

SEQ ID NO: 9348239 - DNA, 22 bp, Homo sapiens
cactgcactccagctgggtgac

SEQ ID NO: 9348240 - DNA, 22 bp, Homo sapiens
cactgcactccagcctgggtga

SEQ ID NO: 9348241 - DNA, 22 bp, Homo sapiens
ggctctgcttcagaaggctcat

SEQ ID NO: 9348242 - DNA, 22 bp, Homo sapiens
ggctctgcttcctggaattgtg

SEQ ID NO: 9348243 - DNA, 22 bp, Homo sapiens
ggctctgctggtaagatgcctc

SEQ ID NO: 9348244 - DNA, 22 bp, Homo sapiens
ggctctgcttcagaaggctcat

SEQ ID NO: 9348245 - DNA, 22 bp, Homo sapiens
ggctctgcttcagaaggctcat

SEQ ID NO: 9348246 - DNA, 22 bp, Homo sapiens
ggctctgctggattgaggccag

SEQ ID NO: 9348247 - DNA, 22 bp, Homo sapiens
ggctctgctggtaagatgcctc

SEQ ID NO: 9348248 - DNA, 22 bp, Homo sapiens
ggctctgctggtaagatgcctc

SEQ ID NO: 9348249 - DNA, 22 bp, Homo sapiens
cactgtactgtgaataaggagg

SEQ ID NO: 9348250 - DNA, 21 bp, Homo sapiens
cactgtatagcaggagaaaac

SEQ ID NO: 9348251 - DNA, 22 bp, Homo sapiens
cactgtattattaggaatgaca

SEQ ID NO: 9348252 - DNA, 22 bp, Homo sapiens
ggctctgctggattgaggccag

SEQ ID NO: 9348253 - DNA, 22 bp, Homo sapiens
cactgtaaagcgtcacagggac

SEQ ID NO: 9348254 - DNA, 22 bp, Homo sapiens
cactgggcaattctgagcctaa

SEQ ID NO: 9348255 - DNA, 22 bp, Homo sapiens
cactggtgccagagaacagaat

SEQ ID NO: 9348256 - DNA, 22 bp, Homo sapiens
cacttagtctcaccagttcagt

SEQ ID NO: 9348257 - DNA, 22 bp, Homo sapiens
cacttatctcatttaatcacca

SEQ ID NO: 9348258 - DNA, 22 bp, Homo sapiens
cacttaagcagttaatttatct

SEQ ID NO: 9348259 - DNA, 22 bp, Homo sapiens
cacttatttatgcagaaaagtt

SEQ ID NO: 9348260 - DNA, 22 bp, Homo sapiens
cacttattatgggctaggaact

SEQ ID NO: 9348261 - DNA, 22 bp, Homo sapiens
cacttcattgggaccagggctg

SEQ ID NO: 9348262 - DNA, 22 bp, Homo sapiens
cacttccagagtctgggctggg

SEQ ID NO: 9348263 - DNA, 22 bp, Homo sapiens
cacttcagctacaatcacatga

SEQ ID NO: 9348264 - DNA, 22 bp, Homo sapiens
cacttaaatctgttgagaaaaa

SEQ ID NO: 9348265 - DNA, 22 bp, Homo sapiens
ggctctggaaagtgtccttgat

SEQ ID NO: 9348266 - DNA, 22 bp, Homo sapiens
ggctctggaaagtgtccttgat

SEQ ID NO: 9348267 - DNA, 22 bp, Homo sapiens
ggctctggaaagtgtccttgat

SEQ ID NO: 9348268 - DNA, 20 bp, Homo sapiens
ggctctggaatctggtgggc

SEQ ID NO: 9348269 - DNA, 20 bp, Homo sapiens
ggctctggaatctggtgggc

SEQ ID NO: 9348270 - DNA, 20 bp, Homo sapiens
ggctctggaatctggtgggc

SEQ ID NO: 9348271 - DNA, 20 bp, Homo sapiens
ggctctggaatctggtgggc

SEQ ID NO: 9348272 - DNA, 20 bp, Homo sapiens
ggctctggaatctggtgggc

SEQ ID NO: 9348273 - DNA, 20 bp, Homo sapiens
ggctctgcttgtgagcagcc

SEQ ID NO: 9348274 - DNA, 22 bp, Homo sapiens
ggctctggaaagtgtccttgat

SEQ ID NO: 9348275 - DNA, 20 bp, Homo sapiens
ggctctgcttgtgagcagcc

SEQ ID NO: 9348276 - DNA, 22 bp, Homo sapiens
ggctctggaaagtgtccttgat

SEQ ID NO: 9348277 - DNA, 22 bp, Homo sapiens
cacttgcctacccttagaacgt

SEQ ID NO: 9348278 - DNA, 22 bp, Homo sapiens
cacttggaggaaggcctattca

SEQ ID NO: 9348279 - DNA, 22 bp, Homo sapiens
cacttgatatcttatatttaat

SEQ ID NO: 9348280 - DNA, 22 bp, Homo sapiens
cactttaactcacatttcagct

SEQ ID NO: 9348281 - DNA, 22 bp, Homo sapiens
cactttaactcacatttcagct

SEQ ID NO: 9348282 - DNA, 17 bp, Homo sapiens
ggctgctgtgctggtgc

SEQ ID NO: 9348283 - DNA, 17 bp, Homo sapiens
ggctgctgtgctggtgc

SEQ ID NO: 9348284 - DNA, 17 bp, Homo sapiens
ggctgctgtgctggtgc

SEQ ID NO: 9348285 - DNA, 22 bp, Homo sapiens
ggctggcaagtcagtgctgatg

SEQ ID NO: 9348286 - DNA, 22 bp, Homo sapiens
ggctggcaagtcagtgctgatg

SEQ ID NO: 9348287 - DNA, 22 bp, Homo sapiens
ggctggatttttggaaggagag

SEQ ID NO: 9348288 - DNA, 22 bp, Homo sapiens
ggctggcaaaaaccttctctga

SEQ ID NO: 9348289 - DNA, 22 bp, Homo sapiens
ggctggcaaaaaccttctctga

SEQ ID NO: 9348290 - DNA, 22 bp, Homo sapiens
cacttgttggtggtgaaatcac

SEQ ID NO: 9348291 - DNA, 22 bp, Homo sapiens
cacttgggattaggggctaggt

SEQ ID NO: 9348292 - DNA, 22 bp, Homo sapiens
cacttgttggtggtgaaatcac

SEQ ID NO: 9348293 - DNA, 22 bp, Homo sapiens
cacttgttggtggtgaaatcac

SEQ ID NO: 9348294 - DNA, 21 bp, Homo sapiens
cactttaaaaatatctttata

SEQ ID NO: 9348295 - DNA, 22 bp, Homo sapiens
ggcaaggggtcaggctgagaca

SEQ ID NO: 9348296 - DNA, 22 bp, Homo sapiens
ggcaagggacggccgtgagaca

SEQ ID NO: 9348297 - DNA, 17 bp, Homo sapiens
ggcaaggttccttttca

SEQ ID NO: 9348298 - DNA, 22 bp, Homo sapiens
ggcaaggtgctacagacagtga

SEQ ID NO: 9348299 - DNA, 22 bp, Homo sapiens
ggcaaggtgatgaatgtctaca

SEQ ID NO: 9348300 - DNA, 22 bp, Homo sapiens
ggcaaggtactctagagcacat

SEQ ID NO: 9348301 - DNA, 22 bp, Homo sapiens
ggcaagtggaggtgttcatcag

SEQ ID NO: 9348302 - DNA, 22 bp, Homo sapiens
cacagtgactggcacatagtaa

SEQ ID NO: 9348303 - DNA, 22 bp, Homo sapiens
cacagtgacctctttaaaaggg

SEQ ID NO: 9348304 - DNA, 22 bp, Homo sapiens
cacagtgactggcacatagtaa

SEQ ID NO: 9348305 - DNA, 22 bp, Homo sapiens
cacagtgacagctatacagaga

SEQ ID NO: 9348306 - DNA, 22 bp, Homo sapiens
cacagtgaatttcaagtgttgt

SEQ ID NO: 9348307 - DNA, 22 bp, Homo sapiens
cacagtgacagctatacagaga

SEQ ID NO: 9348308 - DNA, 22 bp, Homo sapiens
cacagtgacattagtgagaaaa

SEQ ID NO: 9348309 - DNA, 22 bp, Homo sapiens
cacagtgacattagtgagaaaa

SEQ ID NO: 9348310 - DNA, 22 bp, Homo sapiens
cacagtgattgatttttacttt

SEQ ID NO: 9348311 - DNA, 22 bp, Homo sapiens
cacagtgactggcacctagtat

SEQ ID NO: 9348312 - DNA, 22 bp, Homo sapiens
cacaggtgtatgaatatgtcca

SEQ ID NO: 9348313 - DNA, 21 bp, Homo sapiens
cacaggtgggtcagtgaggcc

SEQ ID NO: 9348314 - DNA, 22 bp, Homo sapiens
cacaggtggcttctttcatctt

SEQ ID NO: 9348315 - DNA, 17 bp, Homo sapiens
cacaggtgtggtttgag

SEQ ID NO: 9348316 - DNA, 22 bp, Homo sapiens
cacaggtgtctctagtagcgtt

SEQ ID NO: 9348317 - DNA, 22 bp, Homo sapiens
cacaggtgtccaatacctgctt

SEQ ID NO: 9348318 - DNA, 23 bp, Homo sapiens
cacaggtgtttcatcttctcagt

SEQ ID NO: 9348319 - DNA, 22 bp, Homo sapiens
cacaggtgttcttgcagtgaaa

SEQ ID NO: 9348320 - DNA, 22 bp, Homo sapiens
cacaggtgtttgttatactcag

SEQ ID NO: 9348321 - DNA, 22 bp, Homo sapiens
cacaggtgttcttgcagtgaaa

SEQ ID NO: 9348322 - DNA, 22 bp, Homo sapiens
cacaggtgtgtcctggtcttgt

SEQ ID NO: 9348323 - DNA, 22 bp, Homo sapiens
cacaggtgtgtgccttatcaaa

SEQ ID NO: 9348324 - DNA, 22 bp, Homo sapiens
cacagtcctgccagagggcctt

SEQ ID NO: 9348325 - DNA, 22 bp, Homo sapiens
cacagtcctgccagagggcctt

SEQ ID NO: 9348326 - DNA, 22 bp, Homo sapiens
cacagtgaacattctgtcaggg

SEQ ID NO: 9348327 - DNA, 22 bp, Homo sapiens
cacaggttcacctcaggtaggt

SEQ ID NO: 9348328 - DNA, 22 bp, Homo sapiens
cacaggttcaaattcaggtcgc

SEQ ID NO: 9348329 - DNA, 22 bp, Homo sapiens
cacaggttaggtattatactat

SEQ ID NO: 9348330 - DNA, 22 bp, Homo sapiens
cacaggttcaaattcaggtcgc

SEQ ID NO: 9348331 - DNA, 22 bp, Homo sapiens
cacaggcagccttgtagaagaa

SEQ ID NO: 9348332 - DNA, 22 bp, Homo sapiens
cacaggcagccttgtagaagaa

SEQ ID NO: 9348333 - DNA, 22 bp, Homo sapiens
cacaggcagccttgtagaagaa

SEQ ID NO: 9348334 - DNA, 22 bp, Homo sapiens
cacaggcaggaggttctccagt

SEQ ID NO: 9348335 - DNA, 18 bp, Homo sapiens
cacaggcaggtgataggt

SEQ ID NO: 9348336 - DNA, 18 bp, Homo sapiens
cacaggcaggtgataggt

SEQ ID NO: 9348337 - DNA, 18 bp, Homo sapiens
cacaggcaggtgataggt

SEQ ID NO: 9348338 - DNA, 18 bp, Homo sapiens
cacaggcaggtgataggt

SEQ ID NO: 9348339 - DNA, 23 bp, Homo sapiens
cacaggcagaaatcaagacggta

SEQ ID NO: 9348340 - DNA, 23 bp, Homo sapiens
cacaggcagaaatcaagacggta

SEQ ID NO: 9348341 - DNA, 22 bp, Homo sapiens
cacaggcacccctgactgctca

SEQ ID NO: 9348342 - DNA, 22 bp, Homo sapiens
cacaggcacccctgactgctca

SEQ ID NO: 9348343 - DNA, 22 bp, Homo sapiens
cacaggcacccctgactgctca

SEQ ID NO: 9348344 - DNA, 22 bp, Homo sapiens
cacaggcacgcctctggccagg

SEQ ID NO: 9348345 - DNA, 22 bp, Homo sapiens
ggagagctagtgcctgccagta

SEQ ID NO: 9348346 - DNA, 22 bp, Homo sapiens
cacaggagattgatctattggt

SEQ ID NO: 9348347 - DNA, 18 bp, Homo sapiens
cacaggagccacactcac

SEQ ID NO: 9348348 - DNA, 22 bp, Homo sapiens
cacaggaggttaggaagtggtc

SEQ ID NO: 9348349 - DNA, 22 bp, Homo sapiens
cacaggaggttaggaagtggtc

SEQ ID NO: 9348350 - DNA, 22 bp, Homo sapiens
cacaggaggttaggaagtggtc

SEQ ID NO: 9348351 - DNA, 22 bp, Homo sapiens
cacaggagtgctgctattgttg

SEQ ID NO: 9348352 - DNA, 22 bp, Homo sapiens
cacaggagtgctgctattgttg

SEQ ID NO: 9348353 - DNA, 22 bp, Homo sapiens
cacaggagtgctgctattgttg

SEQ ID NO: 9348354 - DNA, 22 bp, Homo sapiens
cacaggagttaacataattaag

SEQ ID NO: 9348355 - DNA, 20 bp, Homo sapiens
cacaggccttgtgagcagac

SEQ ID NO: 9348356 - DNA, 22 bp, Homo sapiens
cacaggcctggggttgagcggg

SEQ ID NO: 9348357 - DNA, 22 bp, Homo sapiens
cacaggcctgtctctttctaac

SEQ ID NO: 9348358 - DNA, 22 bp, Homo sapiens
cacaggcctgtctctttctaac

SEQ ID NO: 9348359 - DNA, 22 bp, Homo sapiens
cacaggcctggggttgagcggg

SEQ ID NO: 9348360 - DNA, 22 bp, Homo sapiens
cacagggcaggtactctcagag

SEQ ID NO: 9348361 - DNA, 22 bp, Homo sapiens
cacagggcaggccccaggcctc

SEQ ID NO: 9348362 - DNA, 20 bp, Homo sapiens
cacaggccttgtgagcagac

SEQ ID NO: 9348363 - DNA, 18 bp, Homo sapiens
cacaggcaggtgataggt

SEQ ID NO: 9348364 - DNA, 22 bp, Homo sapiens
cacaggccaataccctctctct

SEQ ID NO: 9348365 - DNA, 22 bp, Homo sapiens
cacaggccaataccctctctct

SEQ ID NO: 9348366 - DNA, 22 bp, Homo sapiens
cacaggccagtaagactgtgtt

SEQ ID NO: 9348367 - DNA, 20 bp, Homo sapiens
cacaggccccaagacctgta

SEQ ID NO: 9348368 - DNA, 22 bp, Homo sapiens
cacaggccagtaagactgtgtt

SEQ ID NO: 9348369 - DNA, 22 bp, Homo sapiens
cacagggctttgatggctgagt

SEQ ID NO: 9348370 - DNA, 22 bp, Homo sapiens
cacaggggcaaactgtagggga

SEQ ID NO: 9348371 - DNA, 22 bp, Homo sapiens
cacaggtggctccaagttagag

SEQ ID NO: 9348372 - DNA, 22 bp, Homo sapiens
cacaggtgctcctcggggagct

SEQ ID NO: 9348373 - DNA, 22 bp, Homo sapiens
cacaggtgcaagaagttgcagt

SEQ ID NO: 9348374 - DNA, 22 bp, Homo sapiens
cacaggtgccatctcttcatgg

SEQ ID NO: 9348375 - DNA, 22 bp, Homo sapiens
cacaggtccttcctgccctggg

SEQ ID NO: 9348376 - DNA, 22 bp, Homo sapiens
caccaggagccatcaggagtcc

SEQ ID NO: 9348377 - DNA, 22 bp, Homo sapiens
caccaggaagtggtggcctggg

SEQ ID NO: 9348378 - DNA, 22 bp, Homo sapiens
caccagctccaccagggcaggt

SEQ ID NO: 9348379 - DNA, 22 bp, Homo sapiens
cacattcaggtggcatgttaga

SEQ ID NO: 9348380 - DNA, 22 bp, Homo sapiens
cacattcctgagcttcgacctg

SEQ ID NO: 9348381 - DNA, 22 bp, Homo sapiens
cacatgtgtgctgaggactgtg

SEQ ID NO: 9348382 - DNA, 22 bp, Homo sapiens
cacatgtgtgctgaggactgtg

SEQ ID NO: 9348383 - DNA, 22 bp, Homo sapiens
cacatgtgtatatgtgaggggg

SEQ ID NO: 9348384 - DNA, 22 bp, Homo sapiens
cacatgtgggaaatggtgctta

SEQ ID NO: 9348385 - DNA, 22 bp, Homo sapiens
cacatgtgggaaatggtgctta

SEQ ID NO: 9348386 - DNA, 22 bp, Homo sapiens
cacatgtgcagttacatgaatt

SEQ ID NO: 9348387 - DNA, 22 bp, Homo sapiens
cacatgtgcaaatactgaggct

SEQ ID NO: 9348388 - DNA, 22 bp, Homo sapiens
cacatgtgcagttacatgaatt

SEQ ID NO: 9348389 - DNA, 21 bp, Homo sapiens
cacatgtgaattactgaactg

SEQ ID NO: 9348390 - DNA, 21 bp, Homo sapiens
cacatgtgaattactgaactg

SEQ ID NO: 9348391 - DNA, 20 bp, Homo sapiens
cacattaaggaaaacaactg

SEQ ID NO: 9348392 - DNA, 22 bp, Homo sapiens
cacattattctaaagaggtact

SEQ ID NO: 9348393 - DNA, 22 bp, Homo sapiens
cacattaaaatcctaacttcca

SEQ ID NO: 9348394 - DNA, 22 bp, Homo sapiens
cacattaaatagtagggatgct

SEQ ID NO: 9348395 - DNA, 22 bp, Homo sapiens
cacattaagaataatgagacta

SEQ ID NO: 9348396 - DNA, 18 bp, Homo sapiens
ggcagatgacaggagaga

SEQ ID NO: 9348397 - DNA, 22 bp, Homo sapiens
ggcagatggaagaggctgggtc

SEQ ID NO: 9348398 - DNA, 22 bp, Homo sapiens
ggcagatggaagaggctgggtc

SEQ ID NO: 9348399 - DNA, 22 bp, Homo sapiens
ggcagatggaagaggctgggtc

SEQ ID NO: 9348400 - DNA, 22 bp, Homo sapiens
ggcagagttggtggagtcagtt

SEQ ID NO: 9348401 - DNA, 22 bp, Homo sapiens
ggcagagtggagtgcggcctcc

SEQ ID NO: 9348402 - DNA, 22 bp, Homo sapiens
ggcagagttggtggagtcagtt

SEQ ID NO: 9348403 - DNA, 22 bp, Homo sapiens
ggcagagttggtggagtcagtt

SEQ ID NO: 9348404 - DNA, 22 bp, Homo sapiens
ggcagagtggagtgcggcctcc

SEQ ID NO: 9348405 - DNA, 22 bp, Homo sapiens
cacatgcaagtcctcagttcta

SEQ ID NO: 9348406 - DNA, 22 bp, Homo sapiens
cacatgcaccagaaatcaacat

SEQ ID NO: 9348407 - DNA, 22 bp, Homo sapiens
cacatgatggtggaagccatag

SEQ ID NO: 9348408 - DNA, 22 bp, Homo sapiens
ggcagaggtgacagtgtctttt

SEQ ID NO: 9348409 - DNA, 22 bp, Homo sapiens
ggcagaggtgacagtgtctttt

SEQ ID NO: 9348410 - DNA, 22 bp, Homo sapiens
cacatgcaggagccaatgtaca

SEQ ID NO: 9348411 - DNA, 22 bp, Homo sapiens
cacatgcaggagccaatgtaca

SEQ ID NO: 9348412 - DNA, 22 bp, Homo sapiens
ggcagagtcagaggtggttctg

SEQ ID NO: 9348413 - DNA, 22 bp, Homo sapiens
ggcagagtgctctgggcagggg

SEQ ID NO: 9348414 - DNA, 22 bp, Homo sapiens
ggcagagtgctctgggcagggg

SEQ ID NO: 9348415 - DNA, 22 bp, Homo sapiens
cacatgactctggctacccaga

SEQ ID NO: 9348416 - DNA, 22 bp, Homo sapiens
cacatgagagcccccaagagca

SEQ ID NO: 9348417 - DNA, 22 bp, Homo sapiens
cacatgagacaattaaagactt

SEQ ID NO: 9348418 - DNA, 22 bp, Homo sapiens
cacatgaataaggctttattgt

SEQ ID NO: 9348419 - DNA, 22 bp, Homo sapiens
cacatgaaggctggggtcgtga

SEQ ID NO: 9348420 - DNA, 22 bp, Homo sapiens
ggcaatatggtgaaaccccatc

SEQ ID NO: 9348421 - DNA, 22 bp, Homo sapiens
cacatatatgggcccctgaggg

SEQ ID NO: 9348422 - DNA, 16 bp, Homo sapiens
cacatatatttatatg

SEQ ID NO: 9348423 - DNA, 22 bp, Homo sapiens
cacatgaagattcaactggatg

SEQ ID NO: 9348424 - DNA, 22 bp, Homo sapiens
ggcaatttggtcatttgtattg

SEQ ID NO: 9348425 - DNA, 22 bp, Homo sapiens
atgtgctggctaactggatggg

SEQ ID NO: 9348426 - DNA, 22 bp, Homo sapiens
atgtgctaagcactacttgtca

SEQ ID NO: 9348427 - DNA, 22 bp, Homo sapiens
atgtgctttaggtttgtttaca

SEQ ID NO: 9348428 - DNA, 22 bp, Homo sapiens
atgtgctttctttgtttcataa

SEQ ID NO: 9348429 - DNA, 22 bp, Homo sapiens
atgtgctttgctggaaatgtca

SEQ ID NO: 9348430 - DNA, 22 bp, Homo sapiens
atgtggaatgaacaaaggaggc

SEQ ID NO: 9348431 - DNA, 22 bp, Homo sapiens
atgtggatgtttatatgaagaa

SEQ ID NO: 9348432 - DNA, 22 bp, Homo sapiens
atgtggatctgttattctagat

SEQ ID NO: 9348433 - DNA, 22 bp, Homo sapiens
atgtggatggaagtcagatagc

SEQ ID NO: 9348434 - DNA, 22 bp, Homo sapiens
atgtggatggaagtcagatagc

SEQ ID NO: 9348435 - DNA, 22 bp, Homo sapiens
atgtggatgtttatatgaagaa

SEQ ID NO: 9348436 - DNA, 22 bp, Homo sapiens
atgtggaatgaacaaaggaggc

SEQ ID NO: 9348437 - DNA, 20 bp, Homo sapiens
atgtggataagggcagaatc

SEQ ID NO: 9348438 - DNA, 22 bp, Homo sapiens
atgtggatagcacaggaatggt

SEQ ID NO: 9348439 - DNA, 22 bp, Homo sapiens
atgtggattgtaggaaactgat

SEQ ID NO: 9348440 - DNA, 22 bp, Homo sapiens
atgtggcctagtatagaaatga

SEQ ID NO: 9348441 - DNA, 22 bp, Homo sapiens
atgtgaggttaacctactgtta

SEQ ID NO: 9348442 - DNA, 22 bp, Homo sapiens
atgtgaggttaacctactgtta

SEQ ID NO: 9348443 - DNA, 22 bp, Homo sapiens
atgtcatattactaatgctggc

SEQ ID NO: 9348444 - DNA, 22 bp, Homo sapiens
atgtgaggtagataggatgcag

SEQ ID NO: 9348445 - DNA, 22 bp, Homo sapiens
atgtcaggaccctactgcattg

SEQ ID NO: 9348446 - DNA, 21 bp, Homo sapiens
atgtcaggcacttatgaggaa

SEQ ID NO: 9348447 - DNA, 20 bp, Homo sapiens
atgtcaggaagggagtcagg

SEQ ID NO: 9348448 - DNA, 22 bp, Homo sapiens
atgtcagtagtttctttgagtt

SEQ ID NO: 9348449 - DNA, 22 bp, Homo sapiens
atgtcagttataaaagacagat

SEQ ID NO: 9348450 - DNA, 22 bp, Homo sapiens
atgtcactgtgaggcagctgtc

SEQ ID NO: 9348451 - DNA, 22 bp, Homo sapiens
atgtcactgtgaggcagctgtc

SEQ ID NO: 9348452 - DNA, 22 bp, Homo sapiens
atgtcacttttgagactaggtt

SEQ ID NO: 9348453 - DNA, 22 bp, Homo sapiens
gaggctgaacaggttctcatga

SEQ ID NO: 9348454 - DNA, 22 bp, Homo sapiens
gaggctgaacaggttctcatga

SEQ ID NO: 9348455 - DNA, 22 bp, Homo sapiens
gaggctcttttctgctgtgtct

SEQ ID NO: 9348456 - DNA, 22 bp, Homo sapiens
atgttactgtgatcatgatact

SEQ ID NO: 9348457 - DNA, 22 bp, Homo sapiens
atgttacctctattagaatatt

SEQ ID NO: 9348458 - DNA, 22 bp, Homo sapiens
atgttacagagaaagtggaagc

SEQ ID NO: 9348459 - DNA, 22 bp, Homo sapiens
atgttacagggagagaaggcca

SEQ ID NO: 9348460 - DNA, 22 bp, Homo sapiens
atgttacagttgagtaaattaa

SEQ ID NO: 9348461 - DNA, 22 bp, Homo sapiens
atgttacatagtccttatttgt

SEQ ID NO: 9348462 - DNA, 22 bp, Homo sapiens
atgttacatagtccttatttgt

SEQ ID NO: 9348463 - DNA, 22 bp, Homo sapiens
atgttacattgagaggtggttg

SEQ ID NO: 9348464 - DNA, 22 bp, Homo sapiens
atgtggctagggaataaaatat

SEQ ID NO: 9348465 - DNA, 22 bp, Homo sapiens
atgtggctcacatagctggaaa

SEQ ID NO: 9348466 - DNA, 21 bp, Homo sapiens
atgtggctcccttcctcagga

SEQ ID NO: 9348467 - DNA, 22 bp, Homo sapiens
atgtggctcattgtttgcttac

SEQ ID NO: 9348468 - DNA, 22 bp, Homo sapiens
atgtggctagtggctatgatct

SEQ ID NO: 9348469 - DNA, 18 bp, Homo sapiens
atgtggctagtgctactg

SEQ ID NO: 9348470 - DNA, 23 bp, Homo sapiens
atgttaaacataactgaagagcc

SEQ ID NO: 9348471 - DNA, 22 bp, Homo sapiens
atgtggctgccacctgcctgaa

SEQ ID NO: 9348472 - DNA, 22 bp, Homo sapiens
atgtggctgatcgcagagctct

SEQ ID NO: 9348473 - DNA, 22 bp, Homo sapiens
gaggtgtgctgcggcccggtgc

SEQ ID NO: 9348474 - DNA, 22 bp, Homo sapiens
gaggtgtggtcctcagccccca

SEQ ID NO: 9348475 - DNA, 22 bp, Homo sapiens
gaggtgtgcacagcgtgctgac

SEQ ID NO: 9348476 - DNA, 22 bp, Homo sapiens
gaggtgtgcacagcgtgctgac

SEQ ID NO: 9348477 - DNA, 22 bp, Homo sapiens
gaggtgtgttacagattgtcat

SEQ ID NO: 9348478 - DNA, 22 bp, Homo sapiens
gaggtgtgttacagattgtcat

SEQ ID NO: 9348479 - DNA, 22 bp, Homo sapiens
gaggtgtgttacagattgtcat

SEQ ID NO: 9348480 - DNA, 22 bp, Homo sapiens
atgttagtgtcactttgtacaa

SEQ ID NO: 9348481 - DNA, 22 bp, Homo sapiens
atgttataaatagagacactgg

SEQ ID NO: 9348482 - DNA, 22 bp, Homo sapiens
atgttataaatagagacactgg

SEQ ID NO: 9348483 - DNA, 22 bp, Homo sapiens
atgttataaatagagacactgg

SEQ ID NO: 9348484 - DNA, 22 bp, Homo sapiens
atgttatgacaagcatgacaga

SEQ ID NO: 9348485 - DNA, 22 bp, Homo sapiens
atgttatgacaagcatgacaga

SEQ ID NO: 9348486 - DNA, 22 bp, Homo sapiens
atgttatgtccctcttactcag

SEQ ID NO: 9348487 - DNA, 22 bp, Homo sapiens
atgttatgtaacacttgtttct

SEQ ID NO: 9348488 - DNA, 22 bp, Homo sapiens
gaggtgtgaggaatgaatgggg

SEQ ID NO: 9348489 - DNA, 21 bp, Homo sapiens
gagtgcaggtctgatgccatc

SEQ ID NO: 9348490 - DNA, 22 bp, Homo sapiens
gagtgcagtatcttctgtgtcc

SEQ ID NO: 9348491 - DNA, 22 bp, Homo sapiens
gaggttggcgccctgcctggcc

SEQ ID NO: 9348492 - DNA, 22 bp, Homo sapiens
gaggttggagggctggcctgca

SEQ ID NO: 9348493 - DNA, 22 bp, Homo sapiens
gaggttgccatgcatcctggtt

SEQ ID NO: 9348494 - DNA, 22 bp, Homo sapiens
gaggttccccattgtactggct

SEQ ID NO: 9348495 - DNA, 22 bp, Homo sapiens
gaggagggcagttcctctttta

SEQ ID NO: 9348496 - DNA, 22 bp, Homo sapiens
gaggaggggacagtacttgtgc

SEQ ID NO: 9348497 - DNA, 22 bp, Homo sapiens
gaggagggctttgttgatgtta

SEQ ID NO: 9348498 - DNA, 22 bp, Homo sapiens
gaggagggctttgttgatgtta

SEQ ID NO: 9348499 - DNA, 22 bp, Homo sapiens
gaggagggcctggtgtcccttc

SEQ ID NO: 9348500 - DNA, 22 bp, Homo sapiens
atgggcagctgcagcagtggtg

SEQ ID NO: 9348501 - DNA, 22 bp, Homo sapiens
atgggcagcagctgtcattttc

SEQ ID NO: 9348502 - DNA, 22 bp, Homo sapiens
atgggcagcagctgtcattttc

SEQ ID NO: 9348503 - DNA, 22 bp, Homo sapiens
atgggcagctgcagcagtggtg

SEQ ID NO: 9348504 - DNA, 22 bp, Homo sapiens
atgggcagcagctgccattcat

SEQ ID NO: 9348505 - DNA, 22 bp, Homo sapiens
gaggagctgggtcagggagaca

SEQ ID NO: 9348506 - DNA, 22 bp, Homo sapiens
gaggaggggcacttgtctccta

SEQ ID NO: 9348507 - DNA, 22 bp, Homo sapiens
gaggcacaatacatgtctcaag

SEQ ID NO: 9348508 - DNA, 22 bp, Homo sapiens
gaggaggggcacttgtctccta

SEQ ID NO: 9348509 - DNA, 22 bp, Homo sapiens
gaggcacaccagggagtcttgt

SEQ ID NO: 9348510 - DNA, 22 bp, Homo sapiens
gaggcacagagccctaggagct

SEQ ID NO: 9348511 - DNA, 22 bp, Homo sapiens
gaggcacagagccctaggagct

SEQ ID NO: 9348512 - DNA, 22 bp, Homo sapiens
gaggcacagagtaggtgcacac

SEQ ID NO: 9348513 - DNA, 22 bp, Homo sapiens
atgtagctggggaggttgagtc

SEQ ID NO: 9348514 - DNA, 22 bp, Homo sapiens
atgtagctgcagatgataatgc

SEQ ID NO: 9348515 - DNA, 22 bp, Homo sapiens
gaggcacatatatacagagccc

SEQ ID NO: 9348516 - DNA, 22 bp, Homo sapiens
atgtagcttcctaggagtgatt

SEQ ID NO: 9348517 - DNA, 22 bp, Homo sapiens
atgtaggattgagtgatagagg

SEQ ID NO: 9348518 - DNA, 22 bp, Homo sapiens
atgtatcaacaaattgtacagt

SEQ ID NO: 9348519 - DNA, 22 bp, Homo sapiens
gaggcacagtcccgaggcaagg

SEQ ID NO: 9348520 - DNA, 22 bp, Homo sapiens
gaggcacagtgtttggtcagtg

SEQ ID NO: 9348521 - DNA, 22 bp, Homo sapiens
atgtatcagataaagcatgtgg

SEQ ID NO: 9348522 - DNA, 22 bp, Homo sapiens
atgtatcacagcaatgtagtca

SEQ ID NO: 9348523 - DNA, 22 bp, Homo sapiens
atgtatcagaaatagcattggc

SEQ ID NO: 9348524 - DNA, 18 bp, Homo sapiens
atgtatgtacatatttat

SEQ ID NO: 9348525 - DNA, 18 bp, Homo sapiens
atgtatgtacatatttat

SEQ ID NO: 9348526 - DNA, 22 bp, Homo sapiens
atgtatgtaggatgggccagtg

SEQ ID NO: 9348527 - DNA, 22 bp, Homo sapiens
atgtatgtaaatttcagtcctt

SEQ ID NO: 9348528 - DNA, 22 bp, Homo sapiens
atgtatgcatagtgagtaaatg

SEQ ID NO: 9348529 - DNA, 22 bp, Homo sapiens
atgtatgtataacacccagcta

SEQ ID NO: 9348530 - DNA, 22 bp, Homo sapiens
atgtatgtataacacccagcta

SEQ ID NO: 9348531 - DNA, 22 bp, Homo sapiens
atgtatgtatacaccccacata

SEQ ID NO: 9348532 - DNA, 22 bp, Homo sapiens
atgtatgtagtgtacatataca

SEQ ID NO: 9348533 - DNA, 22 bp, Homo sapiens
atgtatgtagtgtacatataca

SEQ ID NO: 9348534 - DNA, 22 bp, Homo sapiens
atgtatgtctaaaacggggagg

SEQ ID NO: 9348535 - DNA, 22 bp, Homo sapiens
atgtatgtatgtacttttgtat

SEQ ID NO: 9348536 - DNA, 22 bp, Homo sapiens
atgtatgtatgtacttttgtat

SEQ ID NO: 9348537 - DNA, 22 bp, Homo sapiens
atgtatgtatgctgtgcttgca

SEQ ID NO: 9348538 - DNA, 22 bp, Homo sapiens
atgtatgtatgctgtgcttgca

SEQ ID NO: 9348539 - DNA, 22 bp, Homo sapiens
atgtatgtatgctgtgcttgca

SEQ ID NO: 9348540 - DNA, 22 bp, Homo sapiens
atgtatgtttttgcagatacat

SEQ ID NO: 9348541 - DNA, 22 bp, Homo sapiens
atgtatgttttcagttgtatta

SEQ ID NO: 9348542 - DNA, 22 bp, Homo sapiens
atgtatgttttcagttgtatta

SEQ ID NO: 9348543 - DNA, 23 bp, Homo sapiens
atgtatgtttctgcatcttcaac

SEQ ID NO: 9348544 - DNA, 22 bp, Homo sapiens
atgtatgtttctatatatgaca

SEQ ID NO: 9348545 - DNA, 22 bp, Homo sapiens
atgtatgtttctatatatgaca

SEQ ID NO: 9348546 - DNA, 22 bp, Homo sapiens
atgtatgtttcatatcttcatt

SEQ ID NO: 9348547 - DNA, 22 bp, Homo sapiens
atgtatgttcaagcaatgatta

SEQ ID NO: 9348548 - DNA, 22 bp, Homo sapiens
atgtatgttcaagcaatgatta

SEQ ID NO: 9348549 - DNA, 22 bp, Homo sapiens
atgtatgttcaagcaatgatta

SEQ ID NO: 9348550 - DNA, 22 bp, Homo sapiens
atgtatgtctgcatacacatac

SEQ ID NO: 9348551 - DNA, 22 bp, Homo sapiens
atgtatgtgagctttgagatca

SEQ ID NO: 9348552 - DNA, 22 bp, Homo sapiens
atgtatgtctgatgcacatgca

SEQ ID NO: 9348553 - DNA, 22 bp, Homo sapiens
atgtatgtctgatgcacatgca

SEQ ID NO: 9348554 - DNA, 22 bp, Homo sapiens
atgtatgtctgatgcacatgca

SEQ ID NO: 9348555 - DNA, 22 bp, Homo sapiens
atgtatgtctgcatacacatac

SEQ ID NO: 9348556 - DNA, 22 bp, Homo sapiens
atgtatgttagtgtattatcta

SEQ ID NO: 9348557 - DNA, 22 bp, Homo sapiens
atgtatgttagtgtattatcta

SEQ ID NO: 9348558 - DNA, 22 bp, Homo sapiens
atgtatgttagtgtattatcta

SEQ ID NO: 9348559 - DNA, 22 bp, Homo sapiens
atgtatgtgttgcaattatgtt

SEQ ID NO: 9348560 - DNA, 22 bp, Homo sapiens
atgtatgtgcacgcatgtacat

SEQ ID NO: 9348561 - DNA, 22 bp, Homo sapiens
atgtatgtgcacgcatgtacat

SEQ ID NO: 9348562 - DNA, 22 bp, Homo sapiens
atgtatgttagacaagcctaca

SEQ ID NO: 9348563 - DNA, 22 bp, Homo sapiens
atgtatgttagacaagcctaca

SEQ ID NO: 9348564 - DNA, 22 bp, Homo sapiens
atgtatgttagacaagcctaca

SEQ ID NO: 9348565 - DNA, 22 bp, Homo sapiens
gaggctccatggaggagtatgg

SEQ ID NO: 9348566 - DNA, 22 bp, Homo sapiens
gaggctccagcgacacctaggc

SEQ ID NO: 9348567 - DNA, 22 bp, Homo sapiens
atgtatttctatgtagtgaaga

SEQ ID NO: 9348568 - DNA, 22 bp, Homo sapiens
atgtatttctatgtagtgaaga

SEQ ID NO: 9348569 - DNA, 22 bp, Homo sapiens
gaggcctgggttacctactcgt

SEQ ID NO: 9348570 - DNA, 22 bp, Homo sapiens
gaggcctgggttggaggtgcat

SEQ ID NO: 9348571 - DNA, 22 bp, Homo sapiens
atgtatttctatgtagtgaaga

SEQ ID NO: 9348572 - DNA, 22 bp, Homo sapiens
atgtatttactgagaaggaaac

SEQ ID NO: 9348573 - DNA, 23 bp, Homo sapiens
atgtatttaaatttcagtgatga

SEQ ID NO: 9348574 - DNA, 22 bp, Homo sapiens
atgtatttactgagaaggaaac

SEQ ID NO: 9348575 - DNA, 22 bp, Homo sapiens
atgtattgaccatactactaaa

SEQ ID NO: 9348576 - DNA, 23 bp, Homo sapiens
atgtatttaaatttcagtgatga

SEQ ID NO: 9348577 - DNA, 22 bp, Homo sapiens
gaggctccctcaactctgggtg

SEQ ID NO: 9348578 - DNA, 22 bp, Homo sapiens
gaggctccccatgaggccccag

SEQ ID NO: 9348579 - DNA, 22 bp, Homo sapiens
gaggctccctcaactctgggtg

SEQ ID NO: 9348580 - DNA, 22 bp, Homo sapiens
gaggctcccaaggggctaggcc

SEQ ID NO: 9348581 - DNA, 22 bp, Homo sapiens
gaggctccggtagtagccttga

SEQ ID NO: 9348582 - DNA, 22 bp, Homo sapiens
gaggctccctttaggtccagat

SEQ ID NO: 9348583 - DNA, 22 bp, Homo sapiens
gaggctccgtgctgctgccctg

SEQ ID NO: 9348584 - DNA, 20 bp, Homo sapiens
gaggctctgggcatggcgcc

SEQ ID NO: 9348585 - DNA, 22 bp, Homo sapiens
gaggctctggagtaggtacaca

SEQ ID NO: 9348586 - DNA, 22 bp, Homo sapiens
gaggctcctccttacatttacc

SEQ ID NO: 9348587 - DNA, 22 bp, Homo sapiens
gaggctccttgaaagggggact

SEQ ID NO: 9348588 - DNA, 22 bp, Homo sapiens
gaggctcctcattcagtatgct

SEQ ID NO: 9348589 - DNA, 22 bp, Homo sapiens
gaggctctgtgatgtgccaggc

SEQ ID NO: 9348590 - DNA, 20 bp, Homo sapiens
gaggctctgggcatggcgcc

SEQ ID NO: 9348591 - DNA, 22 bp, Homo sapiens
gaggctcttcaataggtcaatg

SEQ ID NO: 9348592 - DNA, 22 bp, Homo sapiens
gaggctcttcaataggtcaatg

SEQ ID NO: 9348593 - DNA, 22 bp, Homo sapiens
gagaagtcatttgaccacctag

SEQ ID NO: 9348594 - DNA, 22 bp, Homo sapiens
gagaaggggtgatgtgggtaat

SEQ ID NO: 9348595 - DNA, 22 bp, Homo sapiens
gagaaggtggacctgaaggagc

SEQ ID NO: 9348596 - DNA, 22 bp, Homo sapiens
gagaataaatctaaagtttctt

SEQ ID NO: 9348597 - DNA, 22 bp, Homo sapiens
gagaagtttggagtgaaggttt

SEQ ID NO: 9348598 - DNA, 22 bp, Homo sapiens
gagaagtttggagtgaaggttt

SEQ ID NO: 9348599 - DNA, 22 bp, Homo sapiens
gagaagttgtaggagaattttg

SEQ ID NO: 9348600 - DNA, 22 bp, Homo sapiens
gagaagttgtgtggatttaaag

SEQ ID NO: 9348601 - DNA, 22 bp, Homo sapiens
gagaagttgtaggagaattttg

SEQ ID NO: 9348602 - DNA, 22 bp, Homo sapiens
atgctgtgttttaaatggaaat

SEQ ID NO: 9348603 - DNA, 22 bp, Homo sapiens
atgctgtgtttgagaacctagg

SEQ ID NO: 9348604 - DNA, 22 bp, Homo sapiens
atgctgtgtggtcaagttaatt

SEQ ID NO: 9348605 - DNA, 22 bp, Homo sapiens
atgctgtgtcctagtgaaagaa

SEQ ID NO: 9348606 - DNA, 22 bp, Homo sapiens
atgctgtgtggccacctccatg

SEQ ID NO: 9348607 - DNA, 22 bp, Homo sapiens
atgctgtgtctagcaggaacac

SEQ ID NO: 9348608 - DNA, 22 bp, Homo sapiens
atgctggcagccgagtgctcca

SEQ ID NO: 9348609 - DNA, 22 bp, Homo sapiens
atgctggcagccgagtgctcca

SEQ ID NO: 9348610 - DNA, 22 bp, Homo sapiens
atgctgggaaactgaaaggaat

SEQ ID NO: 9348611 - DNA, 22 bp, Homo sapiens
atgctggcagccgagtgctcca

SEQ ID NO: 9348612 - DNA, 22 bp, Homo sapiens
atgctgggaagacaaggtggag

SEQ ID NO: 9348613 - DNA, 22 bp, Homo sapiens
atgctgggaagacaaggtggag

SEQ ID NO: 9348614 - DNA, 22 bp, Homo sapiens
atgctgggaagtcctaaccaca

SEQ ID NO: 9348615 - DNA, 22 bp, Homo sapiens
atgctggggcctcagaccagaa

SEQ ID NO: 9348616 - DNA, 22 bp, Homo sapiens
atgctggtttcatgataacata

SEQ ID NO: 9348617 - DNA, 22 bp, Homo sapiens
atgctggtctcattgggttagg

SEQ ID NO: 9348618 - DNA, 22 bp, Homo sapiens
atgctggtgctagaaactggaa

SEQ ID NO: 9348619 - DNA, 22 bp, Homo sapiens
atgctggtggttgatggcagga

SEQ ID NO: 9348620 - DNA, 22 bp, Homo sapiens
atgctgtgagtgtgccgcagag

SEQ ID NO: 9348621 - DNA, 22 bp, Homo sapiens
atgctgtgattgtagaaatatt

SEQ ID NO: 9348622 - DNA, 22 bp, Homo sapiens
atgctgtgaaaaagaaggctga

SEQ ID NO: 9348623 - DNA, 22 bp, Homo sapiens
atgctgtgcctggaaagcggct

SEQ ID NO: 9348624 - DNA, 22 bp, Homo sapiens
atgctgtgccttctctgtgcca

SEQ ID NO: 9348625 - DNA, 22 bp, Homo sapiens
atgctgtgctggctaaccatgg

SEQ ID NO: 9348626 - DNA, 22 bp, Homo sapiens
atgctgtggaagttcctgaagc

SEQ ID NO: 9348627 - DNA, 22 bp, Homo sapiens
atgctgtggccagagttcaact

SEQ ID NO: 9348628 - DNA, 22 bp, Homo sapiens
atgctgtggatgccttgcccca

SEQ ID NO: 9348629 - DNA, 22 bp, Homo sapiens
atgctgtggggagtgagggtag

SEQ ID NO: 9348630 - DNA, 22 bp, Homo sapiens
atgctgtggggagtgagggtag

SEQ ID NO: 9348631 - DNA, 22 bp, Homo sapiens
atgctgtgtcaggaatttgata

SEQ ID NO: 9348632 - DNA, 22 bp, Homo sapiens
atgctgtgtcaccttaggattt

SEQ ID NO: 9348633 - DNA, 22 bp, Homo sapiens
atgctgtgtattttactctttc

SEQ ID NO: 9348634 - DNA, 22 bp, Homo sapiens
atgctgtggtagacagcattcc

SEQ ID NO: 9348635 - DNA, 22 bp, Homo sapiens
atggatgtgaagagggagaagc

SEQ ID NO: 9348636 - DNA, 22 bp, Homo sapiens
atggattggatttttatggacc

SEQ ID NO: 9348637 - DNA, 21 bp, Homo sapiens
atggatttaaacaggccacaa

SEQ ID NO: 9348638 - DNA, 22 bp, Homo sapiens
atggatttggatgagattactt

SEQ ID NO: 9348639 - DNA, 22 bp, Homo sapiens
atggatttgcttatacacatgt

SEQ ID NO: 9348640 - DNA, 20 bp, Homo sapiens
atggatgaccttggccaggg

SEQ ID NO: 9348641 - DNA, 22 bp, Homo sapiens
atggatcttccctcatttctga

SEQ ID NO: 9348642 - DNA, 22 bp, Homo sapiens
atggcaagcaagctgaagagat

SEQ ID NO: 9348643 - DNA, 22 bp, Homo sapiens
atggcagaatatctgcatcgca

SEQ ID NO: 9348644 - DNA, 22 bp, Homo sapiens
atggcagacctgggctggagaa

SEQ ID NO: 9348645 - DNA, 22 bp, Homo sapiens
atggcagacctcctggccacaa

SEQ ID NO: 9348646 - DNA, 22 bp, Homo sapiens
atggcagacctcctggccacaa

SEQ ID NO: 9348647 - DNA, 22 bp, Homo sapiens
atggcactaagagggagctgga

SEQ ID NO: 9348648 - DNA, 22 bp, Homo sapiens
atggcaccaaatatgtctcatt

SEQ ID NO: 9348649 - DNA, 22 bp, Homo sapiens
atggcaccttccccagagctca

SEQ ID NO: 9348650 - DNA, 22 bp, Homo sapiens
atggcagaaagaatagaggcta

SEQ ID NO: 9348651 - DNA, 22 bp, Homo sapiens
atggcactgacctcccttgtaa

SEQ ID NO: 9348652 - DNA, 22 bp, Homo sapiens
atggcagaaaggcatgtgggcc

SEQ ID NO: 9348653 - DNA, 22 bp, Homo sapiens
atggcagaaaggcatgtgggcc

SEQ ID NO: 9348654 - DNA, 22 bp, Homo sapiens
gagacaggatttaaccaaagct

SEQ ID NO: 9348655 - DNA, 22 bp, Homo sapiens
gagaatatcttggcagtctctg

SEQ ID NO: 9348656 - DNA, 22 bp, Homo sapiens
gagaatatattgaagtagttcc

SEQ ID NO: 9348657 - DNA, 21 bp, Homo sapiens
gagaatagaggggaagctgaa

SEQ ID NO: 9348658 - DNA, 21 bp, Homo sapiens
gagaatcaggaaggattgatg

SEQ ID NO: 9348659 - DNA, 22 bp, Homo sapiens
gagaatattagagttagtttat

SEQ ID NO: 9348660 - DNA, 22 bp, Homo sapiens
gagacaggccaggtggtactta

SEQ ID NO: 9348661 - DNA, 22 bp, Homo sapiens
gagacaggccaggtggtactta

SEQ ID NO: 9348662 - DNA, 22 bp, Homo sapiens
gagacaggcagctagtgggtca

SEQ ID NO: 9348663 - DNA, 22 bp, Homo sapiens
gagacaggcagctagtgggtca

SEQ ID NO: 9348664 - DNA, 22 bp, Homo sapiens
gagacaggcagctagtgggtca

SEQ ID NO: 9348665 - DNA, 22 bp, Homo sapiens
atggagggtgtcagagagcgaa

SEQ ID NO: 9348666 - DNA, 22 bp, Homo sapiens
atggagggtgtcagagagcgaa

SEQ ID NO: 9348667 - DNA, 22 bp, Homo sapiens
atggagggtgtcagagagcgaa

SEQ ID NO: 9348668 - DNA, 22 bp, Homo sapiens
gagacagtgaggaaggctaggt

SEQ ID NO: 9348669 - DNA, 22 bp, Homo sapiens
atggatattggccaaactcatt

SEQ ID NO: 9348670 - DNA, 22 bp, Homo sapiens
atggatctcagccaaccagtgt

SEQ ID NO: 9348671 - DNA, 22 bp, Homo sapiens
atgggcagagtggggacaggaa

SEQ ID NO: 9348672 - DNA, 22 bp, Homo sapiens
gagctgcagcggctgacgcaac

SEQ ID NO: 9348673 - DNA, 22 bp, Homo sapiens
gagctgagtgtcctaggcatgg

SEQ ID NO: 9348674 - DNA, 20 bp, Homo sapiens
gagctgagtgtggtcatggg

SEQ ID NO: 9348675 - DNA, 20 bp, Homo sapiens
gagccctctgcactagcgcc

SEQ ID NO: 9348676 - DNA, 19 bp, Homo sapiens
gagccctctccatggccac

SEQ ID NO: 9348677 - DNA, 22 bp, Homo sapiens
gagctctgtgaatgtggggagg

SEQ ID NO: 9348678 - DNA, 22 bp, Homo sapiens
gagctctgtgaatgtggggagg

SEQ ID NO: 9348679 - DNA, 17 bp, Homo sapiens
gagctctgtggcacaag

SEQ ID NO: 9348680 - DNA, 17 bp, Homo sapiens
gagctctgtggcacaag

SEQ ID NO: 9348681 - DNA, 22 bp, Homo sapiens
gagccctccatggagccaggca

SEQ ID NO: 9348682 - DNA, 22 bp, Homo sapiens
gagccctcaccgcctgaccagg

SEQ ID NO: 9348683 - DNA, 22 bp, Homo sapiens
atgggcaaggggtaaggacact

SEQ ID NO: 9348684 - DNA, 22 bp, Homo sapiens
atgggatgcatggctgtggcca

SEQ ID NO: 9348685 - DNA, 22 bp, Homo sapiens
atgggatgaacttgatctgctt

SEQ ID NO: 9348686 - DNA, 22 bp, Homo sapiens
atgggatgcatggctgtggcca

SEQ ID NO: 9348687 - DNA, 22 bp, Homo sapiens
atgggatgcatggctgtggcca

SEQ ID NO: 9348688 - DNA, 22 bp, Homo sapiens
atgggatcttgccctgagggct

SEQ ID NO: 9348689 - DNA, 22 bp, Homo sapiens
atgggagttttctctgatgctc

SEQ ID NO: 9348690 - DNA, 21 bp, Homo sapiens
atgggcagaggcagagaggct

SEQ ID NO: 9348691 - DNA, 22 bp, Homo sapiens
atggctctagaatacccctcag

SEQ ID NO: 9348692 - DNA, 22 bp, Homo sapiens
atggcagacctgggctggagaa

SEQ ID NO: 9348693 - DNA, 22 bp, Homo sapiens
atggcagagaaagcgagccaca

SEQ ID NO: 9348694 - DNA, 22 bp, Homo sapiens
atggccctttattccttcttcc

SEQ ID NO: 9348695 - DNA, 22 bp, Homo sapiens
atggccctgtttatggtaaggc

SEQ ID NO: 9348696 - DNA, 20 bp, Homo sapiens
atggctctgattctgagccc

SEQ ID NO: 9348697 - DNA, 20 bp, Homo sapiens
atggctctgtttggcagtga

SEQ ID NO: 9348698 - DNA, 22 bp, Homo sapiens
atggctctgagaacctgagcta

SEQ ID NO: 9348699 - DNA, 22 bp, Homo sapiens
atggctctctagggcccaggtt

SEQ ID NO: 9348700 - DNA, 22 bp, Homo sapiens
atggctctcttgacctaggcac

SEQ ID NO: 9348701 - DNA, 22 bp, Homo sapiens
atggctgagatgggctccaggc

SEQ ID NO: 9348702 - DNA, 22 bp, Homo sapiens
atggctgaggctggaggtggca

SEQ ID NO: 9348703 - DNA, 22 bp, Homo sapiens
atggctgaggctggaggtggca

SEQ ID NO: 9348704 - DNA, 22 bp, Homo sapiens
atggctgcagtccgtgccctgg

SEQ ID NO: 9348705 - DNA, 22 bp, Homo sapiens
atggctgcagtccgtgccctgg

SEQ ID NO: 9348706 - DNA, 22 bp, Homo sapiens
atggctgcatcatcctggttga

SEQ ID NO: 9348707 - DNA, 22 bp, Homo sapiens
atggctgcagagacctgaagaa

SEQ ID NO: 9348708 - DNA, 22 bp, Homo sapiens
atggctgcagccggccctgcgc

SEQ ID NO: 9348709 - DNA, 22 bp, Homo sapiens
atggctgcagccggccctgcgc

SEQ ID NO: 9348710 - DNA, 22 bp, Homo sapiens
atgggagggtggaaaggctctg

SEQ ID NO: 9348711 - DNA, 22 bp, Homo sapiens
atgggagggtggaaaggctctg

SEQ ID NO: 9348712 - DNA, 22 bp, Homo sapiens
atgggagtgtggttagagacct

SEQ ID NO: 9348713 - DNA, 22 bp, Homo sapiens
atgggagtgtgcttgaggagtt

SEQ ID NO: 9348714 - DNA, 22 bp, Homo sapiens
atgggagttttctctgatgctc

SEQ ID NO: 9348715 - DNA, 22 bp, Homo sapiens
atgggagttgggtaaggatcat

SEQ ID NO: 9348716 - DNA, 22 bp, Homo sapiens
atgggagtgtggttagagacct

SEQ ID NO: 9348717 - DNA, 22 bp, Homo sapiens
atgggagttgggtaaggatcat

SEQ ID NO: 9348718 - DNA, 22 bp, Homo sapiens
atgggagtggaggaaaaaagtt

SEQ ID NO: 9348719 - DNA, 22 bp, Homo sapiens
atgggagtgacagggccactgg

SEQ ID NO: 9348720 - DNA, 22 bp, Homo sapiens
atgggagtccaacatcaaggac

SEQ ID NO: 9348721 - DNA, 22 bp, Homo sapiens
atgggagtccaacatcaaggac

SEQ ID NO: 9348722 - DNA, 22 bp, Homo sapiens
gagcacagggaatagacagata

SEQ ID NO: 9348723 - DNA, 22 bp, Homo sapiens
atgggaggaagagaagatgtct

SEQ ID NO: 9348724 - DNA, 22 bp, Homo sapiens
gagcacaggctttggtggacac

SEQ ID NO: 9348725 - DNA, 22 bp, Homo sapiens
gagcacagggaatagacagata

SEQ ID NO: 9348726 - DNA, 22 bp, Homo sapiens
gagcacagcagggctctgggtg

SEQ ID NO: 9348727 - DNA, 22 bp, Homo sapiens
gagcacagcagggctctgggtg

SEQ ID NO: 9348728 - DNA, 22 bp, Homo sapiens
gagcacagctggaggtagcatt

SEQ ID NO: 9348729 - DNA, 22 bp, Homo sapiens
cttgttttaaactgttgtggct

SEQ ID NO: 9348730 - DNA, 22 bp, Homo sapiens
atctttgattgaagggaccctg

SEQ ID NO: 9348731 - DNA, 22 bp, Homo sapiens
ctttacacaatgattttcttta

SEQ ID NO: 9348732 - DNA, 22 bp, Homo sapiens
ctttacacaatgattttcttta

SEQ ID NO: 9348733 - DNA, 22 bp, Homo sapiens
ctttacacatcctaaccagtgt

SEQ ID NO: 9348734 - DNA, 22 bp, Homo sapiens
ctttacacatgagacctgcaat

SEQ ID NO: 9348735 - DNA, 22 bp, Homo sapiens
ctttacaccaagcagatctttc

SEQ ID NO: 9348736 - DNA, 22 bp, Homo sapiens
ctttacaccaagcagatctttc

SEQ ID NO: 9348737 - DNA, 22 bp, Homo sapiens
ctttacacttggacccacactt

SEQ ID NO: 9348738 - DNA, 22 bp, Homo sapiens
ctttacagaaagagaactctgg

SEQ ID NO: 9348739 - DNA, 22 bp, Homo sapiens
ctttacagaataagaatactgg

SEQ ID NO: 9348740 - DNA, 22 bp, Homo sapiens
ctttacagaataagaatactgg

SEQ ID NO: 9348741 - DNA, 22 bp, Homo sapiens
ctttacagtgctgctaatggct

SEQ ID NO: 9348742 - DNA, 22 bp, Homo sapiens
ctttacataaggataaacctgg

SEQ ID NO: 9348743 - DNA, 22 bp, Homo sapiens
ctttacataaggataaacctgg

SEQ ID NO: 9348744 - DNA, 22 bp, Homo sapiens
ctttacagtgaacttgcttgtc

SEQ ID NO: 9348745 - DNA, 22 bp, Homo sapiens
ctttacaggaaaaggtggctgt

SEQ ID NO: 9348746 - DNA, 22 bp, Homo sapiens
ctttacagcttagtggtatgga

SEQ ID NO: 9348747 - DNA, 22 bp, Homo sapiens
ctttacagataggaactactca

SEQ ID NO: 9348748 - DNA, 22 bp, Homo sapiens
ctttacagatggataattgttt

SEQ ID NO: 9348749 - DNA, 22 bp, Homo sapiens
ctttacagcctccagaaggaac

SEQ ID NO: 9348750 - DNA, 22 bp, Homo sapiens
ctttacagccccacttccgggc

SEQ ID NO: 9348751 - DNA, 22 bp, Homo sapiens
ctttacagcttagtggtatgga

SEQ ID NO: 9348752 - DNA, 22 bp, Homo sapiens
ctttacagcctccagaaggaac

SEQ ID NO: 9348753 - DNA, 22 bp, Homo sapiens
ctttacattaatttctactgat

SEQ ID NO: 9348754 - DNA, 22 bp, Homo sapiens
ctttactatcaggaataaacaa

SEQ ID NO: 9348755 - DNA, 22 bp, Homo sapiens
ctttactgtttggtgctctatt

SEQ ID NO: 9348756 - DNA, 22 bp, Homo sapiens
ctttacttctcaaaataaagca

SEQ ID NO: 9348757 - DNA, 22 bp, Homo sapiens
ctttacttgctttgttacaaaa

SEQ ID NO: 9348758 - DNA, 22 bp, Homo sapiens
ctttattagatgtagactttct

SEQ ID NO: 9348759 - DNA, 22 bp, Homo sapiens
ctttattgtccttcttaggtgg

SEQ ID NO: 9348760 - DNA, 22 bp, Homo sapiens
ctttattgtccttcttaggtgg

SEQ ID NO: 9348761 - DNA, 22 bp, Homo sapiens
ctttattctgcaaattgccttg

SEQ ID NO: 9348762 - DNA, 22 bp, Homo sapiens
ctttattgtccttcttaggtgg

SEQ ID NO: 9348763 - DNA, 22 bp, Homo sapiens
ctttattgtccttcttaggtgg

SEQ ID NO: 9348764 - DNA, 22 bp, Homo sapiens
ctttattctgcaaattgccttg

SEQ ID NO: 9348765 - DNA, 22 bp, Homo sapiens
ctttattcctacaagattttct

SEQ ID NO: 9348766 - DNA, 22 bp, Homo sapiens
ctttattcctacaagattttct

SEQ ID NO: 9348767 - DNA, 22 bp, Homo sapiens
cttctccctggcttctgcacac

SEQ ID NO: 9348768 - DNA, 22 bp, Homo sapiens
cttctccctggcttctgcacac

SEQ ID NO: 9348769 - DNA, 22 bp, Homo sapiens
cttctccctggcttctgcacac

SEQ ID NO: 9348770 - DNA, 22 bp, Homo sapiens
cttctcccgaagccggttctgc

SEQ ID NO: 9348771 - DNA, 22 bp, Homo sapiens
cttctcccgaagccggttctgc

SEQ ID NO: 9348772 - DNA, 18 bp, Homo sapiens
cttctcccatcttggcca

SEQ ID NO: 9348773 - DNA, 22 bp, Homo sapiens
cttctccccagaaaagatttct

SEQ ID NO: 9348774 - DNA, 19 bp, Homo sapiens
cttctccagcttctagaag

SEQ ID NO: 9348775 - DNA, 22 bp, Homo sapiens
cttctcccaagtatgcagtttg

SEQ ID NO: 9348776 - DNA, 22 bp, Homo sapiens
cttctcccaagtatgcagtttg

SEQ ID NO: 9348777 - DNA, 18 bp, Homo sapiens
cttctcccatcttggcca

SEQ ID NO: 9348778 - DNA, 22 bp, Homo sapiens
cttctcctaaggtcagaattgc

SEQ ID NO: 9348779 - DNA, 22 bp, Homo sapiens
cttctccctgggggctctttat

SEQ ID NO: 9348780 - DNA, 22 bp, Homo sapiens
cttctccctggcttctgcacac

SEQ ID NO: 9348781 - DNA, 22 bp, Homo sapiens
cttctccctgggggctctttat

SEQ ID NO: 9348782 - DNA, 22 bp, Homo sapiens
cttctccctggcttctgcacac

SEQ ID NO: 9348783 - DNA, 22 bp, Homo sapiens
cttctcctctgagtcctgggag

SEQ ID NO: 9348784 - DNA, 22 bp, Homo sapiens
cttctcctctgagtcctgggag

SEQ ID NO: 9348785 - DNA, 22 bp, Homo sapiens
atctggagaaaccgccaaggga

SEQ ID NO: 9348786 - DNA, 22 bp, Homo sapiens
cttctccagccacgcccactcc

SEQ ID NO: 9348787 - DNA, 22 bp, Homo sapiens
cttctccagccacgcccactcc

SEQ ID NO: 9348788 - DNA, 22 bp, Homo sapiens
atctggactggacatagtcttt

SEQ ID NO: 9348789 - DNA, 22 bp, Homo sapiens
atctggaattgaagaggtttga

SEQ ID NO: 9348790 - DNA, 22 bp, Homo sapiens
atctggaattgaagaggtttga

SEQ ID NO: 9348791 - DNA, 22 bp, Homo sapiens
atctggaattaagagaaagtga

SEQ ID NO: 9348792 - DNA, 22 bp, Homo sapiens
atctggaattaagagaaagtga

SEQ ID NO: 9348793 - DNA, 17 bp, Homo sapiens
atctggaagctagctga

SEQ ID NO: 9348794 - DNA, 17 bp, Homo sapiens
atctggaagctagctga

SEQ ID NO: 9348795 - DNA, 22 bp, Homo sapiens
atctggaagtaggagagtgggc

SEQ ID NO: 9348796 - DNA, 22 bp, Homo sapiens
atctggaagtcagaggtttgca

SEQ ID NO: 9348797 - DNA, 22 bp, Homo sapiens
atctggaagtcagaggtttgca

SEQ ID NO: 9348798 - DNA, 22 bp, Homo sapiens
atctggaagttaagcttggtgc

SEQ ID NO: 9348799 - DNA, 22 bp, Homo sapiens
atctggaagtctccgaaggcag

SEQ ID NO: 9348800 - DNA, 22 bp, Homo sapiens
atctggaatagcatggggttga

SEQ ID NO: 9348801 - DNA, 22 bp, Homo sapiens
atctggaatcttgctgaccctg

SEQ ID NO: 9348802 - DNA, 22 bp, Homo sapiens
atctggaatccttgtggacaat

SEQ ID NO: 9348803 - DNA, 22 bp, Homo sapiens
atctggaatgtctcattgggaa

SEQ ID NO: 9348804 - DNA, 22 bp, Homo sapiens
atctttcagggccatttgtatt

SEQ ID NO: 9348805 - DNA, 20 bp, Homo sapiens
atcttgggacagggcacatg

SEQ ID NO: 9348806 - DNA, 22 bp, Homo sapiens
cttctcctgtaagaagatcaaa

SEQ ID NO: 9348807 - DNA, 22 bp, Homo sapiens
atcttgggaattttccaggagt

SEQ ID NO: 9348808 - DNA, 22 bp, Homo sapiens
atctttctccatatacatcttt

SEQ ID NO: 9348809 - DNA, 22 bp, Homo sapiens
atctttctccatatacatcttt

SEQ ID NO: 9348810 - DNA, 22 bp, Homo sapiens
atctttctccatatacatcttt

SEQ ID NO: 9348811 - DNA, 22 bp, Homo sapiens
atctttctctgcactatacaat

SEQ ID NO: 9348812 - DNA, 22 bp, Homo sapiens
atctttcttatttgaagaaaga

SEQ ID NO: 9348813 - DNA, 22 bp, Homo sapiens
atctttctctgcactatacaat

SEQ ID NO: 9348814 - DNA, 22 bp, Homo sapiens
atctttctatggtactttctcc

SEQ ID NO: 9348815 - DNA, 22 bp, Homo sapiens
atctttctatttctaaaaacta

SEQ ID NO: 9348816 - DNA, 18 bp, Homo sapiens
atctttccatagcatgtt

SEQ ID NO: 9348817 - DNA, 22 bp, Homo sapiens
atctttcctgttttcagacagc

SEQ ID NO: 9348818 - DNA, 22 bp, Homo sapiens
atctttctatggtactttctcc

SEQ ID NO: 9348819 - DNA, 22 bp, Homo sapiens
ctttgcttgacactgtgattgt

SEQ ID NO: 9348820 - DNA, 22 bp, Homo sapiens
ctttgctgatctctggtttaaa

SEQ ID NO: 9348821 - DNA, 22 bp, Homo sapiens
ctttgctgttataatgatagct

SEQ ID NO: 9348822 - DNA, 20 bp, Homo sapiens
ctttgcctattctctgcctg

SEQ ID NO: 9348823 - DNA, 22 bp, Homo sapiens
ctttgcattttgcccaactgtg

SEQ ID NO: 9348824 - DNA, 23 bp, Homo sapiens
ctttgccacccagagcctgacag

SEQ ID NO: 9348825 - DNA, 22 bp, Homo sapiens
ctttctttcgaagacgtgatta

SEQ ID NO: 9348826 - DNA, 22 bp, Homo sapiens
ctttctttgcagtgagccagag

SEQ ID NO: 9348827 - DNA, 22 bp, Homo sapiens
ctttggctgacgaggaggaggc

SEQ ID NO: 9348828 - DNA, 22 bp, Homo sapiens
ctttggctgggcaaagggaggt

SEQ ID NO: 9348829 - DNA, 22 bp, Homo sapiens
ctttggcttgccctggcagtac

SEQ ID NO: 9348830 - DNA, 22 bp, Homo sapiens
atgaattgtaaattccttgaaa

SEQ ID NO: 9348831 - DNA, 22 bp, Homo sapiens
atgaattgtccgatgttgtgca

SEQ ID NO: 9348832 - DNA, 23 bp, Homo sapiens
atgacactcctgtgcgcaccctg

SEQ ID NO: 9348833 - DNA, 22 bp, Homo sapiens
atgacaatggacatagttaaaa

SEQ ID NO: 9348834 - DNA, 22 bp, Homo sapiens
atgacaaaagaagacatgaggt

SEQ ID NO: 9348835 - DNA, 22 bp, Homo sapiens
atgacacataaaacaaggactg

SEQ ID NO: 9348836 - DNA, 22 bp, Homo sapiens
atgagaatatgatttactattg

SEQ ID NO: 9348837 - DNA, 22 bp, Homo sapiens
atgagacattgcaagtccagaa

SEQ ID NO: 9348838 - DNA, 22 bp, Homo sapiens
atgagaaagttaatcatcatga

SEQ ID NO: 9348839 - DNA, 22 bp, Homo sapiens
atgagaaatttattacaagcta

SEQ ID NO: 9348840 - DNA, 22 bp, Homo sapiens
atgagaggtttcgtcagaggaa

SEQ ID NO: 9348841 - DNA, 22 bp, Homo sapiens
atgagatagactatgtcataca

SEQ ID NO: 9348842 - DNA, 22 bp, Homo sapiens
ctttttatctcttaatgatgtt

SEQ ID NO: 9348843 - DNA, 22 bp, Homo sapiens
ctttttatctcttaatgatgtt

SEQ ID NO: 9348844 - DNA, 22 bp, Homo sapiens
ctttttatagctatgtcctatg

SEQ ID NO: 9348845 - DNA, 22 bp, Homo sapiens
ctttttataccgtgccagttga

SEQ ID NO: 9348846 - DNA, 22 bp, Homo sapiens
atgacagatagtcttcatttgc

SEQ ID NO: 9348847 - DNA, 22 bp, Homo sapiens
atgacagaggagtgcaggtgat

SEQ ID NO: 9348848 - DNA, 22 bp, Homo sapiens
atgacagaggagtgcaggtgat

SEQ ID NO: 9348849 - DNA, 22 bp, Homo sapiens
atgacagaggagtgcaggtgat

SEQ ID NO: 9348850 - DNA, 22 bp, Homo sapiens
gaatttcctctaaacccctgag

SEQ ID NO: 9348851 - DNA, 22 bp, Homo sapiens
atgcctggatttgggactcaaa

SEQ ID NO: 9348852 - DNA, 22 bp, Homo sapiens
atgctatactcaaagaaattca

SEQ ID NO: 9348853 - DNA, 22 bp, Homo sapiens
atgctatagaaatatttaaatt

SEQ ID NO: 9348854 - DNA, 22 bp, Homo sapiens
atgctatagaaatatttaaatt

SEQ ID NO: 9348855 - DNA, 22 bp, Homo sapiens
atgctatagaaatatttaaatt

SEQ ID NO: 9348856 - DNA, 22 bp, Homo sapiens
atgctataaactctaggtcatt

SEQ ID NO: 9348857 - DNA, 22 bp, Homo sapiens
gacaggaaaggggtctgttttc

SEQ ID NO: 9348858 - DNA, 22 bp, Homo sapiens
atgctgaaaattggatttgaat

SEQ ID NO: 9348859 - DNA, 16 bp, Homo sapiens
atgctgctattagagg

SEQ ID NO: 9348860 - DNA, 22 bp, Homo sapiens
gacaggaaacaagaaggcagga

SEQ ID NO: 9348861 - DNA, 22 bp, Homo sapiens
atgccactgcactccagcctag

SEQ ID NO: 9348862 - DNA, 22 bp, Homo sapiens
atgccactgcactccagcctag

SEQ ID NO: 9348863 - DNA, 22 bp, Homo sapiens
atgccactgcactccagcctag

SEQ ID NO: 9348864 - DNA, 22 bp, Homo sapiens
atgccactgcactccagcctag

SEQ ID NO: 9348865 - DNA, 22 bp, Homo sapiens
atgccactgcactccagcctgg

SEQ ID NO: 9348866 - DNA, 22 bp, Homo sapiens
atgccactgcactccagcctgg

SEQ ID NO: 9348867 - DNA, 22 bp, Homo sapiens
atgccactgcactccagcctgg

SEQ ID NO: 9348868 - DNA, 22 bp, Homo sapiens
atgccactgcactccagcctgg

SEQ ID NO: 9348869 - DNA, 22 bp, Homo sapiens
atgccactgcactccagcctgg

SEQ ID NO: 9348870 - DNA, 22 bp, Homo sapiens
gaatttcagaggtaacatcatc

SEQ ID NO: 9348871 - DNA, 22 bp, Homo sapiens
atgccactgcacttcagcttgg

SEQ ID NO: 9348872 - DNA, 22 bp, Homo sapiens
atgccactgcacttcagcctgg

SEQ ID NO: 9348873 - DNA, 22 bp, Homo sapiens
atgccactgcacttcagcctgg

SEQ ID NO: 9348874 - DNA, 22 bp, Homo sapiens
atgccactgcacttcagcctgg

SEQ ID NO: 9348875 - DNA, 22 bp, Homo sapiens
gaatttatctacgttaagtatg

SEQ ID NO: 9348876 - DNA, 22 bp, Homo sapiens
atgccactgcacttcagcttgg

SEQ ID NO: 9348877 - DNA, 22 bp, Homo sapiens
atgccactgcacttcagcctgg

SEQ ID NO: 9348878 - DNA, 22 bp, Homo sapiens
atgccactgcacttcagcctgg

SEQ ID NO: 9348879 - DNA, 22 bp, Homo sapiens
atgccactgcacttcagcctgg

SEQ ID NO: 9348880 - DNA, 22 bp, Homo sapiens
gaagtctgagtgggggccaggc

SEQ ID NO: 9348881 - DNA, 22 bp, Homo sapiens
gaagaaagggaattaacttgag

SEQ ID NO: 9348882 - DNA, 22 bp, Homo sapiens
gaagaaagggaattaacttgag

SEQ ID NO: 9348883 - DNA, 22 bp, Homo sapiens
gaagaaagggaattaacttgag

SEQ ID NO: 9348884 - DNA, 22 bp, Homo sapiens
gaagagagagccctggggtccg

SEQ ID NO: 9348885 - DNA, 22 bp, Homo sapiens
gaagagagaacattacataaac

SEQ ID NO: 9348886 - DNA, 22 bp, Homo sapiens
gaagagagcagcaaactggagt

SEQ ID NO: 9348887 - DNA, 22 bp, Homo sapiens
gaagagagcagcaaactggagt

SEQ ID NO: 9348888 - DNA, 21 bp, Homo sapiens
gaagagagtcctcatcctgag

SEQ ID NO: 9348889 - DNA, 22 bp, Homo sapiens
gaagagagagtggggttctgcg

SEQ ID NO: 9348890 - DNA, 22 bp, Homo sapiens
gaagagagagtggggttctgcg

SEQ ID NO: 9348891 - DNA, 22 bp, Homo sapiens
gaagagagagtggggttctgcg

SEQ ID NO: 9348892 - DNA, 22 bp, Homo sapiens
atgagcccagggaattcctttc

SEQ ID NO: 9348893 - DNA, 22 bp, Homo sapiens
atgagctgtgggattccagagg

SEQ ID NO: 9348894 - DNA, 22 bp, Homo sapiens
atgagcagtaggttcatggctg

SEQ ID NO: 9348895 - DNA, 22 bp, Homo sapiens
atgagcaggtttaagagaggcc

SEQ ID NO: 9348896 - DNA, 23 bp, Homo sapiens
gaagcagatgtctgagtaggcag

SEQ ID NO: 9348897 - DNA, 22 bp, Homo sapiens
atgatgttggtttaatttgagt

SEQ ID NO: 9348898 - DNA, 22 bp, Homo sapiens
atgatgtccacaggggtgttca

SEQ ID NO: 9348899 - DNA, 22 bp, Homo sapiens
atgatgtcattcttgtttgctc

SEQ ID NO: 9348900 - DNA, 22 bp, Homo sapiens
atgatgtatgactgtgttcaaa

SEQ ID NO: 9348901 - DNA, 22 bp, Homo sapiens
atgatgtaacataaagatgtct

SEQ ID NO: 9348902 - DNA, 22 bp, Homo sapiens
atgatggatatgtaaagtgttg

SEQ ID NO: 9348903 - DNA, 22 bp, Homo sapiens
gaagagctaaaggcacaggctt

SEQ ID NO: 9348904 - DNA, 22 bp, Homo sapiens
atgatggctaggctggttttga

SEQ ID NO: 9348905 - DNA, 22 bp, Homo sapiens
gaagagatgacaaaggagcatg

SEQ ID NO: 9348906 - DNA, 22 bp, Homo sapiens
gaagagatgacaaaggagcatg

SEQ ID NO: 9348907 - DNA, 21 bp, Homo sapiens
gaagagagtcctcatcctgag

SEQ ID NO: 9348908 - DNA, 21 bp, Homo sapiens
gaagagagtcctcatcctgag

SEQ ID NO: 9348909 - DNA, 22 bp, Homo sapiens
gaagagcatttgcccaggctgt

SEQ ID NO: 9348910 - DNA, 22 bp, Homo sapiens
gaagagcatatgaagagcatat

SEQ ID NO: 9348911 - DNA, 22 bp, Homo sapiens
atgcaggttgtatctgaagcca

SEQ ID NO: 9348912 - DNA, 22 bp, Homo sapiens
atgcagtgtttggaagcttaag

SEQ ID NO: 9348913 - DNA, 22 bp, Homo sapiens
gaaggaggtgtcagttggactg

SEQ ID NO: 9348914 - DNA, 22 bp, Homo sapiens
gaaggaggtgtcagttggactg

SEQ ID NO: 9348915 - DNA, 22 bp, Homo sapiens
gaaggagggtgcggatctgagc

SEQ ID NO: 9348916 - DNA, 22 bp, Homo sapiens
gaaggagggtgcggatctgagc

SEQ ID NO: 9348917 - DNA, 22 bp, Homo sapiens
gaaggagggtgcggatctgagc

SEQ ID NO: 9348918 - DNA, 22 bp, Homo sapiens
gaaggagggtgcggatctgagc

SEQ ID NO: 9348919 - DNA, 22 bp, Homo sapiens
gaaggagggtgcggatctgagc

SEQ ID NO: 9348920 - DNA, 22 bp, Homo sapiens
gaaggagggagcggcgcggatt

SEQ ID NO: 9348921 - DNA, 22 bp, Homo sapiens
gaaggaggctccccaaagtctg

SEQ ID NO: 9348922 - DNA, 22 bp, Homo sapiens
gaaggagggtgcggatctgagc

SEQ ID NO: 9348923 - DNA, 22 bp, Homo sapiens
gaaggagggagcggcgcggatt

SEQ ID NO: 9348924 - DNA, 22 bp, Homo sapiens
gaagctaggctggggttcagga

SEQ ID NO: 9348925 - DNA, 22 bp, Homo sapiens
gaagctgcaataattgttttga

SEQ ID NO: 9348926 - DNA, 22 bp, Homo sapiens
gaagctgcgtgtagccatactt

SEQ ID NO: 9348927 - DNA, 22 bp, Homo sapiens
gaagctgcaataattgttttga

SEQ ID NO: 9348928 - DNA, 22 bp, Homo sapiens
gaagctgggtcgctgggatcct

SEQ ID NO: 9348929 - DNA, 22 bp, Homo sapiens
gaaggaggcgttagccctagga

SEQ ID NO: 9348930 - DNA, 22 bp, Homo sapiens
gaaggaggcgttagccctagga

SEQ ID NO: 9348931 - DNA, 22 bp, Homo sapiens
gaaggaggcgttagccctagga

SEQ ID NO: 9348932 - DNA, 22 bp, Homo sapiens
gaagccttgaactgcaaacccc

SEQ ID NO: 9348933 - DNA, 22 bp, Homo sapiens
gaagccttgaactgcaaacccc

SEQ ID NO: 9348934 - DNA, 22 bp, Homo sapiens
gaagcgtcatgaaagaaaggct

SEQ ID NO: 9348935 - DNA, 22 bp, Homo sapiens
gaagcgtctaggtagaaattta

SEQ ID NO: 9348936 - DNA, 22 bp, Homo sapiens
gaagcctgtggataggggcatc

SEQ ID NO: 9348937 - DNA, 22 bp, Homo sapiens
gaagcctggtccagagctccca

SEQ ID NO: 9348938 - DNA, 22 bp, Homo sapiens
gcacacagaattgattcactgt

SEQ ID NO: 9348939 - DNA, 22 bp, Homo sapiens
attatcacaggtgagtctcact

SEQ ID NO: 9348940 - DNA, 22 bp, Homo sapiens
attatccaacacccagttacat

SEQ ID NO: 9348941 - DNA, 22 bp, Homo sapiens
attatattgagtataaccagag

SEQ ID NO: 9348942 - DNA, 22 bp, Homo sapiens
attagtttggtgcaaaagtaat

SEQ ID NO: 9348943 - DNA, 22 bp, Homo sapiens
attagttggggtggagaaggat

SEQ ID NO: 9348944 - DNA, 22 bp, Homo sapiens
attaagatcattgtagaagatt

SEQ ID NO: 9348945 - DNA, 22 bp, Homo sapiens
attataggcttgagccaccgtg

SEQ ID NO: 9348946 - DNA, 22 bp, Homo sapiens
attatataaaattctggaagct

SEQ ID NO: 9348947 - DNA, 22 bp, Homo sapiens
attataggcttgagccaccgtg

SEQ ID NO: 9348948 - DNA, 22 bp, Homo sapiens
attataggcttgagccaccgtg

SEQ ID NO: 9348949 - DNA, 22 bp, Homo sapiens
gcacacagactaaccatatttc

SEQ ID NO: 9348950 - DNA, 22 bp, Homo sapiens
gcacacagagaggtggtatgtc

SEQ ID NO: 9348951 - DNA, 22 bp, Homo sapiens
gcacacagaattgattcactgt

SEQ ID NO: 9348952 - DNA, 22 bp, Homo sapiens
gcacacagctagattaccattc

SEQ ID NO: 9348953 - DNA, 22 bp, Homo sapiens
gcacacaggcagtttccagcca

SEQ ID NO: 9348954 - DNA, 22 bp, Homo sapiens
gcacagggctgccaggcggctt

SEQ ID NO: 9348955 - DNA, 22 bp, Homo sapiens
gcaccaggaggcccttctcatc

SEQ ID NO: 9348956 - DNA, 22 bp, Homo sapiens
gcaccaggcagctgagcaggcc

SEQ ID NO: 9348957 - DNA, 22 bp, Homo sapiens
gcaccaggcagctgagcaggcc

SEQ ID NO: 9348958 - DNA, 22 bp, Homo sapiens
gcaccaggcagctgagcaggcc

SEQ ID NO: 9348959 - DNA, 22 bp, Homo sapiens
gcaccaggcagctgagcaggcc

SEQ ID NO: 9348960 - DNA, 22 bp, Homo sapiens
gcaccaggcttagagccccagg

SEQ ID NO: 9348961 - DNA, 22 bp, Homo sapiens
gcaccagggagggtgtgcttca

SEQ ID NO: 9348962 - DNA, 22 bp, Homo sapiens
attatgcatttgttagtattaa

SEQ ID NO: 9348963 - DNA, 22 bp, Homo sapiens
attatgcatatacatttgacta

SEQ ID NO: 9348964 - DNA, 22 bp, Homo sapiens
attatcttgataaaatggcagt

SEQ ID NO: 9348965 - DNA, 22 bp, Homo sapiens
gcaccatgatggagcctcatta

SEQ ID NO: 9348966 - DNA, 22 bp, Homo sapiens
gcaccatgatggagcctcatta

SEQ ID NO: 9348967 - DNA, 22 bp, Homo sapiens
gcacccagaataaggacaggac

SEQ ID NO: 9348968 - DNA, 22 bp, Homo sapiens
gcacccacttaggccagtcaat

SEQ ID NO: 9348969 - DNA, 22 bp, Homo sapiens
gcacccagaataaggacaggac

SEQ ID NO: 9348970 - DNA, 22 bp, Homo sapiens
attatgtagctaaaaattgtgt

SEQ ID NO: 9348971 - DNA, 22 bp, Homo sapiens
gcagagaccccgcagtgaggcc

SEQ ID NO: 9348972 - DNA, 23 bp, Homo sapiens
gcagagacagccccagcgcgatg

SEQ ID NO: 9348973 - DNA, 22 bp, Homo sapiens
gcagagagttgggctgcgccag

SEQ ID NO: 9348974 - DNA, 22 bp, Homo sapiens
gcagagataagtagacaggatg

SEQ ID NO: 9348975 - DNA, 22 bp, Homo sapiens
gcagagaggaatgaagccatcc

SEQ ID NO: 9348976 - DNA, 22 bp, Homo sapiens
gcagagattggtgcactgatga

SEQ ID NO: 9348977 - DNA, 22 bp, Homo sapiens
attcaagtacagttttcttctt

SEQ ID NO: 9348978 - DNA, 22 bp, Homo sapiens
attcaagtccagcttctctaca

SEQ ID NO: 9348979 - DNA, 22 bp, Homo sapiens
attcaataaatatgctacatgg

SEQ ID NO: 9348980 - DNA, 22 bp, Homo sapiens
gcagagatccagggtataggtt

SEQ ID NO: 9348981 - DNA, 22 bp, Homo sapiens
gcagagatattgatatagattt

SEQ ID NO: 9348982 - DNA, 22 bp, Homo sapiens
gcagagatggctgatctattcc

SEQ ID NO: 9348983 - DNA, 22 bp, Homo sapiens
gcagagattatgccatggaaag

SEQ ID NO: 9348984 - DNA, 22 bp, Homo sapiens
gcagagattatgccatggaaag

SEQ ID NO: 9348985 - DNA, 18 bp, Homo sapiens
gatgtgggccctggatat

SEQ ID NO: 9348986 - DNA, 22 bp, Homo sapiens
gatgtgtcatttggtcatctgc

SEQ ID NO: 9348987 - DNA, 22 bp, Homo sapiens
gatgtgtcatttggtcatctgc

SEQ ID NO: 9348988 - DNA, 22 bp, Homo sapiens
gattcactcatattttacgttt

SEQ ID NO: 9348989 - DNA, 22 bp, Homo sapiens
gattcactcatattttacgttt

SEQ ID NO: 9348990 - DNA, 22 bp, Homo sapiens
gattcactcatattttacgttt

SEQ ID NO: 9348991 - DNA, 22 bp, Homo sapiens
gatggccacatacatggctggg

SEQ ID NO: 9348992 - DNA, 22 bp, Homo sapiens
gatgtgagtggtagctgggatt

SEQ ID NO: 9348993 - DNA, 22 bp, Homo sapiens
gatgtgaggactcatgtggagg

SEQ ID NO: 9348994 - DNA, 22 bp, Homo sapiens
gatgtgaggactcatgtggagg

SEQ ID NO: 9348995 - DNA, 22 bp, Homo sapiens
gattctggagttaaggatgcct

SEQ ID NO: 9348996 - DNA, 22 bp, Homo sapiens
gattctgatctatagtgttata

SEQ ID NO: 9348997 - DNA, 22 bp, Homo sapiens
gattctgaggccttgctcaaga

SEQ ID NO: 9348998 - DNA, 22 bp, Homo sapiens
gattctgagacagaaacgtatt

SEQ ID NO: 9348999 - DNA, 22 bp, Homo sapiens
gattctgagctggtgttttacg

SEQ ID NO: 9349000 - DNA, 22 bp, Homo sapiens
gattctgaaattaacagactgg

SEQ ID NO: 9349001 - DNA, 22 bp, Homo sapiens
gattctctctggatcccatgga

SEQ ID NO: 9349002 - DNA, 22 bp, Homo sapiens
gattcctgctattcacagggct

SEQ ID NO: 9349003 - DNA, 22 bp, Homo sapiens
gattcccatgtctgaggaggtg

SEQ ID NO: 9349004 - DNA, 22 bp, Homo sapiens
gattcttgggccttctgaagtt

SEQ ID NO: 9349005 - DNA, 22 bp, Homo sapiens
attaaattggatctgcatagtt

SEQ ID NO: 9349006 - DNA, 22 bp, Homo sapiens
attaaattttcactaggctccc

SEQ ID NO: 9349007 - DNA, 22 bp, Homo sapiens
attaacagaattttacatgctt

SEQ ID NO: 9349008 - DNA, 22 bp, Homo sapiens
attaacagcagcatccccagcc

SEQ ID NO: 9349009 - DNA, 22 bp, Homo sapiens
attaacatgagttggagatagg

SEQ ID NO: 9349010 - DNA, 22 bp, Homo sapiens
gagtggggcgtggatccagcgt

SEQ ID NO: 9349011 - DNA, 22 bp, Homo sapiens
atgttatgtgcaagatacataa

SEQ ID NO: 9349012 - DNA, 22 bp, Homo sapiens
atgttatgtgcaagatacataa

SEQ ID NO: 9349013 - DNA, 22 bp, Homo sapiens
atgttatgtctgggaaggggta

SEQ ID NO: 9349014 - DNA, 22 bp, Homo sapiens
gagtggggcgaagtcggcgagt

SEQ ID NO: 9349015 - DNA, 22 bp, Homo sapiens
gagtggggcgaagtcggcgagt

SEQ ID NO: 9349016 - DNA, 22 bp, Homo sapiens
atgttattaaagtacagattct

SEQ ID NO: 9349017 - DNA, 23 bp, Homo sapiens
atgttattattagcagtcttgcc

SEQ ID NO: 9349018 - DNA, 22 bp, Homo sapiens
gagtggggaaagccaggacaga

SEQ ID NO: 9349019 - DNA, 23 bp, Homo sapiens
gagtggggagaaattggttaaac

SEQ ID NO: 9349020 - DNA, 22 bp, Homo sapiens
gagtggggcccactgctgggtg

SEQ ID NO: 9349021 - DNA, 22 bp, Homo sapiens
gagtggggcccactgctgggtg

SEQ ID NO: 9349022 - DNA, 22 bp, Homo sapiens
gagtggggcccactgctgggtg

SEQ ID NO: 9349023 - DNA, 22 bp, Homo sapiens
gagtggggcccactgctgggtg

SEQ ID NO: 9349024 - DNA, 22 bp, Homo sapiens
gagtgggcaccgtgggcacact

SEQ ID NO: 9349025 - DNA, 22 bp, Homo sapiens
gagtggggaaagccaggacaga

SEQ ID NO: 9349026 - DNA, 22 bp, Homo sapiens
gagtggggaaagccaggacaga

SEQ ID NO: 9349027 - DNA, 22 bp, Homo sapiens
gagtggggaaagccaggacaga

SEQ ID NO: 9349028 - DNA, 22 bp, Homo sapiens
gatggcagtcaaccaggtgagg

SEQ ID NO: 9349029 - DNA, 22 bp, Homo sapiens
gatggcaggtgatagccgagtc

SEQ ID NO: 9349030 - DNA, 22 bp, Homo sapiens
gatggccacatacatggctggg

SEQ ID NO: 9349031 - DNA, 22 bp, Homo sapiens
gatggccaaggaccacgcatcg

SEQ ID NO: 9349032 - DNA, 22 bp, Homo sapiens
gatggcagtgggcctcgagtcc

SEQ ID NO: 9349033 - DNA, 22 bp, Homo sapiens
gatggcagcagcagccagggat

SEQ ID NO: 9349034 - DNA, 22 bp, Homo sapiens
gatggcagcatattgacagcat

SEQ ID NO: 9349035 - DNA, 22 bp, Homo sapiens
gatggcagcagcagccagggat

SEQ ID NO: 9349036 - DNA, 22 bp, Homo sapiens
gatggcagcagcagccagggat

SEQ ID NO: 9349037 - DNA, 22 bp, Homo sapiens
gatggcaggtagtggtctcatc

SEQ ID NO: 9349038 - DNA, 22 bp, Homo sapiens
gatggcaggcaggtgagtagag

SEQ ID NO: 9349039 - DNA, 22 bp, Homo sapiens
gatggcaggcaggtgagtagag

SEQ ID NO: 9349040 - DNA, 22 bp, Homo sapiens
gatggcaggcaggtgagtagag

SEQ ID NO: 9349041 - DNA, 22 bp, Homo sapiens
gatggcagcatattgacagcat

SEQ ID NO: 9349042 - DNA, 22 bp, Homo sapiens
gatggaggagatggcagggtgc

SEQ ID NO: 9349043 - DNA, 22 bp, Homo sapiens
gatggaggagatggcagggtgc

SEQ ID NO: 9349044 - DNA, 22 bp, Homo sapiens
gatggagtctgaagctgggaac

SEQ ID NO: 9349045 - DNA, 21 bp, Homo sapiens
gatgatggcaggcagcactgg

SEQ ID NO: 9349046 - DNA, 22 bp, Homo sapiens
gatggcacacagacatccccgc

SEQ ID NO: 9349047 - DNA, 22 bp, Homo sapiens
gatggcaccttgaacgctgcgt

SEQ ID NO: 9349048 - DNA, 22 bp, Homo sapiens
atgttatttattgaaacacttt

SEQ ID NO: 9349049 - DNA, 22 bp, Homo sapiens
atgttatttattgaaacacttt

SEQ ID NO: 9349050 - DNA, 22 bp, Homo sapiens
atgttatttctgaaagatcatt

SEQ ID NO: 9349051 - DNA, 20 bp, Homo sapiens
gcaggcagggaatgggggtg

SEQ ID NO: 9349052 - DNA, 20 bp, Homo sapiens
gcaggcagggaatgggggtg

SEQ ID NO: 9349053 - DNA, 20 bp, Homo sapiens
gcaggcagggaatgggggtg

SEQ ID NO: 9349054 - DNA, 22 bp, Homo sapiens
gcaggcaggcttccttgaactg

SEQ ID NO: 9349055 - DNA, 22 bp, Homo sapiens
gcaggcaggcttccttgaactg

SEQ ID NO: 9349056 - DNA, 22 bp, Homo sapiens
gcaggcaggcttccttgaactg

SEQ ID NO: 9349057 - DNA, 22 bp, Homo sapiens
gcaggcaggcttccttgaactg

SEQ ID NO: 9349058 - DNA, 22 bp, Homo sapiens
gcaggcaggagcccaactgcct

SEQ ID NO: 9349059 - DNA, 22 bp, Homo sapiens
gcaggcaggagcccaactgcct

SEQ ID NO: 9349060 - DNA, 22 bp, Homo sapiens
gcaggcaggagcccaactgcct

SEQ ID NO: 9349061 - DNA, 22 bp, Homo sapiens
gcaggcaggaaggactaagtaa

SEQ ID NO: 9349062 - DNA, 22 bp, Homo sapiens
gcaggcaggaaggactaagtaa

SEQ ID NO: 9349063 - DNA, 19 bp, Homo sapiens
gcaggcagctggggtatcc

SEQ ID NO: 9349064 - DNA, 22 bp, Homo sapiens
gcagcttggatttctgtagttt

SEQ ID NO: 9349065 - DNA, 23 bp, Homo sapiens
gcagcttgtggtttagtagaggg

SEQ ID NO: 9349066 - DNA, 19 bp, Homo sapiens
gcaggcagctggggtatcc

SEQ ID NO: 9349067 - DNA, 19 bp, Homo sapiens
gcaggcagctggggtatcc

SEQ ID NO: 9349068 - DNA, 22 bp, Homo sapiens
gcagcttcagccagagggccag

SEQ ID NO: 9349069 - DNA, 22 bp, Homo sapiens
gcagcttcaagatactttttct

SEQ ID NO: 9349070 - DNA, 22 bp, Homo sapiens
gcagctgttcagctggccagat

SEQ ID NO: 9349071 - DNA, 22 bp, Homo sapiens
gcagcttcctgagtgtggacag

SEQ ID NO: 9349072 - DNA, 22 bp, Homo sapiens
gcagcttcagtaggtgaagaca

SEQ ID NO: 9349073 - DNA, 22 bp, Homo sapiens
gcagctgtgtaatgagcccaca

SEQ ID NO: 9349074 - DNA, 22 bp, Homo sapiens
gcagctgtgtaatgagcccaca

SEQ ID NO: 9349075 - DNA, 22 bp, Homo sapiens
gcagctgtggtgctgagatagg

SEQ ID NO: 9349076 - DNA, 22 bp, Homo sapiens
attctgatatgaacacacatat

SEQ ID NO: 9349077 - DNA, 19 bp, Homo sapiens
gcagctgtgggaagagcca

SEQ ID NO: 9349078 - DNA, 22 bp, Homo sapiens
gcagctgtgggcctcggagagc

SEQ ID NO: 9349079 - DNA, 22 bp, Homo sapiens
gcagctgtgggcctcggagagc

SEQ ID NO: 9349080 - DNA, 22 bp, Homo sapiens
attctgataaataagcagcaag

SEQ ID NO: 9349081 - DNA, 21 bp, Homo sapiens
attctgagttgtcagtcttca

SEQ ID NO: 9349082 - DNA, 22 bp, Homo sapiens
attctgagtccatgggggcagg

SEQ ID NO: 9349083 - DNA, 23 bp, Homo sapiens
attctgagtcagaaagtttgggg

SEQ ID NO: 9349084 - DNA, 22 bp, Homo sapiens
attctgaattctgagcctttca

SEQ ID NO: 9349085 - DNA, 22 bp, Homo sapiens
attctgaggacagagtctagca

SEQ ID NO: 9349086 - DNA, 22 bp, Homo sapiens
attctgaggacagagtctagca

SEQ ID NO: 9349087 - DNA, 22 bp, Homo sapiens
attccacttccactagtttctc

SEQ ID NO: 9349088 - DNA, 22 bp, Homo sapiens
attccacttgattttaggggaa

SEQ ID NO: 9349089 - DNA, 20 bp, Homo sapiens
attccacttgtttgaggtac

SEQ ID NO: 9349090 - DNA, 22 bp, Homo sapiens
attctccacacatccagacctt

SEQ ID NO: 9349091 - DNA, 22 bp, Homo sapiens
attccactgccgaatgatacat

SEQ ID NO: 9349092 - DNA, 22 bp, Homo sapiens
attccactgttataaaatgtcc

SEQ ID NO: 9349093 - DNA, 22 bp, Homo sapiens
attccactccaataagtgtcaa

SEQ ID NO: 9349094 - DNA, 22 bp, Homo sapiens
attccacttagtgactcatttg

SEQ ID NO: 9349095 - DNA, 22 bp, Homo sapiens
attccacttatatgaagtaacg

SEQ ID NO: 9349096 - DNA, 20 bp, Homo sapiens
attccacttatatgaggtcc

SEQ ID NO: 9349097 - DNA, 17 bp, Homo sapiens
attccacagggaatctg

SEQ ID NO: 9349098 - DNA, 22 bp, Homo sapiens
attccaattgtacttgctttta

SEQ ID NO: 9349099 - DNA, 22 bp, Homo sapiens
attccacaagaccataaattag

SEQ ID NO: 9349100 - DNA, 22 bp, Homo sapiens
attccaaaggttaatgcccatt

SEQ ID NO: 9349101 - DNA, 22 bp, Homo sapiens
attcacaagttgatggatattt

SEQ ID NO: 9349102 - DNA, 22 bp, Homo sapiens
attcacaagttgatggatattt

SEQ ID NO: 9349103 - DNA, 22 bp, Homo sapiens
attcatgaccccatggttgatt

SEQ ID NO: 9349104 - DNA, 22 bp, Homo sapiens
attccaaacttaccccagagga

SEQ ID NO: 9349105 - DNA, 22 bp, Homo sapiens
attccaaacagtgctgcagact

SEQ ID NO: 9349106 - DNA, 22 bp, Homo sapiens
attcacaaaatgatatagatac

SEQ ID NO: 9349107 - DNA, 22 bp, Homo sapiens
attcacaaagaagggaagtaca

SEQ ID NO: 9349108 - DNA, 22 bp, Homo sapiens
attcacaaaatgatatagatac

SEQ ID NO: 9349109 - DNA, 22 bp, Homo sapiens
attcacaaaatgatatagatac

SEQ ID NO: 9349110 - DNA, 22 bp, Homo sapiens
attcacaacaaaaggatatgag

SEQ ID NO: 9349111 - DNA, 22 bp, Homo sapiens
attcacaagttctagggattag

SEQ ID NO: 9349112 - DNA, 22 bp, Homo sapiens
attgcacagctgaatattttgg

SEQ ID NO: 9349113 - DNA, 22 bp, Homo sapiens
attgcacagctgaatattttgg

SEQ ID NO: 9349114 - DNA, 22 bp, Homo sapiens
attgcactccagcctgggggac

SEQ ID NO: 9349115 - DNA, 22 bp, Homo sapiens
attgcactccagcctgggtgac

SEQ ID NO: 9349116 - DNA, 22 bp, Homo sapiens
attgcactccggcctgggtgac

SEQ ID NO: 9349117 - DNA, 22 bp, Homo sapiens
gcatcagtagctatagttacaa

SEQ ID NO: 9349118 - DNA, 22 bp, Homo sapiens
gcatcatcacggtcaccgagcc

SEQ ID NO: 9349119 - DNA, 19 bp, Homo sapiens
gcatcatttgtctcttctt

SEQ ID NO: 9349120 - DNA, 22 bp, Homo sapiens
gcatggcaagatcaggagacca

SEQ ID NO: 9349121 - DNA, 22 bp, Homo sapiens
gcatggcagtgaggatggtgct

SEQ ID NO: 9349122 - DNA, 22 bp, Homo sapiens
gcatggcagtgaggatggtgct

SEQ ID NO: 9349123 - DNA, 22 bp, Homo sapiens
gcatggcaaatatcgagggcag

SEQ ID NO: 9349124 - DNA, 22 bp, Homo sapiens
gcatggcaagatcaggagacca

SEQ ID NO: 9349125 - DNA, 22 bp, Homo sapiens
gcatggaattcccttatgggcc

SEQ ID NO: 9349126 - DNA, 22 bp, Homo sapiens
gcatggagaagtgggaacaggt

SEQ ID NO: 9349127 - DNA, 22 bp, Homo sapiens
attgcaaaggtcccattcaaga

SEQ ID NO: 9349128 - DNA, 22 bp, Homo sapiens
attgcaaataactgtactgaat

SEQ ID NO: 9349129 - DNA, 22 bp, Homo sapiens
attcttttttaaggaatagaac

SEQ ID NO: 9349130 - DNA, 22 bp, Homo sapiens
attcttttttaaggaatagaac

SEQ ID NO: 9349131 - DNA, 19 bp, Homo sapiens
gcaggtggatgtggtcagc

SEQ ID NO: 9349132 - DNA, 19 bp, Homo sapiens
gcaggtggatgtggtcagc

SEQ ID NO: 9349133 - DNA, 19 bp, Homo sapiens
gcaggtggatgtggtcagc

SEQ ID NO: 9349134 - DNA, 18 bp, Homo sapiens
gcaggtgtggagaagggg

SEQ ID NO: 9349135 - DNA, 18 bp, Homo sapiens
gcaggtgtggagaagggg

SEQ ID NO: 9349136 - DNA, 22 bp, Homo sapiens
gcaggtgtgctgaattacgtga

SEQ ID NO: 9349137 - DNA, 22 bp, Homo sapiens
gcaggtgtgctgaattacgtga

SEQ ID NO: 9349138 - DNA, 22 bp, Homo sapiens
gcaggtgtgctgaattacgtga

SEQ ID NO: 9349139 - DNA, 22 bp, Homo sapiens
gcaggtgtggagtggggtgagc

SEQ ID NO: 9349140 - DNA, 22 bp, Homo sapiens
gcaggtgtggagagtggtcggg

SEQ ID NO: 9349141 - DNA, 22 bp, Homo sapiens
gcaggtgtggagagtggtcggg

SEQ ID NO: 9349142 - DNA, 22 bp, Homo sapiens
gcaggtgtggagagtggtcggg

SEQ ID NO: 9349143 - DNA, 22 bp, Homo sapiens
gcaggtgtgggtggctgccagg

SEQ ID NO: 9349144 - DNA, 22 bp, Homo sapiens
gcaggtgtggatttgcatccag

SEQ ID NO: 9349145 - DNA, 22 bp, Homo sapiens
gcaggtgtggatttgcatccag

SEQ ID NO: 9349146 - DNA, 22 bp, Homo sapiens
gcaggtgtggatttgcatccag

SEQ ID NO: 9349147 - DNA, 22 bp, Homo sapiens
gcaggtgtggagtggggtgagc

SEQ ID NO: 9349148 - DNA, 22 bp, Homo sapiens
gcaggtgtggagtggggtgagc

SEQ ID NO: 9349149 - DNA, 22 bp, Homo sapiens
gcaggtgttctcagaggaggct

SEQ ID NO: 9349150 - DNA, 21 bp, Homo sapiens
gcaggtgtggtatcagcttcc

SEQ ID NO: 9349151 - DNA, 21 bp, Homo sapiens
gcaggtgtggtatcagcttcc

SEQ ID NO: 9349152 - DNA, 22 bp, Homo sapiens
gcaggtgtgggtggctgccagg

SEQ ID NO: 9349153 - DNA, 22 bp, Homo sapiens
gcaggtgttttaagacattgaa

SEQ ID NO: 9349154 - DNA, 21 bp, Homo sapiens
gcaggtgtggtatcagcttcc

SEQ ID NO: 9349155 - DNA, 22 bp, Homo sapiens
gcaggtgttctcagaggaggct

SEQ ID NO: 9349156 - DNA, 22 bp, Homo sapiens
gcaggtgttttaagacattgaa

SEQ ID NO: 9349157 - DNA, 22 bp, Homo sapiens
gcaggtgttttaagacattgaa

SEQ ID NO: 9349158 - DNA, 22 bp, Homo sapiens
gcaggtgttttaagacattgaa

SEQ ID NO: 9349159 - DNA, 22 bp, Homo sapiens
gcaggtgttctcagaggaggct

SEQ ID NO: 9349160 - DNA, 22 bp, Homo sapiens
gcaggtgttttaagacattgaa

SEQ ID NO: 9349161 - DNA, 22 bp, Homo sapiens
gcagggcatagaggcacggagg

SEQ ID NO: 9349162 - DNA, 22 bp, Homo sapiens
gcagggcatagaggcacggagg

SEQ ID NO: 9349163 - DNA, 22 bp, Homo sapiens
gcagggcatccctgagcgggtg

SEQ ID NO: 9349164 - DNA, 22 bp, Homo sapiens
gcagggcatccctgagcgggtg

SEQ ID NO: 9349165 - DNA, 22 bp, Homo sapiens
gcagggcatagaggcacggagg

SEQ ID NO: 9349166 - DNA, 22 bp, Homo sapiens
gcagggcagtgtgtctgtgggg

SEQ ID NO: 9349167 - DNA, 22 bp, Homo sapiens
gcagggcagtgtgtctgtgggg

SEQ ID NO: 9349168 - DNA, 22 bp, Homo sapiens
gcagggcatccctgagcgggtg

SEQ ID NO: 9349169 - DNA, 22 bp, Homo sapiens
gcagggcatccctgagcgggtg

SEQ ID NO: 9349170 - DNA, 20 bp, Homo sapiens
gcagggcatcttggccccca

SEQ ID NO: 9349171 - DNA, 20 bp, Homo sapiens
gcagggcatcttggccccca

SEQ ID NO: 9349172 - DNA, 22 bp, Homo sapiens
attctttccagacactgattgc

SEQ ID NO: 9349173 - DNA, 22 bp, Homo sapiens
attctttccagacactgattgc

SEQ ID NO: 9349174 - DNA, 22 bp, Homo sapiens
attctttccagacactgattgc

SEQ ID NO: 9349175 - DNA, 20 bp, Homo sapiens
gcagggcatcttggccccca

SEQ ID NO: 9349176 - DNA, 20 bp, Homo sapiens
gcagggcatcttggccccca

SEQ ID NO: 9349177 - DNA, 22 bp, Homo sapiens
gcagggcatgggccctgtctgc

SEQ ID NO: 9349178 - DNA, 22 bp, Homo sapiens
attcttttaaatggcagtagta

SEQ ID NO: 9349179 - DNA, 22 bp, Homo sapiens
attctttggacaataagtggtg

SEQ ID NO: 9349180 - DNA, 22 bp, Homo sapiens
attcttttcccaactgctttaa

SEQ ID NO: 9349181 - DNA, 22 bp, Homo sapiens
attcttttcccaactgctttaa

SEQ ID NO: 9349182 - DNA, 22 bp, Homo sapiens
attcttttcccaactgctttaa

SEQ ID NO: 9349183 - DNA, 22 bp, Homo sapiens
attcttttaagccccagggatt

SEQ ID NO: 9349184 - DNA, 22 bp, Homo sapiens
attcttttaagccccagggatt

SEQ ID NO: 9349185 - DNA, 22 bp, Homo sapiens
attcttttgtcctagcttgata

SEQ ID NO: 9349186 - DNA, 22 bp, Homo sapiens
attcttttgtcctagcttgata

SEQ ID NO: 9349187 - DNA, 22 bp, Homo sapiens
attctgctagtaacagatgaag

SEQ ID NO: 9349188 - DNA, 22 bp, Homo sapiens
attctgcatgtaggtttgctca

SEQ ID NO: 9349189 - DNA, 22 bp, Homo sapiens
attctgcacttcctttgcttcc

SEQ ID NO: 9349190 - DNA, 22 bp, Homo sapiens
attctgcacatccaagaacagg

SEQ ID NO: 9349191 - DNA, 22 bp, Homo sapiens
attctgcacttcctttgcttcc

SEQ ID NO: 9349192 - DNA, 22 bp, Homo sapiens
attctgcataatttcctggcag

SEQ ID NO: 9349193 - DNA, 22 bp, Homo sapiens
attctgcaggtggaggatggca

SEQ ID NO: 9349194 - DNA, 22 bp, Homo sapiens
attctgcatggtggtgtctctg

SEQ ID NO: 9349195 - DNA, 20 bp, Homo sapiens
gcaggcagggaatgggggtg

SEQ ID NO: 9349196 - DNA, 20 bp, Homo sapiens
gcaggcagggaatgggggtg

SEQ ID NO: 9349197 - DNA, 22 bp, Homo sapiens
gcaggcaggtggcatcttgtga

SEQ ID NO: 9349198 - DNA, 15 bp, Homo sapiens
gcaggcaggtcacct

SEQ ID NO: 9349199 - DNA, 22 bp, Homo sapiens
attctgatgcttcacaaaggta

SEQ ID NO: 9349200 - DNA, 22 bp, Homo sapiens
attctgcaactgttgttggtgg

SEQ ID NO: 9349201 - DNA, 22 bp, Homo sapiens
attctgcacatccaagaacagg

SEQ ID NO: 9349202 - DNA, 22 bp, Homo sapiens
attctgctccacactgattcat

SEQ ID NO: 9349203 - DNA, 22 bp, Homo sapiens
attctgctagttaatatctctc

SEQ ID NO: 9349204 - DNA, 22 bp, Homo sapiens
attctgctgcctagtttatgaa

SEQ ID NO: 9349205 - DNA, 20 bp, Homo sapiens
attctgctttctgatagagc

SEQ ID NO: 9349206 - DNA, 22 bp, Homo sapiens
attctgcttttgctgacctacc

SEQ ID NO: 9349207 - DNA, 20 bp, Homo sapiens
attctgctttgaaaataagg

SEQ ID NO: 9349208 - DNA, 22 bp, Homo sapiens
attctggaaagctattctctct

SEQ ID NO: 9349209 - DNA, 22 bp, Homo sapiens
attctgctggtaactctataaa

SEQ ID NO: 9349210 - DNA, 22 bp, Homo sapiens
attctgcttcttatttcacgtg

SEQ ID NO: 9349211 - DNA, 22 bp, Homo sapiens
gcagggcagtgtgtctgtgggg

SEQ ID NO: 9349212 - DNA, 22 bp, Homo sapiens
gcagggcagtgtgtctgtgggg

SEQ ID NO: 9349213 - DNA, 22 bp, Homo sapiens
gcagggcagtgtgtctgtgggg

SEQ ID NO: 9349214 - DNA, 22 bp, Homo sapiens
gcagggcagtaagagctagagt

SEQ ID NO: 9349215 - DNA, 22 bp, Homo sapiens
gcagggcaaacccaggtgttca

SEQ ID NO: 9349216 - DNA, 22 bp, Homo sapiens
gcagggcagtaagagctagagt

SEQ ID NO: 9349217 - DNA, 22 bp, Homo sapiens
gcagggcaaacccaggtgttca

SEQ ID NO: 9349218 - DNA, 22 bp, Homo sapiens
attctggaaagctattctctct

SEQ ID NO: 9349219 - DNA, 22 bp, Homo sapiens
attctggaaagctattctctct

SEQ ID NO: 9349220 - DNA, 22 bp, Homo sapiens
gctcccaggatgaggagccagg

SEQ ID NO: 9349221 - DNA, 22 bp, Homo sapiens
gctccagggaacagaatgtact

SEQ ID NO: 9349222 - DNA, 22 bp, Homo sapiens
gctcccagggacactggccact

SEQ ID NO: 9349223 - DNA, 22 bp, Homo sapiens
gctcccaggcatggaggtaatt

SEQ ID NO: 9349224 - DNA, 22 bp, Homo sapiens
gctccccaaaagctccaggaaa

SEQ ID NO: 9349225 - DNA, 22 bp, Homo sapiens
gctcccagtctgatggaggaga

SEQ ID NO: 9349226 - DNA, 22 bp, Homo sapiens
gctccccagcttagccctggct

SEQ ID NO: 9349227 - DNA, 22 bp, Homo sapiens
gctccccagcttagccctggct

SEQ ID NO: 9349228 - DNA, 22 bp, Homo sapiens
gctccccaaaagctccaggaaa

SEQ ID NO: 9349229 - DNA, 22 bp, Homo sapiens
gctcccagggcagcgcagaaga

SEQ ID NO: 9349230 - DNA, 22 bp, Homo sapiens
gctcccagggcagcgcagaaga

SEQ ID NO: 9349231 - DNA, 22 bp, Homo sapiens
gctcccagtctgatggaggaga

SEQ ID NO: 9349232 - DNA, 22 bp, Homo sapiens
caaagaatcactcatctttagc

SEQ ID NO: 9349233 - DNA, 22 bp, Homo sapiens
caaagaatagcatggcatttgt

SEQ ID NO: 9349234 - DNA, 22 bp, Homo sapiens
caaagaaggaactataatccca

SEQ ID NO: 9349235 - DNA, 22 bp, Homo sapiens
gctccccaggctggtcccctcg

SEQ ID NO: 9349236 - DNA, 22 bp, Homo sapiens
caaagaagagatttacagagct

SEQ ID NO: 9349237 - DNA, 22 bp, Homo sapiens
caaagaagagatttacagagct

SEQ ID NO: 9349238 - DNA, 22 bp, Homo sapiens
caaagaagagatttacagagct

SEQ ID NO: 9349239 - DNA, 22 bp, Homo sapiens
caaagacacgggaaacaacgtt

SEQ ID NO: 9349240 - DNA, 22 bp, Homo sapiens
caaagactgcataacacatgaa

SEQ ID NO: 9349241 - DNA, 22 bp, Homo sapiens
caaagactgcataacacatgaa

SEQ ID NO: 9349242 - DNA, 22 bp, Homo sapiens
caaagaggtgagaggagccttt

SEQ ID NO: 9349243 - DNA, 22 bp, Homo sapiens
gctctgctgtggaatcctctcc

SEQ ID NO: 9349244 - DNA, 22 bp, Homo sapiens
gctctgagataaacgttgccct

SEQ ID NO: 9349245 - DNA, 22 bp, Homo sapiens
gctctgagagtgggtgattctg

SEQ ID NO: 9349246 - DNA, 22 bp, Homo sapiens
gctctgagattgagcctttggt

SEQ ID NO: 9349247 - DNA, 22 bp, Homo sapiens
gctcagagaaaactggggcttg

SEQ ID NO: 9349248 - DNA, 22 bp, Homo sapiens
gctcagagaaagattagtccct

SEQ ID NO: 9349249 - DNA, 22 bp, Homo sapiens
gctcagagaaattataggaatt

SEQ ID NO: 9349250 - DNA, 22 bp, Homo sapiens
gctcagagaaaactggggcttg

SEQ ID NO: 9349251 - DNA, 22 bp, Homo sapiens
gctcagactgcacaccctggtc

SEQ ID NO: 9349252 - DNA, 22 bp, Homo sapiens
gctcagactgcacaccctggtc

SEQ ID NO: 9349253 - DNA, 22 bp, Homo sapiens
gctcagactctggcctgatgat

SEQ ID NO: 9349254 - DNA, 22 bp, Homo sapiens
gctcagacttgttttacaggct

SEQ ID NO: 9349255 - DNA, 22 bp, Homo sapiens
gctcagacttgttttacaggct

SEQ ID NO: 9349256 - DNA, 22 bp, Homo sapiens
gctcaaatcccagcgggctcct

SEQ ID NO: 9349257 - DNA, 22 bp, Homo sapiens
gctcaaatgtcatggggagcct

SEQ ID NO: 9349258 - DNA, 22 bp, Homo sapiens
attttgatgctatctaatgaat

SEQ ID NO: 9349259 - DNA, 22 bp, Homo sapiens
attttgatgtatctttgtagct

SEQ ID NO: 9349260 - DNA, 22 bp, Homo sapiens
attttgcacactatgcagcttt

SEQ ID NO: 9349261 - DNA, 17 bp, Homo sapiens
gccttccttcctccaca

SEQ ID NO: 9349262 - DNA, 22 bp, Homo sapiens
attttgactgcattacagaaca

SEQ ID NO: 9349263 - DNA, 22 bp, Homo sapiens
attttgactgcattacagaaca

SEQ ID NO: 9349264 - DNA, 22 bp, Homo sapiens
attttgataatcatgttagaga

SEQ ID NO: 9349265 - DNA, 22 bp, Homo sapiens
gctcagagaatttactgctgcc

SEQ ID NO: 9349266 - DNA, 22 bp, Homo sapiens
gctcagagaatcagcagacacc

SEQ ID NO: 9349267 - DNA, 22 bp, Homo sapiens
gctcagagaatttactgctgcc

SEQ ID NO: 9349268 - DNA, 22 bp, Homo sapiens
gctcagagaagttgtgcctggc

SEQ ID NO: 9349269 - DNA, 22 bp, Homo sapiens
gctcagagaatcagcagacacc

SEQ ID NO: 9349270 - DNA, 22 bp, Homo sapiens
gctcagagaagttaaggaattt

SEQ ID NO: 9349271 - DNA, 22 bp, Homo sapiens
gctcagagaagcggtttcgcct

SEQ ID NO: 9349272 - DNA, 22 bp, Homo sapiens
gctcagagagaggctcaccatt

SEQ ID NO: 9349273 - DNA, 22 bp, Homo sapiens
gctcagagagaggatatgttat

SEQ ID NO: 9349274 - DNA, 19 bp, Homo sapiens
gctcagagacacctgttgc

SEQ ID NO: 9349275 - DNA, 19 bp, Homo sapiens
gctcagagacacctgttgc

SEQ ID NO: 9349276 - DNA, 21 bp, Homo sapiens
gctcagagagggtaattaacc

SEQ ID NO: 9349277 - DNA, 22 bp, Homo sapiens
gctcagagagattaaataattt

SEQ ID NO: 9349278 - DNA, 22 bp, Homo sapiens
gctcagagagtttcacaagttt

SEQ ID NO: 9349279 - DNA, 22 bp, Homo sapiens
caaaagaagctcttggggctag

SEQ ID NO: 9349280 - DNA, 20 bp, Homo sapiens
caaaagcaatgaagttatga

SEQ ID NO: 9349281 - DNA, 22 bp, Homo sapiens
gcctgtgctgttccctctgcca

SEQ ID NO: 9349282 - DNA, 22 bp, Homo sapiens
gcctgtgcttaactgacgtgag

SEQ ID NO: 9349283 - DNA, 22 bp, Homo sapiens
gccttccagaatacacatagca

SEQ ID NO: 9349284 - DNA, 17 bp, Homo sapiens
gccttccagcatgtggg

SEQ ID NO: 9349285 - DNA, 17 bp, Homo sapiens
gccttccagcatgtggg

SEQ ID NO: 9349286 - DNA, 22 bp, Homo sapiens
attttccttctaagaggaaggt

SEQ ID NO: 9349287 - DNA, 22 bp, Homo sapiens
attttcctctggtttccccaga

SEQ ID NO: 9349288 - DNA, 22 bp, Homo sapiens
attttcctccatgtgagcagtt

SEQ ID NO: 9349289 - DNA, 22 bp, Homo sapiens
attttcctccatgtgagcagtt

SEQ ID NO: 9349290 - DNA, 22 bp, Homo sapiens
attttcctagtcatgtgcttct

SEQ ID NO: 9349291 - DNA, 22 bp, Homo sapiens
gccttcctgcagctctgagcgt

SEQ ID NO: 9349292 - DNA, 22 bp, Homo sapiens
gccttccttacacctgctcagc

SEQ ID NO: 9349293 - DNA, 22 bp, Homo sapiens
gccttccttacacctgctcagc

SEQ ID NO: 9349294 - DNA, 22 bp, Homo sapiens
gccttccctctcatcctgctgg

SEQ ID NO: 9349295 - DNA, 19 bp, Homo sapiens
gccttcccaccacccgtcc

SEQ ID NO: 9349296 - DNA, 20 bp, Homo sapiens
gccttccagttcagtggcac

SEQ ID NO: 9349297 - DNA, 20 bp, Homo sapiens
gccttccagttcagtggcac

SEQ ID NO: 9349298 - DNA, 22 bp, Homo sapiens
gccttcccaagacgcctgagtt

SEQ ID NO: 9349299 - DNA, 21 bp, Homo sapiens
attttcattaattcagtgtgg

SEQ ID NO: 9349300 - DNA, 22 bp, Homo sapiens
attttccagcctttctagaact

SEQ ID NO: 9349301 - DNA, 22 bp, Homo sapiens
attttccatctccacaccaggg

SEQ ID NO: 9349302 - DNA, 22 bp, Homo sapiens
attttccaaaataattgttact

SEQ ID NO: 9349303 - DNA, 22 bp, Homo sapiens
attttccaaaataattgttact

SEQ ID NO: 9349304 - DNA, 22 bp, Homo sapiens
attttccaaaataattgttact

SEQ ID NO: 9349305 - DNA, 22 bp, Homo sapiens
attttcagttgaaaaagttggt

SEQ ID NO: 9349306 - DNA, 22 bp, Homo sapiens
attttcagtgtaaatgttttat

SEQ ID NO: 9349307 - DNA, 22 bp, Homo sapiens
attttcatcatgggtttaacat

SEQ ID NO: 9349308 - DNA, 22 bp, Homo sapiens
attttcatggcttctgctcagt

SEQ ID NO: 9349309 - DNA, 22 bp, Homo sapiens
atttggaatgtgtttgatcacc

SEQ ID NO: 9349310 - DNA, 22 bp, Homo sapiens
atttcttcctctgtcagtaact

SEQ ID NO: 9349311 - DNA, 22 bp, Homo sapiens
atttcttcctctgtcagtaact

SEQ ID NO: 9349312 - DNA, 22 bp, Homo sapiens
atttcttcctctgtcagtaact

SEQ ID NO: 9349313 - DNA, 22 bp, Homo sapiens
atttgggcagtccatgaaataa

SEQ ID NO: 9349314 - DNA, 22 bp, Homo sapiens
atttggttactcagttgtctga

SEQ ID NO: 9349315 - DNA, 22 bp, Homo sapiens
atttgtaaagtgcttaaaagta

SEQ ID NO: 9349316 - DNA, 22 bp, Homo sapiens
atttgtacaaatttatgttagt

SEQ ID NO: 9349317 - DNA, 22 bp, Homo sapiens
atttgtaagctagagccatgat

SEQ ID NO: 9349318 - DNA, 22 bp, Homo sapiens
atttgtatcaatctcaatatat

SEQ ID NO: 9349319 - DNA, 22 bp, Homo sapiens
atttgtatcttctaatattatc

SEQ ID NO: 9349320 - DNA, 22 bp, Homo sapiens
atttgtatcttctaatattatc

SEQ ID NO: 9349321 - DNA, 22 bp, Homo sapiens
attttcaggttttgccattgta

SEQ ID NO: 9349322 - DNA, 22 bp, Homo sapiens
attttcagtctggctggaccca

SEQ ID NO: 9349323 - DNA, 22 bp, Homo sapiens
atttgtctaatgagtgtgtact

SEQ ID NO: 9349324 - DNA, 22 bp, Homo sapiens
gccatctggcattgcagcacct

SEQ ID NO: 9349325 - DNA, 19 bp, Homo sapiens
atttattgtatgattccat

SEQ ID NO: 9349326 - DNA, 19 bp, Homo sapiens
atttattgtatgattccat

SEQ ID NO: 9349327 - DNA, 19 bp, Homo sapiens
atttattgtatgattccat

SEQ ID NO: 9349328 - DNA, 19 bp, Homo sapiens
atttattgtatgattccat

SEQ ID NO: 9349329 - DNA, 22 bp, Homo sapiens
gccatgcctgtgtctccaggcc

SEQ ID NO: 9349330 - DNA, 22 bp, Homo sapiens
atttattggtttgcatggtgaa

SEQ ID NO: 9349331 - DNA, 22 bp, Homo sapiens
atttattggtttgcatggtgaa

SEQ ID NO: 9349332 - DNA, 19 bp, Homo sapiens
gcccaggggcccgatgctg

SEQ ID NO: 9349333 - DNA, 22 bp, Homo sapiens
atttcaagtccaagtcttgggt

SEQ ID NO: 9349334 - DNA, 22 bp, Homo sapiens
atttcaaggctattaatataaa

SEQ ID NO: 9349335 - DNA, 19 bp, Homo sapiens
atttcaagaggtttattgg

SEQ ID NO: 9349336 - DNA, 22 bp, Homo sapiens
atttcaacgttagatgtaatag

SEQ ID NO: 9349337 - DNA, 22 bp, Homo sapiens
atttcaaggactacttttcaat

SEQ ID NO: 9349338 - DNA, 22 bp, Homo sapiens
atttcaagaaggcagcagtggt

SEQ ID NO: 9349339 - DNA, 22 bp, Homo sapiens
gcccagtgccctagaatgcact

SEQ ID NO: 9349340 - DNA, 22 bp, Homo sapiens
gcccagtctcttctggccctgt

SEQ ID NO: 9349341 - DNA, 22 bp, Homo sapiens
gcccagtctcttctggccctgt

SEQ ID NO: 9349342 - DNA, 22 bp, Homo sapiens
gcccagtagttcaaggttgcag

SEQ ID NO: 9349343 - DNA, 22 bp, Homo sapiens
gcccagtagttcaaggttgcag

SEQ ID NO: 9349344 - DNA, 22 bp, Homo sapiens
gcccagtagttcaaggttgcag

SEQ ID NO: 9349345 - DNA, 22 bp, Homo sapiens
gcccagggtgaagtgcagttgt

SEQ ID NO: 9349346 - DNA, 22 bp, Homo sapiens
gcccaggtgccctctgccttac

SEQ ID NO: 9349347 - DNA, 22 bp, Homo sapiens
gcccaggtttcatctgctccgt

SEQ ID NO: 9349348 - DNA, 22 bp, Homo sapiens
gcccaggtttcatctgctccgt

SEQ ID NO: 9349349 - DNA, 22 bp, Homo sapiens
gccctggggaaggtgtctccaa

SEQ ID NO: 9349350 - DNA, 22 bp, Homo sapiens
gccctggggaaggtgtctccaa

SEQ ID NO: 9349351 - DNA, 22 bp, Homo sapiens
gccctggggaaggtgtctccaa

SEQ ID NO: 9349352 - DNA, 22 bp, Homo sapiens
gccctggggaaggtgtctccaa

SEQ ID NO: 9349353 - DNA, 22 bp, Homo sapiens
gccctggggaaggtgtctccaa

SEQ ID NO: 9349354 - DNA, 22 bp, Homo sapiens
gccctgggctccctgctccaca

SEQ ID NO: 9349355 - DNA, 22 bp, Homo sapiens
gccctgggctccctgctccaca

SEQ ID NO: 9349356 - DNA, 22 bp, Homo sapiens
gccctgggctccctgctccaca

SEQ ID NO: 9349357 - DNA, 22 bp, Homo sapiens
gccctgggctccctgctccaca

SEQ ID NO: 9349358 - DNA, 17 bp, Homo sapiens
gccctgcctgctgccct

SEQ ID NO: 9349359 - DNA, 23 bp, Homo sapiens
atttcctaaaagataatcattac

SEQ ID NO: 9349360 - DNA, 23 bp, Homo sapiens
atttcccattgtgtcagcagagc

SEQ ID NO: 9349361 - DNA, 23 bp, Homo sapiens
atttcctactataaaagaggtaa

SEQ ID NO: 9349362 - DNA, 22 bp, Homo sapiens
atttcctaacagaggcaacagt

SEQ ID NO: 9349363 - DNA, 22 bp, Homo sapiens
atttcctaatttagggatagac

SEQ ID NO: 9349364 - DNA, 22 bp, Homo sapiens
atttcctaatttatgcaggagt

SEQ ID NO: 9349365 - DNA, 22 bp, Homo sapiens
gcccagtgggaagctaaggtgg

SEQ ID NO: 9349366 - DNA, 22 bp, Homo sapiens
gcccagtggtaaaagcaggcct

SEQ ID NO: 9349367 - DNA, 22 bp, Homo sapiens
gcccagtgctgagggtgctgct

SEQ ID NO: 9349368 - DNA, 22 bp, Homo sapiens
atttcccactctactacatgct

SEQ ID NO: 9349369 - DNA, 22 bp, Homo sapiens
atttcccaatacgctaagtgga

SEQ ID NO: 9349370 - DNA, 22 bp, Homo sapiens
gccctggttttagaggagcagg

SEQ ID NO: 9349371 - DNA, 18 bp, Homo sapiens
gccctggtggagctggtg

SEQ ID NO: 9349372 - DNA, 18 bp, Homo sapiens
gccctggtggagctggtg

SEQ ID NO: 9349373 - DNA, 22 bp, Homo sapiens
gccctggtgtgcccagcatggg

SEQ ID NO: 9349374 - DNA, 22 bp, Homo sapiens
gccctggtgtgcccagcatggg

SEQ ID NO: 9349375 - DNA, 22 bp, Homo sapiens
gccctggttttagaggagcagg

SEQ ID NO: 9349376 - DNA, 20 bp, Homo sapiens
gccctgtgatgtcttgacct

SEQ ID NO: 9349377 - DNA, 20 bp, Homo sapiens
gccctgtgatgtcttgacct

SEQ ID NO: 9349378 - DNA, 20 bp, Homo sapiens
gccctgtgatgtcttgacct

SEQ ID NO: 9349379 - DNA, 22 bp, Homo sapiens
gccctgtgccagtcacgctgtg

SEQ ID NO: 9349380 - DNA, 22 bp, Homo sapiens
gccctgtgcaggtgtgcagcag

SEQ ID NO: 9349381 - DNA, 22 bp, Homo sapiens
atttcttatgaatattgactgt

SEQ ID NO: 9349382 - DNA, 22 bp, Homo sapiens
atttcttacataacaaattgtt

SEQ ID NO: 9349383 - DNA, 22 bp, Homo sapiens
atttctgtttgctactataagt

SEQ ID NO: 9349384 - DNA, 22 bp, Homo sapiens
atttctgtttgctactataagt

SEQ ID NO: 9349385 - DNA, 22 bp, Homo sapiens
atttctgtttgctactataagt

SEQ ID NO: 9349386 - DNA, 22 bp, Homo sapiens
atttcttcaggtcagaaataga

SEQ ID NO: 9349387 - DNA, 22 bp, Homo sapiens
atttcttatgaatattgactgt

SEQ ID NO: 9349388 - DNA, 22 bp, Homo sapiens
atttcttccattgcctcttcaa

SEQ ID NO: 9349389 - DNA, 22 bp, Homo sapiens
atttcttcaggttcttctagga

SEQ ID NO: 9349390 - DNA, 22 bp, Homo sapiens
atttcttcaggttcttctagga

SEQ ID NO: 9349391 - DNA, 22 bp, Homo sapiens
atttattatgggatttggcaca

SEQ ID NO: 9349392 - DNA, 22 bp, Homo sapiens
atttattacctcggagtttctg

SEQ ID NO: 9349393 - DNA, 22 bp, Homo sapiens
gccatcatatcccctgtgacct

SEQ ID NO: 9349394 - DNA, 22 bp, Homo sapiens
gccaggtggctgagcagctgca

SEQ ID NO: 9349395 - DNA, 22 bp, Homo sapiens
gccaggtggctgagcagctgca

SEQ ID NO: 9349396 - DNA, 22 bp, Homo sapiens
gccaggtggctgagcagctgca

SEQ ID NO: 9349397 - DNA, 22 bp, Homo sapiens
atttatgtatctgtgtagatca

SEQ ID NO: 9349398 - DNA, 22 bp, Homo sapiens
atttatgtatctgtgtagatca

SEQ ID NO: 9349399 - DNA, 22 bp, Homo sapiens
atttatgtatctgtgtagatca

SEQ ID NO: 9349400 - DNA, 22 bp, Homo sapiens
atttattaagcatctgctatgt

SEQ ID NO: 9349401 - DNA, 22 bp, Homo sapiens
atttatgattagcctattgttg

SEQ ID NO: 9349402 - DNA, 18 bp, Homo sapiens
atttatgctaatgggata

SEQ ID NO: 9349403 - DNA, 22 bp, Homo sapiens
atttatgactggtgaatagaac

SEQ ID NO: 9349404 - DNA, 22 bp, Homo sapiens
atttatagggcattgaaaactg

SEQ ID NO: 9349405 - DNA, 22 bp, Homo sapiens
atttatattttgggagctcctg

SEQ ID NO: 9349406 - DNA, 22 bp, Homo sapiens
atttatcaacatgtaccattgg

SEQ ID NO: 9349407 - DNA, 22 bp, Homo sapiens
atttatcaccagttagctgact

SEQ ID NO: 9349408 - DNA, 22 bp, Homo sapiens
atttatctctggaaactaagca

SEQ ID NO: 9349409 - DNA, 22 bp, Homo sapiens
atttataacgtgcagccagggt

SEQ ID NO: 9349410 - DNA, 22 bp, Homo sapiens
atttagtttaggaaaagtaggt

SEQ ID NO: 9349411 - DNA, 22 bp, Homo sapiens
gccagctggagtgagagtgggc

SEQ ID NO: 9349412 - DNA, 21 bp, Homo sapiens
atttagaaggaaattttgcaa

SEQ ID NO: 9349413 - DNA, 22 bp, Homo sapiens
gccagctggaaatctgcttgaa

SEQ ID NO: 9349414 - DNA, 22 bp, Homo sapiens
gccagctggaaatctgcttgaa

SEQ ID NO: 9349415 - DNA, 22 bp, Homo sapiens
gccagctggaaatctgcttgaa

SEQ ID NO: 9349416 - DNA, 22 bp, Homo sapiens
gccagctgcttctccagaattt

SEQ ID NO: 9349417 - DNA, 22 bp, Homo sapiens
gccagctgcttctccagaattt

SEQ ID NO: 9349418 - DNA, 22 bp, Homo sapiens
gccagctggagactggcagggg

SEQ ID NO: 9349419 - DNA, 22 bp, Homo sapiens
gccagctggagactggcagggg

SEQ ID NO: 9349420 - DNA, 22 bp, Homo sapiens
gccagctggagactggcagggg

SEQ ID NO: 9349421 - DNA, 22 bp, Homo sapiens
gccagctggagactggcagggg

SEQ ID NO: 9349422 - DNA, 22 bp, Homo sapiens
gccagccataggccagcactgg

SEQ ID NO: 9349423 - DNA, 21 bp, Homo sapiens
gccagctgcagggcttccttg

SEQ ID NO: 9349424 - DNA, 22 bp, Homo sapiens
gccagctgcatctcctgggctg

SEQ ID NO: 9349425 - DNA, 22 bp, Homo sapiens
gccagctgcatctcctgggctg

SEQ ID NO: 9349426 - DNA, 22 bp, Homo sapiens
gccagctgccctctgctggtcc

SEQ ID NO: 9349427 - DNA, 22 bp, Homo sapiens
gccagctgccaagttgtgagat

SEQ ID NO: 9349428 - DNA, 22 bp, Homo sapiens
gccagctgccctctgctggtcc

SEQ ID NO: 9349429 - DNA, 22 bp, Homo sapiens
gccagctgctcgcgtagggtag

SEQ ID NO: 9349430 - DNA, 22 bp, Homo sapiens
gccagctgctggaacagcgcga

SEQ ID NO: 9349431 - DNA, 22 bp, Homo sapiens
gccagccagtttgctgatggct

SEQ ID NO: 9349432 - DNA, 22 bp, Homo sapiens
gccagccagggaagggagagac

SEQ ID NO: 9349433 - DNA, 22 bp, Homo sapiens
gccagccagagtccatctgaga

SEQ ID NO: 9349434 - DNA, 22 bp, Homo sapiens
gccagccagagaggcatggtta

SEQ ID NO: 9349435 - DNA, 22 bp, Homo sapiens
gccagccagagtggctgtgtgt

SEQ ID NO: 9349436 - DNA, 22 bp, Homo sapiens
gccagccagagaggcatggtta

SEQ ID NO: 9349437 - DNA, 22 bp, Homo sapiens
gccagccacttcccagactggc

SEQ ID NO: 9349438 - DNA, 22 bp, Homo sapiens
gccagccacttcccagactggc

SEQ ID NO: 9349439 - DNA, 22 bp, Homo sapiens
gcatggcattaacaagatggaa

SEQ ID NO: 9349440 - DNA, 22 bp, Homo sapiens
gcatggcattaacaagatggaa

SEQ ID NO: 9349441 - DNA, 22 bp, Homo sapiens
gcatggcatttgaaggtagaag

SEQ ID NO: 9349442 - DNA, 22 bp, Homo sapiens
gcatggcatttgaaggtagaag

SEQ ID NO: 9349443 - DNA, 22 bp, Homo sapiens
attgtacactagtggcagcagt

SEQ ID NO: 9349444 - DNA, 22 bp, Homo sapiens
attgtacagacatgggaaacaa

SEQ ID NO: 9349445 - DNA, 22 bp, Homo sapiens
attgtacataaaatgtatgtct

SEQ ID NO: 9349446 - DNA, 22 bp, Homo sapiens
attgtacataaaatgtatgtct

SEQ ID NO: 9349447 - DNA, 22 bp, Homo sapiens
attgtacatatgatgtatgtaa

SEQ ID NO: 9349448 - DNA, 22 bp, Homo sapiens
attgtacataaaatgtatgtct

SEQ ID NO: 9349449 - DNA, 22 bp, Homo sapiens
attgtacatatgatgtatgtaa

SEQ ID NO: 9349450 - DNA, 22 bp, Homo sapiens
attgtacatgcagtgagtcatc

SEQ ID NO: 9349451 - DNA, 22 bp, Homo sapiens
attgtacatatgatgtatgtaa

SEQ ID NO: 9349452 - DNA, 22 bp, Homo sapiens
attgtacatgcagtgagtcatc

SEQ ID NO: 9349453 - DNA, 22 bp, Homo sapiens
attgtactagaaattgtattca

SEQ ID NO: 9349454 - DNA, 19 bp, Homo sapiens
attgtacattgagtttggc

SEQ ID NO: 9349455 - DNA, 19 bp, Homo sapiens
attgtacattgagtttggc

SEQ ID NO: 9349456 - DNA, 22 bp, Homo sapiens
attgtacatgcagtgagtcatc

SEQ ID NO: 9349457 - DNA, 22 bp, Homo sapiens
attgtactcacaaaacatgagt

SEQ ID NO: 9349458 - DNA, 22 bp, Homo sapiens
attgtactcacaaaacatgagt

SEQ ID NO: 9349459 - DNA, 22 bp, Homo sapiens
attgtactggtaaagaagtggg

SEQ ID NO: 9349460 - DNA, 20 bp, Homo sapiens
attgtacttctgttgatggt

SEQ ID NO: 9349461 - DNA, 22 bp, Homo sapiens
gccagccaagattgagaaggta

SEQ ID NO: 9349462 - DNA, 22 bp, Homo sapiens
gccagagtgccatcagtgccat

SEQ ID NO: 9349463 - DNA, 22 bp, Homo sapiens
gccagccacgttagactggccc

SEQ ID NO: 9349464 - DNA, 22 bp, Homo sapiens
aatgttcattgattaaatgaat

SEQ ID NO: 9349465 - DNA, 22 bp, Homo sapiens
aatgttcagtagaataggaatg

SEQ ID NO: 9349466 - DNA, 22 bp, Homo sapiens
aatgttgcagagtgattgtcca

SEQ ID NO: 9349467 - DNA, 22 bp, Homo sapiens
aatgttgcagagtgattgtcca

SEQ ID NO: 9349468 - DNA, 22 bp, Homo sapiens
aatgttgacctcctgaatgttt

SEQ ID NO: 9349469 - DNA, 22 bp, Homo sapiens
aatgttgacctcctgaatgttt

SEQ ID NO: 9349470 - DNA, 22 bp, Homo sapiens
aatgttctgatgtagggtttag

SEQ ID NO: 9349471 - DNA, 22 bp, Homo sapiens
aatgttgacagtggtgatctca

SEQ ID NO: 9349472 - DNA, 22 bp, Homo sapiens
aatgttatttctgcatagtagt

SEQ ID NO: 9349473 - DNA, 22 bp, Homo sapiens
aatgttattgtcctttccaaaa

SEQ ID NO: 9349474 - DNA, 22 bp, Homo sapiens
aatgttatttctgcatagtagt

SEQ ID NO: 9349475 - DNA, 22 bp, Homo sapiens
aatgttcaaacagatcacttag

SEQ ID NO: 9349476 - DNA, 22 bp, Homo sapiens
aatgtttcaattaagtctttta

SEQ ID NO: 9349477 - DNA, 22 bp, Homo sapiens
aatgtttgagcatctacatgct

SEQ ID NO: 9349478 - DNA, 22 bp, Homo sapiens
aatgtttgcatctattcacatg

SEQ ID NO: 9349479 - DNA, 22 bp, Homo sapiens
aatgtttaatgttagtggtaat

SEQ ID NO: 9349480 - DNA, 19 bp, Homo sapiens
aatgtttaagagaaaaagg

SEQ ID NO: 9349481 - DNA, 19 bp, Homo sapiens
aatgtttaagagaaaaagg

SEQ ID NO: 9349482 - DNA, 22 bp, Homo sapiens
aatgttgtgcatgtattttgta

SEQ ID NO: 9349483 - DNA, 22 bp, Homo sapiens
aattagctgtcaatgaggatct

SEQ ID NO: 9349484 - DNA, 22 bp, Homo sapiens
aattagctgcaaaggatgttat

SEQ ID NO: 9349485 - DNA, 20 bp, Homo sapiens
aattagcttaagtcaatcag

SEQ ID NO: 9349486 - DNA, 22 bp, Homo sapiens
aattactgatctacaaaatcca

SEQ ID NO: 9349487 - DNA, 22 bp, Homo sapiens
aattagcttatgtgtacttttc

SEQ ID NO: 9349488 - DNA, 22 bp, Homo sapiens
aattagctttacctaggattgt

SEQ ID NO: 9349489 - DNA, 22 bp, Homo sapiens
aattagcttcagcttgtggggc

SEQ ID NO: 9349490 - DNA, 22 bp, Homo sapiens
aatgtttgcatctattcacatg

SEQ ID NO: 9349491 - DNA, 22 bp, Homo sapiens
aattagctttccgccatcacac

SEQ ID NO: 9349492 - DNA, 22 bp, Homo sapiens
aattagcttatgtgtacttttc

SEQ ID NO: 9349493 - DNA, 22 bp, Homo sapiens
aattagtaacctaattccatct

SEQ ID NO: 9349494 - DNA, 22 bp, Homo sapiens
aatttacacttcatttggaggg

SEQ ID NO: 9349495 - DNA, 22 bp, Homo sapiens
aatttacacttcatttggaggg

SEQ ID NO: 9349496 - DNA, 22 bp, Homo sapiens
aatttacacttcatttggaggg

SEQ ID NO: 9349497 - DNA, 22 bp, Homo sapiens
aatttacaggtgcactcgccat

SEQ ID NO: 9349498 - DNA, 22 bp, Homo sapiens
aatttacaggtgcactcgccat

SEQ ID NO: 9349499 - DNA, 22 bp, Homo sapiens
aatttacagttgctgatggtac

SEQ ID NO: 9349500 - DNA, 22 bp, Homo sapiens
aatttacagttgctgatggtac

SEQ ID NO: 9349501 - DNA, 22 bp, Homo sapiens
aatttacagttgctgatggtac

SEQ ID NO: 9349502 - DNA, 22 bp, Homo sapiens
agagctggggccagagtcaagg

SEQ ID NO: 9349503 - DNA, 22 bp, Homo sapiens
agagctgggacttggactcaat

SEQ ID NO: 9349504 - DNA, 22 bp, Homo sapiens
aatttatatgtaattaggcaca

SEQ ID NO: 9349505 - DNA, 22 bp, Homo sapiens
aatttataataaatagggcttt

SEQ ID NO: 9349506 - DNA, 19 bp, Homo sapiens
aatttagttcttgtttaga

SEQ ID NO: 9349507 - DNA, 22 bp, Homo sapiens
aatttagattgataaacatgga

SEQ ID NO: 9349508 - DNA, 22 bp, Homo sapiens
aattggaaaaagacttaattgc

SEQ ID NO: 9349509 - DNA, 22 bp, Homo sapiens
aattatattgtggtgtgaatgt

SEQ ID NO: 9349510 - DNA, 22 bp, Homo sapiens
aattatattgaagttgaatgtc

SEQ ID NO: 9349511 - DNA, 22 bp, Homo sapiens
aattagtattgcgattcattag

SEQ ID NO: 9349512 - DNA, 21 bp, Homo sapiens
aattagtgctccttgtttcaa

SEQ ID NO: 9349513 - DNA, 22 bp, Homo sapiens
aattatacattgaacaatctag

SEQ ID NO: 9349514 - DNA, 22 bp, Homo sapiens
aattatatgttaatcttcaatt

SEQ ID NO: 9349515 - DNA, 22 bp, Homo sapiens
aatgtctgtgccttaaaacttc

SEQ ID NO: 9349516 - DNA, 22 bp, Homo sapiens
aatgtctcaccgtaaatgtaac

SEQ ID NO: 9349517 - DNA, 22 bp, Homo sapiens
aatgtctgctctactcaggagg

SEQ ID NO: 9349518 - DNA, 22 bp, Homo sapiens
aatgtcattgtgagttaggctt

SEQ ID NO: 9349519 - DNA, 22 bp, Homo sapiens
aatgtcctaggcatgattttgt

SEQ ID NO: 9349520 - DNA, 22 bp, Homo sapiens
aatgtcctaggcatgattttgt

SEQ ID NO: 9349521 - DNA, 22 bp, Homo sapiens
aatgtcatgggaatttattcat

SEQ ID NO: 9349522 - DNA, 22 bp, Homo sapiens
agacagggagggagcgcggctg

SEQ ID NO: 9349523 - DNA, 22 bp, Homo sapiens
agacagggtcttgatcagagct

SEQ ID NO: 9349524 - DNA, 22 bp, Homo sapiens
agacagggtgatcgcttgagcc

SEQ ID NO: 9349525 - DNA, 22 bp, Homo sapiens
agacagggtgatcgcttgagcc

SEQ ID NO: 9349526 - DNA, 22 bp, Homo sapiens
agacagggtgatcgcttgagcc

SEQ ID NO: 9349527 - DNA, 22 bp, Homo sapiens
agaagggccagctggacacctg

SEQ ID NO: 9349528 - DNA, 22 bp, Homo sapiens
agaagtataaagaatgtttatg

SEQ ID NO: 9349529 - DNA, 22 bp, Homo sapiens
agaagtatgtgagaaattatcc

SEQ ID NO: 9349530 - DNA, 22 bp, Homo sapiens
agaagggtagttgtaagagtga

SEQ ID NO: 9349531 - DNA, 23 bp, Homo sapiens
agaagggtccttggcagcgacag

SEQ ID NO: 9349532 - DNA, 22 bp, Homo sapiens
aatgcaaagtgaggtgagtggc

SEQ ID NO: 9349533 - DNA, 22 bp, Homo sapiens
aatgcaaagcaagcagagattt

SEQ ID NO: 9349534 - DNA, 22 bp, Homo sapiens
aatgcaatgcagcacctccttg

SEQ ID NO: 9349535 - DNA, 22 bp, Homo sapiens
aatgcaatacctttttatgctg

SEQ ID NO: 9349536 - DNA, 22 bp, Homo sapiens
agacagactttgatctggatgt

SEQ ID NO: 9349537 - DNA, 19 bp, Homo sapiens
agacagagactgaaataga

SEQ ID NO: 9349538 - DNA, 19 bp, Homo sapiens
agacagagctcagtgggtt

SEQ ID NO: 9349539 - DNA, 23 bp, Homo sapiens
agacagaggctgaggctggccgc

SEQ ID NO: 9349540 - DNA, 23 bp, Homo sapiens
agacagaggctgaggctggccgc

SEQ ID NO: 9349541 - DNA, 21 bp, Homo sapiens
agacagagtgcagtctacata

SEQ ID NO: 9349542 - DNA, 22 bp, Homo sapiens
agacagcaatatgggagacgga

SEQ ID NO: 9349543 - DNA, 22 bp, Homo sapiens
agacagcagaaactagagcact

SEQ ID NO: 9349544 - DNA, 22 bp, Homo sapiens
agacagcagaaactagagcact

SEQ ID NO: 9349545 - DNA, 22 bp, Homo sapiens
agacaggcatgaggctggattg

SEQ ID NO: 9349546 - DNA, 22 bp, Homo sapiens
agacaggcatgaggctggattg

SEQ ID NO: 9349547 - DNA, 22 bp, Homo sapiens
agacaggccactctggtctggt

SEQ ID NO: 9349548 - DNA, 22 bp, Homo sapiens
agacaggccactctggtctggt

SEQ ID NO: 9349549 - DNA, 22 bp, Homo sapiens
agacaggctgctgtctgctagg

SEQ ID NO: 9349550 - DNA, 22 bp, Homo sapiens
agacaggccactctggtctggt

SEQ ID NO: 9349551 - DNA, 22 bp, Homo sapiens
agcaaggaaactatggagagat

SEQ ID NO: 9349552 - DNA, 22 bp, Homo sapiens
agcaagctggaggggctcatga

SEQ ID NO: 9349553 - DNA, 22 bp, Homo sapiens
agcaagctcttggaaatgagct

SEQ ID NO: 9349554 - DNA, 22 bp, Homo sapiens
agcaagcaggatggtcaaacta

SEQ ID NO: 9349555 - DNA, 22 bp, Homo sapiens
agcaagcagaaatgccatggca

SEQ ID NO: 9349556 - DNA, 22 bp, Homo sapiens
agcaagattgaggcttcctcag

SEQ ID NO: 9349557 - DNA, 20 bp, Homo sapiens
agcaccagtgggggcagccc

SEQ ID NO: 9349558 - DNA, 22 bp, Homo sapiens
agcacaggtacggagatgctac

SEQ ID NO: 9349559 - DNA, 21 bp, Homo sapiens
agcaaggcagcctctcagcct

SEQ ID NO: 9349560 - DNA, 22 bp, Homo sapiens
agcacaggtacggagatgctac

SEQ ID NO: 9349561 - DNA, 22 bp, Homo sapiens
agcaaggcagtcagctggctgg

SEQ ID NO: 9349562 - DNA, 22 bp, Homo sapiens
agcacaggtaatacagagtaac

SEQ ID NO: 9349563 - DNA, 22 bp, Homo sapiens
agatgggtaactggagtctgct

SEQ ID NO: 9349564 - DNA, 22 bp, Homo sapiens
acaatgttttgaaacatctagg

SEQ ID NO: 9349565 - DNA, 22 bp, Homo sapiens
agatggggctcagtgtggaggc

SEQ ID NO: 9349566 - DNA, 22 bp, Homo sapiens
agatggggctcagtgtggaggc

SEQ ID NO: 9349567 - DNA, 22 bp, Homo sapiens
agatggggctcagtgtggaggc

SEQ ID NO: 9349568 - DNA, 22 bp, Homo sapiens
agatggggtttcatcatgttgg

SEQ ID NO: 9349569 - DNA, 22 bp, Homo sapiens
agatggggctgaaagttccaat

SEQ ID NO: 9349570 - DNA, 22 bp, Homo sapiens
acaattcaagatgagattcagg

SEQ ID NO: 9349571 - DNA, 22 bp, Homo sapiens
acaattactcaactttgctgct

SEQ ID NO: 9349572 - DNA, 22 bp, Homo sapiens
acaattctgatggtttcccagt

SEQ ID NO: 9349573 - DNA, 22 bp, Homo sapiens
agcaagattgaggcttcctcag

SEQ ID NO: 9349574 - DNA, 22 bp, Homo sapiens
acaattctctcatatcttatta

SEQ ID NO: 9349575 - DNA, 22 bp, Homo sapiens
acaattcctgagaatacttgtt

SEQ ID NO: 9349576 - DNA, 22 bp, Homo sapiens
acaattctctcatatcttatta

SEQ ID NO: 9349577 - DNA, 22 bp, Homo sapiens
acaagctttgtgatagtagaga

SEQ ID NO: 9349578 - DNA, 22 bp, Homo sapiens
acaaattgaccgcaagattcat

SEQ ID NO: 9349579 - DNA, 22 bp, Homo sapiens
acaaatgttggatttgtcttcc

SEQ ID NO: 9349580 - DNA, 22 bp, Homo sapiens
acaaatgtgtctaattgtgcct

SEQ ID NO: 9349581 - DNA, 22 bp, Homo sapiens
acaaatgtggacatggataatg

SEQ ID NO: 9349582 - DNA, 22 bp, Homo sapiens
acaaatgtgattgtttctgaaa

SEQ ID NO: 9349583 - DNA, 22 bp, Homo sapiens
acaaatgtctcctcttttgtta

SEQ ID NO: 9349584 - DNA, 22 bp, Homo sapiens
acaaatgtggacatggataatg

SEQ ID NO: 9349585 - DNA, 22 bp, Homo sapiens
acaaatgtggacatggataatg

SEQ ID NO: 9349586 - DNA, 22 bp, Homo sapiens
acaaatggagaaactgaggccc

SEQ ID NO: 9349587 - DNA, 22 bp, Homo sapiens
acaaatgtctacattgagaata

SEQ ID NO: 9349588 - DNA, 22 bp, Homo sapiens
acaaatgtctacattgagaata

SEQ ID NO: 9349589 - DNA, 22 bp, Homo sapiens
acaaggttcttgtggaggaatt

SEQ ID NO: 9349590 - DNA, 22 bp, Homo sapiens
acaaggttcttagagctgggat

SEQ ID NO: 9349591 - DNA, 22 bp, Homo sapiens
acaaggttgttctgaggattta

SEQ ID NO: 9349592 - DNA, 22 bp, Homo sapiens
acaaggttggctctttctttgt

SEQ ID NO: 9349593 - DNA, 22 bp, Homo sapiens
acaaggttgattctggcatctg

SEQ ID NO: 9349594 - DNA, 22 bp, Homo sapiens
acaaggttctatggcgtctgtg

SEQ ID NO: 9349595 - DNA, 22 bp, Homo sapiens
acaaggtttaaatagccatcag

SEQ ID NO: 9349596 - DNA, 22 bp, Homo sapiens
acaaggtttggtaccacatcca

SEQ ID NO: 9349597 - DNA, 22 bp, Homo sapiens
acaaggtttggtcctatatttt

SEQ ID NO: 9349598 - DNA, 22 bp, Homo sapiens
acaagtcactctatcattttca

SEQ ID NO: 9349599 - DNA, 22 bp, Homo sapiens
acaagtatttaaggttagtata

SEQ ID NO: 9349600 - DNA, 22 bp, Homo sapiens
acaagtgggtcctacataaagc

SEQ ID NO: 9349601 - DNA, 22 bp, Homo sapiens
acaagtgggtcctacataaagc

SEQ ID NO: 9349602 - DNA, 22 bp, Homo sapiens
acaagtggctacctagattata

SEQ ID NO: 9349603 - DNA, 22 bp, Homo sapiens
acaagtgtgtgcagtttgtaaa

SEQ ID NO: 9349604 - DNA, 22 bp, Homo sapiens
acaagtgttgcattttgccatt

SEQ ID NO: 9349605 - DNA, 22 bp, Homo sapiens
acaagtgttgcattttgccatt

SEQ ID NO: 9349606 - DNA, 22 bp, Homo sapiens
acaagtctttttcatgtcttct

SEQ ID NO: 9349607 - DNA, 22 bp, Homo sapiens
acaagtgcatggaatcagctgt

SEQ ID NO: 9349608 - DNA, 19 bp, Homo sapiens
acaagtcacttacttagta

SEQ ID NO: 9349609 - DNA, 22 bp, Homo sapiens
agatggggcagaatggagccat

SEQ ID NO: 9349610 - DNA, 22 bp, Homo sapiens
agatggggctcagtgtggaggc

SEQ ID NO: 9349611 - DNA, 19 bp, Homo sapiens
agatggggaagagtgtgag

SEQ ID NO: 9349612 - DNA, 19 bp, Homo sapiens
agatggggaagagtgtgag

SEQ ID NO: 9349613 - DNA, 22 bp, Homo sapiens
acaagtttatttgattagaaca

SEQ ID NO: 9349614 - DNA, 22 bp, Homo sapiens
acaagttaccaaaaaagattca

SEQ ID NO: 9349615 - DNA, 22 bp, Homo sapiens
acaaaattgtgttaaactttat

SEQ ID NO: 9349616 - DNA, 22 bp, Homo sapiens
acaaaattatgaagaggccttg

SEQ ID NO: 9349617 - DNA, 22 bp, Homo sapiens
acaaaattgtgttaaactttat

SEQ ID NO: 9349618 - DNA, 22 bp, Homo sapiens
acaaaatttttagacaaggctt

SEQ ID NO: 9349619 - DNA, 22 bp, Homo sapiens
acaaaattacctagttattttc

SEQ ID NO: 9349620 - DNA, 22 bp, Homo sapiens
acaaaattacctagttattttc

SEQ ID NO: 9349621 - DNA, 22 bp, Homo sapiens
acaaaattacctagttattttc

SEQ ID NO: 9349622 - DNA, 22 bp, Homo sapiens
acaaacagagttgaaaaatagg

SEQ ID NO: 9349623 - DNA, 22 bp, Homo sapiens
acaaactaaaattctttattga

SEQ ID NO: 9349624 - DNA, 22 bp, Homo sapiens
acaaacatcttgacctcagatt

SEQ ID NO: 9349625 - DNA, 19 bp, Homo sapiens
acaaatgatgttgcactga

SEQ ID NO: 9349626 - DNA, 22 bp, Homo sapiens
acaaatgagaatgtagacagag

SEQ ID NO: 9349627 - DNA, 22 bp, Homo sapiens
acaaacttcccagacaagctcc

SEQ ID NO: 9349628 - DNA, 22 bp, Homo sapiens
acaaacttccatcatgaatttt

SEQ ID NO: 9349629 - DNA, 22 bp, Homo sapiens
acaaactacctacagatgttca

SEQ ID NO: 9349630 - DNA, 22 bp, Homo sapiens
acaaacttcccagacaagctcc

SEQ ID NO: 9349631 - DNA, 22 bp, Homo sapiens
acaaatatggtactcggagaaa

SEQ ID NO: 9349632 - DNA, 22 bp, Homo sapiens
acaaatgactatttggtacagg

SEQ ID NO: 9349633 - DNA, 22 bp, Homo sapiens
acaaatgactatttggtacagg

SEQ ID NO: 9349634 - DNA, 22 bp, Homo sapiens
aattttatgccttgcacgttgg

SEQ ID NO: 9349635 - DNA, 22 bp, Homo sapiens
aattttatgccttgcacgttgg

SEQ ID NO: 9349636 - DNA, 22 bp, Homo sapiens
aattttatgccttgcacgttgg

SEQ ID NO: 9349637 - DNA, 22 bp, Homo sapiens
aattttattaactggatgtagc

SEQ ID NO: 9349638 - DNA, 22 bp, Homo sapiens
aattttattaactggatgtagc

SEQ ID NO: 9349639 - DNA, 22 bp, Homo sapiens
aattttattaactggatgtagc

SEQ ID NO: 9349640 - DNA, 22 bp, Homo sapiens
aattttcacagtgctgtgagat

SEQ ID NO: 9349641 - DNA, 22 bp, Homo sapiens
aattttattagaaggcaagggg

SEQ ID NO: 9349642 - DNA, 22 bp, Homo sapiens
aattttattagaaggcaagggg

SEQ ID NO: 9349643 - DNA, 22 bp, Homo sapiens
aattttattagaaggcaagggg

SEQ ID NO: 9349644 - DNA, 22 bp, Homo sapiens
agagctgggtggtggtgactca

SEQ ID NO: 9349645 - DNA, 22 bp, Homo sapiens
agagctgggtggtggtgactca

SEQ ID NO: 9349646 - DNA, 22 bp, Homo sapiens
aatttgttaaaagtgagtgaca

SEQ ID NO: 9349647 - DNA, 22 bp, Homo sapiens
agagctgggtggtggtgactca

SEQ ID NO: 9349648 - DNA, 22 bp, Homo sapiens
agagctggggctctgggtttaa

SEQ ID NO: 9349649 - DNA, 22 bp, Homo sapiens
aattttctgcctagcaaaaact

SEQ ID NO: 9349650 - DNA, 22 bp, Homo sapiens
aattttctgatgatgaagcacg

SEQ ID NO: 9349651 - DNA, 20 bp, Homo sapiens
agaggccagttaggagtcta

SEQ ID NO: 9349652 - DNA, 22 bp, Homo sapiens
agaggccatgctagaggcctgg

SEQ ID NO: 9349653 - DNA, 22 bp, Homo sapiens
agaggccatgctagaggcctgg

SEQ ID NO: 9349654 - DNA, 21 bp, Homo sapiens
agaggccctcggactgggcgt

SEQ ID NO: 9349655 - DNA, 21 bp, Homo sapiens
agaggccctcggactgggcgt

SEQ ID NO: 9349656 - DNA, 22 bp, Homo sapiens
agaggccatgctagaggcctgg

SEQ ID NO: 9349657 - DNA, 22 bp, Homo sapiens
agaggccatgctagaggcctgg

SEQ ID NO: 9349658 - DNA, 22 bp, Homo sapiens
acaaaatagagttctcccctgg

SEQ ID NO: 9349659 - DNA, 22 bp, Homo sapiens
acaaaaagggagatgaggtaga

SEQ ID NO: 9349660 - DNA, 20 bp, Homo sapiens
acaaaataggtactgggtag

SEQ ID NO: 9349661 - DNA, 20 bp, Homo sapiens
acaaaataggtactgggtag

SEQ ID NO: 9349662 - DNA, 22 bp, Homo sapiens
acagagagggagtgataaatcc

SEQ ID NO: 9349663 - DNA, 22 bp, Homo sapiens
acagagcaggtccagaagtgcc

SEQ ID NO: 9349664 - DNA, 22 bp, Homo sapiens
acagagcagtaagaacacagct

SEQ ID NO: 9349665 - DNA, 22 bp, Homo sapiens
acagagcagtaagaacacagct

SEQ ID NO: 9349666 - DNA, 17 bp, Homo sapiens
acagagcacatcaagat

SEQ ID NO: 9349667 - DNA, 22 bp, Homo sapiens
acagagcactgccctgtgccgc

SEQ ID NO: 9349668 - DNA, 22 bp, Homo sapiens
acagagcactgccctgtgccgc

SEQ ID NO: 9349669 - DNA, 22 bp, Homo sapiens
agcccagctgcctgcctgctgt

SEQ ID NO: 9349670 - DNA, 22 bp, Homo sapiens
agccatggcgccactagaggga

SEQ ID NO: 9349671 - DNA, 22 bp, Homo sapiens
agccatggcgccactagaggga

SEQ ID NO: 9349672 - DNA, 22 bp, Homo sapiens
agccatggcgccactagaggga

SEQ ID NO: 9349673 - DNA, 22 bp, Homo sapiens
agccatgcaccttactcttgct

SEQ ID NO: 9349674 - DNA, 22 bp, Homo sapiens
agccatgctcagttcctggagc

SEQ ID NO: 9349675 - DNA, 22 bp, Homo sapiens
agccatgttaaatggacttgat

SEQ ID NO: 9349676 - DNA, 22 bp, Homo sapiens
agccattcattgtgctctcaga

SEQ ID NO: 9349677 - DNA, 22 bp, Homo sapiens
agccatggtctcagggccataa

SEQ ID NO: 9349678 - DNA, 22 bp, Homo sapiens
agccatggtctcagggccataa

SEQ ID NO: 9349679 - DNA, 21 bp, Homo sapiens
agccatcctgaatggtgccat

SEQ ID NO: 9349680 - DNA, 21 bp, Homo sapiens
agccatcctgaatggtgccat

SEQ ID NO: 9349681 - DNA, 22 bp, Homo sapiens
agccagggtgggtgaatgctat

SEQ ID NO: 9349682 - DNA, 22 bp, Homo sapiens
agccagggtgggtgaatgctat

SEQ ID NO: 9349683 - DNA, 22 bp, Homo sapiens
agccacagtcaacctgtccata

SEQ ID NO: 9349684 - DNA, 22 bp, Homo sapiens
agccacagtcaacctgtccata

SEQ ID NO: 9349685 - DNA, 22 bp, Homo sapiens
agccacaggtgttggccagtgt

SEQ ID NO: 9349686 - DNA, 22 bp, Homo sapiens
agccacagtctgatgcctgaga

SEQ ID NO: 9349687 - DNA, 22 bp, Homo sapiens
agccacagtcaacctgtccata

SEQ ID NO: 9349688 - DNA, 22 bp, Homo sapiens
agccacagtcaacctgtccata

SEQ ID NO: 9349689 - DNA, 22 bp, Homo sapiens
acagagcatttgggacagagag

SEQ ID NO: 9349690 - DNA, 22 bp, Homo sapiens
agccccctccctagtgactgga

SEQ ID NO: 9349691 - DNA, 23 bp, Homo sapiens
agcccctcatggtgtctagacag

SEQ ID NO: 9349692 - DNA, 23 bp, Homo sapiens
agcccctcatatctgctttctct

SEQ ID NO: 9349693 - DNA, 22 bp, Homo sapiens
agcccctctgtggctctgcctc

SEQ ID NO: 9349694 - DNA, 22 bp, Homo sapiens
acagagcatgatggaagatcga

SEQ ID NO: 9349695 - DNA, 22 bp, Homo sapiens
acagagcatgctcagtgtgtga

SEQ ID NO: 9349696 - DNA, 22 bp, Homo sapiens
acagagcatttgggacagagag

SEQ ID NO: 9349697 - DNA, 22 bp, Homo sapiens
acagagcatcagatgaaatcaa

SEQ ID NO: 9349698 - DNA, 22 bp, Homo sapiens
acagagcatataaagtgctttg

SEQ ID NO: 9349699 - DNA, 22 bp, Homo sapiens
acagagcatataaagtgctttg

SEQ ID NO: 9349700 - DNA, 22 bp, Homo sapiens
acagagcatataaagtgctttg

SEQ ID NO: 9349701 - DNA, 22 bp, Homo sapiens
acagagcagttctggagctggc

SEQ ID NO: 9349702 - DNA, 22 bp, Homo sapiens
acagagcagttctggagctggc

SEQ ID NO: 9349703 - DNA, 21 bp, Homo sapiens
acagagcataatggtgtggca

SEQ ID NO: 9349704 - DNA, 22 bp, Homo sapiens
acagagcataatgtctagcaca

SEQ ID NO: 9349705 - DNA, 22 bp, Homo sapiens
acagagcataatgtctagcaca

SEQ ID NO: 9349706 - DNA, 22 bp, Homo sapiens
acagagcataatgtctagcaca

SEQ ID NO: 9349707 - DNA, 22 bp, Homo sapiens
agcccctgggagtagctgctgc

SEQ ID NO: 9349708 - DNA, 22 bp, Homo sapiens
agcccctgctgggtgtagctca

SEQ ID NO: 9349709 - DNA, 22 bp, Homo sapiens
agcccctctgtggctctgcctc

SEQ ID NO: 9349710 - DNA, 22 bp, Homo sapiens
agcccctgggagtagctgctgc

SEQ ID NO: 9349711 - DNA, 22 bp, Homo sapiens
agcccctgtaccctgagtgctt

SEQ ID NO: 9349712 - DNA, 22 bp, Homo sapiens
agcccctgtaccctgagtgctt

SEQ ID NO: 9349713 - DNA, 22 bp, Homo sapiens
agcccctgtaccctgagtgctt

SEQ ID NO: 9349714 - DNA, 22 bp, Homo sapiens
acagagtcattcattgtccagt

SEQ ID NO: 9349715 - DNA, 22 bp, Homo sapiens
acagagtcttacgtggtgataa

SEQ ID NO: 9349716 - DNA, 22 bp, Homo sapiens
acagagttgtgtttgtacaacg

SEQ ID NO: 9349717 - DNA, 22 bp, Homo sapiens
acagagttgtgtttgtacaacg

SEQ ID NO: 9349718 - DNA, 22 bp, Homo sapiens
acagagtgtttttaagtatatt

SEQ ID NO: 9349719 - DNA, 22 bp, Homo sapiens
acagagttaaagtggagtttaa

SEQ ID NO: 9349720 - DNA, 22 bp, Homo sapiens
acagagtggagttcagtaaata

SEQ ID NO: 9349721 - DNA, 22 bp, Homo sapiens
acagagttagcagaaagttgga

SEQ ID NO: 9349722 - DNA, 22 bp, Homo sapiens
acagataatacattgtgctaca

SEQ ID NO: 9349723 - DNA, 22 bp, Homo sapiens
acagagtttatgtgtgtacaaa

SEQ ID NO: 9349724 - DNA, 22 bp, Homo sapiens
acagcaggcatgaatgacactg

SEQ ID NO: 9349725 - DNA, 22 bp, Homo sapiens
acagcaggcatgaatgacactg

SEQ ID NO: 9349726 - DNA, 22 bp, Homo sapiens
acagcaggcatgaatgacactg

SEQ ID NO: 9349727 - DNA, 22 bp, Homo sapiens
acagcaggcatgaagaaatgtt

SEQ ID NO: 9349728 - DNA, 22 bp, Homo sapiens
acagcaggcatgaagaaatgtt

SEQ ID NO: 9349729 - DNA, 22 bp, Homo sapiens
acagcaggcatgaagaaatgtt

SEQ ID NO: 9349730 - DNA, 22 bp, Homo sapiens
acagcaggcatgaagaaatgtt

SEQ ID NO: 9349731 - DNA, 22 bp, Homo sapiens
acagcaggcacacaaggataga

SEQ ID NO: 9349732 - DNA, 22 bp, Homo sapiens
acagcaggcacacaaggataga

SEQ ID NO: 9349733 - DNA, 22 bp, Homo sapiens
acagcaggcacacaaggataga

SEQ ID NO: 9349734 - DNA, 22 bp, Homo sapiens
acagcaggatttggcgatgttg

SEQ ID NO: 9349735 - DNA, 22 bp, Homo sapiens
acagcaggatttggcgatgttg

SEQ ID NO: 9349736 - DNA, 22 bp, Homo sapiens
acagcagctaaaggtgtctcct

SEQ ID NO: 9349737 - DNA, 22 bp, Homo sapiens
acagcaggaattaacatataag

SEQ ID NO: 9349738 - DNA, 22 bp, Homo sapiens
acagcaggaattaacatataag

SEQ ID NO: 9349739 - DNA, 22 bp, Homo sapiens
acagcaggagccttcatatgct

SEQ ID NO: 9349740 - DNA, 22 bp, Homo sapiens
acagcaggatttggcgatgttg

SEQ ID NO: 9349741 - DNA, 22 bp, Homo sapiens
acagcaggagccttcatatgct

SEQ ID NO: 9349742 - DNA, 21 bp, Homo sapiens
agctatttcagatttgagagc

SEQ ID NO: 9349743 - DNA, 22 bp, Homo sapiens
agctatttcaaagtttgagaca

SEQ ID NO: 9349744 - DNA, 22 bp, Homo sapiens
acagcagctaaaggtgtctcct

SEQ ID NO: 9349745 - DNA, 22 bp, Homo sapiens
agctctgggggaaagtctgctc

SEQ ID NO: 9349746 - DNA, 22 bp, Homo sapiens
agctctggggcctgtcccacat

SEQ ID NO: 9349747 - DNA, 18 bp, Homo sapiens
agctctggggagatgggc

SEQ ID NO: 9349748 - DNA, 18 bp, Homo sapiens
agctctggggagatgggc

SEQ ID NO: 9349749 - DNA, 18 bp, Homo sapiens
agctctggggagatgggc

SEQ ID NO: 9349750 - DNA, 22 bp, Homo sapiens
agctctggggtggagcccagga

SEQ ID NO: 9349751 - DNA, 22 bp, Homo sapiens
agctctggggtagggcccaaca

SEQ ID NO: 9349752 - DNA, 22 bp, Homo sapiens
agctctgggggaaagtctgctc

SEQ ID NO: 9349753 - DNA, 22 bp, Homo sapiens
agctctgggggaaagtctgctc

SEQ ID NO: 9349754 - DNA, 18 bp, Homo sapiens
agctctggggagatgggc

SEQ ID NO: 9349755 - DNA, 18 bp, Homo sapiens
agctctggggagatgggc

SEQ ID NO: 9349756 - DNA, 22 bp, Homo sapiens
agctctgggctgacatgctccc

SEQ ID NO: 9349757 - DNA, 22 bp, Homo sapiens
agctctgggctgacatgctccc

SEQ ID NO: 9349758 - DNA, 22 bp, Homo sapiens
agctctgggctgacatgctccc

SEQ ID NO: 9349759 - DNA, 22 bp, Homo sapiens
agctctccatctatctgtgatg

SEQ ID NO: 9349760 - DNA, 22 bp, Homo sapiens
agctctccacacataggactag

SEQ ID NO: 9349761 - DNA, 19 bp, Homo sapiens
agctcctgttcagcagctc

SEQ ID NO: 9349762 - DNA, 19 bp, Homo sapiens
agctcctgttcagcagctc

SEQ ID NO: 9349763 - DNA, 19 bp, Homo sapiens
agctcctgttcagcagctc

SEQ ID NO: 9349764 - DNA, 22 bp, Homo sapiens
agctcctgttctgagagcagga

SEQ ID NO: 9349765 - DNA, 22 bp, Homo sapiens
agctccttgaaggcagtagctg

SEQ ID NO: 9349766 - DNA, 22 bp, Homo sapiens
agctccttgaaggcagtagctg

SEQ ID NO: 9349767 - DNA, 22 bp, Homo sapiens
agctctagggaagaaaggcaca

SEQ ID NO: 9349768 - DNA, 20 bp, Homo sapiens
agctcctttgtgtccaggat

SEQ ID NO: 9349769 - DNA, 22 bp, Homo sapiens
agctccttgaagggctctggga

SEQ ID NO: 9349770 - DNA, 23 bp, Homo sapiens
agctcctttgaaagtatgttttt

SEQ ID NO: 9349771 - DNA, 22 bp, Homo sapiens
agctccttgcaggttgccttgg

SEQ ID NO: 9349772 - DNA, 22 bp, Homo sapiens
agctatctgcatgttttgctag

SEQ ID NO: 9349773 - DNA, 22 bp, Homo sapiens
agctatgtccctatgaattctg

SEQ ID NO: 9349774 - DNA, 22 bp, Homo sapiens
agctatgttatagcatgtatca

SEQ ID NO: 9349775 - DNA, 22 bp, Homo sapiens
agctagtatttcattgaggatt

SEQ ID NO: 9349776 - DNA, 22 bp, Homo sapiens
agctagtatttcattgaggatt

SEQ ID NO: 9349777 - DNA, 22 bp, Homo sapiens
agctaggggaccaaggtggccc

SEQ ID NO: 9349778 - DNA, 22 bp, Homo sapiens
agctaggggaccaaggtggccc

SEQ ID NO: 9349779 - DNA, 22 bp, Homo sapiens
agctagggcaaatatgagatac

SEQ ID NO: 9349780 - DNA, 22 bp, Homo sapiens
agctaggccatttgttcagtga

SEQ ID NO: 9349781 - DNA, 22 bp, Homo sapiens
agctagggctttcgtagacagt

SEQ ID NO: 9349782 - DNA, 22 bp, Homo sapiens
acagcaagacccctagcatggt

SEQ ID NO: 9349783 - DNA, 23 bp, Homo sapiens
acagcaagaggaccagatgtgag

SEQ ID NO: 9349784 - DNA, 21 bp, Homo sapiens
acagcaagccttcacatgagt

SEQ ID NO: 9349785 - DNA, 22 bp, Homo sapiens
acagcaagccagcttgtcactg

SEQ ID NO: 9349786 - DNA, 22 bp, Homo sapiens
acagcaataggaaatacttgca

SEQ ID NO: 9349787 - DNA, 22 bp, Homo sapiens
agctaggataagcagagactgg

SEQ ID NO: 9349788 - DNA, 21 bp, Homo sapiens
acagcaagccttcacatgagt

SEQ ID NO: 9349789 - DNA, 21 bp, Homo sapiens
acagcaagccttcacatgagt

SEQ ID NO: 9349790 - DNA, 22 bp, Homo sapiens
agcctgcgcggcctggggcgaa

SEQ ID NO: 9349791 - DNA, 22 bp, Homo sapiens
agcctgcgatcccacctggcct

SEQ ID NO: 9349792 - DNA, 22 bp, Homo sapiens
acagatttaggactgtagcgat

SEQ ID NO: 9349793 - DNA, 22 bp, Homo sapiens
acagcaaaagacaagaacttaa

SEQ ID NO: 9349794 - DNA, 22 bp, Homo sapiens
acagcaagacccctagcatggt

SEQ ID NO: 9349795 - DNA, 22 bp, Homo sapiens
agcctgccaggcgctgcctgga

SEQ ID NO: 9349796 - DNA, 22 bp, Homo sapiens
agcctgcacctgaccaacctgc

SEQ ID NO: 9349797 - DNA, 22 bp, Homo sapiens
agcctgagtgcttaggactgtt

SEQ ID NO: 9349798 - DNA, 22 bp, Homo sapiens
agcctgcaggatgggcagcacc

SEQ ID NO: 9349799 - DNA, 20 bp, Homo sapiens
agcctgccagctggcccaga

SEQ ID NO: 9349800 - DNA, 22 bp, Homo sapiens
agcctgcctcagactcaggata

SEQ ID NO: 9349801 - DNA, 17 bp, Homo sapiens
agcctgccccatgctgc

SEQ ID NO: 9349802 - DNA, 22 bp, Homo sapiens
agcctgcctcagactcaggata

SEQ ID NO: 9349803 - DNA, 22 bp, Homo sapiens
agccacaggtgttggccagtgt

SEQ ID NO: 9349804 - DNA, 22 bp, Homo sapiens
agccacaggccatgagatacca

SEQ ID NO: 9349805 - DNA, 22 bp, Homo sapiens
agccacagggggtgagggacaa

SEQ ID NO: 9349806 - DNA, 22 bp, Homo sapiens
acagaacaagacctgcttattg

SEQ ID NO: 9349807 - DNA, 22 bp, Homo sapiens
acagaaattgggcaaatggaag

SEQ ID NO: 9349808 - DNA, 22 bp, Homo sapiens
acagaaattgggcaaatggaag

SEQ ID NO: 9349809 - DNA, 19 bp, Homo sapiens
acagaaattagttattttc

SEQ ID NO: 9349810 - DNA, 22 bp, Homo sapiens
acagaaattagcagtgagttta

SEQ ID NO: 9349811 - DNA, 22 bp, Homo sapiens
acagaaattctgggacagaaaa

SEQ ID NO: 9349812 - DNA, 22 bp, Homo sapiens
agcagtgggtgacagagctgag

SEQ ID NO: 9349813 - DNA, 22 bp, Homo sapiens
agcagtggtgtgaggagggctc

SEQ ID NO: 9349814 - DNA, 22 bp, Homo sapiens
agcagtggtccccaacctttct

SEQ ID NO: 9349815 - DNA, 22 bp, Homo sapiens
agcagtgggggagtgttagttt

SEQ ID NO: 9349816 - DNA, 22 bp, Homo sapiens
agcagtggctggatggtgtgct

SEQ ID NO: 9349817 - DNA, 22 bp, Homo sapiens
acactgtgcatgcatatacaca

SEQ ID NO: 9349818 - DNA, 22 bp, Homo sapiens
agcagtggctgacagacttacc

SEQ ID NO: 9349819 - DNA, 22 bp, Homo sapiens
agcagtggtgtgaggagggctc

SEQ ID NO: 9349820 - DNA, 22 bp, Homo sapiens
agcagtgtgcttcgtttcatga

SEQ ID NO: 9349821 - DNA, 18 bp, Homo sapiens
agcagtgtgacctgaaga

SEQ ID NO: 9349822 - DNA, 18 bp, Homo sapiens
agcagtgtgacctgaaga

SEQ ID NO: 9349823 - DNA, 18 bp, Homo sapiens
agcagtgtggcaagcaga

SEQ ID NO: 9349824 - DNA, 22 bp, Homo sapiens
agcagtgttcaatgatacactg

SEQ ID NO: 9349825 - DNA, 22 bp, Homo sapiens
agcagtgttttagccatttctg

SEQ ID NO: 9349826 - DNA, 22 bp, Homo sapiens
agcagtgttttagccatttctg

SEQ ID NO: 9349827 - DNA, 22 bp, Homo sapiens
acagaaagataggcacaaggtc

SEQ ID NO: 9349828 - DNA, 22 bp, Homo sapiens
acagaaagataggcacaaggtc

SEQ ID NO: 9349829 - DNA, 22 bp, Homo sapiens
agcagggccaacagtaaacacc

SEQ ID NO: 9349830 - DNA, 18 bp, Homo sapiens
agcagggcattttgccat

SEQ ID NO: 9349831 - DNA, 22 bp, Homo sapiens
agcagggcatgaataagggttt

SEQ ID NO: 9349832 - DNA, 22 bp, Homo sapiens
agcagggcagttaaagggtcct

SEQ ID NO: 9349833 - DNA, 22 bp, Homo sapiens
agcagggcatgaataagggttt

SEQ ID NO: 9349834 - DNA, 22 bp, Homo sapiens
agcagggcccactaggggagat

SEQ ID NO: 9349835 - DNA, 22 bp, Homo sapiens
agcagggcccactaggggagat

SEQ ID NO: 9349836 - DNA, 23 bp, Homo sapiens
agcagggccagaatacttgctgt

SEQ ID NO: 9349837 - DNA, 22 bp, Homo sapiens
agcagggcccactaggggagat

SEQ ID NO: 9349838 - DNA, 22 bp, Homo sapiens
acactgcagatgtaatttgagt

SEQ ID NO: 9349839 - DNA, 22 bp, Homo sapiens
agcagggcccactaggggagat

SEQ ID NO: 9349840 - DNA, 22 bp, Homo sapiens
acactgtctcatatgaggggac

SEQ ID NO: 9349841 - DNA, 22 bp, Homo sapiens
acactgtctgggactcaggagt

SEQ ID NO: 9349842 - DNA, 22 bp, Homo sapiens
acactgtctgggactcaggagt

SEQ ID NO: 9349843 - DNA, 22 bp, Homo sapiens
acactgtgagctgaagggctgc

SEQ ID NO: 9349844 - DNA, 22 bp, Homo sapiens
acactgtgacaagaaagagctg

SEQ ID NO: 9349845 - DNA, 22 bp, Homo sapiens
acacatttctctttttgtaagt

SEQ ID NO: 9349846 - DNA, 20 bp, Homo sapiens
agcaggaaaagtgccagtct

SEQ ID NO: 9349847 - DNA, 23 bp, Homo sapiens
agcaggaaaccgagggtgatgtt

SEQ ID NO: 9349848 - DNA, 23 bp, Homo sapiens
agcaggaaaccgagggtgatgtt

SEQ ID NO: 9349849 - DNA, 22 bp, Homo sapiens
acacatttgggctcctacataa

SEQ ID NO: 9349850 - DNA, 22 bp, Homo sapiens
acacattttctaacagggatca

SEQ ID NO: 9349851 - DNA, 22 bp, Homo sapiens
acacattttcaacactgtcaag

SEQ ID NO: 9349852 - DNA, 22 bp, Homo sapiens
acacattttcaacactgtcaag

SEQ ID NO: 9349853 - DNA, 22 bp, Homo sapiens
acacattttcaacactgtcaag

SEQ ID NO: 9349854 - DNA, 23 bp, Homo sapiens
acacatttttcccgttctgaggt

SEQ ID NO: 9349855 - DNA, 23 bp, Homo sapiens
acacatttttcccgttctgaggt

SEQ ID NO: 9349856 - DNA, 22 bp, Homo sapiens
agcagggcagttaaagggtcct

SEQ ID NO: 9349857 - DNA, 22 bp, Homo sapiens
acaattgactgtatttttagct

SEQ ID NO: 9349858 - DNA, 21 bp, Homo sapiens
acaattgatggcttaagttgc

SEQ ID NO: 9349859 - DNA, 22 bp, Homo sapiens
acaattgctaatgcttctgttg

SEQ ID NO: 9349860 - DNA, 20 bp, Homo sapiens
acaatttcctcactatatgc

SEQ ID NO: 9349861 - DNA, 22 bp, Homo sapiens
acaatttatccattgtatagtt

SEQ ID NO: 9349862 - DNA, 22 bp, Homo sapiens
acaatttatccattgtatagtt

SEQ ID NO: 9349863 - DNA, 22 bp, Homo sapiens
acaatttatccattgtatagtt

SEQ ID NO: 9349864 - DNA, 22 bp, Homo sapiens
acaattctgatggtttcccagt

SEQ ID NO: 9349865 - DNA, 22 bp, Homo sapiens
acaattctgtggttgtctgtgg

SEQ ID NO: 9349866 - DNA, 22 bp, Homo sapiens
acaattctgggtatttatatag

SEQ ID NO: 9349867 - DNA, 22 bp, Homo sapiens
acaattctgatggtttcccagt

SEQ ID NO: 9349868 - DNA, 22 bp, Homo sapiens
agcacctgcctgcattggctat

SEQ ID NO: 9349869 - DNA, 20 bp, Homo sapiens
agcacctcccatatgctaga

SEQ ID NO: 9349870 - DNA, 22 bp, Homo sapiens
agcaccctggggaagcacaaag

SEQ ID NO: 9349871 - DNA, 22 bp, Homo sapiens
agcaccatgaccttgccattga

SEQ ID NO: 9349872 - DNA, 22 bp, Homo sapiens
agcaccattgcaaatatggcag

SEQ ID NO: 9349873 - DNA, 22 bp, Homo sapiens
acaattttccccataggttatc

SEQ ID NO: 9349874 - DNA, 22 bp, Homo sapiens
acacaggaactctgagaggtgg

SEQ ID NO: 9349875 - DNA, 22 bp, Homo sapiens
acacaggaagagagataataat

SEQ ID NO: 9349876 - DNA, 22 bp, Homo sapiens
acacaggaactctgagaggtgg

SEQ ID NO: 9349877 - DNA, 22 bp, Homo sapiens
acacaggaagagagataataat

SEQ ID NO: 9349878 - DNA, 22 bp, Homo sapiens
acacaggaagagagataataat

SEQ ID NO: 9349879 - DNA, 23 bp, Homo sapiens
acacaggatacatacggaagcaa

SEQ ID NO: 9349880 - DNA, 22 bp, Homo sapiens
acacaggaggaggatggtggtc

SEQ ID NO: 9349881 - DNA, 22 bp, Homo sapiens
acacaggaggaggatggtggtc

SEQ ID NO: 9349882 - DNA, 22 bp, Homo sapiens
acacaggagaaaagatctccca

SEQ ID NO: 9349883 - DNA, 22 bp, Homo sapiens
acacaggaagtcagcactgatg

SEQ ID NO: 9349884 - DNA, 22 bp, Homo sapiens
acacaggaagtcagcactgatg

SEQ ID NO: 9349885 - DNA, 22 bp, Homo sapiens
acacaggaagtcagcactgatg

SEQ ID NO: 9349886 - DNA, 22 bp, Homo sapiens
acacaggacggccctgtggctt

SEQ ID NO: 9349887 - DNA, 22 bp, Homo sapiens
acacaggacagggatgtgtttt

SEQ ID NO: 9349888 - DNA, 23 bp, Homo sapiens
agcagcagtgagaggtgtcttac

SEQ ID NO: 9349889 - DNA, 22 bp, Homo sapiens
agcagcagtgacagccgaaagc

SEQ ID NO: 9349890 - DNA, 22 bp, Homo sapiens
agcagcagtcctttgtgtaatt

SEQ ID NO: 9349891 - DNA, 23 bp, Homo sapiens
agcagcagtgagaggtgtcttac

SEQ ID NO: 9349892 - DNA, 23 bp, Homo sapiens
agcagcagtgagaggtgtcttac

SEQ ID NO: 9349893 - DNA, 22 bp, Homo sapiens
agcagcagtgtggtttggggaa

SEQ ID NO: 9349894 - DNA, 22 bp, Homo sapiens
acacatatatgtgcgtgtatat

SEQ ID NO: 9349895 - DNA, 22 bp, Homo sapiens
acacatatatgtgcgtgtatat

SEQ ID NO: 9349896 - DNA, 22 bp, Homo sapiens
acacatatatgtgcgtgtatat

SEQ ID NO: 9349897 - DNA, 22 bp, Homo sapiens
acacatatattatttgtggctc

SEQ ID NO: 9349898 - DNA, 22 bp, Homo sapiens
agcagcagtgttctggaattct

SEQ ID NO: 9349899 - DNA, 22 bp, Homo sapiens
agcagcagttgctgacgttcta

SEQ ID NO: 9349900 - DNA, 22 bp, Homo sapiens
agcagcagtgtgtggtcatgtt

SEQ ID NO: 9349901 - DNA, 22 bp, Homo sapiens
agcagcagtgtgtggtcatgtt

SEQ ID NO: 9349902 - DNA, 22 bp, Homo sapiens
acacaggcaatgtgagtgggag

SEQ ID NO: 9349903 - DNA, 22 bp, Homo sapiens
acacaggcaatgtgagtgggag

SEQ ID NO: 9349904 - DNA, 22 bp, Homo sapiens
acacaggcaagagtgcaggtct

SEQ ID NO: 9349905 - DNA, 22 bp, Homo sapiens
agcagcaggtgacctcgatgcc

SEQ ID NO: 9349906 - DNA, 22 bp, Homo sapiens
agcagcaggtgcttctggatct

SEQ ID NO: 9349907 - DNA, 22 bp, Homo sapiens
agcagcaggtgacctcgatgcc

SEQ ID NO: 9349908 - DNA, 22 bp, Homo sapiens
agcagcagtcctttgtgtaatt

SEQ ID NO: 9349909 - DNA, 22 bp, Homo sapiens
agcagcagtcatgcctatgctc

SEQ ID NO: 9349910 - DNA, 22 bp, Homo sapiens
agcagcagtcatgcctatgctc

SEQ ID NO: 9349911 - DNA, 22 bp, Homo sapiens
agcagcagtcatgcctatgctc

SEQ ID NO: 9349912 - DNA, 22 bp, Homo sapiens
agcagcagtatccttccccggc

SEQ ID NO: 9349913 - DNA, 22 bp, Homo sapiens
agcagcagtatccttccccggc

SEQ ID NO: 9349914 - DNA, 22 bp, Homo sapiens
agcagcagtacatataagacta

SEQ ID NO: 9349915 - DNA, 22 bp, Homo sapiens
agcagcagtacatataagacta

SEQ ID NO: 9349916 - DNA, 22 bp, Homo sapiens
agcagcaggtgcttctggatct

SEQ ID NO: 9349917 - DNA, 22 bp, Homo sapiens
agcagcagtacatataagacta

SEQ ID NO: 9349918 - DNA, 22 bp, Homo sapiens
agcagcagtacatataagacta

SEQ ID NO: 9349919 - DNA, 22 bp, Homo sapiens
agcagcttgttaaaaagttcca

SEQ ID NO: 9349920 - DNA, 22 bp, Homo sapiens
agcagcttggttttaggcatgg

SEQ ID NO: 9349921 - DNA, 22 bp, Homo sapiens
agcagcttgggtctctcctgct

SEQ ID NO: 9349922 - DNA, 22 bp, Homo sapiens
agcagctttaagtcactggtta

SEQ ID NO: 9349923 - DNA, 22 bp, Homo sapiens
agcagctttcacctccccgcct

SEQ ID NO: 9349924 - DNA, 22 bp, Homo sapiens
agcagctttcctctggggtcag

SEQ ID NO: 9349925 - DNA, 20 bp, Homo sapiens
agcaggaaaagtgccagtct

SEQ ID NO: 9349926 - DNA, 20 bp, Homo sapiens
agcaggaaaagtgccagtct

SEQ ID NO: 9349927 - DNA, 23 bp, Homo sapiens
agcaggaaaccgagggtgatgtt

SEQ ID NO: 9349928 - DNA, 20 bp, Homo sapiens
agcaggaaaagtgccagtct

SEQ ID NO: 9349929 - DNA, 18 bp, Homo sapiens
agcagctttgtgcttgat

SEQ ID NO: 9349930 - DNA, 21 bp, Homo sapiens
agcagctttggttgaagcaga

SEQ ID NO: 9349931 - DNA, 18 bp, Homo sapiens
agcagctttgacaggaaa

SEQ ID NO: 9349932 - DNA, 22 bp, Homo sapiens
acacatatgtatgcatcatgtg

SEQ ID NO: 9349933 - DNA, 22 bp, Homo sapiens
acacatatgtatgcatcatgtg

SEQ ID NO: 9349934 - DNA, 22 bp, Homo sapiens
agcagcttgaggctggattcca

SEQ ID NO: 9349935 - DNA, 22 bp, Homo sapiens
acacatatgtatgcatcatgtg

SEQ ID NO: 9349936 - DNA, 22 bp, Homo sapiens
acacatatggttggtaggagtt

SEQ ID NO: 9349937 - DNA, 22 bp, Homo sapiens
acacatatgtatgcatcatgtg

SEQ ID NO: 9349938 - DNA, 21 bp, Homo sapiens
agcagcttgagtctggagctc

SEQ ID NO: 9349939 - DNA, 22 bp, Homo sapiens
agcagcttgaggctggattcca

SEQ ID NO: 9349940 - DNA, 21 bp, Homo sapiens
agcagcttgagtctggagctc

SEQ ID NO: 9349941 - DNA, 22 bp, Homo sapiens
agcagcttgggtctctcctgct

SEQ ID NO: 9349942 - DNA, 22 bp, Homo sapiens
agcagcttggggccgagataga

SEQ ID NO: 9349943 - DNA, 22 bp, Homo sapiens
agcagcttggggccgagataga

SEQ ID NO: 9349944 - DNA, 22 bp, Homo sapiens
agcagcttgggtctctcctgct

SEQ ID NO: 9349945 - DNA, 22 bp, Homo sapiens
acacatatctaagatagatgac

SEQ ID NO: 9349946 - DNA, 22 bp, Homo sapiens
acacatatctaagatagatgac

SEQ ID NO: 9349947 - DNA, 22 bp, Homo sapiens
acacatatgcagatcccccaca

SEQ ID NO: 9349948 - DNA, 22 bp, Homo sapiens
acacatatgcagatcccccaca

SEQ ID NO: 9349949 - DNA, 22 bp, Homo sapiens
acacatatctaagatagatgac

SEQ ID NO: 9349950 - DNA, 22 bp, Homo sapiens
acacatatctaagatagatgac

SEQ ID NO: 9349951 - DNA, 22 bp, Homo sapiens
acacatatggttgctgcagtga

SEQ ID NO: 9349952 - DNA, 22 bp, Homo sapiens
acacatatggttgctgcagtga

SEQ ID NO: 9349953 - DNA, 22 bp, Homo sapiens
acacatatggttgctgcagtga

SEQ ID NO: 9349954 - DNA, 22 bp, Homo sapiens
acacatatgccattacagcaaa

SEQ ID NO: 9349955 - DNA, 22 bp, Homo sapiens
acacatatgccattacagcaaa

SEQ ID NO: 9349956 - DNA, 22 bp, Homo sapiens
acacatatgccattacagcaaa

SEQ ID NO: 9349957 - DNA, 23 bp, Homo sapiens
acacatatattcagatacagatg

SEQ ID NO: 9349958 - DNA, 23 bp, Homo sapiens
acacatatattcagatacagatg

SEQ ID NO: 9349959 - DNA, 23 bp, Homo sapiens
acacatatattcagatacagatg

SEQ ID NO: 9349960 - DNA, 22 bp, Homo sapiens
acacatatatttgcatatacac

SEQ ID NO: 9349961 - DNA, 22 bp, Homo sapiens
acacatatatttgcatatacac

SEQ ID NO: 9349962 - DNA, 22 bp, Homo sapiens
acacatatatttgcatatacac

SEQ ID NO: 9349963 - DNA, 22 bp, Homo sapiens
acacatatatttgcatatacac

SEQ ID NO: 9349964 - DNA, 22 bp, Homo sapiens
accatccaaactgctttctgtg

SEQ ID NO: 9349965 - DNA, 22 bp, Homo sapiens
aaggtggtaggctatatcagta

SEQ ID NO: 9349966 - DNA, 22 bp, Homo sapiens
aaggtggcatgtcccctggcca

SEQ ID NO: 9349967 - DNA, 22 bp, Homo sapiens
aaggtggcgctggagctggtcc

SEQ ID NO: 9349968 - DNA, 22 bp, Homo sapiens
aaggtggccctgagcatgacaa

SEQ ID NO: 9349969 - DNA, 22 bp, Homo sapiens
aaggtggtaatagtgcaggatt

SEQ ID NO: 9349970 - DNA, 22 bp, Homo sapiens
aaggtggtaggctatatcagta

SEQ ID NO: 9349971 - DNA, 22 bp, Homo sapiens
aaggtggtaatagtgcaggatt

SEQ ID NO: 9349972 - DNA, 22 bp, Homo sapiens
aaggtgggtggatcacgaggtc

SEQ ID NO: 9349973 - DNA, 22 bp, Homo sapiens
accatgccagtggcagccagac

SEQ ID NO: 9349974 - DNA, 22 bp, Homo sapiens
accatgggtcagccacctcagc

SEQ ID NO: 9349975 - DNA, 22 bp, Homo sapiens
accatgacgtcacagaggcttc

SEQ ID NO: 9349976 - DNA, 22 bp, Homo sapiens
accatgcaggctattttcaaat

SEQ ID NO: 9349977 - DNA, 22 bp, Homo sapiens
aaggtctgttctaggtgagggt

SEQ ID NO: 9349978 - DNA, 22 bp, Homo sapiens
aaggtctgttgagtgaatagta

SEQ ID NO: 9349979 - DNA, 22 bp, Homo sapiens
aaggtgaactggtaatgacaga

SEQ ID NO: 9349980 - DNA, 22 bp, Homo sapiens
aaggtgaaactggaagctggcc

SEQ ID NO: 9349981 - DNA, 22 bp, Homo sapiens
aaggtgaactggtaatgacaga

SEQ ID NO: 9349982 - DNA, 22 bp, Homo sapiens
aaggtgctcgttatggccagtg

SEQ ID NO: 9349983 - DNA, 22 bp, Homo sapiens
aaggtggaggttgcagtgagct

SEQ ID NO: 9349984 - DNA, 22 bp, Homo sapiens
aaggtgctcacgggctcaggga

SEQ ID NO: 9349985 - DNA, 22 bp, Homo sapiens
aaggtgcctgtctgcaaacctg

SEQ ID NO: 9349986 - DNA, 22 bp, Homo sapiens
aaggtgccatattttggaatag

SEQ ID NO: 9349987 - DNA, 22 bp, Homo sapiens
aaggtgcctggctttgccttct

SEQ ID NO: 9349988 - DNA, 22 bp, Homo sapiens
aaggtgccccctcctgaacctt

SEQ ID NO: 9349989 - DNA, 22 bp, Homo sapiens
aaggtgccagcccctccactga

SEQ ID NO: 9349990 - DNA, 22 bp, Homo sapiens
aaggtgccacttccctcagact

SEQ ID NO: 9349991 - DNA, 22 bp, Homo sapiens
aaggtgccacagttcttttagc

SEQ ID NO: 9349992 - DNA, 22 bp, Homo sapiens
aaggtagcttgcttcctgagta

SEQ ID NO: 9349993 - DNA, 22 bp, Homo sapiens
aaggtagatgttgtcatgccca

SEQ ID NO: 9349994 - DNA, 22 bp, Homo sapiens
aagggctgatctcactttcttt

SEQ ID NO: 9349995 - DNA, 22 bp, Homo sapiens
aagggctgatctcactttcttt

SEQ ID NO: 9349996 - DNA, 22 bp, Homo sapiens
aagggctgagcacagtgagcca

SEQ ID NO: 9349997 - DNA, 22 bp, Homo sapiens
aagggctgagcacagtgagcca

SEQ ID NO: 9349998 - DNA, 22 bp, Homo sapiens
aagggctgagcacagtgagcca

SEQ ID NO: 9349999 - DNA, 22 bp, Homo sapiens
aagggctgagcacagtgagcca

SEQ ID NO: 9350000 - DNA, 22 bp, Homo sapiens
aagggctgagcacagtgagcca

SEQ ID NO: 9350001 - DNA, 22 bp, Homo sapiens
aagggctgagaagtggggctgg

SEQ ID NO: 9350002 - DNA, 22 bp, Homo sapiens
aagggctgagaagtggggctgg

SEQ ID NO: 9350003 - DNA, 22 bp, Homo sapiens
aagggctgagaagtggggctgg

SEQ ID NO: 9350004 - DNA, 22 bp, Homo sapiens
aagggctgaatgaagggttgaa

SEQ ID NO: 9350005 - DNA, 22 bp, Homo sapiens
aagggctgaatgaagggttgaa

SEQ ID NO: 9350006 - DNA, 22 bp, Homo sapiens
aagggctgaatgaagggttgaa

SEQ ID NO: 9350007 - DNA, 22 bp, Homo sapiens
aagggctgaatgaagggttgaa

SEQ ID NO: 9350008 - DNA, 22 bp, Homo sapiens
aagggctgaaagaccttgggca

SEQ ID NO: 9350009 - DNA, 22 bp, Homo sapiens
aagggctgaaagaccttgggca

SEQ ID NO: 9350010 - DNA, 22 bp, Homo sapiens
aagtacttctagatggataatc

SEQ ID NO: 9350011 - DNA, 22 bp, Homo sapiens
aagtacatggaggatagctgct

SEQ ID NO: 9350012 - DNA, 22 bp, Homo sapiens
aagtcacacagttaacatgagg

SEQ ID NO: 9350013 - DNA, 22 bp, Homo sapiens
acccccttcgcacactctttca

SEQ ID NO: 9350014 - DNA, 23 bp, Homo sapiens
accccaggcatcgcattcctctt

SEQ ID NO: 9350015 - DNA, 23 bp, Homo sapiens
accccaggcatcgcattcctctt

SEQ ID NO: 9350016 - DNA, 22 bp, Homo sapiens
accccagggctgccagcctcct

SEQ ID NO: 9350017 - DNA, 22 bp, Homo sapiens
accccaggtcatctgagagtcc

SEQ ID NO: 9350018 - DNA, 22 bp, Homo sapiens
accccagggctgccagcctcct

SEQ ID NO: 9350019 - DNA, 22 bp, Homo sapiens
accccaggtccaggttacagag

SEQ ID NO: 9350020 - DNA, 22 bp, Homo sapiens
accccaggtccaggttacagag

SEQ ID NO: 9350021 - DNA, 22 bp, Homo sapiens
accccaggtctccaggctctgg

SEQ ID NO: 9350022 - DNA, 22 bp, Homo sapiens
accccaggtctccaggctctgg

SEQ ID NO: 9350023 - DNA, 22 bp, Homo sapiens
aaggctttgaaaaccaaaaggt

SEQ ID NO: 9350024 - DNA, 22 bp, Homo sapiens
aagggcaggaaaagatggatgt

SEQ ID NO: 9350025 - DNA, 22 bp, Homo sapiens
aagggcaggaaaagatggatgt

SEQ ID NO: 9350026 - DNA, 22 bp, Homo sapiens
aagggagaaaacttgtggctta

SEQ ID NO: 9350027 - DNA, 22 bp, Homo sapiens
aagggacatagactgtacatct

SEQ ID NO: 9350028 - DNA, 22 bp, Homo sapiens
aagggccattgctgagagcagt

SEQ ID NO: 9350029 - DNA, 22 bp, Homo sapiens
aagggccatcccagaacagaaa

SEQ ID NO: 9350030 - DNA, 22 bp, Homo sapiens
aagggccataacttgcagtgtt

SEQ ID NO: 9350031 - DNA, 22 bp, Homo sapiens
aagggcatgggatgaaaagtag

SEQ ID NO: 9350032 - DNA, 22 bp, Homo sapiens
aagggcctttcaaaggtgatta

SEQ ID NO: 9350033 - DNA, 22 bp, Homo sapiens
aagggctagctgcatatatatt

SEQ ID NO: 9350034 - DNA, 22 bp, Homo sapiens
aagggccttgccaggtgaagag

SEQ ID NO: 9350035 - DNA, 22 bp, Homo sapiens
aagggccttgccaggtgaagag

SEQ ID NO: 9350036 - DNA, 22 bp, Homo sapiens
aagggccttcactgtctaagca

SEQ ID NO: 9350037 - DNA, 22 bp, Homo sapiens
aagggcctcctggggagcctgg

SEQ ID NO: 9350038 - DNA, 19 bp, Homo sapiens
aagggcctctgctgtcttc

SEQ ID NO: 9350039 - DNA, 22 bp, Homo sapiens
aagggctctgtgcttgtcccat

SEQ ID NO: 9350040 - DNA, 22 bp, Homo sapiens
aagggctgaaagaccttgggca

SEQ ID NO: 9350041 - DNA, 22 bp, Homo sapiens
acatgtgtggccgctgtagaca

SEQ ID NO: 9350042 - DNA, 22 bp, Homo sapiens
acatgtgtggacatgaatctac

SEQ ID NO: 9350043 - DNA, 22 bp, Homo sapiens
acatgtgtgacaacagaggtga

SEQ ID NO: 9350044 - DNA, 22 bp, Homo sapiens
acatgtgtggacatgaatctac

SEQ ID NO: 9350045 - DNA, 22 bp, Homo sapiens
acatgtgtatagcctgtataga

SEQ ID NO: 9350046 - DNA, 22 bp, Homo sapiens
acatgtgtatagcctgtataga

SEQ ID NO: 9350047 - DNA, 22 bp, Homo sapiens
acatgtgtacttttaaggatgt

SEQ ID NO: 9350048 - DNA, 22 bp, Homo sapiens
acatgtgtctaagaatgaaaga

SEQ ID NO: 9350049 - DNA, 22 bp, Homo sapiens
acatgtgtatagcctgtataga

SEQ ID NO: 9350050 - DNA, 22 bp, Homo sapiens
acatgtgtgacaacagaggtga

SEQ ID NO: 9350051 - DNA, 22 bp, Homo sapiens
aaggctggtttccttgatgttt

SEQ ID NO: 9350052 - DNA, 22 bp, Homo sapiens
aaggctggtttccttgatgttt

SEQ ID NO: 9350053 - DNA, 22 bp, Homo sapiens
aaggctggggtgcagacggcct

SEQ ID NO: 9350054 - DNA, 22 bp, Homo sapiens
aaggctgggaaacatgcaggcc

SEQ ID NO: 9350055 - DNA, 22 bp, Homo sapiens
aaggctgggaaacatgcaggcc

SEQ ID NO: 9350056 - DNA, 22 bp, Homo sapiens
acatgtgtggccgctgtagaca

SEQ ID NO: 9350057 - DNA, 22 bp, Homo sapiens
acatgtgtggccgctgtagaca

SEQ ID NO: 9350058 - DNA, 22 bp, Homo sapiens
acatgtgtgtatacgtatttat

SEQ ID NO: 9350059 - DNA, 22 bp, Homo sapiens
aaggctgtgtcagaagctccct

SEQ ID NO: 9350060 - DNA, 22 bp, Homo sapiens
aaggcttggagtaagcttggct

SEQ ID NO: 9350061 - DNA, 22 bp, Homo sapiens
aaggcttgtagatttgggcttt

SEQ ID NO: 9350062 - DNA, 19 bp, Homo sapiens
aaggcttggctgagctggg

SEQ ID NO: 9350063 - DNA, 19 bp, Homo sapiens
aaggcttggctgagctggg

SEQ ID NO: 9350064 - DNA, 22 bp, Homo sapiens
aaggctttatgtgaccaaaaga

SEQ ID NO: 9350065 - DNA, 22 bp, Homo sapiens
aaggcttgtgtgttcagtgagg

SEQ ID NO: 9350066 - DNA, 22 bp, Homo sapiens
aaggctgaggcagtgaggcaga

SEQ ID NO: 9350067 - DNA, 22 bp, Homo sapiens
aaggctgaggcagtgaggcaga

SEQ ID NO: 9350068 - DNA, 22 bp, Homo sapiens
aaggctgaggagggcctgcagg

SEQ ID NO: 9350069 - DNA, 22 bp, Homo sapiens
aaggcatatgctgtgtacagtt

SEQ ID NO: 9350070 - DNA, 22 bp, Homo sapiens
aaggcataggacaaatcagtga

SEQ ID NO: 9350071 - DNA, 22 bp, Homo sapiens
aaggcatgatgtaatcaatgat

SEQ ID NO: 9350072 - DNA, 22 bp, Homo sapiens
aaggcatggcagggtttacaca

SEQ ID NO: 9350073 - DNA, 22 bp, Homo sapiens
aaggctcttgagtggtgatagt

SEQ ID NO: 9350074 - DNA, 22 bp, Homo sapiens
acatgtgtacttttaaggatgt

SEQ ID NO: 9350075 - DNA, 22 bp, Homo sapiens
acatgtgtacatatatatgtgc

SEQ ID NO: 9350076 - DNA, 22 bp, Homo sapiens
acatgtgtacatatatatgtgc

SEQ ID NO: 9350077 - DNA, 22 bp, Homo sapiens
acatgtgtacatatatatgtgc

SEQ ID NO: 9350078 - DNA, 22 bp, Homo sapiens
acatgtgtaaggtctctcagtc

SEQ ID NO: 9350079 - DNA, 22 bp, Homo sapiens
aaggctgcctctgccagaggag

SEQ ID NO: 9350080 - DNA, 22 bp, Homo sapiens
aaggctgcctctgccagaggag

SEQ ID NO: 9350081 - DNA, 16 bp, Homo sapiens
aaggctgattttccct

SEQ ID NO: 9350082 - DNA, 22 bp, Homo sapiens
aaggctgagggctgtacctggc

SEQ ID NO: 9350083 - DNA, 22 bp, Homo sapiens
acagtataaactcctaaaagcc

SEQ ID NO: 9350084 - DNA, 22 bp, Homo sapiens
acagtagagtaaaagggagcct

SEQ ID NO: 9350085 - DNA, 22 bp, Homo sapiens
acagtactgtgttaactgaacc

SEQ ID NO: 9350086 - DNA, 22 bp, Homo sapiens
acagtagaaacaggcaggcaga

SEQ ID NO: 9350087 - DNA, 22 bp, Homo sapiens
acagtagtacacatctatgtcc

SEQ ID NO: 9350088 - DNA, 22 bp, Homo sapiens
acagtagatggctcagagacag

SEQ ID NO: 9350089 - DNA, 22 bp, Homo sapiens
acagtagtgctcaatcagtgtt

SEQ ID NO: 9350090 - DNA, 22 bp, Homo sapiens
aaggcagaaattcaactactgg

SEQ ID NO: 9350091 - DNA, 22 bp, Homo sapiens
aaggcagaaattcaactactgg

SEQ ID NO: 9350092 - DNA, 22 bp, Homo sapiens
aaggcagaaagggatgtgagtg

SEQ ID NO: 9350093 - DNA, 19 bp, Homo sapiens
aaggcagaagttggatatg

SEQ ID NO: 9350094 - DNA, 21 bp, Homo sapiens
aaggcagaagcatggaatgag

SEQ ID NO: 9350095 - DNA, 21 bp, Homo sapiens
aaggcagaagcatggaatgag

SEQ ID NO: 9350096 - DNA, 22 bp, Homo sapiens
aaggcagaaagggatgtgagtg

SEQ ID NO: 9350097 - DNA, 22 bp, Homo sapiens
aaggcagaaagggatgtgagtg

SEQ ID NO: 9350098 - DNA, 22 bp, Homo sapiens
aaggcagaaagggatgtgagtg

SEQ ID NO: 9350099 - DNA, 22 bp, Homo sapiens
aaggaagaagactctttactcc

SEQ ID NO: 9350100 - DNA, 22 bp, Homo sapiens
aaggcactacgctgctggggcg

SEQ ID NO: 9350101 - DNA, 22 bp, Homo sapiens
aaggcactagcaagctgcctgg

SEQ ID NO: 9350102 - DNA, 22 bp, Homo sapiens
aaggcacttgcccagagctgca

SEQ ID NO: 9350103 - DNA, 22 bp, Homo sapiens
aaggaagaaatgaataggtgga

SEQ ID NO: 9350104 - DNA, 22 bp, Homo sapiens
aaggcaggtattgatgccacag

SEQ ID NO: 9350105 - DNA, 22 bp, Homo sapiens
aaggcaggtattgatgccacag

SEQ ID NO: 9350106 - DNA, 22 bp, Homo sapiens
aaggcagtggttgggtggagga

SEQ ID NO: 9350107 - DNA, 22 bp, Homo sapiens
aaggcagtggttgggtggagga

SEQ ID NO: 9350108 - DNA, 22 bp, Homo sapiens
aaggcagttcactcacgcagcc

SEQ ID NO: 9350109 - DNA, 22 bp, Homo sapiens
aaggcagttaatttggctagaa

SEQ ID NO: 9350110 - DNA, 22 bp, Homo sapiens
aaggcaggagctgtatcttatt

SEQ ID NO: 9350111 - DNA, 22 bp, Homo sapiens
aaggcaggagctgtatcttatt

SEQ ID NO: 9350112 - DNA, 22 bp, Homo sapiens
aaggcaggagctgtatcttatt

SEQ ID NO: 9350113 - DNA, 22 bp, Homo sapiens
aaggcaggatgcggacccatct

SEQ ID NO: 9350114 - DNA, 22 bp, Homo sapiens
aaggcaggatgcggacccatct

SEQ ID NO: 9350115 - DNA, 22 bp, Homo sapiens
aaggcagcttcaccacagcatt

SEQ ID NO: 9350116 - DNA, 22 bp, Homo sapiens
aaggcagggaaagtggattagg

SEQ ID NO: 9350117 - DNA, 22 bp, Homo sapiens
aaggcaggatgggaaaagattt

SEQ ID NO: 9350118 - DNA, 22 bp, Homo sapiens
aaggcagggaaagtggattagg

SEQ ID NO: 9350119 - DNA, 22 bp, Homo sapiens
aaggcaggatgcggacccatct

SEQ ID NO: 9350120 - DNA, 22 bp, Homo sapiens
aaggcaggatgggaaaagattt

SEQ ID NO: 9350121 - DNA, 22 bp, Homo sapiens
aaggcagcctttgtttgattga

SEQ ID NO: 9350122 - DNA, 22 bp, Homo sapiens
aaggcagctcagctcatggcag

SEQ ID NO: 9350123 - DNA, 22 bp, Homo sapiens
aaggcagctcagctcatggcag

SEQ ID NO: 9350124 - DNA, 22 bp, Homo sapiens
aaggcagcctctgccagccggg

SEQ ID NO: 9350125 - DNA, 22 bp, Homo sapiens
aaggcagatataaagactagag

SEQ ID NO: 9350126 - DNA, 22 bp, Homo sapiens
aaggcagccgtgtgactgcatg

SEQ ID NO: 9350127 - DNA, 22 bp, Homo sapiens
aaggcagccgtgtgactgcatg

SEQ ID NO: 9350128 - DNA, 22 bp, Homo sapiens
aaggcagatataaagactagag

SEQ ID NO: 9350129 - DNA, 22 bp, Homo sapiens
acagttctgtcctagacttcgt

SEQ ID NO: 9350130 - DNA, 22 bp, Homo sapiens
acagttctgcctgtttgagaag

SEQ ID NO: 9350131 - DNA, 19 bp, Homo sapiens
acagttctaatttctgtgg

SEQ ID NO: 9350132 - DNA, 22 bp, Homo sapiens
acagttctcttgtcacttcctc

SEQ ID NO: 9350133 - DNA, 22 bp, Homo sapiens
acagttctagcttttacatttt

SEQ ID NO: 9350134 - DNA, 22 bp, Homo sapiens
acagttctccagtgcctttgag

SEQ ID NO: 9350135 - DNA, 22 bp, Homo sapiens
aagccaggggttggtatgctat

SEQ ID NO: 9350136 - DNA, 22 bp, Homo sapiens
aagccagggattcctgagggag

SEQ ID NO: 9350137 - DNA, 22 bp, Homo sapiens
aagccagggtcaggggcctcct

SEQ ID NO: 9350138 - DNA, 22 bp, Homo sapiens
aagccagggattcctgagggag

SEQ ID NO: 9350139 - DNA, 22 bp, Homo sapiens
aagccagggatggaatgatagg

SEQ ID NO: 9350140 - DNA, 22 bp, Homo sapiens
aagccaggccattctctggttc

SEQ ID NO: 9350141 - DNA, 22 bp, Homo sapiens
aagccaggctgcacttgctggg

SEQ ID NO: 9350142 - DNA, 22 bp, Homo sapiens
aagccaggtgttgtggtaagag

SEQ ID NO: 9350143 - DNA, 22 bp, Homo sapiens
aagccaggtgtttaggccagcg

SEQ ID NO: 9350144 - DNA, 18 bp, Homo sapiens
aagccaggtcaagataag

SEQ ID NO: 9350145 - DNA, 22 bp, Homo sapiens
aagctgcaaggaagtgtgccag

SEQ ID NO: 9350146 - DNA, 22 bp, Homo sapiens
aagctgcaaggaagtgtgccag

SEQ ID NO: 9350147 - DNA, 22 bp, Homo sapiens
acaggcaggttgagaaacattt

SEQ ID NO: 9350148 - DNA, 22 bp, Homo sapiens
acaggcaggttgagaaacattt

SEQ ID NO: 9350149 - DNA, 22 bp, Homo sapiens
acaggcaggttgagaaacattt

SEQ ID NO: 9350150 - DNA, 22 bp, Homo sapiens
acaggcagtgatttcctctggt

SEQ ID NO: 9350151 - DNA, 22 bp, Homo sapiens
acaggcagtgatttcctctggt

SEQ ID NO: 9350152 - DNA, 22 bp, Homo sapiens
acaggcagtgggccagatttgt

SEQ ID NO: 9350153 - DNA, 22 bp, Homo sapiens
acaggcagtgatttcctctggt

SEQ ID NO: 9350154 - DNA, 22 bp, Homo sapiens
acaggcagtgatttcctctggt

SEQ ID NO: 9350155 - DNA, 22 bp, Homo sapiens
acaggcagtgatttcctctggt

SEQ ID NO: 9350156 - DNA, 22 bp, Homo sapiens
acaggcaggtcctgtcccagct

SEQ ID NO: 9350157 - DNA, 22 bp, Homo sapiens
acaggcaggtcctgtcccagct

SEQ ID NO: 9350158 - DNA, 22 bp, Homo sapiens
aagctgcactacttgagggacc

SEQ ID NO: 9350159 - DNA, 22 bp, Homo sapiens
aagctgcagatgtgcctgtgga

SEQ ID NO: 9350160 - DNA, 22 bp, Homo sapiens
aagctgcagaccccctgtctca

SEQ ID NO: 9350161 - DNA, 22 bp, Homo sapiens
aagctgcagatgtgcctgtgga

SEQ ID NO: 9350162 - DNA, 22 bp, Homo sapiens
aagctgcagaccccctgtctca

SEQ ID NO: 9350163 - DNA, 22 bp, Homo sapiens
aagctgcatgaagttgagtaga

SEQ ID NO: 9350164 - DNA, 22 bp, Homo sapiens
aagctgcaggttgaatccaggt

SEQ ID NO: 9350165 - DNA, 22 bp, Homo sapiens
aagctgcagatgtgcctgtgga

SEQ ID NO: 9350166 - DNA, 22 bp, Homo sapiens
aagctgcagcacagagaggtgg

SEQ ID NO: 9350167 - DNA, 22 bp, Homo sapiens
acaggccacagtggagtctctg

SEQ ID NO: 9350168 - DNA, 22 bp, Homo sapiens
acaggccacagtggagtctctg

SEQ ID NO: 9350169 - DNA, 22 bp, Homo sapiens
acaggcagttgaggtttgtgtg

SEQ ID NO: 9350170 - DNA, 22 bp, Homo sapiens
aaggaaagacatataaatgact

SEQ ID NO: 9350171 - DNA, 22 bp, Homo sapiens
acaggccagaggtggggcagcc

SEQ ID NO: 9350172 - DNA, 22 bp, Homo sapiens
aagctttaagtgtcagtcagcc

SEQ ID NO: 9350173 - DNA, 22 bp, Homo sapiens
aaggaaaggatgagcatgcatt

SEQ ID NO: 9350174 - DNA, 22 bp, Homo sapiens
aaggaaaggatgagcatgcatt

SEQ ID NO: 9350175 - DNA, 22 bp, Homo sapiens
aaggaaagctgtggttctgaga

SEQ ID NO: 9350176 - DNA, 22 bp, Homo sapiens
aaggaaagattctctctctaga

SEQ ID NO: 9350177 - DNA, 22 bp, Homo sapiens
aaggaaagagtatgcaccttgt

SEQ ID NO: 9350178 - DNA, 19 bp, Homo sapiens
acagggctctggacgccat

SEQ ID NO: 9350179 - DNA, 22 bp, Homo sapiens
acagggctccttgggctgacac

SEQ ID NO: 9350180 - DNA, 22 bp, Homo sapiens
acagggctgaggctggcttctt

SEQ ID NO: 9350181 - DNA, 22 bp, Homo sapiens
acagggctgaggctggcttctt

SEQ ID NO: 9350182 - DNA, 23 bp, Homo sapiens
acagggctggcagctgcaagacc

SEQ ID NO: 9350183 - DNA, 22 bp, Homo sapiens
acagggctggggaaagaggcta

SEQ ID NO: 9350184 - DNA, 22 bp, Homo sapiens
acagggctggggcacttggctg

SEQ ID NO: 9350185 - DNA, 22 bp, Homo sapiens
acagggctggggcacttggctg

SEQ ID NO: 9350186 - DNA, 22 bp, Homo sapiens
acagggctggggaaagaggcta

SEQ ID NO: 9350187 - DNA, 22 bp, Homo sapiens
acagggctggcgttgggacaga

SEQ ID NO: 9350188 - DNA, 23 bp, Homo sapiens
acagggctgtccagggctaggtc

SEQ ID NO: 9350189 - DNA, 22 bp, Homo sapiens
acagggcttagaacttggcctc

SEQ ID NO: 9350190 - DNA, 22 bp, Homo sapiens
acagggcttagaacttggcctc

SEQ ID NO: 9350191 - DNA, 22 bp, Homo sapiens
acaggtgtggggctgtggtact

SEQ ID NO: 9350192 - DNA, 22 bp, Homo sapiens
acaggtgtgttcccggaaagcc

SEQ ID NO: 9350193 - DNA, 22 bp, Homo sapiens
acaggtgtggggctgtggtact

SEQ ID NO: 9350194 - DNA, 22 bp, Homo sapiens
acaggtgtgttcccggaaagcc

SEQ ID NO: 9350195 - DNA, 22 bp, Homo sapiens
acagtacatagatctctaccct

SEQ ID NO: 9350196 - DNA, 22 bp, Homo sapiens
acagtactaagtgctcacatga

SEQ ID NO: 9350197 - DNA, 22 bp, Homo sapiens
acagtacagtgcagaggaagat

SEQ ID NO: 9350198 - DNA, 22 bp, Homo sapiens
aataagataagatttctgctct

SEQ ID NO: 9350199 - DNA, 22 bp, Homo sapiens
aataagataagatttctgctct

SEQ ID NO: 9350200 - DNA, 22 bp, Homo sapiens
aataagaattgccagatttgaa

SEQ ID NO: 9350201 - DNA, 22 bp, Homo sapiens
aataagaattgccagatttgaa

SEQ ID NO: 9350202 - DNA, 22 bp, Homo sapiens
aataacttaagaaatttcccca

SEQ ID NO: 9350203 - DNA, 22 bp, Homo sapiens
aagtttattaattgacttgtgc

SEQ ID NO: 9350204 - DNA, 22 bp, Homo sapiens
aagtttatgttggtaagatatc

SEQ ID NO: 9350205 - DNA, 22 bp, Homo sapiens
aagtttatgttggtaagatatc

SEQ ID NO: 9350206 - DNA, 22 bp, Homo sapiens
aagtttatgttggtaagatatc

SEQ ID NO: 9350207 - DNA, 22 bp, Homo sapiens
aagtttcaaatgttgattatgc

SEQ ID NO: 9350208 - DNA, 22 bp, Homo sapiens
aagtttattaattgacttgtgc

SEQ ID NO: 9350209 - DNA, 22 bp, Homo sapiens
aagtttcaagaggttctttgaa

SEQ ID NO: 9350210 - DNA, 22 bp, Homo sapiens
aagtttcatgacttggttatta

SEQ ID NO: 9350211 - DNA, 20 bp, Homo sapiens
aagtttcatgctctggggat

SEQ ID NO: 9350212 - DNA, 22 bp, Homo sapiens
aagttggtaggagacagaaggt

SEQ ID NO: 9350213 - DNA, 22 bp, Homo sapiens
aagttggtgtatgagacagaag

SEQ ID NO: 9350214 - DNA, 22 bp, Homo sapiens
aagtttaacttgaattctttct

SEQ ID NO: 9350215 - DNA, 22 bp, Homo sapiens
aagtttacataagtgatgatga

SEQ ID NO: 9350216 - DNA, 22 bp, Homo sapiens
aagttgttgttgaggtgggtaa

SEQ ID NO: 9350217 - DNA, 22 bp, Homo sapiens
aagttgtatgtcttagaaagta

SEQ ID NO: 9350218 - DNA, 22 bp, Homo sapiens
aagtttaacttgaattctttct

SEQ ID NO: 9350219 - DNA, 23 bp, Homo sapiens
aagttgtttttggccagggaaag

SEQ ID NO: 9350220 - DNA, 22 bp, Homo sapiens
aagtttatccctctcacagtta

SEQ ID NO: 9350221 - DNA, 22 bp, Homo sapiens
aagtttacataagtgatgatga

SEQ ID NO: 9350222 - DNA, 22 bp, Homo sapiens
aagtttatccctctcacagtta

SEQ ID NO: 9350223 - DNA, 22 bp, Homo sapiens
aagtttatctttgctgggtact

SEQ ID NO: 9350224 - DNA, 22 bp, Homo sapiens
aagtttatccctctcacagtta

SEQ ID NO: 9350225 - DNA, 22 bp, Homo sapiens
aagtttatccctctcacagtta

SEQ ID NO: 9350226 - DNA, 22 bp, Homo sapiens
aagtttatgaagtctaagccaa

SEQ ID NO: 9350227 - DNA, 22 bp, Homo sapiens
aagtttatgaagtctaagccaa

SEQ ID NO: 9350228 - DNA, 22 bp, Homo sapiens
aagtttatctttgctgggtact

SEQ ID NO: 9350229 - DNA, 22 bp, Homo sapiens
aagtttatgttggtaagatatc

SEQ ID NO: 9350230 - DNA, 22 bp, Homo sapiens
aagtttatgttctttgaaggca

SEQ ID NO: 9350231 - DNA, 22 bp, Homo sapiens
aagtttatgttctttgaaggca

SEQ ID NO: 9350232 - DNA, 22 bp, Homo sapiens
aagtttatgttctttgaaggca

SEQ ID NO: 9350233 - DNA, 22 bp, Homo sapiens
aataatttccagccaactggaa

SEQ ID NO: 9350234 - DNA, 22 bp, Homo sapiens
aataattatttgagagcagacc

SEQ ID NO: 9350235 - DNA, 22 bp, Homo sapiens
aataattttagctcagagttgt

SEQ ID NO: 9350236 - DNA, 22 bp, Homo sapiens
aatacaatcaaattcactagca

SEQ ID NO: 9350237 - DNA, 22 bp, Homo sapiens
aataattacccatctttttgta

SEQ ID NO: 9350238 - DNA, 22 bp, Homo sapiens
aataattagtgggacagagaac

SEQ ID NO: 9350239 - DNA, 22 bp, Homo sapiens
actgccttttccattacttaat

SEQ ID NO: 9350240 - DNA, 20 bp, Homo sapiens
actgcctttaggtatccttg

SEQ ID NO: 9350241 - DNA, 20 bp, Homo sapiens
actgccttggttcagtaggt

SEQ ID NO: 9350242 - DNA, 22 bp, Homo sapiens
actgccttgtctcttgcctgtt

SEQ ID NO: 9350243 - DNA, 22 bp, Homo sapiens
aataatagttgcaaagtgttta

SEQ ID NO: 9350244 - DNA, 22 bp, Homo sapiens
aataatagttgcaaagtgttta

SEQ ID NO: 9350245 - DNA, 22 bp, Homo sapiens
actgccttctgctcagggttca

SEQ ID NO: 9350246 - DNA, 22 bp, Homo sapiens
actgccttctttaatcctagtt

SEQ ID NO: 9350247 - DNA, 22 bp, Homo sapiens
actgccttcttggccttcaaaa

SEQ ID NO: 9350248 - DNA, 22 bp, Homo sapiens
actgccttgaaagattgttgag

SEQ ID NO: 9350249 - DNA, 22 bp, Homo sapiens
actgccttgattcatgctgatg

SEQ ID NO: 9350250 - DNA, 22 bp, Homo sapiens
actgccttgattgccagtttcc

SEQ ID NO: 9350251 - DNA, 22 bp, Homo sapiens
actgccttcaaacagcgccacc

SEQ ID NO: 9350252 - DNA, 22 bp, Homo sapiens
actgccttcatgcagacccctg

SEQ ID NO: 9350253 - DNA, 22 bp, Homo sapiens
actgccttccacctatggatga

SEQ ID NO: 9350254 - DNA, 22 bp, Homo sapiens
actgccttatatgctgtgtgtg

SEQ ID NO: 9350255 - DNA, 22 bp, Homo sapiens
actgccttataatatgtcaaca

SEQ ID NO: 9350256 - DNA, 22 bp, Homo sapiens
actgccttataatatgtcaaca

SEQ ID NO: 9350257 - DNA, 22 bp, Homo sapiens
aataagattgacacaagtacct

SEQ ID NO: 9350258 - DNA, 22 bp, Homo sapiens
aataagatgtgcttgagtttgg

SEQ ID NO: 9350259 - DNA, 22 bp, Homo sapiens
aataagattactggttgtctga

SEQ ID NO: 9350260 - DNA, 22 bp, Homo sapiens
aataagatcttaaaggttatat

SEQ ID NO: 9350261 - DNA, 22 bp, Homo sapiens
aataagatcttaaaggttatat

SEQ ID NO: 9350262 - DNA, 22 bp, Homo sapiens
actgccttagaacaaagcagga

SEQ ID NO: 9350263 - DNA, 23 bp, Homo sapiens
actgcctgtgccgatctctctca

SEQ ID NO: 9350264 - DNA, 22 bp, Homo sapiens
actgcctgtgtcccttcagtgc

SEQ ID NO: 9350265 - DNA, 22 bp, Homo sapiens
aagtgctttcatatagtcttaa

SEQ ID NO: 9350266 - DNA, 22 bp, Homo sapiens
aagtgctttataaacaatgaag

SEQ ID NO: 9350267 - DNA, 22 bp, Homo sapiens
aagtgctttacaaatgtctgtt

SEQ ID NO: 9350268 - DNA, 22 bp, Homo sapiens
aagtggactaatacaaggacta

SEQ ID NO: 9350269 - DNA, 22 bp, Homo sapiens
aagtggaagagaagttatctta

SEQ ID NO: 9350270 - DNA, 23 bp, Homo sapiens
aagtgctttgggatggagtctgg

SEQ ID NO: 9350271 - DNA, 22 bp, Homo sapiens
aagtgctttttcttgagctgct

SEQ ID NO: 9350272 - DNA, 22 bp, Homo sapiens
aagtgcatacactagttaattg

SEQ ID NO: 9350273 - DNA, 21 bp, Homo sapiens
aagtggagaagaaaagctgga

SEQ ID NO: 9350274 - DNA, 22 bp, Homo sapiens
aagtggactaatacaaggacta

SEQ ID NO: 9350275 - DNA, 22 bp, Homo sapiens
aagtggagagccctggaggtct

SEQ ID NO: 9350276 - DNA, 21 bp, Homo sapiens
aagtggagaagaaaagctgga

SEQ ID NO: 9350277 - DNA, 22 bp, Homo sapiens
aagtggagagccctggaggtct

SEQ ID NO: 9350278 - DNA, 22 bp, Homo sapiens
aagtggagagccctggaggtct

SEQ ID NO: 9350279 - DNA, 22 bp, Homo sapiens
aagtggagccagggaaactgaa

SEQ ID NO: 9350280 - DNA, 22 bp, Homo sapiens
aagtggagccagggaaactgaa

SEQ ID NO: 9350281 - DNA, 22 bp, Homo sapiens
aagtggagctataggctcagat

SEQ ID NO: 9350282 - DNA, 22 bp, Homo sapiens
actaacatgttaatcaaaagaa

SEQ ID NO: 9350283 - DNA, 22 bp, Homo sapiens
aagtcagcactccaggaagcca

SEQ ID NO: 9350284 - DNA, 22 bp, Homo sapiens
aagtcagacagctgagctgcct

SEQ ID NO: 9350285 - DNA, 22 bp, Homo sapiens
aagtcagaaatatctgccatca

SEQ ID NO: 9350286 - DNA, 22 bp, Homo sapiens
aagtcagaaaacagagcaatta

SEQ ID NO: 9350287 - DNA, 22 bp, Homo sapiens
aagtcacttgattgttgacaga

SEQ ID NO: 9350288 - DNA, 22 bp, Homo sapiens
aagtcacagaacccattgtaac

SEQ ID NO: 9350289 - DNA, 22 bp, Homo sapiens
aagtcacagaacccattgtaac

SEQ ID NO: 9350290 - DNA, 17 bp, Homo sapiens
aagtcacttctgggcca

SEQ ID NO: 9350291 - DNA, 22 bp, Homo sapiens
aagtcactggcaaaagctgcag

SEQ ID NO: 9350292 - DNA, 22 bp, Homo sapiens
actccaggttttctctcaagtt

SEQ ID NO: 9350293 - DNA, 20 bp, Homo sapiens
actccaggtggcatgaggac

SEQ ID NO: 9350294 - DNA, 20 bp, Homo sapiens
actccaggtggcatgaggac

SEQ ID NO: 9350295 - DNA, 22 bp, Homo sapiens
actccaggtaggcacattgaca

SEQ ID NO: 9350296 - DNA, 22 bp, Homo sapiens
aagttcaagagtgacatattag

SEQ ID NO: 9350297 - DNA, 22 bp, Homo sapiens
aagttattggtggagagcactg

SEQ ID NO: 9350298 - DNA, 22 bp, Homo sapiens
aagttcaaaaatgtaatcagtg

SEQ ID NO: 9350299 - DNA, 22 bp, Homo sapiens
actccaggttttctctcaagtt

SEQ ID NO: 9350300 - DNA, 22 bp, Homo sapiens
actccaggttttttcactgaag

SEQ ID NO: 9350301 - DNA, 22 bp, Homo sapiens
actccatacaatggcaggctgt

SEQ ID NO: 9350302 - DNA, 18 bp, Homo sapiens
actccccacaggctctgt

SEQ ID NO: 9350303 - DNA, 22 bp, Homo sapiens
actccccaaaactaaccatgca

SEQ ID NO: 9350304 - DNA, 22 bp, Homo sapiens
actccccaaaactaaccatgca

SEQ ID NO: 9350305 - DNA, 22 bp, Homo sapiens
actcccaggttgcctggcaggc

SEQ ID NO: 9350306 - DNA, 22 bp, Homo sapiens
actccccagactgccatgctgg

SEQ ID NO: 9350307 - DNA, 22 bp, Homo sapiens
aagttctaattttgcattcagg

SEQ ID NO: 9350308 - DNA, 23 bp, Homo sapiens
actccccagtctcttcttgccaa

SEQ ID NO: 9350309 - DNA, 22 bp, Homo sapiens
actccccagactgccatgctgg

SEQ ID NO: 9350310 - DNA, 18 bp, Homo sapiens
actccccacaggctctgt

SEQ ID NO: 9350311 - DNA, 22 bp, Homo sapiens
aagtgttttgtaaacagaaaag

SEQ ID NO: 9350312 - DNA, 22 bp, Homo sapiens
aagttacattttggtctaattg

SEQ ID NO: 9350313 - DNA, 22 bp, Homo sapiens
aagttactggcaagggctgcag

SEQ ID NO: 9350314 - DNA, 20 bp, Homo sapiens
actaaggtggtagcagcagg

SEQ ID NO: 9350315 - DNA, 22 bp, Homo sapiens
actaagatgcaggaaatgctag

SEQ ID NO: 9350316 - DNA, 21 bp, Homo sapiens
actaagagatctctgtctcat

SEQ ID NO: 9350317 - DNA, 22 bp, Homo sapiens
actaattcaattaggaaaggaa

SEQ ID NO: 9350318 - DNA, 22 bp, Homo sapiens
actaagtgggacatttactagg

SEQ ID NO: 9350319 - DNA, 22 bp, Homo sapiens
aatatatagaagtacccgttgt

SEQ ID NO: 9350320 - DNA, 22 bp, Homo sapiens
aatatatagaagtacccgttgt

SEQ ID NO: 9350321 - DNA, 22 bp, Homo sapiens
acttgaggaagcagcaagggat

SEQ ID NO: 9350322 - DNA, 22 bp, Homo sapiens
aatatatgactccactgcatga

SEQ ID NO: 9350323 - DNA, 21 bp, Homo sapiens
aatatatgcaatgctttctgc

SEQ ID NO: 9350324 - DNA, 22 bp, Homo sapiens
aatatatgagggagctatttga

SEQ ID NO: 9350325 - DNA, 22 bp, Homo sapiens
aatatatgagggagctatttga

SEQ ID NO: 9350326 - DNA, 22 bp, Homo sapiens
aatatatagaagtacccgttgt

SEQ ID NO: 9350327 - DNA, 22 bp, Homo sapiens
aatatatagaagtacccgttgt

SEQ ID NO: 9350328 - DNA, 22 bp, Homo sapiens
aatatatagaagtacccgttgt

SEQ ID NO: 9350329 - DNA, 22 bp, Homo sapiens
aatatatagaagtacccgttgt

SEQ ID NO: 9350330 - DNA, 22 bp, Homo sapiens
aatatatgaccaggaagttctg

SEQ ID NO: 9350331 - DNA, 22 bp, Homo sapiens
aatatatgaccaggaagttctg

SEQ ID NO: 9350332 - DNA, 22 bp, Homo sapiens
aatatatgtggtattgaccagc

SEQ ID NO: 9350333 - DNA, 23 bp, Homo sapiens
aatatatgtgtttttctgcttca

SEQ ID NO: 9350334 - DNA, 22 bp, Homo sapiens
aatatatttgaatcaggaacaa

SEQ ID NO: 9350335 - DNA, 22 bp, Homo sapiens
aatatttgttagtgttttaatg

SEQ ID NO: 9350336 - DNA, 22 bp, Homo sapiens
aatattctaataaatgcccatc

SEQ ID NO: 9350337 - DNA, 19 bp, Homo sapiens
acttgaaagcagagagttt

SEQ ID NO: 9350338 - DNA, 22 bp, Homo sapiens
acttgaaaagctcagcagtagt

SEQ ID NO: 9350339 - DNA, 22 bp, Homo sapiens
acttgaaaccctgagatgataa

SEQ ID NO: 9350340 - DNA, 19 bp, Homo sapiens
acttcttttcaacacagga

SEQ ID NO: 9350341 - DNA, 22 bp, Homo sapiens
acttcttttcaaatcatgcaaa

SEQ ID NO: 9350342 - DNA, 22 bp, Homo sapiens
aatacaatcaaattcactagca

SEQ ID NO: 9350343 - DNA, 22 bp, Homo sapiens
aatacaatcaaattcactagca

SEQ ID NO: 9350344 - DNA, 22 bp, Homo sapiens
aatacagagaatgttatttgga

SEQ ID NO: 9350345 - DNA, 22 bp, Homo sapiens
aatcctgaggcaaagagatgag

SEQ ID NO: 9350346 - DNA, 22 bp, Homo sapiens
aatcctaagcatccttttctgc

SEQ ID NO: 9350347 - DNA, 22 bp, Homo sapiens
aatccctctgtcgggcatctgt

SEQ ID NO: 9350348 - DNA, 22 bp, Homo sapiens
aatcccagctactcaggaagtt

SEQ ID NO: 9350349 - DNA, 22 bp, Homo sapiens
aatccatttactctttacaaga

SEQ ID NO: 9350350 - DNA, 22 bp, Homo sapiens
aatccagctgtgtcacaggtga

SEQ ID NO: 9350351 - DNA, 22 bp, Homo sapiens
aatccataatgttgtggggttt

SEQ ID NO: 9350352 - DNA, 22 bp, Homo sapiens
aatccaggtggcggaggttgtg

SEQ ID NO: 9350353 - DNA, 22 bp, Homo sapiens
aatccataggtttttccaagag

SEQ ID NO: 9350354 - DNA, 22 bp, Homo sapiens
aatccatagaataaaattgcag

SEQ ID NO: 9350355 - DNA, 22 bp, Homo sapiens
acttggttggtctcaccctgtt

SEQ ID NO: 9350356 - DNA, 22 bp, Homo sapiens
acttgtaagctctgtatttgag

SEQ ID NO: 9350357 - DNA, 22 bp, Homo sapiens
acttgtctggcagatcatgcaa

SEQ ID NO: 9350358 - DNA, 22 bp, Homo sapiens
acttgtctaccatgaatattta

SEQ ID NO: 9350359 - DNA, 22 bp, Homo sapiens
acttgtctatggttacatccta

SEQ ID NO: 9350360 - DNA, 22 bp, Homo sapiens
acttgtctttgtaaaatagaaa

SEQ ID NO: 9350361 - DNA, 22 bp, Homo sapiens
aatcaacattgttttaagtcaa

SEQ ID NO: 9350362 - DNA, 22 bp, Homo sapiens
aatcaaaacctacagaggtaat

SEQ ID NO: 9350363 - DNA, 22 bp, Homo sapiens
aatattttaggctttccaggct

SEQ ID NO: 9350364 - DNA, 22 bp, Homo sapiens
aatatttttgaggccctgttat

SEQ ID NO: 9350365 - DNA, 22 bp, Homo sapiens
aatatttttgaggccctgttat

SEQ ID NO: 9350366 - DNA, 22 bp, Homo sapiens
aatatttttgaggccctgttat

SEQ ID NO: 9350367 - DNA, 22 bp, Homo sapiens
agaagggagagaaagttggtta

SEQ ID NO: 9350368 - DNA, 18 bp, Homo sapiens
agaaggagctatgggcag

SEQ ID NO: 9350369 - DNA, 20 bp, Homo sapiens
aatgagttattttgtatatg

SEQ ID NO: 9350370 - DNA, 20 bp, Homo sapiens
aatgagttattttgtatatg

SEQ ID NO: 9350371 - DNA, 22 bp, Homo sapiens
aatgaggttttttaaagccaga

SEQ ID NO: 9350372 - DNA, 22 bp, Homo sapiens
aatgagatggaattcccgccta

SEQ ID NO: 9350373 - DNA, 22 bp, Homo sapiens
aatgagggggatgggaaagtgt

SEQ ID NO: 9350374 - DNA, 22 bp, Homo sapiens
aatgacctgggtgtcatttcat

SEQ ID NO: 9350375 - DNA, 22 bp, Homo sapiens
aatgaatgtttgttgagtgaag

SEQ ID NO: 9350376 - DNA, 22 bp, Homo sapiens
agaaatacttaatctttgcagg

SEQ ID NO: 9350377 - DNA, 22 bp, Homo sapiens
agaaatactgtgagagcagcct

SEQ ID NO: 9350378 - DNA, 22 bp, Homo sapiens
agaaatactgcctaagactgta

SEQ ID NO: 9350379 - DNA, 22 bp, Homo sapiens
aatgactgtagtcatattaagg

SEQ ID NO: 9350380 - DNA, 22 bp, Homo sapiens
agaaataagagctttccttggg

SEQ ID NO: 9350381 - DNA, 22 bp, Homo sapiens
agaaataagagctttccttggg

SEQ ID NO: 9350382 - DNA, 21 bp, Homo sapiens
agaaatacagcagggatgatc

SEQ ID NO: 9350383 - DNA, 22 bp, Homo sapiens
agaaatacaaagtactaagata

SEQ ID NO: 9350384 - DNA, 20 bp, Homo sapiens
agaaatacatgcatgcatga

SEQ ID NO: 9350385 - DNA, 20 bp, Homo sapiens
agaaatacatgcatgcatga

SEQ ID NO: 9350386 - DNA, 20 bp, Homo sapiens
agaaatacatgcatgcatga

SEQ ID NO: 9350387 - DNA, 20 bp, Homo sapiens
agaaataccacatttggcaa

SEQ ID NO: 9350388 - DNA, 22 bp, Homo sapiens
agaaatacattctctggtgtgt

SEQ ID NO: 9350389 - DNA, 18 bp, Homo sapiens
agaaataccagtattgga

SEQ ID NO: 9350390 - DNA, 18 bp, Homo sapiens
agaaataccagtattgga

SEQ ID NO: 9350391 - DNA, 20 bp, Homo sapiens
agaaataccacatttggcaa

SEQ ID NO: 9350392 - DNA, 22 bp, Homo sapiens
agaaatactaggaatattcata

SEQ ID NO: 9350393 - DNA, 22 bp, Homo sapiens
agaaatactaggaatattcata

SEQ ID NO: 9350394 - DNA, 22 bp, Homo sapiens
aatgaacagtgggtgaggtacc

SEQ ID NO: 9350395 - DNA, 22 bp, Homo sapiens
agaaaacattacataggtgtgt

SEQ ID NO: 9350396 - DNA, 22 bp, Homo sapiens
aatcctggaatgagtttgctga

SEQ ID NO: 9350397 - DNA, 22 bp, Homo sapiens
agaaaaatcttggcgcttgtct

SEQ ID NO: 9350398 - DNA, 22 bp, Homo sapiens
agaaaacactgccccctctctc

SEQ ID NO: 9350399 - DNA, 22 bp, Homo sapiens
agaaaacactgccccctctctc

SEQ ID NO: 9350400 - DNA, 22 bp, Homo sapiens
agaaaacataggagacaggaaa

SEQ ID NO: 9350401 - DNA, 22 bp, Homo sapiens
agaaaacagaaagtcattggtg

SEQ ID NO: 9350402 - DNA, 19 bp, Homo sapiens
aacatggaactggagaggg

SEQ ID NO: 9350403 - DNA, 22 bp, Homo sapiens
aacatgtaaatatcattgtact

SEQ ID NO: 9350404 - DNA, 22 bp, Homo sapiens
aacatgtaaatatcattgtact

SEQ ID NO: 9350405 - DNA, 22 bp, Homo sapiens
aataacttcagttcttacatta

SEQ ID NO: 9350406 - DNA, 22 bp, Homo sapiens
aataacttcagttcttacatta

SEQ ID NO: 9350407 - DNA, 22 bp, Homo sapiens
aataacttcagttcttacatta

SEQ ID NO: 9350408 - DNA, 22 bp, Homo sapiens
aataacttcatgtaacatttaa

SEQ ID NO: 9350409 - DNA, 22 bp, Homo sapiens
aataacttcatcttcaggatag

SEQ ID NO: 9350410 - DNA, 22 bp, Homo sapiens
aataacttcatcttcaggatag

SEQ ID NO: 9350411 - DNA, 22 bp, Homo sapiens
aataacttgtatggttattcca

SEQ ID NO: 9350412 - DNA, 22 bp, Homo sapiens
aataacttgaagatctcttcca

SEQ ID NO: 9350413 - DNA, 22 bp, Homo sapiens
aataacttgaagatctcttcca

SEQ ID NO: 9350414 - DNA, 20 bp, Homo sapiens
aaccaacagaatcatgtctc

SEQ ID NO: 9350415 - DNA, 22 bp, Homo sapiens
aataacttttaaaagaccctgg

SEQ ID NO: 9350416 - DNA, 22 bp, Homo sapiens
aataagaactccatttactcgt

SEQ ID NO: 9350417 - DNA, 22 bp, Homo sapiens
aataagaacaactaaggtttat

SEQ ID NO: 9350418 - DNA, 22 bp, Homo sapiens
aataagaacaactaaggtttat

SEQ ID NO: 9350419 - DNA, 22 bp, Homo sapiens
aaccagaggggccctgcctggg

SEQ ID NO: 9350420 - DNA, 21 bp, Homo sapiens
aaccagagccaggctctcagc

SEQ ID NO: 9350421 - DNA, 22 bp, Homo sapiens
aatataaattcctgggcccagc

SEQ ID NO: 9350422 - DNA, 22 bp, Homo sapiens
aatagtttgaatttatcagatg

SEQ ID NO: 9350423 - DNA, 22 bp, Homo sapiens
aaccacagacccagactagaga

SEQ ID NO: 9350424 - DNA, 22 bp, Homo sapiens
aaccacaacactaaatgctggt

SEQ ID NO: 9350425 - DNA, 22 bp, Homo sapiens
aaccacaacactaaatgctggt

SEQ ID NO: 9350426 - DNA, 22 bp, Homo sapiens
aaccacagagccccctcagatg

SEQ ID NO: 9350427 - DNA, 22 bp, Homo sapiens
aaccacagacccagactagaga

SEQ ID NO: 9350428 - DNA, 22 bp, Homo sapiens
aacatgaaacccaaacagaata

SEQ ID NO: 9350429 - DNA, 22 bp, Homo sapiens
aacatgctgcctttctacgagt

SEQ ID NO: 9350430 - DNA, 22 bp, Homo sapiens
aacatgctctgtttcttggatg

SEQ ID NO: 9350431 - DNA, 22 bp, Homo sapiens
aacatgcatgttatttatcagt

SEQ ID NO: 9350432 - DNA, 22 bp, Homo sapiens
aacatgcatgaagaagttatat

SEQ ID NO: 9350433 - DNA, 18 bp, Homo sapiens
aacatgcattagaactgc

SEQ ID NO: 9350434 - DNA, 18 bp, Homo sapiens
aacatgcattagaactgc

SEQ ID NO: 9350435 - DNA, 18 bp, Homo sapiens
aacatgcattagaactgc

SEQ ID NO: 9350436 - DNA, 22 bp, Homo sapiens
aacaggcttcttctgggctcct

SEQ ID NO: 9350437 - DNA, 22 bp, Homo sapiens
aacaggctggccttgaagcagt

SEQ ID NO: 9350438 - DNA, 22 bp, Homo sapiens
aacaggcttttggaaagttaca

SEQ ID NO: 9350439 - DNA, 22 bp, Homo sapiens
aacagggctttggaagtctccg

SEQ ID NO: 9350440 - DNA, 20 bp, Homo sapiens
aacagggcagaagcggagac

SEQ ID NO: 9350441 - DNA, 20 bp, Homo sapiens
aacagggcagaagcggagac

SEQ ID NO: 9350442 - DNA, 22 bp, Homo sapiens
aacaggcctatagggaaggcgc

SEQ ID NO: 9350443 - DNA, 22 bp, Homo sapiens
aacaggcaggagaattctgcct

SEQ ID NO: 9350444 - DNA, 22 bp, Homo sapiens
aacaggcaggagaattctgcct

SEQ ID NO: 9350445 - DNA, 22 bp, Homo sapiens
aacaggctagttttaaagcata

SEQ ID NO: 9350446 - DNA, 22 bp, Homo sapiens
aacaggcaaactgtgggatccc

SEQ ID NO: 9350447 - DNA, 22 bp, Homo sapiens
aacaggagtcattgtcattatt

SEQ ID NO: 9350448 - DNA, 22 bp, Homo sapiens
aacaggcaacagttgactctga

SEQ ID NO: 9350449 - DNA, 22 bp, Homo sapiens
aacaggcaacagttgactctga

SEQ ID NO: 9350450 - DNA, 22 bp, Homo sapiens
aacaggcaatttaggactcttt

SEQ ID NO: 9350451 - DNA, 22 bp, Homo sapiens
aacaggaggccttccagtccag

SEQ ID NO: 9350452 - DNA, 22 bp, Homo sapiens
aacaggagtcattgtcattatt

SEQ ID NO: 9350453 - DNA, 22 bp, Homo sapiens
aacaggagtcattgtcattatt

SEQ ID NO: 9350454 - DNA, 22 bp, Homo sapiens
aacaggaggccttccagtccag

SEQ ID NO: 9350455 - DNA, 22 bp, Homo sapiens
aacaggagagtaaatatatgat

SEQ ID NO: 9350456 - DNA, 22 bp, Homo sapiens
aacaggagagtaaatatatgat

SEQ ID NO: 9350457 - DNA, 22 bp, Homo sapiens
aacaggagaggggaatgtagag

SEQ ID NO: 9350458 - DNA, 22 bp, Homo sapiens
aacaggagaggggaatgtagag

SEQ ID NO: 9350459 - DNA, 22 bp, Homo sapiens
aacaggaattgcaggcagatct

SEQ ID NO: 9350460 - DNA, 22 bp, Homo sapiens
aacaggaattgcaggcagatct

SEQ ID NO: 9350461 - DNA, 22 bp, Homo sapiens
aatgatatagcagacatagcct

SEQ ID NO: 9350462 - DNA, 22 bp, Homo sapiens
aactgctgtggcctagtactta

SEQ ID NO: 9350463 - DNA, 22 bp, Homo sapiens
aactgcatttaacaaatactct

SEQ ID NO: 9350464 - DNA, 22 bp, Homo sapiens
aatgatatgcaaattatcatca

SEQ ID NO: 9350465 - DNA, 22 bp, Homo sapiens
aatgatatttattgaatagatg

SEQ ID NO: 9350466 - DNA, 22 bp, Homo sapiens
aatgatcacctggtaaagagag

SEQ ID NO: 9350467 - DNA, 22 bp, Homo sapiens
aatgatatagcagacatagcct

SEQ ID NO: 9350468 - DNA, 22 bp, Homo sapiens
aatgatcattataaagtgctct

SEQ ID NO: 9350469 - DNA, 19 bp, Homo sapiens
aactgtaaagatctgtagc

SEQ ID NO: 9350470 - DNA, 22 bp, Homo sapiens
aacttaaacccactcatgtaga

SEQ ID NO: 9350471 - DNA, 23 bp, Homo sapiens
aacttaatactgggataagatgc

SEQ ID NO: 9350472 - DNA, 22 bp, Homo sapiens
aacttacaatgttagagtctca

SEQ ID NO: 9350473 - DNA, 22 bp, Homo sapiens
aacttacaaggatgatagctgc

SEQ ID NO: 9350474 - DNA, 22 bp, Homo sapiens
aacttacaaggatgatagctgc

SEQ ID NO: 9350475 - DNA, 23 bp, Homo sapiens
aacttaatactgggataagatgc

SEQ ID NO: 9350476 - DNA, 22 bp, Homo sapiens
aacttaatccaacacgggcatc

SEQ ID NO: 9350477 - DNA, 22 bp, Homo sapiens
aacttaatgatttcatgcatgt

SEQ ID NO: 9350478 - DNA, 22 bp, Homo sapiens
aatcatgaaatatcagttcttt

SEQ ID NO: 9350479 - DNA, 22 bp, Homo sapiens
aatcatggcgtgtttagcttaa

SEQ ID NO: 9350480 - DNA, 21 bp, Homo sapiens
aatcatacaaaacatgtcagg

SEQ ID NO: 9350481 - DNA, 21 bp, Homo sapiens
aatcatacaaaacatgtcagg

SEQ ID NO: 9350482 - DNA, 22 bp, Homo sapiens
aatcatcacgaacacaacagcg

SEQ ID NO: 9350483 - DNA, 22 bp, Homo sapiens
aatcatcctgaagtcaataaag

SEQ ID NO: 9350484 - DNA, 22 bp, Homo sapiens
aatcatctccgaaaaaagagta

SEQ ID NO: 9350485 - DNA, 22 bp, Homo sapiens
aatcattgagacaaattagctt

SEQ ID NO: 9350486 - DNA, 22 bp, Homo sapiens
aatcattgctcctttctctggt

SEQ ID NO: 9350487 - DNA, 22 bp, Homo sapiens
aatcattgtaaatggttttgtt

SEQ ID NO: 9350488 - DNA, 22 bp, Homo sapiens
aatccaatcctactcagaaagt

SEQ ID NO: 9350489 - DNA, 22 bp, Homo sapiens
aatcattgttgtcgttcctaga

SEQ ID NO: 9350490 - DNA, 22 bp, Homo sapiens
aatcattgttcttcagatttga

SEQ ID NO: 9350491 - DNA, 22 bp, Homo sapiens
aatcattctcatgccagtttcc

SEQ ID NO: 9350492 - DNA, 22 bp, Homo sapiens
aatcattcttatttcacagcaa

SEQ ID NO: 9350493 - DNA, 22 bp, Homo sapiens
aatcatgtttcagatgagtttt

SEQ ID NO: 9350494 - DNA, 22 bp, Homo sapiens
aatcatgtttacgtgacatgtc

SEQ ID NO: 9350495 - DNA, 22 bp, Homo sapiens
aactgcattgtactaaacttgt

SEQ ID NO: 9350496 - DNA, 22 bp, Homo sapiens
aactgcaattacttttgcacta

SEQ ID NO: 9350497 - DNA, 22 bp, Homo sapiens
aactgcaattacttttgcacta

SEQ ID NO: 9350498 - DNA, 22 bp, Homo sapiens
aactgcaatcacttttgcacca

SEQ ID NO: 9350499 - DNA, 22 bp, Homo sapiens
aactgcaattacttttgcacca

SEQ ID NO: 9350500 - DNA, 22 bp, Homo sapiens
aactgcaatcacttttgcacca

SEQ ID NO: 9350501 - DNA, 22 bp, Homo sapiens
aactgcaattacttttgcacca

SEQ ID NO: 9350502 - DNA, 22 bp, Homo sapiens
aactgaaacggtgatcttttaa

SEQ ID NO: 9350503 - DNA, 22 bp, Homo sapiens
aactacagaatcatagaaaata

SEQ ID NO: 9350504 - DNA, 22 bp, Homo sapiens
aactacagcatctatacaaata

SEQ ID NO: 9350505 - DNA, 22 bp, Homo sapiens
aactacagaaaaggtaagctct

SEQ ID NO: 9350506 - DNA, 22 bp, Homo sapiens
aatataatgctgttttatgcca

SEQ ID NO: 9350507 - DNA, 22 bp, Homo sapiens
aatataatgctgttttatgcca

SEQ ID NO: 9350508 - DNA, 22 bp, Homo sapiens
aatataatgctgttttatgcca

SEQ ID NO: 9350509 - DNA, 22 bp, Homo sapiens
aatcataattttgtgaatgtag

SEQ ID NO: 9350510 - DNA, 22 bp, Homo sapiens
aactacagctcttgtctttctg

SEQ ID NO: 9350511 - DNA, 22 bp, Homo sapiens
aactacagggggtggcaggcgg

SEQ ID NO: 9350512 - DNA, 19 bp, Homo sapiens
aactacagcgcactgtcct

SEQ ID NO: 9350513 - DNA, 21 bp, Homo sapiens
aactacagttgttccttcatt

SEQ ID NO: 9350514 - DNA, 22 bp, Homo sapiens
aactacagtgggcagaggcaat

SEQ ID NO: 9350515 - DNA, 22 bp, Homo sapiens
aactacagtagtttgcccttct

SEQ ID NO: 9350516 - DNA, 22 bp, Homo sapiens
aactacagtatgtccaaagaat

SEQ ID NO: 9350517 - DNA, 22 bp, Homo sapiens
aacagcagggacttgaatggaa

SEQ ID NO: 9350518 - DNA, 22 bp, Homo sapiens
aaggtctggatgatgggtgtgc

SEQ ID NO: 9350519 - DNA, 22 bp, Homo sapiens
aacagcaggcaccaaggctatg

SEQ ID NO: 9350520 - DNA, 23 bp, Homo sapiens
aacagcaggatgatagaggaggt

SEQ ID NO: 9350521 - DNA, 22 bp, Homo sapiens
aacagcaggcaccaaggctatg

SEQ ID NO: 9350522 - DNA, 22 bp, Homo sapiens
aacagcagctttcaggatcatc

SEQ ID NO: 9350523 - DNA, 22 bp, Homo sapiens
aagtccaggtccaggaggttcc

SEQ ID NO: 9350524 - DNA, 22 bp, Homo sapiens
aacaggaattgatgggagtcct

SEQ ID NO: 9350525 - DNA, 22 bp, Homo sapiens
aacaggaatgaggagaaaaggt

SEQ ID NO: 9350526 - DNA, 22 bp, Homo sapiens
aacagcttgaggaatatcatca

SEQ ID NO: 9350527 - DNA, 22 bp, Homo sapiens
aagtcatgagtcctcttctgtg

SEQ ID NO: 9350528 - DNA, 22 bp, Homo sapiens
aagtcatcttgagtctaagatt

SEQ ID NO: 9350529 - DNA, 22 bp, Homo sapiens
aacagcctcagtgagattagga

SEQ ID NO: 9350530 - DNA, 22 bp, Homo sapiens
aagtcattggtagcttgatagg

SEQ ID NO: 9350531 - DNA, 22 bp, Homo sapiens
aagtccaaggtcaccattcaca

SEQ ID NO: 9350532 - DNA, 22 bp, Homo sapiens
aagtccaaggctgggtgcagtg

SEQ ID NO: 9350533 - DNA, 22 bp, Homo sapiens
aaggtcactgatcagttgagta

SEQ ID NO: 9350534 - DNA, 22 bp, Homo sapiens
aaggtcaaagacagtaactttt

SEQ ID NO: 9350535 - DNA, 22 bp, Homo sapiens
aaggtatcagtaaagctctgcc

SEQ ID NO: 9350536 - DNA, 22 bp, Homo sapiens
aacactgaagaccaggtaattt

SEQ ID NO: 9350537 - DNA, 22 bp, Homo sapiens
aacaaatgacctgatttcttcc

SEQ ID NO: 9350538 - DNA, 22 bp, Homo sapiens
aacaaatgacctgatttcttcc

SEQ ID NO: 9350539 - DNA, 22 bp, Homo sapiens
aacaaatggggccttgtatgaa

SEQ ID NO: 9350540 - DNA, 22 bp, Homo sapiens
aacaccagtcccaagagaggct

SEQ ID NO: 9350541 - DNA, 19 bp, Homo sapiens
aacaccagagtcaggagtc

SEQ ID NO: 9350542 - DNA, 22 bp, Homo sapiens
aacactctctgttggtaaggct

SEQ ID NO: 9350543 - DNA, 22 bp, Homo sapiens
aacactctctgttggtaaggct

SEQ ID NO: 9350544 - DNA, 22 bp, Homo sapiens
aaatgtgtgtatgtacatatat

SEQ ID NO: 9350545 - DNA, 19 bp, Homo sapiens
aaatgtgatggtacaattc

SEQ ID NO: 9350546 - DNA, 22 bp, Homo sapiens
aaatgtctatctggcatattcc

SEQ ID NO: 9350547 - DNA, 22 bp, Homo sapiens
aaatgtgtttagatggtttatt

SEQ ID NO: 9350548 - DNA, 22 bp, Homo sapiens
aaatgtgtttgataggaatatt

SEQ ID NO: 9350549 - DNA, 22 bp, Homo sapiens
aaatgtgtttctttgtgaatgg

SEQ ID NO: 9350550 - DNA, 22 bp, Homo sapiens
aaatgtgtttgataggaatatt

SEQ ID NO: 9350551 - DNA, 22 bp, Homo sapiens
aaattccattttgtgactattc

SEQ ID NO: 9350552 - DNA, 22 bp, Homo sapiens
aaatgttttgctcccatgtggt

SEQ ID NO: 9350553 - DNA, 21 bp, Homo sapiens
aaattcacctagtaaaacttc

SEQ ID NO: 9350554 - DNA, 22 bp, Homo sapiens
aaatgtttaagtgtaggagcaa

SEQ ID NO: 9350555 - DNA, 22 bp, Homo sapiens
aaatgtttctacttgtgagcat

SEQ ID NO: 9350556 - DNA, 22 bp, Homo sapiens
aaatgtttctacttgtgagcat

SEQ ID NO: 9350557 - DNA, 22 bp, Homo sapiens
aacaaacagttaagtgtggatg

SEQ ID NO: 9350558 - DNA, 22 bp, Homo sapiens
aaattgcattcaggatgcagga

SEQ ID NO: 9350559 - DNA, 22 bp, Homo sapiens
aaattgcattcaggatgcagga

SEQ ID NO: 9350560 - DNA, 22 bp, Homo sapiens
aacaaacattacctggtgctgg

SEQ ID NO: 9350561 - DNA, 22 bp, Homo sapiens
aacaaacattacctggtgctgg

SEQ ID NO: 9350562 - DNA, 22 bp, Homo sapiens
aacaaacattacctggtgctgg

SEQ ID NO: 9350563 - DNA, 20 bp, Homo sapiens
aacaaactacaaaattatgt

SEQ ID NO: 9350564 - DNA, 20 bp, Homo sapiens
aacaaactacaaaattatgt

SEQ ID NO: 9350565 - DNA, 22 bp, Homo sapiens
aacaaagatgggtgggaaagag

SEQ ID NO: 9350566 - DNA, 22 bp, Homo sapiens
aacaaagcaccactgagtcagt

SEQ ID NO: 9350567 - DNA, 22 bp, Homo sapiens
aacaaagatgggtgggaaagag

SEQ ID NO: 9350568 - DNA, 22 bp, Homo sapiens
aacaaaggccgttaataaccac

SEQ ID NO: 9350569 - DNA, 22 bp, Homo sapiens
aacaaagccctgcccaagagct

SEQ ID NO: 9350570 - DNA, 22 bp, Homo sapiens
aaattgatgttcccagttgaaa

SEQ ID NO: 9350571 - DNA, 22 bp, Homo sapiens
aaattgcaaaagtacttttagg

SEQ ID NO: 9350572 - DNA, 22 bp, Homo sapiens
aaattgatgttcccagttgaaa

SEQ ID NO: 9350573 - DNA, 22 bp, Homo sapiens
aaattgcacaatatagacatga

SEQ ID NO: 9350574 - DNA, 22 bp, Homo sapiens
aaattctttggcctactttgaa

SEQ ID NO: 9350575 - DNA, 22 bp, Homo sapiens
aaattgaatgattaagtggtga

SEQ ID NO: 9350576 - DNA, 22 bp, Homo sapiens
aaattgaatttgggaaacattg

SEQ ID NO: 9350577 - DNA, 22 bp, Homo sapiens
aaattctttggcctactttgaa

SEQ ID NO: 9350578 - DNA, 22 bp, Homo sapiens
aaattctttcatggctaataag

SEQ ID NO: 9350579 - DNA, 22 bp, Homo sapiens
aaattctggcctatcacagtga

SEQ ID NO: 9350580 - DNA, 22 bp, Homo sapiens
aaattctgcaatttgacaagat

SEQ ID NO: 9350581 - DNA, 19 bp, Homo sapiens
aaattctgacagtctttta

SEQ ID NO: 9350582 - DNA, 22 bp, Homo sapiens
aaattctatgtcaatgtttatt

SEQ ID NO: 9350583 - DNA, 22 bp, Homo sapiens
aaattctaaggtcacaatgttg

SEQ ID NO: 9350584 - DNA, 22 bp, Homo sapiens
aaattctaaggtcacaatgttg

SEQ ID NO: 9350585 - DNA, 22 bp, Homo sapiens
aaattctctaaagaaaacatga

SEQ ID NO: 9350586 - DNA, 22 bp, Homo sapiens
aaattctcaagtgatcctgttg

SEQ ID NO: 9350587 - DNA, 22 bp, Homo sapiens
aagagattcctcactcagaatg

SEQ ID NO: 9350588 - DNA, 22 bp, Homo sapiens
aagagatgatggcagccagagg

SEQ ID NO: 9350589 - DNA, 22 bp, Homo sapiens
aagagatgctttacatcggatg

SEQ ID NO: 9350590 - DNA, 22 bp, Homo sapiens
acaaggacatgcaatttggatt

SEQ ID NO: 9350591 - DNA, 22 bp, Homo sapiens
aagagattggttataagagatt

SEQ ID NO: 9350592 - DNA, 22 bp, Homo sapiens
acaaggagaagaaattggtcat

SEQ ID NO: 9350593 - DNA, 22 bp, Homo sapiens
acaaggatctgtgtaggcaggc

SEQ ID NO: 9350594 - DNA, 22 bp, Homo sapiens
acaaggattaaatgatatacag

SEQ ID NO: 9350595 - DNA, 22 bp, Homo sapiens
acaaggattaaggtatgcaaca

SEQ ID NO: 9350596 - DNA, 22 bp, Homo sapiens
acaaggagagcacacatgggga

SEQ ID NO: 9350597 - DNA, 22 bp, Homo sapiens
aagagagggacttattaaagtc

SEQ ID NO: 9350598 - DNA, 22 bp, Homo sapiens
aagagagggacttattaaagtc

SEQ ID NO: 9350599 - DNA, 22 bp, Homo sapiens
aagagagggatttggtttattg

SEQ ID NO: 9350600 - DNA, 22 bp, Homo sapiens
aagagagggatttggtttattg

SEQ ID NO: 9350601 - DNA, 22 bp, Homo sapiens
aagagaggggttgcatggaaat

SEQ ID NO: 9350602 - DNA, 22 bp, Homo sapiens
aagagaggggttgcatggaaat

SEQ ID NO: 9350603 - DNA, 22 bp, Homo sapiens
aagagaggggttgcatggaaat

SEQ ID NO: 9350604 - DNA, 22 bp, Homo sapiens
aagagaggggttgcatggaaat

SEQ ID NO: 9350605 - DNA, 22 bp, Homo sapiens
aagagaggggttgcatggaaat

SEQ ID NO: 9350606 - DNA, 17 bp, Homo sapiens
aagagaggctgagctgg

SEQ ID NO: 9350607 - DNA, 17 bp, Homo sapiens
aagagaggctgagctgg

SEQ ID NO: 9350608 - DNA, 17 bp, Homo sapiens
aagagaggctgagctgg

SEQ ID NO: 9350609 - DNA, 22 bp, Homo sapiens
aagagaggacatggtgaacctg

SEQ ID NO: 9350610 - DNA, 22 bp, Homo sapiens
aagagaggacatggtgaacctg

SEQ ID NO: 9350611 - DNA, 22 bp, Homo sapiens
acaaagattcatttgcattatt

SEQ ID NO: 9350612 - DNA, 22 bp, Homo sapiens
acaaagccagattctggagcac

SEQ ID NO: 9350613 - DNA, 22 bp, Homo sapiens
aagagagaacacagcttgggca

SEQ ID NO: 9350614 - DNA, 22 bp, Homo sapiens
aagagagaacacagcttgggca

SEQ ID NO: 9350615 - DNA, 22 bp, Homo sapiens
aagagagaacacagcttgggca

SEQ ID NO: 9350616 - DNA, 22 bp, Homo sapiens
acaaagatgtttaaagcattta

SEQ ID NO: 9350617 - DNA, 22 bp, Homo sapiens
acaaagatgtttaaagcattta

SEQ ID NO: 9350618 - DNA, 22 bp, Homo sapiens
aagacataaaacagtcagcgaa

SEQ ID NO: 9350619 - DNA, 22 bp, Homo sapiens
aagacattactggaatctgact

SEQ ID NO: 9350620 - DNA, 22 bp, Homo sapiens
aagacattactggaatctgact

SEQ ID NO: 9350621 - DNA, 22 bp, Homo sapiens
acaaagagggaccagtgacttg

SEQ ID NO: 9350622 - DNA, 22 bp, Homo sapiens
acaaagataagtcagaaagtca

SEQ ID NO: 9350623 - DNA, 22 bp, Homo sapiens
aagagctggctcttgcagcagc

SEQ ID NO: 9350624 - DNA, 22 bp, Homo sapiens
aagagctgtgggtggtagtcct

SEQ ID NO: 9350625 - DNA, 18 bp, Homo sapiens
aagagcttcgcatataca

SEQ ID NO: 9350626 - DNA, 21 bp, Homo sapiens
aagagctggatcaaggataag

SEQ ID NO: 9350627 - DNA, 22 bp, Homo sapiens
aagagctggagtttgcagccct

SEQ ID NO: 9350628 - DNA, 22 bp, Homo sapiens
aagagctggagctgctacagga

SEQ ID NO: 9350629 - DNA, 22 bp, Homo sapiens
aagagctggaagtgaagataac

SEQ ID NO: 9350630 - DNA, 22 bp, Homo sapiens
aagagcagtgttttactcagct

SEQ ID NO: 9350631 - DNA, 19 bp, Homo sapiens
aagagcagggaaagaattg

SEQ ID NO: 9350632 - DNA, 20 bp, Homo sapiens
aagagctgactcacagtggt

SEQ ID NO: 9350633 - DNA, 22 bp, Homo sapiens
aagagctatgttaaggaagaga

SEQ ID NO: 9350634 - DNA, 20 bp, Homo sapiens
aagagctgactcacagtggt

SEQ ID NO: 9350635 - DNA, 22 bp, Homo sapiens
acaaggctgtgggagaacctct

SEQ ID NO: 9350636 - DNA, 22 bp, Homo sapiens
acaaggcagtacaatgatgaca

SEQ ID NO: 9350637 - DNA, 22 bp, Homo sapiens
acaaggccaagcattctagcaa

SEQ ID NO: 9350638 - DNA, 23 bp, Homo sapiens
acaaggcaacatagatcagggca

SEQ ID NO: 9350639 - DNA, 22 bp, Homo sapiens
aacttagtttagggtattgatt

SEQ ID NO: 9350640 - DNA, 22 bp, Homo sapiens
aacttatcagactgatgtatgg

SEQ ID NO: 9350641 - DNA, 22 bp, Homo sapiens
aacttatacccagggcagaaat

SEQ ID NO: 9350642 - DNA, 22 bp, Homo sapiens
aacttatcagactgatgtatgg

SEQ ID NO: 9350643 - DNA, 22 bp, Homo sapiens
aacttcatgtaatttaaaacag

SEQ ID NO: 9350644 - DNA, 21 bp, Homo sapiens
aagaaagataattaaggaccc

SEQ ID NO: 9350645 - DNA, 22 bp, Homo sapiens
aagaaatattgggccttataaa

SEQ ID NO: 9350646 - DNA, 22 bp, Homo sapiens
aagaaatacatggtttttgagt

SEQ ID NO: 9350647 - DNA, 22 bp, Homo sapiens
aagaaatacatggtttttgagt

SEQ ID NO: 9350648 - DNA, 22 bp, Homo sapiens
aagaaatattgggccttataaa

SEQ ID NO: 9350649 - DNA, 22 bp, Homo sapiens
aagaaatcatatcatttcttgg

SEQ ID NO: 9350650 - DNA, 22 bp, Homo sapiens
aatgttttgcattagttttcta

SEQ ID NO: 9350651 - DNA, 22 bp, Homo sapiens
aatgttttctgactgctaactt

SEQ ID NO: 9350652 - DNA, 22 bp, Homo sapiens
aatgttttatagctcaagcaat

SEQ ID NO: 9350653 - DNA, 22 bp, Homo sapiens
aatgttttcattatcctaactg

SEQ ID NO: 9350654 - DNA, 22 bp, Homo sapiens
aatgttttcattatcctaactg

SEQ ID NO: 9350655 - DNA, 22 bp, Homo sapiens
aatgttttcccagtgcagacga

SEQ ID NO: 9350656 - DNA, 22 bp, Homo sapiens
aagaaatgctgatgttggatgg

SEQ ID NO: 9350657 - DNA, 22 bp, Homo sapiens
aattggttattctgtccttttt

SEQ ID NO: 9350658 - DNA, 22 bp, Homo sapiens
aattggcatagcatacaattca

SEQ ID NO: 9350659 - DNA, 22 bp, Homo sapiens
aattggcagaactttatatatt

SEQ ID NO: 9350660 - DNA, 22 bp, Homo sapiens
aattggaaaatgctacatatca

SEQ ID NO: 9350661 - DNA, 22 bp, Homo sapiens
aagaataagtagatgggagaag

SEQ ID NO: 9350662 - DNA, 22 bp, Homo sapiens
aagaatacgtatcaacaatggt

SEQ ID NO: 9350663 - DNA, 22 bp, Homo sapiens
aagaataagtagatgggagaag

SEQ ID NO: 9350664 - DNA, 22 bp, Homo sapiens
aagaataaattaagatacttag

SEQ ID NO: 9350665 - DNA, 22 bp, Homo sapiens
aagaataaattaagatacttag

SEQ ID NO: 9350666 - DNA, 22 bp, Homo sapiens
aagaataacacttaggttttgc

SEQ ID NO: 9350667 - DNA, 22 bp, Homo sapiens
aattgtcaaaaattgcaattgt

SEQ ID NO: 9350668 - DNA, 22 bp, Homo sapiens
aattgttgtacagaataaatga

SEQ ID NO: 9350669 - DNA, 22 bp, Homo sapiens
aattgttgggtattcctgtgac

SEQ ID NO: 9350670 - DNA, 22 bp, Homo sapiens
aattgttgggccctaccccaga

SEQ ID NO: 9350671 - DNA, 22 bp, Homo sapiens
aattgtgctgtgatcaattact

SEQ ID NO: 9350672 - DNA, 23 bp, Homo sapiens
aattgtgcttcccaggggctatt

SEQ ID NO: 9350673 - DNA, 20 bp, Homo sapiens
aattgttgactccccagaga

SEQ ID NO: 9350674 - DNA, 22 bp, Homo sapiens
aattgttgagcataaattatcg

SEQ ID NO: 9350675 - DNA, 22 bp, Homo sapiens
aattgtgatgacagctggtggt

SEQ ID NO: 9350676 - DNA, 22 bp, Homo sapiens
aattgtgcccgtgacatttcat

SEQ ID NO: 9350677 - DNA, 22 bp, Homo sapiens
aattgtgcatttttaaatcacg

SEQ ID NO: 9350678 - DNA, 22 bp, Homo sapiens
aattgtgctatgattatgaaag

SEQ ID NO: 9350679 - DNA, 22 bp, Homo sapiens
aattgtgctgctataggattaa

SEQ ID NO: 9350680 - DNA, 21 bp, Homo sapiens
aattgtgctattctgctttta

SEQ ID NO: 9350681 - DNA, 22 bp, Homo sapiens
aattgtgctgtaggctcgttaa

SEQ ID NO: 9350682 - DNA, 22 bp, Homo sapiens
aagacagtgacagtcacaattg

SEQ ID NO: 9350683 - DNA, 22 bp, Homo sapiens
aagacagtgatctctgagagat

SEQ ID NO: 9350684 - DNA, 22 bp, Homo sapiens
aagacaggaacatagcaaatcc

SEQ ID NO: 9350685 - DNA, 22 bp, Homo sapiens
aagacaggaaaagctccaggcc

SEQ ID NO: 9350686 - DNA, 22 bp, Homo sapiens
aagacaggaaaagctccaggcc

SEQ ID NO: 9350687 - DNA, 22 bp, Homo sapiens
aagacagcagcacctctcgttt

SEQ ID NO: 9350688 - DNA, 22 bp, Homo sapiens
acacaggaactcaagctcgctt

SEQ ID NO: 9350689 - DNA, 22 bp, Homo sapiens
acacaggaactcaagctcgctt

SEQ ID NO: 9350690 - DNA, 22 bp, Homo sapiens
acacaggaactcaagctcgctt

SEQ ID NO: 9350691 - DNA, 22 bp, Homo sapiens
acacagggctgcgcctgacccc

SEQ ID NO: 9350692 - DNA, 22 bp, Homo sapiens
acacaggggctcggctgggtgc

SEQ ID NO: 9350693 - DNA, 22 bp, Homo sapiens
acacaggggaaagtggagctga

SEQ ID NO: 9350694 - DNA, 22 bp, Homo sapiens
acacagggggcattctaggagt

SEQ ID NO: 9350695 - DNA, 22 bp, Homo sapiens
acacagggtctagagttaggcc

SEQ ID NO: 9350696 - DNA, 20 bp, Homo sapiens
acacagtagcaattagtgca

SEQ ID NO: 9350697 - DNA, 22 bp, Homo sapiens
aagaggcttcagatccttcaga

SEQ ID NO: 9350698 - DNA, 22 bp, Homo sapiens
aagaggcttatagtcttcctgt

SEQ ID NO: 9350699 - DNA, 20 bp, Homo sapiens
aagaggctgtggatcctact

SEQ ID NO: 9350700 - DNA, 22 bp, Homo sapiens
aagaggctggcattgatggtag

SEQ ID NO: 9350701 - DNA, 18 bp, Homo sapiens
aagaggctgttctgtggg

SEQ ID NO: 9350702 - DNA, 22 bp, Homo sapiens
aagaggctgaatgagaaagtac

SEQ ID NO: 9350703 - DNA, 22 bp, Homo sapiens
aagaggctggaggatactgcgc

SEQ ID NO: 9350704 - DNA, 22 bp, Homo sapiens
aagaggctagccggctcactaa

SEQ ID NO: 9350705 - DNA, 22 bp, Homo sapiens
aagaggcctggaggcagaggtg

SEQ ID NO: 9350706 - DNA, 22 bp, Homo sapiens
aagattgttttgggggaagtgg

SEQ ID NO: 9350707 - DNA, 22 bp, Homo sapiens
aagattgttttggatgctaact

SEQ ID NO: 9350708 - DNA, 22 bp, Homo sapiens
aagatttaccactttattcaag

SEQ ID NO: 9350709 - DNA, 22 bp, Homo sapiens
aagattgacggctttgagtgct

SEQ ID NO: 9350710 - DNA, 22 bp, Homo sapiens
aagatttctgcttttggaggca

SEQ ID NO: 9350711 - DNA, 22 bp, Homo sapiens
aagatttccttcagtagagcta

SEQ ID NO: 9350712 - DNA, 22 bp, Homo sapiens
aagatttctctcctggaaagca

SEQ ID NO: 9350713 - DNA, 22 bp, Homo sapiens
aagatttctgctcctgagagaa

SEQ ID NO: 9350714 - DNA, 17 bp, Homo sapiens
aagatttcattagctga

SEQ ID NO: 9350715 - DNA, 22 bp, Homo sapiens
aagatttccatttctagctcat

SEQ ID NO: 9350716 - DNA, 22 bp, Homo sapiens
aagatttcctggatgtaattcc

SEQ ID NO: 9350717 - DNA, 22 bp, Homo sapiens
aagatttcagagtttgggggaa

SEQ ID NO: 9350718 - DNA, 22 bp, Homo sapiens
aagatttactttctttgtaata

SEQ ID NO: 9350719 - DNA, 22 bp, Homo sapiens
acactgcatttcaacaaggccc

SEQ ID NO: 9350720 - DNA, 22 bp, Homo sapiens
acactgcatttcaacaaggccc

SEQ ID NO: 9350721 - DNA, 21 bp, Homo sapiens
acactgcaggtgaagtgcact

SEQ ID NO: 9350722 - DNA, 21 bp, Homo sapiens
acactgcaggtgaagtgcact

SEQ ID NO: 9350723 - DNA, 22 bp, Homo sapiens
acactggatgaagcaagctaaa

SEQ ID NO: 9350724 - DNA, 22 bp, Homo sapiens
acactggataccactgttatta

SEQ ID NO: 9350725 - DNA, 22 bp, Homo sapiens
acactggataccactgttatta

SEQ ID NO: 9350726 - DNA, 22 bp, Homo sapiens
acactggaccatttaaacttga

SEQ ID NO: 9350727 - DNA, 22 bp, Homo sapiens
acactggaccatttaaacttga

SEQ ID NO: 9350728 - DNA, 22 bp, Homo sapiens
acactggaccatttaaacttga

SEQ ID NO: 9350729 - DNA, 22 bp, Homo sapiens
acactggagcttctagcccacg

SEQ ID NO: 9350730 - DNA, 22 bp, Homo sapiens
acactggactcagaggccagaa

SEQ ID NO: 9350731 - DNA, 22 bp, Homo sapiens
acactggtaggaagagatggct

SEQ ID NO: 9350732 - DNA, 22 bp, Homo sapiens
acactgggtaacatatctgtta

SEQ ID NO: 9350733 - DNA, 22 bp, Homo sapiens
aagcacaggagacgcacagcca

SEQ ID NO: 9350734 - DNA, 22 bp, Homo sapiens
aagcacaggatcttgaggagcg

SEQ ID NO: 9350735 - DNA, 18 bp, Homo sapiens
aagcacaggtgtttcagg

SEQ ID NO: 9350736 - DNA, 22 bp, Homo sapiens
aagcacagtgccaagttctatt

SEQ ID NO: 9350737 - DNA, 22 bp, Homo sapiens
aagcatttcaggtagagatatt

SEQ ID NO: 9350738 - DNA, 22 bp, Homo sapiens
acagcagctaacccctgggcca

SEQ ID NO: 9350739 - DNA, 19 bp, Homo sapiens
aagcattagccaaagcatt

SEQ ID NO: 9350740 - DNA, 23 bp, Homo sapiens
aagcatggttcacagttagtact

SEQ ID NO: 9350741 - DNA, 22 bp, Homo sapiens
aagcattgtaagcagaagatgc

SEQ ID NO: 9350742 - DNA, 22 bp, Homo sapiens
aagcatttatagataagaattt

SEQ ID NO: 9350743 - DNA, 22 bp, Homo sapiens
aagcatttcaatataatattca

SEQ ID NO: 9350744 - DNA, 22 bp, Homo sapiens
aagccaggaatggagtcttcgc

SEQ ID NO: 9350745 - DNA, 22 bp, Homo sapiens
aagccaggagcgaggcctcggc

SEQ ID NO: 9350746 - DNA, 22 bp, Homo sapiens
aagccaggaccaaactcatcct

SEQ ID NO: 9350747 - DNA, 22 bp, Homo sapiens
aagccaggaagagagccttcac

SEQ ID NO: 9350748 - DNA, 22 bp, Homo sapiens
aagccaggaagggagctgtccc

SEQ ID NO: 9350749 - DNA, 22 bp, Homo sapiens
aagccaggaagagagccttcac

SEQ ID NO: 9350750 - DNA, 19 bp, Homo sapiens
aagccagctgccagctcgg

SEQ ID NO: 9350751 - DNA, 21 bp, Homo sapiens
aagccagcccacagtggtttg

SEQ ID NO: 9350752 - DNA, 22 bp, Homo sapiens
aagccaatcgtgtgaacttagt

SEQ ID NO: 9350753 - DNA, 22 bp, Homo sapiens
aagccagcctgtttccttcttc

SEQ ID NO: 9350754 - DNA, 22 bp, Homo sapiens
acagcagcttgcgtgtctggtc

SEQ ID NO: 9350755 - DNA, 22 bp, Homo sapiens
acagcagcttgcgtgtctggtc

SEQ ID NO: 9350756 - DNA, 22 bp, Homo sapiens
acagcagcttgtctgttcttta

SEQ ID NO: 9350757 - DNA, 22 bp, Homo sapiens
acagcagcttgcgtgtctggtc

SEQ ID NO: 9350758 - DNA, 22 bp, Homo sapiens
acagcagctgccttcaggctct

SEQ ID NO: 9350759 - DNA, 22 bp, Homo sapiens
acagcagctgccttcaggctct

SEQ ID NO: 9350760 - DNA, 22 bp, Homo sapiens
acagcagctgccttcaggctct

SEQ ID NO: 9350761 - DNA, 22 bp, Homo sapiens
acagcagctgggttcccaccat

SEQ ID NO: 9350762 - DNA, 22 bp, Homo sapiens
acagaggtgtgtgtaggacagt

SEQ ID NO: 9350763 - DNA, 22 bp, Homo sapiens
acagaggtgttccagacctagg

SEQ ID NO: 9350764 - DNA, 22 bp, Homo sapiens
aagcagctgatttcacagctca

SEQ ID NO: 9350765 - DNA, 22 bp, Homo sapiens
aagcagccactggccagttata

SEQ ID NO: 9350766 - DNA, 22 bp, Homo sapiens
aagcagcattgtaaccaatgcc

SEQ ID NO: 9350767 - DNA, 22 bp, Homo sapiens
aagcagcattgtggtaggggag

SEQ ID NO: 9350768 - DNA, 22 bp, Homo sapiens
aagcagctgaaggattcagggt

SEQ ID NO: 9350769 - DNA, 22 bp, Homo sapiens
aagcagcatgattgtaatacta

SEQ ID NO: 9350770 - DNA, 22 bp, Homo sapiens
aagcagcatcctgggcagacct

SEQ ID NO: 9350771 - DNA, 18 bp, Homo sapiens
acagacaaaatggaaatg

SEQ ID NO: 9350772 - DNA, 18 bp, Homo sapiens
acagacaaaatggaaatg

SEQ ID NO: 9350773 - DNA, 22 bp, Homo sapiens
aagcagaggtagggtgtgcagt

SEQ ID NO: 9350774 - DNA, 22 bp, Homo sapiens
aagcagaggtagggtgtgcagt

SEQ ID NO: 9350775 - DNA, 22 bp, Homo sapiens
aagcagaggtagggtgtgcagt

SEQ ID NO: 9350776 - DNA, 22 bp, Homo sapiens
aagcagcattgtaaccaatgcc

SEQ ID NO: 9350777 - DNA, 22 bp, Homo sapiens
aagcagcattgtaaccaatgcc

SEQ ID NO: 9350778 - DNA, 22 bp, Homo sapiens
aagcagcattcagtgaaatgtg

SEQ ID NO: 9350779 - DNA, 22 bp, Homo sapiens
aagcagcattcagtgaaatgtg

SEQ ID NO: 9350780 - DNA, 22 bp, Homo sapiens
aagcagcatgattgtaatacta

SEQ ID NO: 9350781 - DNA, 22 bp, Homo sapiens
aagcagcatgctatgctggtgg

SEQ ID NO: 9350782 - DNA, 22 bp, Homo sapiens
aagcagcatgtgggttatcggg

SEQ ID NO: 9350783 - DNA, 22 bp, Homo sapiens
aagcagcatgctatgctggtgg

SEQ ID NO: 9350784 - DNA, 22 bp, Homo sapiens
acagaattgaaagtataatctg

SEQ ID NO: 9350785 - DNA, 22 bp, Homo sapiens
aaagctcttggattttagactc

SEQ ID NO: 9350786 - DNA, 22 bp, Homo sapiens
aaagctaaggtagcattggaga

SEQ ID NO: 9350787 - DNA, 22 bp, Homo sapiens
aacagcaatagcactattcatt

SEQ ID NO: 9350788 - DNA, 22 bp, Homo sapiens
aacagcaatagcactattcatt

SEQ ID NO: 9350789 - DNA, 22 bp, Homo sapiens
aacagcagaaactgcaagctac

SEQ ID NO: 9350790 - DNA, 22 bp, Homo sapiens
aacagcagcaagtaagcaggtc

SEQ ID NO: 9350791 - DNA, 22 bp, Homo sapiens
aaagccatctgtattaagtgaa

SEQ ID NO: 9350792 - DNA, 22 bp, Homo sapiens
aacagattgtaacctgatagcc

SEQ ID NO: 9350793 - DNA, 22 bp, Homo sapiens
aacagatttaagaagccaaggt

SEQ ID NO: 9350794 - DNA, 22 bp, Homo sapiens
aaagctttctagctatgttcta

SEQ ID NO: 9350795 - DNA, 22 bp, Homo sapiens
aaagctgctttggtttctggaa

SEQ ID NO: 9350796 - DNA, 22 bp, Homo sapiens
aaagctgctgtgaatggtttgg

SEQ ID NO: 9350797 - DNA, 22 bp, Homo sapiens
aaagctgctgtgaatggtttgg

SEQ ID NO: 9350798 - DNA, 22 bp, Homo sapiens
aaagctgattgcaggaagagag

SEQ ID NO: 9350799 - DNA, 22 bp, Homo sapiens
aaagctgcccagctgcctgttt

SEQ ID NO: 9350800 - DNA, 22 bp, Homo sapiens
aaattttcagagcactagagaa

SEQ ID NO: 9350801 - DNA, 22 bp, Homo sapiens
aaattgtgctcacactgatatt

SEQ ID NO: 9350802 - DNA, 22 bp, Homo sapiens
aaattgtgctttgactcctgcc

SEQ ID NO: 9350803 - DNA, 22 bp, Homo sapiens
aaattgtgagctatagatctag

SEQ ID NO: 9350804 - DNA, 22 bp, Homo sapiens
aaattgtgcatccttggcatat

SEQ ID NO: 9350805 - DNA, 22 bp, Homo sapiens
aaattttagtaaggaagttgag

SEQ ID NO: 9350806 - DNA, 22 bp, Homo sapiens
aacaaaacatttgtcttgtttc

SEQ ID NO: 9350807 - DNA, 22 bp, Homo sapiens
aacaaaacatttgtcttgtttc

SEQ ID NO: 9350808 - DNA, 22 bp, Homo sapiens
aacaaaacatttgtcttgtttc

SEQ ID NO: 9350809 - DNA, 22 bp, Homo sapiens
aacaaaagccgaagtaggtgtc

SEQ ID NO: 9350810 - DNA, 22 bp, Homo sapiens
aacaaacaaacattttgtcatc

SEQ ID NO: 9350811 - DNA, 22 bp, Homo sapiens
aaagccagttcttttatattgg

SEQ ID NO: 9350812 - DNA, 22 bp, Homo sapiens
aaagccataagcctaatactaa

SEQ ID NO: 9350813 - DNA, 22 bp, Homo sapiens
aaagccatcagtaaaatgattt

SEQ ID NO: 9350814 - DNA, 22 bp, Homo sapiens
aaagccagttcttagagaaagc

SEQ ID NO: 9350815 - DNA, 22 bp, Homo sapiens
aaagccagtggtatgagagaaa

SEQ ID NO: 9350816 - DNA, 22 bp, Homo sapiens
aaagccaggttgtgtgcaggaa

SEQ ID NO: 9350817 - DNA, 22 bp, Homo sapiens
aaagccagggtccaggcctgcc

SEQ ID NO: 9350818 - DNA, 22 bp, Homo sapiens
aaagccaggggagggattccca

SEQ ID NO: 9350819 - DNA, 22 bp, Homo sapiens
aaagccacagttctatgtctgc

SEQ ID NO: 9350820 - DNA, 22 bp, Homo sapiens
aaagatcagaggatagctgagt

SEQ ID NO: 9350821 - DNA, 22 bp, Homo sapiens
aaagccaggggagggattccca

SEQ ID NO: 9350822 - DNA, 22 bp, Homo sapiens
aaagccacgtggcctggggagc

SEQ ID NO: 9350823 - DNA, 22 bp, Homo sapiens
aaagatcacgtcccaggactcg

SEQ ID NO: 9350824 - DNA, 22 bp, Homo sapiens
aaagatcaatagataaagctac

SEQ ID NO: 9350825 - DNA, 22 bp, Homo sapiens
aaagatacttaatagttgtctg

SEQ ID NO: 9350826 - DNA, 20 bp, Homo sapiens
aaagatactttttgtaatgg

SEQ ID NO: 9350827 - DNA, 20 bp, Homo sapiens
aaagatactttttgtaatgg

SEQ ID NO: 9350828 - DNA, 22 bp, Homo sapiens
aaagcttttgttttcgtaactg

SEQ ID NO: 9350829 - DNA, 22 bp, Homo sapiens
aaaggaagatgccaggactctg

SEQ ID NO: 9350830 - DNA, 22 bp, Homo sapiens
aaaggttttattctgagctctg

SEQ ID NO: 9350831 - DNA, 22 bp, Homo sapiens
aaaggttttatgttttccactt

SEQ ID NO: 9350832 - DNA, 22 bp, Homo sapiens
aaaggttttcatcacagcaaga

SEQ ID NO: 9350833 - DNA, 22 bp, Homo sapiens
aaaggttttattctgagctctg

SEQ ID NO: 9350834 - DNA, 22 bp, Homo sapiens
aaaggtttgccgacctctgctt

SEQ ID NO: 9350835 - DNA, 22 bp, Homo sapiens
aaaggttttatgttttccactt

SEQ ID NO: 9350836 - DNA, 22 bp, Homo sapiens
aaaggtttgccgacctctgctt

SEQ ID NO: 9350837 - DNA, 22 bp, Homo sapiens
aaaggtttgcatggaatttacc

SEQ ID NO: 9350838 - DNA, 22 bp, Homo sapiens
aaaggtttgaggtgggaagagg

SEQ ID NO: 9350839 - DNA, 22 bp, Homo sapiens
aaaggtttgcatggaatttacc

SEQ ID NO: 9350840 - DNA, 22 bp, Homo sapiens
aaaggtttgaggtgggaagagg

SEQ ID NO: 9350841 - DNA, 22 bp, Homo sapiens
aaaggtttccgagctttaattt

SEQ ID NO: 9350842 - DNA, 22 bp, Homo sapiens
aaaggtttatttaatcagggag

SEQ ID NO: 9350843 - DNA, 22 bp, Homo sapiens
aaaggtttatttaatcagggag

SEQ ID NO: 9350844 - DNA, 22 bp, Homo sapiens
aaaggtttatttgttgctcaca

SEQ ID NO: 9350845 - DNA, 22 bp, Homo sapiens
aaaggtttccgagctttaattt

SEQ ID NO: 9350846 - DNA, 22 bp, Homo sapiens
aaaggtttatttgttgctcaca

SEQ ID NO: 9350847 - DNA, 22 bp, Homo sapiens
aaaggtttattgctatggttgt

SEQ ID NO: 9350848 - DNA, 22 bp, Homo sapiens
aaaggtttattgctatggttgt

SEQ ID NO: 9350849 - DNA, 22 bp, Homo sapiens
aaaggtttattgattctgctct

SEQ ID NO: 9350850 - DNA, 22 bp, Homo sapiens
aaaggtttattgattctgctct

SEQ ID NO: 9350851 - DNA, 22 bp, Homo sapiens
aactaacagtcattaaaagaac

SEQ ID NO: 9350852 - DNA, 22 bp, Homo sapiens
aaagtaattgtggttcttgcca

SEQ ID NO: 9350853 - DNA, 22 bp, Homo sapiens
aaagtaattgtggtttctgtca

SEQ ID NO: 9350854 - DNA, 22 bp, Homo sapiens
aaagtaattgtggtttctgtca

SEQ ID NO: 9350855 - DNA, 22 bp, Homo sapiens
aaaggttttcatcacagcaaga

SEQ ID NO: 9350856 - DNA, 22 bp, Homo sapiens
aactaaaactggtttgttctct

SEQ ID NO: 9350857 - DNA, 22 bp, Homo sapiens
aactaaaactggtttgttctct

SEQ ID NO: 9350858 - DNA, 22 bp, Homo sapiens
aactaaaactggtttgttctct

SEQ ID NO: 9350859 - DNA, 18 bp, Homo sapiens
aactaaagatctttaagc

SEQ ID NO: 9350860 - DNA, 22 bp, Homo sapiens
aactaaatctggcatttagagc

SEQ ID NO: 9350861 - DNA, 22 bp, Homo sapiens
aactaaatctggcatttagagc

SEQ ID NO: 9350862 - DNA, 18 bp, Homo sapiens
aactaaagatctttaagc

SEQ ID NO: 9350863 - DNA, 22 bp, Homo sapiens
aactaaagtaaccaaggatatc

SEQ ID NO: 9350864 - DNA, 22 bp, Homo sapiens
aactaaatctggcatttagagc

SEQ ID NO: 9350865 - DNA, 22 bp, Homo sapiens
aactaaatctggcatttagagc

SEQ ID NO: 9350866 - DNA, 22 bp, Homo sapiens
aaagtagtccttggagcgaaat

SEQ ID NO: 9350867 - DNA, 22 bp, Homo sapiens
aaagtatttgtgatttttacca

SEQ ID NO: 9350868 - DNA, 22 bp, Homo sapiens
aaagtattcttgactgtttttc

SEQ ID NO: 9350869 - DNA, 22 bp, Homo sapiens
aaagtattcaaaaatatttggt

SEQ ID NO: 9350870 - DNA, 22 bp, Homo sapiens
aaagtgctttaggatatttgga

SEQ ID NO: 9350871 - DNA, 23 bp, Homo sapiens
aaagtgcttggcacgacacctgg

SEQ ID NO: 9350872 - DNA, 22 bp, Homo sapiens
aaagtgctgggattccaggcgt

SEQ ID NO: 9350873 - DNA, 22 bp, Homo sapiens
aaagtcacatagcatcacttct

SEQ ID NO: 9350874 - DNA, 22 bp, Homo sapiens
aaagtgggaacaatggagagtg

SEQ ID NO: 9350875 - DNA, 22 bp, Homo sapiens
aaagtggggtctagagggcctg

SEQ ID NO: 9350876 - DNA, 22 bp, Homo sapiens
aaagtgggaacaatggagagtg

SEQ ID NO: 9350877 - DNA, 22 bp, Homo sapiens
aaagtgggaacaatggagagtg

SEQ ID NO: 9350878 - DNA, 22 bp, Homo sapiens
aagcatctcacctgcccccacg

SEQ ID NO: 9350879 - DNA, 22 bp, Homo sapiens
aagcatgcactccaaacagctt

SEQ ID NO: 9350880 - DNA, 23 bp, Homo sapiens
aagcatcttttcctagctccatc

SEQ ID NO: 9350881 - DNA, 22 bp, Homo sapiens
aaatgtaagtctttgtttctta

SEQ ID NO: 9350882 - DNA, 22 bp, Homo sapiens
aaatgtacaacatccatatata

SEQ ID NO: 9350883 - DNA, 22 bp, Homo sapiens
aaatgtattgcataggatattt

SEQ ID NO: 9350884 - DNA, 22 bp, Homo sapiens
aaatgtacgggagtagaattag

SEQ ID NO: 9350885 - DNA, 22 bp, Homo sapiens
aaatgcaggaaattatgctttt

SEQ ID NO: 9350886 - DNA, 22 bp, Homo sapiens
aaatgcagctgggcatgagagg

SEQ ID NO: 9350887 - DNA, 22 bp, Homo sapiens
aagcacagattgctgcatccat

SEQ ID NO: 9350888 - DNA, 22 bp, Homo sapiens
aagcacagatgcaagggggacc

SEQ ID NO: 9350889 - DNA, 22 bp, Homo sapiens
aagcacagctggaacagcagga

SEQ ID NO: 9350890 - DNA, 22 bp, Homo sapiens
aaatgcaggtagtatttatttt

SEQ ID NO: 9350891 - DNA, 22 bp, Homo sapiens
aaatgcaggttcttgagccaag

SEQ ID NO: 9350892 - DNA, 22 bp, Homo sapiens
aaatgcatgagaaagtattctg

SEQ ID NO: 9350893 - DNA, 22 bp, Homo sapiens
aaatgcatgagaaagtattctg

SEQ ID NO: 9350894 - DNA, 22 bp, Homo sapiens
aaatgcagtttcctgagaccca

SEQ ID NO: 9350895 - DNA, 22 bp, Homo sapiens
aaatcctgtccatttaccagat

SEQ ID NO: 9350896 - DNA, 23 bp, Homo sapiens
aaatcctgcctcttgtatttatc

SEQ ID NO: 9350897 - DNA, 19 bp, Homo sapiens
aaatcctgaggttcaaaag

SEQ ID NO: 9350898 - DNA, 22 bp, Homo sapiens
aaatcctaatgacaagtttagt

SEQ ID NO: 9350899 - DNA, 22 bp, Homo sapiens
aaatcctaaggagaatatgatt

SEQ ID NO: 9350900 - DNA, 22 bp, Homo sapiens
aaatcccatcggagaggaggat

SEQ ID NO: 9350901 - DNA, 22 bp, Homo sapiens
aaatcctaaaagtttgacttaa

SEQ ID NO: 9350902 - DNA, 22 bp, Homo sapiens
aaatcctaaaagtttgacttaa

SEQ ID NO: 9350903 - DNA, 22 bp, Homo sapiens
aagcacagagaggtaaagtaac

SEQ ID NO: 9350904 - DNA, 22 bp, Homo sapiens
aagcacagactccctctgagtg

SEQ ID NO: 9350905 - DNA, 22 bp, Homo sapiens
aaataacttggtttcatcagag

SEQ ID NO: 9350906 - DNA, 22 bp, Homo sapiens
aaataagaaattcttctttgca

SEQ ID NO: 9350907 - DNA, 22 bp, Homo sapiens
aaataatcaatttttgtagata

SEQ ID NO: 9350908 - DNA, 22 bp, Homo sapiens
aaataattatagcgagtctatc

SEQ ID NO: 9350909 - DNA, 22 bp, Homo sapiens
aaataagtagtttagtgttgtg

SEQ ID NO: 9350910 - DNA, 22 bp, Homo sapiens
aaataagttaaactagaatgat

SEQ ID NO: 9350911 - DNA, 23 bp, Homo sapiens
aaagtgtagccaggttaagaacc

SEQ ID NO: 9350912 - DNA, 22 bp, Homo sapiens
aaagtgtaggcttcaaagaggg

SEQ ID NO: 9350913 - DNA, 22 bp, Homo sapiens
aaagtgtggcacaagtcacatc

SEQ ID NO: 9350914 - DNA, 21 bp, Homo sapiens
aaagtgtgtggggaagaagga

SEQ ID NO: 9350915 - DNA, 22 bp, Homo sapiens
aaatagatttcctagcattgga

SEQ ID NO: 9350916 - DNA, 22 bp, Homo sapiens
aaatagagctgggttaaacttt

SEQ ID NO: 9350917 - DNA, 22 bp, Homo sapiens
aaatagcaatgtgaaaagagga

SEQ ID NO: 9350918 - DNA, 22 bp, Homo sapiens
aaatagcagcctttagttaaca

SEQ ID NO: 9350919 - DNA, 22 bp, Homo sapiens
aaatagcagcctttagttaaca

SEQ ID NO: 9350920 - DNA, 22 bp, Homo sapiens
aaatagcaatgtgaaaagagga

SEQ ID NO: 9350921 - DNA, 22 bp, Homo sapiens
aaatagatttcctagcattgga

SEQ ID NO: 9350922 - DNA, 22 bp, Homo sapiens
aaatagacaggcttaaatagga

SEQ ID NO: 9350923 - DNA, 22 bp, Homo sapiens
aaatagacaggcttaaatagga

SEQ ID NO: 9350924 - DNA, 22 bp, Homo sapiens
aaataattgagttggtcaatat

SEQ ID NO: 9350925 - DNA, 22 bp, Homo sapiens
aaataattgagttggtcaatat

SEQ ID NO: 9350926 - DNA, 22 bp, Homo sapiens
aaatacaaaaattagccaggca

SEQ ID NO: 9350927 - DNA, 22 bp, Homo sapiens
aaataattgagttggtcaatat

SEQ ID NO: 9350928 - DNA, 22 bp, Homo sapiens
aaataattatagcgagtctatc

SEQ ID NO: 9350929 - DNA, 22 bp, Homo sapiens
aaataattatagcgagtctatc

SEQ ID NO: 9350930 - DNA, 22 bp, Homo sapiens
aaataattatagcgagtctatc

SEQ ID NO: 9350931 - DNA, 22 bp, Homo sapiens
aaatcccactcagaaactgcca

SEQ ID NO: 9350932 - DNA, 22 bp, Homo sapiens
aaatccatcaaatcttctagaa

SEQ ID NO: 9350933 - DNA, 23 bp, Homo sapiens
aaataggagtatctggatcatga

SEQ ID NO: 9350934 - DNA, 22 bp, Homo sapiens
aaataggagcttaagcacttct

SEQ ID NO: 9350935 - DNA, 22 bp, Homo sapiens
aaataggagcttaagcacttct

SEQ ID NO: 9350936 - DNA, 23 bp, Homo sapiens
aaataggagtatctggatcatga

SEQ ID NO: 9350937 - DNA, 23 bp, Homo sapiens
aaataggagtatctggatcatga

SEQ ID NO: 9350938 - DNA, 23 bp, Homo sapiens
aaataggagtatctggatcatga

SEQ ID NO: 9350939 - DNA, 23 bp, Homo sapiens
aaataggagtatctggatcatga

SEQ ID NO: 9350940 - DNA, 22 bp, Homo sapiens
aaataggaatgtggtcctggga

SEQ ID NO: 9350941 - DNA, 22 bp, Homo sapiens
aaatagcttttcataattctca

SEQ ID NO: 9350942 - DNA, 22 bp, Homo sapiens
aaatagctacatgatctctagg

SEQ ID NO: 9350943 - DNA, 22 bp, Homo sapiens
aaatagcataaaataggaagct

SEQ ID NO: 9350944 - DNA, 22 bp, Homo sapiens
aaatagcagcctttagttaaca

SEQ ID NO: 9350945 - DNA, 22 bp, Homo sapiens
aaatagcagcctttagttaaca

SEQ ID NO: 9350946 - DNA, 22 bp, Homo sapiens
aaatagcagctttgacagcaca

SEQ ID NO: 9350947 - DNA, 22 bp, Homo sapiens
aaaatgaataagttaacccagg

SEQ ID NO: 9350948 - DNA, 22 bp, Homo sapiens
aaaaatagaaggattgactgag

SEQ ID NO: 9350949 - DNA, 22 bp, Homo sapiens
aaaaatagaaggattgactgag

SEQ ID NO: 9350950 - DNA, 22 bp, Homo sapiens
aaaaatagcttctcttgtccct

SEQ ID NO: 9350951 - DNA, 22 bp, Homo sapiens
aaacacaggtactgcagaagtg

SEQ ID NO: 9350952 - DNA, 22 bp, Homo sapiens
aaacacaggtactgcagaagtg

SEQ ID NO: 9350953 - DNA, 22 bp, Homo sapiens
aaacacaggtactgcagaagtg

SEQ ID NO: 9350954 - DNA, 22 bp, Homo sapiens
aaaaatcacttttataggcagc

SEQ ID NO: 9350955 - DNA, 22 bp, Homo sapiens
aaaaatcacttttataggcagc

SEQ ID NO: 9350956 - DNA, 22 bp, Homo sapiens
aaaaatcacttttataggcagc

SEQ ID NO: 9350957 - DNA, 22 bp, Homo sapiens
aaacacttcctgtaacatgaca

SEQ ID NO: 9350958 - DNA, 22 bp, Homo sapiens
aaacactttagaaagggacttg

SEQ ID NO: 9350959 - DNA, 22 bp, Homo sapiens
aaacagagggccactgaggctc

SEQ ID NO: 9350960 - DNA, 22 bp, Homo sapiens
aaaaactgcaattacttttgtc

SEQ ID NO: 9350961 - DNA, 22 bp, Homo sapiens
aaaaaccattgtcttcagtctc

SEQ ID NO: 9350962 - DNA, 22 bp, Homo sapiens
aaaaacctcaattacttttgca

SEQ ID NO: 9350963 - DNA, 22 bp, Homo sapiens
aaaaaccattgtcttcagtctc

SEQ ID NO: 9350964 - DNA, 22 bp, Homo sapiens
aaaaacctttcattgcaaatgt

SEQ ID NO: 9350965 - DNA, 22 bp, Homo sapiens
aaaatcttgtgacttaggaagg

SEQ ID NO: 9350966 - DNA, 22 bp, Homo sapiens
aaaatctggtaatttgaatgtg

SEQ ID NO: 9350967 - DNA, 22 bp, Homo sapiens
aaaatgaacagaacaatgggga

SEQ ID NO: 9350968 - DNA, 22 bp, Homo sapiens
aaaatgaacagaacaatgggga

SEQ ID NO: 9350969 - DNA, 22 bp, Homo sapiens
aaaatgaataagttaacccagg

SEQ ID NO: 9350970 - DNA, 22 bp, Homo sapiens
aaaaaattatcatagttcctga

SEQ ID NO: 9350971 - DNA, 22 bp, Homo sapiens
aaaaaattatcatagttcctga

SEQ ID NO: 9350972 - DNA, 23 bp, Homo sapiens
aaaaaaccatgtaggcactcagt

SEQ ID NO: 9350973 - DNA, 22 bp, Homo sapiens
aaaaacacaactgtctttctct

SEQ ID NO: 9350974 - DNA, 22 bp, Homo sapiens
aaaaaattccattctgtgcctt

SEQ ID NO: 9350975 - DNA, 22 bp, Homo sapiens
aaacaaggcacaattcaggatt

SEQ ID NO: 9350976 - DNA, 20 bp, Homo sapiens
aaacaaggttgctctgagga

SEQ ID NO: 9350977 - DNA, 22 bp, Homo sapiens
aaacaagtcactttatcttgaa

SEQ ID NO: 9350978 - DNA, 22 bp, Homo sapiens
aaacaagtcactttatcttgaa

SEQ ID NO: 9350979 - DNA, 22 bp, Homo sapiens
aaacaatccaggaacctgttta

SEQ ID NO: 9350980 - DNA, 22 bp, Homo sapiens
aaaatcagtacactttattttg

SEQ ID NO: 9350981 - DNA, 22 bp, Homo sapiens
aaaatcagtacactttattttg

SEQ ID NO: 9350982 - DNA, 22 bp, Homo sapiens
aaagactaaatgaatgagctca

SEQ ID NO: 9350983 - DNA, 22 bp, Homo sapiens
aaaatcctgctgactcgagatg

SEQ ID NO: 9350984 - DNA, 22 bp, Homo sapiens
aaaatcctgctgactcgagatg

SEQ ID NO: 9350985 - DNA, 22 bp, Homo sapiens
aaaatcctctaattctagaata

SEQ ID NO: 9350986 - DNA, 22 bp, Homo sapiens
aaaatcctctaattctagaata

SEQ ID NO: 9350987 - DNA, 22 bp, Homo sapiens
aaaatcctctaattctagaata

SEQ ID NO: 9350988 - DNA, 23 bp, Homo sapiens
aaaatcattaatttaccctgaaa

SEQ ID NO: 9350989 - DNA, 22 bp, Homo sapiens
aaactcctgcatactcagaagc

SEQ ID NO: 9350990 - DNA, 22 bp, Homo sapiens
aaactcctgggctcaagcagtt

SEQ ID NO: 9350991 - DNA, 20 bp, Homo sapiens
aaactctacctcaatcgtca

SEQ ID NO: 9350992 - DNA, 22 bp, Homo sapiens
aaactctagctactaggataac

SEQ ID NO: 9350993 - DNA, 22 bp, Homo sapiens
aaactctaatcaaatatagcat

SEQ ID NO: 9350994 - DNA, 22 bp, Homo sapiens
aaaagtactattttaacaaagt

SEQ ID NO: 9350995 - DNA, 22 bp, Homo sapiens
aaaagtactattttaacaaagt

SEQ ID NO: 9350996 - DNA, 22 bp, Homo sapiens
aaaagtactattttaacaaagt

SEQ ID NO: 9350997 - DNA, 22 bp, Homo sapiens
aaaagtactattttaacaaagt

SEQ ID NO: 9350998 - DNA, 22 bp, Homo sapiens
aaaagtatagggtttggagtca

SEQ ID NO: 9350999 - DNA, 22 bp, Homo sapiens
aaaagtatggtggtccttttta

SEQ ID NO: 9351000 - DNA, 22 bp, Homo sapiens
aaaagtattggccaccatttct

SEQ ID NO: 9351001 - DNA, 22 bp, Homo sapiens
aaaagtatttatggctatgtaa

SEQ ID NO: 9351002 - DNA, 22 bp, Homo sapiens
aaagaagggacagactgcctct

SEQ ID NO: 9351003 - DNA, 22 bp, Homo sapiens
aaactcagaaggtacagaaggg

SEQ ID NO: 9351004 - DNA, 19 bp, Homo sapiens
aaactcatagactcatatt

SEQ ID NO: 9351005 - DNA, 22 bp, Homo sapiens
aaactcagacacagtatctgtt

SEQ ID NO: 9351006 - DNA, 22 bp, Homo sapiens
aaactagctcttagtttagagg

SEQ ID NO: 9351007 - DNA, 22 bp, Homo sapiens
aaaagagaatcctgtacagaga

SEQ ID NO: 9351008 - DNA, 22 bp, Homo sapiens
aaaagagagctgaggagctcca

SEQ ID NO: 9351009 - DNA, 22 bp, Homo sapiens
aaaagagaatcctgtacagaga

SEQ ID NO: 9351010 - DNA, 22 bp, Homo sapiens
aaaagagaaagtggcaggcttt

SEQ ID NO: 9351011 - DNA, 22 bp, Homo sapiens
aaaagagagttgccagtctgta

SEQ ID NO: 9351012 - DNA, 22 bp, Homo sapiens
aaacccagggttttgtcttccc

SEQ ID NO: 9351013 - DNA, 22 bp, Homo sapiens
aaacccagagactagaaagacc

SEQ ID NO: 9351014 - DNA, 18 bp, Homo sapiens
aaacccactcagcgctga

SEQ ID NO: 9351015 - DNA, 22 bp, Homo sapiens
aaactgaaacatcatcatgttg

SEQ ID NO: 9351016 - DNA, 21 bp, Homo sapiens
aaactgaagagacaggaactt

SEQ ID NO: 9351017 - DNA, 17 bp, Homo sapiens
aaactgaaaaattcact

SEQ ID NO: 9351018 - DNA, 17 bp, Homo sapiens
aaactgaaaaattcact

SEQ ID NO: 9351019 - DNA, 22 bp, Homo sapiens
aaactctgttgagataatattt

SEQ ID NO: 9351020 - DNA, 22 bp, Homo sapiens
aaactcttcatatacatatgct

SEQ ID NO: 9351021 - DNA, 21 bp, Homo sapiens
aaactgaccttgcctgagaca

SEQ ID NO: 9351022 - DNA, 22 bp, Homo sapiens
aaactgaattcaagtatccagt

SEQ ID NO: 9351023 - DNA, 22 bp, Homo sapiens
aaactgagaccgaaaggggtag

SEQ ID NO: 9351024 - DNA, 22 bp, Homo sapiens
aaactgagattgctgctgtctg

SEQ ID NO: 9351025 - DNA, 22 bp, Homo sapiens
aaactgaggaacaaggaaggat

SEQ ID NO: 9351026 - DNA, 22 bp, Homo sapiens
aaactgaggaatgacagcatta

SEQ ID NO: 9351027 - DNA, 21 bp, Homo sapiens
aaactgaggagatgaggacta

SEQ ID NO: 9351028 - DNA, 22 bp, Homo sapiens
aaactgaggagttagactaggg

SEQ ID NO: 9351029 - DNA, 22 bp, Homo sapiens
aaactgaggagttagactaggg

SEQ ID NO: 9351030 - DNA, 22 bp, Homo sapiens
aaactgaggcaggggatgatta

SEQ ID NO: 9351031 - DNA, 22 bp, Homo sapiens
aaactgaggcccagagaggcag

SEQ ID NO: 9351032 - DNA, 21 bp, Homo sapiens
aaactgaggcttcaagcagtg

SEQ ID NO: 9351033 - DNA, 21 bp, Homo sapiens
aaactgaggcttcaagcagtg

SEQ ID NO: 9351034 - DNA, 22 bp, Homo sapiens
aaactgaggctcccgagggtgt

SEQ ID NO: 9351035 - DNA, 22 bp, Homo sapiens
aaagaatagcctttgtccaaat

SEQ ID NO: 9351036 - DNA, 22 bp, Homo sapiens
aaagaatactccttttgccttg

SEQ ID NO: 9351037 - DNA, 22 bp, Homo sapiens
aaagaatcgtgtgtagtttgaa

SEQ ID NO: 9351038 - DNA, 21 bp, Homo sapiens
aaagaatcatgggtaatttca

SEQ ID NO: 9351039 - DNA, 22 bp, Homo sapiens
aaactgataaaataagtacatt

SEQ ID NO: 9351040 - DNA, 22 bp, Homo sapiens
aaactgagtggcttataaacaa

SEQ ID NO: 9351041 - DNA, 22 bp, Homo sapiens
aaactgagttttctgaacccca

SEQ ID NO: 9351042 - DNA, 16 bp, Homo sapiens
aaactgagttcagttc

SEQ ID NO: 9351043 - DNA, 22 bp, Homo sapiens
aaactgagtggcttataaacaa

SEQ ID NO: 9351044 - DNA, 23 bp, Homo sapiens
aaactgaggcttgatgaggcggt

SEQ ID NO: 9351045 - DNA, 22 bp, Homo sapiens
aaactgagtacctctgcattca

SEQ ID NO: 9351046 - DNA, 22 bp, Homo sapiens
aaactgaggtgaggccatcgct

SEQ ID NO: 9351047 - DNA, 22 bp, Homo sapiens
aaagaagtgttgaatttgcaag

SEQ ID NO: 9351048 - DNA, 22 bp, Homo sapiens
aaagaaggtagggctggtgact

SEQ ID NO: 9351049 - DNA, 22 bp, Homo sapiens
aaagaggcaatcaatgtagcaa

SEQ ID NO: 9351050 - DNA, 22 bp, Homo sapiens
aaagaggcaggtgttactggaa

SEQ ID NO: 9351051 - DNA, 22 bp, Homo sapiens
aaagaggctcaaggtgggccag

SEQ ID NO: 9351052 - DNA, 22 bp, Homo sapiens
aaagaggaaccaagagcacgtg

SEQ ID NO: 9351053 - DNA, 22 bp, Homo sapiens
aaagaggatggagtagtcagct

SEQ ID NO: 9351054 - DNA, 22 bp, Homo sapiens
aaagaggatggagtagtcagct

SEQ ID NO: 9351055 - DNA, 22 bp, Homo sapiens
aaatgcagcagctaattgaaaa

SEQ ID NO: 9351056 - DNA, 22 bp, Homo sapiens
aaatgcagcagctaattgaaaa

SEQ ID NO: 9351057 - DNA, 22 bp, Homo sapiens
aaatgcagaatgatttcatcta

SEQ ID NO: 9351058 - DNA, 22 bp, Homo sapiens
aaatgcagattgtcattcagga

SEQ ID NO: 9351059 - DNA, 22 bp, Homo sapiens
aaatgcagatccctgaatctca

SEQ ID NO: 9351060 - DNA, 22 bp, Homo sapiens
aaatgcagattcatgagcccca

SEQ ID NO: 9351061 - DNA, 22 bp, Homo sapiens
aaattactttacactttcatct

SEQ ID NO: 9351062 - DNA, 20 bp, Homo sapiens
aaattactgccacacatttc

SEQ ID NO: 9351063 - DNA, 22 bp, Homo sapiens
aaattagaaatactttcaaagc

SEQ ID NO: 9351064 - DNA, 22 bp, Homo sapiens
aaattagaccagggctcctgga

SEQ ID NO: 9351065 - DNA, 22 bp, Homo sapiens
aaattgtgagactgaaccaaat

SEQ ID NO: 9351066 - DNA, 22 bp, Homo sapiens
aaattacagatcaccaatgcat

SEQ ID NO: 9351067 - DNA, 22 bp, Homo sapiens
aaattacagccttgggtagctt

SEQ ID NO: 9351068 - DNA, 22 bp, Homo sapiens
aaattaagagtaactctgtaga

SEQ ID NO: 9351069 - DNA, 22 bp, Homo sapiens
aaagagttgaggcagttatcca

SEQ ID NO: 9351070 - DNA, 22 bp, Homo sapiens
aaacagtgtgtttcagagaggc

SEQ ID NO: 9351071 - DNA, 22 bp, Homo sapiens
aaacagtgcctggcatggagga

SEQ ID NO: 9351072 - DNA, 22 bp, Homo sapiens
aaacagtgtaggtggccaggca

SEQ ID NO: 9351073 - DNA, 22 bp, Homo sapiens
aaacagttgttatttttatatg

SEQ ID NO: 9351074 - DNA, 22 bp, Homo sapiens
aaaggtatgatactgtgacatg

SEQ ID NO: 9351075 - DNA, 22 bp, Homo sapiens
aaaggtagtacttctagaaggg

SEQ ID NO: 9351076 - DNA, 22 bp, Homo sapiens
aaagggctgtcaaataagcaac

SEQ ID NO: 9351077 - DNA, 22 bp, Homo sapiens
aaagggctgatgtgacatagct

SEQ ID NO: 9351078 - DNA, 22 bp, Homo sapiens
aaacagtgccaggcagatgcca

SEQ ID NO: 9351079 - DNA, 22 bp, Homo sapiens
aaacaatttccacctctcctga

SEQ ID NO: 9351080 - DNA, 22 bp, Homo sapiens
aaacctggtggaacggtgaata

SEQ ID NO: 9351081 - DNA, 22 bp, Homo sapiens
aaaccttttcagctgaatggag

SEQ ID NO: 9351082 - DNA, 22 bp, Homo sapiens
aaacctttctgctctcagcgta

SEQ ID NO: 9351083 - DNA, 19 bp, Homo sapiens
aaacctgttagtagagcac

SEQ ID NO: 9351084 - DNA, 22 bp, Homo sapiens
aaaggtgttgccttggagacct

SEQ ID NO: 9351085 - DNA, 22 bp, Homo sapiens
aaaggtgttctcactgggggtc

SEQ ID NO: 9351086 - DNA, 22 bp, Homo sapiens
aaaggtcttttttctaacacca

SEQ ID NO: 9351087 - DNA, 22 bp, Homo sapiens
aaacccagggttttgtcttccc

SEQ ID NO: 9351088 - DNA, 22 bp, Homo sapiens
aaacccagggttttgtcttccc

SEQ ID NO: 9351089 - DNA, 22 bp, Homo sapiens
aaagttcactgaccagcactgg

SEQ ID NO: 9351090 - DNA, 22 bp, Homo sapiens
aaagttcactgaccagcactgg

SEQ ID NO: 9351091 - DNA, 22 bp, Homo sapiens
aaagttagtttcttatatgtct

SEQ ID NO: 9351092 - DNA, 22 bp, Homo sapiens
aaagttaggtgtggatttctca

SEQ ID NO: 9351093 - DNA, 22 bp, Homo sapiens
aaagttagcattctctcttgct

SEQ ID NO: 9351094 - DNA, 22 bp, Homo sapiens
aaagttagacagcatcatttct

SEQ ID NO: 9351095 - DNA, 22 bp, Homo sapiens
aaagttacccaatctctatgaa

SEQ ID NO: 9351096 - DNA, 21 bp, Homo sapiens
aaagttacagtcagtgggtgc

SEQ ID NO: 9351097 - DNA, 22 bp, Homo sapiens
aaagttacacgactatttatgt

SEQ ID NO: 9351098 - DNA, 22 bp, Homo sapiens
atgtgggccgtgcgggtgtcct

SEQ ID NO: 9351099 - DNA, 22 bp, Homo sapiens
atgtgggagatttcaggaggtg

SEQ ID NO: 9351100 - DNA, 22 bp, Homo sapiens
atgtggggactctgagagaatt

SEQ ID NO: 9351101 - DNA, 22 bp, Homo sapiens
atgtgggttgatggaggtgtca

SEQ ID NO: 9351102 - DNA, 22 bp, Homo sapiens
atgtgggtgagtgagagataga

SEQ ID NO: 9351103 - DNA, 22 bp, Homo sapiens
atgtggggactctgagagaatt

SEQ ID NO: 9351104 - DNA, 22 bp, Homo sapiens
agagcctggtctgagataggac

SEQ ID NO: 9351105 - DNA, 22 bp, Homo sapiens
agagcctgtacttttctgtgaa

SEQ ID NO: 9351106 - DNA, 22 bp, Homo sapiens
agagcctgtaacatctttctta

SEQ ID NO: 9351107 - DNA, 22 bp, Homo sapiens
agagcctggttcaaattttacc

SEQ ID NO: 9351108 - DNA, 22 bp, Homo sapiens
agagcctgtcaattgtaaagag

SEQ ID NO: 9351109 - DNA, 22 bp, Homo sapiens
agagcctgtctgcctttctacc

SEQ ID NO: 9351110 - DNA, 22 bp, Homo sapiens
agagcctgtcaattgtaaagag

SEQ ID NO: 9351111 - DNA, 22 bp, Homo sapiens
agagcctgttcggaggcgcccc

SEQ ID NO: 9351112 - DNA, 22 bp, Homo sapiens
agagcctgttttgtgggagatg

SEQ ID NO: 9351113 - DNA, 22 bp, Homo sapiens
agagcctgtgattgtcatcacc

SEQ ID NO: 9351114 - DNA, 22 bp, Homo sapiens
agagcctgtgggagatgcagct

SEQ ID NO: 9351115 - DNA, 22 bp, Homo sapiens
atgtatttgcttgttatggatt

SEQ ID NO: 9351116 - DNA, 22 bp, Homo sapiens
atgtatttgcttgttatggatt

SEQ ID NO: 9351117 - DNA, 22 bp, Homo sapiens
atgtatttgcttgttatggatt

SEQ ID NO: 9351118 - DNA, 22 bp, Homo sapiens
atgtatttgcgtatggacatac

SEQ ID NO: 9351119 - DNA, 22 bp, Homo sapiens
atgtatttgcgaggttaggaaa

SEQ ID NO: 9351120 - DNA, 22 bp, Homo sapiens
atgtatttgcgtatggacatac

SEQ ID NO: 9351121 - DNA, 22 bp, Homo sapiens
atgtatttgcgtatggacatac

SEQ ID NO: 9351122 - DNA, 22 bp, Homo sapiens
atgtatttgcgtatggacatac

SEQ ID NO: 9351123 - DNA, 22 bp, Homo sapiens
agagccagcaactctagccctg

SEQ ID NO: 9351124 - DNA, 22 bp, Homo sapiens
agagccagcaactctagccctg

SEQ ID NO: 9351125 - DNA, 22 bp, Homo sapiens
atgtatttgcgaggttaggaaa

SEQ ID NO: 9351126 - DNA, 22 bp, Homo sapiens
atgtatttgaaatttgagacat

SEQ ID NO: 9351127 - DNA, 22 bp, Homo sapiens
atgtatttgaaatttgagacat

SEQ ID NO: 9351128 - DNA, 22 bp, Homo sapiens
agagcctgcagtggagaccttg

SEQ ID NO: 9351129 - DNA, 22 bp, Homo sapiens
agagcctgcagtggagaccttg

SEQ ID NO: 9351130 - DNA, 22 bp, Homo sapiens
agagcctgggaatttgcatgtt

SEQ ID NO: 9351131 - DNA, 22 bp, Homo sapiens
agagcctggctcccagctaccg

SEQ ID NO: 9351132 - DNA, 22 bp, Homo sapiens
agagcctgggcagctcctctgg

SEQ ID NO: 9351133 - DNA, 22 bp, Homo sapiens
agagcctggggattggcaaggg

SEQ ID NO: 9351134 - DNA, 22 bp, Homo sapiens
agagcctgggcagctcctctgg

SEQ ID NO: 9351135 - DNA, 22 bp, Homo sapiens
atgtattttgccagactgtctc

SEQ ID NO: 9351136 - DNA, 22 bp, Homo sapiens
atgtattttgccagactgtctc

SEQ ID NO: 9351137 - DNA, 22 bp, Homo sapiens
atgtattttaagatttgcctca

SEQ ID NO: 9351138 - DNA, 22 bp, Homo sapiens
atgtattttaagatttgcctca

SEQ ID NO: 9351139 - DNA, 22 bp, Homo sapiens
atgtattttaagatttgcctca

SEQ ID NO: 9351140 - DNA, 22 bp, Homo sapiens
atgtattttaagatttgcctca

SEQ ID NO: 9351141 - DNA, 19 bp, Homo sapiens
agagccagacagcatagga

SEQ ID NO: 9351142 - DNA, 22 bp, Homo sapiens
agagccacggcaggcctaggaa

SEQ ID NO: 9351143 - DNA, 22 bp, Homo sapiens
agagccacggcaggcctaggaa

SEQ ID NO: 9351144 - DNA, 19 bp, Homo sapiens
agagccagacagcatagga

SEQ ID NO: 9351145 - DNA, 22 bp, Homo sapiens
agagccagaccattgccgtgca

SEQ ID NO: 9351146 - DNA, 22 bp, Homo sapiens
agagccagaccattgccgtgca

SEQ ID NO: 9351147 - DNA, 22 bp, Homo sapiens
agagccagaccattgccgtgca

SEQ ID NO: 9351148 - DNA, 22 bp, Homo sapiens
agagcagcctcagctccctgtg

SEQ ID NO: 9351149 - DNA, 22 bp, Homo sapiens
agagcagcctgtgatgatgcac

SEQ ID NO: 9351150 - DNA, 22 bp, Homo sapiens
agagcatctaacacataagcct

SEQ ID NO: 9351151 - DNA, 22 bp, Homo sapiens
agagccaaggcctcagtctcaa

SEQ ID NO: 9351152 - DNA, 17 bp, Homo sapiens
agagcatgtgtaggagc

SEQ ID NO: 9351153 - DNA, 22 bp, Homo sapiens
atggggtggagtccgggcagcg

SEQ ID NO: 9351154 - DNA, 22 bp, Homo sapiens
atggggtggagtccgggcagcg

SEQ ID NO: 9351155 - DNA, 22 bp, Homo sapiens
atgggtcagttcagtggccaac

SEQ ID NO: 9351156 - DNA, 22 bp, Homo sapiens
atgggtgcagcatggtgggaac

SEQ ID NO: 9351157 - DNA, 22 bp, Homo sapiens
atgggtggagggtgacacggat

SEQ ID NO: 9351158 - DNA, 22 bp, Homo sapiens
atgggtggaggagaaaggcatc

SEQ ID NO: 9351159 - DNA, 22 bp, Homo sapiens
agagatggccttaggtgggaat

SEQ ID NO: 9351160 - DNA, 22 bp, Homo sapiens
agagatggccttaggtgggaat

SEQ ID NO: 9351161 - DNA, 22 bp, Homo sapiens
agagatggccttaggtgggaat

SEQ ID NO: 9351162 - DNA, 22 bp, Homo sapiens
agagatggatgttattatgggt

SEQ ID NO: 9351163 - DNA, 22 bp, Homo sapiens
agagatggatgttattatgggt

SEQ ID NO: 9351164 - DNA, 22 bp, Homo sapiens
atgggggaaagtacgagcatgg

SEQ ID NO: 9351165 - DNA, 22 bp, Homo sapiens
atggggtgaccatgagcattta

SEQ ID NO: 9351166 - DNA, 16 bp, Homo sapiens
atggggtacaaccagt

SEQ ID NO: 9351167 - DNA, 22 bp, Homo sapiens
atggggtgcatgcagattggga

SEQ ID NO: 9351168 - DNA, 22 bp, Homo sapiens
atggggtgagactaggattaaa

SEQ ID NO: 9351169 - DNA, 22 bp, Homo sapiens
agagatgaatcttgagactctg

SEQ ID NO: 9351170 - DNA, 22 bp, Homo sapiens
agagatgacatgagggacttaa

SEQ ID NO: 9351171 - DNA, 22 bp, Homo sapiens
agagatgagaacatgcttggat

SEQ ID NO: 9351172 - DNA, 22 bp, Homo sapiens
agagatgagaacatgcttggat

SEQ ID NO: 9351173 - DNA, 22 bp, Homo sapiens
agagatgcggttccatggttat

SEQ ID NO: 9351174 - DNA, 22 bp, Homo sapiens
agagatggagagcactggggct

SEQ ID NO: 9351175 - DNA, 22 bp, Homo sapiens
agagatggagagcactggggct

SEQ ID NO: 9351176 - DNA, 22 bp, Homo sapiens
agagatggagagcactggggct

SEQ ID NO: 9351177 - DNA, 22 bp, Homo sapiens
agacattttggaaagtattact

SEQ ID NO: 9351178 - DNA, 22 bp, Homo sapiens
agacattttggaaagtattact

SEQ ID NO: 9351179 - DNA, 22 bp, Homo sapiens
agacattttggaaagtattact

SEQ ID NO: 9351180 - DNA, 22 bp, Homo sapiens
agacattttacattcttccatt

SEQ ID NO: 9351181 - DNA, 22 bp, Homo sapiens
agacattttagacataaaagat

SEQ ID NO: 9351182 - DNA, 22 bp, Homo sapiens
agacattttagacataaaagat

SEQ ID NO: 9351183 - DNA, 22 bp, Homo sapiens
agacattttgcattccctgaag

SEQ ID NO: 9351184 - DNA, 22 bp, Homo sapiens
agacattttcgttggagaggtt

SEQ ID NO: 9351185 - DNA, 22 bp, Homo sapiens
agacattttgatacccctaccg

SEQ ID NO: 9351186 - DNA, 22 bp, Homo sapiens
agacattttgatacccctaccg

SEQ ID NO: 9351187 - DNA, 22 bp, Homo sapiens
agacattttgcaatgggtagct

SEQ ID NO: 9351188 - DNA, 22 bp, Homo sapiens
agacccagaaagcagctgcatt

SEQ ID NO: 9351189 - DNA, 22 bp, Homo sapiens
agacccagaaagcagctgcatt

SEQ ID NO: 9351190 - DNA, 22 bp, Homo sapiens
agaccaggaaggcctacagata

SEQ ID NO: 9351191 - DNA, 22 bp, Homo sapiens
agaccactggcctcctgcagac

SEQ ID NO: 9351192 - DNA, 22 bp, Homo sapiens
atggccagcttataggggctca

SEQ ID NO: 9351193 - DNA, 22 bp, Homo sapiens
atggccagcttataggggctca

SEQ ID NO: 9351194 - DNA, 22 bp, Homo sapiens
atggccagggccaaaagagatg

SEQ ID NO: 9351195 - DNA, 22 bp, Homo sapiens
atggccaggcacctctggctga

SEQ ID NO: 9351196 - DNA, 22 bp, Homo sapiens
atggccaggcacctctggctga

SEQ ID NO: 9351197 - DNA, 22 bp, Homo sapiens
atggccagtcaagcctctggct

SEQ ID NO: 9351198 - DNA, 22 bp, Homo sapiens
atggccagggtggcactgtggt

SEQ ID NO: 9351199 - DNA, 22 bp, Homo sapiens
atggccagggtggcactgtggt

SEQ ID NO: 9351200 - DNA, 22 bp, Homo sapiens
atggccagggtggcactgtggt

SEQ ID NO: 9351201 - DNA, 22 bp, Homo sapiens
atggccagggtggcactgtggt

SEQ ID NO: 9351202 - DNA, 22 bp, Homo sapiens
agagaagagcaatgataaattt

SEQ ID NO: 9351203 - DNA, 18 bp, Homo sapiens
agagaagaggtgttagtc

SEQ ID NO: 9351204 - DNA, 23 bp, Homo sapiens
agacccagagactggctctgctc

SEQ ID NO: 9351205 - DNA, 22 bp, Homo sapiens
agacccagagggctgctgggag

SEQ ID NO: 9351206 - DNA, 22 bp, Homo sapiens
agacccagagggctgctgggag

SEQ ID NO: 9351207 - DNA, 22 bp, Homo sapiens
atggcagcctgagcagaggaat

SEQ ID NO: 9351208 - DNA, 22 bp, Homo sapiens
atggcagcctgagcagaggaat

SEQ ID NO: 9351209 - DNA, 22 bp, Homo sapiens
atggccagcaagttcagaattt

SEQ ID NO: 9351210 - DNA, 22 bp, Homo sapiens
atggccagcaagttcagaattt

SEQ ID NO: 9351211 - DNA, 22 bp, Homo sapiens
atggccagcaagttcagaattt

SEQ ID NO: 9351212 - DNA, 22 bp, Homo sapiens
atggcagcggagctggaaatga

SEQ ID NO: 9351213 - DNA, 22 bp, Homo sapiens
atggcagcggagctggaaatga

SEQ ID NO: 9351214 - DNA, 22 bp, Homo sapiens
atggccagcaaggtagggcaat

SEQ ID NO: 9351215 - DNA, 22 bp, Homo sapiens
atggcagcctgtggacagtcaa

SEQ ID NO: 9351216 - DNA, 22 bp, Homo sapiens
atggcagcctgtggacagtcaa

SEQ ID NO: 9351217 - DNA, 22 bp, Homo sapiens
atggccagctagcacttgcatt

SEQ ID NO: 9351218 - DNA, 22 bp, Homo sapiens
atggccagctagcacttgcatt

SEQ ID NO: 9351219 - DNA, 22 bp, Homo sapiens
atggccagcctggtacttggca

SEQ ID NO: 9351220 - DNA, 22 bp, Homo sapiens
atggccagcccttcccgcagct

SEQ ID NO: 9351221 - DNA, 22 bp, Homo sapiens
atggccagctcagagcactcag

SEQ ID NO: 9351222 - DNA, 22 bp, Homo sapiens
atggccagctcagagcactcag

SEQ ID NO: 9351223 - DNA, 22 bp, Homo sapiens
atggccagctcagagcactcag

SEQ ID NO: 9351224 - DNA, 22 bp, Homo sapiens
atggccagccactcctgatggc

SEQ ID NO: 9351225 - DNA, 22 bp, Homo sapiens
atggccagcccttcccgcagct

SEQ ID NO: 9351226 - DNA, 22 bp, Homo sapiens
atggccagcccttcccgcagct

SEQ ID NO: 9351227 - DNA, 22 bp, Homo sapiens
atggccagcccttcccgcagct

SEQ ID NO: 9351228 - DNA, 19 bp, Homo sapiens
agagaccacagagctgcct

SEQ ID NO: 9351229 - DNA, 21 bp, Homo sapiens
agagaccagctgttactccca

SEQ ID NO: 9351230 - DNA, 22 bp, Homo sapiens
agagacagggttttgtcgtgtt

SEQ ID NO: 9351231 - DNA, 22 bp, Homo sapiens
agagacagggttttgtcgtgtt

SEQ ID NO: 9351232 - DNA, 22 bp, Homo sapiens
agagacagggttttgtcgtgtt

SEQ ID NO: 9351233 - DNA, 22 bp, Homo sapiens
agagacatgcagttgttgtgaa

SEQ ID NO: 9351234 - DNA, 22 bp, Homo sapiens
agagacatgcagttgttgtgaa

SEQ ID NO: 9351235 - DNA, 22 bp, Homo sapiens
agagaagagtcttgtcaaatta

SEQ ID NO: 9351236 - DNA, 22 bp, Homo sapiens
agagaagattcttatatgtctt

SEQ ID NO: 9351237 - DNA, 22 bp, Homo sapiens
agagacagggttttgtcgtgtt

SEQ ID NO: 9351238 - DNA, 22 bp, Homo sapiens
atggcggcgccaggccctaatt

SEQ ID NO: 9351239 - DNA, 22 bp, Homo sapiens
atggcctttctcagtggtgctt

SEQ ID NO: 9351240 - DNA, 22 bp, Homo sapiens
atggctagcaccgcgttgctgg

SEQ ID NO: 9351241 - DNA, 17 bp, Homo sapiens
atggctcacctgtgggc

SEQ ID NO: 9351242 - DNA, 22 bp, Homo sapiens
atggctagttgatatggtgttt

SEQ ID NO: 9351243 - DNA, 17 bp, Homo sapiens
atggctcacctgtgggc

SEQ ID NO: 9351244 - DNA, 22 bp, Homo sapiens
agagatgaaaagtggagactgg

SEQ ID NO: 9351245 - DNA, 22 bp, Homo sapiens
agagactgatggagctcactct

SEQ ID NO: 9351246 - DNA, 22 bp, Homo sapiens
agagactaagccagcatagtgc

SEQ ID NO: 9351247 - DNA, 22 bp, Homo sapiens
atggcctgatgcacctgtccca

SEQ ID NO: 9351248 - DNA, 22 bp, Homo sapiens
agagacctttctcctgcctttc

SEQ ID NO: 9351249 - DNA, 22 bp, Homo sapiens
agagacctgaagagcttcctca

SEQ ID NO: 9351250 - DNA, 22 bp, Homo sapiens
atggcctggggattcctgagca

SEQ ID NO: 9351251 - DNA, 22 bp, Homo sapiens
atggcctggggattcctgagca

SEQ ID NO: 9351252 - DNA, 22 bp, Homo sapiens
atggcctggggattcctgagca

SEQ ID NO: 9351253 - DNA, 22 bp, Homo sapiens
atggcctggggagcatgggaag

SEQ ID NO: 9351254 - DNA, 22 bp, Homo sapiens
atggcctgcagtgctgccacag

SEQ ID NO: 9351255 - DNA, 22 bp, Homo sapiens
atgcacctgaactccatcagct

SEQ ID NO: 9351256 - DNA, 22 bp, Homo sapiens
atgcacctgaactccatcagct

SEQ ID NO: 9351257 - DNA, 22 bp, Homo sapiens
atgcacccttatgaatatgatc

SEQ ID NO: 9351258 - DNA, 22 bp, Homo sapiens
atgcacatgtatgtcaatattt

SEQ ID NO: 9351259 - DNA, 22 bp, Homo sapiens
atgcacatgtatctatatacaa

SEQ ID NO: 9351260 - DNA, 22 bp, Homo sapiens
agacagacatgctagttttctt

SEQ ID NO: 9351261 - DNA, 22 bp, Homo sapiens
agacagacatgctagttttctt

SEQ ID NO: 9351262 - DNA, 22 bp, Homo sapiens
atgcactgttggatatatttgt

SEQ ID NO: 9351263 - DNA, 22 bp, Homo sapiens
agacagacattctagagccacc

SEQ ID NO: 9351264 - DNA, 22 bp, Homo sapiens
agacagaccatggctattcaga

SEQ ID NO: 9351265 - DNA, 22 bp, Homo sapiens
agacagacggctttatacacag

SEQ ID NO: 9351266 - DNA, 22 bp, Homo sapiens
agacagacggctttatacacag

SEQ ID NO: 9351267 - DNA, 17 bp, Homo sapiens
agacagacctctgcatc

SEQ ID NO: 9351268 - DNA, 21 bp, Homo sapiens
agacagactgcctgacccacg

SEQ ID NO: 9351269 - DNA, 22 bp, Homo sapiens
agacagactggtttgaattggt

SEQ ID NO: 9351270 - DNA, 22 bp, Homo sapiens
agacagacgtagtgtgagagta

SEQ ID NO: 9351271 - DNA, 22 bp, Homo sapiens
atgcacatacatatgctctata

SEQ ID NO: 9351272 - DNA, 22 bp, Homo sapiens
atgcacataggccaaatcattt

SEQ ID NO: 9351273 - DNA, 22 bp, Homo sapiens
atgcacataggccaaatcattt

SEQ ID NO: 9351274 - DNA, 20 bp, Homo sapiens
atgcacatacgcatgcacat

SEQ ID NO: 9351275 - DNA, 22 bp, Homo sapiens
atgcacatcactctgaagaaaa

SEQ ID NO: 9351276 - DNA, 23 bp, Homo sapiens
atgacaaacaggacatcttgtgc

SEQ ID NO: 9351277 - DNA, 22 bp, Homo sapiens
atgacaaaattcacaggtgtga

SEQ ID NO: 9351278 - DNA, 22 bp, Homo sapiens
atgacaaaagaagacatgaggt

SEQ ID NO: 9351279 - DNA, 22 bp, Homo sapiens
agacaggacacaagctgcataa

SEQ ID NO: 9351280 - DNA, 22 bp, Homo sapiens
agacaggagagggaactgccgg

SEQ ID NO: 9351281 - DNA, 22 bp, Homo sapiens
agacaggagagggaactgccgg

SEQ ID NO: 9351282 - DNA, 22 bp, Homo sapiens
agacaggagagggaactgccgg

SEQ ID NO: 9351283 - DNA, 20 bp, Homo sapiens
agacaggagcccccattcag

SEQ ID NO: 9351284 - DNA, 22 bp, Homo sapiens
agacaggatgcatactcttggt

SEQ ID NO: 9351285 - DNA, 22 bp, Homo sapiens
agacaggatgcatactcttggt

SEQ ID NO: 9351286 - DNA, 22 bp, Homo sapiens
agacaggcagaggctgcagagg

SEQ ID NO: 9351287 - DNA, 22 bp, Homo sapiens
agacagctgttccttcatgttt

SEQ ID NO: 9351288 - DNA, 22 bp, Homo sapiens
agacaggacacaagctgcataa

SEQ ID NO: 9351289 - DNA, 22 bp, Homo sapiens
agacatttggaagatacacata

SEQ ID NO: 9351290 - DNA, 22 bp, Homo sapiens
agacatttcctgtgaacctact

SEQ ID NO: 9351291 - DNA, 22 bp, Homo sapiens
agacattttaacatctgggttt

SEQ ID NO: 9351292 - DNA, 23 bp, Homo sapiens
agacattttaataaggacttttt

SEQ ID NO: 9351293 - DNA, 22 bp, Homo sapiens
agacatttggagccaactttcc

SEQ ID NO: 9351294 - DNA, 22 bp, Homo sapiens
agacatttggaagatacacata

SEQ ID NO: 9351295 - DNA, 22 bp, Homo sapiens
agacatttattgaacacctagc

SEQ ID NO: 9351296 - DNA, 22 bp, Homo sapiens
agacatttcctagacatcaatg

SEQ ID NO: 9351297 - DNA, 22 bp, Homo sapiens
agacatatggtgaaacatttta

SEQ ID NO: 9351298 - DNA, 22 bp, Homo sapiens
agacatatgcctaatactggtt

SEQ ID NO: 9351299 - DNA, 22 bp, Homo sapiens
agacagctagggctgcagggac

SEQ ID NO: 9351300 - DNA, 22 bp, Homo sapiens
agacagcgaggacagaggggtg

SEQ ID NO: 9351301 - DNA, 22 bp, Homo sapiens
agacagctatcaacaactttct

SEQ ID NO: 9351302 - DNA, 22 bp, Homo sapiens
agacagctccaagtgtctctgt

SEQ ID NO: 9351303 - DNA, 22 bp, Homo sapiens
agacagcatttctagcaccagg

SEQ ID NO: 9351304 - DNA, 22 bp, Homo sapiens
agacagcatgatacatgatgct

SEQ ID NO: 9351305 - DNA, 22 bp, Homo sapiens
agacagcatgagcctgctgatg

SEQ ID NO: 9351306 - DNA, 22 bp, Homo sapiens
agacagactgtgtttgaatcct

SEQ ID NO: 9351307 - DNA, 22 bp, Homo sapiens
agacagacttgaaaatgttctt

SEQ ID NO: 9351308 - DNA, 22 bp, Homo sapiens
agacagcagaaactagagcact

SEQ ID NO: 9351309 - DNA, 22 bp, Homo sapiens
atgaacaataatcatgtctatg

SEQ ID NO: 9351310 - DNA, 22 bp, Homo sapiens
atgaacaataatcatgtctatg

SEQ ID NO: 9351311 - DNA, 22 bp, Homo sapiens
atgaacaataaaatagatcaca

SEQ ID NO: 9351312 - DNA, 22 bp, Homo sapiens
atgaacaatgactacatattga

SEQ ID NO: 9351313 - DNA, 22 bp, Homo sapiens
atgaacaatctgttgacttctg

SEQ ID NO: 9351314 - DNA, 22 bp, Homo sapiens
atgaacaatctggcaagaactt

SEQ ID NO: 9351315 - DNA, 22 bp, Homo sapiens
agacaaagaaaccgtagaagca

SEQ ID NO: 9351316 - DNA, 22 bp, Homo sapiens
agacaaagaaaccgtagaagca

SEQ ID NO: 9351317 - DNA, 22 bp, Homo sapiens
agacaaaggattaatgatgatg

SEQ ID NO: 9351318 - DNA, 22 bp, Homo sapiens
agacaaatgaacaaatatgtga

SEQ ID NO: 9351319 - DNA, 22 bp, Homo sapiens
atgaaagatgatttaaagtact

SEQ ID NO: 9351320 - DNA, 22 bp, Homo sapiens
atgaaagcacgtgggaagataa

SEQ ID NO: 9351321 - DNA, 22 bp, Homo sapiens
atgaaagtacctgtaatatgtt

SEQ ID NO: 9351322 - DNA, 22 bp, Homo sapiens
atgaacaagagagggaagattc

SEQ ID NO: 9351323 - DNA, 22 bp, Homo sapiens
atgaacaataaaatagatcaca

SEQ ID NO: 9351324 - DNA, 22 bp, Homo sapiens
atgaacaagtatttgcatgagc

SEQ ID NO: 9351325 - DNA, 22 bp, Homo sapiens
atgaacaataaaatagatcaca

SEQ ID NO: 9351326 - DNA, 22 bp, Homo sapiens
atgaaattttaattatacctct

SEQ ID NO: 9351327 - DNA, 22 bp, Homo sapiens
atgaacaaaaacaaggcctgtt

SEQ ID NO: 9351328 - DNA, 22 bp, Homo sapiens
atgaaatttgaccaattattta

SEQ ID NO: 9351329 - DNA, 22 bp, Homo sapiens
atgaaatttgaccaattattta

SEQ ID NO: 9351330 - DNA, 22 bp, Homo sapiens
atgaaatttgaccaattattta

SEQ ID NO: 9351331 - DNA, 22 bp, Homo sapiens
atgaaattgatcttgaactttt

SEQ ID NO: 9351332 - DNA, 22 bp, Homo sapiens
agaagtttcacaatgggtttta

SEQ ID NO: 9351333 - DNA, 19 bp, Homo sapiens
agaagttagacattgcaat

SEQ ID NO: 9351334 - DNA, 20 bp, Homo sapiens
agaagtggctgcagacacta

SEQ ID NO: 9351335 - DNA, 22 bp, Homo sapiens
agaagtttggtcctataaactc

SEQ ID NO: 9351336 - DNA, 20 bp, Homo sapiens
agaagtttgggggtgtggag

SEQ ID NO: 9351337 - DNA, 22 bp, Homo sapiens
atctttgttatctcagatcttg

SEQ ID NO: 9351338 - DNA, 22 bp, Homo sapiens
atctttgttgctctcatttctg

SEQ ID NO: 9351339 - DNA, 22 bp, Homo sapiens
atctttgttgctctcatttctg

SEQ ID NO: 9351340 - DNA, 22 bp, Homo sapiens
agaagtcaatgatgagagtgct

SEQ ID NO: 9351341 - DNA, 22 bp, Homo sapiens
atctcaggaggaccctgatgct

SEQ ID NO: 9351342 - DNA, 22 bp, Homo sapiens
agaagtattctgcatgtactga

SEQ ID NO: 9351343 - DNA, 22 bp, Homo sapiens
atctcagaaacatatctaatcc

SEQ ID NO: 9351344 - DNA, 22 bp, Homo sapiens
atctcaggaggaccctgatgct

SEQ ID NO: 9351345 - DNA, 22 bp, Homo sapiens
agaagtcagccacagtgggaga

SEQ ID NO: 9351346 - DNA, 23 bp, Homo sapiens
agaagtggaatggccgtggggtc

SEQ ID NO: 9351347 - DNA, 22 bp, Homo sapiens
agaagtgccgaaaggaagacag

SEQ ID NO: 9351348 - DNA, 22 bp, Homo sapiens
agaagtgctccagtgagttggg

SEQ ID NO: 9351349 - DNA, 22 bp, Homo sapiens
agaagtgagtgtgactcagcag

SEQ ID NO: 9351350 - DNA, 16 bp, Homo sapiens
atttccagattatgca

SEQ ID NO: 9351351 - DNA, 17 bp, Homo sapiens
atttccagagtggccct

SEQ ID NO: 9351352 - DNA, 17 bp, Homo sapiens
atttccagagtggccct

SEQ ID NO: 9351353 - DNA, 22 bp, Homo sapiens
atttccagactttttccaggaa

SEQ ID NO: 9351354 - DNA, 22 bp, Homo sapiens
atttcctatacagttgtccata

SEQ ID NO: 9351355 - DNA, 22 bp, Homo sapiens
atttcctaggtgctcgagtgct

SEQ ID NO: 9351356 - DNA, 16 bp, Homo sapiens
atttccagattatgca

SEQ ID NO: 9351357 - DNA, 22 bp, Homo sapiens
atttccagcagcatatttgtct

SEQ ID NO: 9351358 - DNA, 22 bp, Homo sapiens
atttccagcagcatatttgtct

SEQ ID NO: 9351359 - DNA, 22 bp, Homo sapiens
atttcctatagatatggtgagt

SEQ ID NO: 9351360 - DNA, 22 bp, Homo sapiens
atttcctatcctggtcttaaaa

SEQ ID NO: 9351361 - DNA, 22 bp, Homo sapiens
atttcctatttcttgtccccta

SEQ ID NO: 9351362 - DNA, 22 bp, Homo sapiens
atttcctatggatacaggcaga

SEQ ID NO: 9351363 - DNA, 22 bp, Homo sapiens
atttccagactttttccaggaa

SEQ ID NO: 9351364 - DNA, 22 bp, Homo sapiens
agataggagccaggacttaaca

SEQ ID NO: 9351365 - DNA, 22 bp, Homo sapiens
agatactatggaattttatgag

SEQ ID NO: 9351366 - DNA, 17 bp, Homo sapiens
atttcctgcaagcccct

SEQ ID NO: 9351367 - DNA, 22 bp, Homo sapiens
atttcctgcagagcccctccga

SEQ ID NO: 9351368 - DNA, 22 bp, Homo sapiens
atttccttcagtgtttaatact

SEQ ID NO: 9351369 - DNA, 22 bp, Homo sapiens
atttctcagttcctactgttta

SEQ ID NO: 9351370 - DNA, 22 bp, Homo sapiens
atttctccttgttgcaatgcag

SEQ ID NO: 9351371 - DNA, 22 bp, Homo sapiens
atttctcctccagatggtggtt

SEQ ID NO: 9351372 - DNA, 22 bp, Homo sapiens
atttctccttgttgcaatgcag

SEQ ID NO: 9351373 - DNA, 22 bp, Homo sapiens
atttctctaagcatccgtttgc

SEQ ID NO: 9351374 - DNA, 22 bp, Homo sapiens
atttctcctccagatggtggtt

SEQ ID NO: 9351375 - DNA, 22 bp, Homo sapiens
atttctccttgttgcaatgcag

SEQ ID NO: 9351376 - DNA, 22 bp, Homo sapiens
atttctcctccagatggtggtt

SEQ ID NO: 9351377 - DNA, 22 bp, Homo sapiens
atttctctcattgttagctagg

SEQ ID NO: 9351378 - DNA, 22 bp, Homo sapiens
atttctctaagcatccgtttgc

SEQ ID NO: 9351379 - DNA, 22 bp, Homo sapiens
atttgctttcccttccctgaca

SEQ ID NO: 9351380 - DNA, 22 bp, Homo sapiens
atttctctgcctcagcttctgc

SEQ ID NO: 9351381 - DNA, 22 bp, Homo sapiens
atttgttgctagcagcactgat

SEQ ID NO: 9351382 - DNA, 22 bp, Homo sapiens
atttgttgctagcagcactgat

SEQ ID NO: 9351383 - DNA, 22 bp, Homo sapiens
atttgtttatcgtcgattgtag

SEQ ID NO: 9351384 - DNA, 22 bp, Homo sapiens
attttttgttaactcaggatag

SEQ ID NO: 9351385 - DNA, 22 bp, Homo sapiens
attttaaccctcttatatatac

SEQ ID NO: 9351386 - DNA, 22 bp, Homo sapiens
attttttgttaactcaggatag

SEQ ID NO: 9351387 - DNA, 22 bp, Homo sapiens
attttaaccctcttatatatac

SEQ ID NO: 9351388 - DNA, 22 bp, Homo sapiens
attttaaccctcttatatatac

SEQ ID NO: 9351389 - DNA, 21 bp, Homo sapiens
caaaaggataggaaattaggg

SEQ ID NO: 9351390 - DNA, 22 bp, Homo sapiens
caaaagtaattgcagtttttgc

SEQ ID NO: 9351391 - DNA, 22 bp, Homo sapiens
caaaagtaccttgtgtgctttg

SEQ ID NO: 9351392 - DNA, 22 bp, Homo sapiens
caaaagtaattgcagtttttgc

SEQ ID NO: 9351393 - DNA, 22 bp, Homo sapiens
caaaaggccagtactttgtttg

SEQ ID NO: 9351394 - DNA, 22 bp, Homo sapiens
atttgtctttggacctgtgaga

SEQ ID NO: 9351395 - DNA, 22 bp, Homo sapiens
atttgtgaattaagcatgtcaa

SEQ ID NO: 9351396 - DNA, 22 bp, Homo sapiens
atttgttcacaatcagggcagg

SEQ ID NO: 9351397 - DNA, 22 bp, Homo sapiens
atttgttccatgagtaaggcta

SEQ ID NO: 9351398 - DNA, 22 bp, Homo sapiens
agagtttaccactatttttggt

SEQ ID NO: 9351399 - DNA, 22 bp, Homo sapiens
agagttgctaccaagatgctag

SEQ ID NO: 9351400 - DNA, 22 bp, Homo sapiens
agagttgcgtccatgcagagtt

SEQ ID NO: 9351401 - DNA, 23 bp, Homo sapiens
agagttgctaaaaacactcagat

SEQ ID NO: 9351402 - DNA, 22 bp, Homo sapiens
agagttgctaaattcaggtctt

SEQ ID NO: 9351403 - DNA, 22 bp, Homo sapiens
agagttgctaatgtgcagaata

SEQ ID NO: 9351404 - DNA, 22 bp, Homo sapiens
agagttgctatagaaggatgga

SEQ ID NO: 9351405 - DNA, 22 bp, Homo sapiens
agagttgctccattagaactta

SEQ ID NO: 9351406 - DNA, 22 bp, Homo sapiens
agagttgctgagtatataccca

SEQ ID NO: 9351407 - DNA, 22 bp, Homo sapiens
agagttgcttatgtcaggtgag

SEQ ID NO: 9351408 - DNA, 22 bp, Homo sapiens
agagttgcttatttgagtttct

SEQ ID NO: 9351409 - DNA, 22 bp, Homo sapiens
agagttgctgttggagcagtga

SEQ ID NO: 9351410 - DNA, 22 bp, Homo sapiens
agagttgcttatgtcaggtgag

SEQ ID NO: 9351411 - DNA, 22 bp, Homo sapiens
agaggtcttaagatctagactg

SEQ ID NO: 9351412 - DNA, 22 bp, Homo sapiens
agaggtcttaagatctagactg

SEQ ID NO: 9351413 - DNA, 22 bp, Homo sapiens
agaggtcttaagttccttgatg

SEQ ID NO: 9351414 - DNA, 22 bp, Homo sapiens
agaggtcttcacatggcaatga

SEQ ID NO: 9351415 - DNA, 22 bp, Homo sapiens
agaggtcttttggtctgcagaa

SEQ ID NO: 9351416 - DNA, 22 bp, Homo sapiens
agaggtcttttggtctgcagaa

SEQ ID NO: 9351417 - DNA, 22 bp, Homo sapiens
agaggtcttcagcatttgaact

SEQ ID NO: 9351418 - DNA, 22 bp, Homo sapiens
agaggtgacataggagaggctc

SEQ ID NO: 9351419 - DNA, 22 bp, Homo sapiens
agaggtgaaagaatttggctct

SEQ ID NO: 9351420 - DNA, 22 bp, Homo sapiens
agagtgggtgatctctgttgtc

SEQ ID NO: 9351421 - DNA, 21 bp, Homo sapiens
agagttcttgctgagcaagcc

SEQ ID NO: 9351422 - DNA, 21 bp, Homo sapiens
agagttgcagcaaatggggga

SEQ ID NO: 9351423 - DNA, 22 bp, Homo sapiens
agagttgcaaacagatacctac

SEQ ID NO: 9351424 - DNA, 22 bp, Homo sapiens
agagttgcatagtgcttttaag

SEQ ID NO: 9351425 - DNA, 22 bp, Homo sapiens
agagttgccagcttatggccaa

SEQ ID NO: 9351426 - DNA, 22 bp, Homo sapiens
agagtgggtgatctctgttgtc

SEQ ID NO: 9351427 - DNA, 22 bp, Homo sapiens
attgcattgcagctagattttg

SEQ ID NO: 9351428 - DNA, 22 bp, Homo sapiens
attgccaggagggttgagaata

SEQ ID NO: 9351429 - DNA, 22 bp, Homo sapiens
attgctgaaagtattttatgac

SEQ ID NO: 9351430 - DNA, 21 bp, Homo sapiens
agaggtctaagattctagctt

SEQ ID NO: 9351431 - DNA, 22 bp, Homo sapiens
agaggtctatgctaggggaact

SEQ ID NO: 9351432 - DNA, 22 bp, Homo sapiens
agaggtctgactcagcagatta

SEQ ID NO: 9351433 - DNA, 22 bp, Homo sapiens
agaggtctgagcaatctcaagc

SEQ ID NO: 9351434 - DNA, 22 bp, Homo sapiens
agaggtctgagcaatctcaagc

SEQ ID NO: 9351435 - DNA, 22 bp, Homo sapiens
agaggtctcagttatgtttaaa

SEQ ID NO: 9351436 - DNA, 22 bp, Homo sapiens
agaggtcagagcaggaaaggca

SEQ ID NO: 9351437 - DNA, 22 bp, Homo sapiens
agaggtcagaacaggaaagtgt

SEQ ID NO: 9351438 - DNA, 22 bp, Homo sapiens
atttcacagctgtcagtgttac

SEQ ID NO: 9351439 - DNA, 22 bp, Homo sapiens
atttcacagctgtcagtgttac

SEQ ID NO: 9351440 - DNA, 22 bp, Homo sapiens
atttcacaggccagtggtgggg

SEQ ID NO: 9351441 - DNA, 22 bp, Homo sapiens
atttcacagctgtcagtgttac

SEQ ID NO: 9351442 - DNA, 22 bp, Homo sapiens
atttcacagctgctgttcaggt

SEQ ID NO: 9351443 - DNA, 22 bp, Homo sapiens
atttcacattaatttgatgctc

SEQ ID NO: 9351444 - DNA, 22 bp, Homo sapiens
atttcacattaatttgatgctc

SEQ ID NO: 9351445 - DNA, 22 bp, Homo sapiens
agatacatagctgtgagcacac

SEQ ID NO: 9351446 - DNA, 22 bp, Homo sapiens
agatacatagctgtgagcacac

SEQ ID NO: 9351447 - DNA, 22 bp, Homo sapiens
agatacatatagaaaacatcaa

SEQ ID NO: 9351448 - DNA, 22 bp, Homo sapiens
atttattgaagcttattacgtt

SEQ ID NO: 9351449 - DNA, 22 bp, Homo sapiens
atttattgaagcttattacgtt

SEQ ID NO: 9351450 - DNA, 22 bp, Homo sapiens
atttcacagctgctgttcaggt

SEQ ID NO: 9351451 - DNA, 22 bp, Homo sapiens
atttcacagctgctgttcaggt

SEQ ID NO: 9351452 - DNA, 22 bp, Homo sapiens
atttcacagcgtggttgactgc

SEQ ID NO: 9351453 - DNA, 22 bp, Homo sapiens
atttattgagacttaacaaccc

SEQ ID NO: 9351454 - DNA, 22 bp, Homo sapiens
attcagggaggaaaggggcctc

SEQ ID NO: 9351455 - DNA, 22 bp, Homo sapiens
attcagtagaagttagctatta

SEQ ID NO: 9351456 - DNA, 22 bp, Homo sapiens
attcatgtggggagccttctgt

SEQ ID NO: 9351457 - DNA, 22 bp, Homo sapiens
attcatgttttcttgcttcaag

SEQ ID NO: 9351458 - DNA, 22 bp, Homo sapiens
attcattccaggtcagtcagac

SEQ ID NO: 9351459 - DNA, 22 bp, Homo sapiens
attcatgttttcttgcttcaag

SEQ ID NO: 9351460 - DNA, 22 bp, Homo sapiens
agaggcaggaagagctgatttt

SEQ ID NO: 9351461 - DNA, 22 bp, Homo sapiens
agaggcaggaggttgacttgag

SEQ ID NO: 9351462 - DNA, 22 bp, Homo sapiens
agaggcagccgtatttcaaagg

SEQ ID NO: 9351463 - DNA, 22 bp, Homo sapiens
agaggcaggaagagctgatttt

SEQ ID NO: 9351464 - DNA, 22 bp, Homo sapiens
agaggcagcagtcatactacag

SEQ ID NO: 9351465 - DNA, 17 bp, Homo sapiens
agaggcagatacttgga

SEQ ID NO: 9351466 - DNA, 17 bp, Homo sapiens
agaggcagatacttgga

SEQ ID NO: 9351467 - DNA, 17 bp, Homo sapiens
agaggcagatacttgga

SEQ ID NO: 9351468 - DNA, 19 bp, Homo sapiens
attcattggccagggtggt

SEQ ID NO: 9351469 - DNA, 22 bp, Homo sapiens
attcatttagagggattaagca

SEQ ID NO: 9351470 - DNA, 22 bp, Homo sapiens
attcatttaggtattcacttac

SEQ ID NO: 9351471 - DNA, 22 bp, Homo sapiens
agaggcctgtgtgctccagtgg

SEQ ID NO: 9351472 - DNA, 22 bp, Homo sapiens
agaggcctgtgtgctccagtgg

SEQ ID NO: 9351473 - DNA, 22 bp, Homo sapiens
agaggcctgtgtgctccagtgg

SEQ ID NO: 9351474 - DNA, 22 bp, Homo sapiens
attcatttgctattgtgtatgg

SEQ ID NO: 9351475 - DNA, 22 bp, Homo sapiens
attcatttgctattgtgtatgg

SEQ ID NO: 9351476 - DNA, 22 bp, Homo sapiens
attcatttgctattgtgtatgg

SEQ ID NO: 9351477 - DNA, 22 bp, Homo sapiens
agaggctcctcggtgcctcgtg

SEQ ID NO: 9351478 - DNA, 22 bp, Homo sapiens
agaggctccaccttctctgtcc

SEQ ID NO: 9351479 - DNA, 22 bp, Homo sapiens
agaggctccgtcatccctcttt

SEQ ID NO: 9351480 - DNA, 22 bp, Homo sapiens
agaggctcactcttggaaccca

SEQ ID NO: 9351481 - DNA, 22 bp, Homo sapiens
agaggctaggaccatgtatcat

SEQ ID NO: 9351482 - DNA, 22 bp, Homo sapiens
attgcagatgatccccaagtta

SEQ ID NO: 9351483 - DNA, 22 bp, Homo sapiens
attgcagtgatggttgcataat

SEQ ID NO: 9351484 - DNA, 22 bp, Homo sapiens
attgcagtgtgtgttccatgag

SEQ ID NO: 9351485 - DNA, 22 bp, Homo sapiens
attccagatgttactgaaaggc

SEQ ID NO: 9351486 - DNA, 22 bp, Homo sapiens
attccagatgttactgaaaggc

SEQ ID NO: 9351487 - DNA, 22 bp, Homo sapiens
attccagatgttactgaaaggc

SEQ ID NO: 9351488 - DNA, 22 bp, Homo sapiens
agagggaaggacagatgtttca

SEQ ID NO: 9351489 - DNA, 18 bp, Homo sapiens
agagggaatcagttggat

SEQ ID NO: 9351490 - DNA, 22 bp, Homo sapiens
agagggaaatccaggagtgctt

SEQ ID NO: 9351491 - DNA, 18 bp, Homo sapiens
agagggaaagcaggctga

SEQ ID NO: 9351492 - DNA, 22 bp, Homo sapiens
agagggaaatccaggagtgctt

SEQ ID NO: 9351493 - DNA, 22 bp, Homo sapiens
agagggaaaaactcatgtcatt

SEQ ID NO: 9351494 - DNA, 17 bp, Homo sapiens
agagggaaaatgcggtt

SEQ ID NO: 9351495 - DNA, 22 bp, Homo sapiens
agaggctgtgcagagggagtgc

SEQ ID NO: 9351496 - DNA, 22 bp, Homo sapiens
agaggctgtgcagagggagtgc

SEQ ID NO: 9351497 - DNA, 22 bp, Homo sapiens
agagggacaataagataaaatg

SEQ ID NO: 9351498 - DNA, 22 bp, Homo sapiens
agagggaatgtgattgcaccat

SEQ ID NO: 9351499 - DNA, 22 bp, Homo sapiens
agagggagaaaagaatcagttg

SEQ ID NO: 9351500 - DNA, 21 bp, Homo sapiens
agagggagagtggcccttcca

SEQ ID NO: 9351501 - DNA, 22 bp, Homo sapiens
attccagatgaattgcatagtt

SEQ ID NO: 9351502 - DNA, 22 bp, Homo sapiens
attccagatgaattgcatagtt

SEQ ID NO: 9351503 - DNA, 22 bp, Homo sapiens
attccagatgaattgcatagtt

SEQ ID NO: 9351504 - DNA, 22 bp, Homo sapiens
attccagatggcttcaagtaag

SEQ ID NO: 9351505 - DNA, 23 bp, Homo sapiens
attccagagctagagtcaagtgg

SEQ ID NO: 9351506 - DNA, 23 bp, Homo sapiens
attccagagctagagtcaagtgg

SEQ ID NO: 9351507 - DNA, 22 bp, Homo sapiens
attccagagaggttctggaggt

SEQ ID NO: 9351508 - DNA, 22 bp, Homo sapiens
attccagacaggtaaattaggt

SEQ ID NO: 9351509 - DNA, 22 bp, Homo sapiens
attccagaataccggcaagatg

SEQ ID NO: 9351510 - DNA, 21 bp, Homo sapiens
agagggagagtggcccttcca

SEQ ID NO: 9351511 - DNA, 22 bp, Homo sapiens
agaggaagctgagatgcctctt

SEQ ID NO: 9351512 - DNA, 22 bp, Homo sapiens
agaggaagctgagatgcctctt

SEQ ID NO: 9351513 - DNA, 22 bp, Homo sapiens
agaggacaaaatgagaagtgct

SEQ ID NO: 9351514 - DNA, 22 bp, Homo sapiens
agaggacaaaatgagaagtgct

SEQ ID NO: 9351515 - DNA, 22 bp, Homo sapiens
atgtttatggagcaggtattag

SEQ ID NO: 9351516 - DNA, 22 bp, Homo sapiens
atgtttatggagcaggtattag

SEQ ID NO: 9351517 - DNA, 22 bp, Homo sapiens
agaggacaggttttccatgggc

SEQ ID NO: 9351518 - DNA, 22 bp, Homo sapiens
agaggacaggttttccatgggc

SEQ ID NO: 9351519 - DNA, 22 bp, Homo sapiens
agaggacagcccccttgtctgg

SEQ ID NO: 9351520 - DNA, 22 bp, Homo sapiens
agaggacagagtgctggattta

SEQ ID NO: 9351521 - DNA, 22 bp, Homo sapiens
agaggacagagtgctggattta

SEQ ID NO: 9351522 - DNA, 22 bp, Homo sapiens
agaggacagcccccttgtctgg

SEQ ID NO: 9351523 - DNA, 22 bp, Homo sapiens
agaggacaaaatgagaagtgct

SEQ ID NO: 9351524 - DNA, 22 bp, Homo sapiens
agaggacacatctttcctcaaa

SEQ ID NO: 9351525 - DNA, 22 bp, Homo sapiens
agaggacagacggaaagtgcca

SEQ ID NO: 9351526 - DNA, 22 bp, Homo sapiens
agaggacagacggaaagtgcca

SEQ ID NO: 9351527 - DNA, 19 bp, Homo sapiens
atgtttacactcaggggct

SEQ ID NO: 9351528 - DNA, 21 bp, Homo sapiens
atgtttacactgactactgtg

SEQ ID NO: 9351529 - DNA, 22 bp, Homo sapiens
atgtttacagaggaagtgcctc

SEQ ID NO: 9351530 - DNA, 22 bp, Homo sapiens
atgtttactgaaaagatttcaa

SEQ ID NO: 9351531 - DNA, 22 bp, Homo sapiens
atgtttacaattcagtattaca

SEQ ID NO: 9351532 - DNA, 22 bp, Homo sapiens
atgtttacaattcagtattaca

SEQ ID NO: 9351533 - DNA, 22 bp, Homo sapiens
atgtttacaaaaaggaggcttg

SEQ ID NO: 9351534 - DNA, 22 bp, Homo sapiens
atgtttatgcaaacatgtgagt

SEQ ID NO: 9351535 - DNA, 22 bp, Homo sapiens
atgtttactggtttatagaata

SEQ ID NO: 9351536 - DNA, 22 bp, Homo sapiens
agagctgtatccccttaccagt

SEQ ID NO: 9351537 - DNA, 21 bp, Homo sapiens
agagctgggacttgcctgaga

SEQ ID NO: 9351538 - DNA, 22 bp, Homo sapiens
atgtgtatatttattgtagttt

SEQ ID NO: 9351539 - DNA, 22 bp, Homo sapiens
atgtgtatatttggtgtcaata

SEQ ID NO: 9351540 - DNA, 22 bp, Homo sapiens
atgtgtatatttattgtagttt

SEQ ID NO: 9351541 - DNA, 22 bp, Homo sapiens
atgtgtatacttgtgcttactc

SEQ ID NO: 9351542 - DNA, 22 bp, Homo sapiens
atgtgtaggtgaatcgaggctg

SEQ ID NO: 9351543 - DNA, 21 bp, Homo sapiens
agagctggtaggtaggtaggt

SEQ ID NO: 9351544 - DNA, 21 bp, Homo sapiens
agagctggtaggtaggtaggt

SEQ ID NO: 9351545 - DNA, 22 bp, Homo sapiens
agagctgggacttggactcaat

SEQ ID NO: 9351546 - DNA, 22 bp, Homo sapiens
agagctggtttactcaggaatt

SEQ ID NO: 9351547 - DNA, 22 bp, Homo sapiens
agagctggtttactcaggaatt

SEQ ID NO: 9351548 - DNA, 22 bp, Homo sapiens
agaggagaatccgtttccttgc

SEQ ID NO: 9351549 - DNA, 22 bp, Homo sapiens
agaggacaggttttccatgggc

SEQ ID NO: 9351550 - DNA, 22 bp, Homo sapiens
agaggacaggttttccatgggc

SEQ ID NO: 9351551 - DNA, 22 bp, Homo sapiens
agaggacaggttttccatgggc

SEQ ID NO: 9351552 - DNA, 20 bp, Homo sapiens
agaggaggattattttattc

SEQ ID NO: 9351553 - DNA, 20 bp, Homo sapiens
agaggaggattattttattc

SEQ ID NO: 9351554 - DNA, 22 bp, Homo sapiens
agaggaggaagagctttaaaat

SEQ ID NO: 9351555 - DNA, 22 bp, Homo sapiens
agaggaggaagagctttaaaat

SEQ ID NO: 9351556 - DNA, 22 bp, Homo sapiens
agaggaggatttgtaaaggtct

SEQ ID NO: 9351557 - DNA, 22 bp, Homo sapiens
agaggaggatttgtaaaggtct

SEQ ID NO: 9351558 - DNA, 22 bp, Homo sapiens
agaggaggatttgtaaaggtct

SEQ ID NO: 9351559 - DNA, 22 bp, Homo sapiens
agaggaggatttgtaaaggtct

SEQ ID NO: 9351560 - DNA, 22 bp, Homo sapiens
agaggaggctgggtccagataa

SEQ ID NO: 9351561 - DNA, 22 bp, Homo sapiens
agaggaggctctgggatcgtcc

SEQ ID NO: 9351562 - DNA, 22 bp, Homo sapiens
agaggaggctctgggatcgtcc

SEQ ID NO: 9351563 - DNA, 22 bp, Homo sapiens
agaggaggctctgggatcgtcc

SEQ ID NO: 9351564 - DNA, 22 bp, Homo sapiens
attataggcttgagccaccgtg

SEQ ID NO: 9351565 - DNA, 22 bp, Homo sapiens
agaggaggctgggtccagataa

SEQ ID NO: 9351566 - DNA, 22 bp, Homo sapiens
agaggaggctgggtccagataa

SEQ ID NO: 9351567 - DNA, 22 bp, Homo sapiens
agaggaggcagcttaactcagt

SEQ ID NO: 9351568 - DNA, 22 bp, Homo sapiens
agaggaggatttgtaaaggtct

SEQ ID NO: 9351569 - DNA, 22 bp, Homo sapiens
agaggaggcagcttaactcagt

SEQ ID NO: 9351570 - DNA, 22 bp, Homo sapiens
agaggaggcagcttaactcagt

SEQ ID NO: 9351571 - DNA, 22 bp, Homo sapiens
agaggaggctctgggatcgtcc

SEQ ID NO: 9351572 - DNA, 22 bp, Homo sapiens
agaggaggccaggcccacacct

SEQ ID NO: 9351573 - DNA, 22 bp, Homo sapiens
agaggaggccaggcccacacct

SEQ ID NO: 9351574 - DNA, 22 bp, Homo sapiens
agaggaggccaggcccacacct

SEQ ID NO: 9351575 - DNA, 22 bp, Homo sapiens
attattataaagtgcatgacct

SEQ ID NO: 9351576 - DNA, 22 bp, Homo sapiens
attattagattcttaattgtaa

SEQ ID NO: 9351577 - DNA, 22 bp, Homo sapiens
attattaggactactggggttg

SEQ ID NO: 9351578 - DNA, 22 bp, Homo sapiens
attattaggtgctctctgacaa

SEQ ID NO: 9351579 - DNA, 22 bp, Homo sapiens
attattagacttatatggtagt

SEQ ID NO: 9351580 - DNA, 22 bp, Homo sapiens
agaggcagaagtgttcaaaccc

SEQ ID NO: 9351581 - DNA, 22 bp, Homo sapiens
agaggcactgttcttagcgact

SEQ ID NO: 9351582 - DNA, 22 bp, Homo sapiens
attattcaacacttgagaaatt

SEQ ID NO: 9351583 - DNA, 22 bp, Homo sapiens
cacagttatatgttcacaagga

SEQ ID NO: 9351584 - DNA, 22 bp, Homo sapiens
cacagttagctccagtcttagc

SEQ ID NO: 9351585 - DNA, 22 bp, Homo sapiens
cacagtgttccagagcagtggt

SEQ ID NO: 9351586 - DNA, 22 bp, Homo sapiens
agcaggcaggaatggtggaaca

SEQ ID NO: 9351587 - DNA, 22 bp, Homo sapiens
agcaggcaggcccagcggctgg

SEQ ID NO: 9351588 - DNA, 22 bp, Homo sapiens
agcaggcagccatttggaaggc

SEQ ID NO: 9351589 - DNA, 22 bp, Homo sapiens
agcaggcagcatgggaccctcc

SEQ ID NO: 9351590 - DNA, 22 bp, Homo sapiens
agcaggcagcatgggaccctcc

SEQ ID NO: 9351591 - DNA, 22 bp, Homo sapiens
agcaggcactatgccaggatct

SEQ ID NO: 9351592 - DNA, 22 bp, Homo sapiens
agcaggcactatgccaggatct

SEQ ID NO: 9351593 - DNA, 22 bp, Homo sapiens
agcaggcagcctaggaagtgaa

SEQ ID NO: 9351594 - DNA, 22 bp, Homo sapiens
agcaggcagcctaggaagtgaa

SEQ ID NO: 9351595 - DNA, 22 bp, Homo sapiens
agcaggcagctgggggagttga

SEQ ID NO: 9351596 - DNA, 22 bp, Homo sapiens
agcaggcaggaaggcagcactg

SEQ ID NO: 9351597 - DNA, 22 bp, Homo sapiens
agcaggcaggaaggcagcactg

SEQ ID NO: 9351598 - DNA, 22 bp, Homo sapiens
cacagtttctataggtcagaat

SEQ ID NO: 9351599 - DNA, 22 bp, Homo sapiens
cacagtttcaataattattctt

SEQ ID NO: 9351600 - DNA, 22 bp, Homo sapiens
cacagtttctgaacactttgca

SEQ ID NO: 9351601 - DNA, 22 bp, Homo sapiens
cacagtttgcataggaaaaaca

SEQ ID NO: 9351602 - DNA, 22 bp, Homo sapiens
agcaggctgatgggcatgcttg

SEQ ID NO: 9351603 - DNA, 22 bp, Homo sapiens
agcaggctgatgggcatgcttg

SEQ ID NO: 9351604 - DNA, 17 bp, Homo sapiens
agcaggctgcagaggcc

SEQ ID NO: 9351605 - DNA, 22 bp, Homo sapiens
agcaggctccttccttctctgg

SEQ ID NO: 9351606 - DNA, 22 bp, Homo sapiens
agcaggctccttccttctctgg

SEQ ID NO: 9351607 - DNA, 22 bp, Homo sapiens
agcaggctgagcacccaggggg

SEQ ID NO: 9351608 - DNA, 22 bp, Homo sapiens
agcaggctgagcacccaggggg

SEQ ID NO: 9351609 - DNA, 22 bp, Homo sapiens
agcaggctccttccttctctgg

SEQ ID NO: 9351610 - DNA, 22 bp, Homo sapiens
agcaggctccaggctggccatc

SEQ ID NO: 9351611 - DNA, 22 bp, Homo sapiens
agcaggctccttccttctctgg

SEQ ID NO: 9351612 - DNA, 22 bp, Homo sapiens
agcaggctccaggctggccatc

SEQ ID NO: 9351613 - DNA, 22 bp, Homo sapiens
agcaggctccaggctggccatc

SEQ ID NO: 9351614 - DNA, 22 bp, Homo sapiens
agcagctgcagggagggtctgc

SEQ ID NO: 9351615 - DNA, 22 bp, Homo sapiens
agcagctgcagggagggtctgc

SEQ ID NO: 9351616 - DNA, 22 bp, Homo sapiens
agcagctgcagagggctccccc

SEQ ID NO: 9351617 - DNA, 22 bp, Homo sapiens
agcagctgatggggaaggagtt

SEQ ID NO: 9351618 - DNA, 22 bp, Homo sapiens
agcagctgatggggaaggagtt

SEQ ID NO: 9351619 - DNA, 22 bp, Homo sapiens
agcagctgatggggaaggagtt

SEQ ID NO: 9351620 - DNA, 22 bp, Homo sapiens
agcagctgccagagagagttcc

SEQ ID NO: 9351621 - DNA, 22 bp, Homo sapiens
agcagctgccactggaatagga

SEQ ID NO: 9351622 - DNA, 22 bp, Homo sapiens
cacaatttttcttaggtcctgg

SEQ ID NO: 9351623 - DNA, 22 bp, Homo sapiens
cacaattttcctttaagtgtat

SEQ ID NO: 9351624 - DNA, 22 bp, Homo sapiens
cacacaattatgtgtgcacaat

SEQ ID NO: 9351625 - DNA, 22 bp, Homo sapiens
cacacacagttttgtattctgt

SEQ ID NO: 9351626 - DNA, 22 bp, Homo sapiens
cacacacagttttgtattctgt

SEQ ID NO: 9351627 - DNA, 22 bp, Homo sapiens
agcaggcacaagaaagggaggt

SEQ ID NO: 9351628 - DNA, 22 bp, Homo sapiens
agcaggcaccagggctcgtcct

SEQ ID NO: 9351629 - DNA, 22 bp, Homo sapiens
agcaggcaccagggctcgtcct

SEQ ID NO: 9351630 - DNA, 17 bp, Homo sapiens
agcaggcacgtcagcac

SEQ ID NO: 9351631 - DNA, 22 bp, Homo sapiens
agcaggcacgctccctgcgcga

SEQ ID NO: 9351632 - DNA, 23 bp, Homo sapiens
agcaggataattttattatgccc

SEQ ID NO: 9351633 - DNA, 22 bp, Homo sapiens
agcaggagtttgatgcttttat

SEQ ID NO: 9351634 - DNA, 22 bp, Homo sapiens
agcaggattttgaagtgcaagt

SEQ ID NO: 9351635 - DNA, 22 bp, Homo sapiens
agcaggattttgaagtgcaagt

SEQ ID NO: 9351636 - DNA, 21 bp, Homo sapiens
agcaggcaaaggtgaagtctt

SEQ ID NO: 9351637 - DNA, 22 bp, Homo sapiens
agcaggcaagcgtgagttctct

SEQ ID NO: 9351638 - DNA, 22 bp, Homo sapiens
agcaggcaagcgtgagttctct

SEQ ID NO: 9351639 - DNA, 22 bp, Homo sapiens
agcaggcaaggtccgtgcctcg

SEQ ID NO: 9351640 - DNA, 22 bp, Homo sapiens
agcaggcaaggtccgtgcctcg

SEQ ID NO: 9351641 - DNA, 22 bp, Homo sapiens
cacacacagttttgtattctgt

SEQ ID NO: 9351642 - DNA, 22 bp, Homo sapiens
cacacacagttttgtattctgt

SEQ ID NO: 9351643 - DNA, 22 bp, Homo sapiens
cacacactcttcctggcaccta

SEQ ID NO: 9351644 - DNA, 22 bp, Homo sapiens
cacacactgacaccttatcttg

SEQ ID NO: 9351645 - DNA, 22 bp, Homo sapiens
agcaggagtgtcccctggctgt

SEQ ID NO: 9351646 - DNA, 22 bp, Homo sapiens
agcaggagcatttccatgattc

SEQ ID NO: 9351647 - DNA, 22 bp, Homo sapiens
agcaggagcccttatcaccagg

SEQ ID NO: 9351648 - DNA, 22 bp, Homo sapiens
agcaggagtgtcccctggctgt

SEQ ID NO: 9351649 - DNA, 23 bp, Homo sapiens
agcaggctgcttctccacagctg

SEQ ID NO: 9351650 - DNA, 23 bp, Homo sapiens
agcaggctgcttctccacagctg

SEQ ID NO: 9351651 - DNA, 23 bp, Homo sapiens
agcaggctgcttctccacagctg

SEQ ID NO: 9351652 - DNA, 22 bp, Homo sapiens
agcaggctgccttccaaagcct

SEQ ID NO: 9351653 - DNA, 22 bp, Homo sapiens
agcagggctggggcacgagcca

SEQ ID NO: 9351654 - DNA, 22 bp, Homo sapiens
agcagggctgtgctccttccga

SEQ ID NO: 9351655 - DNA, 22 bp, Homo sapiens
agcaggggcagggttttgtgct

SEQ ID NO: 9351656 - DNA, 22 bp, Homo sapiens
agcaggggcagggttttgtgct

SEQ ID NO: 9351657 - DNA, 22 bp, Homo sapiens
agcagggggcatccttgccctt

SEQ ID NO: 9351658 - DNA, 22 bp, Homo sapiens
agcagggggagttagactagat

SEQ ID NO: 9351659 - DNA, 22 bp, Homo sapiens
agcagggggagttagactagat

SEQ ID NO: 9351660 - DNA, 22 bp, Homo sapiens
agcagggggccacagtcacagc

SEQ ID NO: 9351661 - DNA, 22 bp, Homo sapiens
agcagggggccacagtcacagc

SEQ ID NO: 9351662 - DNA, 22 bp, Homo sapiens
agcaggggtaacagaaggaaag

SEQ ID NO: 9351663 - DNA, 22 bp, Homo sapiens
agcaggggtctctgctaatgaa

SEQ ID NO: 9351664 - DNA, 22 bp, Homo sapiens
agcaggggtggaaggtagcttt

SEQ ID NO: 9351665 - DNA, 22 bp, Homo sapiens
agcaggggtggaaggtagcttt

SEQ ID NO: 9351666 - DNA, 22 bp, Homo sapiens
agcaggggtggaaggtagcttt

SEQ ID NO: 9351667 - DNA, 22 bp, Homo sapiens
agcagggtatgttagagctgta

SEQ ID NO: 9351668 - DNA, 22 bp, Homo sapiens
agcagggtcctgaggtgagtca

SEQ ID NO: 9351669 - DNA, 22 bp, Homo sapiens
agcagggtcctgaggtgagtca

SEQ ID NO: 9351670 - DNA, 22 bp, Homo sapiens
agcagggtgtggtggccctgga

SEQ ID NO: 9351671 - DNA, 22 bp, Homo sapiens
agcagggttccaggagttgcag

SEQ ID NO: 9351672 - DNA, 22 bp, Homo sapiens
agcagggttctcagttggtgct

SEQ ID NO: 9351673 - DNA, 22 bp, Homo sapiens
agcagggttctcagttggtgct

SEQ ID NO: 9351674 - DNA, 22 bp, Homo sapiens
agcagggtttggggattggcac

SEQ ID NO: 9351675 - DNA, 22 bp, Homo sapiens
cacccaggctggagtgcagtgg

SEQ ID NO: 9351676 - DNA, 22 bp, Homo sapiens
cacccaggctggagtgcagtga

SEQ ID NO: 9351677 - DNA, 22 bp, Homo sapiens
caccaggtggaaatgtcacagc

SEQ ID NO: 9351678 - DNA, 22 bp, Homo sapiens
caccaggtggaaatgtcacagc

SEQ ID NO: 9351679 - DNA, 20 bp, Homo sapiens
agcaggtaaggcacagcagt

SEQ ID NO: 9351680 - DNA, 22 bp, Homo sapiens
agcagggtttggggattggcac

SEQ ID NO: 9351681 - DNA, 22 bp, Homo sapiens
cacccaggctggagtgcagggg

SEQ ID NO: 9351682 - DNA, 22 bp, Homo sapiens
cactgctgatttcataggcagg

SEQ ID NO: 9351683 - DNA, 22 bp, Homo sapiens
cactgcttataaattctaggca

SEQ ID NO: 9351684 - DNA, 22 bp, Homo sapiens
cactgcttagttggtaaatgtg

SEQ ID NO: 9351685 - DNA, 22 bp, Homo sapiens
cactgctagtctgaagtactgg

SEQ ID NO: 9351686 - DNA, 22 bp, Homo sapiens
cactgctacctctgcctcccgg

SEQ ID NO: 9351687 - DNA, 23 bp, Homo sapiens
cactgccttcagttgcttcacct

SEQ ID NO: 9351688 - DNA, 20 bp, Homo sapiens
agcatacatcataagaaacc

SEQ ID NO: 9351689 - DNA, 22 bp, Homo sapiens
agcatacaggtctgaaacagct

SEQ ID NO: 9351690 - DNA, 22 bp, Homo sapiens
cactgcttgcagtatgagtgga

SEQ ID NO: 9351691 - DNA, 22 bp, Homo sapiens
cacctgagactcctcaccatga

SEQ ID NO: 9351692 - DNA, 22 bp, Homo sapiens
cactgcctgtgagctgtgtgcc

SEQ ID NO: 9351693 - DNA, 22 bp, Homo sapiens
cactgcctgtgagctgtgtgcc

SEQ ID NO: 9351694 - DNA, 22 bp, Homo sapiens
cacctctgctgtccacaggatg

SEQ ID NO: 9351695 - DNA, 22 bp, Homo sapiens
cacctagggcatccctgcccca

SEQ ID NO: 9351696 - DNA, 22 bp, Homo sapiens
cacccttcagctttcttagctc

SEQ ID NO: 9351697 - DNA, 22 bp, Homo sapiens
caccgtggaggagctggagggc

SEQ ID NO: 9351698 - DNA, 22 bp, Homo sapiens
cacccaggctggagtgcattgg

SEQ ID NO: 9351699 - DNA, 22 bp, Homo sapiens
cacccagggctgtgcctgccca

SEQ ID NO: 9351700 - DNA, 20 bp, Homo sapiens
cacaagagaatacacactgg

SEQ ID NO: 9351701 - DNA, 20 bp, Homo sapiens
cacaagagaatacacactgg

SEQ ID NO: 9351702 - DNA, 22 bp, Homo sapiens
agcagcagggtcattgctcttt

SEQ ID NO: 9351703 - DNA, 22 bp, Homo sapiens
agcagcagggtcattgctcttt

SEQ ID NO: 9351704 - DNA, 22 bp, Homo sapiens
agcagcagggtcattgctcttt

SEQ ID NO: 9351705 - DNA, 22 bp, Homo sapiens
agcagcagggtgatagtgccca

SEQ ID NO: 9351706 - DNA, 22 bp, Homo sapiens
agcagcagggtgatagtgccca

SEQ ID NO: 9351707 - DNA, 22 bp, Homo sapiens
agcagcagggtgatagtgccca

SEQ ID NO: 9351708 - DNA, 22 bp, Homo sapiens
agcagcagggtgatagtgccca

SEQ ID NO: 9351709 - DNA, 22 bp, Homo sapiens
caatttttgtacttatagtact

SEQ ID NO: 9351710 - DNA, 21 bp, Homo sapiens
agcagcagggaagcctcatcc

SEQ ID NO: 9351711 - DNA, 21 bp, Homo sapiens
agcagcagggaagcctcatcc

SEQ ID NO: 9351712 - DNA, 21 bp, Homo sapiens
agcagcagggaagcctcatcc

SEQ ID NO: 9351713 - DNA, 22 bp, Homo sapiens
agcagcaggcttaaggaaaagt

SEQ ID NO: 9351714 - DNA, 21 bp, Homo sapiens
agcagcagggaagcctcatcc

SEQ ID NO: 9351715 - DNA, 22 bp, Homo sapiens
agcagcaggcttaaggaaaagt

SEQ ID NO: 9351716 - DNA, 22 bp, Homo sapiens
agcagcagggacaaaggaacag

SEQ ID NO: 9351717 - DNA, 22 bp, Homo sapiens
agcagcagggacaaaggaacag

SEQ ID NO: 9351718 - DNA, 22 bp, Homo sapiens
agcagcagggacaaaggaacag

SEQ ID NO: 9351719 - DNA, 22 bp, Homo sapiens
agcagcagggacaaaggaacag

SEQ ID NO: 9351720 - DNA, 22 bp, Homo sapiens
agcagcagggcatgtcttactc

SEQ ID NO: 9351721 - DNA, 22 bp, Homo sapiens
agcagcagggcatgtcttactc

SEQ ID NO: 9351722 - DNA, 22 bp, Homo sapiens
agcagcagggcatgtcttactc

SEQ ID NO: 9351723 - DNA, 22 bp, Homo sapiens
agcagcagggcatgtcttactc

SEQ ID NO: 9351724 - DNA, 22 bp, Homo sapiens
agcagcagggctctgcccgtgc

SEQ ID NO: 9351725 - DNA, 22 bp, Homo sapiens
agcagcagggctctgcccgtgc

SEQ ID NO: 9351726 - DNA, 22 bp, Homo sapiens
agcagcagggctctgcccgtgc

SEQ ID NO: 9351727 - DNA, 22 bp, Homo sapiens
agcagcagggctctgcccgtgc

SEQ ID NO: 9351728 - DNA, 22 bp, Homo sapiens
agcagcagggtcattgctcttt

SEQ ID NO: 9351729 - DNA, 22 bp, Homo sapiens
cacaaggctgggacaagtgctg

SEQ ID NO: 9351730 - DNA, 22 bp, Homo sapiens
agcagccaaggtaacctgtgct

SEQ ID NO: 9351731 - DNA, 22 bp, Homo sapiens
agcagccaaggtaacctgtgct

SEQ ID NO: 9351732 - DNA, 22 bp, Homo sapiens
cacaagctccttatgtggagaa

SEQ ID NO: 9351733 - DNA, 22 bp, Homo sapiens
agcagctcctctaggaacggat

SEQ ID NO: 9351734 - DNA, 22 bp, Homo sapiens
agcagctgagccccagctgtga

SEQ ID NO: 9351735 - DNA, 22 bp, Homo sapiens
agcagccagaaatccagaggtg

SEQ ID NO: 9351736 - DNA, 22 bp, Homo sapiens
agcagccagaaatccagaggtg

SEQ ID NO: 9351737 - DNA, 22 bp, Homo sapiens
agcagccagaaatccagaggtg

SEQ ID NO: 9351738 - DNA, 22 bp, Homo sapiens
agcagccagaaagggcagtcga

SEQ ID NO: 9351739 - DNA, 22 bp, Homo sapiens
agcagccacagtctgggacagg

SEQ ID NO: 9351740 - DNA, 22 bp, Homo sapiens
agcagccacccagctgctcatt

SEQ ID NO: 9351741 - DNA, 22 bp, Homo sapiens
agcagccacccagctgctcatt

SEQ ID NO: 9351742 - DNA, 22 bp, Homo sapiens
agcagccacacgcctccttctc

SEQ ID NO: 9351743 - DNA, 22 bp, Homo sapiens
caagattttatctccgtttctg

SEQ ID NO: 9351744 - DNA, 22 bp, Homo sapiens
caagatttgtattgggcctctg

SEQ ID NO: 9351745 - DNA, 22 bp, Homo sapiens
caagatttggcaactttgtcat

SEQ ID NO: 9351746 - DNA, 22 bp, Homo sapiens
caagatttggcattctgaggag

SEQ ID NO: 9351747 - DNA, 22 bp, Homo sapiens
caagatttccaaccctgggtaa

SEQ ID NO: 9351748 - DNA, 22 bp, Homo sapiens
caagatttgacttcgtggtttg

SEQ ID NO: 9351749 - DNA, 22 bp, Homo sapiens
caagcagacagtaggcctagaa

SEQ ID NO: 9351750 - DNA, 22 bp, Homo sapiens
caagcagagaagtctctaggct

SEQ ID NO: 9351751 - DNA, 22 bp, Homo sapiens
caagcagaagcctcaggggcat

SEQ ID NO: 9351752 - DNA, 22 bp, Homo sapiens
caagcagaaatctagaactcca

SEQ ID NO: 9351753 - DNA, 22 bp, Homo sapiens
caagcagaagcctcaggggcat

SEQ ID NO: 9351754 - DNA, 22 bp, Homo sapiens
caagcaccatgtgctccatgtt

SEQ ID NO: 9351755 - DNA, 22 bp, Homo sapiens
caagagcacgtgccctccataa

SEQ ID NO: 9351756 - DNA, 22 bp, Homo sapiens
caagagatacatttctagtagg

SEQ ID NO: 9351757 - DNA, 22 bp, Homo sapiens
caagagcatccctgcatccagc

SEQ ID NO: 9351758 - DNA, 22 bp, Homo sapiens
caagagcatccctgcatccagc

SEQ ID NO: 9351759 - DNA, 22 bp, Homo sapiens
caagagcatccctgcatccagc

SEQ ID NO: 9351760 - DNA, 22 bp, Homo sapiens
caagagcctttgggcagaagga

SEQ ID NO: 9351761 - DNA, 22 bp, Homo sapiens
caagagctaccctgtgccatat

SEQ ID NO: 9351762 - DNA, 22 bp, Homo sapiens
caagatttagcctgctgcctgt

SEQ ID NO: 9351763 - DNA, 22 bp, Homo sapiens
caagagctagaaattggttaga

SEQ ID NO: 9351764 - DNA, 22 bp, Homo sapiens
agcagcaggaggctgtccacca

SEQ ID NO: 9351765 - DNA, 22 bp, Homo sapiens
agcagcaggaggctgtccacca

SEQ ID NO: 9351766 - DNA, 22 bp, Homo sapiens
agcagcaggaggccattgtctt

SEQ ID NO: 9351767 - DNA, 22 bp, Homo sapiens
agcagcaggaggctgtccacca

SEQ ID NO: 9351768 - DNA, 22 bp, Homo sapiens
agcagcaggaggccattgtctt

SEQ ID NO: 9351769 - DNA, 22 bp, Homo sapiens
agcagcaggagccgtggggtga

SEQ ID NO: 9351770 - DNA, 22 bp, Homo sapiens
agcagcaggagccgtggggtga

SEQ ID NO: 9351771 - DNA, 22 bp, Homo sapiens
agcagcaggagccgtggggtga

SEQ ID NO: 9351772 - DNA, 22 bp, Homo sapiens
caagcagagactagatagctgt

SEQ ID NO: 9351773 - DNA, 22 bp, Homo sapiens
caagcagagaagtctctaggct

SEQ ID NO: 9351774 - DNA, 20 bp, Homo sapiens
agcagcagatgttggaggtg

SEQ ID NO: 9351775 - DNA, 22 bp, Homo sapiens
agcagcagctctgttgccctac

SEQ ID NO: 9351776 - DNA, 22 bp, Homo sapiens
agcagcagctctgttgccctac

SEQ ID NO: 9351777 - DNA, 22 bp, Homo sapiens
agcagcagattatggtctacat

SEQ ID NO: 9351778 - DNA, 22 bp, Homo sapiens
agcagcagctctgttgccctac

SEQ ID NO: 9351779 - DNA, 22 bp, Homo sapiens
agcagcaggattttcgttggga

SEQ ID NO: 9351780 - DNA, 23 bp, Homo sapiens
agcagcaggaggtattgataagg

SEQ ID NO: 9351781 - DNA, 22 bp, Homo sapiens
agcagcaggattttcgttggga

SEQ ID NO: 9351782 - DNA, 22 bp, Homo sapiens
agcagcaggctagggaactgct

SEQ ID NO: 9351783 - DNA, 22 bp, Homo sapiens
agcagcaggctagggaactgct

SEQ ID NO: 9351784 - DNA, 22 bp, Homo sapiens
agcagcaggctagggaactgct

SEQ ID NO: 9351785 - DNA, 22 bp, Homo sapiens
agcagcaggctgtgtggactga

SEQ ID NO: 9351786 - DNA, 22 bp, Homo sapiens
agcagcaggcttaaggaaaagt

SEQ ID NO: 9351787 - DNA, 22 bp, Homo sapiens
agcagcaggctgtgtggactga

SEQ ID NO: 9351788 - DNA, 22 bp, Homo sapiens
agcagcaggctgggatgagtct

SEQ ID NO: 9351789 - DNA, 22 bp, Homo sapiens
agcagcaggctgggatgagtct

SEQ ID NO: 9351790 - DNA, 22 bp, Homo sapiens
agcagcaggctgggatgagtct

SEQ ID NO: 9351791 - DNA, 22 bp, Homo sapiens
agcagcaggctgtgtggactga

SEQ ID NO: 9351792 - DNA, 22 bp, Homo sapiens
agcagcaggctgggatgagtct

SEQ ID NO: 9351793 - DNA, 22 bp, Homo sapiens
agcacattcccacctgtacttc

SEQ ID NO: 9351794 - DNA, 22 bp, Homo sapiens
caacagctgatctttgatgaag

SEQ ID NO: 9351795 - DNA, 22 bp, Homo sapiens
caacagagagaccagaaacagg

SEQ ID NO: 9351796 - DNA, 22 bp, Homo sapiens
caacagagagaccagaaacagg

SEQ ID NO: 9351797 - DNA, 22 bp, Homo sapiens
caaatattccaggtacatccct

SEQ ID NO: 9351798 - DNA, 22 bp, Homo sapiens
caaatatctttggcaaagagaa

SEQ ID NO: 9351799 - DNA, 20 bp, Homo sapiens
caacactgcccattgtttgc

SEQ ID NO: 9351800 - DNA, 23 bp, Homo sapiens
caacactgccttcaggtgaagaa

SEQ ID NO: 9351801 - DNA, 22 bp, Homo sapiens
caacacttcttatacttactga

SEQ ID NO: 9351802 - DNA, 22 bp, Homo sapiens
caacagaaggaagcagggtcag

SEQ ID NO: 9351803 - DNA, 22 bp, Homo sapiens
agcaccagcaactatgggctgc

SEQ ID NO: 9351804 - DNA, 22 bp, Homo sapiens
agcacattctgccttgctttgc

SEQ ID NO: 9351805 - DNA, 22 bp, Homo sapiens
agcacattctgccttgctttgc

SEQ ID NO: 9351806 - DNA, 22 bp, Homo sapiens
caagagacttatgtggaaacct

SEQ ID NO: 9351807 - DNA, 22 bp, Homo sapiens
agcaccaggctgttggaagccc

SEQ ID NO: 9351808 - DNA, 22 bp, Homo sapiens
agcaccaggcagtatatcaaag

SEQ ID NO: 9351809 - DNA, 22 bp, Homo sapiens
caagacaatgggtaagtgtaac

SEQ ID NO: 9351810 - DNA, 22 bp, Homo sapiens
caacttgttcttggtagatcta

SEQ ID NO: 9351811 - DNA, 22 bp, Homo sapiens
agcacaggtgaaacagtcaggt

SEQ ID NO: 9351812 - DNA, 22 bp, Homo sapiens
agcacaggtgaaacagtcaggt

SEQ ID NO: 9351813 - DNA, 22 bp, Homo sapiens
agcacaggtgaaacagtcaggt

SEQ ID NO: 9351814 - DNA, 22 bp, Homo sapiens
agcacatgcacagtgctacact

SEQ ID NO: 9351815 - DNA, 22 bp, Homo sapiens
agcaaagacagggacgaccaag

SEQ ID NO: 9351816 - DNA, 22 bp, Homo sapiens
agcaaagcaccatatggcagtt

SEQ ID NO: 9351817 - DNA, 22 bp, Homo sapiens
agcaaagcagtggctaagctga

SEQ ID NO: 9351818 - DNA, 22 bp, Homo sapiens
agcacaggtacggagatgctac

SEQ ID NO: 9351819 - DNA, 22 bp, Homo sapiens
cagcagctcaggctgcttccca

SEQ ID NO: 9351820 - DNA, 22 bp, Homo sapiens
cagcagctcaggctgcttccca

SEQ ID NO: 9351821 - DNA, 22 bp, Homo sapiens
cagcagctcaggctgcttccca

SEQ ID NO: 9351822 - DNA, 22 bp, Homo sapiens
cagcagctcaggctccttccca

SEQ ID NO: 9351823 - DNA, 22 bp, Homo sapiens
cagcagctcaggctccttccca

SEQ ID NO: 9351824 - DNA, 22 bp, Homo sapiens
cagcagctcagtctctcagtag

SEQ ID NO: 9351825 - DNA, 22 bp, Homo sapiens
cagcagctcagtctctcagtag

SEQ ID NO: 9351826 - DNA, 22 bp, Homo sapiens
cagcagctcagtctctcagtag

SEQ ID NO: 9351827 - DNA, 22 bp, Homo sapiens
cagcagctcagtctctcagtag

SEQ ID NO: 9351828 - DNA, 22 bp, Homo sapiens
cagcagctcaggctgcttccca

SEQ ID NO: 9351829 - DNA, 22 bp, Homo sapiens
cagcagctgactccaagagagc

SEQ ID NO: 9351830 - DNA, 22 bp, Homo sapiens
cagcagctccaaagaatagcca

SEQ ID NO: 9351831 - DNA, 22 bp, Homo sapiens
cagcagctccaaagaatagcca

SEQ ID NO: 9351832 - DNA, 22 bp, Homo sapiens
agcctgagagccaagctgtgca

SEQ ID NO: 9351833 - DNA, 23 bp, Homo sapiens
agcctcttgtggatggtcagcga

SEQ ID NO: 9351834 - DNA, 21 bp, Homo sapiens
agcctgaatcccaccagttca

SEQ ID NO: 9351835 - DNA, 22 bp, Homo sapiens
agcctctttttcaaggtccaca

SEQ ID NO: 9351836 - DNA, 20 bp, Homo sapiens
cagcagccaaacttctattc

SEQ ID NO: 9351837 - DNA, 22 bp, Homo sapiens
cagcagcattgctctggattcc

SEQ ID NO: 9351838 - DNA, 22 bp, Homo sapiens
cagcagctcactcaggtggctc

SEQ ID NO: 9351839 - DNA, 22 bp, Homo sapiens
cagcagctcactcaggtggctc

SEQ ID NO: 9351840 - DNA, 22 bp, Homo sapiens
agcctggcactgaggcagggcg

SEQ ID NO: 9351841 - DNA, 22 bp, Homo sapiens
cagcaggatatggtggagagag

SEQ ID NO: 9351842 - DNA, 22 bp, Homo sapiens
agcctggcactgccccatccat

SEQ ID NO: 9351843 - DNA, 22 bp, Homo sapiens
cagcagggcccccgggtgcgcc

SEQ ID NO: 9351844 - DNA, 22 bp, Homo sapiens
cagcagggcccccgggtgcgcc

SEQ ID NO: 9351845 - DNA, 22 bp, Homo sapiens
cagcagggcccccgggtgcgcc

SEQ ID NO: 9351846 - DNA, 22 bp, Homo sapiens
cagcagggcccccgggtgcgcc

SEQ ID NO: 9351847 - DNA, 22 bp, Homo sapiens
cagcaggggaactgtgggccag

SEQ ID NO: 9351848 - DNA, 22 bp, Homo sapiens
cagcaggggaactgtgggccag

SEQ ID NO: 9351849 - DNA, 22 bp, Homo sapiens
cagcagggcccccgggtgcgcc

SEQ ID NO: 9351850 - DNA, 22 bp, Homo sapiens
cagcagggctgtgctaccccat

SEQ ID NO: 9351851 - DNA, 22 bp, Homo sapiens
agcctggcactgaggcagggcg

SEQ ID NO: 9351852 - DNA, 22 bp, Homo sapiens
agcctggattcgtgcatccaca

SEQ ID NO: 9351853 - DNA, 22 bp, Homo sapiens
agcctggattcgtgcatccaca

SEQ ID NO: 9351854 - DNA, 22 bp, Homo sapiens
agcctggattcgtgcatccaca

SEQ ID NO: 9351855 - DNA, 22 bp, Homo sapiens
agcctggattcgtgcatccaca

SEQ ID NO: 9351856 - DNA, 22 bp, Homo sapiens
agcctggatcctaggctcagct

SEQ ID NO: 9351857 - DNA, 22 bp, Homo sapiens
agcctggatcctaggctcagct

SEQ ID NO: 9351858 - DNA, 22 bp, Homo sapiens
agcctggatcctaggctcagct

SEQ ID NO: 9351859 - DNA, 22 bp, Homo sapiens
cagcagctgaggcgctggcgtg

SEQ ID NO: 9351860 - DNA, 22 bp, Homo sapiens
agcctggagttcccaggagaag

SEQ ID NO: 9351861 - DNA, 22 bp, Homo sapiens
agcctggaggtaatgaggaaac

SEQ ID NO: 9351862 - DNA, 22 bp, Homo sapiens
agcctggatccatgtggctacc

SEQ ID NO: 9351863 - DNA, 22 bp, Homo sapiens
agcctggagttcccaggagaag

SEQ ID NO: 9351864 - DNA, 22 bp, Homo sapiens
agcctggagttcccaggagaag

SEQ ID NO: 9351865 - DNA, 22 bp, Homo sapiens
agcctctgcttatgcaaaggta

SEQ ID NO: 9351866 - DNA, 18 bp, Homo sapiens
agcctctggcagagagaa

SEQ ID NO: 9351867 - DNA, 18 bp, Homo sapiens
agcctctggcagagagaa

SEQ ID NO: 9351868 - DNA, 22 bp, Homo sapiens
agcctctgctggccctggcact

SEQ ID NO: 9351869 - DNA, 22 bp, Homo sapiens
agcctctgcacttcttacaggt

SEQ ID NO: 9351870 - DNA, 22 bp, Homo sapiens
agcctctgggggagctgggagc

SEQ ID NO: 9351871 - DNA, 22 bp, Homo sapiens
agcctctgggggagctgggagc

SEQ ID NO: 9351872 - DNA, 22 bp, Homo sapiens
agcctctggtcctccctcagct

SEQ ID NO: 9351873 - DNA, 22 bp, Homo sapiens
agcctctgtgactcacaggtca

SEQ ID NO: 9351874 - DNA, 22 bp, Homo sapiens
agcctctgtcaagcttttcaaa

SEQ ID NO: 9351875 - DNA, 22 bp, Homo sapiens
agcctctgtagaaagcagtgtg

SEQ ID NO: 9351876 - DNA, 22 bp, Homo sapiens
agcctctgtagaaagcagtgtg

SEQ ID NO: 9351877 - DNA, 22 bp, Homo sapiens
cagaggtgcatacaggtcatta

SEQ ID NO: 9351878 - DNA, 22 bp, Homo sapiens
cagaggtgcatacaggtcatta

SEQ ID NO: 9351879 - DNA, 22 bp, Homo sapiens
agcctcctggagtttctgggat

SEQ ID NO: 9351880 - DNA, 22 bp, Homo sapiens
agcctcctggagtttctgggat

SEQ ID NO: 9351881 - DNA, 22 bp, Homo sapiens
cagaggtccctgttcttaagga

SEQ ID NO: 9351882 - DNA, 22 bp, Homo sapiens
cagaggtccctgttcttaagga

SEQ ID NO: 9351883 - DNA, 22 bp, Homo sapiens
cagaggtccctatttctttgtt

SEQ ID NO: 9351884 - DNA, 22 bp, Homo sapiens
cagaggtccctatttctttgtt

SEQ ID NO: 9351885 - DNA, 21 bp, Homo sapiens
cagaggtcatcctgaggacaa

SEQ ID NO: 9351886 - DNA, 22 bp, Homo sapiens
cagaggtccagcatacatttcc

SEQ ID NO: 9351887 - DNA, 19 bp, Homo sapiens
cagaggtgatatatgccca

SEQ ID NO: 9351888 - DNA, 22 bp, Homo sapiens
cagaggtctgatgcgtccctgc

SEQ ID NO: 9351889 - DNA, 22 bp, Homo sapiens
cagaggtctgacactgaatggt

SEQ ID NO: 9351890 - DNA, 22 bp, Homo sapiens
cagaggtctgacactgaatggt

SEQ ID NO: 9351891 - DNA, 22 bp, Homo sapiens
cagaggtctgacactgaatggt

SEQ ID NO: 9351892 - DNA, 22 bp, Homo sapiens
cagaggtctccatcaccctcct

SEQ ID NO: 9351893 - DNA, 22 bp, Homo sapiens
cagaggtctccatcaccctcct

SEQ ID NO: 9351894 - DNA, 22 bp, Homo sapiens
cagagggcactcggagtgacat

SEQ ID NO: 9351895 - DNA, 22 bp, Homo sapiens
cagagggccatctctatcttca

SEQ ID NO: 9351896 - DNA, 22 bp, Homo sapiens
cagaggtcaggttggacattat

SEQ ID NO: 9351897 - DNA, 22 bp, Homo sapiens
cagaggtcaggacttcattata

SEQ ID NO: 9351898 - DNA, 22 bp, Homo sapiens
cagaggtcaagatctgaagtga

SEQ ID NO: 9351899 - DNA, 22 bp, Homo sapiens
cagaggtcaagatctgaagtga

SEQ ID NO: 9351900 - DNA, 22 bp, Homo sapiens
cagccctgcacgctgcctccgc

SEQ ID NO: 9351901 - DNA, 22 bp, Homo sapiens
cagccctgcacgctgcctccgc

SEQ ID NO: 9351902 - DNA, 22 bp, Homo sapiens
cagccctgcagagggcgctcct

SEQ ID NO: 9351903 - DNA, 22 bp, Homo sapiens
cagccctgcagagggcgctcct

SEQ ID NO: 9351904 - DNA, 22 bp, Homo sapiens
agctcagagataatcaagagac

SEQ ID NO: 9351905 - DNA, 22 bp, Homo sapiens
agctcagagaatagggcttgag

SEQ ID NO: 9351906 - DNA, 22 bp, Homo sapiens
cagccctgcacgctgcctccgc

SEQ ID NO: 9351907 - DNA, 22 bp, Homo sapiens
cagccctgagaaggaggatctc

SEQ ID NO: 9351908 - DNA, 22 bp, Homo sapiens
cagccctgagaaggaggatctc

SEQ ID NO: 9351909 - DNA, 22 bp, Homo sapiens
cagcatcaacattctcagctct

SEQ ID NO: 9351910 - DNA, 22 bp, Homo sapiens
cagcagtttcctatggttcagc

SEQ ID NO: 9351911 - DNA, 22 bp, Homo sapiens
cagcataaaataaatctacatg

SEQ ID NO: 9351912 - DNA, 22 bp, Homo sapiens
cagcataaaataaatctacatg

SEQ ID NO: 9351913 - DNA, 22 bp, Homo sapiens
cagcaggggaactgtgggccag

SEQ ID NO: 9351914 - DNA, 22 bp, Homo sapiens
cagcaggggtgtcattgtagtt

SEQ ID NO: 9351915 - DNA, 22 bp, Homo sapiens
cagcagggtatacagggaattt

SEQ ID NO: 9351916 - DNA, 22 bp, Homo sapiens
cagcagggtatacagggaattt

SEQ ID NO: 9351917 - DNA, 22 bp, Homo sapiens
cagcagggtatacagggaattt

SEQ ID NO: 9351918 - DNA, 22 bp, Homo sapiens
cagcagggttaagtgactcacc

SEQ ID NO: 9351919 - DNA, 22 bp, Homo sapiens
cagcagtgtctccagcatcaca

SEQ ID NO: 9351920 - DNA, 22 bp, Homo sapiens
agctcctgaaaatccagactgg

SEQ ID NO: 9351921 - DNA, 22 bp, Homo sapiens
cagctccaaagccccactgtcc

SEQ ID NO: 9351922 - DNA, 22 bp, Homo sapiens
agctcctgaaaatccagactgg

SEQ ID NO: 9351923 - DNA, 22 bp, Homo sapiens
cagctcagtttcaataccaggt

SEQ ID NO: 9351924 - DNA, 22 bp, Homo sapiens
cagctcagtttcaataccaggt

SEQ ID NO: 9351925 - DNA, 19 bp, Homo sapiens
cagctcagtttgattctct

SEQ ID NO: 9351926 - DNA, 19 bp, Homo sapiens
cagctcagtttgattctct

SEQ ID NO: 9351927 - DNA, 22 bp, Homo sapiens
cagctcagtgatgccttcacag

SEQ ID NO: 9351928 - DNA, 22 bp, Homo sapiens
cagctcagtgatgccttcacag

SEQ ID NO: 9351929 - DNA, 22 bp, Homo sapiens
cagctcagtcttgaagcactgg

SEQ ID NO: 9351930 - DNA, 22 bp, Homo sapiens
cagctcagtcttgaagcactgg

SEQ ID NO: 9351931 - DNA, 22 bp, Homo sapiens
cagctcagtcttgaagcactgg

SEQ ID NO: 9351932 - DNA, 22 bp, Homo sapiens
agctcctgatacatgcaggaat

SEQ ID NO: 9351933 - DNA, 22 bp, Homo sapiens
agctcctgatacatgcaggaat

SEQ ID NO: 9351934 - DNA, 22 bp, Homo sapiens
agctcctgattctcagagatag

SEQ ID NO: 9351935 - DNA, 20 bp, Homo sapiens
cagctctgggcaggtcgagg

SEQ ID NO: 9351936 - DNA, 22 bp, Homo sapiens
cagctctgacacagtacaaaat

SEQ ID NO: 9351937 - DNA, 22 bp, Homo sapiens
cagctctgagactgaggctatg

SEQ ID NO: 9351938 - DNA, 23 bp, Homo sapiens
agctcctgaggccagcctctcct

SEQ ID NO: 9351939 - DNA, 20 bp, Homo sapiens
agctcctgagggttactttc

SEQ ID NO: 9351940 - DNA, 22 bp, Homo sapiens
agctcagcactgtcagcactcc

SEQ ID NO: 9351941 - DNA, 22 bp, Homo sapiens
agctcagcactgtcagcactcc

SEQ ID NO: 9351942 - DNA, 22 bp, Homo sapiens
agctcagagggaggtgaagtgg

SEQ ID NO: 9351943 - DNA, 21 bp, Homo sapiens
agctcagcaagatggaggctc

SEQ ID NO: 9351944 - DNA, 22 bp, Homo sapiens
agctcagagctcgggaggatgg

SEQ ID NO: 9351945 - DNA, 22 bp, Homo sapiens
agctcagagggaggtgaagtgg

SEQ ID NO: 9351946 - DNA, 22 bp, Homo sapiens
agctcagagctcgggaggatgg

SEQ ID NO: 9351947 - DNA, 22 bp, Homo sapiens
agctcagagctcgggaggatgg

SEQ ID NO: 9351948 - DNA, 22 bp, Homo sapiens
agctcagagataatcaagagac

SEQ ID NO: 9351949 - DNA, 22 bp, Homo sapiens
agctcaggcaactctgggcccc

SEQ ID NO: 9351950 - DNA, 22 bp, Homo sapiens
agctcagcttcctctccatgct

SEQ ID NO: 9351951 - DNA, 22 bp, Homo sapiens
agctcagcttcctctccatgct

SEQ ID NO: 9351952 - DNA, 22 bp, Homo sapiens
agctcagcttcctctccatgct

SEQ ID NO: 9351953 - DNA, 21 bp, Homo sapiens
agctcagccgggcacagtggc

SEQ ID NO: 9351954 - DNA, 21 bp, Homo sapiens
agctcagccgggcacagtggc

SEQ ID NO: 9351955 - DNA, 22 bp, Homo sapiens
agctcagcgggcttctggtaag

SEQ ID NO: 9351956 - DNA, 22 bp, Homo sapiens
agctcagccctcctgtgcagct

SEQ ID NO: 9351957 - DNA, 22 bp, Homo sapiens
agctcagcccgttagtaagccc

SEQ ID NO: 9351958 - DNA, 22 bp, Homo sapiens
agctcagccctcctgtgcagct

SEQ ID NO: 9351959 - DNA, 22 bp, Homo sapiens
cagctcagtctggagagatgca

SEQ ID NO: 9351960 - DNA, 22 bp, Homo sapiens
cagctcaggctctccatgctcc

SEQ ID NO: 9351961 - DNA, 22 bp, Homo sapiens
cagctcaggctctccatgctcc

SEQ ID NO: 9351962 - DNA, 19 bp, Homo sapiens
cagctcaggactcagcccc

SEQ ID NO: 9351963 - DNA, 22 bp, Homo sapiens
cagctcaggcactggcgcggga

SEQ ID NO: 9351964 - DNA, 22 bp, Homo sapiens
cagctcaggcactggcgcggga

SEQ ID NO: 9351965 - DNA, 22 bp, Homo sapiens
cagctcaggaaggaaggccggc

SEQ ID NO: 9351966 - DNA, 19 bp, Homo sapiens
cagctcaggactcagcccc

SEQ ID NO: 9351967 - DNA, 19 bp, Homo sapiens
cagctcaggactcagcccc

SEQ ID NO: 9351968 - DNA, 22 bp, Homo sapiens
agctcaggcaactctgggcccc

SEQ ID NO: 9351969 - DNA, 22 bp, Homo sapiens
cagcgtgggatttggaaaccag

SEQ ID NO: 9351970 - DNA, 22 bp, Homo sapiens
cagctaagaatgtctgagatca

SEQ ID NO: 9351971 - DNA, 22 bp, Homo sapiens
agcccagagccccggccatgtt

SEQ ID NO: 9351972 - DNA, 22 bp, Homo sapiens
agcccagagggtagcagaagaa

SEQ ID NO: 9351973 - DNA, 22 bp, Homo sapiens
agcccagagggtagcagaagaa

SEQ ID NO: 9351974 - DNA, 22 bp, Homo sapiens
agcccagatggtagccctagaa

SEQ ID NO: 9351975 - DNA, 22 bp, Homo sapiens
agcccagcccgggctgcgcttt

SEQ ID NO: 9351976 - DNA, 22 bp, Homo sapiens
agcccagcccgggctgcgcttt

SEQ ID NO: 9351977 - DNA, 22 bp, Homo sapiens
agcccagcactgggggcccagc

SEQ ID NO: 9351978 - DNA, 22 bp, Homo sapiens
agcccagcagaaagtccagcct

SEQ ID NO: 9351979 - DNA, 22 bp, Homo sapiens
agcccagcactgggggcccagc

SEQ ID NO: 9351980 - DNA, 22 bp, Homo sapiens
cagagaaagaagcccattcatt

SEQ ID NO: 9351981 - DNA, 22 bp, Homo sapiens
cagagaaagggtgaattccttc

SEQ ID NO: 9351982 - DNA, 22 bp, Homo sapiens
agcccaagctatgaggtgacct

SEQ ID NO: 9351983 - DNA, 22 bp, Homo sapiens
agcccaagcctggctggcgatg

SEQ ID NO: 9351984 - DNA, 22 bp, Homo sapiens
agcccaagcataggagggaggc

SEQ ID NO: 9351985 - DNA, 22 bp, Homo sapiens
agcccaagaagagctttcttgc

SEQ ID NO: 9351986 - DNA, 22 bp, Homo sapiens
cagacttttgacattaatacag

SEQ ID NO: 9351987 - DNA, 21 bp, Homo sapiens
cagaggcaggtcctgggacgg

SEQ ID NO: 9351988 - DNA, 21 bp, Homo sapiens
cagaggcaggctctgtgtgtg

SEQ ID NO: 9351989 - DNA, 22 bp, Homo sapiens
cagaggagttcagtacacagcc

SEQ ID NO: 9351990 - DNA, 22 bp, Homo sapiens
cagaggagttcagtacacagcc

SEQ ID NO: 9351991 - DNA, 22 bp, Homo sapiens
agcccagccggattcccagttc

SEQ ID NO: 9351992 - DNA, 21 bp, Homo sapiens
cagaggcaggtcctgggacgg

SEQ ID NO: 9351993 - DNA, 21 bp, Homo sapiens
cagaggcaggtcctgggacgg

SEQ ID NO: 9351994 - DNA, 21 bp, Homo sapiens
cagaggcaggtcctgggacgg

SEQ ID NO: 9351995 - DNA, 21 bp, Homo sapiens
cagaggcaggtcctgggacgg

SEQ ID NO: 9351996 - DNA, 22 bp, Homo sapiens
cagaggcagtggggttgctcct

SEQ ID NO: 9351997 - DNA, 22 bp, Homo sapiens
cagaggcattactgaaaaggtg

SEQ ID NO: 9351998 - DNA, 22 bp, Homo sapiens
agcccaggcagagggatgcttg

SEQ ID NO: 9351999 - DNA, 22 bp, Homo sapiens
cagaggcattactgaaaaggtg

SEQ ID NO: 9352000 - DNA, 22 bp, Homo sapiens
cagaggcattactgaaaaggtg

SEQ ID NO: 9352001 - DNA, 22 bp, Homo sapiens
agcccaggcagagggatgcttg

SEQ ID NO: 9352002 - DNA, 22 bp, Homo sapiens
agcccaggcagagggatgcttg

SEQ ID NO: 9352003 - DNA, 23 bp, Homo sapiens
cagaggcatcggattcaacatca

SEQ ID NO: 9352004 - DNA, 22 bp, Homo sapiens
cagaggcatataattgctgggg

SEQ ID NO: 9352005 - DNA, 23 bp, Homo sapiens
cagaggcatcggattcaacatca

SEQ ID NO: 9352006 - DNA, 22 bp, Homo sapiens
cagaggcatataattgctgggg

SEQ ID NO: 9352007 - DNA, 22 bp, Homo sapiens
cagaggcatataattgctgggg

SEQ ID NO: 9352008 - DNA, 22 bp, Homo sapiens
cagaggcatactcccagtcttg

SEQ ID NO: 9352009 - DNA, 22 bp, Homo sapiens
cagagggaccagaacatactgt

SEQ ID NO: 9352010 - DNA, 22 bp, Homo sapiens
cagagggagccctccaggagca

SEQ ID NO: 9352011 - DNA, 22 bp, Homo sapiens
agcccagggaaccaggaagtgg

SEQ ID NO: 9352012 - DNA, 22 bp, Homo sapiens
cagaggctgacaaaatattgct

SEQ ID NO: 9352013 - DNA, 22 bp, Homo sapiens
cagagggaaaaggggagtaata

SEQ ID NO: 9352014 - DNA, 22 bp, Homo sapiens
cagagggacagtatgatgaaag

SEQ ID NO: 9352015 - DNA, 22 bp, Homo sapiens
agcccaggctggagtgcagtgg

SEQ ID NO: 9352016 - DNA, 20 bp, Homo sapiens
agcccaggcctgtgtgagtc

SEQ ID NO: 9352017 - DNA, 18 bp, Homo sapiens
agcccaggcatcgtctgc

SEQ ID NO: 9352018 - DNA, 18 bp, Homo sapiens
agcccaggcatcgtctgc

SEQ ID NO: 9352019 - DNA, 22 bp, Homo sapiens
agcccagggaaccaggaagtgg

SEQ ID NO: 9352020 - DNA, 22 bp, Homo sapiens
agcccagggaaccaggaagtgg

SEQ ID NO: 9352021 - DNA, 22 bp, Homo sapiens
agcccagggaaccaggaagtgg

SEQ ID NO: 9352022 - DNA, 22 bp, Homo sapiens
agcccaggctggagtgcagtgg

SEQ ID NO: 9352023 - DNA, 22 bp, Homo sapiens
agcccaggctggagtgcagtgg

SEQ ID NO: 9352024 - DNA, 22 bp, Homo sapiens
agcccaggctggagtgcagtgg

SEQ ID NO: 9352025 - DNA, 22 bp, Homo sapiens
cagaatgggaaggactgcagtt

SEQ ID NO: 9352026 - DNA, 22 bp, Homo sapiens
agccactgtgagaggaccaggg

SEQ ID NO: 9352027 - DNA, 22 bp, Homo sapiens
agccactgtgagaggaccaggg

SEQ ID NO: 9352028 - DNA, 22 bp, Homo sapiens
agccactgtgtgaccagctgtc

SEQ ID NO: 9352029 - DNA, 22 bp, Homo sapiens
agccactgtgtgaccagctgtc

SEQ ID NO: 9352030 - DNA, 22 bp, Homo sapiens
agccagaacgcatcgccaaggc

SEQ ID NO: 9352031 - DNA, 22 bp, Homo sapiens
agccagaacgcatcgccaaggc

SEQ ID NO: 9352032 - DNA, 22 bp, Homo sapiens
agccactttactttcatatttt

SEQ ID NO: 9352033 - DNA, 22 bp, Homo sapiens
agccagaaaaacaccaagagga

SEQ ID NO: 9352034 - DNA, 22 bp, Homo sapiens
cagaatatgactcgggcactac

SEQ ID NO: 9352035 - DNA, 22 bp, Homo sapiens
cagaatatgaccctaggccttt

SEQ ID NO: 9352036 - DNA, 22 bp, Homo sapiens
cagaatgaaatgtaagaacacc

SEQ ID NO: 9352037 - DNA, 22 bp, Homo sapiens
cagaatgagataacccagattg

SEQ ID NO: 9352038 - DNA, 22 bp, Homo sapiens
cagaatgagtagcatcttcacc

SEQ ID NO: 9352039 - DNA, 22 bp, Homo sapiens
agccagagaacagcaggaaatg

SEQ ID NO: 9352040 - DNA, 22 bp, Homo sapiens
agccagagaacagcaggaaatg

SEQ ID NO: 9352041 - DNA, 22 bp, Homo sapiens
cagacaggaagttcagaagaaa

SEQ ID NO: 9352042 - DNA, 22 bp, Homo sapiens
cagacagggtgggtttctgggc

SEQ ID NO: 9352043 - DNA, 22 bp, Homo sapiens
cagacagggttttggtctttgg

SEQ ID NO: 9352044 - DNA, 22 bp, Homo sapiens
agccagagagtgttggagatgt

SEQ ID NO: 9352045 - DNA, 22 bp, Homo sapiens
agccagagagccccaggttcta

SEQ ID NO: 9352046 - DNA, 22 bp, Homo sapiens
cagacaggttgcaaaacttcaa

SEQ ID NO: 9352047 - DNA, 22 bp, Homo sapiens
cagacaggtagggacagaacat

SEQ ID NO: 9352048 - DNA, 22 bp, Homo sapiens
cagacagtggacttgataaagg

SEQ ID NO: 9352049 - DNA, 22 bp, Homo sapiens
cagacatccaggtacgagcttt

SEQ ID NO: 9352050 - DNA, 22 bp, Homo sapiens
cagacatatgttttaacagatt

SEQ ID NO: 9352051 - DNA, 22 bp, Homo sapiens
agccactggtaaactggtagga

SEQ ID NO: 9352052 - DNA, 22 bp, Homo sapiens
cagaaatatatatgggtcagag

SEQ ID NO: 9352053 - DNA, 22 bp, Homo sapiens
cagaaatatcacctggactcta

SEQ ID NO: 9352054 - DNA, 22 bp, Homo sapiens
cagaaatatcagttgaaagtgc

SEQ ID NO: 9352055 - DNA, 22 bp, Homo sapiens
cagaaatatcagttgaaagtgc

SEQ ID NO: 9352056 - DNA, 22 bp, Homo sapiens
cagaaatatgtgccatgcctta

SEQ ID NO: 9352057 - DNA, 22 bp, Homo sapiens
cagaaatattccaagtactgca

SEQ ID NO: 9352058 - DNA, 22 bp, Homo sapiens
cagaaatatttattgagtgaca

SEQ ID NO: 9352059 - DNA, 18 bp, Homo sapiens
cagaaatcacaccagcac

SEQ ID NO: 9352060 - DNA, 22 bp, Homo sapiens
cagaaggagcgctaaggtccca

SEQ ID NO: 9352061 - DNA, 22 bp, Homo sapiens
cagaaggagggggcaagccctg

SEQ ID NO: 9352062 - DNA, 22 bp, Homo sapiens
agccacctctatcttgggctcc

SEQ ID NO: 9352063 - DNA, 22 bp, Homo sapiens
agccacctcacctgctgccgtt

SEQ ID NO: 9352064 - DNA, 22 bp, Homo sapiens
agccactccttcagcgtctgct

SEQ ID NO: 9352065 - DNA, 22 bp, Homo sapiens
agccacctctgtgcaggcctcg

SEQ ID NO: 9352066 - DNA, 22 bp, Homo sapiens
agccacctctgtgcaggcctcg

SEQ ID NO: 9352067 - DNA, 22 bp, Homo sapiens
agccaccaccactgaaaggtta

SEQ ID NO: 9352068 - DNA, 22 bp, Homo sapiens
agccacatttttctgctcctga

SEQ ID NO: 9352069 - DNA, 22 bp, Homo sapiens
agccacagtgggctaccagctc

SEQ ID NO: 9352070 - DNA, 22 bp, Homo sapiens
agcatataaatggacatatttg

SEQ ID NO: 9352071 - DNA, 23 bp, Homo sapiens
agcatagttgtggggccttttga

SEQ ID NO: 9352072 - DNA, 22 bp, Homo sapiens
agcatagtatgataagtgacaa

SEQ ID NO: 9352073 - DNA, 22 bp, Homo sapiens
agccacaggaaacagagacagc

SEQ ID NO: 9352074 - DNA, 22 bp, Homo sapiens
agccacaggaaacagagacagc

SEQ ID NO: 9352075 - DNA, 22 bp, Homo sapiens
agcatatagctatctttgattg

SEQ ID NO: 9352076 - DNA, 22 bp, Homo sapiens
agccacagtgcaagagagaaaa

SEQ ID NO: 9352077 - DNA, 22 bp, Homo sapiens
agccacagtctgtagccagctt

SEQ ID NO: 9352078 - DNA, 22 bp, Homo sapiens
agccacagtctgtagccagctt

SEQ ID NO: 9352079 - DNA, 22 bp, Homo sapiens
agggggaggctgtgctgcgtct

SEQ ID NO: 9352080 - DNA, 22 bp, Homo sapiens
agggggaggctgtgctgcgtct

SEQ ID NO: 9352081 - DNA, 22 bp, Homo sapiens
aggggcctggcactgagctggc

SEQ ID NO: 9352082 - DNA, 22 bp, Homo sapiens
acccaggctggcgtgcagtggc

SEQ ID NO: 9352083 - DNA, 22 bp, Homo sapiens
agggggcatcaggtcctggctc

SEQ ID NO: 9352084 - DNA, 22 bp, Homo sapiens
agggggcaggagagacctgctg

SEQ ID NO: 9352085 - DNA, 22 bp, Homo sapiens
accctccacaccagtcttattt

SEQ ID NO: 9352086 - DNA, 20 bp, Homo sapiens
accctccactgttcactgtg

SEQ ID NO: 9352087 - DNA, 22 bp, Homo sapiens
accctccactttatctgtcttt

SEQ ID NO: 9352088 - DNA, 22 bp, Homo sapiens
accctcagtaatcgtgcagttt

SEQ ID NO: 9352089 - DNA, 22 bp, Homo sapiens
agggctgcctgctctgcattga

SEQ ID NO: 9352090 - DNA, 22 bp, Homo sapiens
agggctgctaccttaatcagtt

SEQ ID NO: 9352091 - DNA, 22 bp, Homo sapiens
agggctgctatgttgattcaga

SEQ ID NO: 9352092 - DNA, 22 bp, Homo sapiens
agggctgcctgactccagagcc

SEQ ID NO: 9352093 - DNA, 22 bp, Homo sapiens
agggctgcctgactccagagcc

SEQ ID NO: 9352094 - DNA, 22 bp, Homo sapiens
agggctgcctgactccagagcc

SEQ ID NO: 9352095 - DNA, 22 bp, Homo sapiens
agggctgcctgactccagagcc

SEQ ID NO: 9352096 - DNA, 22 bp, Homo sapiens
agggctgccccagtccagccgg

SEQ ID NO: 9352097 - DNA, 22 bp, Homo sapiens
agggctgccccagtccagccgg

SEQ ID NO: 9352098 - DNA, 19 bp, Homo sapiens
agggctgctctggcctggg

SEQ ID NO: 9352099 - DNA, 22 bp, Homo sapiens
agggctgctcctccttcaggcc

SEQ ID NO: 9352100 - DNA, 22 bp, Homo sapiens
agggctgctgaggaagccttgc

SEQ ID NO: 9352101 - DNA, 22 bp, Homo sapiens
acccaggctggagtgcagtgac

SEQ ID NO: 9352102 - DNA, 22 bp, Homo sapiens
acccaggctggagtgcagtgat

SEQ ID NO: 9352103 - DNA, 22 bp, Homo sapiens
acccaggctggcgtgcagtggc

SEQ ID NO: 9352104 - DNA, 22 bp, Homo sapiens
acccaggctggcagaggctcct

SEQ ID NO: 9352105 - DNA, 22 bp, Homo sapiens
acccaggctggagtgcagtgtc

SEQ ID NO: 9352106 - DNA, 22 bp, Homo sapiens
acccaggctggagtgcagtgtc

SEQ ID NO: 9352107 - DNA, 22 bp, Homo sapiens
acccaggctggagtgcagtggt

SEQ ID NO: 9352108 - DNA, 22 bp, Homo sapiens
acccaggctggagtgcagtggt

SEQ ID NO: 9352109 - DNA, 22 bp, Homo sapiens
acccaggctggagtgcagtggc

SEQ ID NO: 9352110 - DNA, 22 bp, Homo sapiens
acccaggctggagtgcagtggc

SEQ ID NO: 9352111 - DNA, 22 bp, Homo sapiens
acccaggctggagtgcagtgat

SEQ ID NO: 9352112 - DNA, 22 bp, Homo sapiens
acccaggctggagtgcagtggg

SEQ ID NO: 9352113 - DNA, 22 bp, Homo sapiens
acccaggctggagtgcagtggg

SEQ ID NO: 9352114 - DNA, 22 bp, Homo sapiens
accaggcctggctgggcagcca

SEQ ID NO: 9352115 - DNA, 22 bp, Homo sapiens
accaggcctggctgggcagcca

SEQ ID NO: 9352116 - DNA, 22 bp, Homo sapiens
accaggctccccttggatcctg

SEQ ID NO: 9352117 - DNA, 22 bp, Homo sapiens
accaggcctggctgggcagcca

SEQ ID NO: 9352118 - DNA, 22 bp, Homo sapiens
accaggctccccttggatcctg

SEQ ID NO: 9352119 - DNA, 22 bp, Homo sapiens
accaggctctgccagtgtttac

SEQ ID NO: 9352120 - DNA, 22 bp, Homo sapiens
accaggctctgccagtgtttac

SEQ ID NO: 9352121 - DNA, 22 bp, Homo sapiens
accaggctggagtgcagtggcg

SEQ ID NO: 9352122 - DNA, 22 bp, Homo sapiens
accaggctgtgaagtgagacta

SEQ ID NO: 9352123 - DNA, 22 bp, Homo sapiens
accaggctggagtgcagtggcg

SEQ ID NO: 9352124 - DNA, 22 bp, Homo sapiens
accaggctgtgaagtgagacta

SEQ ID NO: 9352125 - DNA, 22 bp, Homo sapiens
acccagataaatgacagggctt

SEQ ID NO: 9352126 - DNA, 22 bp, Homo sapiens
acccaggaaaacatggtgcaga

SEQ ID NO: 9352127 - DNA, 22 bp, Homo sapiens
acccaggaaaacatggtgcaga

SEQ ID NO: 9352128 - DNA, 22 bp, Homo sapiens
acccagctggatgcatggaggc

SEQ ID NO: 9352129 - DNA, 22 bp, Homo sapiens
acccagctggatgcatggaggc

SEQ ID NO: 9352130 - DNA, 20 bp, Homo sapiens
acccagctctgtgccctggg

SEQ ID NO: 9352131 - DNA, 22 bp, Homo sapiens
acccagctaaccctaccctgga

SEQ ID NO: 9352132 - DNA, 22 bp, Homo sapiens
agggctgccatttctggcccaa

SEQ ID NO: 9352133 - DNA, 22 bp, Homo sapiens
agggctgacagtgaggagtcaa

SEQ ID NO: 9352134 - DNA, 22 bp, Homo sapiens
agggctgccatttctggcccaa

SEQ ID NO: 9352135 - DNA, 22 bp, Homo sapiens
agggctgccatttctggcccaa

SEQ ID NO: 9352136 - DNA, 22 bp, Homo sapiens
agggctgacagtgaggagtcaa

SEQ ID NO: 9352137 - DNA, 22 bp, Homo sapiens
agggctgcccagtgtgagagct

SEQ ID NO: 9352138 - DNA, 22 bp, Homo sapiens
agggctgcccagtgtgagagct

SEQ ID NO: 9352139 - DNA, 16 bp, Homo sapiens
agggagagaggaacat

SEQ ID NO: 9352140 - DNA, 18 bp, Homo sapiens
agggagagaccgcgggtc

SEQ ID NO: 9352141 - DNA, 16 bp, Homo sapiens
agggagagaggaacat

SEQ ID NO: 9352142 - DNA, 22 bp, Homo sapiens
agggagaggagcgtttcacatc

SEQ ID NO: 9352143 - DNA, 22 bp, Homo sapiens
agggagaggagggtcttgttga

SEQ ID NO: 9352144 - DNA, 22 bp, Homo sapiens
agggagaggagcgtttcacatc

SEQ ID NO: 9352145 - DNA, 22 bp, Homo sapiens
agggagaggagcgtttcacatc

SEQ ID NO: 9352146 - DNA, 18 bp, Homo sapiens
agggagagaccgcgggtc

SEQ ID NO: 9352147 - DNA, 22 bp, Homo sapiens
agggagagacatttccttcttg

SEQ ID NO: 9352148 - DNA, 22 bp, Homo sapiens
agggagagacatttccttcttg

SEQ ID NO: 9352149 - DNA, 22 bp, Homo sapiens
agggagagaagttatacaagat

SEQ ID NO: 9352150 - DNA, 19 bp, Homo sapiens
agggagaattccaagagga

SEQ ID NO: 9352151 - DNA, 22 bp, Homo sapiens
agggcacttcagtcagactgag

SEQ ID NO: 9352152 - DNA, 22 bp, Homo sapiens
agggcagcaaagtttgacctca

SEQ ID NO: 9352153 - DNA, 22 bp, Homo sapiens
agggcactttacccatagcttg

SEQ ID NO: 9352154 - DNA, 22 bp, Homo sapiens
agggcagcaatgcagctgctgc

SEQ ID NO: 9352155 - DNA, 22 bp, Homo sapiens
agggcagcaatgcagctgctgc

SEQ ID NO: 9352156 - DNA, 22 bp, Homo sapiens
agggcagcacaaggcatggact

SEQ ID NO: 9352157 - DNA, 22 bp, Homo sapiens
agggcagcacaaggcatggact

SEQ ID NO: 9352158 - DNA, 22 bp, Homo sapiens
agggcagcagcggcccaggcct

SEQ ID NO: 9352159 - DNA, 19 bp, Homo sapiens
accaggcctcagaggccct

SEQ ID NO: 9352160 - DNA, 22 bp, Homo sapiens
agggcagcagcccatggctctg

SEQ ID NO: 9352161 - DNA, 22 bp, Homo sapiens
agggcagcagcccatggctctg

SEQ ID NO: 9352162 - DNA, 22 bp, Homo sapiens
aggcttggtgccaaggagcctg

SEQ ID NO: 9352163 - DNA, 21 bp, Homo sapiens
aggcttgggtaaaaaggtcat

SEQ ID NO: 9352164 - DNA, 22 bp, Homo sapiens
aggcttggttaattctgtgtga

SEQ ID NO: 9352165 - DNA, 20 bp, Homo sapiens
aggcttggcttggcaggaac

SEQ ID NO: 9352166 - DNA, 20 bp, Homo sapiens
aggcttggcttggcaggaac

SEQ ID NO: 9352167 - DNA, 22 bp, Homo sapiens
aggcttggctggcagccctggg

SEQ ID NO: 9352168 - DNA, 20 bp, Homo sapiens
aggcttggcttggcaggaac

SEQ ID NO: 9352169 - DNA, 20 bp, Homo sapiens
aggcttggcttggcaggaac

SEQ ID NO: 9352170 - DNA, 18 bp, Homo sapiens
aggcttgggcccagcagc

SEQ ID NO: 9352171 - DNA, 22 bp, Homo sapiens
agggacagtatccatctcacag

SEQ ID NO: 9352172 - DNA, 22 bp, Homo sapiens
agggacagtatccatctcacag

SEQ ID NO: 9352173 - DNA, 22 bp, Homo sapiens
agggacagtctactgttcactg

SEQ ID NO: 9352174 - DNA, 22 bp, Homo sapiens
aggctttaagtggcctacagct

SEQ ID NO: 9352175 - DNA, 22 bp, Homo sapiens
aggctttaattatctacaggag

SEQ ID NO: 9352176 - DNA, 22 bp, Homo sapiens
aggcttgtggattggagcgagt

SEQ ID NO: 9352177 - DNA, 22 bp, Homo sapiens
agggagagaagttatacaagat

SEQ ID NO: 9352178 - DNA, 19 bp, Homo sapiens
agggagaattccaagagga

SEQ ID NO: 9352179 - DNA, 22 bp, Homo sapiens
agggagacaaaagcagctgcca

SEQ ID NO: 9352180 - DNA, 22 bp, Homo sapiens
agggagacaaaagcagctgcca

SEQ ID NO: 9352181 - DNA, 22 bp, Homo sapiens
accagcagagttgaggaggaca

SEQ ID NO: 9352182 - DNA, 22 bp, Homo sapiens
accagagctggctctgagcacc

SEQ ID NO: 9352183 - DNA, 22 bp, Homo sapiens
accagagctggcagagtatcaa

SEQ ID NO: 9352184 - DNA, 22 bp, Homo sapiens
accagagctcttcagcacagga

SEQ ID NO: 9352185 - DNA, 22 bp, Homo sapiens
acatttgtatatatgcagcata

SEQ ID NO: 9352186 - DNA, 22 bp, Homo sapiens
accagcaggtggcagtatgtat

SEQ ID NO: 9352187 - DNA, 22 bp, Homo sapiens
accagcaggccaggggcactgc

SEQ ID NO: 9352188 - DNA, 22 bp, Homo sapiens
accagcagttatgaggccagga

SEQ ID NO: 9352189 - DNA, 22 bp, Homo sapiens
accagccaccaccaggagatcg

SEQ ID NO: 9352190 - DNA, 22 bp, Homo sapiens
aggcctgaaggaagatgagctg

SEQ ID NO: 9352191 - DNA, 22 bp, Homo sapiens
aggcctcttgtcttcctcacat

SEQ ID NO: 9352192 - DNA, 22 bp, Homo sapiens
aggcctgaggaccttctggagg

SEQ ID NO: 9352193 - DNA, 20 bp, Homo sapiens
aggcctgagagatgactggg

SEQ ID NO: 9352194 - DNA, 18 bp, Homo sapiens
aggcctctgtgtgcccag

SEQ ID NO: 9352195 - DNA, 18 bp, Homo sapiens
aggcctctgtgtgcccag

SEQ ID NO: 9352196 - DNA, 22 bp, Homo sapiens
aggcctctgttccccatgtttt

SEQ ID NO: 9352197 - DNA, 22 bp, Homo sapiens
aggcctctgttccccatgtttt

SEQ ID NO: 9352198 - DNA, 22 bp, Homo sapiens
aggcctctgttccccatgtttt

SEQ ID NO: 9352199 - DNA, 22 bp, Homo sapiens
aggcctctgtctttatatgact

SEQ ID NO: 9352200 - DNA, 22 bp, Homo sapiens
aggcctctgtagggccctgaag

SEQ ID NO: 9352201 - DNA, 22 bp, Homo sapiens
aggcctctgtagggccctgaag

SEQ ID NO: 9352202 - DNA, 22 bp, Homo sapiens
aggcctcttcagggagcatgga

SEQ ID NO: 9352203 - DNA, 21 bp, Homo sapiens
aggcctcttcatggccatgat

SEQ ID NO: 9352204 - DNA, 20 bp, Homo sapiens
aggcctcttcatgacagctg

SEQ ID NO: 9352205 - DNA, 20 bp, Homo sapiens
aggcctcttcatgacagctg

SEQ ID NO: 9352206 - DNA, 22 bp, Homo sapiens
acatgtttgataaatatttggg

SEQ ID NO: 9352207 - DNA, 22 bp, Homo sapiens
acatgtttggctctatgctata

SEQ ID NO: 9352208 - DNA, 22 bp, Homo sapiens
aggcctctgggtctcctctgac

SEQ ID NO: 9352209 - DNA, 22 bp, Homo sapiens
aggcctctgggtctcctctgac

SEQ ID NO: 9352210 - DNA, 22 bp, Homo sapiens
aggccagggtcccacactcgca

SEQ ID NO: 9352211 - DNA, 22 bp, Homo sapiens
aggccagggtcccacactcgca

SEQ ID NO: 9352212 - DNA, 22 bp, Homo sapiens
aggccagggtcccacactcgca

SEQ ID NO: 9352213 - DNA, 22 bp, Homo sapiens
aggccagggtcccacactcgca

SEQ ID NO: 9352214 - DNA, 22 bp, Homo sapiens
aggccagggtagggcccattgt

SEQ ID NO: 9352215 - DNA, 22 bp, Homo sapiens
acatgtgtaagatgtgatatat

SEQ ID NO: 9352216 - DNA, 22 bp, Homo sapiens
acatgtgtaaggtctctcagtc

SEQ ID NO: 9352217 - DNA, 22 bp, Homo sapiens
acatgtgtaagatgtgatatat

SEQ ID NO: 9352218 - DNA, 22 bp, Homo sapiens
acatgtgtaagatgtgatatat

SEQ ID NO: 9352219 - DNA, 22 bp, Homo sapiens
acatgtgttttcctacttatga

SEQ ID NO: 9352220 - DNA, 22 bp, Homo sapiens
acatgtgttttcctacttatga

SEQ ID NO: 9352221 - DNA, 22 bp, Homo sapiens
acatgtgttttcctacttatga

SEQ ID NO: 9352222 - DNA, 22 bp, Homo sapiens
acatgttagggacagagtatgt

SEQ ID NO: 9352223 - DNA, 22 bp, Homo sapiens
acatgttcatgcatgcacaggt

SEQ ID NO: 9352224 - DNA, 22 bp, Homo sapiens
acatgttagctactattgttat

SEQ ID NO: 9352225 - DNA, 22 bp, Homo sapiens
acatgttagctactattgttat

SEQ ID NO: 9352226 - DNA, 22 bp, Homo sapiens
acatgttagaaatgcagaatct

SEQ ID NO: 9352227 - DNA, 22 bp, Homo sapiens
aggccagggccagattagccac

SEQ ID NO: 9352228 - DNA, 22 bp, Homo sapiens
aggccaggggtgagcacttctg

SEQ ID NO: 9352229 - DNA, 22 bp, Homo sapiens
aggccagggtagggcccattgt

SEQ ID NO: 9352230 - DNA, 22 bp, Homo sapiens
aggccaggggtgagcacttctg

SEQ ID NO: 9352231 - DNA, 22 bp, Homo sapiens
aggccaggcgagacacccggct

SEQ ID NO: 9352232 - DNA, 22 bp, Homo sapiens
aggccagggcactgctctttag

SEQ ID NO: 9352233 - DNA, 22 bp, Homo sapiens
aggccaggcctttctccattcc

SEQ ID NO: 9352234 - DNA, 22 bp, Homo sapiens
acatgctggatgaattacctac

SEQ ID NO: 9352235 - DNA, 22 bp, Homo sapiens
aggccaggcctttctccattcc

SEQ ID NO: 9352236 - DNA, 22 bp, Homo sapiens
acatgctaattgcaaagtcttg

SEQ ID NO: 9352237 - DNA, 22 bp, Homo sapiens
acatgccatcactttcattcct

SEQ ID NO: 9352238 - DNA, 22 bp, Homo sapiens
acatccatcttatgagataggt

SEQ ID NO: 9352239 - DNA, 22 bp, Homo sapiens
acatgccagcccatttaaatgg

SEQ ID NO: 9352240 - DNA, 22 bp, Homo sapiens
acatgccaatttggttagttca

SEQ ID NO: 9352241 - DNA, 22 bp, Homo sapiens
acatcacacgccttccaggagg

SEQ ID NO: 9352242 - DNA, 22 bp, Homo sapiens
acatcacagagcccagataaag

SEQ ID NO: 9352243 - DNA, 22 bp, Homo sapiens
acatcacagagcccagataaag

SEQ ID NO: 9352244 - DNA, 22 bp, Homo sapiens
acatcacagtagttaagccaga

SEQ ID NO: 9352245 - DNA, 22 bp, Homo sapiens
acatcagattatgctttgctta

SEQ ID NO: 9352246 - DNA, 22 bp, Homo sapiens
acatcagagggctcacatgatc

SEQ ID NO: 9352247 - DNA, 22 bp, Homo sapiens
acatccagatctcagcatggct

SEQ ID NO: 9352248 - DNA, 22 bp, Homo sapiens
acatccagatctcagcatggct

SEQ ID NO: 9352249 - DNA, 22 bp, Homo sapiens
acatccagaggcgtggaaggct

SEQ ID NO: 9352250 - DNA, 22 bp, Homo sapiens
acatcatttgtctgtagctgaa

SEQ ID NO: 9352251 - DNA, 22 bp, Homo sapiens
acatcattttcttcagtgtttg

SEQ ID NO: 9352252 - DNA, 22 bp, Homo sapiens
acatcatcgtgcacatacataa

SEQ ID NO: 9352253 - DNA, 22 bp, Homo sapiens
acatcattgtttataaagggag

SEQ ID NO: 9352254 - DNA, 22 bp, Homo sapiens
acatcatttctagttcctgtca

SEQ ID NO: 9352255 - DNA, 22 bp, Homo sapiens
acatcattgtccgttgtcatga

SEQ ID NO: 9352256 - DNA, 22 bp, Homo sapiens
acatcattcagggcctcgttgg

SEQ ID NO: 9352257 - DNA, 22 bp, Homo sapiens
acatttgactacatttatatat

SEQ ID NO: 9352258 - DNA, 22 bp, Homo sapiens
acatttgacccatggagggtag

SEQ ID NO: 9352259 - DNA, 22 bp, Homo sapiens
acatttgagatgccttttaggt

SEQ ID NO: 9352260 - DNA, 22 bp, Homo sapiens
acatttgagcatatttcttgtc

SEQ ID NO: 9352261 - DNA, 22 bp, Homo sapiens
acatttgagcatctactaagtg

SEQ ID NO: 9352262 - DNA, 22 bp, Homo sapiens
acatttcttttcatctctatat

SEQ ID NO: 9352263 - DNA, 22 bp, Homo sapiens
acatttcttttcatctctatat

SEQ ID NO: 9352264 - DNA, 22 bp, Homo sapiens
acatttcttttcatctctatat

SEQ ID NO: 9352265 - DNA, 22 bp, Homo sapiens
acatttgaaatgccatgtgagg

SEQ ID NO: 9352266 - DNA, 22 bp, Homo sapiens
acatttgaaaaagttgatggag

SEQ ID NO: 9352267 - DNA, 22 bp, Homo sapiens
acatttgagtcatatttgctta

SEQ ID NO: 9352268 - DNA, 22 bp, Homo sapiens
acatttgatatggagttgtgta

SEQ ID NO: 9352269 - DNA, 22 bp, Homo sapiens
acatttgatggagttagtaggt

SEQ ID NO: 9352270 - DNA, 22 bp, Homo sapiens
acatttgatatggagttgtgta

SEQ ID NO: 9352271 - DNA, 22 bp, Homo sapiens
acatttgagtcatatttgctta

SEQ ID NO: 9352272 - DNA, 22 bp, Homo sapiens
acatttggcaagaaagagaaac

SEQ ID NO: 9352273 - DNA, 22 bp, Homo sapiens
acatttgggaccctctcttcac

SEQ ID NO: 9352274 - DNA, 22 bp, Homo sapiens
acatttggtaacacttgagcat

SEQ ID NO: 9352275 - DNA, 22 bp, Homo sapiens
aggctgagctggtagtgagtac

SEQ ID NO: 9352276 - DNA, 22 bp, Homo sapiens
aggctgaggagggatgttgctt

SEQ ID NO: 9352277 - DNA, 22 bp, Homo sapiens
aggctgaggagggatgttgctt

SEQ ID NO: 9352278 - DNA, 22 bp, Homo sapiens
aggctgaggagggatgttgctt

SEQ ID NO: 9352279 - DNA, 22 bp, Homo sapiens
aggctgagctggtagtgagtac

SEQ ID NO: 9352280 - DNA, 22 bp, Homo sapiens
aggctgagctggtagtgagtac

SEQ ID NO: 9352281 - DNA, 22 bp, Homo sapiens
aggctgagctggtagtgagtac

SEQ ID NO: 9352282 - DNA, 22 bp, Homo sapiens
aggctgagctggcccttgaaat

SEQ ID NO: 9352283 - DNA, 22 bp, Homo sapiens
aggctgagctggcccttgaaat

SEQ ID NO: 9352284 - DNA, 22 bp, Homo sapiens
aggctgagctggcccttgaaat

SEQ ID NO: 9352285 - DNA, 18 bp, Homo sapiens
acatttctatgcttctgg

SEQ ID NO: 9352286 - DNA, 18 bp, Homo sapiens
acatttctatgcttctgg

SEQ ID NO: 9352287 - DNA, 22 bp, Homo sapiens
acatttctcagggagttttgct

SEQ ID NO: 9352288 - DNA, 22 bp, Homo sapiens
acatttctcttgatgtctctat

SEQ ID NO: 9352289 - DNA, 22 bp, Homo sapiens
acatttctttgctagacagcag

SEQ ID NO: 9352290 - DNA, 22 bp, Homo sapiens
acatttctttctattcagtagc

SEQ ID NO: 9352291 - DNA, 22 bp, Homo sapiens
acatttctttctattcagtagc

SEQ ID NO: 9352292 - DNA, 22 bp, Homo sapiens
acatttctttgctagacagcag

SEQ ID NO: 9352293 - DNA, 22 bp, Homo sapiens
acattgtataatgattatcaca

SEQ ID NO: 9352294 - DNA, 22 bp, Homo sapiens
acattggtcactgaagaatgag

SEQ ID NO: 9352295 - DNA, 22 bp, Homo sapiens
acattgctgcattctccttccc

SEQ ID NO: 9352296 - DNA, 22 bp, Homo sapiens
acattgtaagcatattagctga

SEQ ID NO: 9352297 - DNA, 22 bp, Homo sapiens
acattgtagacttttcatatgt

SEQ ID NO: 9352298 - DNA, 22 bp, Homo sapiens
acattgtagttgttctgcagca

SEQ ID NO: 9352299 - DNA, 22 bp, Homo sapiens
acatttctaatttaatgtaaca

SEQ ID NO: 9352300 - DNA, 22 bp, Homo sapiens
acatttctaatttaatgtaaca

SEQ ID NO: 9352301 - DNA, 22 bp, Homo sapiens
acatttctaatttaatgtaaca

SEQ ID NO: 9352302 - DNA, 17 bp, Homo sapiens
acatttcctaactgaag

SEQ ID NO: 9352303 - DNA, 22 bp, Homo sapiens
acatttctagttgttcatctcc

SEQ ID NO: 9352304 - DNA, 22 bp, Homo sapiens
acatttctatagtgcatctgtt

SEQ ID NO: 9352305 - DNA, 22 bp, Homo sapiens
acatttctatagtgcatctgtt

SEQ ID NO: 9352306 - DNA, 22 bp, Homo sapiens
acatttctatcatcctgtaatg

SEQ ID NO: 9352307 - DNA, 22 bp, Homo sapiens
aggctgagaaagtgggaagatg

SEQ ID NO: 9352308 - DNA, 22 bp, Homo sapiens
aggctgagaaagtgggaagatg

SEQ ID NO: 9352309 - DNA, 22 bp, Homo sapiens
aggctgagaaagtgggaagatg

SEQ ID NO: 9352310 - DNA, 22 bp, Homo sapiens
aggctgagaaagtgggaagatg

SEQ ID NO: 9352311 - DNA, 22 bp, Homo sapiens
aggctgagactgtgcattagtg

SEQ ID NO: 9352312 - DNA, 22 bp, Homo sapiens
aggctgagactgtgcattagtg

SEQ ID NO: 9352313 - DNA, 22 bp, Homo sapiens
aggctgagactgtgcattagtg

SEQ ID NO: 9352314 - DNA, 22 bp, Homo sapiens
acattgcaattaggtacctatg

SEQ ID NO: 9352315 - DNA, 22 bp, Homo sapiens
acattgcagatgtgtttaatgt

SEQ ID NO: 9352316 - DNA, 22 bp, Homo sapiens
aggctctggctactacagagct

SEQ ID NO: 9352317 - DNA, 22 bp, Homo sapiens
aggctctggctactacagagct

SEQ ID NO: 9352318 - DNA, 22 bp, Homo sapiens
aggctctgttattctagagggc

SEQ ID NO: 9352319 - DNA, 22 bp, Homo sapiens
aggctctggctactacagagct

SEQ ID NO: 9352320 - DNA, 22 bp, Homo sapiens
aggctctggctactacagagct

SEQ ID NO: 9352321 - DNA, 22 bp, Homo sapiens
aggcctgcccgtgggacctgtg

SEQ ID NO: 9352322 - DNA, 22 bp, Homo sapiens
aggcctgaggttcctgtgctca

SEQ ID NO: 9352323 - DNA, 22 bp, Homo sapiens
aggctctgttattctagagggc

SEQ ID NO: 9352324 - DNA, 22 bp, Homo sapiens
aggctctgttattctagagggc

SEQ ID NO: 9352325 - DNA, 22 bp, Homo sapiens
aggctctgtttgctgtggtacc

SEQ ID NO: 9352326 - DNA, 22 bp, Homo sapiens
aggctctgtttgctgtggtacc

SEQ ID NO: 9352327 - DNA, 22 bp, Homo sapiens
aggctctttgagactacctgga

SEQ ID NO: 9352328 - DNA, 22 bp, Homo sapiens
aggctgaaaacgagatggcaat

SEQ ID NO: 9352329 - DNA, 22 bp, Homo sapiens
aggctgacaagttcgtctaaag

SEQ ID NO: 9352330 - DNA, 22 bp, Homo sapiens
aggaagaacagataatggacgc

SEQ ID NO: 9352331 - DNA, 22 bp, Homo sapiens
aggaagaaatgtgacttcaaac

SEQ ID NO: 9352332 - DNA, 18 bp, Homo sapiens
acagggagggcgctgggg

SEQ ID NO: 9352333 - DNA, 22 bp, Homo sapiens
acagggagccccagcatttcca

SEQ ID NO: 9352334 - DNA, 19 bp, Homo sapiens
acagggcttggcctgacat

SEQ ID NO: 9352335 - DNA, 22 bp, Homo sapiens
aggaagagcattcacatggtag

SEQ ID NO: 9352336 - DNA, 22 bp, Homo sapiens
acagggctatattcctcagagt

SEQ ID NO: 9352337 - DNA, 22 bp, Homo sapiens
aggaagagcatctttgggtctg

SEQ ID NO: 9352338 - DNA, 22 bp, Homo sapiens
aggaagagcatctttgggtctg

SEQ ID NO: 9352339 - DNA, 22 bp, Homo sapiens
aggaagagcatctttgggtctg

SEQ ID NO: 9352340 - DNA, 18 bp, Homo sapiens
aggaagaccatcagatat

SEQ ID NO: 9352341 - DNA, 22 bp, Homo sapiens
aggaagacaatctgtgtgctgt

SEQ ID NO: 9352342 - DNA, 22 bp, Homo sapiens
aggaagagcatctttgggtctg

SEQ ID NO: 9352343 - DNA, 22 bp, Homo sapiens
aggaagaatgtttacatatcaa

SEQ ID NO: 9352344 - DNA, 22 bp, Homo sapiens
acagggcttttaatcagtagtt

SEQ ID NO: 9352345 - DNA, 22 bp, Homo sapiens
acaggggaatttactgtcatta

SEQ ID NO: 9352346 - DNA, 22 bp, Homo sapiens
acaggggacctaggaccctcgg

SEQ ID NO: 9352347 - DNA, 22 bp, Homo sapiens
acaggggcaagggctcacggcc

SEQ ID NO: 9352348 - DNA, 22 bp, Homo sapiens
acaggggattgattggaagtct

SEQ ID NO: 9352349 - DNA, 22 bp, Homo sapiens
acaggggcaggcaggacccttt

SEQ ID NO: 9352350 - DNA, 22 bp, Homo sapiens
acaggggcaggcaggacccttt

SEQ ID NO: 9352351 - DNA, 19 bp, Homo sapiens
acaggggcctttccagggt

SEQ ID NO: 9352352 - DNA, 22 bp, Homo sapiens
acaggggcaagggctcacggcc

SEQ ID NO: 9352353 - DNA, 22 bp, Homo sapiens
acaggggcaagggctcacggcc

SEQ ID NO: 9352354 - DNA, 22 bp, Homo sapiens
acaggggcaagggctcacggcc

SEQ ID NO: 9352355 - DNA, 20 bp, Homo sapiens
acaggggcagcacaataatg

SEQ ID NO: 9352356 - DNA, 22 bp, Homo sapiens
aggacacacaaagagtgagaac

SEQ ID NO: 9352357 - DNA, 19 bp, Homo sapiens
acaggggcctttccagggt

SEQ ID NO: 9352358 - DNA, 19 bp, Homo sapiens
acaggggctagcggaagca

SEQ ID NO: 9352359 - DNA, 22 bp, Homo sapiens
aggacacactgttctcacgtaa

SEQ ID NO: 9352360 - DNA, 22 bp, Homo sapiens
aggacacactgcaagagcctgg

SEQ ID NO: 9352361 - DNA, 22 bp, Homo sapiens
aggacacactgcaagagcctgg

SEQ ID NO: 9352362 - DNA, 22 bp, Homo sapiens
aggacacactgcaagagcctgg

SEQ ID NO: 9352363 - DNA, 22 bp, Homo sapiens
aggacacacagaatacaaatcc

SEQ ID NO: 9352364 - DNA, 22 bp, Homo sapiens
aggacacacccagctcacgggg

SEQ ID NO: 9352365 - DNA, 22 bp, Homo sapiens
aggacacacccagctcacgggg

SEQ ID NO: 9352366 - DNA, 22 bp, Homo sapiens
aggacacaccaggtccagctgt

SEQ ID NO: 9352367 - DNA, 22 bp, Homo sapiens
acaggcagggaccttggctaag

SEQ ID NO: 9352368 - DNA, 22 bp, Homo sapiens
acaggcagggaccttggctaag

SEQ ID NO: 9352369 - DNA, 22 bp, Homo sapiens
acaggctgttggggtccagggt

SEQ ID NO: 9352370 - DNA, 22 bp, Homo sapiens
acaggctgttggggtccagggt

SEQ ID NO: 9352371 - DNA, 22 bp, Homo sapiens
acaggctgttggggtccagggt

SEQ ID NO: 9352372 - DNA, 22 bp, Homo sapiens
acagggaaggacatgacttggc

SEQ ID NO: 9352373 - DNA, 22 bp, Homo sapiens
acagggaagctcaggggctctg

SEQ ID NO: 9352374 - DNA, 22 bp, Homo sapiens
acaggcaggcttcggccagagc

SEQ ID NO: 9352375 - DNA, 22 bp, Homo sapiens
acaggcaggcttcggccagagc

SEQ ID NO: 9352376 - DNA, 22 bp, Homo sapiens
acaggcaggcttcggccagagc

SEQ ID NO: 9352377 - DNA, 22 bp, Homo sapiens
acaggcaggcttcggccagagc

SEQ ID NO: 9352378 - DNA, 22 bp, Homo sapiens
acaggcagggacctcttgagtt

SEQ ID NO: 9352379 - DNA, 22 bp, Homo sapiens
acaggcagggacctcttgagtt

SEQ ID NO: 9352380 - DNA, 22 bp, Homo sapiens
acaggcagggacctcttgagtt

SEQ ID NO: 9352381 - DNA, 22 bp, Homo sapiens
acaggcagggacctcttgagtt

SEQ ID NO: 9352382 - DNA, 22 bp, Homo sapiens
acaggcagggaccttggctaag

SEQ ID NO: 9352383 - DNA, 22 bp, Homo sapiens
acagggaaggagcatagaaaaa

SEQ ID NO: 9352384 - DNA, 22 bp, Homo sapiens
acagggaagttctgcaacagga

SEQ ID NO: 9352385 - DNA, 22 bp, Homo sapiens
acagggaatggagggatcagta

SEQ ID NO: 9352386 - DNA, 22 bp, Homo sapiens
acagggacctgtgagctccata

SEQ ID NO: 9352387 - DNA, 22 bp, Homo sapiens
acagggacctgtgagctccata

SEQ ID NO: 9352388 - DNA, 22 bp, Homo sapiens
acagggaatggagggatcagta

SEQ ID NO: 9352389 - DNA, 22 bp, Homo sapiens
acagggaccttggaagctggaa

SEQ ID NO: 9352390 - DNA, 22 bp, Homo sapiens
acagggaccttggaagctggaa

SEQ ID NO: 9352391 - DNA, 22 bp, Homo sapiens
acaggcagcgtcattgctgctc

SEQ ID NO: 9352392 - DNA, 22 bp, Homo sapiens
acaggcagcactaatctctggt

SEQ ID NO: 9352393 - DNA, 22 bp, Homo sapiens
acaggcagccctctccctggtt

SEQ ID NO: 9352394 - DNA, 22 bp, Homo sapiens
acaggcagcgtcattgctgctc

SEQ ID NO: 9352395 - DNA, 22 bp, Homo sapiens
acaggcagcgtcattgctgctc

SEQ ID NO: 9352396 - DNA, 22 bp, Homo sapiens
acaggcaggagctccccattcc

SEQ ID NO: 9352397 - DNA, 22 bp, Homo sapiens
acaggcaggagctccccattcc

SEQ ID NO: 9352398 - DNA, 22 bp, Homo sapiens
acaggcaggcgggacagcccga

SEQ ID NO: 9352399 - DNA, 22 bp, Homo sapiens
acaggcaggcgggacagcccga

SEQ ID NO: 9352400 - DNA, 23 bp, Homo sapiens
acaggcaggcatggccaaatgtg

SEQ ID NO: 9352401 - DNA, 23 bp, Homo sapiens
acaggcaggcatggccaaatgtg

SEQ ID NO: 9352402 - DNA, 22 bp, Homo sapiens
acaggcaggcgggacagcccga

SEQ ID NO: 9352403 - DNA, 22 bp, Homo sapiens
acaggcaggcgggacagcccga

SEQ ID NO: 9352404 - DNA, 22 bp, Homo sapiens
acaggcaggcttcggccagagc

SEQ ID NO: 9352405 - DNA, 22 bp, Homo sapiens
acaggcaggcttcggccagagc

SEQ ID NO: 9352406 - DNA, 22 bp, Homo sapiens
acaggcagcactaatctctggt

SEQ ID NO: 9352407 - DNA, 22 bp, Homo sapiens
acaggcagcaaaatcagcctca

SEQ ID NO: 9352408 - DNA, 22 bp, Homo sapiens
acaggcagcactaatctctggt

SEQ ID NO: 9352409 - DNA, 22 bp, Homo sapiens
acaggcagcactaatctctggt

SEQ ID NO: 9352410 - DNA, 22 bp, Homo sapiens
acaggcagcaaaatcagcctca

SEQ ID NO: 9352411 - DNA, 22 bp, Homo sapiens
acaggcagcaaaatcagcctca

SEQ ID NO: 9352412 - DNA, 22 bp, Homo sapiens
acaggcagcaaaatcagcctca

SEQ ID NO: 9352413 - DNA, 14 bp, Homo sapiens
acaggcagatttct

SEQ ID NO: 9352414 - DNA, 22 bp, Homo sapiens
acaggcagattaagggtaggca

SEQ ID NO: 9352415 - DNA, 22 bp, Homo sapiens
acaggcagattaagggtaggca

SEQ ID NO: 9352416 - DNA, 17 bp, Homo sapiens
acaggcagatcacctga

SEQ ID NO: 9352417 - DNA, 17 bp, Homo sapiens
acaggcagatcacctga

SEQ ID NO: 9352418 - DNA, 22 bp, Homo sapiens
acaggcagattaagggtaggca

SEQ ID NO: 9352419 - DNA, 22 bp, Homo sapiens
acaggcagatgttttagttgta

SEQ ID NO: 9352420 - DNA, 22 bp, Homo sapiens
acaggagtttaagaaatatttc

SEQ ID NO: 9352421 - DNA, 22 bp, Homo sapiens
acaggagtttctgacagagaca

SEQ ID NO: 9352422 - DNA, 22 bp, Homo sapiens
acaggagttaaggctgagttga

SEQ ID NO: 9352423 - DNA, 22 bp, Homo sapiens
acaggagttaaccatgggaagt

SEQ ID NO: 9352424 - DNA, 22 bp, Homo sapiens
acaggagttaaggctgagttga

SEQ ID NO: 9352425 - DNA, 22 bp, Homo sapiens
acaggagttcagaggacacccc

SEQ ID NO: 9352426 - DNA, 22 bp, Homo sapiens
agctggtggagaagcagacctc

SEQ ID NO: 9352427 - DNA, 22 bp, Homo sapiens
agctggtggagcctttctgttt

SEQ ID NO: 9352428 - DNA, 22 bp, Homo sapiens
acaggatcgccctgttgcccag

SEQ ID NO: 9352429 - DNA, 18 bp, Homo sapiens
agctggtggggagacagc

SEQ ID NO: 9352430 - DNA, 18 bp, Homo sapiens
agctggtggggagacagc

SEQ ID NO: 9352431 - DNA, 18 bp, Homo sapiens
agctggtggggagacagc

SEQ ID NO: 9352432 - DNA, 22 bp, Homo sapiens
agctggtggggaagctgcaggt

SEQ ID NO: 9352433 - DNA, 22 bp, Homo sapiens
agctggtggattatgctgtaca

SEQ ID NO: 9352434 - DNA, 22 bp, Homo sapiens
agctggtggattatgctgtaca

SEQ ID NO: 9352435 - DNA, 22 bp, Homo sapiens
agctggtggattatgctgtaca

SEQ ID NO: 9352436 - DNA, 22 bp, Homo sapiens
agctggtggggaagctgcaggt

SEQ ID NO: 9352437 - DNA, 22 bp, Homo sapiens
agctggtggggaagctgcaggt

SEQ ID NO: 9352438 - DNA, 22 bp, Homo sapiens
acaggcagagtcaggttgggtt

SEQ ID NO: 9352439 - DNA, 22 bp, Homo sapiens
acaggcacctgccaccacatct

SEQ ID NO: 9352440 - DNA, 22 bp, Homo sapiens
agctggtgtgctctggaatcct

SEQ ID NO: 9352441 - DNA, 22 bp, Homo sapiens
agctggtgtgctctggaatcct

SEQ ID NO: 9352442 - DNA, 22 bp, Homo sapiens
agctggtgtgccagttccagtt

SEQ ID NO: 9352443 - DNA, 22 bp, Homo sapiens
agctggtgtgccagttccagtt

SEQ ID NO: 9352444 - DNA, 21 bp, Homo sapiens
agctggtgtcagagctctggg

SEQ ID NO: 9352445 - DNA, 21 bp, Homo sapiens
agctggtgtcagagctctggg

SEQ ID NO: 9352446 - DNA, 22 bp, Homo sapiens
agctggcagaaagctttgcccg

SEQ ID NO: 9352447 - DNA, 19 bp, Homo sapiens
agctggcactagaatccag

SEQ ID NO: 9352448 - DNA, 22 bp, Homo sapiens
agctggcactagcgtttccaag

SEQ ID NO: 9352449 - DNA, 19 bp, Homo sapiens
agctggcactagaatccag

SEQ ID NO: 9352450 - DNA, 22 bp, Homo sapiens
agctggcaccaaatatagtaaa

SEQ ID NO: 9352451 - DNA, 22 bp, Homo sapiens
agctggcaccaaatatagtaaa

SEQ ID NO: 9352452 - DNA, 22 bp, Homo sapiens
agctggcacagaccaggagatc

SEQ ID NO: 9352453 - DNA, 22 bp, Homo sapiens
agctggcacagaccaggagatc

SEQ ID NO: 9352454 - DNA, 22 bp, Homo sapiens
agctggcagctctcaggggtac

SEQ ID NO: 9352455 - DNA, 22 bp, Homo sapiens
agctggcagctctcaggggtac

SEQ ID NO: 9352456 - DNA, 22 bp, Homo sapiens
agctggcagctctcaggggtac

SEQ ID NO: 9352457 - DNA, 21 bp, Homo sapiens
agctggcagatatggtgtctg

SEQ ID NO: 9352458 - DNA, 21 bp, Homo sapiens
agctggcagatatggtgtctg

SEQ ID NO: 9352459 - DNA, 21 bp, Homo sapiens
agctggcagatatggtgtctg

SEQ ID NO: 9352460 - DNA, 22 bp, Homo sapiens
agctggcagagcatttgtggcc

SEQ ID NO: 9352461 - DNA, 22 bp, Homo sapiens
agctggcagagcatttgtggcc

SEQ ID NO: 9352462 - DNA, 22 bp, Homo sapiens
agctggcagagcatttgtggcc

SEQ ID NO: 9352463 - DNA, 21 bp, Homo sapiens
agctggcaatgttgtcctctt

SEQ ID NO: 9352464 - DNA, 22 bp, Homo sapiens
agctggcaatgtaagtccctgg

SEQ ID NO: 9352465 - DNA, 21 bp, Homo sapiens
agctggcaatgttgtcctctt

SEQ ID NO: 9352466 - DNA, 22 bp, Homo sapiens
agctggcaatgtaagtccctgg

SEQ ID NO: 9352467 - DNA, 22 bp, Homo sapiens
agctggcaagttgaaggtggct

SEQ ID NO: 9352468 - DNA, 22 bp, Homo sapiens
agctggcaatctttctaaatac

SEQ ID NO: 9352469 - DNA, 22 bp, Homo sapiens
agctggcaagttgaaggtggct

SEQ ID NO: 9352470 - DNA, 22 bp, Homo sapiens
agctggcaaggctttagattca

SEQ ID NO: 9352471 - DNA, 22 bp, Homo sapiens
agctggcaaaactaatgggaag

SEQ ID NO: 9352472 - DNA, 22 bp, Homo sapiens
agctggcaaaactaatgggaag

SEQ ID NO: 9352473 - DNA, 22 bp, Homo sapiens
agctggcaaacagcttacggcc

SEQ ID NO: 9352474 - DNA, 22 bp, Homo sapiens
agctggcaaaactaatgggaag

SEQ ID NO: 9352475 - DNA, 22 bp, Homo sapiens
agctggcaagttgaaggtggct

SEQ ID NO: 9352476 - DNA, 22 bp, Homo sapiens
agctggcaaggcaatttggatt

SEQ ID NO: 9352477 - DNA, 22 bp, Homo sapiens
agctggcaaggcaatttggatt

SEQ ID NO: 9352478 - DNA, 22 bp, Homo sapiens
agctggcaaggcaatttggatt

SEQ ID NO: 9352479 - DNA, 22 bp, Homo sapiens
acaggagtggagaggtgcctct

SEQ ID NO: 9352480 - DNA, 22 bp, Homo sapiens
acaggagtggctctaccagacc

SEQ ID NO: 9352481 - DNA, 22 bp, Homo sapiens
acaggagtgaatctggcactta

SEQ ID NO: 9352482 - DNA, 22 bp, Homo sapiens
acaggagtagggctggtggaga

SEQ ID NO: 9352483 - DNA, 23 bp, Homo sapiens
acaggaggggacaggtggccgtg

SEQ ID NO: 9352484 - DNA, 22 bp, Homo sapiens
acaggagggacaccttcctgct

SEQ ID NO: 9352485 - DNA, 22 bp, Homo sapiens
acaggagggacaccttcctgct

SEQ ID NO: 9352486 - DNA, 22 bp, Homo sapiens
acaggagggacaccttcctgct

SEQ ID NO: 9352487 - DNA, 22 bp, Homo sapiens
acaggagaattatctggaacaa

SEQ ID NO: 9352488 - DNA, 22 bp, Homo sapiens
acaggagaattatctggaacaa

SEQ ID NO: 9352489 - DNA, 21 bp, Homo sapiens
acagctgcctgccatgggggt

SEQ ID NO: 9352490 - DNA, 22 bp, Homo sapiens
acagctggcaggggggcatgaa

SEQ ID NO: 9352491 - DNA, 22 bp, Homo sapiens
acagctggcaggggggcatgaa

SEQ ID NO: 9352492 - DNA, 22 bp, Homo sapiens
acagctggcaggggggcatgaa

SEQ ID NO: 9352493 - DNA, 22 bp, Homo sapiens
acagctggcaggggggcatgaa

SEQ ID NO: 9352494 - DNA, 21 bp, Homo sapiens
acagctggccgcgcgggtcgg

SEQ ID NO: 9352495 - DNA, 22 bp, Homo sapiens
acagctgggaactcacacagca

SEQ ID NO: 9352496 - DNA, 22 bp, Homo sapiens
acagctggccgaggctcaggga

SEQ ID NO: 9352497 - DNA, 22 bp, Homo sapiens
acagctggccgaggctcaggga

SEQ ID NO: 9352498 - DNA, 22 bp, Homo sapiens
acagctgggaatcagctgggga

SEQ ID NO: 9352499 - DNA, 22 bp, Homo sapiens
acagctgggtgctgctcagagc

SEQ ID NO: 9352500 - DNA, 22 bp, Homo sapiens
acagctggtgaatgttctctgt

SEQ ID NO: 9352501 - DNA, 22 bp, Homo sapiens
acagctgggtgtcccacttctg

SEQ ID NO: 9352502 - DNA, 22 bp, Homo sapiens
acagctgggtgctgctcagagc

SEQ ID NO: 9352503 - DNA, 21 bp, Homo sapiens
acagctggtgcagggcgggga

SEQ ID NO: 9352504 - DNA, 21 bp, Homo sapiens
acagctggtgcagggcgggga

SEQ ID NO: 9352505 - DNA, 21 bp, Homo sapiens
acagctggtgcagggcgggga

SEQ ID NO: 9352506 - DNA, 21 bp, Homo sapiens
acagctggtgcagggcgggga

SEQ ID NO: 9352507 - DNA, 22 bp, Homo sapiens
acagctggtgaatgttctctgt

SEQ ID NO: 9352508 - DNA, 22 bp, Homo sapiens
agctggaggggccagcaggtgt

SEQ ID NO: 9352509 - DNA, 22 bp, Homo sapiens
acagctgtatccccagagctca

SEQ ID NO: 9352510 - DNA, 23 bp, Homo sapiens
agctggaggctgtctactcccaa

SEQ ID NO: 9352511 - DNA, 22 bp, Homo sapiens
agctggaggggccagcaggtgt

SEQ ID NO: 9352512 - DNA, 22 bp, Homo sapiens
agctctggtgagatgttattca

SEQ ID NO: 9352513 - DNA, 22 bp, Homo sapiens
agctctggttattgaagcaggg

SEQ ID NO: 9352514 - DNA, 22 bp, Homo sapiens
agctctggttattgaagcaggg

SEQ ID NO: 9352515 - DNA, 22 bp, Homo sapiens
agctctggggtggagcccagga

SEQ ID NO: 9352516 - DNA, 22 bp, Homo sapiens
agctctgggtcacggctgccga

SEQ ID NO: 9352517 - DNA, 22 bp, Homo sapiens
agctctggttattgaagcaggg

SEQ ID NO: 9352518 - DNA, 22 bp, Homo sapiens
agctctggttattgaagcaggg

SEQ ID NO: 9352519 - DNA, 22 bp, Homo sapiens
agctgaagcaacaacaggatgg

SEQ ID NO: 9352520 - DNA, 22 bp, Homo sapiens
agctgaagcaacaacaggatgg

SEQ ID NO: 9352521 - DNA, 22 bp, Homo sapiens
agctctggttattgaagcaggg

SEQ ID NO: 9352522 - DNA, 22 bp, Homo sapiens
agctctggttattgaagcaggg

SEQ ID NO: 9352523 - DNA, 22 bp, Homo sapiens
agctgaagcactgggatggaag

SEQ ID NO: 9352524 - DNA, 22 bp, Homo sapiens
agctgaagcactgggatggaag

SEQ ID NO: 9352525 - DNA, 22 bp, Homo sapiens
agctgacctggaagggggcacg

SEQ ID NO: 9352526 - DNA, 17 bp, Homo sapiens
agctgaccagatggact

SEQ ID NO: 9352527 - DNA, 22 bp, Homo sapiens
agctgaagtttagaattgtgaa

SEQ ID NO: 9352528 - DNA, 22 bp, Homo sapiens
acagtcagtatcccaggcaaat

SEQ ID NO: 9352529 - DNA, 22 bp, Homo sapiens
acagtcagggcttactcaggga

SEQ ID NO: 9352530 - DNA, 22 bp, Homo sapiens
acagtcagttgaatccaaggag

SEQ ID NO: 9352531 - DNA, 22 bp, Homo sapiens
acagtcaatcagaacagcatgt

SEQ ID NO: 9352532 - DNA, 22 bp, Homo sapiens
acagtcaatcagaacagcatgt

SEQ ID NO: 9352533 - DNA, 22 bp, Homo sapiens
acagtcaggccgagatgggcct

SEQ ID NO: 9352534 - DNA, 22 bp, Homo sapiens
acagtcaatcagaacagcatgt

SEQ ID NO: 9352535 - DNA, 21 bp, Homo sapiens
acagtcacaaaaccaaggcag

SEQ ID NO: 9352536 - DNA, 23 bp, Homo sapiens
acagtcgtaggtatccttttcct

SEQ ID NO: 9352537 - DNA, 22 bp, Homo sapiens
acagtctcttgcttgaatacta

SEQ ID NO: 9352538 - DNA, 22 bp, Homo sapiens
acagtctctgttgctgctgttt

SEQ ID NO: 9352539 - DNA, 22 bp, Homo sapiens
acagtgtggtttgagcactggg

SEQ ID NO: 9352540 - DNA, 22 bp, Homo sapiens
acagtgtggttgtttctggtta

SEQ ID NO: 9352541 - DNA, 22 bp, Homo sapiens
acagtgtggtttgagcactggg

SEQ ID NO: 9352542 - DNA, 22 bp, Homo sapiens
acagtgtggtgatggcacttgc

SEQ ID NO: 9352543 - DNA, 22 bp, Homo sapiens
acagtgtgacaattgtgtcaga

SEQ ID NO: 9352544 - DNA, 22 bp, Homo sapiens
acagtgggacagtgacggggga

SEQ ID NO: 9352545 - DNA, 22 bp, Homo sapiens
acagtctgcttgtctccatggt

SEQ ID NO: 9352546 - DNA, 17 bp, Homo sapiens
acagtctgcctgacagt

SEQ ID NO: 9352547 - DNA, 22 bp, Homo sapiens
acagtctgcagggtgaacatgt

SEQ ID NO: 9352548 - DNA, 22 bp, Homo sapiens
acagtctgcatatgacctgtag

SEQ ID NO: 9352549 - DNA, 22 bp, Homo sapiens
acagtctgcaggcaagttctac

SEQ ID NO: 9352550 - DNA, 22 bp, Homo sapiens
acagtctgagaattactgctct

SEQ ID NO: 9352551 - DNA, 22 bp, Homo sapiens
acagtgggatgaggctggcccc

SEQ ID NO: 9352552 - DNA, 22 bp, Homo sapiens
acagtggggtcttaatagaaca

SEQ ID NO: 9352553 - DNA, 22 bp, Homo sapiens
aggagcagaccgtagtcctgca

SEQ ID NO: 9352554 - DNA, 22 bp, Homo sapiens
aggagcagaccgtagtcctgca

SEQ ID NO: 9352555 - DNA, 22 bp, Homo sapiens
acagtacaccactgtgtacagt

SEQ ID NO: 9352556 - DNA, 22 bp, Homo sapiens
aggagcagaccgtagtcctgca

SEQ ID NO: 9352557 - DNA, 22 bp, Homo sapiens
aggagcagaccgtagtcctgca

SEQ ID NO: 9352558 - DNA, 22 bp, Homo sapiens
aggagcagaccgtagtcctgca

SEQ ID NO: 9352559 - DNA, 22 bp, Homo sapiens
aggagcagaatttaatgtgcag

SEQ ID NO: 9352560 - DNA, 22 bp, Homo sapiens
acagtatatatagtctaaaagc

SEQ ID NO: 9352561 - DNA, 22 bp, Homo sapiens
acagtatagggcttatattgta

SEQ ID NO: 9352562 - DNA, 22 bp, Homo sapiens
aggagcagaactgattctgact

SEQ ID NO: 9352563 - DNA, 22 bp, Homo sapiens
aggagcagaactgttgtggagg

SEQ ID NO: 9352564 - DNA, 22 bp, Homo sapiens
aggagatggagctcagtgggca

SEQ ID NO: 9352565 - DNA, 22 bp, Homo sapiens
acagtaaatcaacagaatatct

SEQ ID NO: 9352566 - DNA, 22 bp, Homo sapiens
aggagcaaatgatgagacagca

SEQ ID NO: 9352567 - DNA, 22 bp, Homo sapiens
aggagattgtggtgcaaggaat

SEQ ID NO: 9352568 - DNA, 22 bp, Homo sapiens
aggagcaaatgatgagacagca

SEQ ID NO: 9352569 - DNA, 22 bp, Homo sapiens
acagtaaaaagccttagaattt

SEQ ID NO: 9352570 - DNA, 22 bp, Homo sapiens
acagtaaataatgcatgttgat

SEQ ID NO: 9352571 - DNA, 22 bp, Homo sapiens
acagtaaagccttctggttgac

SEQ ID NO: 9352572 - DNA, 22 bp, Homo sapiens
aggacacagctgctctgcagag

SEQ ID NO: 9352573 - DNA, 22 bp, Homo sapiens
aggacacagctgctctgcagag

SEQ ID NO: 9352574 - DNA, 22 bp, Homo sapiens
aggacacaggcaggaggagatc

SEQ ID NO: 9352575 - DNA, 21 bp, Homo sapiens
aggacacagagacacctattg

SEQ ID NO: 9352576 - DNA, 21 bp, Homo sapiens
aggacacagagacacctattg

SEQ ID NO: 9352577 - DNA, 22 bp, Homo sapiens
acaggtgttttggaggatgatt

SEQ ID NO: 9352578 - DNA, 22 bp, Homo sapiens
acaggtgttttggaggatgatt

SEQ ID NO: 9352579 - DNA, 20 bp, Homo sapiens
acaggttcattctgtgtgac

SEQ ID NO: 9352580 - DNA, 22 bp, Homo sapiens
acaggtttagctcttagtagtc

SEQ ID NO: 9352581 - DNA, 22 bp, Homo sapiens
acaggtgtacaatgcatgacag

SEQ ID NO: 9352582 - DNA, 22 bp, Homo sapiens
acaggtgtaatttgcccgaggt

SEQ ID NO: 9352583 - DNA, 22 bp, Homo sapiens
acaggtgtaatttgcccgaggt

SEQ ID NO: 9352584 - DNA, 22 bp, Homo sapiens
acaggtgttgaatgatgtcaca

SEQ ID NO: 9352585 - DNA, 22 bp, Homo sapiens
acaggtgttgactcacaggccc

SEQ ID NO: 9352586 - DNA, 22 bp, Homo sapiens
acaggtgtacaatgcatgacag

SEQ ID NO: 9352587 - DNA, 22 bp, Homo sapiens
acaggtgttgaatgatgtcaca

SEQ ID NO: 9352588 - DNA, 22 bp, Homo sapiens
acaggtgttgactcacaggccc

SEQ ID NO: 9352589 - DNA, 22 bp, Homo sapiens
acatatttccatgcagcatgtc

SEQ ID NO: 9352590 - DNA, 22 bp, Homo sapiens
acatatattttcacacatggtt

SEQ ID NO: 9352591 - DNA, 22 bp, Homo sapiens
acatatattttcacacatggtt

SEQ ID NO: 9352592 - DNA, 22 bp, Homo sapiens
acatatctgtgaggttttgttg

SEQ ID NO: 9352593 - DNA, 20 bp, Homo sapiens
acatatcatggtagagtcct

SEQ ID NO: 9352594 - DNA, 22 bp, Homo sapiens
aggcagctctgtggcctcccag

SEQ ID NO: 9352595 - DNA, 21 bp, Homo sapiens
aggcagctcaggcccagagag

SEQ ID NO: 9352596 - DNA, 21 bp, Homo sapiens
aggcagctggaaggcctggct

SEQ ID NO: 9352597 - DNA, 22 bp, Homo sapiens
aggcagctgccctctccttcct

SEQ ID NO: 9352598 - DNA, 22 bp, Homo sapiens
acatagcagaggactgagcaga

SEQ ID NO: 9352599 - DNA, 22 bp, Homo sapiens
acatagtgttttgagagacagc

SEQ ID NO: 9352600 - DNA, 21 bp, Homo sapiens
acataggcgaatgttcgggag

SEQ ID NO: 9352601 - DNA, 22 bp, Homo sapiens
acatagtaagtgctcagtaaat

SEQ ID NO: 9352602 - DNA, 22 bp, Homo sapiens
aggcagctagagagtgaaactg

SEQ ID NO: 9352603 - DNA, 22 bp, Homo sapiens
acatagaaggaagagtagtagg

SEQ ID NO: 9352604 - DNA, 22 bp, Homo sapiens
acatagaacttcccagtgagca

SEQ ID NO: 9352605 - DNA, 22 bp, Homo sapiens
acatagatttaagagcaattag

SEQ ID NO: 9352606 - DNA, 22 bp, Homo sapiens
acatagatgcctctgctgcttc

SEQ ID NO: 9352607 - DNA, 22 bp, Homo sapiens
acatagaagtgatgcttatcca

SEQ ID NO: 9352608 - DNA, 22 bp, Homo sapiens
aggatggattctgtatgtggga

SEQ ID NO: 9352609 - DNA, 19 bp, Homo sapiens
aggatggagcaggcggtga

SEQ ID NO: 9352610 - DNA, 20 bp, Homo sapiens
acagtttatccagttagcag

SEQ ID NO: 9352611 - DNA, 22 bp, Homo sapiens
acagtttataaaaataatgagg

SEQ ID NO: 9352612 - DNA, 22 bp, Homo sapiens
acagtttagagcatgatgacca

SEQ ID NO: 9352613 - DNA, 22 bp, Homo sapiens
aggatgccttcattgcatggcc

SEQ ID NO: 9352614 - DNA, 21 bp, Homo sapiens
aggatggaaaggactaggggt

SEQ ID NO: 9352615 - DNA, 22 bp, Homo sapiens
aggatggaattaggtagcaagt

SEQ ID NO: 9352616 - DNA, 22 bp, Homo sapiens
aggatgccttcattgcatggcc

SEQ ID NO: 9352617 - DNA, 20 bp, Homo sapiens
aggatgcagggagtctgcag

SEQ ID NO: 9352618 - DNA, 20 bp, Homo sapiens
aggatgcagggagtctgcag

SEQ ID NO: 9352619 - DNA, 22 bp, Homo sapiens
aggatgagccgcgcaagctgac

SEQ ID NO: 9352620 - DNA, 22 bp, Homo sapiens
aggatgagattgctgtgttgta

SEQ ID NO: 9352621 - DNA, 22 bp, Homo sapiens
aggatgagattccagggtcaat

SEQ ID NO: 9352622 - DNA, 22 bp, Homo sapiens
aggatgagccgcgcaagctgac

SEQ ID NO: 9352623 - DNA, 22 bp, Homo sapiens
aggatgagagatacatggagca

SEQ ID NO: 9352624 - DNA, 20 bp, Homo sapiens
acagtttattttacttggtt

SEQ ID NO: 9352625 - DNA, 20 bp, Homo sapiens
acagtttattttacttggtt

SEQ ID NO: 9352626 - DNA, 22 bp, Homo sapiens
acagtttccccctagggcagca

SEQ ID NO: 9352627 - DNA, 22 bp, Homo sapiens
aggcactgcttctaagtaggaa

SEQ ID NO: 9352628 - DNA, 17 bp, Homo sapiens
acagtttgattttagca

SEQ ID NO: 9352629 - DNA, 22 bp, Homo sapiens
acagtttgaataatttagatag

SEQ ID NO: 9352630 - DNA, 22 bp, Homo sapiens
acagtttatggtgttttatata

SEQ ID NO: 9352631 - DNA, 22 bp, Homo sapiens
acagtttatggtgttttatata

SEQ ID NO: 9352632 - DNA, 20 bp, Homo sapiens
aggcactggggataggtaag

SEQ ID NO: 9352633 - DNA, 22 bp, Homo sapiens
aggcactgggggatgagcaagg

SEQ ID NO: 9352634 - DNA, 22 bp, Homo sapiens
aggcactgggtaattagtagct

SEQ ID NO: 9352635 - DNA, 22 bp, Homo sapiens
aggcactgggggatgagcaagg

SEQ ID NO: 9352636 - DNA, 20 bp, Homo sapiens
aggcactggatttcttatat

SEQ ID NO: 9352637 - DNA, 18 bp, Homo sapiens
aggcactggaattaaggg

SEQ ID NO: 9352638 - DNA, 22 bp, Homo sapiens
aggcactgggaatatgctgagg

SEQ ID NO: 9352639 - DNA, 22 bp, Homo sapiens
agtcccagtgagatgagccacg

SEQ ID NO: 9352640 - DNA, 22 bp, Homo sapiens
agtcccagtgagatgagccacg

SEQ ID NO: 9352641 - DNA, 22 bp, Homo sapiens
agtcccagtgagatgagccacg

SEQ ID NO: 9352642 - DNA, 22 bp, Homo sapiens
agtcccagcttcccccatgcag

SEQ ID NO: 9352643 - DNA, 22 bp, Homo sapiens
actcctgggttgcagtcctcaa

SEQ ID NO: 9352644 - DNA, 22 bp, Homo sapiens
actcctgggttgcagtcctcaa

SEQ ID NO: 9352645 - DNA, 20 bp, Homo sapiens
actcctggtaacttttgtga

SEQ ID NO: 9352646 - DNA, 17 bp, Homo sapiens
actcctggtctgaaggg

SEQ ID NO: 9352647 - DNA, 17 bp, Homo sapiens
actcctggtctgaaggg

SEQ ID NO: 9352648 - DNA, 22 bp, Homo sapiens
actcctgggttctaaatttgaa

SEQ ID NO: 9352649 - DNA, 22 bp, Homo sapiens
actcctgggttccggagattct

SEQ ID NO: 9352650 - DNA, 22 bp, Homo sapiens
actcctgggttccggagattct

SEQ ID NO: 9352651 - DNA, 18 bp, Homo sapiens
agtcccatcttcagctct

SEQ ID NO: 9352652 - DNA, 22 bp, Homo sapiens
actcctggtttgtgtcctggct

SEQ ID NO: 9352653 - DNA, 22 bp, Homo sapiens
actcctggtttgtgtcctggct

SEQ ID NO: 9352654 - DNA, 22 bp, Homo sapiens
actcctgtgaggtaggtggcaa

SEQ ID NO: 9352655 - DNA, 22 bp, Homo sapiens
actcctgtgggcatggcacccc

SEQ ID NO: 9352656 - DNA, 22 bp, Homo sapiens
actcctgtgtggctgggaggtt

SEQ ID NO: 9352657 - DNA, 22 bp, Homo sapiens
actcctggttcccagttgagat

SEQ ID NO: 9352658 - DNA, 17 bp, Homo sapiens
actcctggtctgaaggg

SEQ ID NO: 9352659 - DNA, 22 bp, Homo sapiens
actcctggtgctgatgaagaga

SEQ ID NO: 9352660 - DNA, 22 bp, Homo sapiens
actcctggtgctgatgaagaga

SEQ ID NO: 9352661 - DNA, 22 bp, Homo sapiens
agtcttgctcttgcatctgctt

SEQ ID NO: 9352662 - DNA, 22 bp, Homo sapiens
agtcttgcattttctgaagatg

SEQ ID NO: 9352663 - DNA, 22 bp, Homo sapiens
agtcttctttcatttactcagt

SEQ ID NO: 9352664 - DNA, 22 bp, Homo sapiens
agtcttcttgatcttttcagtg

SEQ ID NO: 9352665 - DNA, 22 bp, Homo sapiens
agtcttctgggtgtttccagag

SEQ ID NO: 9352666 - DNA, 20 bp, Homo sapiens
agtctgtcaatttacagtgg

SEQ ID NO: 9352667 - DNA, 20 bp, Homo sapiens
agtctgtcaatttacagtgg

SEQ ID NO: 9352668 - DNA, 22 bp, Homo sapiens
actcggcagcctgagagttcac

SEQ ID NO: 9352669 - DNA, 23 bp, Homo sapiens
actcgtggaattctctgcgatcg

SEQ ID NO: 9352670 - DNA, 20 bp, Homo sapiens
actctgtactgtcaatgttg

SEQ ID NO: 9352671 - DNA, 22 bp, Homo sapiens
actctgtacgcaagagatggag

SEQ ID NO: 9352672 - DNA, 22 bp, Homo sapiens
actctgtaattctatatgcagt

SEQ ID NO: 9352673 - DNA, 22 bp, Homo sapiens
agtctttaagtaatgataggca

SEQ ID NO: 9352674 - DNA, 22 bp, Homo sapiens
agtctttaacatttggagattg

SEQ ID NO: 9352675 - DNA, 18 bp, Homo sapiens
agtcttgttctgttgccc

SEQ ID NO: 9352676 - DNA, 22 bp, Homo sapiens
actcttcacacttgtctccagg

SEQ ID NO: 9352677 - DNA, 22 bp, Homo sapiens
agtgcaatgaataacagccacc

SEQ ID NO: 9352678 - DNA, 22 bp, Homo sapiens
agtgcaggttaaggaactggcc

SEQ ID NO: 9352679 - DNA, 22 bp, Homo sapiens
agtgcaggttaaggaactggcc

SEQ ID NO: 9352680 - DNA, 22 bp, Homo sapiens
agtgcaggttaaggaactggcc

SEQ ID NO: 9352681 - DNA, 22 bp, Homo sapiens
agtgcaggttaaggaactggcc

SEQ ID NO: 9352682 - DNA, 22 bp, Homo sapiens
agtgcagggggaaagggtgtct

SEQ ID NO: 9352683 - DNA, 22 bp, Homo sapiens
agtgcagggggaaagggtgtct

SEQ ID NO: 9352684 - DNA, 22 bp, Homo sapiens
agtgcagggggaaagggtgtct

SEQ ID NO: 9352685 - DNA, 22 bp, Homo sapiens
agtgcagggggaaagggtgtct

SEQ ID NO: 9352686 - DNA, 22 bp, Homo sapiens
agtgcagggggaaagggtgtct

SEQ ID NO: 9352687 - DNA, 22 bp, Homo sapiens
actctgtgccaggcactttggg

SEQ ID NO: 9352688 - DNA, 22 bp, Homo sapiens
actctgtcacctactcactgta

SEQ ID NO: 9352689 - DNA, 21 bp, Homo sapiens
actctgtcttgagccatctgt

SEQ ID NO: 9352690 - DNA, 22 bp, Homo sapiens
actctgtgaagtcttattatgc

SEQ ID NO: 9352691 - DNA, 22 bp, Homo sapiens
actctgtagatgtggaaatgcg

SEQ ID NO: 9352692 - DNA, 22 bp, Homo sapiens
actctgtagggacggttctccc

SEQ ID NO: 9352693 - DNA, 22 bp, Homo sapiens
actctgtcacctactcactgta

SEQ ID NO: 9352694 - DNA, 22 bp, Homo sapiens
actctgtatccctctcaaattg

SEQ ID NO: 9352695 - DNA, 22 bp, Homo sapiens
actgaggaacatatataagatg

SEQ ID NO: 9352696 - DNA, 21 bp, Homo sapiens
actgaggcaatggatttttgt

SEQ ID NO: 9352697 - DNA, 22 bp, Homo sapiens
actgaggcagtgaggtcggtct

SEQ ID NO: 9352698 - DNA, 22 bp, Homo sapiens
actgaggcagaagggtaagtgg

SEQ ID NO: 9352699 - DNA, 22 bp, Homo sapiens
actgaggcttacaaaggtaaag

SEQ ID NO: 9352700 - DNA, 21 bp, Homo sapiens
actgagggccagagaggacct

SEQ ID NO: 9352701 - DNA, 22 bp, Homo sapiens
actgaggcttaaagagattagg

SEQ ID NO: 9352702 - DNA, 22 bp, Homo sapiens
actgaggctagattgctgttct

SEQ ID NO: 9352703 - DNA, 22 bp, Homo sapiens
actgaggcgcagtccggctgtc

SEQ ID NO: 9352704 - DNA, 22 bp, Homo sapiens
actgaggcccgaggatctcctg

SEQ ID NO: 9352705 - DNA, 22 bp, Homo sapiens
actgaggcccgaggatctcctg

SEQ ID NO: 9352706 - DNA, 22 bp, Homo sapiens
actgaggcagtgaggtcggtct

SEQ ID NO: 9352707 - DNA, 22 bp, Homo sapiens
agtgcataatgaaggagcttga

SEQ ID NO: 9352708 - DNA, 22 bp, Homo sapiens
agtgcatagctgcgaagcattt

SEQ ID NO: 9352709 - DNA, 22 bp, Homo sapiens
agtgcatagggggatgcacagc

SEQ ID NO: 9352710 - DNA, 22 bp, Homo sapiens
agtgcatgccttcctgtggatg

SEQ ID NO: 9352711 - DNA, 22 bp, Homo sapiens
agtgcatgccttcctgtggatg

SEQ ID NO: 9352712 - DNA, 22 bp, Homo sapiens
agtgcatgcgcttgggaggggt

SEQ ID NO: 9352713 - DNA, 22 bp, Homo sapiens
agtgcatgcgcttgggaggggt

SEQ ID NO: 9352714 - DNA, 22 bp, Homo sapiens
agtgcatgtatctacagtcaca

SEQ ID NO: 9352715 - DNA, 22 bp, Homo sapiens
agtgcatgtccagtagtttatg

SEQ ID NO: 9352716 - DNA, 18 bp, Homo sapiens
agtgcatgctaggggaag

SEQ ID NO: 9352717 - DNA, 23 bp, Homo sapiens
agtgcatgcttgacttagcaagc

SEQ ID NO: 9352718 - DNA, 19 bp, Homo sapiens
agtgcatgggcgaggtgca

SEQ ID NO: 9352719 - DNA, 20 bp, Homo sapiens
agtgcatggagggagagggc

SEQ ID NO: 9352720 - DNA, 20 bp, Homo sapiens
agtgcatggagggagagggc

SEQ ID NO: 9352721 - DNA, 20 bp, Homo sapiens
agtgtatgaatctggatggg

SEQ ID NO: 9352722 - DNA, 22 bp, Homo sapiens
agtgtattaagttatgaagtta

SEQ ID NO: 9352723 - DNA, 22 bp, Homo sapiens
agtgtatgtcaagtatatacac

SEQ ID NO: 9352724 - DNA, 22 bp, Homo sapiens
agtgtatgtcaagtatatacac

SEQ ID NO: 9352725 - DNA, 22 bp, Homo sapiens
actgctttatctgagaagtcct

SEQ ID NO: 9352726 - DNA, 22 bp, Homo sapiens
agtgtgtgaccttttaatttaa

SEQ ID NO: 9352727 - DNA, 22 bp, Homo sapiens
actggaattaggtttgtataca

SEQ ID NO: 9352728 - DNA, 22 bp, Homo sapiens
actggaagccagttgacaatca

SEQ ID NO: 9352729 - DNA, 21 bp, Homo sapiens
actggaagtgggtcaggaagt

SEQ ID NO: 9352730 - DNA, 22 bp, Homo sapiens
actggaagtatctgcttgtttt

SEQ ID NO: 9352731 - DNA, 22 bp, Homo sapiens
actggaagtatctgcttgtttt

SEQ ID NO: 9352732 - DNA, 22 bp, Homo sapiens
agtgtttagtgatgaaagagaa

SEQ ID NO: 9352733 - DNA, 22 bp, Homo sapiens
agtgtttagtcaagtaagacgc

SEQ ID NO: 9352734 - DNA, 22 bp, Homo sapiens
agtgtttagaggaggaaagatg

SEQ ID NO: 9352735 - DNA, 22 bp, Homo sapiens
agtgtttagaggaggaaagatg

SEQ ID NO: 9352736 - DNA, 20 bp, Homo sapiens
agtgtttagaatactattat

SEQ ID NO: 9352737 - DNA, 22 bp, Homo sapiens
agtgtttaccccaatcagttta

SEQ ID NO: 9352738 - DNA, 21 bp, Homo sapiens
actggcttggctctggctgaa

SEQ ID NO: 9352739 - DNA, 22 bp, Homo sapiens
agtgtttatattatggaaatat

SEQ ID NO: 9352740 - DNA, 22 bp, Homo sapiens
agtgtttatattatggaaatat

SEQ ID NO: 9352741 - DNA, 22 bp, Homo sapiens
agtgtttaagttacacacatat

SEQ ID NO: 9352742 - DNA, 22 bp, Homo sapiens
agtgtttacagagtagtggaaa

SEQ ID NO: 9352743 - DNA, 22 bp, Homo sapiens
agtgtttacagagtagtggaaa

SEQ ID NO: 9352744 - DNA, 22 bp, Homo sapiens
agtgtttaaactgaagtgatga

SEQ ID NO: 9352745 - DNA, 23 bp, Homo sapiens
agtgttggttgggaagccaagca

SEQ ID NO: 9352746 - DNA, 21 bp, Homo sapiens
agtgtgtgataggcaggaaga

SEQ ID NO: 9352747 - DNA, 22 bp, Homo sapiens
agtgttggaccgaggtggagcc

SEQ ID NO: 9352748 - DNA, 22 bp, Homo sapiens
agtgttggaccgaggtggagcc

SEQ ID NO: 9352749 - DNA, 22 bp, Homo sapiens
actgcacttcagcctgggtgtc

SEQ ID NO: 9352750 - DNA, 22 bp, Homo sapiens
actgcagactctacagttataa

SEQ ID NO: 9352751 - DNA, 22 bp, Homo sapiens
actgcacttcagcctgggtgtc

SEQ ID NO: 9352752 - DNA, 22 bp, Homo sapiens
actgcagcaaagcccgtgtctt

SEQ ID NO: 9352753 - DNA, 21 bp, Homo sapiens
agtggggtctctgtggaggcc

SEQ ID NO: 9352754 - DNA, 21 bp, Homo sapiens
agtggggtctctgtggaggcc

SEQ ID NO: 9352755 - DNA, 22 bp, Homo sapiens
actgcactttaggccaactagg

SEQ ID NO: 9352756 - DNA, 22 bp, Homo sapiens
agtgtagcctagtggttaaggg

SEQ ID NO: 9352757 - DNA, 19 bp, Homo sapiens
agtgtagctaggatgtgct

SEQ ID NO: 9352758 - DNA, 22 bp, Homo sapiens
agtgtagatgaaattaaaccca

SEQ ID NO: 9352759 - DNA, 22 bp, Homo sapiens
agtgtacatcagaacatatcaa

SEQ ID NO: 9352760 - DNA, 22 bp, Homo sapiens
agtgtacatcagaacatatcaa

SEQ ID NO: 9352761 - DNA, 22 bp, Homo sapiens
agtgtacagttctatgaatttc

SEQ ID NO: 9352762 - DNA, 22 bp, Homo sapiens
agtgtacagttctatgaatttc

SEQ ID NO: 9352763 - DNA, 22 bp, Homo sapiens
agtgtacagtttgtagtactac

SEQ ID NO: 9352764 - DNA, 22 bp, Homo sapiens
agtgtacaagaccttattgttg

SEQ ID NO: 9352765 - DNA, 22 bp, Homo sapiens
agtggcagtagatgagctggtt

SEQ ID NO: 9352766 - DNA, 22 bp, Homo sapiens
agtggcagtagatgagctggtt

SEQ ID NO: 9352767 - DNA, 22 bp, Homo sapiens
agtggcagtagatgagctggtt

SEQ ID NO: 9352768 - DNA, 22 bp, Homo sapiens
agtggcaggtgtttcgtggtgc

SEQ ID NO: 9352769 - DNA, 22 bp, Homo sapiens
agtggcaggtgtttcgtggtgc

SEQ ID NO: 9352770 - DNA, 22 bp, Homo sapiens
agtggcaggtgtttcgtggtgc

SEQ ID NO: 9352771 - DNA, 22 bp, Homo sapiens
agtggcagggctggctgctgca

SEQ ID NO: 9352772 - DNA, 22 bp, Homo sapiens
agtggcagggctggctgctgca

SEQ ID NO: 9352773 - DNA, 22 bp, Homo sapiens
agtggcagagctgtgtcttgaa

SEQ ID NO: 9352774 - DNA, 22 bp, Homo sapiens
agtggcagggctggctgctgca

SEQ ID NO: 9352775 - DNA, 22 bp, Homo sapiens
agtggcagggctggctgctgca

SEQ ID NO: 9352776 - DNA, 22 bp, Homo sapiens
agtggcagagccagggttggga

SEQ ID NO: 9352777 - DNA, 22 bp, Homo sapiens
actgaggggttggagagtgagg

SEQ ID NO: 9352778 - DNA, 22 bp, Homo sapiens
actgaggggttggagagtgagg

SEQ ID NO: 9352779 - DNA, 21 bp, Homo sapiens
actgagggccagagaggacct

SEQ ID NO: 9352780 - DNA, 21 bp, Homo sapiens
actgagggccagagaggacct

SEQ ID NO: 9352781 - DNA, 22 bp, Homo sapiens
actgaggggctttcaggcccag

SEQ ID NO: 9352782 - DNA, 22 bp, Homo sapiens
agtggcagtggctgggcagagc

SEQ ID NO: 9352783 - DNA, 22 bp, Homo sapiens
agtggcagtggctgggcagagc

SEQ ID NO: 9352784 - DNA, 22 bp, Homo sapiens
agtggcagtggctgggcagagc

SEQ ID NO: 9352785 - DNA, 22 bp, Homo sapiens
agtggcagtggaaagcacacgg

SEQ ID NO: 9352786 - DNA, 22 bp, Homo sapiens
actgcacttcagcctgggtgac

SEQ ID NO: 9352787 - DNA, 22 bp, Homo sapiens
actgcacttcagcctgggtgtc

SEQ ID NO: 9352788 - DNA, 22 bp, Homo sapiens
actgcacttcagcctgggtgac

SEQ ID NO: 9352789 - DNA, 20 bp, Homo sapiens
acctgaggtccctatggtct

SEQ ID NO: 9352790 - DNA, 22 bp, Homo sapiens
acctgaggactggatggtagaa

SEQ ID NO: 9352791 - DNA, 22 bp, Homo sapiens
acctgaggactggatggtagaa

SEQ ID NO: 9352792 - DNA, 21 bp, Homo sapiens
acctgagctccacctcctgcc

SEQ ID NO: 9352793 - DNA, 22 bp, Homo sapiens
acctgagacctaatctgactgt

SEQ ID NO: 9352794 - DNA, 22 bp, Homo sapiens
acctgcatgatggaacatgagg

SEQ ID NO: 9352795 - DNA, 22 bp, Homo sapiens
aggtccagttgccagaatggcc

SEQ ID NO: 9352796 - DNA, 22 bp, Homo sapiens
acctgcccacacttccttccca

SEQ ID NO: 9352797 - DNA, 22 bp, Homo sapiens
aggtccagttgccagaatggcc

SEQ ID NO: 9352798 - DNA, 22 bp, Homo sapiens
acctgcaggcacaggtgtgcgc

SEQ ID NO: 9352799 - DNA, 22 bp, Homo sapiens
acctgcagctaaagatgtaggg

SEQ ID NO: 9352800 - DNA, 22 bp, Homo sapiens
accctccccaagaggtcgtgcc

SEQ ID NO: 9352801 - DNA, 22 bp, Homo sapiens
accctccaggcgggcttgtgac

SEQ ID NO: 9352802 - DNA, 22 bp, Homo sapiens
accctccaggctgcagctcctg

SEQ ID NO: 9352803 - DNA, 19 bp, Homo sapiens
accctctcagtgcctgagg

SEQ ID NO: 9352804 - DNA, 19 bp, Homo sapiens
accctctcagtgcctgagg

SEQ ID NO: 9352805 - DNA, 19 bp, Homo sapiens
accctctccccactgggtc

SEQ ID NO: 9352806 - DNA, 19 bp, Homo sapiens
accctctccccactgggtc

SEQ ID NO: 9352807 - DNA, 19 bp, Homo sapiens
accctctctgtagaaagat

SEQ ID NO: 9352808 - DNA, 20 bp, Homo sapiens
accctctgaatagtatctgg

SEQ ID NO: 9352809 - DNA, 22 bp, Homo sapiens
acctcctccaaggagccatagg

SEQ ID NO: 9352810 - DNA, 22 bp, Homo sapiens
accctctgcatcagcttcttta

SEQ ID NO: 9352811 - DNA, 22 bp, Homo sapiens
acctctggccttcaggcatcat

SEQ ID NO: 9352812 - DNA, 22 bp, Homo sapiens
acctctggccttcaggcatcat

SEQ ID NO: 9352813 - DNA, 22 bp, Homo sapiens
acctcctgatgagagtaaagga

SEQ ID NO: 9352814 - DNA, 22 bp, Homo sapiens
acctcctgatgagagtaaagga

SEQ ID NO: 9352815 - DNA, 22 bp, Homo sapiens
acctctgggaaaagtatggaaa

SEQ ID NO: 9352816 - DNA, 22 bp, Homo sapiens
acctctgggaaaagtatggaaa

SEQ ID NO: 9352817 - DNA, 22 bp, Homo sapiens
acctctgggcagcacctttgta

SEQ ID NO: 9352818 - DNA, 22 bp, Homo sapiens
acctgaaaccaacttgtgtact

SEQ ID NO: 9352819 - DNA, 22 bp, Homo sapiens
acctgaaactcaactttatctc

SEQ ID NO: 9352820 - DNA, 22 bp, Homo sapiens
acctgaaaattattatttccgc

SEQ ID NO: 9352821 - DNA, 22 bp, Homo sapiens
acctgaattttggatgagctgt

SEQ ID NO: 9352822 - DNA, 22 bp, Homo sapiens
acctgaatccccagggccttcc

SEQ ID NO: 9352823 - DNA, 22 bp, Homo sapiens
aggtctcaattcctgctcctgt

SEQ ID NO: 9352824 - DNA, 22 bp, Homo sapiens
aggtctcaaactggcaccctgt

SEQ ID NO: 9352825 - DNA, 22 bp, Homo sapiens
aggtcctgtttcttccctgggg

SEQ ID NO: 9352826 - DNA, 22 bp, Homo sapiens
aggtcgagtttcggggctactt

SEQ ID NO: 9352827 - DNA, 22 bp, Homo sapiens
aggtccagttgccagaatggcc

SEQ ID NO: 9352828 - DNA, 22 bp, Homo sapiens
aggtcctgtcttatctctgtaa

SEQ ID NO: 9352829 - DNA, 22 bp, Homo sapiens
aggtcctgtggtttgggtaaaa

SEQ ID NO: 9352830 - DNA, 22 bp, Homo sapiens
aggtcctgtgtccaggggcctg

SEQ ID NO: 9352831 - DNA, 20 bp, Homo sapiens
aggtcctgttccttgtctcc

SEQ ID NO: 9352832 - DNA, 22 bp, Homo sapiens
aggtctctagaaattcagccag

SEQ ID NO: 9352833 - DNA, 22 bp, Homo sapiens
aggtctctcacactcacagggc

SEQ ID NO: 9352834 - DNA, 22 bp, Homo sapiens
aggtctccttgtgggtcttgcc

SEQ ID NO: 9352835 - DNA, 22 bp, Homo sapiens
aggtctctcagccctgacattc

SEQ ID NO: 9352836 - DNA, 22 bp, Homo sapiens
aggtctctcacactcacagggc

SEQ ID NO: 9352837 - DNA, 22 bp, Homo sapiens
aggtctctgagtactgctggac

SEQ ID NO: 9352838 - DNA, 22 bp, Homo sapiens
aggtctctggggaactccaggg

SEQ ID NO: 9352839 - DNA, 22 bp, Homo sapiens
aggtctctggggaactccaggg

SEQ ID NO: 9352840 - DNA, 22 bp, Homo sapiens
aggtctctgcccacacaggctt

SEQ ID NO: 9352841 - DNA, 22 bp, Homo sapiens
acctggagtcatttgaggagta

SEQ ID NO: 9352842 - DNA, 22 bp, Homo sapiens
acctggagtcatttgaggagta

SEQ ID NO: 9352843 - DNA, 22 bp, Homo sapiens
acctggatgctggccttgcctt

SEQ ID NO: 9352844 - DNA, 22 bp, Homo sapiens
acctggcacacactggggagtg

SEQ ID NO: 9352845 - DNA, 22 bp, Homo sapiens
acctggcacacactggggagtg

SEQ ID NO: 9352846 - DNA, 22 bp, Homo sapiens
acctggcacagagtatgctctc

SEQ ID NO: 9352847 - DNA, 22 bp, Homo sapiens
acctggcacattctaccacagt

SEQ ID NO: 9352848 - DNA, 22 bp, Homo sapiens
aggtctcttgctgtctctgggc

SEQ ID NO: 9352849 - DNA, 22 bp, Homo sapiens
aggtctcttgctgtctctgggc

SEQ ID NO: 9352850 - DNA, 22 bp, Homo sapiens
acctggagcttccaactcaact

SEQ ID NO: 9352851 - DNA, 22 bp, Homo sapiens
acctggaggcagaggttgcagt

SEQ ID NO: 9352852 - DNA, 22 bp, Homo sapiens
acctggaggcagaggttgcagt

SEQ ID NO: 9352853 - DNA, 22 bp, Homo sapiens
acctggagggaagttctgactt

SEQ ID NO: 9352854 - DNA, 22 bp, Homo sapiens
acctggagggaagttctgactt

SEQ ID NO: 9352855 - DNA, 22 bp, Homo sapiens
aggtggccaataaatgttggag

SEQ ID NO: 9352856 - DNA, 22 bp, Homo sapiens
aggtggccaagactgtttgaca

SEQ ID NO: 9352857 - DNA, 22 bp, Homo sapiens
aggtggcatgcctgagacataa

SEQ ID NO: 9352858 - DNA, 22 bp, Homo sapiens
aggtggcatttacaccatggga

SEQ ID NO: 9352859 - DNA, 20 bp, Homo sapiens
aggtggcccattatagtgga

SEQ ID NO: 9352860 - DNA, 22 bp, Homo sapiens
aggtggcccagctgacagatag

SEQ ID NO: 9352861 - DNA, 22 bp, Homo sapiens
aggtggccccaggcctctgcca

SEQ ID NO: 9352862 - DNA, 19 bp, Homo sapiens
aggtggccatgtccagcct

SEQ ID NO: 9352863 - DNA, 19 bp, Homo sapiens
aggtggccatgtccagcct

SEQ ID NO: 9352864 - DNA, 23 bp, Homo sapiens
aggtggccaccagaatgttaagg

SEQ ID NO: 9352865 - DNA, 21 bp, Homo sapiens
aggtggccacaaatctgtttc

SEQ ID NO: 9352866 - DNA, 18 bp, Homo sapiens
aggtggcctgggagcttt

SEQ ID NO: 9352867 - DNA, 22 bp, Homo sapiens
aggtggccggtgccagccgggc

SEQ ID NO: 9352868 - DNA, 18 bp, Homo sapiens
aggtggcctgggagcttt

SEQ ID NO: 9352869 - DNA, 18 bp, Homo sapiens
aggtggcctgggagcttt

SEQ ID NO: 9352870 - DNA, 22 bp, Homo sapiens
aggtggcctaaggtggcactgg

SEQ ID NO: 9352871 - DNA, 22 bp, Homo sapiens
aggtggctcctcccatggctgg

SEQ ID NO: 9352872 - DNA, 22 bp, Homo sapiens
aggtggctcccagtgttgttgt

SEQ ID NO: 9352873 - DNA, 22 bp, Homo sapiens
aggtggctatgaggatgcagtc

SEQ ID NO: 9352874 - DNA, 22 bp, Homo sapiens
aggtggctatgaggatgcagtc

SEQ ID NO: 9352875 - DNA, 22 bp, Homo sapiens
aggtggctatgaggatgcagtc

SEQ ID NO: 9352876 - DNA, 23 bp, Homo sapiens
aggtggcctttgcctctttctct

SEQ ID NO: 9352877 - DNA, 22 bp, Homo sapiens
acctggcactacaggcacctgt

SEQ ID NO: 9352878 - DNA, 22 bp, Homo sapiens
acctggcactacaggcacctgt

SEQ ID NO: 9352879 - DNA, 22 bp, Homo sapiens
acctggcataagggcttgagtc

SEQ ID NO: 9352880 - DNA, 22 bp, Homo sapiens
acctggcaggaaggtgggtgat

SEQ ID NO: 9352881 - DNA, 22 bp, Homo sapiens
acctggcaggaaggtgggtgat

SEQ ID NO: 9352882 - DNA, 22 bp, Homo sapiens
acctggcatgaagcatgcctta

SEQ ID NO: 9352883 - DNA, 22 bp, Homo sapiens
acctggcatgaagcatgcctta

SEQ ID NO: 9352884 - DNA, 22 bp, Homo sapiens
acctggccagtggggccgcgct

SEQ ID NO: 9352885 - DNA, 22 bp, Homo sapiens
aggtggagatcagggactaagg

SEQ ID NO: 9352886 - DNA, 22 bp, Homo sapiens
acctggctgagaacgtgcagct

SEQ ID NO: 9352887 - DNA, 22 bp, Homo sapiens
aggtggcatgcctgagacataa

SEQ ID NO: 9352888 - DNA, 22 bp, Homo sapiens
aggtggagatcagggactaagg

SEQ ID NO: 9352889 - DNA, 20 bp, Homo sapiens
acctggctctcaggagcaac

SEQ ID NO: 9352890 - DNA, 22 bp, Homo sapiens
agtaaaattgtattggaaaaca

SEQ ID NO: 9352891 - DNA, 22 bp, Homo sapiens
agtaaacacgtggggtttcttt

SEQ ID NO: 9352892 - DNA, 22 bp, Homo sapiens
agtaaaacagagaaatcactca

SEQ ID NO: 9352893 - DNA, 22 bp, Homo sapiens
agtaaaatcaccatctctttgt

SEQ ID NO: 9352894 - DNA, 22 bp, Homo sapiens
agtaaaattaatggatcagaag

SEQ ID NO: 9352895 - DNA, 22 bp, Homo sapiens
agtaaaatcaccatctctttgt

SEQ ID NO: 9352896 - DNA, 22 bp, Homo sapiens
agtaaacagaaagcaagatgat

SEQ ID NO: 9352897 - DNA, 22 bp, Homo sapiens
agtaaacagaaagcaagatgat

SEQ ID NO: 9352898 - DNA, 22 bp, Homo sapiens
agtaaacagaaagcaagatgat

SEQ ID NO: 9352899 - DNA, 22 bp, Homo sapiens
actagaaattactcagaataaa

SEQ ID NO: 9352900 - DNA, 22 bp, Homo sapiens
actagctgtgacagctgcgtgt

SEQ ID NO: 9352901 - DNA, 22 bp, Homo sapiens
acggcaggctcagagctggaat

SEQ ID NO: 9352902 - DNA, 22 bp, Homo sapiens
agtaaaaattgaggtgcaaaat

SEQ ID NO: 9352903 - DNA, 22 bp, Homo sapiens
agtaaaaattgaggtgcaaaat

SEQ ID NO: 9352904 - DNA, 22 bp, Homo sapiens
acgcctgtaatcccagcacttt

SEQ ID NO: 9352905 - DNA, 23 bp, Homo sapiens
acgctgggtggccagaacgacag

SEQ ID NO: 9352906 - DNA, 23 bp, Homo sapiens
acgctgggtggccagaacgacag

SEQ ID NO: 9352907 - DNA, 21 bp, Homo sapiens
acgctgcaccacgttctgcgg

SEQ ID NO: 9352908 - DNA, 21 bp, Homo sapiens
acgctggggatggggtctaga

SEQ ID NO: 9352909 - DNA, 22 bp, Homo sapiens
acgcagtttgtggacatttttt

SEQ ID NO: 9352910 - DNA, 22 bp, Homo sapiens
acgcctctgcagctgccgggcc

SEQ ID NO: 9352911 - DNA, 22 bp, Homo sapiens
acgcaggagtgggtggagtgga

SEQ ID NO: 9352912 - DNA, 22 bp, Homo sapiens
acgatgatgaaagagaacattc

SEQ ID NO: 9352913 - DNA, 20 bp, Homo sapiens
aggtggctcctgctgggggt

SEQ ID NO: 9352914 - DNA, 20 bp, Homo sapiens
aggtggctcctgctgggggt

SEQ ID NO: 9352915 - DNA, 20 bp, Homo sapiens
aggtggctcctgctgggggt

SEQ ID NO: 9352916 - DNA, 20 bp, Homo sapiens
aggtggctcctgctgggggt

SEQ ID NO: 9352917 - DNA, 22 bp, Homo sapiens
aggtggctcctcccatggctgg

SEQ ID NO: 9352918 - DNA, 22 bp, Homo sapiens
aggtggctcctcccatggctgg

SEQ ID NO: 9352919 - DNA, 22 bp, Homo sapiens
aggtggctcctcccatggctgg

SEQ ID NO: 9352920 - DNA, 22 bp, Homo sapiens
actcaggaagaaagcagctggt

SEQ ID NO: 9352921 - DNA, 22 bp, Homo sapiens
actcaggaaattgagataatgg

SEQ ID NO: 9352922 - DNA, 22 bp, Homo sapiens
actcaggaaatgagaggctctc

SEQ ID NO: 9352923 - DNA, 22 bp, Homo sapiens
agtcaaatgagtaaatatataa

SEQ ID NO: 9352924 - DNA, 22 bp, Homo sapiens
agtcaacaaaaatgtggagcct

SEQ ID NO: 9352925 - DNA, 22 bp, Homo sapiens
agtcaaataagactgtcataag

SEQ ID NO: 9352926 - DNA, 19 bp, Homo sapiens
actcaggcaatgagaaaca

SEQ ID NO: 9352927 - DNA, 19 bp, Homo sapiens
actcaggcaatgagaaaca

SEQ ID NO: 9352928 - DNA, 21 bp, Homo sapiens
actcaggcaccaggggatggc

SEQ ID NO: 9352929 - DNA, 22 bp, Homo sapiens
actcaggcactcagccctcgcc

SEQ ID NO: 9352930 - DNA, 21 bp, Homo sapiens
actcaggcaccaggggatggc

SEQ ID NO: 9352931 - DNA, 22 bp, Homo sapiens
actcaggcctccttctgtcctt

SEQ ID NO: 9352932 - DNA, 22 bp, Homo sapiens
actcaggcctccttctgtcctt

SEQ ID NO: 9352933 - DNA, 22 bp, Homo sapiens
actcaggccccatcgcccatct

SEQ ID NO: 9352934 - DNA, 22 bp, Homo sapiens
actcaggctacaacgcgtggct

SEQ ID NO: 9352935 - DNA, 22 bp, Homo sapiens
actcaggctacaggggcagaag

SEQ ID NO: 9352936 - DNA, 22 bp, Homo sapiens
actcaggctagggaaaaagtgg

SEQ ID NO: 9352937 - DNA, 22 bp, Homo sapiens
agtccaggcgggtatagaggct

SEQ ID NO: 9352938 - DNA, 22 bp, Homo sapiens
agtccaggcgggtatagaggct

SEQ ID NO: 9352939 - DNA, 22 bp, Homo sapiens
actcaggcttcaggcacagctg

SEQ ID NO: 9352940 - DNA, 22 bp, Homo sapiens
actcaggctgttttttccttgt

SEQ ID NO: 9352941 - DNA, 22 bp, Homo sapiens
agtcccagctctgccacttact

SEQ ID NO: 9352942 - DNA, 22 bp, Homo sapiens
actagtattgcctactgtacat

SEQ ID NO: 9352943 - DNA, 22 bp, Homo sapiens
actaggggctcaggcccaggga

SEQ ID NO: 9352944 - DNA, 22 bp, Homo sapiens
actagtattagactaaaagtca

SEQ ID NO: 9352945 - DNA, 22 bp, Homo sapiens
agtatactgaaagtaaatatga

SEQ ID NO: 9352946 - DNA, 22 bp, Homo sapiens
agtatttcttcatatgattact

SEQ ID NO: 9352947 - DNA, 22 bp, Homo sapiens
agtatacatatattagccttcg

SEQ ID NO: 9352948 - DNA, 22 bp, Homo sapiens
actaggggctcaggcccaggga

SEQ ID NO: 9352949 - DNA, 22 bp, Homo sapiens
actagggaaagttatgttcaca

SEQ ID NO: 9352950 - DNA, 22 bp, Homo sapiens
actaggaaggcatatgggcaga

SEQ ID NO: 9352951 - DNA, 21 bp, Homo sapiens
actagctttctggagaagtgt

SEQ ID NO: 9352952 - DNA, 22 bp, Homo sapiens
actagctttacagcatgagtgg

SEQ ID NO: 9352953 - DNA, 22 bp, Homo sapiens
actagcttgggcctgggtcaga

SEQ ID NO: 9352954 - DNA, 22 bp, Homo sapiens
agtatttggtgtggtattgacc

SEQ ID NO: 9352955 - DNA, 22 bp, Homo sapiens
agaaagttctgtgagttgttca

SEQ ID NO: 9352956 - DNA, 22 bp, Homo sapiens
agaaagttgttttagccaaacc

SEQ ID NO: 9352957 - DNA, 22 bp, Homo sapiens
agaaagttgttggaggaaatga

SEQ ID NO: 9352958 - DNA, 22 bp, Homo sapiens
agaaagttcactggtatatttt

SEQ ID NO: 9352959 - DNA, 22 bp, Homo sapiens
agaaagttatcacaaaattgag

SEQ ID NO: 9352960 - DNA, 22 bp, Homo sapiens
agaaagttagcagactcttggc

SEQ ID NO: 9352961 - DNA, 22 bp, Homo sapiens
agaaagttagcagactcttggc

SEQ ID NO: 9352962 - DNA, 22 bp, Homo sapiens
agaaagttaaacagtgataaga

SEQ ID NO: 9352963 - DNA, 22 bp, Homo sapiens
agaaagtctgctttctggatgg

SEQ ID NO: 9352964 - DNA, 22 bp, Homo sapiens
agaaagggttctctgaggtgct

SEQ ID NO: 9352965 - DNA, 22 bp, Homo sapiens
agaaagggtcactgaaagagga

SEQ ID NO: 9352966 - DNA, 22 bp, Homo sapiens
agaaagggtcactgaaagagga

SEQ ID NO: 9352967 - DNA, 22 bp, Homo sapiens
agaaagggctattttgaggtag

SEQ ID NO: 9352968 - DNA, 22 bp, Homo sapiens
agaaagggctattttgaggtag

SEQ ID NO: 9352969 - DNA, 22 bp, Homo sapiens
agaaaggtggatgctctggaat

SEQ ID NO: 9352970 - DNA, 23 bp, Homo sapiens
agaaagtcatggccaggtttgat

SEQ ID NO: 9352971 - DNA, 22 bp, Homo sapiens
agaaaggtcaaaatcgtgacat

SEQ ID NO: 9352972 - DNA, 22 bp, Homo sapiens
agaaaggtcacttagcctcagc

SEQ ID NO: 9352973 - DNA, 22 bp, Homo sapiens
agaaagggttctctgaggtgct

SEQ ID NO: 9352974 - DNA, 22 bp, Homo sapiens
agaaagggttctctgaggtgct

SEQ ID NO: 9352975 - DNA, 22 bp, Homo sapiens
agaaagggttctctgaggtgct

SEQ ID NO: 9352976 - DNA, 22 bp, Homo sapiens
agaacagcagcacgtcaagctg

SEQ ID NO: 9352977 - DNA, 22 bp, Homo sapiens
agaacagaggccttatgtttca

SEQ ID NO: 9352978 - DNA, 22 bp, Homo sapiens
agaacagaggccttatgtttca

SEQ ID NO: 9352979 - DNA, 23 bp, Homo sapiens
agaaagtttgtgccttgtgacac

SEQ ID NO: 9352980 - DNA, 22 bp, Homo sapiens
agaaagtttggggctgggcacg

SEQ ID NO: 9352981 - DNA, 22 bp, Homo sapiens
agaaagtttattcctatctagc

SEQ ID NO: 9352982 - DNA, 22 bp, Homo sapiens
agaaagtttatttcttgatgga

SEQ ID NO: 9352983 - DNA, 22 bp, Homo sapiens
agaaagtttgagaactgtagat

SEQ ID NO: 9352984 - DNA, 22 bp, Homo sapiens
agaaagtttgagaactgtagat

SEQ ID NO: 9352985 - DNA, 22 bp, Homo sapiens
agaaattatgcagtagttttat

SEQ ID NO: 9352986 - DNA, 22 bp, Homo sapiens
agaacacatagagaagttttat

SEQ ID NO: 9352987 - DNA, 22 bp, Homo sapiens
agaacactctcctgaaaattaa

SEQ ID NO: 9352988 - DNA, 22 bp, Homo sapiens
agaacactgctagtataatcac

SEQ ID NO: 9352989 - DNA, 22 bp, Homo sapiens
atcctgggcaaagtatgctgtc

SEQ ID NO: 9352990 - DNA, 22 bp, Homo sapiens
atcctttataagacttgtattc

SEQ ID NO: 9352991 - DNA, 18 bp, Homo sapiens
atcctgggagcagacagc

SEQ ID NO: 9352992 - DNA, 22 bp, Homo sapiens
atcatcttaaatctagaatgtg

SEQ ID NO: 9352993 - DNA, 22 bp, Homo sapiens
atcatcttaaatctagaatgtg

SEQ ID NO: 9352994 - DNA, 22 bp, Homo sapiens
atcatcttaaggtatctcaagc

SEQ ID NO: 9352995 - DNA, 22 bp, Homo sapiens
atcatcttaaggtatctcaagc

SEQ ID NO: 9352996 - DNA, 22 bp, Homo sapiens
atcatcttatctgactcatttt

SEQ ID NO: 9352997 - DNA, 22 bp, Homo sapiens
atcatcttcgaaaaaagtcaga

SEQ ID NO: 9352998 - DNA, 22 bp, Homo sapiens
atcatcttcatattcctcagct

SEQ ID NO: 9352999 - DNA, 22 bp, Homo sapiens
atcatcttgaaagtctatgttt

SEQ ID NO: 9353000 - DNA, 22 bp, Homo sapiens
atcatcttgaaagtctatgttt

SEQ ID NO: 9353001 - DNA, 22 bp, Homo sapiens
atcatcctattgtgccccaggt

SEQ ID NO: 9353002 - DNA, 19 bp, Homo sapiens
atcatcctgggtcatgcac

SEQ ID NO: 9353003 - DNA, 19 bp, Homo sapiens
atcatcctgggtcatgcac

SEQ ID NO: 9353004 - DNA, 22 bp, Homo sapiens
atcatcgtcccttctcttgtca

SEQ ID NO: 9353005 - DNA, 22 bp, Homo sapiens
atcatccagtttttcagcctct

SEQ ID NO: 9353006 - DNA, 22 bp, Homo sapiens
atcatccatggctgatcataaa

SEQ ID NO: 9353007 - DNA, 22 bp, Homo sapiens
atcatctggcattcagattggc

SEQ ID NO: 9353008 - DNA, 20 bp, Homo sapiens
atcatctcaaagctgaggtt

SEQ ID NO: 9353009 - DNA, 22 bp, Homo sapiens
atcatctagtttaactttcttt

SEQ ID NO: 9353010 - DNA, 22 bp, Homo sapiens
atcatctaaattgagtccagct

SEQ ID NO: 9353011 - DNA, 22 bp, Homo sapiens
agaacaggcagttggttggatt

SEQ ID NO: 9353012 - DNA, 22 bp, Homo sapiens
agaacaggaggaagccagctcc

SEQ ID NO: 9353013 - DNA, 22 bp, Homo sapiens
atcatccaagcgtagttcttct

SEQ ID NO: 9353014 - DNA, 22 bp, Homo sapiens
atcatccactggagccggcagg

SEQ ID NO: 9353015 - DNA, 22 bp, Homo sapiens
atcatccatctagcgcgggggg

SEQ ID NO: 9353016 - DNA, 22 bp, Homo sapiens
atcatccaagcgtagttcttct

SEQ ID NO: 9353017 - DNA, 22 bp, Homo sapiens
atcatcattcttggataaagca

SEQ ID NO: 9353018 - DNA, 22 bp, Homo sapiens
atctcaaatgattacaccaagc

SEQ ID NO: 9353019 - DNA, 21 bp, Homo sapiens
atctcacagcccagagaagcc

SEQ ID NO: 9353020 - DNA, 22 bp, Homo sapiens
atctaataccctctttatttct

SEQ ID NO: 9353021 - DNA, 22 bp, Homo sapiens
atctaaagtgtcataagtagct

SEQ ID NO: 9353022 - DNA, 20 bp, Homo sapiens
atcggcttgcctggaaacaa

SEQ ID NO: 9353023 - DNA, 22 bp, Homo sapiens
actttcaagccctctagagaca

SEQ ID NO: 9353024 - DNA, 22 bp, Homo sapiens
actttcagaattgtacagagtc

SEQ ID NO: 9353025 - DNA, 22 bp, Homo sapiens
actttcatttgtaataaacttc

SEQ ID NO: 9353026 - DNA, 22 bp, Homo sapiens
actttcatttgtaataaacttc

SEQ ID NO: 9353027 - DNA, 22 bp, Homo sapiens
actttcctagacttcagtgaca

SEQ ID NO: 9353028 - DNA, 22 bp, Homo sapiens
actttctcaggaattcacagac

SEQ ID NO: 9353029 - DNA, 22 bp, Homo sapiens
actttctattcccacagagata

SEQ ID NO: 9353030 - DNA, 22 bp, Homo sapiens
actttctattgtttagattctg

SEQ ID NO: 9353031 - DNA, 22 bp, Homo sapiens
actttctccagaaaaccaagga

SEQ ID NO: 9353032 - DNA, 22 bp, Homo sapiens
actttctcccacccacccgtct

SEQ ID NO: 9353033 - DNA, 20 bp, Homo sapiens
actttctcggtttctcacct

SEQ ID NO: 9353034 - DNA, 20 bp, Homo sapiens
actttctcggtttctcacct

SEQ ID NO: 9353035 - DNA, 22 bp, Homo sapiens
atatggaagagcctgggaattt

SEQ ID NO: 9353036 - DNA, 22 bp, Homo sapiens
agaaaaggttgaaagtaggatt

SEQ ID NO: 9353037 - DNA, 22 bp, Homo sapiens
atatggacttaaaatttgatgt

SEQ ID NO: 9353038 - DNA, 22 bp, Homo sapiens
atatggagaactcaaaaagtga

SEQ ID NO: 9353039 - DNA, 22 bp, Homo sapiens
atattacacacggtatcacggg

SEQ ID NO: 9353040 - DNA, 22 bp, Homo sapiens
atattacacacggtatcacggg

SEQ ID NO: 9353041 - DNA, 22 bp, Homo sapiens
atattacacacggtatcacggg

SEQ ID NO: 9353042 - DNA, 22 bp, Homo sapiens
atattacacacggtatcacggg

SEQ ID NO: 9353043 - DNA, 21 bp, Homo sapiens
agaaaagtatttgaatcaaga

SEQ ID NO: 9353044 - DNA, 21 bp, Homo sapiens
agaaaagtatttgaatcaaga

SEQ ID NO: 9353045 - DNA, 22 bp, Homo sapiens
atattcttccaaaacatcattt

SEQ ID NO: 9353046 - DNA, 22 bp, Homo sapiens
atatttataaggcaggcaagta

SEQ ID NO: 9353047 - DNA, 22 bp, Homo sapiens
atatttataagcaagcaggact

SEQ ID NO: 9353048 - DNA, 22 bp, Homo sapiens
atattcttccaaaacatcattt

SEQ ID NO: 9353049 - DNA, 23 bp, Homo sapiens
atatttccaggttagtgaggtaa

SEQ ID NO: 9353050 - DNA, 22 bp, Homo sapiens
atatttcatggggttccatact

SEQ ID NO: 9353051 - DNA, 21 bp, Homo sapiens
atatttctcataaggttatgg

SEQ ID NO: 9353052 - DNA, 22 bp, Homo sapiens
agaaagctccccatgagatgat

SEQ ID NO: 9353053 - DNA, 21 bp, Homo sapiens
atatttctcataaggttatgg

SEQ ID NO: 9353054 - DNA, 21 bp, Homo sapiens
atatttctcataaggttatgg

SEQ ID NO: 9353055 - DNA, 21 bp, Homo sapiens
atatttctcataaggttatgg

SEQ ID NO: 9353056 - DNA, 23 bp, Homo sapiens
atatttccaggttagtgaggtaa

SEQ ID NO: 9353057 - DNA, 22 bp, Homo sapiens
atatttataaggcaggcaagta

SEQ ID NO: 9353058 - DNA, 22 bp, Homo sapiens
atatttcacgtaggttgttttc

SEQ ID NO: 9353059 - DNA, 22 bp, Homo sapiens
atatttcacgtaggttgttttc

SEQ ID NO: 9353060 - DNA, 21 bp, Homo sapiens
atatttcagatttccgtaatc

SEQ ID NO: 9353061 - DNA, 22 bp, Homo sapiens
atatttcagctttacttaggaa

SEQ ID NO: 9353062 - DNA, 22 bp, Homo sapiens
atatttcagctttacttaggaa

SEQ ID NO: 9353063 - DNA, 22 bp, Homo sapiens
atatttcaggttttgcaggccg

SEQ ID NO: 9353064 - DNA, 20 bp, Homo sapiens
atatttcaggtagtgtgccc

SEQ ID NO: 9353065 - DNA, 22 bp, Homo sapiens
acttcttcttcagctgggggat

SEQ ID NO: 9353066 - DNA, 22 bp, Homo sapiens
acttctgtatgtcctgcattca

SEQ ID NO: 9353067 - DNA, 22 bp, Homo sapiens
acttctgtcctccaagccacgt

SEQ ID NO: 9353068 - DNA, 22 bp, Homo sapiens
acttctgtatgtcctgcattca

SEQ ID NO: 9353069 - DNA, 22 bp, Homo sapiens
atacatgttcgtgtacatgttc

SEQ ID NO: 9353070 - DNA, 22 bp, Homo sapiens
atacatgttcgtgtacatgttc

SEQ ID NO: 9353071 - DNA, 22 bp, Homo sapiens
atacattagctcatatgattaa

SEQ ID NO: 9353072 - DNA, 22 bp, Homo sapiens
atacattagctcatatgattaa

SEQ ID NO: 9353073 - DNA, 22 bp, Homo sapiens
atacattattgttaaagaacat

SEQ ID NO: 9353074 - DNA, 22 bp, Homo sapiens
atacattagtgaacaaaagaga

SEQ ID NO: 9353075 - DNA, 22 bp, Homo sapiens
atacattagtgaacaaaagaga

SEQ ID NO: 9353076 - DNA, 22 bp, Homo sapiens
atacatgttgagaaaatatctg

SEQ ID NO: 9353077 - DNA, 22 bp, Homo sapiens
atacatgttgtaccatatgttt

SEQ ID NO: 9353078 - DNA, 22 bp, Homo sapiens
atacatgttgtaccatatgttt

SEQ ID NO: 9353079 - DNA, 22 bp, Homo sapiens
actttatcaggaatcacacagc

SEQ ID NO: 9353080 - DNA, 23 bp, Homo sapiens
actttatcctatatctttgttct

SEQ ID NO: 9353081 - DNA, 22 bp, Homo sapiens
actttcaaatatcatgattcta

SEQ ID NO: 9353082 - DNA, 22 bp, Homo sapiens
actttatttcctattgcatcca

SEQ ID NO: 9353083 - DNA, 22 bp, Homo sapiens
atactgtagaggcatagctagt

SEQ ID NO: 9353084 - DNA, 22 bp, Homo sapiens
atactgtagttgtccaactatc

SEQ ID NO: 9353085 - DNA, 22 bp, Homo sapiens
atactgtatcacttgtgagtga

SEQ ID NO: 9353086 - DNA, 22 bp, Homo sapiens
atactgtatatttcacatcttg

SEQ ID NO: 9353087 - DNA, 22 bp, Homo sapiens
atacattattgttaaagaacat

SEQ ID NO: 9353088 - DNA, 22 bp, Homo sapiens
atactgtaatacctaaatgaac

SEQ ID NO: 9353089 - DNA, 22 bp, Homo sapiens
atactgtaatacctaaatgaac

SEQ ID NO: 9353090 - DNA, 22 bp, Homo sapiens
atactgattgatattcccatga

SEQ ID NO: 9353091 - DNA, 22 bp, Homo sapiens
atacagcagtgaataagataaa

SEQ ID NO: 9353092 - DNA, 22 bp, Homo sapiens
atacagcttacagttctaatgc

SEQ ID NO: 9353093 - DNA, 22 bp, Homo sapiens
atacagccagcttcctgacctt

SEQ ID NO: 9353094 - DNA, 22 bp, Homo sapiens
atacagggacatccagtttttc

SEQ ID NO: 9353095 - DNA, 22 bp, Homo sapiens
atacagcttatgcatatatctc

SEQ ID NO: 9353096 - DNA, 22 bp, Homo sapiens
atacagcttacagttctaatgc

SEQ ID NO: 9353097 - DNA, 22 bp, Homo sapiens
atacagctttctttcacatgag

SEQ ID NO: 9353098 - DNA, 22 bp, Homo sapiens
acttctcttccccggaactcta

SEQ ID NO: 9353099 - DNA, 22 bp, Homo sapiens
acttctcttccccggaactcta

SEQ ID NO: 9353100 - DNA, 22 bp, Homo sapiens
acttctctttagtactaaatgt

SEQ ID NO: 9353101 - DNA, 22 bp, Homo sapiens
acttctctttagtactaaatgt

SEQ ID NO: 9353102 - DNA, 22 bp, Homo sapiens
acttactactcctttgcaattt

SEQ ID NO: 9353103 - DNA, 22 bp, Homo sapiens
atacacttgtacattttttaat

SEQ ID NO: 9353104 - DNA, 22 bp, Homo sapiens
atacagatgttaaagcaatttc

SEQ ID NO: 9353105 - DNA, 22 bp, Homo sapiens
atacagatgttaaagcaatttc

SEQ ID NO: 9353106 - DNA, 22 bp, Homo sapiens
ataatgcatttagaataattca

SEQ ID NO: 9353107 - DNA, 22 bp, Homo sapiens
ataatgccattgtctcatccag

SEQ ID NO: 9353108 - DNA, 22 bp, Homo sapiens
ataatgcatttagaataattca

SEQ ID NO: 9353109 - DNA, 21 bp, Homo sapiens
acttaaattccttgatattta

SEQ ID NO: 9353110 - DNA, 22 bp, Homo sapiens
acttaacagacattatttacct

SEQ ID NO: 9353111 - DNA, 22 bp, Homo sapiens
acttaaagttataatttgctaa

SEQ ID NO: 9353112 - DNA, 22 bp, Homo sapiens
actgggaagagagaattctgtc

SEQ ID NO: 9353113 - DNA, 19 bp, Homo sapiens
actgggaaaaaggcactgg

SEQ ID NO: 9353114 - DNA, 22 bp, Homo sapiens
actgggaaagtgctgcctgcag

SEQ ID NO: 9353115 - DNA, 22 bp, Homo sapiens
actgggaacaaggtgctcagcg

SEQ ID NO: 9353116 - DNA, 22 bp, Homo sapiens
actgggaagtcagagagaggct

SEQ ID NO: 9353117 - DNA, 23 bp, Homo sapiens
actgggaagtttggagagacgca

SEQ ID NO: 9353118 - DNA, 22 bp, Homo sapiens
actgtagagaatctgagaaaaa

SEQ ID NO: 9353119 - DNA, 22 bp, Homo sapiens
actgtagaggcctggattgagg

SEQ ID NO: 9353120 - DNA, 22 bp, Homo sapiens
actgtagctgccactggatgca

SEQ ID NO: 9353121 - DNA, 22 bp, Homo sapiens
actgtacatgcatcttgtctat

SEQ ID NO: 9353122 - DNA, 22 bp, Homo sapiens
actgtaaattttggttgcaggt

SEQ ID NO: 9353123 - DNA, 22 bp, Homo sapiens
actgtacatgtaaacattgtca

SEQ ID NO: 9353124 - DNA, 22 bp, Homo sapiens
actgtacatgtaaacattgtca

SEQ ID NO: 9353125 - DNA, 22 bp, Homo sapiens
actgtatagtatttattcttag

SEQ ID NO: 9353126 - DNA, 22 bp, Homo sapiens
actgtattctagtcatgtttgt

SEQ ID NO: 9353127 - DNA, 22 bp, Homo sapiens
actgtatagatggagttgattt

SEQ ID NO: 9353128 - DNA, 22 bp, Homo sapiens
actgtagtctaaatatagtctt

SEQ ID NO: 9353129 - DNA, 22 bp, Homo sapiens
actgtattggaaatatagcaaa

SEQ ID NO: 9353130 - DNA, 22 bp, Homo sapiens
actgtatttttgaatcattgtg

SEQ ID NO: 9353131 - DNA, 22 bp, Homo sapiens
actgtattttgggtgtattttc

SEQ ID NO: 9353132 - DNA, 22 bp, Homo sapiens
actgtcaaatgcaatgaactca

SEQ ID NO: 9353133 - DNA, 19 bp, Homo sapiens
actgtcacataaaggaagg

SEQ ID NO: 9353134 - DNA, 19 bp, Homo sapiens
actgtcacataaaggaagg

SEQ ID NO: 9353135 - DNA, 22 bp, Homo sapiens
ataaaaactgacccatcctttg

SEQ ID NO: 9353136 - DNA, 22 bp, Homo sapiens
ataaaaactgacccatcctttg

SEQ ID NO: 9353137 - DNA, 22 bp, Homo sapiens
actgtcatctggtagatgatgg

SEQ ID NO: 9353138 - DNA, 22 bp, Homo sapiens
actgtcactgacagaatcaaca

SEQ ID NO: 9353139 - DNA, 22 bp, Homo sapiens
actgtcactgtgatgttagaga

SEQ ID NO: 9353140 - DNA, 22 bp, Homo sapiens
actgtcacttgcaactgtgagg

SEQ ID NO: 9353141 - DNA, 22 bp, Homo sapiens
ataatgaatgcagagttatttt

SEQ ID NO: 9353142 - DNA, 22 bp, Homo sapiens
ataatccatgtctagagtaaag

SEQ ID NO: 9353143 - DNA, 22 bp, Homo sapiens
actgtgcattccccaacctgtg

SEQ ID NO: 9353144 - DNA, 22 bp, Homo sapiens
ataaggttggtcttaactacct

SEQ ID NO: 9353145 - DNA, 22 bp, Homo sapiens
actgtgcaccctggacagtgtc

SEQ ID NO: 9353146 - DNA, 22 bp, Homo sapiens
actgtgcaggtagatgcctggg

SEQ ID NO: 9353147 - DNA, 22 bp, Homo sapiens
ataaacagtaaatgtgagcagt

SEQ ID NO: 9353148 - DNA, 22 bp, Homo sapiens
actgtgatgttctctatcttgg

SEQ ID NO: 9353149 - DNA, 22 bp, Homo sapiens
actgtgagtgatttccttctgg

SEQ ID NO: 9353150 - DNA, 21 bp, Homo sapiens
actgtgataatgctttttctg

SEQ ID NO: 9353151 - DNA, 22 bp, Homo sapiens
actgtgagtgatttccttctgg

SEQ ID NO: 9353152 - DNA, 22 bp, Homo sapiens
actgtgcaaatgacaggcacac

SEQ ID NO: 9353153 - DNA, 22 bp, Homo sapiens
actgtgcaaatgacaggcacac

SEQ ID NO: 9353154 - DNA, 22 bp, Homo sapiens
ataaaatttgctactgttaaat

SEQ ID NO: 9353155 - DNA, 22 bp, Homo sapiens
ataaaatttgctactgttaaat

SEQ ID NO: 9353156 - DNA, 22 bp, Homo sapiens
ataaaatttgctactgttaaat

SEQ ID NO: 9353157 - DNA, 22 bp, Homo sapiens
ataaaatggtaaacgaagctga

SEQ ID NO: 9353158 - DNA, 22 bp, Homo sapiens
ataaaatggtaaacgaagctga

SEQ ID NO: 9353159 - DNA, 22 bp, Homo sapiens
ataaaaactgacccatcctttg

SEQ ID NO: 9353160 - DNA, 22 bp, Homo sapiens
gtctaagtgggtggcactgaca

SEQ ID NO: 9353161 - DNA, 22 bp, Homo sapiens
gtctacatgtgttcttaagaga

SEQ ID NO: 9353162 - DNA, 22 bp, Homo sapiens
gtctacaaagcatataaaagag

SEQ ID NO: 9353163 - DNA, 22 bp, Homo sapiens
gtctagaattgcttggcagatg

SEQ ID NO: 9353164 - DNA, 22 bp, Homo sapiens
gtctactttttaatcttggcag

SEQ ID NO: 9353165 - DNA, 22 bp, Homo sapiens
gtctccagatatcctacacaac

SEQ ID NO: 9353166 - DNA, 22 bp, Homo sapiens
gtctccagaggttacatcctgt

SEQ ID NO: 9353167 - DNA, 22 bp, Homo sapiens
gtctatgtgtaatagcatgtgt

SEQ ID NO: 9353168 - DNA, 22 bp, Homo sapiens
gtctatgtaaacgtctacatta

SEQ ID NO: 9353169 - DNA, 22 bp, Homo sapiens
gtctataagcaggggaaaactt

SEQ ID NO: 9353170 - DNA, 22 bp, Homo sapiens
gtctagagaggaaggaagtgtg

SEQ ID NO: 9353171 - DNA, 22 bp, Homo sapiens
gtctatgatattttgttatagc

SEQ ID NO: 9353172 - DNA, 22 bp, Homo sapiens
gtctatgtaaacgtctacatta

SEQ ID NO: 9353173 - DNA, 22 bp, Homo sapiens
gtctatgtaaacgtctacatta

SEQ ID NO: 9353174 - DNA, 22 bp, Homo sapiens
gtctccagttacagcagccagg

SEQ ID NO: 9353175 - DNA, 19 bp, Homo sapiens
gtcttggctctcaaccatc

SEQ ID NO: 9353176 - DNA, 22 bp, Homo sapiens
gtcttgcacttacctaagaact

SEQ ID NO: 9353177 - DNA, 22 bp, Homo sapiens
gtctttatatttactaaagaat

SEQ ID NO: 9353178 - DNA, 22 bp, Homo sapiens
gtctttatggtatgaaaactga

SEQ ID NO: 9353179 - DNA, 22 bp, Homo sapiens
gtcttgtttgggatgtggatgg

SEQ ID NO: 9353180 - DNA, 22 bp, Homo sapiens
gtcttgtcagtgttggcagctt

SEQ ID NO: 9353181 - DNA, 22 bp, Homo sapiens
gtcttgttggagttcttgcagc

SEQ ID NO: 9353182 - DNA, 22 bp, Homo sapiens
gtcttgttaagattttggaata

SEQ ID NO: 9353183 - DNA, 22 bp, Homo sapiens
gtcttgtcccagctctgccact

SEQ ID NO: 9353184 - DNA, 22 bp, Homo sapiens
gtctttctatgcatagagcaga

SEQ ID NO: 9353185 - DNA, 22 bp, Homo sapiens
gtctttctatgcatagagcaga

SEQ ID NO: 9353186 - DNA, 22 bp, Homo sapiens
gtctttctatgcatagagcaga

SEQ ID NO: 9353187 - DNA, 21 bp, Homo sapiens
gtcttttaagtgaagagaggc

SEQ ID NO: 9353188 - DNA, 22 bp, Homo sapiens
gtctttcactgcggtttacatg

SEQ ID NO: 9353189 - DNA, 22 bp, Homo sapiens
gtctttcatggatattcagttt

SEQ ID NO: 9353190 - DNA, 21 bp, Homo sapiens
gtctttctacctctatgtggc

SEQ ID NO: 9353191 - DNA, 21 bp, Homo sapiens
gtctttctacctctatgtggc

SEQ ID NO: 9353192 - DNA, 22 bp, Homo sapiens
gtctttcatggatattcagttt

SEQ ID NO: 9353193 - DNA, 22 bp, Homo sapiens
gtctttctatgatgaactgttg

SEQ ID NO: 9353194 - DNA, 22 bp, Homo sapiens
gtctttctatgatgaactgttg

SEQ ID NO: 9353195 - DNA, 22 bp, Homo sapiens
gtgaaaaatgatttgttaactg

SEQ ID NO: 9353196 - DNA, 22 bp, Homo sapiens
gtgagcagtggccagggtccta

SEQ ID NO: 9353197 - DNA, 22 bp, Homo sapiens
gtgaaaaatcatcatgacttga

SEQ ID NO: 9353198 - DNA, 22 bp, Homo sapiens
gtgaaaaatcatcatgacttga

SEQ ID NO: 9353199 - DNA, 22 bp, Homo sapiens
gtgaggaagtgtttgtcaaatt

SEQ ID NO: 9353200 - DNA, 22 bp, Homo sapiens
gtgagctgttggagtggcagag

SEQ ID NO: 9353201 - DNA, 22 bp, Homo sapiens
gtgagctttgtggtaatgaagt

SEQ ID NO: 9353202 - DNA, 22 bp, Homo sapiens
gtgaggagggctggtcccaggc

SEQ ID NO: 9353203 - DNA, 22 bp, Homo sapiens
gtgaggagtctgaagcacataa

SEQ ID NO: 9353204 - DNA, 22 bp, Homo sapiens
gtgaggagggctggtcccaggc

SEQ ID NO: 9353205 - DNA, 22 bp, Homo sapiens
gtgaggagctgacactggggtg

SEQ ID NO: 9353206 - DNA, 22 bp, Homo sapiens
gtgaggagctctttgactcacg

SEQ ID NO: 9353207 - DNA, 22 bp, Homo sapiens
gtgaggagctctttgactcacg

SEQ ID NO: 9353208 - DNA, 22 bp, Homo sapiens
gtgaggagctgacactggggtg

SEQ ID NO: 9353209 - DNA, 22 bp, Homo sapiens
gtgagccattctactcctaacc

SEQ ID NO: 9353210 - DNA, 22 bp, Homo sapiens
gtgagctggaatagtggagaaa

SEQ ID NO: 9353211 - DNA, 22 bp, Homo sapiens
gtgagcagtggccagggtccta

SEQ ID NO: 9353212 - DNA, 22 bp, Homo sapiens
gtgagccattctactcctaacc

SEQ ID NO: 9353213 - DNA, 22 bp, Homo sapiens
gtgagccagttcgactgtttct

SEQ ID NO: 9353214 - DNA, 22 bp, Homo sapiens
gtgagccagttcgactgtttct

SEQ ID NO: 9353215 - DNA, 22 bp, Homo sapiens
gtgagccaataccatgctgttc

SEQ ID NO: 9353216 - DNA, 18 bp, Homo sapiens
gtgccaggaggcgcagcc

SEQ ID NO: 9353217 - DNA, 18 bp, Homo sapiens
gtgccaggaggcgcagcc

SEQ ID NO: 9353218 - DNA, 18 bp, Homo sapiens
gtgccaggaggcgcagcc

SEQ ID NO: 9353219 - DNA, 20 bp, Homo sapiens
gtgccaggcaagacaggtgg

SEQ ID NO: 9353220 - DNA, 18 bp, Homo sapiens
gtgccaggaggcgcagcc

SEQ ID NO: 9353221 - DNA, 18 bp, Homo sapiens
gtgccaggaggcgcagcc

SEQ ID NO: 9353222 - DNA, 22 bp, Homo sapiens
gtgccagcctggtgcgcctggg

SEQ ID NO: 9353223 - DNA, 22 bp, Homo sapiens
gtgccagccgcaccccaggaga

SEQ ID NO: 9353224 - DNA, 22 bp, Homo sapiens
gtgccagcctggtgcgcctggg

SEQ ID NO: 9353225 - DNA, 20 bp, Homo sapiens
gtgccaggcaagacaggtgg

SEQ ID NO: 9353226 - DNA, 22 bp, Homo sapiens
gtgccaggcccagggagcgggg

SEQ ID NO: 9353227 - DNA, 22 bp, Homo sapiens
gtgccaggcccagggagcgggg

SEQ ID NO: 9353228 - DNA, 22 bp, Homo sapiens
gtgccaggcccagggagcgggg

SEQ ID NO: 9353229 - DNA, 22 bp, Homo sapiens
gtgccagggagtggaggagctt

SEQ ID NO: 9353230 - DNA, 22 bp, Homo sapiens
gtgccagggagtggaggagctt

SEQ ID NO: 9353231 - DNA, 22 bp, Homo sapiens
gtgccagggagtggaggagctt

SEQ ID NO: 9353232 - DNA, 22 bp, Homo sapiens
gtgccagggagtggaggagctt

SEQ ID NO: 9353233 - DNA, 22 bp, Homo sapiens
gtgccaggtgctaagctgtgct

SEQ ID NO: 9353234 - DNA, 22 bp, Homo sapiens
gtgccagggggcactgaacaga

SEQ ID NO: 9353235 - DNA, 22 bp, Homo sapiens
gtgccagggagtggaggagctt

SEQ ID NO: 9353236 - DNA, 22 bp, Homo sapiens
gtgccagtctctgagttaggac

SEQ ID NO: 9353237 - DNA, 22 bp, Homo sapiens
gtgccaggtgctaagctgtgct

SEQ ID NO: 9353238 - DNA, 22 bp, Homo sapiens
gtgcccagcagcagcgtccccg

SEQ ID NO: 9353239 - DNA, 22 bp, Homo sapiens
gtgcccagctccacctcacaga

SEQ ID NO: 9353240 - DNA, 22 bp, Homo sapiens
gtgctgaataacagtagaaatt

SEQ ID NO: 9353241 - DNA, 18 bp, Homo sapiens
gtgctgaataactacttt

SEQ ID NO: 9353242 - DNA, 22 bp, Homo sapiens
gtgctgaatccactcttaggaa

SEQ ID NO: 9353243 - DNA, 22 bp, Homo sapiens
gtgcccaggcccaaggcaccac

SEQ ID NO: 9353244 - DNA, 22 bp, Homo sapiens
gtgcccaggcccaaggcaccac

SEQ ID NO: 9353245 - DNA, 22 bp, Homo sapiens
gtgctgaatttgagaaactctg

SEQ ID NO: 9353246 - DNA, 22 bp, Homo sapiens
gtgctgaattgtgctctttaca

SEQ ID NO: 9353247 - DNA, 22 bp, Homo sapiens
gtgctgaattggagatgctcct

SEQ ID NO: 9353248 - DNA, 22 bp, Homo sapiens
gtgctgaattggagatgctcct

SEQ ID NO: 9353249 - DNA, 22 bp, Homo sapiens
gtgctgacaggagcctggcggt

SEQ ID NO: 9353250 - DNA, 22 bp, Homo sapiens
gtgctgagtgcagagtgcagag

SEQ ID NO: 9353251 - DNA, 22 bp, Homo sapiens
gtgctgcagagtctcgtgccgc

SEQ ID NO: 9353252 - DNA, 22 bp, Homo sapiens
gtgctgcagggcctcctgcacc

SEQ ID NO: 9353253 - DNA, 23 bp, Homo sapiens
gtgctgcaaaatcggccactgca

SEQ ID NO: 9353254 - DNA, 22 bp, Homo sapiens
gtgctgcatgacttgctcctga

SEQ ID NO: 9353255 - DNA, 22 bp, Homo sapiens
gtgctgccagacagtgagaggg

SEQ ID NO: 9353256 - DNA, 22 bp, Homo sapiens
gtgctgccggcatagcagtgaa

SEQ ID NO: 9353257 - DNA, 22 bp, Homo sapiens
gtgctgcctccatatccgtcag

SEQ ID NO: 9353258 - DNA, 22 bp, Homo sapiens
gtgctgctcaagggacaggaca

SEQ ID NO: 9353259 - DNA, 22 bp, Homo sapiens
gtgctgctgccagcaggatcct

SEQ ID NO: 9353260 - DNA, 22 bp, Homo sapiens
gtgctggcacccctctccagtt

SEQ ID NO: 9353261 - DNA, 22 bp, Homo sapiens
gtgctggccctgtcctcgagct

SEQ ID NO: 9353262 - DNA, 22 bp, Homo sapiens
gtgctggccctgtcctcgagct

SEQ ID NO: 9353263 - DNA, 22 bp, Homo sapiens
gtgctggccctgtcctcgagct

SEQ ID NO: 9353264 - DNA, 22 bp, Homo sapiens
gtgctggccctgtcctcgagct

SEQ ID NO: 9353265 - DNA, 22 bp, Homo sapiens
gtgctggaccctggaaggtggt

SEQ ID NO: 9353266 - DNA, 22 bp, Homo sapiens
gtgctgcttgggggcagagcag

SEQ ID NO: 9353267 - DNA, 20 bp, Homo sapiens
gtgctggagttaggaaaggt

SEQ ID NO: 9353268 - DNA, 22 bp, Homo sapiens
gtgcagggcagccgaatgggct

SEQ ID NO: 9353269 - DNA, 22 bp, Homo sapiens
gtgcagggcagccgaatgggct

SEQ ID NO: 9353270 - DNA, 22 bp, Homo sapiens
gtgcagggcagccgaatgggct

SEQ ID NO: 9353271 - DNA, 17 bp, Homo sapiens
gtgcagggatgaaggat

SEQ ID NO: 9353272 - DNA, 17 bp, Homo sapiens
gtgcagggatgaaggat

SEQ ID NO: 9353273 - DNA, 17 bp, Homo sapiens
gtgcagggatgaaggat

SEQ ID NO: 9353274 - DNA, 22 bp, Homo sapiens
gtgcagggctggcaccggaggc

SEQ ID NO: 9353275 - DNA, 22 bp, Homo sapiens
gtgcagggctggcaccggaggc

SEQ ID NO: 9353276 - DNA, 22 bp, Homo sapiens
gtgcaggggatcaggttgcagc

SEQ ID NO: 9353277 - DNA, 22 bp, Homo sapiens
gtgcaggggatcaggttgcagc

SEQ ID NO: 9353278 - DNA, 22 bp, Homo sapiens
gtgcagggcaggtgtccttcca

SEQ ID NO: 9353279 - DNA, 22 bp, Homo sapiens
gtgcagggcaggtgtccttcca

SEQ ID NO: 9353280 - DNA, 22 bp, Homo sapiens
gtgcagggcagccgaatgggct

SEQ ID NO: 9353281 - DNA, 22 bp, Homo sapiens
gtgcagggtagcgacggcagga

SEQ ID NO: 9353282 - DNA, 22 bp, Homo sapiens
gtgcagggtagcgacggcagga

SEQ ID NO: 9353283 - DNA, 22 bp, Homo sapiens
gtgcagggtagcgacggcagga

SEQ ID NO: 9353284 - DNA, 22 bp, Homo sapiens
gtgcagggtagcgacggcagga

SEQ ID NO: 9353285 - DNA, 22 bp, Homo sapiens
gtgcagggtagcgacggcagga

SEQ ID NO: 9353286 - DNA, 22 bp, Homo sapiens
gtgcagggtagcgacggcagga

SEQ ID NO: 9353287 - DNA, 22 bp, Homo sapiens
gtgcaggggcctccccttgctg

SEQ ID NO: 9353288 - DNA, 22 bp, Homo sapiens
gtgcaggggatcaggttgcagc

SEQ ID NO: 9353289 - DNA, 22 bp, Homo sapiens
gtgcaggggatcaggttgcagc

SEQ ID NO: 9353290 - DNA, 22 bp, Homo sapiens
gtgcaggggatcaggttgcagc

SEQ ID NO: 9353291 - DNA, 22 bp, Homo sapiens
gtgccagcagttatggtgattt

SEQ ID NO: 9353292 - DNA, 22 bp, Homo sapiens
gtgccagagatgacaggcctgc

SEQ ID NO: 9353293 - DNA, 22 bp, Homo sapiens
gtgccagagatgacaggcctgc

SEQ ID NO: 9353294 - DNA, 22 bp, Homo sapiens
gtgcaggcaaaagggccaggcc

SEQ ID NO: 9353295 - DNA, 22 bp, Homo sapiens
gtgcaggcaaaagggccaggcc

SEQ ID NO: 9353296 - DNA, 22 bp, Homo sapiens
gtgcaggcattgggctagccat

SEQ ID NO: 9353297 - DNA, 22 bp, Homo sapiens
gtgcagggagcccagaaggtcc

SEQ ID NO: 9353298 - DNA, 22 bp, Homo sapiens
gtgcaggaggtaacatagcaaa

SEQ ID NO: 9353299 - DNA, 22 bp, Homo sapiens
gtgcaggagtaggagagggctt

SEQ ID NO: 9353300 - DNA, 22 bp, Homo sapiens
gtgaggagtctgaagcacataa

SEQ ID NO: 9353301 - DNA, 22 bp, Homo sapiens
gtgaggatacttaagagaacac

SEQ ID NO: 9353302 - DNA, 22 bp, Homo sapiens
gtgaggcagaagttccctttta

SEQ ID NO: 9353303 - DNA, 22 bp, Homo sapiens
gtgaggcaagggcatactaggc

SEQ ID NO: 9353304 - DNA, 22 bp, Homo sapiens
gtgaggatgcagatgagggcct

SEQ ID NO: 9353305 - DNA, 22 bp, Homo sapiens
gtgcagcaaactagtgcgaggg

SEQ ID NO: 9353306 - DNA, 22 bp, Homo sapiens
gtgaggcagggaaagaggataa

SEQ ID NO: 9353307 - DNA, 22 bp, Homo sapiens
gtgaggcaggcattctcctttc

SEQ ID NO: 9353308 - DNA, 22 bp, Homo sapiens
gtgaggcagcaggagcctctgt

SEQ ID NO: 9353309 - DNA, 22 bp, Homo sapiens
gtagtttacagaagaggagcaa

SEQ ID NO: 9353310 - DNA, 22 bp, Homo sapiens
gtagtttaattcctggcctttc

SEQ ID NO: 9353311 - DNA, 22 bp, Homo sapiens
gtagttctgcagtgtcacctga

SEQ ID NO: 9353312 - DNA, 22 bp, Homo sapiens
gtagttctgcagtgtcacctga

SEQ ID NO: 9353313 - DNA, 22 bp, Homo sapiens
gtagtgggtgaggaaggaagga

SEQ ID NO: 9353314 - DNA, 22 bp, Homo sapiens
gtagttctgcagtgtcacctga

SEQ ID NO: 9353315 - DNA, 22 bp, Homo sapiens
gtagttatgtttacatgccatc

SEQ ID NO: 9353316 - DNA, 20 bp, Homo sapiens
gtataagatttcacacatta

SEQ ID NO: 9353317 - DNA, 22 bp, Homo sapiens
gtataaagtataagcttgtttt

SEQ ID NO: 9353318 - DNA, 19 bp, Homo sapiens
gtataacttacaccagcaa

SEQ ID NO: 9353319 - DNA, 22 bp, Homo sapiens
gtatacaatacacaatgctctg

SEQ ID NO: 9353320 - DNA, 22 bp, Homo sapiens
gtatacaatacacaatgctctg

SEQ ID NO: 9353321 - DNA, 22 bp, Homo sapiens
gtattttatggcatgcagtggc

SEQ ID NO: 9353322 - DNA, 22 bp, Homo sapiens
gtattttatggcatgcagtggc

SEQ ID NO: 9353323 - DNA, 22 bp, Homo sapiens
gtatttcctcgcttgtgggatt

SEQ ID NO: 9353324 - DNA, 22 bp, Homo sapiens
gtatttcctcgcttgtgggatt

SEQ ID NO: 9353325 - DNA, 22 bp, Homo sapiens
gtatttcctatagtgagggcct

SEQ ID NO: 9353326 - DNA, 22 bp, Homo sapiens
gtatttccctgagttctgtgag

SEQ ID NO: 9353327 - DNA, 22 bp, Homo sapiens
gtatttcctatagtgagggcct

SEQ ID NO: 9353328 - DNA, 22 bp, Homo sapiens
gtatttcccccagactccctgg

SEQ ID NO: 9353329 - DNA, 22 bp, Homo sapiens
gtatttccattagtgtgtgcac

SEQ ID NO: 9353330 - DNA, 22 bp, Homo sapiens
gtatttccctgagttctgtgag

SEQ ID NO: 9353331 - DNA, 22 bp, Homo sapiens
gtatttcccccagactccctgg

SEQ ID NO: 9353332 - DNA, 22 bp, Homo sapiens
gtatacatacttctagattaaa

SEQ ID NO: 9353333 - DNA, 22 bp, Homo sapiens
gtattttcaagagcagtagtat

SEQ ID NO: 9353334 - DNA, 22 bp, Homo sapiens
gtatttttaggtaaggaaagta

SEQ ID NO: 9353335 - DNA, 22 bp, Homo sapiens
gtcaaaaagtagtcatttctgt

SEQ ID NO: 9353336 - DNA, 22 bp, Homo sapiens
gtcaaaaagtagtcatttctgt

SEQ ID NO: 9353337 - DNA, 22 bp, Homo sapiens
gtcaaaacaaagttaagaattc

SEQ ID NO: 9353338 - DNA, 22 bp, Homo sapiens
gtcaaaaagtagtcatttctgt

SEQ ID NO: 9353339 - DNA, 22 bp, Homo sapiens
gtatttttcattccaagtgaga

SEQ ID NO: 9353340 - DNA, 22 bp, Homo sapiens
gtatttttcattccaagtgaga

SEQ ID NO: 9353341 - DNA, 22 bp, Homo sapiens
gtatttttcagttaggagctta

SEQ ID NO: 9353342 - DNA, 22 bp, Homo sapiens
gtatttttagtagagtcggggt

SEQ ID NO: 9353343 - DNA, 22 bp, Homo sapiens
gtatttttaggtaaggaaagta

SEQ ID NO: 9353344 - DNA, 22 bp, Homo sapiens
gtatttttagtagagtcggggt

SEQ ID NO: 9353345 - DNA, 22 bp, Homo sapiens
gtatttttcagttaggagctta

SEQ ID NO: 9353346 - DNA, 22 bp, Homo sapiens
gtcaaatatatgcaaaactatt

SEQ ID NO: 9353347 - DNA, 22 bp, Homo sapiens
gtcaaatatactaagaggtaaa

SEQ ID NO: 9353348 - DNA, 22 bp, Homo sapiens
gtcaaaaagtagtcatttctgt

SEQ ID NO: 9353349 - DNA, 22 bp, Homo sapiens
gtcaaaaagtagtcatttctgt

SEQ ID NO: 9353350 - DNA, 22 bp, Homo sapiens
gtcaaataattttctcaatagt

SEQ ID NO: 9353351 - DNA, 22 bp, Homo sapiens
gtcaaacatagggactttgtgg

SEQ ID NO: 9353352 - DNA, 22 bp, Homo sapiens
gtcaaagaaacgcaccttacat

SEQ ID NO: 9353353 - DNA, 22 bp, Homo sapiens
gtacaataactagtcttatagt

SEQ ID NO: 9353354 - DNA, 22 bp, Homo sapiens
gtagggttggagagcacaacca

SEQ ID NO: 9353355 - DNA, 22 bp, Homo sapiens
gtaggggtcaggtagggactct

SEQ ID NO: 9353356 - DNA, 22 bp, Homo sapiens
gtaggggtcaggtagggactct

SEQ ID NO: 9353357 - DNA, 22 bp, Homo sapiens
gtaggggatggttccctagaaa

SEQ ID NO: 9353358 - DNA, 22 bp, Homo sapiens
gtaggggatggttccctagaaa

SEQ ID NO: 9353359 - DNA, 22 bp, Homo sapiens
gtagggctcagtaaatactttg

SEQ ID NO: 9353360 - DNA, 22 bp, Homo sapiens
gtagggctcagtaaatactttg

SEQ ID NO: 9353361 - DNA, 22 bp, Homo sapiens
gtaggcagaataattcctcctt

SEQ ID NO: 9353362 - DNA, 22 bp, Homo sapiens
gtaggcagataggagtgcagcc

SEQ ID NO: 9353363 - DNA, 22 bp, Homo sapiens
gtagggcaacatgggcactagg

SEQ ID NO: 9353364 - DNA, 22 bp, Homo sapiens
gtagggcatagagatgttggca

SEQ ID NO: 9353365 - DNA, 22 bp, Homo sapiens
gtagtataaatgggaaatacat

SEQ ID NO: 9353366 - DNA, 22 bp, Homo sapiens
gtagtatgaacatgtaggtaga

SEQ ID NO: 9353367 - DNA, 22 bp, Homo sapiens
gtaggtcagacataagaggaca

SEQ ID NO: 9353368 - DNA, 22 bp, Homo sapiens
gtaggtcagacataagaggaca

SEQ ID NO: 9353369 - DNA, 22 bp, Homo sapiens
gtaggtcagacataagaggaca

SEQ ID NO: 9353370 - DNA, 22 bp, Homo sapiens
gtaggggtgctgagatctggaa

SEQ ID NO: 9353371 - DNA, 22 bp, Homo sapiens
gtagggttggagagcacaacca

SEQ ID NO: 9353372 - DNA, 22 bp, Homo sapiens
gtaggtgagtgatgctcagatt

SEQ ID NO: 9353373 - DNA, 22 bp, Homo sapiens
gtaggtgagtgatgctcagatt

SEQ ID NO: 9353374 - DNA, 22 bp, Homo sapiens
gtacaaatgtacacttgtataa

SEQ ID NO: 9353375 - DNA, 22 bp, Homo sapiens
gtacaaatgtacacttgtataa

SEQ ID NO: 9353376 - DNA, 22 bp, Homo sapiens
gtacaaatgaaaatagaccact

SEQ ID NO: 9353377 - DNA, 22 bp, Homo sapiens
gtacaaaagttattgcggtttt

SEQ ID NO: 9353378 - DNA, 22 bp, Homo sapiens
gtacaaaagttattgcggtttt

SEQ ID NO: 9353379 - DNA, 22 bp, Homo sapiens
gtacaaattgatacagatttga

SEQ ID NO: 9353380 - DNA, 22 bp, Homo sapiens
gtacaacatgattttactctct

SEQ ID NO: 9353381 - DNA, 22 bp, Homo sapiens
gtacaacatgattttactctct

SEQ ID NO: 9353382 - DNA, 22 bp, Homo sapiens
gtacaacatgattttactctct

SEQ ID NO: 9353383 - DNA, 22 bp, Homo sapiens
gtacaagttctactctataaat

SEQ ID NO: 9353384 - DNA, 22 bp, Homo sapiens
gtacaagtgtgtgtttgagcag

SEQ ID NO: 9353385 - DNA, 22 bp, Homo sapiens
gtacaagttctactctataaat

SEQ ID NO: 9353386 - DNA, 22 bp, Homo sapiens
gtacaagtgtatttggcttgat

SEQ ID NO: 9353387 - DNA, 22 bp, Homo sapiens
gtacaagttgcctaccttaagt

SEQ ID NO: 9353388 - DNA, 21 bp, Homo sapiens
gtacaagctcaccaagtggac

SEQ ID NO: 9353389 - DNA, 22 bp, Homo sapiens
gtacaagtaagaaaattgccca

SEQ ID NO: 9353390 - DNA, 22 bp, Homo sapiens
gtacaagtgctgtgagggaaaa

SEQ ID NO: 9353391 - DNA, 22 bp, Homo sapiens
gtacaagtgtatttggcttgat

SEQ ID NO: 9353392 - DNA, 22 bp, Homo sapiens
gtcaccttgaacaggctactca

SEQ ID NO: 9353393 - DNA, 22 bp, Homo sapiens
gtcactcaggctggagttcagt

SEQ ID NO: 9353394 - DNA, 18 bp, Homo sapiens
gtcactagttcaaacttc

SEQ ID NO: 9353395 - DNA, 22 bp, Homo sapiens
gtcacccactccctgctgctgt

SEQ ID NO: 9353396 - DNA, 22 bp, Homo sapiens
gtcacctcgctgtcttcctgag

SEQ ID NO: 9353397 - DNA, 22 bp, Homo sapiens
gtcacctctcatcacatgctac

SEQ ID NO: 9353398 - DNA, 22 bp, Homo sapiens
gtcacctctcatcacatgctac

SEQ ID NO: 9353399 - DNA, 22 bp, Homo sapiens
gtcacctcgctgtcttcctgag

SEQ ID NO: 9353400 - DNA, 22 bp, Homo sapiens
gtcactggaattacaggcatgc

SEQ ID NO: 9353401 - DNA, 22 bp, Homo sapiens
gtcactggggccacatgcagaa

SEQ ID NO: 9353402 - DNA, 22 bp, Homo sapiens
gtcactgtatccaggttccagc

SEQ ID NO: 9353403 - DNA, 17 bp, Homo sapiens
gtcactgtctaatgaag

SEQ ID NO: 9353404 - DNA, 22 bp, Homo sapiens
gtcactggggccacatgcagaa

SEQ ID NO: 9353405 - DNA, 22 bp, Homo sapiens
gtcactgtatccaggttccagc

SEQ ID NO: 9353406 - DNA, 22 bp, Homo sapiens
gtcagaagcatttgtggctgaa

SEQ ID NO: 9353407 - DNA, 22 bp, Homo sapiens
gtcagaaaaagcaaggctgggc

SEQ ID NO: 9353408 - DNA, 22 bp, Homo sapiens
gtcactttggcctctacagcca

SEQ ID NO: 9353409 - DNA, 17 bp, Homo sapiens
gtcactttgtttaaagg

SEQ ID NO: 9353410 - DNA, 17 bp, Homo sapiens
gtcactttgtttaaagg

SEQ ID NO: 9353411 - DNA, 22 bp, Homo sapiens
gtcacttttaagggccttttct

SEQ ID NO: 9353412 - DNA, 22 bp, Homo sapiens
gtcactttacactcctactaaa

SEQ ID NO: 9353413 - DNA, 22 bp, Homo sapiens
gtcactttaaagggttaacagg

SEQ ID NO: 9353414 - DNA, 22 bp, Homo sapiens
gtcactttacactcctactaaa

SEQ ID NO: 9353415 - DNA, 22 bp, Homo sapiens
gtcactttattaattttggtga

SEQ ID NO: 9353416 - DNA, 22 bp, Homo sapiens
gtcactttgaagctgtttttag

SEQ ID NO: 9353417 - DNA, 22 bp, Homo sapiens
gtcactttctgtgagatgtagt

SEQ ID NO: 9353418 - DNA, 22 bp, Homo sapiens
gtcactttcacactttattgct

SEQ ID NO: 9353419 - DNA, 22 bp, Homo sapiens
gtccagagaagggaggggactc

SEQ ID NO: 9353420 - DNA, 22 bp, Homo sapiens
gtccagagagatcttctgatag

SEQ ID NO: 9353421 - DNA, 22 bp, Homo sapiens
gtccagagaagtcattacttca

SEQ ID NO: 9353422 - DNA, 22 bp, Homo sapiens
gtcagaggaggctgagtaggaa

SEQ ID NO: 9353423 - DNA, 22 bp, Homo sapiens
gtccagaattactactgtttga

SEQ ID NO: 9353424 - DNA, 22 bp, Homo sapiens
gtcagagcactgagttgtgggc

SEQ ID NO: 9353425 - DNA, 22 bp, Homo sapiens
gtcagagcccccagcggcgcgg

SEQ ID NO: 9353426 - DNA, 22 bp, Homo sapiens
gtcagagctggaggcaagttct

SEQ ID NO: 9353427 - DNA, 22 bp, Homo sapiens
gtcagagcccttccctgatttt

SEQ ID NO: 9353428 - DNA, 22 bp, Homo sapiens
gtcagagctgtgcaaggctgag

SEQ ID NO: 9353429 - DNA, 22 bp, Homo sapiens
gtccagccctctgcctccaggt

SEQ ID NO: 9353430 - DNA, 22 bp, Homo sapiens
gtccagcccgggctccgccagc

SEQ ID NO: 9353431 - DNA, 22 bp, Homo sapiens
gtccagctgcagctgggcagaa

SEQ ID NO: 9353432 - DNA, 22 bp, Homo sapiens
gtccagctgcagctgggcagaa

SEQ ID NO: 9353433 - DNA, 22 bp, Homo sapiens
gtccagctgcagctgggcagaa

SEQ ID NO: 9353434 - DNA, 22 bp, Homo sapiens
gtccagctgggccagggcactc

SEQ ID NO: 9353435 - DNA, 22 bp, Homo sapiens
gtccagctctgagaagaaacat

SEQ ID NO: 9353436 - DNA, 22 bp, Homo sapiens
gtccagctgatcttgacccagc

SEQ ID NO: 9353437 - DNA, 22 bp, Homo sapiens
gtccagctctgagaagaaacat

SEQ ID NO: 9353438 - DNA, 22 bp, Homo sapiens
gtccagctctcagatggctgca

SEQ ID NO: 9353439 - DNA, 22 bp, Homo sapiens
gtccagctccagggaggcaggc

SEQ ID NO: 9353440 - DNA, 22 bp, Homo sapiens
gtccagctctcagatggctgca

SEQ ID NO: 9353441 - DNA, 19 bp, Homo sapiens
gtccagcctttgggtctta

SEQ ID NO: 9353442 - DNA, 22 bp, Homo sapiens
gtcctggcccactggcaggctg

SEQ ID NO: 9353443 - DNA, 22 bp, Homo sapiens
gtcctggcccactggcaggctg

SEQ ID NO: 9353444 - DNA, 22 bp, Homo sapiens
gtcctggcccactggcaggctg

SEQ ID NO: 9353445 - DNA, 22 bp, Homo sapiens
gtcctggattgaacataggcag

SEQ ID NO: 9353446 - DNA, 22 bp, Homo sapiens
gtcctggcacctcactggctac

SEQ ID NO: 9353447 - DNA, 22 bp, Homo sapiens
gtcctggattgaacataggcag

SEQ ID NO: 9353448 - DNA, 22 bp, Homo sapiens
gtcctggattgaacataggcag

SEQ ID NO: 9353449 - DNA, 22 bp, Homo sapiens
gtcctggctagtcgtccgcgac

SEQ ID NO: 9353450 - DNA, 22 bp, Homo sapiens
gtcctggctggttctgtggggc

SEQ ID NO: 9353451 - DNA, 22 bp, Homo sapiens
gtcctggcccaggagtacacat

SEQ ID NO: 9353452 - DNA, 22 bp, Homo sapiens
gtcctggcccaggagtacacat

SEQ ID NO: 9353453 - DNA, 22 bp, Homo sapiens
gtcctggcccaggagtacacat

SEQ ID NO: 9353454 - DNA, 22 bp, Homo sapiens
gtcctggcctctgggggtatgg

SEQ ID NO: 9353455 - DNA, 19 bp, Homo sapiens
gtcctggcgccgccacacc

SEQ ID NO: 9353456 - DNA, 22 bp, Homo sapiens
gtcctgggaactggacagctaa

SEQ ID NO: 9353457 - DNA, 22 bp, Homo sapiens
gtcctgggaactggacagctaa

SEQ ID NO: 9353458 - DNA, 22 bp, Homo sapiens
gtcctgggaactggacagctaa

SEQ ID NO: 9353459 - DNA, 22 bp, Homo sapiens
gtcctggctgtcttatgttgaa

SEQ ID NO: 9353460 - DNA, 22 bp, Homo sapiens
gtcctggctgtgtttggtttct

SEQ ID NO: 9353461 - DNA, 22 bp, Homo sapiens
gtcctggcttagttcgctgtaa

SEQ ID NO: 9353462 - DNA, 22 bp, Homo sapiens
gtcgtggtcagacaccagaaaa

SEQ ID NO: 9353463 - DNA, 22 bp, Homo sapiens
gtcgtggagctcacagtgtgcc

SEQ ID NO: 9353464 - DNA, 22 bp, Homo sapiens
gtcgtggagctcacagtgtgcc

SEQ ID NO: 9353465 - DNA, 22 bp, Homo sapiens
gtcgggtagtgctggaaggatt

SEQ ID NO: 9353466 - DNA, 22 bp, Homo sapiens
gtcctctgtagggctgggccac

SEQ ID NO: 9353467 - DNA, 22 bp, Homo sapiens
gtcctctgtagggctgggccac

SEQ ID NO: 9353468 - DNA, 22 bp, Homo sapiens
gtcctctgggctttgagcagtc

SEQ ID NO: 9353469 - DNA, 22 bp, Homo sapiens
gtcctctggtgaaagcattccc

SEQ ID NO: 9353470 - DNA, 22 bp, Homo sapiens
gtcctctgtgtaggctgcagac

SEQ ID NO: 9353471 - DNA, 22 bp, Homo sapiens
gtcctgctaccatgctgtgtga

SEQ ID NO: 9353472 - DNA, 22 bp, Homo sapiens
gtcctggaatcctagaacagtg

SEQ ID NO: 9353473 - DNA, 22 bp, Homo sapiens
gtcctggaatcctagaacagtg

SEQ ID NO: 9353474 - DNA, 22 bp, Homo sapiens
gtcctggagtggcatggcatgg

SEQ ID NO: 9353475 - DNA, 22 bp, Homo sapiens
gtcctggagtggcatggcatgg

SEQ ID NO: 9353476 - DNA, 22 bp, Homo sapiens
gtccaggcacctcccttgtgct

SEQ ID NO: 9353477 - DNA, 19 bp, Homo sapiens
gtccaggcattgggttggt

SEQ ID NO: 9353478 - DNA, 22 bp, Homo sapiens
gtccaggctcaaaaggttgtta

SEQ ID NO: 9353479 - DNA, 22 bp, Homo sapiens
gtccaggctgacccctagagga

SEQ ID NO: 9353480 - DNA, 22 bp, Homo sapiens
gtccaggctgacccctagagga

SEQ ID NO: 9353481 - DNA, 22 bp, Homo sapiens
gtccaggcctgcctctgaggag

SEQ ID NO: 9353482 - DNA, 22 bp, Homo sapiens
gtccaggccccagggattcttg

SEQ ID NO: 9353483 - DNA, 22 bp, Homo sapiens
gtccaggcctgcctctgaggag

SEQ ID NO: 9353484 - DNA, 22 bp, Homo sapiens
gtccaggccccagggattcttg

SEQ ID NO: 9353485 - DNA, 22 bp, Homo sapiens
gtccaggccatggtggacacag

SEQ ID NO: 9353486 - DNA, 22 bp, Homo sapiens
gtccaggccatggtggacacag

SEQ ID NO: 9353487 - DNA, 22 bp, Homo sapiens
gtccaggctgcccagggtcctg

SEQ ID NO: 9353488 - DNA, 22 bp, Homo sapiens
gtccaggctgacccctagagga

SEQ ID NO: 9353489 - DNA, 22 bp, Homo sapiens
gtccaggctgacccctagagga

SEQ ID NO: 9353490 - DNA, 22 bp, Homo sapiens
gtcctctggcctttcccaggac

SEQ ID NO: 9353491 - DNA, 22 bp, Homo sapiens
gtcctctggcctttcccaggac

SEQ ID NO: 9353492 - DNA, 22 bp, Homo sapiens
gtcctctgggcagctgccccac

SEQ ID NO: 9353493 - DNA, 22 bp, Homo sapiens
gtcctctgggcagctgccccac

SEQ ID NO: 9353494 - DNA, 22 bp, Homo sapiens
gtcctctgggagccttgagcct

SEQ ID NO: 9353495 - DNA, 23 bp, Homo sapiens
ggtcccagtggagaggcctcacc

SEQ ID NO: 9353496 - DNA, 22 bp, Homo sapiens
ggtcccaggttgacagggagac

SEQ ID NO: 9353497 - DNA, 22 bp, Homo sapiens
ggtcccagttgcccaggtcagg

SEQ ID NO: 9353498 - DNA, 23 bp, Homo sapiens
ggtcccagtggagaggcctcacc

SEQ ID NO: 9353499 - DNA, 22 bp, Homo sapiens
ggtccccgtggaggctggagcg

SEQ ID NO: 9353500 - DNA, 22 bp, Homo sapiens
ggtccccgtggaggctggagcg

SEQ ID NO: 9353501 - DNA, 22 bp, Homo sapiens
ggtccctgaagatgcctgagga

SEQ ID NO: 9353502 - DNA, 22 bp, Homo sapiens
ggtccctgaagatgcctgagga

SEQ ID NO: 9353503 - DNA, 22 bp, Homo sapiens
ggtccctgcctgaggctggcct

SEQ ID NO: 9353504 - DNA, 20 bp, Homo sapiens
ggtccctgccctctgtcatc

SEQ ID NO: 9353505 - DNA, 22 bp, Homo sapiens
ggtccctgcccaaagcccttgg

SEQ ID NO: 9353506 - DNA, 22 bp, Homo sapiens
ggtcccaggagaataggtgcaa

SEQ ID NO: 9353507 - DNA, 22 bp, Homo sapiens
ggtcccagctgctcaagaggct

SEQ ID NO: 9353508 - DNA, 22 bp, Homo sapiens
ggtcccagctggtcactgtcag

SEQ ID NO: 9353509 - DNA, 22 bp, Homo sapiens
gggttggggcccagcagtctgc

SEQ ID NO: 9353510 - DNA, 22 bp, Homo sapiens
gggttgtcaatcaaaagaaaac

SEQ ID NO: 9353511 - DNA, 22 bp, Homo sapiens
gggttttatggttcacttgcaa

SEQ ID NO: 9353512 - DNA, 19 bp, Homo sapiens
gggttgtgtggaaggtatc

SEQ ID NO: 9353513 - DNA, 22 bp, Homo sapiens
gggttgtgggatagagaaggag

SEQ ID NO: 9353514 - DNA, 22 bp, Homo sapiens
gggttggatcctggtggctgcc

SEQ ID NO: 9353515 - DNA, 22 bp, Homo sapiens
gggttggatcctggtggctgcc

SEQ ID NO: 9353516 - DNA, 22 bp, Homo sapiens
gggttggattacttagggagaa

SEQ ID NO: 9353517 - DNA, 22 bp, Homo sapiens
gggttggcagcaccagaggagg

SEQ ID NO: 9353518 - DNA, 22 bp, Homo sapiens
gggttggcatcagggttctgtg

SEQ ID NO: 9353519 - DNA, 22 bp, Homo sapiens
gggttgggactgtcatctggag

SEQ ID NO: 9353520 - DNA, 22 bp, Homo sapiens
gggtgtccagggcgtgtctgga

SEQ ID NO: 9353521 - DNA, 22 bp, Homo sapiens
gggtgtcctgtgccaagctggg

SEQ ID NO: 9353522 - DNA, 22 bp, Homo sapiens
gggtgtccttctgtggactctg

SEQ ID NO: 9353523 - DNA, 22 bp, Homo sapiens
gggttgaggcggatgtcggcgg

SEQ ID NO: 9353524 - DNA, 22 bp, Homo sapiens
gggtgtccacaaaatggctttg

SEQ ID NO: 9353525 - DNA, 22 bp, Homo sapiens
gggtgtagaaagaaccctctgg

SEQ ID NO: 9353526 - DNA, 22 bp, Homo sapiens
ggtgctcaaggtgacaggacat

SEQ ID NO: 9353527 - DNA, 21 bp, Homo sapiens
ggtgctcctccatgctgctct

SEQ ID NO: 9353528 - DNA, 22 bp, Homo sapiens
ggtgctcaaggtgacaggacat

SEQ ID NO: 9353529 - DNA, 22 bp, Homo sapiens
ggtgagggagtggaacgaggtg

SEQ ID NO: 9353530 - DNA, 22 bp, Homo sapiens
ggtgctgtggcagctcctcctc

SEQ ID NO: 9353531 - DNA, 22 bp, Homo sapiens
ggtgctctttctcagacaagat

SEQ ID NO: 9353532 - DNA, 22 bp, Homo sapiens
ggtgctgaaggactataacggt

SEQ ID NO: 9353533 - DNA, 22 bp, Homo sapiens
ggtgctctggtcatggtggagt

SEQ ID NO: 9353534 - DNA, 21 bp, Homo sapiens
ggtgctcgctgatgaggagtg

SEQ ID NO: 9353535 - DNA, 22 bp, Homo sapiens
ggtggacagtgttagctctggg

SEQ ID NO: 9353536 - DNA, 22 bp, Homo sapiens
ggtggacagtgttagctctggg

SEQ ID NO: 9353537 - DNA, 22 bp, Homo sapiens
ggtggacaaatgaatgactgaa

SEQ ID NO: 9353538 - DNA, 17 bp, Homo sapiens
ggtggaagtttctagtt

SEQ ID NO: 9353539 - DNA, 22 bp, Homo sapiens
ggtggacaaatgaatgactgaa

SEQ ID NO: 9353540 - DNA, 22 bp, Homo sapiens
ggtggaaggcagcagtctcagg

SEQ ID NO: 9353541 - DNA, 22 bp, Homo sapiens
ggtggaaggcctggaaggaggc

SEQ ID NO: 9353542 - DNA, 22 bp, Homo sapiens
ggtggaaggcctggaaggaggc

SEQ ID NO: 9353543 - DNA, 22 bp, Homo sapiens
ggtggaaggcctggaaggaggc

SEQ ID NO: 9353544 - DNA, 22 bp, Homo sapiens
ggtggaaggcctggaaggaggc

SEQ ID NO: 9353545 - DNA, 18 bp, Homo sapiens
ggtgagggagctggaagc

SEQ ID NO: 9353546 - DNA, 18 bp, Homo sapiens
ggtgagggagctggaagc

SEQ ID NO: 9353547 - DNA, 18 bp, Homo sapiens
ggtgagggagctggaagc

SEQ ID NO: 9353548 - DNA, 22 bp, Homo sapiens
ggtgagggacatcactcagcca

SEQ ID NO: 9353549 - DNA, 18 bp, Homo sapiens
ggtgagggagctggaagc

SEQ ID NO: 9353550 - DNA, 18 bp, Homo sapiens
ggtgagggagctggaagc

SEQ ID NO: 9353551 - DNA, 22 bp, Homo sapiens
ggtgaggcctgtacaaagctgc

SEQ ID NO: 9353552 - DNA, 22 bp, Homo sapiens
ggtgaggcccagtgatctgtgt

SEQ ID NO: 9353553 - DNA, 22 bp, Homo sapiens
ggtgaggctaagtgacacaggg

SEQ ID NO: 9353554 - DNA, 22 bp, Homo sapiens
ggtgaggcgtccccaccatggg

SEQ ID NO: 9353555 - DNA, 22 bp, Homo sapiens
ggtgagggacatcactcagcca

SEQ ID NO: 9353556 - DNA, 22 bp, Homo sapiens
ggtgaggctaagtgacacaggg

SEQ ID NO: 9353557 - DNA, 22 bp, Homo sapiens
ggtgagcaaagcttcatctgta

SEQ ID NO: 9353558 - DNA, 22 bp, Homo sapiens
ggtgacagcgggtcaagaggag

SEQ ID NO: 9353559 - DNA, 22 bp, Homo sapiens
ggtgacagcgggtcaagaggag

SEQ ID NO: 9353560 - DNA, 22 bp, Homo sapiens
ggtgacagccgcttgccctgta

SEQ ID NO: 9353561 - DNA, 22 bp, Homo sapiens
ggtccctggaaggccaagcttg

SEQ ID NO: 9353562 - DNA, 22 bp, Homo sapiens
ggtccctggaaggccaagcttg

SEQ ID NO: 9353563 - DNA, 22 bp, Homo sapiens
ggtccctgctgaagccttggtg

SEQ ID NO: 9353564 - DNA, 22 bp, Homo sapiens
ggtccctgctgaagccttggtg

SEQ ID NO: 9353565 - DNA, 22 bp, Homo sapiens
ggtgaggaattggggactgacc

SEQ ID NO: 9353566 - DNA, 22 bp, Homo sapiens
ggtgaggcaggtggctgctgag

SEQ ID NO: 9353567 - DNA, 22 bp, Homo sapiens
ggtgaggaaagatggtgacagt

SEQ ID NO: 9353568 - DNA, 22 bp, Homo sapiens
ggtgaggaattggggactgacc

SEQ ID NO: 9353569 - DNA, 22 bp, Homo sapiens
ggtgaggaattggggactgacc

SEQ ID NO: 9353570 - DNA, 22 bp, Homo sapiens
ggtgaggaattggggactgacc

SEQ ID NO: 9353571 - DNA, 22 bp, Homo sapiens
ggtgagcctggagtcttgctgg

SEQ ID NO: 9353572 - DNA, 22 bp, Homo sapiens
ggtgagccgaaaagggtcataa

SEQ ID NO: 9353573 - DNA, 22 bp, Homo sapiens
ggtgagctggtctggggctgct

SEQ ID NO: 9353574 - DNA, 22 bp, Homo sapiens
ggtgaggaaagatggtgacagt

SEQ ID NO: 9353575 - DNA, 22 bp, Homo sapiens
ggtgaggaaagatggtgacagt

SEQ ID NO: 9353576 - DNA, 22 bp, Homo sapiens
ggtgaggaaagatggtgacagt

SEQ ID NO: 9353577 - DNA, 22 bp, Homo sapiens
ggtgagcttgctgctagaggct

SEQ ID NO: 9353578 - DNA, 19 bp, Homo sapiens
ggtgagccctcgcctgcct

SEQ ID NO: 9353579 - DNA, 22 bp, Homo sapiens
ggtggcagagacataggacata

SEQ ID NO: 9353580 - DNA, 22 bp, Homo sapiens
ggtggcagagaggaggtagttt

SEQ ID NO: 9353581 - DNA, 22 bp, Homo sapiens
ggtggcagagaggaggtagttt

SEQ ID NO: 9353582 - DNA, 22 bp, Homo sapiens
ggtgggcaggcgaggcccaggt

SEQ ID NO: 9353583 - DNA, 22 bp, Homo sapiens
ggtggcagagacataggacata

SEQ ID NO: 9353584 - DNA, 22 bp, Homo sapiens
ggtggcactcattatcaggtgc

SEQ ID NO: 9353585 - DNA, 19 bp, Homo sapiens
ggtggcagaacgtgggtcc

SEQ ID NO: 9353586 - DNA, 22 bp, Homo sapiens
ggtggcaccttgatcttggact

SEQ ID NO: 9353587 - DNA, 22 bp, Homo sapiens
ggtggcaccttaccctgcgcag

SEQ ID NO: 9353588 - DNA, 19 bp, Homo sapiens
ggtggcagaacgtgggtcc

SEQ ID NO: 9353589 - DNA, 19 bp, Homo sapiens
ggtggcagaacgtgggtcc

SEQ ID NO: 9353590 - DNA, 22 bp, Homo sapiens
ggtggagctggaccaggagagg

SEQ ID NO: 9353591 - DNA, 22 bp, Homo sapiens
ggtggagctggaccaggagagg

SEQ ID NO: 9353592 - DNA, 22 bp, Homo sapiens
ggtggactcaaaatgtgcttga

SEQ ID NO: 9353593 - DNA, 22 bp, Homo sapiens
ggtggactgtgttggagttgac

SEQ ID NO: 9353594 - DNA, 22 bp, Homo sapiens
ggtggagtaattcgcagaggtt

SEQ ID NO: 9353595 - DNA, 22 bp, Homo sapiens
ggtggatagctcagctccacgt

SEQ ID NO: 9353596 - DNA, 22 bp, Homo sapiens
ggtggcacactggggagctcgg

SEQ ID NO: 9353597 - DNA, 22 bp, Homo sapiens
ggtggcacactggggagctcgg

SEQ ID NO: 9353598 - DNA, 22 bp, Homo sapiens
ggtggcaagggcagccagtaac

SEQ ID NO: 9353599 - DNA, 22 bp, Homo sapiens
ggtggcaccttaccctgcgcag

SEQ ID NO: 9353600 - DNA, 22 bp, Homo sapiens
ggtggggcctgctccagcggcc

SEQ ID NO: 9353601 - DNA, 22 bp, Homo sapiens
ggtggggcctgctccagcggcc

SEQ ID NO: 9353602 - DNA, 22 bp, Homo sapiens
ggtggggcctgctccagcggcc

SEQ ID NO: 9353603 - DNA, 22 bp, Homo sapiens
ggtggggctaggacctcaggat

SEQ ID NO: 9353604 - DNA, 22 bp, Homo sapiens
ggtgggtgcagggggcttctta

SEQ ID NO: 9353605 - DNA, 22 bp, Homo sapiens
ggtgggtgagccctgggagctg

SEQ ID NO: 9353606 - DNA, 22 bp, Homo sapiens
ggtgggtgagccctgggagctg

SEQ ID NO: 9353607 - DNA, 22 bp, Homo sapiens
ggtggggccctggcactggtat

SEQ ID NO: 9353608 - DNA, 22 bp, Homo sapiens
ggtggggcccaggcatctgatg

SEQ ID NO: 9353609 - DNA, 22 bp, Homo sapiens
ggtggggccagggctccaacct

SEQ ID NO: 9353610 - DNA, 22 bp, Homo sapiens
ggtggggagtcaggcattcttg

SEQ ID NO: 9353611 - DNA, 22 bp, Homo sapiens
ggtggggagtcaggcattcttg

SEQ ID NO: 9353612 - DNA, 22 bp, Homo sapiens
ggtgggccaggaaggccgccag

SEQ ID NO: 9353613 - DNA, 22 bp, Homo sapiens
ggtggtgactgtcctagggatg

SEQ ID NO: 9353614 - DNA, 23 bp, Homo sapiens
ggtggtgctcatatctcaggcct

SEQ ID NO: 9353615 - DNA, 22 bp, Homo sapiens
ggtggtctgcgcagcccagggt

SEQ ID NO: 9353616 - DNA, 22 bp, Homo sapiens
ggtggtgaagacaagtggaagt

SEQ ID NO: 9353617 - DNA, 22 bp, Homo sapiens
ggtggtctgtttattgaaggtt

SEQ ID NO: 9353618 - DNA, 22 bp, Homo sapiens
ggtggtggagccagctgggagt

SEQ ID NO: 9353619 - DNA, 22 bp, Homo sapiens
ggtggtggagccagctgggagt

SEQ ID NO: 9353620 - DNA, 22 bp, Homo sapiens
ggtggtggagccagctgggagt

SEQ ID NO: 9353621 - DNA, 22 bp, Homo sapiens
ggtgtttagggaggggttataa

SEQ ID NO: 9353622 - DNA, 23 bp, Homo sapiens
ggtgtttaattacagactgagag

SEQ ID NO: 9353623 - DNA, 22 bp, Homo sapiens
ggtgtttagacagggcccctct

SEQ ID NO: 9353624 - DNA, 17 bp, Homo sapiens
ggtgtttaagtgccagc

SEQ ID NO: 9353625 - DNA, 23 bp, Homo sapiens
ggttagggaatgatctcaggcat

SEQ ID NO: 9353626 - DNA, 22 bp, Homo sapiens
ggttaggatcagatcctggagg

SEQ ID NO: 9353627 - DNA, 22 bp, Homo sapiens
ggtttaatggagatatttcaga

SEQ ID NO: 9353628 - DNA, 22 bp, Homo sapiens
ggtttaatgggtgaaggcatga

SEQ ID NO: 9353629 - DNA, 21 bp, Homo sapiens
ggttggtgtgtccagtggcca

SEQ ID NO: 9353630 - DNA, 21 bp, Homo sapiens
ggttggtgtgtccagtggcca

SEQ ID NO: 9353631 - DNA, 22 bp, Homo sapiens
ggttgtagttggaggttgtata

SEQ ID NO: 9353632 - DNA, 22 bp, Homo sapiens
ggttgttgtgaaggtgaagaga

SEQ ID NO: 9353633 - DNA, 17 bp, Homo sapiens
ggtttaatccttacctg

SEQ ID NO: 9353634 - DNA, 22 bp, Homo sapiens
ggtttaaaagccatgcatgggg

SEQ ID NO: 9353635 - DNA, 22 bp, Homo sapiens
ggttgtagttggaggttgtata

SEQ ID NO: 9353636 - DNA, 22 bp, Homo sapiens
gtaattgaacattaagttgaag

SEQ ID NO: 9353637 - DNA, 22 bp, Homo sapiens
gtaattctgtgtgaatctatta

SEQ ID NO: 9353638 - DNA, 22 bp, Homo sapiens
gtacaaaagttattgcggtttt

SEQ ID NO: 9353639 - DNA, 22 bp, Homo sapiens
gtacaaaagttattgcggtttt

SEQ ID NO: 9353640 - DNA, 22 bp, Homo sapiens
ggttggggcgagctggaggccc

SEQ ID NO: 9353641 - DNA, 22 bp, Homo sapiens
ggttggggcgagctggaggccc

SEQ ID NO: 9353642 - DNA, 22 bp, Homo sapiens
ggttggtaactccctgtgcagt

SEQ ID NO: 9353643 - DNA, 22 bp, Homo sapiens
ggttccacctggcgaggggtat

SEQ ID NO: 9353644 - DNA, 22 bp, Homo sapiens
ggttggaggtgggaatagctag

SEQ ID NO: 9353645 - DNA, 22 bp, Homo sapiens
ggttggctactggagacctatg

SEQ ID NO: 9353646 - DNA, 22 bp, Homo sapiens
ggttcagagcctgcccagtata

SEQ ID NO: 9353647 - DNA, 22 bp, Homo sapiens
gggcttctccctaaggactctg

SEQ ID NO: 9353648 - DNA, 22 bp, Homo sapiens
gggcttctctcagaaactatca

SEQ ID NO: 9353649 - DNA, 22 bp, Homo sapiens
gggcttctattctggcacaaga

SEQ ID NO: 9353650 - DNA, 22 bp, Homo sapiens
gggcttctctgggagtcctggt

SEQ ID NO: 9353651 - DNA, 22 bp, Homo sapiens
gggcttctctgggagtcctggt

SEQ ID NO: 9353652 - DNA, 22 bp, Homo sapiens
gggcttctctcaggggcatgag

SEQ ID NO: 9353653 - DNA, 22 bp, Homo sapiens
gggcttctctcaggggcatgag

SEQ ID NO: 9353654 - DNA, 22 bp, Homo sapiens
gggcttctctcaggggcatgag

SEQ ID NO: 9353655 - DNA, 22 bp, Homo sapiens
gggcttctctgatcaatatttc

SEQ ID NO: 9353656 - DNA, 22 bp, Homo sapiens
gggcttctgggcaccactccct

SEQ ID NO: 9353657 - DNA, 22 bp, Homo sapiens
gggcttctggtcattcctcatc

SEQ ID NO: 9353658 - DNA, 22 bp, Homo sapiens
gggcttctggtcattcctcatc

SEQ ID NO: 9353659 - DNA, 22 bp, Homo sapiens
gggcttctgggcaccactccct

SEQ ID NO: 9353660 - DNA, 22 bp, Homo sapiens
gggcttctctttagtgagctga

SEQ ID NO: 9353661 - DNA, 22 bp, Homo sapiens
gggcttctctttagtgagctga

SEQ ID NO: 9353662 - DNA, 22 bp, Homo sapiens
gggcttcagggtacttcctcct

SEQ ID NO: 9353663 - DNA, 22 bp, Homo sapiens
gggcttctaagtgaaagtgtaa

SEQ ID NO: 9353664 - DNA, 22 bp, Homo sapiens
gggcttcagttctgaccatctt

SEQ ID NO: 9353665 - DNA, 22 bp, Homo sapiens
gggcttctagaccagcagtgag

SEQ ID NO: 9353666 - DNA, 22 bp, Homo sapiens
gggcttctacttgcaaaggata

SEQ ID NO: 9353667 - DNA, 22 bp, Homo sapiens
gggcttctagaatttctgatat

SEQ ID NO: 9353668 - DNA, 22 bp, Homo sapiens
gggctggtgaggctgccctgca

SEQ ID NO: 9353669 - DNA, 18 bp, Homo sapiens
gggctgtgttcatgccca

SEQ ID NO: 9353670 - DNA, 22 bp, Homo sapiens
gggctgtgtgcccacttcccat

SEQ ID NO: 9353671 - DNA, 22 bp, Homo sapiens
gggctctggggtgccctggcat

SEQ ID NO: 9353672 - DNA, 22 bp, Homo sapiens
gggctctggggtgccctggcat

SEQ ID NO: 9353673 - DNA, 22 bp, Homo sapiens
gggctctggggtgccctggcat

SEQ ID NO: 9353674 - DNA, 22 bp, Homo sapiens
gggctctggggtgccctggcat

SEQ ID NO: 9353675 - DNA, 22 bp, Homo sapiens
gggctctggggtcagacagcct

SEQ ID NO: 9353676 - DNA, 22 bp, Homo sapiens
gggctctggggtcagacagcct

SEQ ID NO: 9353677 - DNA, 22 bp, Homo sapiens
gggctctggggtgccctggcat

SEQ ID NO: 9353678 - DNA, 22 bp, Homo sapiens
gggctctggggtcagacagcct

SEQ ID NO: 9353679 - DNA, 22 bp, Homo sapiens
gggctctggggaggacccttca

SEQ ID NO: 9353680 - DNA, 22 bp, Homo sapiens
gggctctggggaggacccttca

SEQ ID NO: 9353681 - DNA, 22 bp, Homo sapiens
gggctctgggattcagagcaag

SEQ ID NO: 9353682 - DNA, 22 bp, Homo sapiens
gggctctgggattcagagcaag

SEQ ID NO: 9353683 - DNA, 22 bp, Homo sapiens
gggctctgggattcagagcaag

SEQ ID NO: 9353684 - DNA, 22 bp, Homo sapiens
gggctctgggattcagagcaag

SEQ ID NO: 9353685 - DNA, 22 bp, Homo sapiens
gggctctgggattcagagcaag

SEQ ID NO: 9353686 - DNA, 22 bp, Homo sapiens
gggctctgggatgctcttagag

SEQ ID NO: 9353687 - DNA, 22 bp, Homo sapiens
gggctctgggatgctcttagag

SEQ ID NO: 9353688 - DNA, 22 bp, Homo sapiens
gggctctgggatgctcttagag

SEQ ID NO: 9353689 - DNA, 19 bp, Homo sapiens
gggctctggcctcagtggg

SEQ ID NO: 9353690 - DNA, 19 bp, Homo sapiens
gggctctggcctcagtggg

SEQ ID NO: 9353691 - DNA, 22 bp, Homo sapiens
gggctctgggatgctcttagag

SEQ ID NO: 9353692 - DNA, 18 bp, Homo sapiens
gggctctggcatctgggt

SEQ ID NO: 9353693 - DNA, 18 bp, Homo sapiens
gggctctggcatctgggt

SEQ ID NO: 9353694 - DNA, 19 bp, Homo sapiens
gggctctggcctcagtggg

SEQ ID NO: 9353695 - DNA, 19 bp, Homo sapiens
gggctctggcctcagtggg

SEQ ID NO: 9353696 - DNA, 20 bp, Homo sapiens
gggctctggccaatgctttg

SEQ ID NO: 9353697 - DNA, 20 bp, Homo sapiens
gggctctggccaatgctttg

SEQ ID NO: 9353698 - DNA, 22 bp, Homo sapiens
ggggaggagtgtacaggtttat

SEQ ID NO: 9353699 - DNA, 22 bp, Homo sapiens
ggggaggagccatgtaactagt

SEQ ID NO: 9353700 - DNA, 22 bp, Homo sapiens
ggggaggagccatgtaactagt

SEQ ID NO: 9353701 - DNA, 22 bp, Homo sapiens
ggggaggacctttccaaggctt

SEQ ID NO: 9353702 - DNA, 22 bp, Homo sapiens
ggggaggacctttccaaggctt

SEQ ID NO: 9353703 - DNA, 22 bp, Homo sapiens
ggggaggacctttccaaggctt

SEQ ID NO: 9353704 - DNA, 22 bp, Homo sapiens
ggggaggagccatgtaactagt

SEQ ID NO: 9353705 - DNA, 22 bp, Homo sapiens
ggggaggcaagatgaagtgagg

SEQ ID NO: 9353706 - DNA, 22 bp, Homo sapiens
ggggaggcaagatgaagtgagg

SEQ ID NO: 9353707 - DNA, 22 bp, Homo sapiens
ggggaggccagtggaccgtccc

SEQ ID NO: 9353708 - DNA, 22 bp, Homo sapiens
ggggaggctgatgtgggcaaag

SEQ ID NO: 9353709 - DNA, 22 bp, Homo sapiens
ggggaggaagctggaacacggg

SEQ ID NO: 9353710 - DNA, 22 bp, Homo sapiens
ggggaggaagctggaacacggg

SEQ ID NO: 9353711 - DNA, 22 bp, Homo sapiens
ggggaggaagctggaacacggg

SEQ ID NO: 9353712 - DNA, 22 bp, Homo sapiens
ggggaggaagctggaacacggg

SEQ ID NO: 9353713 - DNA, 22 bp, Homo sapiens
ggggaggaagctggaacacggg

SEQ ID NO: 9353714 - DNA, 22 bp, Homo sapiens
ggggaggaagctggaacacggg

SEQ ID NO: 9353715 - DNA, 22 bp, Homo sapiens
ggggaggaagctggaacacggg

SEQ ID NO: 9353716 - DNA, 22 bp, Homo sapiens
ggggaggaagctctcagttcca

SEQ ID NO: 9353717 - DNA, 22 bp, Homo sapiens
gggcttctgttcctttcacttg

SEQ ID NO: 9353718 - DNA, 22 bp, Homo sapiens
gggcttctgttcctttcacttg

SEQ ID NO: 9353719 - DNA, 22 bp, Homo sapiens
gggcttctgtacctacctggaa

SEQ ID NO: 9353720 - DNA, 22 bp, Homo sapiens
gggcttctgtacctacctggaa

SEQ ID NO: 9353721 - DNA, 22 bp, Homo sapiens
ggggagtggttgcctgtgatcc

SEQ ID NO: 9353722 - DNA, 22 bp, Homo sapiens
ggggagtgttttcatgggcttg

SEQ ID NO: 9353723 - DNA, 22 bp, Homo sapiens
ggggagtgttttcatgggcttg

SEQ ID NO: 9353724 - DNA, 22 bp, Homo sapiens
ggggagttaaaatgtgctgcaa

SEQ ID NO: 9353725 - DNA, 22 bp, Homo sapiens
ggggagtgacgcagggccatag

SEQ ID NO: 9353726 - DNA, 19 bp, Homo sapiens
ggggaggtattgttttcat

SEQ ID NO: 9353727 - DNA, 22 bp, Homo sapiens
ggggagttcatgcatttgtgga

SEQ ID NO: 9353728 - DNA, 21 bp, Homo sapiens
ggggatgcgaccacaggctcc

SEQ ID NO: 9353729 - DNA, 22 bp, Homo sapiens
ggggcagggaggttatcgccga

SEQ ID NO: 9353730 - DNA, 22 bp, Homo sapiens
ggggcagggaggttatcgccga

SEQ ID NO: 9353731 - DNA, 22 bp, Homo sapiens
ggggcaggaggtgttctctttt

SEQ ID NO: 9353732 - DNA, 22 bp, Homo sapiens
ggggcagggaggttatcgccga

SEQ ID NO: 9353733 - DNA, 20 bp, Homo sapiens
ggggcaggtttttatggcta

SEQ ID NO: 9353734 - DNA, 20 bp, Homo sapiens
ggggcaggtttttatggcta

SEQ ID NO: 9353735 - DNA, 20 bp, Homo sapiens
ggggcaggtttttatggcta

SEQ ID NO: 9353736 - DNA, 22 bp, Homo sapiens
ggggcagtgaggtggcagcccg

SEQ ID NO: 9353737 - DNA, 22 bp, Homo sapiens
ggggcagtgaggtggcagcccg

SEQ ID NO: 9353738 - DNA, 22 bp, Homo sapiens
ggggccagatatcactaaggtt

SEQ ID NO: 9353739 - DNA, 22 bp, Homo sapiens
ggggccagatatcactaaggtt

SEQ ID NO: 9353740 - DNA, 22 bp, Homo sapiens
ggggccagagaggacccaggtg

SEQ ID NO: 9353741 - DNA, 22 bp, Homo sapiens
ggggccagagaggacccaggtg

SEQ ID NO: 9353742 - DNA, 22 bp, Homo sapiens
ggggcattgtgtctgggttcct

SEQ ID NO: 9353743 - DNA, 22 bp, Homo sapiens
ggggcattgtgtctgggttcct

SEQ ID NO: 9353744 - DNA, 22 bp, Homo sapiens
ggggccagcaatgttgaggaat

SEQ ID NO: 9353745 - DNA, 22 bp, Homo sapiens
ggggccagcaatgttgaggaat

SEQ ID NO: 9353746 - DNA, 22 bp, Homo sapiens
ggggccagatatcactaaggtt

SEQ ID NO: 9353747 - DNA, 22 bp, Homo sapiens
ggggccagcaatgttgaggaat

SEQ ID NO: 9353748 - DNA, 22 bp, Homo sapiens
ggggccagcttcgcgtgctctt

SEQ ID NO: 9353749 - DNA, 22 bp, Homo sapiens
ggggccagtaggagtgatgtac

SEQ ID NO: 9353750 - DNA, 22 bp, Homo sapiens
ggggccagtaggagtgatgtac

SEQ ID NO: 9353751 - DNA, 22 bp, Homo sapiens
ggggccaggtccagcttccaaa

SEQ ID NO: 9353752 - DNA, 22 bp, Homo sapiens
ggggccaggtccagcttccaaa

SEQ ID NO: 9353753 - DNA, 22 bp, Homo sapiens
ggggtaggcaggtgatctgatc

SEQ ID NO: 9353754 - DNA, 22 bp, Homo sapiens
ggggtaggcaggtgatctgatc

SEQ ID NO: 9353755 - DNA, 22 bp, Homo sapiens
ggggcccttgtggctgcaggcc

SEQ ID NO: 9353756 - DNA, 22 bp, Homo sapiens
ggggtagggcgattgctgcttt

SEQ ID NO: 9353757 - DNA, 22 bp, Homo sapiens
ggggtagggcgattgctgcttt

SEQ ID NO: 9353758 - DNA, 22 bp, Homo sapiens
ggggtagggcgattgctgcttt

SEQ ID NO: 9353759 - DNA, 22 bp, Homo sapiens
ggggtagggtgattgtgaagta

SEQ ID NO: 9353760 - DNA, 22 bp, Homo sapiens
ggggtgagtgctcagccccgga

SEQ ID NO: 9353761 - DNA, 22 bp, Homo sapiens
ggggtgagttagcgtcggcttg

SEQ ID NO: 9353762 - DNA, 22 bp, Homo sapiens
ggggcccttgtggctgcaggcc

SEQ ID NO: 9353763 - DNA, 22 bp, Homo sapiens
ggggcccttgtggctgcaggcc

SEQ ID NO: 9353764 - DNA, 19 bp, Homo sapiens
ggggtggctggggctccag

SEQ ID NO: 9353765 - DNA, 22 bp, Homo sapiens
ggggtggctggcacctcctggt

SEQ ID NO: 9353766 - DNA, 19 bp, Homo sapiens
ggggtggctggggctccag

SEQ ID NO: 9353767 - DNA, 19 bp, Homo sapiens
ggggtggctggggctccag

SEQ ID NO: 9353768 - DNA, 22 bp, Homo sapiens
ggggtggctggcacctcctggt

SEQ ID NO: 9353769 - DNA, 22 bp, Homo sapiens
ggggtggctggcacctcctggt

SEQ ID NO: 9353770 - DNA, 22 bp, Homo sapiens
ggggtggctggcacctcctggt

SEQ ID NO: 9353771 - DNA, 22 bp, Homo sapiens
ggggtggctggcacctcctggt

SEQ ID NO: 9353772 - DNA, 22 bp, Homo sapiens
ggggtggccctaccctctggaa

SEQ ID NO: 9353773 - DNA, 22 bp, Homo sapiens
ggggtggccctaccctctggaa

SEQ ID NO: 9353774 - DNA, 22 bp, Homo sapiens
ggggtggccctaccctctggaa

SEQ ID NO: 9353775 - DNA, 22 bp, Homo sapiens
ggggtggcctgtaggcagcatg

SEQ ID NO: 9353776 - DNA, 22 bp, Homo sapiens
ggggtggcctgtaggcagcatg

SEQ ID NO: 9353777 - DNA, 22 bp, Homo sapiens
ggggtggcctgtaggcagcatg

SEQ ID NO: 9353778 - DNA, 22 bp, Homo sapiens
ggggtgggagtgccatccttga

SEQ ID NO: 9353779 - DNA, 19 bp, Homo sapiens
ggggtggctggggctccag

SEQ ID NO: 9353780 - DNA, 22 bp, Homo sapiens
ggggtgctagagtggggccact

SEQ ID NO: 9353781 - DNA, 19 bp, Homo sapiens
ggggtgctagggagggatc

SEQ ID NO: 9353782 - DNA, 22 bp, Homo sapiens
ggggtgctgaagatgtcatggt

SEQ ID NO: 9353783 - DNA, 22 bp, Homo sapiens
ggggtggagatggtggcccttt

SEQ ID NO: 9353784 - DNA, 22 bp, Homo sapiens
ggggtggagatggtggcccttt

SEQ ID NO: 9353785 - DNA, 22 bp, Homo sapiens
ggggtggagatggtggcccttt

SEQ ID NO: 9353786 - DNA, 22 bp, Homo sapiens
ggggtggatcaggcaggcccag

SEQ ID NO: 9353787 - DNA, 22 bp, Homo sapiens
ggggtggagctaaatgtctact

SEQ ID NO: 9353788 - DNA, 22 bp, Homo sapiens
ggggtggagctaaatgtctact

SEQ ID NO: 9353789 - DNA, 22 bp, Homo sapiens
ggggtggattcctacaggtcca

SEQ ID NO: 9353790 - DNA, 22 bp, Homo sapiens
ggggtggattcctacaggtcca

SEQ ID NO: 9353791 - DNA, 22 bp, Homo sapiens
ggggtggattcctacaggtcca

SEQ ID NO: 9353792 - DNA, 22 bp, Homo sapiens
ggggtggattcctacaggtcca

SEQ ID NO: 9353793 - DNA, 22 bp, Homo sapiens
ggggtggatttcaggcggtgtc

SEQ ID NO: 9353794 - DNA, 22 bp, Homo sapiens
ggggtggatttcaggcggtgtc

SEQ ID NO: 9353795 - DNA, 22 bp, Homo sapiens
ggggtggccaaggactctgacc

SEQ ID NO: 9353796 - DNA, 22 bp, Homo sapiens
ggggtggccaaggactctgacc

SEQ ID NO: 9353797 - DNA, 22 bp, Homo sapiens
ggggtggccaaggactctgacc

SEQ ID NO: 9353798 - DNA, 22 bp, Homo sapiens
ggggtggccaaggactctgacc

SEQ ID NO: 9353799 - DNA, 22 bp, Homo sapiens
ggggtggccaaggactctgacc

SEQ ID NO: 9353800 - DNA, 21 bp, Homo sapiens
gggtggggttccagccttttc

SEQ ID NO: 9353801 - DNA, 22 bp, Homo sapiens
gggtggtcatctgaaggtctgg

SEQ ID NO: 9353802 - DNA, 22 bp, Homo sapiens
gggtggagaggctaagtccagt

SEQ ID NO: 9353803 - DNA, 22 bp, Homo sapiens
gggtggagccagttgactctgt

SEQ ID NO: 9353804 - DNA, 22 bp, Homo sapiens
gggtggagccagttgactctgt

SEQ ID NO: 9353805 - DNA, 22 bp, Homo sapiens
gggtggtggcggaggctccagg

SEQ ID NO: 9353806 - DNA, 22 bp, Homo sapiens
gggtggtgtattagagctgcag

SEQ ID NO: 9353807 - DNA, 22 bp, Homo sapiens
gggtggtgtattagagctgcag

SEQ ID NO: 9353808 - DNA, 22 bp, Homo sapiens
gggtggtgtattagagctgcag

SEQ ID NO: 9353809 - DNA, 21 bp, Homo sapiens
gggtggtctgctgaagaggga

SEQ ID NO: 9353810 - DNA, 21 bp, Homo sapiens
gggtggtctagctcaggaact

SEQ ID NO: 9353811 - DNA, 19 bp, Homo sapiens
gggtggtccaactttcagg

SEQ ID NO: 9353812 - DNA, 22 bp, Homo sapiens
gggtggtgagatgtagctgatg

SEQ ID NO: 9353813 - DNA, 22 bp, Homo sapiens
gggtggtctggcaggctggaaa

SEQ ID NO: 9353814 - DNA, 22 bp, Homo sapiens
gggtggtctggcaggctggaaa

SEQ ID NO: 9353815 - DNA, 22 bp, Homo sapiens
gggtggtggccagcagtgggca

SEQ ID NO: 9353816 - DNA, 22 bp, Homo sapiens
gggtggtgagatgtagctgatg

SEQ ID NO: 9353817 - DNA, 16 bp, Homo sapiens
gggtggtcttggagac

SEQ ID NO: 9353818 - DNA, 22 bp, Homo sapiens
gggtgaggccttgctgccatca

SEQ ID NO: 9353819 - DNA, 22 bp, Homo sapiens
gggtgaggcccatttgaggcca

SEQ ID NO: 9353820 - DNA, 20 bp, Homo sapiens
gggtgaggatggagaatttg

SEQ ID NO: 9353821 - DNA, 20 bp, Homo sapiens
gggtgaggatggagaatttg

SEQ ID NO: 9353822 - DNA, 22 bp, Homo sapiens
gggtgaggagctgccagtcatg

SEQ ID NO: 9353823 - DNA, 22 bp, Homo sapiens
gggtgcagcagagctcctctgt

SEQ ID NO: 9353824 - DNA, 22 bp, Homo sapiens
gggtgagggatgagccttcttc

SEQ ID NO: 9353825 - DNA, 22 bp, Homo sapiens
gggtgagggatgagccttcttc

SEQ ID NO: 9353826 - DNA, 22 bp, Homo sapiens
gggtgagggatgagccttcttc

SEQ ID NO: 9353827 - DNA, 22 bp, Homo sapiens
gggtgaggccttgctgccatca

SEQ ID NO: 9353828 - DNA, 22 bp, Homo sapiens
gggtgaggccttgctgccatca

SEQ ID NO: 9353829 - DNA, 21 bp, Homo sapiens
gggtgctgtggtcatgcagga

SEQ ID NO: 9353830 - DNA, 22 bp, Homo sapiens
gggtgctttggctcacgcctgt

SEQ ID NO: 9353831 - DNA, 22 bp, Homo sapiens
gggtggaagccagagaggtcat

SEQ ID NO: 9353832 - DNA, 22 bp, Homo sapiens
gggtgcaggcagcccaggcagg

SEQ ID NO: 9353833 - DNA, 22 bp, Homo sapiens
gggtgcaggcagcccaggcagg

SEQ ID NO: 9353834 - DNA, 22 bp, Homo sapiens
gggtgctgggaggctgacatct

SEQ ID NO: 9353835 - DNA, 18 bp, Homo sapiens
gggtgcaggcactgactg

SEQ ID NO: 9353836 - DNA, 22 bp, Homo sapiens
gggtgcaggcagcccaggcagg

SEQ ID NO: 9353837 - DNA, 22 bp, Homo sapiens
gggtgcaggcagcccaggcagg

SEQ ID NO: 9353838 - DNA, 18 bp, Homo sapiens
gggtgcaggcactgactg

SEQ ID NO: 9353839 - DNA, 22 bp, Homo sapiens
gggtgcagctttgaaagcatgt

SEQ ID NO: 9353840 - DNA, 18 bp, Homo sapiens
gggtgcaggcactgactg

SEQ ID NO: 9353841 - DNA, 22 bp, Homo sapiens
gggtgcagcagagctcctctgt

SEQ ID NO: 9353842 - DNA, 22 bp, Homo sapiens
gggctcagacatccctcctgga

SEQ ID NO: 9353843 - DNA, 22 bp, Homo sapiens
gggctatctgctcaccttcctc

SEQ ID NO: 9353844 - DNA, 20 bp, Homo sapiens
gggctaggtagccatttggc

SEQ ID NO: 9353845 - DNA, 22 bp, Homo sapiens
gggcctcactatgtggtccagg

SEQ ID NO: 9353846 - DNA, 22 bp, Homo sapiens
gggccgtagaccacgtccgggc

SEQ ID NO: 9353847 - DNA, 22 bp, Homo sapiens
gggccggagctgggtcccgcgc

SEQ ID NO: 9353848 - DNA, 22 bp, Homo sapiens
gggccctggggcctgatttgca

SEQ ID NO: 9353849 - DNA, 22 bp, Homo sapiens
gggccctgtgatttcttgagga

SEQ ID NO: 9353850 - DNA, 22 bp, Homo sapiens
gggccctgtgatttcttgagga

SEQ ID NO: 9353851 - DNA, 22 bp, Homo sapiens
gggccctgccccgtggctctga

SEQ ID NO: 9353852 - DNA, 22 bp, Homo sapiens
gggccctgccccgtggctctga

SEQ ID NO: 9353853 - DNA, 22 bp, Homo sapiens
gggccctgccccgtggctctga

SEQ ID NO: 9353854 - DNA, 22 bp, Homo sapiens
gggccctgatctgtgagcgcag

SEQ ID NO: 9353855 - DNA, 22 bp, Homo sapiens
gggccctcagtcccaggccttc

SEQ ID NO: 9353856 - DNA, 22 bp, Homo sapiens
gggccctctgcagctgcccagg

SEQ ID NO: 9353857 - DNA, 22 bp, Homo sapiens
gggccctggggatgtggacgcg

SEQ ID NO: 9353858 - DNA, 22 bp, Homo sapiens
gggccctgggattcagagcaag

SEQ ID NO: 9353859 - DNA, 22 bp, Homo sapiens
gggccctgcctaaggaacacac

SEQ ID NO: 9353860 - DNA, 22 bp, Homo sapiens
gggccctgcctaaggaacacac

SEQ ID NO: 9353861 - DNA, 22 bp, Homo sapiens
gggcaggtgtttccaaggtgag

SEQ ID NO: 9353862 - DNA, 22 bp, Homo sapiens
gggcaggtgttgtcaatctaat

SEQ ID NO: 9353863 - DNA, 22 bp, Homo sapiens
gggcaggtgtttccaaggtgag

SEQ ID NO: 9353864 - DNA, 22 bp, Homo sapiens
gggcaggtgtttccaaggtgag

SEQ ID NO: 9353865 - DNA, 22 bp, Homo sapiens
gggcaggtgtgcagagctgttg

SEQ ID NO: 9353866 - DNA, 22 bp, Homo sapiens
gggcaggtgttgtcaatctaat

SEQ ID NO: 9353867 - DNA, 22 bp, Homo sapiens
gggcaggtgtgcagagctgttg

SEQ ID NO: 9353868 - DNA, 22 bp, Homo sapiens
gggcaggtggcctcttgtacta

SEQ ID NO: 9353869 - DNA, 22 bp, Homo sapiens
gggcaggtggcctcttgtacta

SEQ ID NO: 9353870 - DNA, 22 bp, Homo sapiens
gggcaggtggcagggtctctgg

SEQ ID NO: 9353871 - DNA, 22 bp, Homo sapiens
gggcaggtggcctcttgtacta

SEQ ID NO: 9353872 - DNA, 22 bp, Homo sapiens
gggcaggtggcagggtctctgg

SEQ ID NO: 9353873 - DNA, 22 bp, Homo sapiens
gggcaggtggcagggtctctgg

SEQ ID NO: 9353874 - DNA, 22 bp, Homo sapiens
gggcaggtggcaaagccagagg

SEQ ID NO: 9353875 - DNA, 22 bp, Homo sapiens
gggcaggtggcaaagccagagg

SEQ ID NO: 9353876 - DNA, 22 bp, Homo sapiens
gggcaggtggagggcccagcca

SEQ ID NO: 9353877 - DNA, 22 bp, Homo sapiens
gggcaggtggagggcccagcca

SEQ ID NO: 9353878 - DNA, 22 bp, Homo sapiens
gggccccttgctgctctgctgg

SEQ ID NO: 9353879 - DNA, 22 bp, Homo sapiens
gggccccttgtatctctggctc

SEQ ID NO: 9353880 - DNA, 22 bp, Homo sapiens
gggccccttgtatctctggctc

SEQ ID NO: 9353881 - DNA, 22 bp, Homo sapiens
gggccccaagaacctcctcctg

SEQ ID NO: 9353882 - DNA, 22 bp, Homo sapiens
gggccccactggggctgcctgc

SEQ ID NO: 9353883 - DNA, 22 bp, Homo sapiens
gggcccagtaccctctgccaag

SEQ ID NO: 9353884 - DNA, 22 bp, Homo sapiens
gggcccagtaccctctgccaag

SEQ ID NO: 9353885 - DNA, 22 bp, Homo sapiens
gggcccagtaccctctgccaag

SEQ ID NO: 9353886 - DNA, 22 bp, Homo sapiens
gggccccaaaatgccaggctct

SEQ ID NO: 9353887 - DNA, 22 bp, Homo sapiens
gggcccaggcctccttccttcc

SEQ ID NO: 9353888 - DNA, 22 bp, Homo sapiens
gggctcagcctcctcacttcga

SEQ ID NO: 9353889 - DNA, 22 bp, Homo sapiens
gggctcagcctcctcacttcga

SEQ ID NO: 9353890 - DNA, 21 bp, Homo sapiens
gggctcagcgctcggctcctc

SEQ ID NO: 9353891 - DNA, 22 bp, Homo sapiens
gggctcagcctcctcacttcga

SEQ ID NO: 9353892 - DNA, 16 bp, Homo sapiens
gggctcagatctttga

SEQ ID NO: 9353893 - DNA, 23 bp, Homo sapiens
gggctcagatttcattctgtgcc

SEQ ID NO: 9353894 - DNA, 22 bp, Homo sapiens
gggctcagccccattgaaccag

SEQ ID NO: 9353895 - DNA, 22 bp, Homo sapiens
gggctcagaggagtggcctggg

SEQ ID NO: 9353896 - DNA, 22 bp, Homo sapiens
gggctcagaggagtggcctggg

SEQ ID NO: 9353897 - DNA, 22 bp, Homo sapiens
gggctcagagcatttgggttgg

SEQ ID NO: 9353898 - DNA, 22 bp, Homo sapiens
gggctcagagcatttgggttgg

SEQ ID NO: 9353899 - DNA, 22 bp, Homo sapiens
gggctcagacatccctcctgga

SEQ ID NO: 9353900 - DNA, 21 bp, Homo sapiens
gggctcagcgctcggctcctc

SEQ ID NO: 9353901 - DNA, 22 bp, Homo sapiens
gggctcagctccttccttccta

SEQ ID NO: 9353902 - DNA, 22 bp, Homo sapiens
gggctcagctccttccttccta

SEQ ID NO: 9353903 - DNA, 22 bp, Homo sapiens
gggctcagctgggcgtgctggt

SEQ ID NO: 9353904 - DNA, 22 bp, Homo sapiens
gggctcaggagtttgaggctgc

SEQ ID NO: 9353905 - DNA, 22 bp, Homo sapiens
gggctcagttctgcttcatgct

SEQ ID NO: 9353906 - DNA, 22 bp, Homo sapiens
gggctcagttctgcttcatgct

SEQ ID NO: 9353907 - DNA, 22 bp, Homo sapiens
gggctccaactacatcagcctt

SEQ ID NO: 9353908 - DNA, 22 bp, Homo sapiens
gggctctgaatcccaggtctgc

SEQ ID NO: 9353909 - DNA, 22 bp, Homo sapiens
gggctctgactgaatattgaat

SEQ ID NO: 9353910 - DNA, 22 bp, Homo sapiens
gggctctgaatgagttaccaag

SEQ ID NO: 9353911 - DNA, 22 bp, Homo sapiens
gggctctgaatgagttaccaag

SEQ ID NO: 9353912 - DNA, 22 bp, Homo sapiens
gggctctgagctctgggaatta

SEQ ID NO: 9353913 - DNA, 22 bp, Homo sapiens
gggctctgactgaatattgaat

SEQ ID NO: 9353914 - DNA, 22 bp, Homo sapiens
gggctctgagctctgggaatta

SEQ ID NO: 9353915 - DNA, 22 bp, Homo sapiens
gggctctggaaatgggagctcc

SEQ ID NO: 9353916 - DNA, 22 bp, Homo sapiens
gggctctgagctctgggaatta

SEQ ID NO: 9353917 - DNA, 22 bp, Homo sapiens
gggctctggatggagcctgcag

SEQ ID NO: 9353918 - DNA, 22 bp, Homo sapiens
gggctctggatggagcctgcag

SEQ ID NO: 9353919 - DNA, 22 bp, Homo sapiens
gggctctggatggagcctgcag

SEQ ID NO: 9353920 - DNA, 22 bp, Homo sapiens
gggctctggatggagcctgcag

SEQ ID NO: 9353921 - DNA, 18 bp, Homo sapiens
gggctctggcatctgggt

SEQ ID NO: 9353922 - DNA, 22 bp, Homo sapiens
gggctctggacccaggcaagag

SEQ ID NO: 9353923 - DNA, 22 bp, Homo sapiens
gggctctggagttctagaaaga

SEQ ID NO: 9353924 - DNA, 22 bp, Homo sapiens
gggctctggagttctagaaaga

SEQ ID NO: 9353925 - DNA, 22 bp, Homo sapiens
gggctctggatggagcctgcag

SEQ ID NO: 9353926 - DNA, 22 bp, Homo sapiens
gggctctggatggagcctgcag

SEQ ID NO: 9353927 - DNA, 22 bp, Homo sapiens
gggctctggaaatgggagctcc

SEQ ID NO: 9353928 - DNA, 22 bp, Homo sapiens
gggctctggaaatgggagctcc

SEQ ID NO: 9353929 - DNA, 22 bp, Homo sapiens
gggctctggaaatgggagctcc

SEQ ID NO: 9353930 - DNA, 22 bp, Homo sapiens
gggctctggaaggtgcaccatg

SEQ ID NO: 9353931 - DNA, 22 bp, Homo sapiens
gggctctggacccaggcaagag

SEQ ID NO: 9353932 - DNA, 22 bp, Homo sapiens
gggctctggaaggtgcaccatg

SEQ ID NO: 9353933 - DNA, 22 bp, Homo sapiens
gggctctggacccaggcaagag

SEQ ID NO: 9353934 - DNA, 22 bp, Homo sapiens
gggctctggacccaggcaagag

SEQ ID NO: 9353935 - DNA, 20 bp, Homo sapiens
gggcagagccagccagtccc

SEQ ID NO: 9353936 - DNA, 20 bp, Homo sapiens
gggcagagccagccagtccc

SEQ ID NO: 9353937 - DNA, 22 bp, Homo sapiens
gggcagagagctggaactcctt

SEQ ID NO: 9353938 - DNA, 22 bp, Homo sapiens
gggcagaggctctggcccatcc

SEQ ID NO: 9353939 - DNA, 22 bp, Homo sapiens
gggcagaggctctggcccatcc

SEQ ID NO: 9353940 - DNA, 20 bp, Homo sapiens
gggcagagccagccagtccc

SEQ ID NO: 9353941 - DNA, 20 bp, Homo sapiens
gggcagagccagccagtccc

SEQ ID NO: 9353942 - DNA, 20 bp, Homo sapiens
gggcagagccagccagtccc

SEQ ID NO: 9353943 - DNA, 20 bp, Homo sapiens
gggcagagccagccagtccc

SEQ ID NO: 9353944 - DNA, 20 bp, Homo sapiens
gggcagagccagccagtccc

SEQ ID NO: 9353945 - DNA, 20 bp, Homo sapiens
gggatcaggaaaggaggcta

SEQ ID NO: 9353946 - DNA, 18 bp, Homo sapiens
gggatcaggctgcctagg

SEQ ID NO: 9353947 - DNA, 22 bp, Homo sapiens
gggatcagttaaggagagtttt

SEQ ID NO: 9353948 - DNA, 18 bp, Homo sapiens
gggatcaggctgcctagg

SEQ ID NO: 9353949 - DNA, 22 bp, Homo sapiens
gggcactggtgctgccatcttg

SEQ ID NO: 9353950 - DNA, 22 bp, Homo sapiens
gggcactgggtcttctccacgc

SEQ ID NO: 9353951 - DNA, 22 bp, Homo sapiens
gggcactggtgctgccatcttg

SEQ ID NO: 9353952 - DNA, 22 bp, Homo sapiens
gggcactgtacactgtgcatgg

SEQ ID NO: 9353953 - DNA, 22 bp, Homo sapiens
gggcactgtgctaggtgctgag

SEQ ID NO: 9353954 - DNA, 22 bp, Homo sapiens
gggcagagactcagaaacagaa

SEQ ID NO: 9353955 - DNA, 22 bp, Homo sapiens
gggcagagactcagaaacagaa

SEQ ID NO: 9353956 - DNA, 22 bp, Homo sapiens
gggcagagactcagaaacagaa

SEQ ID NO: 9353957 - DNA, 22 bp, Homo sapiens
gggcagagagctggaactcctt

SEQ ID NO: 9353958 - DNA, 22 bp, Homo sapiens
gggcagagagctggaactcctt

SEQ ID NO: 9353959 - DNA, 22 bp, Homo sapiens
gggcagagagctggaactcctt

SEQ ID NO: 9353960 - DNA, 22 bp, Homo sapiens
gggcaggtgccagctccctgtc

SEQ ID NO: 9353961 - DNA, 22 bp, Homo sapiens
gggcaggtgccagctccctgtc

SEQ ID NO: 9353962 - DNA, 22 bp, Homo sapiens
gggcaggtgccagctccctgtc

SEQ ID NO: 9353963 - DNA, 22 bp, Homo sapiens
gggcaggtgcccagggccagag

SEQ ID NO: 9353964 - DNA, 22 bp, Homo sapiens
gggcaggtgcccagggccagag

SEQ ID NO: 9353965 - DNA, 22 bp, Homo sapiens
gggcaggtgacctcttgtcctg

SEQ ID NO: 9353966 - DNA, 22 bp, Homo sapiens
gggcaggtgattttggctccat

SEQ ID NO: 9353967 - DNA, 22 bp, Homo sapiens
gggcaggtgacctcttgtcctg

SEQ ID NO: 9353968 - DNA, 22 bp, Homo sapiens
gggcaggtgattttggctccat

SEQ ID NO: 9353969 - DNA, 22 bp, Homo sapiens
gggcaggtgattttggctccat

SEQ ID NO: 9353970 - DNA, 21 bp, Homo sapiens
gggcaggtctctgatgtcaac

SEQ ID NO: 9353971 - DNA, 21 bp, Homo sapiens
gggcaggtctctgatgtcaac

SEQ ID NO: 9353972 - DNA, 22 bp, Homo sapiens
gggcaggtctgggtcagcctga

SEQ ID NO: 9353973 - DNA, 22 bp, Homo sapiens
gggcaggtctgggtcagcctga

SEQ ID NO: 9353974 - DNA, 15 bp, Homo sapiens
gggcaggtctggggc

SEQ ID NO: 9353975 - DNA, 15 bp, Homo sapiens
gggcaggtctggggc

SEQ ID NO: 9353976 - DNA, 17 bp, Homo sapiens
gggcagggactcctggg

SEQ ID NO: 9353977 - DNA, 17 bp, Homo sapiens
gggcagggactcctggg

SEQ ID NO: 9353978 - DNA, 21 bp, Homo sapiens
gggcagaggggcctcctgggt

SEQ ID NO: 9353979 - DNA, 21 bp, Homo sapiens
gggcagaggggcctcctgggt

SEQ ID NO: 9353980 - DNA, 22 bp, Homo sapiens
gggcagaggctctggcccatcc

SEQ ID NO: 9353981 - DNA, 22 bp, Homo sapiens
gggcagaggctctggcccatcc

SEQ ID NO: 9353982 - DNA, 21 bp, Homo sapiens
gggcagaggggcctcctgggt

SEQ ID NO: 9353983 - DNA, 21 bp, Homo sapiens
gggcagaggggcctcctgggt

SEQ ID NO: 9353984 - DNA, 21 bp, Homo sapiens
gggcagaggggcctcctgggt

SEQ ID NO: 9353985 - DNA, 21 bp, Homo sapiens
gggcagaggggcctcctgggt

SEQ ID NO: 9353986 - DNA, 21 bp, Homo sapiens
gggcagaggggcctcctgggt

SEQ ID NO: 9353987 - DNA, 22 bp, Homo sapiens
gggagtgggtttggcctaggcc

SEQ ID NO: 9353988 - DNA, 22 bp, Homo sapiens
gggagtgggtttggcctaggcc

SEQ ID NO: 9353989 - DNA, 22 bp, Homo sapiens
gggagtggggcttaccttgaag

SEQ ID NO: 9353990 - DNA, 22 bp, Homo sapiens
gggagtggggcttaccttgaag

SEQ ID NO: 9353991 - DNA, 22 bp, Homo sapiens
gggagtggggcttaccttgaag

SEQ ID NO: 9353992 - DNA, 22 bp, Homo sapiens
gggagtgggtttggcctaggcc

SEQ ID NO: 9353993 - DNA, 20 bp, Homo sapiens
gggagtggtggtagcctgtg

SEQ ID NO: 9353994 - DNA, 20 bp, Homo sapiens
gggagtggtggtagcctgtg

SEQ ID NO: 9353995 - DNA, 22 bp, Homo sapiens
gggagtggttgatggtgaaaat

SEQ ID NO: 9353996 - DNA, 22 bp, Homo sapiens
gggagtgggtttggcctaggcc

SEQ ID NO: 9353997 - DNA, 22 bp, Homo sapiens
gggagtggtcctttcctatctg

SEQ ID NO: 9353998 - DNA, 20 bp, Homo sapiens
gggagtggtggtagcctgtg

SEQ ID NO: 9353999 - DNA, 20 bp, Homo sapiens
gggagtggtggtagcctgtg

SEQ ID NO: 9354000 - DNA, 22 bp, Homo sapiens
gggagtggtcctttcctatctg

SEQ ID NO: 9354001 - DNA, 22 bp, Homo sapiens
gggatcagactctgggatgtag

SEQ ID NO: 9354002 - DNA, 22 bp, Homo sapiens
gggatcagactctgggatgtag

SEQ ID NO: 9354003 - DNA, 22 bp, Homo sapiens
gggatcagattccctgtcccaa

SEQ ID NO: 9354004 - DNA, 22 bp, Homo sapiens
gggatcagcaagccactgcacc

SEQ ID NO: 9354005 - DNA, 22 bp, Homo sapiens
gggatcagaaacatagccctga

SEQ ID NO: 9354006 - DNA, 20 bp, Homo sapiens
gggatcaggaaaggaggcta

SEQ ID NO: 9354007 - DNA, 20 bp, Homo sapiens
gggatcaggaaaggaggcta

SEQ ID NO: 9354008 - DNA, 19 bp, Homo sapiens
gggatcagcccagggctct

SEQ ID NO: 9354009 - DNA, 19 bp, Homo sapiens
gggatcagcccagggctct

SEQ ID NO: 9354010 - DNA, 22 bp, Homo sapiens
gggatcagcaagccactgcacc

SEQ ID NO: 9354011 - DNA, 22 bp, Homo sapiens
gggagtggttgatggtgaaaat

SEQ ID NO: 9354012 - DNA, 22 bp, Homo sapiens
gggataggaaacttaggtacac

SEQ ID NO: 9354013 - DNA, 19 bp, Homo sapiens
gggagttgttctgatccta

SEQ ID NO: 9354014 - DNA, 22 bp, Homo sapiens
gggataggaaacttaggtacac

SEQ ID NO: 9354015 - DNA, 22 bp, Homo sapiens
gggataggtttggaagaggtgg

SEQ ID NO: 9354016 - DNA, 22 bp, Homo sapiens
gggataggtttggaagaggtgg

SEQ ID NO: 9354017 - DNA, 22 bp, Homo sapiens
gggataggagattgggagtgtt

SEQ ID NO: 9354018 - DNA, 22 bp, Homo sapiens
gggataggagattgggagtgtt

SEQ ID NO: 9354019 - DNA, 22 bp, Homo sapiens
gggataggagattgggagtgtt

SEQ ID NO: 9354020 - DNA, 22 bp, Homo sapiens
gggagctgaaggagccggcggg

SEQ ID NO: 9354021 - DNA, 22 bp, Homo sapiens
gggagctgaaggagccggcggg

SEQ ID NO: 9354022 - DNA, 22 bp, Homo sapiens
gggagctgaatggcaatggaga

SEQ ID NO: 9354023 - DNA, 22 bp, Homo sapiens
gggagctgaagtaggggtaaat

SEQ ID NO: 9354024 - DNA, 22 bp, Homo sapiens
gggagctgaactgctgaagttg

SEQ ID NO: 9354025 - DNA, 22 bp, Homo sapiens
gggagctgaactgctgaagttg

SEQ ID NO: 9354026 - DNA, 22 bp, Homo sapiens
gggagctctccctgaggcctgg

SEQ ID NO: 9354027 - DNA, 22 bp, Homo sapiens
gggagctcgtgcgcccaggtgc

SEQ ID NO: 9354028 - DNA, 22 bp, Homo sapiens
gggagcgggactgcgcaggctt

SEQ ID NO: 9354029 - DNA, 22 bp, Homo sapiens
gggagtggagagcaatggatga

SEQ ID NO: 9354030 - DNA, 22 bp, Homo sapiens
gggagtggagagcaatggatga

SEQ ID NO: 9354031 - DNA, 22 bp, Homo sapiens
gggagctgaatggcaatggaga

SEQ ID NO: 9354032 - DNA, 22 bp, Homo sapiens
ggctgcaggttggttggcagct

SEQ ID NO: 9354033 - DNA, 22 bp, Homo sapiens
ggctgcaggttggttggcagct

SEQ ID NO: 9354034 - DNA, 22 bp, Homo sapiens
ggctgcaggttggttggcagct

SEQ ID NO: 9354035 - DNA, 22 bp, Homo sapiens
ggctgcaggttggttggcagct

SEQ ID NO: 9354036 - DNA, 22 bp, Homo sapiens
ggctgcagggcagctggtgtgg

SEQ ID NO: 9354037 - DNA, 22 bp, Homo sapiens
ggctgcagggcagctggtgtgg

SEQ ID NO: 9354038 - DNA, 17 bp, Homo sapiens
ggctgcagtccaggagg

SEQ ID NO: 9354039 - DNA, 17 bp, Homo sapiens
ggctgcagtccaggagg

SEQ ID NO: 9354040 - DNA, 17 bp, Homo sapiens
ggctgcagtccaggagg

SEQ ID NO: 9354041 - DNA, 17 bp, Homo sapiens
ggctgcagtccaggagg

SEQ ID NO: 9354042 - DNA, 17 bp, Homo sapiens
ggctgcagtccaggagg

SEQ ID NO: 9354043 - DNA, 20 bp, Homo sapiens
ggctgcagtgcacctcatct

SEQ ID NO: 9354044 - DNA, 20 bp, Homo sapiens
ggctgcagtgcacctcatct

SEQ ID NO: 9354045 - DNA, 20 bp, Homo sapiens
ggctgcagtgcacctcatct

SEQ ID NO: 9354046 - DNA, 22 bp, Homo sapiens
ggctctgcgcggtaaagtgact

SEQ ID NO: 9354047 - DNA, 22 bp, Homo sapiens
ggctctgcggcgtgtgcgcagg

SEQ ID NO: 9354048 - DNA, 22 bp, Homo sapiens
ggctctgcggcgtgtgcgcagg

SEQ ID NO: 9354049 - DNA, 22 bp, Homo sapiens
ggctgcaggcagggtatccact

SEQ ID NO: 9354050 - DNA, 22 bp, Homo sapiens
ggctgcaggcagggtatccact

SEQ ID NO: 9354051 - DNA, 22 bp, Homo sapiens
ggctgcaggcttccctccagca

SEQ ID NO: 9354052 - DNA, 22 bp, Homo sapiens
ggctgcaggcttccctccagca

SEQ ID NO: 9354053 - DNA, 21 bp, Homo sapiens
ggctgcagggagccctggggt

SEQ ID NO: 9354054 - DNA, 21 bp, Homo sapiens
ggctgcagggagccctggggt

SEQ ID NO: 9354055 - DNA, 21 bp, Homo sapiens
ggctgcagggagccctggggt

SEQ ID NO: 9354056 - DNA, 21 bp, Homo sapiens
ggctgcagggagccctggggt

SEQ ID NO: 9354057 - DNA, 22 bp, Homo sapiens
ggctgcaggcttccctccagca

SEQ ID NO: 9354058 - DNA, 22 bp, Homo sapiens
ggctgcaggcttccctccagca

SEQ ID NO: 9354059 - DNA, 20 bp, Homo sapiens
ggctgcctccttcctttcct

SEQ ID NO: 9354060 - DNA, 19 bp, Homo sapiens
ggctgcctcctgggagatt

SEQ ID NO: 9354061 - DNA, 22 bp, Homo sapiens
ggctgcctcctgctgggctgga

SEQ ID NO: 9354062 - DNA, 22 bp, Homo sapiens
ggctgcctcctgctgggctgga

SEQ ID NO: 9354063 - DNA, 22 bp, Homo sapiens
ggctgcctcctcgagacaggat

SEQ ID NO: 9354064 - DNA, 22 bp, Homo sapiens
ggctgcctccactgcttgtccc

SEQ ID NO: 9354065 - DNA, 22 bp, Homo sapiens
ggctgcctcccaggagaatctg

SEQ ID NO: 9354066 - DNA, 22 bp, Homo sapiens
ggctgccagtgagtgcagaccg

SEQ ID NO: 9354067 - DNA, 22 bp, Homo sapiens
ggctgccacgtcgagggtccaa

SEQ ID NO: 9354068 - DNA, 22 bp, Homo sapiens
ggctgccacgtcgagggtccaa

SEQ ID NO: 9354069 - DNA, 22 bp, Homo sapiens
ggctgccacgtcgagggtccaa

SEQ ID NO: 9354070 - DNA, 22 bp, Homo sapiens
ggctgccagcactggtgtagag

SEQ ID NO: 9354071 - DNA, 22 bp, Homo sapiens
ggctgccagcactggtgtagag

SEQ ID NO: 9354072 - DNA, 22 bp, Homo sapiens
ggctgccaggagaagctcagtg

SEQ ID NO: 9354073 - DNA, 22 bp, Homo sapiens
ggctgccaggagggaggccagt

SEQ ID NO: 9354074 - DNA, 22 bp, Homo sapiens
ggctgccaggagggaggccagt

SEQ ID NO: 9354075 - DNA, 22 bp, Homo sapiens
ggctgccagcactggtgtagag

SEQ ID NO: 9354076 - DNA, 22 bp, Homo sapiens
ggctgccaggagaagctcagtg

SEQ ID NO: 9354077 - DNA, 22 bp, Homo sapiens
ggctgcatgcctcagtgtaaga

SEQ ID NO: 9354078 - DNA, 22 bp, Homo sapiens
ggctgcatgttcagatgacact

SEQ ID NO: 9354079 - DNA, 20 bp, Homo sapiens
ggctgcagtgcacctcatct

SEQ ID NO: 9354080 - DNA, 22 bp, Homo sapiens
ggctgcagttgtgtgaaggccg

SEQ ID NO: 9354081 - DNA, 22 bp, Homo sapiens
ggctgcagttgtgtgaaggccg

SEQ ID NO: 9354082 - DNA, 22 bp, Homo sapiens
ggctgcagttgtgtgaaggccg

SEQ ID NO: 9354083 - DNA, 22 bp, Homo sapiens
ggctggcagaggggagtctgtg

SEQ ID NO: 9354084 - DNA, 22 bp, Homo sapiens
ggctggcagaggggagtctgtg

SEQ ID NO: 9354085 - DNA, 22 bp, Homo sapiens
ggctggcagaggggagtctgtg

SEQ ID NO: 9354086 - DNA, 22 bp, Homo sapiens
ggctggcagaagtgtgctggct

SEQ ID NO: 9354087 - DNA, 22 bp, Homo sapiens
ggctggcagaagtgtgctggct

SEQ ID NO: 9354088 - DNA, 22 bp, Homo sapiens
ggctggcagaagtgtgctggct

SEQ ID NO: 9354089 - DNA, 22 bp, Homo sapiens
ggctggcaggcacagtatgcaa

SEQ ID NO: 9354090 - DNA, 22 bp, Homo sapiens
ggctggcaggcacagtatgcaa

SEQ ID NO: 9354091 - DNA, 22 bp, Homo sapiens
ggctggcaggcacagtatgcaa

SEQ ID NO: 9354092 - DNA, 22 bp, Homo sapiens
ggctggcagaggggagtctgtg

SEQ ID NO: 9354093 - DNA, 22 bp, Homo sapiens
ggctggcagcttcatcccagat

SEQ ID NO: 9354094 - DNA, 22 bp, Homo sapiens
ggctggcagcttcatcccagat

SEQ ID NO: 9354095 - DNA, 22 bp, Homo sapiens
ggctggcaggactcacacttgg

SEQ ID NO: 9354096 - DNA, 22 bp, Homo sapiens
ggctggcatccagggaaatcca

SEQ ID NO: 9354097 - DNA, 22 bp, Homo sapiens
ggctggcattgctctattgcct

SEQ ID NO: 9354098 - DNA, 22 bp, Homo sapiens
ggctggcagtgtgagagaggga

SEQ ID NO: 9354099 - DNA, 22 bp, Homo sapiens
ggctggcagttaatacctgaag

SEQ ID NO: 9354100 - DNA, 22 bp, Homo sapiens
ggctggcatttacacaatgcat

SEQ ID NO: 9354101 - DNA, 22 bp, Homo sapiens
ggctggcattgctctattgcct

SEQ ID NO: 9354102 - DNA, 22 bp, Homo sapiens
ggctggcattgctctattgcct

SEQ ID NO: 9354103 - DNA, 22 bp, Homo sapiens
ggctggcagtgtgagagaggga

SEQ ID NO: 9354104 - DNA, 22 bp, Homo sapiens
ggctggcagtgtgagagaggga

SEQ ID NO: 9354105 - DNA, 22 bp, Homo sapiens
ggctggcagtgtgagagaggga

SEQ ID NO: 9354106 - DNA, 22 bp, Homo sapiens
ggctggcaggggatgtcagatg

SEQ ID NO: 9354107 - DNA, 22 bp, Homo sapiens
ggctggcaggggatgtcagatg

SEQ ID NO: 9354108 - DNA, 22 bp, Homo sapiens
ggctggcaggggatgtcagatg

SEQ ID NO: 9354109 - DNA, 22 bp, Homo sapiens
ggctggcaggggatgtcagatg

SEQ ID NO: 9354110 - DNA, 19 bp, Homo sapiens
ggctggagtggccatctgt

SEQ ID NO: 9354111 - DNA, 19 bp, Homo sapiens
ggctggagtggccatctgt

SEQ ID NO: 9354112 - DNA, 19 bp, Homo sapiens
ggctggagtggccatctgt

SEQ ID NO: 9354113 - DNA, 22 bp, Homo sapiens
ggctggaggtagaagaacactt

SEQ ID NO: 9354114 - DNA, 19 bp, Homo sapiens
ggctggagtggccatctgt

SEQ ID NO: 9354115 - DNA, 17 bp, Homo sapiens
ggctggaggggacccgg

SEQ ID NO: 9354116 - DNA, 22 bp, Homo sapiens
ggctggaggtagaagaacactt

SEQ ID NO: 9354117 - DNA, 22 bp, Homo sapiens
ggctggagtgggctccagagtt

SEQ ID NO: 9354118 - DNA, 22 bp, Homo sapiens
ggctggagtgggctccagagtt

SEQ ID NO: 9354119 - DNA, 22 bp, Homo sapiens
ggctggcagaagtgtgctggct

SEQ ID NO: 9354120 - DNA, 22 bp, Homo sapiens
ggctggatgtactttggggctg

SEQ ID NO: 9354121 - DNA, 22 bp, Homo sapiens
ggctggagtgggctccagagtt

SEQ ID NO: 9354122 - DNA, 22 bp, Homo sapiens
ggctggagtgggctccagagtt

SEQ ID NO: 9354123 - DNA, 22 bp, Homo sapiens
ggctgcctgaactttggggaaa

SEQ ID NO: 9354124 - DNA, 22 bp, Homo sapiens
ggctgcctctgatgtgcagacg

SEQ ID NO: 9354125 - DNA, 22 bp, Homo sapiens
ggctgcctctggaagctggaga

SEQ ID NO: 9354126 - DNA, 22 bp, Homo sapiens
ggctgcctgaggctgaggcccg

SEQ ID NO: 9354127 - DNA, 22 bp, Homo sapiens
ggctgcctgccgcccacttggc

SEQ ID NO: 9354128 - DNA, 22 bp, Homo sapiens
ggctgcctgcctccaagccggg

SEQ ID NO: 9354129 - DNA, 22 bp, Homo sapiens
ggctgcctgctcctcctgcacg

SEQ ID NO: 9354130 - DNA, 22 bp, Homo sapiens
ggctgcctgctcaggtgcggcg

SEQ ID NO: 9354131 - DNA, 22 bp, Homo sapiens
ggctgcctgctcctcctgcacg

SEQ ID NO: 9354132 - DNA, 22 bp, Homo sapiens
ggctgcctggacctcctctttc

SEQ ID NO: 9354133 - DNA, 22 bp, Homo sapiens
ggctggagacaacgtcctgccc

SEQ ID NO: 9354134 - DNA, 22 bp, Homo sapiens
ggctggagacaacgtcctgccc

SEQ ID NO: 9354135 - DNA, 22 bp, Homo sapiens
ggctggagatatgtctggaaca

SEQ ID NO: 9354136 - DNA, 22 bp, Homo sapiens
ggctggagatatgtctggaaca

SEQ ID NO: 9354137 - DNA, 22 bp, Homo sapiens
ggctggaggagaatgggtgtga

SEQ ID NO: 9354138 - DNA, 22 bp, Homo sapiens
ggctggaggagaatgggtgtga

SEQ ID NO: 9354139 - DNA, 17 bp, Homo sapiens
ggctggagcagctcccc

SEQ ID NO: 9354140 - DNA, 22 bp, Homo sapiens
gggaagagtaactagcccatgt

SEQ ID NO: 9354141 - DNA, 22 bp, Homo sapiens
gggaagagtgtcggttgaagtg

SEQ ID NO: 9354142 - DNA, 22 bp, Homo sapiens
gggaagagtgtcggttgaagtg

SEQ ID NO: 9354143 - DNA, 22 bp, Homo sapiens
gggaagagtaactagcccatgt

SEQ ID NO: 9354144 - DNA, 22 bp, Homo sapiens
gggaagatagtgttgagggccc

SEQ ID NO: 9354145 - DNA, 22 bp, Homo sapiens
gggaagcagcattgtgctggct

SEQ ID NO: 9354146 - DNA, 22 bp, Homo sapiens
gggaagcagatcataccagacc

SEQ ID NO: 9354147 - DNA, 22 bp, Homo sapiens
gggaagccatgctcagaggtac

SEQ ID NO: 9354148 - DNA, 22 bp, Homo sapiens
gggaagcatctgagggtccact

SEQ ID NO: 9354149 - DNA, 18 bp, Homo sapiens
gggaagccgggaagccgg

SEQ ID NO: 9354150 - DNA, 22 bp, Homo sapiens
gggaagccctgtgcttgcctgg

SEQ ID NO: 9354151 - DNA, 22 bp, Homo sapiens
gggaaggcaggattctctggtg

SEQ ID NO: 9354152 - DNA, 22 bp, Homo sapiens
gggaaggcatacctgagggaga

SEQ ID NO: 9354153 - DNA, 22 bp, Homo sapiens
gggaaggcatacctgagggaga

SEQ ID NO: 9354154 - DNA, 22 bp, Homo sapiens
gggaaggcagtgggaggaactg

SEQ ID NO: 9354155 - DNA, 22 bp, Homo sapiens
gggaaggcagtgggaggaactg

SEQ ID NO: 9354156 - DNA, 22 bp, Homo sapiens
gggagccacagtagcagctact

SEQ ID NO: 9354157 - DNA, 23 bp, Homo sapiens
gggagatgggaaatgaaggctct

SEQ ID NO: 9354158 - DNA, 22 bp, Homo sapiens
gggagccacagtttatagtgat

SEQ ID NO: 9354159 - DNA, 22 bp, Homo sapiens
gggagccacagtgaggtgcatg

SEQ ID NO: 9354160 - DNA, 22 bp, Homo sapiens
gggagatggctcagaggccgcg

SEQ ID NO: 9354161 - DNA, 23 bp, Homo sapiens
gggagatgggaaatgaaggctct

SEQ ID NO: 9354162 - DNA, 23 bp, Homo sapiens
gggagatgggaaatgaaggctct

SEQ ID NO: 9354163 - DNA, 23 bp, Homo sapiens
gggagatgggaaatgaaggctct

SEQ ID NO: 9354164 - DNA, 22 bp, Homo sapiens
gggagatgactcagtgacctcg

SEQ ID NO: 9354165 - DNA, 22 bp, Homo sapiens
gggaaggccggtccagtcaggt

SEQ ID NO: 9354166 - DNA, 22 bp, Homo sapiens
gggagccagcagggcatggagc

SEQ ID NO: 9354167 - DNA, 22 bp, Homo sapiens
gggagccagcagggcatggagc

SEQ ID NO: 9354168 - DNA, 23 bp, Homo sapiens
gggagccaggacctcgcgcccca

SEQ ID NO: 9354169 - DNA, 22 bp, Homo sapiens
gggagccagccatccagaacct

SEQ ID NO: 9354170 - DNA, 22 bp, Homo sapiens
gggagccagcctttgcctataa

SEQ ID NO: 9354171 - DNA, 18 bp, Homo sapiens
ggctgtgcgtggaggctg

SEQ ID NO: 9354172 - DNA, 18 bp, Homo sapiens
ggctgtgcgtggaggctg

SEQ ID NO: 9354173 - DNA, 22 bp, Homo sapiens
ggctggccagggccctcgctgg

SEQ ID NO: 9354174 - DNA, 22 bp, Homo sapiens
ggctggccagggccctcgctgg

SEQ ID NO: 9354175 - DNA, 22 bp, Homo sapiens
ggctgtgcgggcagccgtggga

SEQ ID NO: 9354176 - DNA, 22 bp, Homo sapiens
ggctgtgctgagggggaagccc

SEQ ID NO: 9354177 - DNA, 22 bp, Homo sapiens
ggctgtgctgagggggaagccc

SEQ ID NO: 9354178 - DNA, 22 bp, Homo sapiens
ggctgtgctgagggggaagccc

SEQ ID NO: 9354179 - DNA, 21 bp, Homo sapiens
ggctgtggagccatgactcac

SEQ ID NO: 9354180 - DNA, 22 bp, Homo sapiens
ggctgtggacactgagctcaga

SEQ ID NO: 9354181 - DNA, 22 bp, Homo sapiens
ggctgtggacactgagctcaga

SEQ ID NO: 9354182 - DNA, 22 bp, Homo sapiens
ggctgtgctttgcccaaagggc

SEQ ID NO: 9354183 - DNA, 22 bp, Homo sapiens
ggctgtggcattaggtgaggcc

SEQ ID NO: 9354184 - DNA, 22 bp, Homo sapiens
ggctgtggccagcggggctgag

SEQ ID NO: 9354185 - DNA, 22 bp, Homo sapiens
ggctgtggcagctggaagtggt

SEQ ID NO: 9354186 - DNA, 22 bp, Homo sapiens
ggctgtggcagctggaagtggt

SEQ ID NO: 9354187 - DNA, 22 bp, Homo sapiens
ggctgtggcagctggaagtggt

SEQ ID NO: 9354188 - DNA, 22 bp, Homo sapiens
ggctgtggcagctggaagtggt

SEQ ID NO: 9354189 - DNA, 22 bp, Homo sapiens
ggctgtggagctgcagagttgg

SEQ ID NO: 9354190 - DNA, 22 bp, Homo sapiens
ggctgtggtctcatctagcctt

SEQ ID NO: 9354191 - DNA, 22 bp, Homo sapiens
ggctgtggtctgggtgctcccc

SEQ ID NO: 9354192 - DNA, 22 bp, Homo sapiens
ggctgtgggtgtgacaggcctc

SEQ ID NO: 9354193 - DNA, 22 bp, Homo sapiens
gggaagagggagctggaatgat

SEQ ID NO: 9354194 - DNA, 22 bp, Homo sapiens
gggaagagggagctggaatgat

SEQ ID NO: 9354195 - DNA, 22 bp, Homo sapiens
gggaagagggagctggaatgat

SEQ ID NO: 9354196 - DNA, 22 bp, Homo sapiens
gggaagagggagctggaatgat

SEQ ID NO: 9354197 - DNA, 22 bp, Homo sapiens
gggaagagggagctggaatgat

SEQ ID NO: 9354198 - DNA, 18 bp, Homo sapiens
gggaagaggatctggccc

SEQ ID NO: 9354199 - DNA, 18 bp, Homo sapiens
gggaagaggatctggccc

SEQ ID NO: 9354200 - DNA, 22 bp, Homo sapiens
gggaagagggagctggaatgat

SEQ ID NO: 9354201 - DNA, 22 bp, Homo sapiens
ggctgtgggatgcataggagct

SEQ ID NO: 9354202 - DNA, 22 bp, Homo sapiens
ggctgtgggatgcataggagct

SEQ ID NO: 9354203 - DNA, 22 bp, Homo sapiens
ggctgtggccagcggggctgag

SEQ ID NO: 9354204 - DNA, 22 bp, Homo sapiens
ggctgtggggaccaacaggact

SEQ ID NO: 9354205 - DNA, 22 bp, Homo sapiens
ggctgtggggggagcctgcccg

SEQ ID NO: 9354206 - DNA, 22 bp, Homo sapiens
ggctgtggggggagcctgcccg

SEQ ID NO: 9354207 - DNA, 22 bp, Homo sapiens
ggctcaccattttcactctctg

SEQ ID NO: 9354208 - DNA, 22 bp, Homo sapiens
ggctcaccatggcctccctgct

SEQ ID NO: 9354209 - DNA, 23 bp, Homo sapiens
ggctcacacggagtgcctccacc

SEQ ID NO: 9354210 - DNA, 22 bp, Homo sapiens
ggctagggaaaatgattggata

SEQ ID NO: 9354211 - DNA, 22 bp, Homo sapiens
ggctagggacacagctctgctc

SEQ ID NO: 9354212 - DNA, 22 bp, Homo sapiens
ggctagggacacagctctgctc

SEQ ID NO: 9354213 - DNA, 22 bp, Homo sapiens
ggctagggacacagctctgctc

SEQ ID NO: 9354214 - DNA, 22 bp, Homo sapiens
ggctcactgcaacttccgcctc

SEQ ID NO: 9354215 - DNA, 22 bp, Homo sapiens
ggctcactgcaacctctgcctc

SEQ ID NO: 9354216 - DNA, 22 bp, Homo sapiens
ggctcactgcaacttccgcctc

SEQ ID NO: 9354217 - DNA, 22 bp, Homo sapiens
ggctcacgcaattatcccggcc

SEQ ID NO: 9354218 - DNA, 22 bp, Homo sapiens
ggcctctggttcacagggagga

SEQ ID NO: 9354219 - DNA, 22 bp, Homo sapiens
ggctaggctcacctggagagtt

SEQ ID NO: 9354220 - DNA, 22 bp, Homo sapiens
ggcctctggtgcctgaagcgcc

SEQ ID NO: 9354221 - DNA, 22 bp, Homo sapiens
ggcctctggtcaagacaagcat

SEQ ID NO: 9354222 - DNA, 22 bp, Homo sapiens
ggcctctggggtcctgagccca

SEQ ID NO: 9354223 - DNA, 22 bp, Homo sapiens
ggcctctggggtcctgagccca

SEQ ID NO: 9354224 - DNA, 22 bp, Homo sapiens
ggcctctggggtcctgagccca

SEQ ID NO: 9354225 - DNA, 18 bp, Homo sapiens
ggcctctggactggcagc

SEQ ID NO: 9354226 - DNA, 22 bp, Homo sapiens
ggcctctggcaggcaggccctc

SEQ ID NO: 9354227 - DNA, 18 bp, Homo sapiens
ggcctctggactggcagc

SEQ ID NO: 9354228 - DNA, 22 bp, Homo sapiens
ggcctctgcttatgctgatgac

SEQ ID NO: 9354229 - DNA, 22 bp, Homo sapiens
ggcctctgcttatgctgatgac

SEQ ID NO: 9354230 - DNA, 22 bp, Homo sapiens
ggcctctgcttatgctgatgac

SEQ ID NO: 9354231 - DNA, 22 bp, Homo sapiens
ggcctctgcttatgctgatgac

SEQ ID NO: 9354232 - DNA, 22 bp, Homo sapiens
ggcctctgcaggcctcgacaag

SEQ ID NO: 9354233 - DNA, 22 bp, Homo sapiens
ggcctctgccccagccacacct

SEQ ID NO: 9354234 - DNA, 22 bp, Homo sapiens
ggcctctgccccagccacacct

SEQ ID NO: 9354235 - DNA, 22 bp, Homo sapiens
ggcctctgcaactggctgtggc

SEQ ID NO: 9354236 - DNA, 22 bp, Homo sapiens
ggcctctgcaactggctgtggc

SEQ ID NO: 9354237 - DNA, 19 bp, Homo sapiens
ggcctctgcaggccgcccc

SEQ ID NO: 9354238 - DNA, 21 bp, Homo sapiens
ggcctctgccttgccccactc

SEQ ID NO: 9354239 - DNA, 21 bp, Homo sapiens
ggcctctgccttgccccactc

SEQ ID NO: 9354240 - DNA, 22 bp, Homo sapiens
ggcctctgccccgcggggctcg

SEQ ID NO: 9354241 - DNA, 22 bp, Homo sapiens
ggcctctgcctcatctgggcac

SEQ ID NO: 9354242 - DNA, 22 bp, Homo sapiens
ggcctctgccctcactcctgtc

SEQ ID NO: 9354243 - DNA, 22 bp, Homo sapiens
ggcctctcttgggacagctgtc

SEQ ID NO: 9354244 - DNA, 22 bp, Homo sapiens
ggcctctctggcatggctgccc

SEQ ID NO: 9354245 - DNA, 22 bp, Homo sapiens
ggcctctctggcatggctgccc

SEQ ID NO: 9354246 - DNA, 22 bp, Homo sapiens
ggcctctcttgggacagctgtc

SEQ ID NO: 9354247 - DNA, 22 bp, Homo sapiens
ggcctctgaggacagccttggc

SEQ ID NO: 9354248 - DNA, 22 bp, Homo sapiens
ggcctctgaggacagccttggc

SEQ ID NO: 9354249 - DNA, 22 bp, Homo sapiens
ggcctctgaggacagccttggc

SEQ ID NO: 9354250 - DNA, 22 bp, Homo sapiens
ggcctctgaggacagccttggc

SEQ ID NO: 9354251 - DNA, 22 bp, Homo sapiens
ggcctctgaggacagccttggc

SEQ ID NO: 9354252 - DNA, 21 bp, Homo sapiens
ggcctcccggaccgcagcgcc

SEQ ID NO: 9354253 - DNA, 21 bp, Homo sapiens
ggcctcccggaccgcagcgcc

SEQ ID NO: 9354254 - DNA, 22 bp, Homo sapiens
ggcctccaggcctactcagggc

SEQ ID NO: 9354255 - DNA, 22 bp, Homo sapiens
ggcctccaggcctactcagggc

SEQ ID NO: 9354256 - DNA, 22 bp, Homo sapiens
ggcctctctccttggcttgcag

SEQ ID NO: 9354257 - DNA, 22 bp, Homo sapiens
ggcctcctcaccctgctcaggc

SEQ ID NO: 9354258 - DNA, 22 bp, Homo sapiens
ggcctctctgagagcagacgtt

SEQ ID NO: 9354259 - DNA, 22 bp, Homo sapiens
ggcctcctcaccctgctcaggc

SEQ ID NO: 9354260 - DNA, 21 bp, Homo sapiens
ggcctcctacagtcatgggcc

SEQ ID NO: 9354261 - DNA, 21 bp, Homo sapiens
ggcctcctacagtcatgggcc

SEQ ID NO: 9354262 - DNA, 22 bp, Homo sapiens
ggcctcctcaccctgctcaggc

SEQ ID NO: 9354263 - DNA, 22 bp, Homo sapiens
ggctctgaacatggggaggagt

SEQ ID NO: 9354264 - DNA, 22 bp, Homo sapiens
ggctctgaaggagacagctgct

SEQ ID NO: 9354265 - DNA, 22 bp, Homo sapiens
ggctctctgaggaaacccttcc

SEQ ID NO: 9354266 - DNA, 17 bp, Homo sapiens
ggctctcttccagactt

SEQ ID NO: 9354267 - DNA, 22 bp, Homo sapiens
ggctcagagttaggacccatgt

SEQ ID NO: 9354268 - DNA, 22 bp, Homo sapiens
ggctcagatggtttgttctaga

SEQ ID NO: 9354269 - DNA, 22 bp, Homo sapiens
ggctcagaggttgaggccggca

SEQ ID NO: 9354270 - DNA, 22 bp, Homo sapiens
ggctcagagttaggacccatgt

SEQ ID NO: 9354271 - DNA, 22 bp, Homo sapiens
ggctcagaggttgaggccggca

SEQ ID NO: 9354272 - DNA, 22 bp, Homo sapiens
ggctcagattccgagtggccct

SEQ ID NO: 9354273 - DNA, 22 bp, Homo sapiens
ggctcagattccgagtggccct

SEQ ID NO: 9354274 - DNA, 22 bp, Homo sapiens
ggctcagattccgagtggccct

SEQ ID NO: 9354275 - DNA, 22 bp, Homo sapiens
ggctcagcacagggctggcatc

SEQ ID NO: 9354276 - DNA, 22 bp, Homo sapiens
ggctcagcacagggctggcatc

SEQ ID NO: 9354277 - DNA, 22 bp, Homo sapiens
ggctcagcaatgatgagcccct

SEQ ID NO: 9354278 - DNA, 22 bp, Homo sapiens
ggctcagcacagggctggcatc

SEQ ID NO: 9354279 - DNA, 22 bp, Homo sapiens
ggctcagcaatgatgagcccct

SEQ ID NO: 9354280 - DNA, 22 bp, Homo sapiens
ggctcagattccgagtggccct

SEQ ID NO: 9354281 - DNA, 22 bp, Homo sapiens
ggctcactgcaacttccgcctc

SEQ ID NO: 9354282 - DNA, 22 bp, Homo sapiens
ggctcactgcaacttccgcctc

SEQ ID NO: 9354283 - DNA, 22 bp, Homo sapiens
ggctcactttggggtcagctgg

SEQ ID NO: 9354284 - DNA, 23 bp, Homo sapiens
ggctcagaaaaagtcctggcctc

SEQ ID NO: 9354285 - DNA, 22 bp, Homo sapiens
ggctcagaaactaaaggcgctg

SEQ ID NO: 9354286 - DNA, 23 bp, Homo sapiens
ggctcagaaaaagtcctggcctc

SEQ ID NO: 9354287 - DNA, 22 bp, Homo sapiens
ggctcagaaacctctggtgtct

SEQ ID NO: 9354288 - DNA, 22 bp, Homo sapiens
ggctcagaaactaaaggcgctg

SEQ ID NO: 9354289 - DNA, 22 bp, Homo sapiens
ggctcagaaggccatgctctgc

SEQ ID NO: 9354290 - DNA, 22 bp, Homo sapiens
ggctcagaaggccatgctctgc

SEQ ID NO: 9354291 - DNA, 22 bp, Homo sapiens
ggctcagaaactaaaggcgctg

SEQ ID NO: 9354292 - DNA, 22 bp, Homo sapiens
ggctcagaggccagcaggtaga

SEQ ID NO: 9354293 - DNA, 22 bp, Homo sapiens
ggctcagaggccagcaggtaga

SEQ ID NO: 9354294 - DNA, 22 bp, Homo sapiens
ggctcagaggccagcaggtaga

SEQ ID NO: 9354295 - DNA, 22 bp, Homo sapiens
ggctcagaggttgaggccggca

SEQ ID NO: 9354296 - DNA, 22 bp, Homo sapiens
ggctcagaggttgaggccggca

SEQ ID NO: 9354297 - DNA, 22 bp, Homo sapiens
ggctcagaggccagcaggtaga

SEQ ID NO: 9354298 - DNA, 22 bp, Homo sapiens
ggctcagaggagctggaacggt

SEQ ID NO: 9354299 - DNA, 22 bp, Homo sapiens
ggctcagaggagctggaacggt

SEQ ID NO: 9354300 - DNA, 22 bp, Homo sapiens
ggctcagacctcccagctccag

SEQ ID NO: 9354301 - DNA, 22 bp, Homo sapiens
ggctcagacctcccagctccag

SEQ ID NO: 9354302 - DNA, 22 bp, Homo sapiens
ggctcagacctcccagctccag

SEQ ID NO: 9354303 - DNA, 22 bp, Homo sapiens
ggctcagacctcccagctccag

SEQ ID NO: 9354304 - DNA, 22 bp, Homo sapiens
ggctcagagacctgcgatctga

SEQ ID NO: 9354305 - DNA, 22 bp, Homo sapiens
ggctcagactcccaggccctct

SEQ ID NO: 9354306 - DNA, 22 bp, Homo sapiens
ggctcagactcccaggccctct

SEQ ID NO: 9354307 - DNA, 22 bp, Homo sapiens
ggctctgcctctgaccctctgg

SEQ ID NO: 9354308 - DNA, 22 bp, Homo sapiens
ggctctgcctgcccagcagcac

SEQ ID NO: 9354309 - DNA, 22 bp, Homo sapiens
ggctctgccgtgtgctcacatg

SEQ ID NO: 9354310 - DNA, 22 bp, Homo sapiens
ggctctgccgtgtgctcacatg

SEQ ID NO: 9354311 - DNA, 22 bp, Homo sapiens
ggctctgcctgcctgagtgtcc

SEQ ID NO: 9354312 - DNA, 22 bp, Homo sapiens
ggctctgcctgcctgagtgtcc

SEQ ID NO: 9354313 - DNA, 22 bp, Homo sapiens
ggctctgcgcctgcggggactt

SEQ ID NO: 9354314 - DNA, 22 bp, Homo sapiens
ggctctgcgcctgcggggactt

SEQ ID NO: 9354315 - DNA, 22 bp, Homo sapiens
ggctctgcctgcctgagtgtcc

SEQ ID NO: 9354316 - DNA, 22 bp, Homo sapiens
ggctctgcccgcggctgcccac

SEQ ID NO: 9354317 - DNA, 22 bp, Homo sapiens
ggctctgcccgcggctgcccac

SEQ ID NO: 9354318 - DNA, 22 bp, Homo sapiens
ggctctgcccagatgaagagga

SEQ ID NO: 9354319 - DNA, 22 bp, Homo sapiens
ggctctgcccaggtggacagca

SEQ ID NO: 9354320 - DNA, 22 bp, Homo sapiens
ggctctgccatttcctagctgc

SEQ ID NO: 9354321 - DNA, 22 bp, Homo sapiens
ggctctgccatttcctagctgc

SEQ ID NO: 9354322 - DNA, 22 bp, Homo sapiens
ggctctgccacttcttggctgt

SEQ ID NO: 9354323 - DNA, 22 bp, Homo sapiens
ggctctgccacttcttggctgt

SEQ ID NO: 9354324 - DNA, 22 bp, Homo sapiens
ggctctgccacttcttggctgt

SEQ ID NO: 9354325 - DNA, 22 bp, Homo sapiens
ggctctgcatgtgagtgggtgg

SEQ ID NO: 9354326 - DNA, 22 bp, Homo sapiens
ggctctgcatgtgagtgggtgg

SEQ ID NO: 9354327 - DNA, 22 bp, Homo sapiens
ggctctgcagtgacttgagggg

SEQ ID NO: 9354328 - DNA, 22 bp, Homo sapiens
ggctctgcatgcaggttgtcag

SEQ ID NO: 9354329 - DNA, 22 bp, Homo sapiens
ggctctgcagcttgctaactgt

SEQ ID NO: 9354330 - DNA, 22 bp, Homo sapiens
ggctctgcagtgacttgagggg

SEQ ID NO: 9354331 - DNA, 22 bp, Homo sapiens
ggctctgcagagggcccagctt

SEQ ID NO: 9354332 - DNA, 22 bp, Homo sapiens
ggctctgcagagggcccagctt

SEQ ID NO: 9354333 - DNA, 22 bp, Homo sapiens
ggctctgcactcagagtcattc

SEQ ID NO: 9354334 - DNA, 22 bp, Homo sapiens
ggctctgcaaaagtagatactt

SEQ ID NO: 9354335 - DNA, 22 bp, Homo sapiens
ggctctgcaaaagtagatactt

SEQ ID NO: 9354336 - DNA, 22 bp, Homo sapiens
ggctctgaggctatgctttaca

SEQ ID NO: 9354337 - DNA, 22 bp, Homo sapiens
ggctctgagtttagaagggtgg

SEQ ID NO: 9354338 - DNA, 22 bp, Homo sapiens
ggctctgagtttagaagggtgg

SEQ ID NO: 9354339 - DNA, 22 bp, Homo sapiens
ggctctgaattattcctgagtc

SEQ ID NO: 9354340 - DNA, 22 bp, Homo sapiens
ggctctgacctcccaggcagtt

SEQ ID NO: 9354341 - DNA, 23 bp, Homo sapiens
ggctctgaggatggagctggtgg

SEQ ID NO: 9354342 - DNA, 22 bp, Homo sapiens
ggcagtggcatgtgggtagtgg

SEQ ID NO: 9354343 - DNA, 22 bp, Homo sapiens
ggcagtggcatgtgggtagtgg

SEQ ID NO: 9354344 - DNA, 22 bp, Homo sapiens
ggcagtggctcctctctactcc

SEQ ID NO: 9354345 - DNA, 22 bp, Homo sapiens
ggcagtggcatgtgggtagtgg

SEQ ID NO: 9354346 - DNA, 22 bp, Homo sapiens
ggcagtgggaaataagtgagaa

SEQ ID NO: 9354347 - DNA, 22 bp, Homo sapiens
ggcagtggctcctctctactcc

SEQ ID NO: 9354348 - DNA, 22 bp, Homo sapiens
ggcagtggctgtagtctcttgg

SEQ ID NO: 9354349 - DNA, 17 bp, Homo sapiens
ggccacagagcttgggg

SEQ ID NO: 9354350 - DNA, 17 bp, Homo sapiens
ggccacagagcttgggg

SEQ ID NO: 9354351 - DNA, 22 bp, Homo sapiens
ggcagtgggtggatctcaggga

SEQ ID NO: 9354352 - DNA, 22 bp, Homo sapiens
ggccacagagggcgggatgctg

SEQ ID NO: 9354353 - DNA, 22 bp, Homo sapiens
ggccacagcagatgcttcagat

SEQ ID NO: 9354354 - DNA, 22 bp, Homo sapiens
ggccacagcagatgcttcagat

SEQ ID NO: 9354355 - DNA, 22 bp, Homo sapiens
ggccacagcaatgctgtgatgt

SEQ ID NO: 9354356 - DNA, 22 bp, Homo sapiens
ggccacagcaatgctgtgatgt

SEQ ID NO: 9354357 - DNA, 22 bp, Homo sapiens
ggccacagcaatgctgtgatgt

SEQ ID NO: 9354358 - DNA, 20 bp, Homo sapiens
ggccacagggtgctggtgga

SEQ ID NO: 9354359 - DNA, 20 bp, Homo sapiens
ggccacagggtgctggtgga

SEQ ID NO: 9354360 - DNA, 22 bp, Homo sapiens
ggccacagggctgaacgtggac

SEQ ID NO: 9354361 - DNA, 20 bp, Homo sapiens
ggccacagggtgctggtgga

SEQ ID NO: 9354362 - DNA, 20 bp, Homo sapiens
ggccacagggtgctggtgga

SEQ ID NO: 9354363 - DNA, 22 bp, Homo sapiens
ggccacagtctctggaaggatg

SEQ ID NO: 9354364 - DNA, 20 bp, Homo sapiens
ggccacagggtgctggtgga

SEQ ID NO: 9354365 - DNA, 22 bp, Homo sapiens
ggccacattcaaagctgtcctg

SEQ ID NO: 9354366 - DNA, 22 bp, Homo sapiens
ggccacattcaaagctgtcctg

SEQ ID NO: 9354367 - DNA, 22 bp, Homo sapiens
ggccacatgtggctgctcgtat

SEQ ID NO: 9354368 - DNA, 22 bp, Homo sapiens
ggccacatgaattcttggacag

SEQ ID NO: 9354369 - DNA, 22 bp, Homo sapiens
ggccacatgaattcttggacag

SEQ ID NO: 9354370 - DNA, 22 bp, Homo sapiens
ggccaccagtcctctggcaggg

SEQ ID NO: 9354371 - DNA, 21 bp, Homo sapiens
ggccacagttagggctcagga

SEQ ID NO: 9354372 - DNA, 22 bp, Homo sapiens
ggccacagtgggaaatcctggg

SEQ ID NO: 9354373 - DNA, 22 bp, Homo sapiens
ggccacagtgggaaatcctggg

SEQ ID NO: 9354374 - DNA, 21 bp, Homo sapiens
ggccacagttagggctcagga

SEQ ID NO: 9354375 - DNA, 21 bp, Homo sapiens
ggccacagttagggctcagga

SEQ ID NO: 9354376 - DNA, 21 bp, Homo sapiens
ggccacagttagggctcagga

SEQ ID NO: 9354377 - DNA, 22 bp, Homo sapiens
ggccacagtgggaaatcctggg

SEQ ID NO: 9354378 - DNA, 19 bp, Homo sapiens
ggccacctctcttcccagg

SEQ ID NO: 9354379 - DNA, 22 bp, Homo sapiens
ggccagagtctatatgcagaca

SEQ ID NO: 9354380 - DNA, 22 bp, Homo sapiens
ggccagagtctatatgcagaca

SEQ ID NO: 9354381 - DNA, 22 bp, Homo sapiens
ggccagagtctatatgcagaca

SEQ ID NO: 9354382 - DNA, 22 bp, Homo sapiens
ggccagcagacctcagggactc

SEQ ID NO: 9354383 - DNA, 22 bp, Homo sapiens
ggccagcagacctcagggactc

SEQ ID NO: 9354384 - DNA, 22 bp, Homo sapiens
ggccagctggatgtgggtgacg

SEQ ID NO: 9354385 - DNA, 22 bp, Homo sapiens
ggccagctggagttccgggtgg

SEQ ID NO: 9354386 - DNA, 22 bp, Homo sapiens
ggccagctgggccaccaggtgc

SEQ ID NO: 9354387 - DNA, 22 bp, Homo sapiens
ggcccagctgggcggggacacg

SEQ ID NO: 9354388 - DNA, 22 bp, Homo sapiens
ggcccagctctattgaattaca

SEQ ID NO: 9354389 - DNA, 22 bp, Homo sapiens
ggccagctgctcagtgtctctg

SEQ ID NO: 9354390 - DNA, 20 bp, Homo sapiens
ggccagctggaggcgccggg

SEQ ID NO: 9354391 - DNA, 22 bp, Homo sapiens
ggccagctgccaccagccctat

SEQ ID NO: 9354392 - DNA, 22 bp, Homo sapiens
ggccagctgccaccagccctat

SEQ ID NO: 9354393 - DNA, 20 bp, Homo sapiens
ggccagctgatgcacgatgc

SEQ ID NO: 9354394 - DNA, 22 bp, Homo sapiens
ggccagcagtcacagggtcaga

SEQ ID NO: 9354395 - DNA, 22 bp, Homo sapiens
ggccagcatatagagtgaagta

SEQ ID NO: 9354396 - DNA, 21 bp, Homo sapiens
ggccagcagcgtccactgtgg

SEQ ID NO: 9354397 - DNA, 22 bp, Homo sapiens
ggccagcaggccctgtgatcct

SEQ ID NO: 9354398 - DNA, 22 bp, Homo sapiens
ggccagctgagctgctgcacag

SEQ ID NO: 9354399 - DNA, 22 bp, Homo sapiens
ggccagctctgcacagcagctg

SEQ ID NO: 9354400 - DNA, 22 bp, Homo sapiens
ggccagctctgcacagcagctg

SEQ ID NO: 9354401 - DNA, 19 bp, Homo sapiens
ggccagccacctcgcctgg

SEQ ID NO: 9354402 - DNA, 19 bp, Homo sapiens
ggccagccacctcgcctgg

SEQ ID NO: 9354403 - DNA, 22 bp, Homo sapiens
ggccagcccagtggtcctctct

SEQ ID NO: 9354404 - DNA, 22 bp, Homo sapiens
ggcccaggctggagtgcagtgg

SEQ ID NO: 9354405 - DNA, 22 bp, Homo sapiens
ggcccaggctggagtgcagtgg

SEQ ID NO: 9354406 - DNA, 22 bp, Homo sapiens
ggcccaggatgcaagaactgaa

SEQ ID NO: 9354407 - DNA, 22 bp, Homo sapiens
ggcccaggatgcaagaactgaa

SEQ ID NO: 9354408 - DNA, 22 bp, Homo sapiens
ggcccagctttcattccttgct

SEQ ID NO: 9354409 - DNA, 22 bp, Homo sapiens
ggcccagctgtgcttccagccc

SEQ ID NO: 9354410 - DNA, 22 bp, Homo sapiens
ggcccagctgtatattacagtt

SEQ ID NO: 9354411 - DNA, 22 bp, Homo sapiens
ggcccagctgggcggggacacg

SEQ ID NO: 9354412 - DNA, 22 bp, Homo sapiens
ggcccagtgtgggtggatgttg

SEQ ID NO: 9354413 - DNA, 22 bp, Homo sapiens
ggcccagtgtgggtggatgttg

SEQ ID NO: 9354414 - DNA, 22 bp, Homo sapiens
ggcccagtgtcccggtcgtggc

SEQ ID NO: 9354415 - DNA, 22 bp, Homo sapiens
ggcccagtgtcccggtcgtggc

SEQ ID NO: 9354416 - DNA, 22 bp, Homo sapiens
ggcccagtgtaccccaggcagt

SEQ ID NO: 9354417 - DNA, 22 bp, Homo sapiens
ggcccagtgttgccagacctga

SEQ ID NO: 9354418 - DNA, 22 bp, Homo sapiens
ggcccatctcttgctctgggtt

SEQ ID NO: 9354419 - DNA, 22 bp, Homo sapiens
ggcccatgaccctagccaactg

SEQ ID NO: 9354420 - DNA, 22 bp, Homo sapiens
ggcccagtctggggccctgtga

SEQ ID NO: 9354421 - DNA, 20 bp, Homo sapiens
ggcccagtgaaccaggacgg

SEQ ID NO: 9354422 - DNA, 22 bp, Homo sapiens
ggcccaggtccagcgagtacct

SEQ ID NO: 9354423 - DNA, 22 bp, Homo sapiens
ggcccaggtccagcgagtacct

SEQ ID NO: 9354424 - DNA, 22 bp, Homo sapiens
ggcacctgctcatctggactca

SEQ ID NO: 9354425 - DNA, 22 bp, Homo sapiens
ggcacctggaggtttactggat

SEQ ID NO: 9354426 - DNA, 22 bp, Homo sapiens
ggcacctggtaagtgctcagta

SEQ ID NO: 9354427 - DNA, 22 bp, Homo sapiens
ggcacctggatgtagcagtgaa

SEQ ID NO: 9354428 - DNA, 22 bp, Homo sapiens
ggcacctgtagttattttgttt

SEQ ID NO: 9354429 - DNA, 22 bp, Homo sapiens
ggcacctggtaagtgctcagta

SEQ ID NO: 9354430 - DNA, 22 bp, Homo sapiens
ggcacctgtctgctcacagtga

SEQ ID NO: 9354431 - DNA, 22 bp, Homo sapiens
ggcacctgtgtaagatctggaa

SEQ ID NO: 9354432 - DNA, 22 bp, Homo sapiens
ggcacctttcatcccatctaga

SEQ ID NO: 9354433 - DNA, 19 bp, Homo sapiens
ggcaccttggtcttggact

SEQ ID NO: 9354434 - DNA, 22 bp, Homo sapiens
ggaggcacttcccgtctcagcc

SEQ ID NO: 9354435 - DNA, 22 bp, Homo sapiens
ggaggcacttcatgctgacccg

SEQ ID NO: 9354436 - DNA, 22 bp, Homo sapiens
ggaggcacttcccgtctcagcc

SEQ ID NO: 9354437 - DNA, 22 bp, Homo sapiens
ggaggcacttcccgtctcagcc

SEQ ID NO: 9354438 - DNA, 22 bp, Homo sapiens
ggaggcagaacttcccgtcagt

SEQ ID NO: 9354439 - DNA, 22 bp, Homo sapiens
ggaggcagaacttcccgtcagt

SEQ ID NO: 9354440 - DNA, 22 bp, Homo sapiens
ggcaccagggacaatcctcttc

SEQ ID NO: 9354441 - DNA, 22 bp, Homo sapiens
ggcaccagggaaggaaggctgg

SEQ ID NO: 9354442 - DNA, 22 bp, Homo sapiens
ggcacccttggggggccacagc

SEQ ID NO: 9354443 - DNA, 18 bp, Homo sapiens
ggcacctctcttgcctta

SEQ ID NO: 9354444 - DNA, 18 bp, Homo sapiens
ggcacctctcttgcctta

SEQ ID NO: 9354445 - DNA, 22 bp, Homo sapiens
ggcaccatcagctgtgcagggg

SEQ ID NO: 9354446 - DNA, 16 bp, Homo sapiens
ggcaccagtgaacaca

SEQ ID NO: 9354447 - DNA, 22 bp, Homo sapiens
ggaggcaaagcactttgcttgg

SEQ ID NO: 9354448 - DNA, 22 bp, Homo sapiens
ggaggatgagctacgaggagct

SEQ ID NO: 9354449 - DNA, 22 bp, Homo sapiens
ggaggatgccaagctgtgcaca

SEQ ID NO: 9354450 - DNA, 22 bp, Homo sapiens
ggaggcaacatgcttgtttcta

SEQ ID NO: 9354451 - DNA, 22 bp, Homo sapiens
ggaggcacacctcagactggga

SEQ ID NO: 9354452 - DNA, 22 bp, Homo sapiens
ggaggcacacctcagactggga

SEQ ID NO: 9354453 - DNA, 23 bp, Homo sapiens
ggaggcacttaggcagagcagag

SEQ ID NO: 9354454 - DNA, 22 bp, Homo sapiens
ggaggcaccctatttgaggcct

SEQ ID NO: 9354455 - DNA, 22 bp, Homo sapiens
ggaggaggtgggttaagttgta

SEQ ID NO: 9354456 - DNA, 23 bp, Homo sapiens
ggaggagttcccagccctcctgg

SEQ ID NO: 9354457 - DNA, 22 bp, Homo sapiens
ggaggagtgtggggcactctgc

SEQ ID NO: 9354458 - DNA, 22 bp, Homo sapiens
ggaggagtgtggggcactctgc

SEQ ID NO: 9354459 - DNA, 22 bp, Homo sapiens
ggaggaggggtttacattggaa

SEQ ID NO: 9354460 - DNA, 22 bp, Homo sapiens
ggaggaggggtttacattggaa

SEQ ID NO: 9354461 - DNA, 22 bp, Homo sapiens
ggaggaggggtttacattggaa

SEQ ID NO: 9354462 - DNA, 22 bp, Homo sapiens
ggaggaggggtgactgaatgct

SEQ ID NO: 9354463 - DNA, 22 bp, Homo sapiens
ggaggaggggtgactgaatgct

SEQ ID NO: 9354464 - DNA, 22 bp, Homo sapiens
ggaggaggggtgactgaatgct

SEQ ID NO: 9354465 - DNA, 22 bp, Homo sapiens
ggcagattcaagggtggagagg

SEQ ID NO: 9354466 - DNA, 22 bp, Homo sapiens
ggcagcaaatattgtcagctgt

SEQ ID NO: 9354467 - DNA, 22 bp, Homo sapiens
ggcagcaaatattgtcagctgt

SEQ ID NO: 9354468 - DNA, 22 bp, Homo sapiens
ggcagcaagagaggttcagctt

SEQ ID NO: 9354469 - DNA, 22 bp, Homo sapiens
ggcagcaactcggagagaagag

SEQ ID NO: 9354470 - DNA, 18 bp, Homo sapiens
ggcagcaagaagggaggg

SEQ ID NO: 9354471 - DNA, 22 bp, Homo sapiens
ggcagcaactcggagagaagag

SEQ ID NO: 9354472 - DNA, 22 bp, Homo sapiens
ggcagcaactcattattcctgt

SEQ ID NO: 9354473 - DNA, 18 bp, Homo sapiens
ggcagcaagaagggaggg

SEQ ID NO: 9354474 - DNA, 22 bp, Homo sapiens
ggcagcaagtggtgggagactt

SEQ ID NO: 9354475 - DNA, 22 bp, Homo sapiens
ggcagcaatgctgtgcaggcat

SEQ ID NO: 9354476 - DNA, 20 bp, Homo sapiens
ggcagcaattcaccctatcc

SEQ ID NO: 9354477 - DNA, 22 bp, Homo sapiens
ggcagcacgacaggagtggaag

SEQ ID NO: 9354478 - DNA, 21 bp, Homo sapiens
ggcagcactacctgaagcata

SEQ ID NO: 9354479 - DNA, 22 bp, Homo sapiens
ggcagcactgcagcttgttggg

SEQ ID NO: 9354480 - DNA, 22 bp, Homo sapiens
ggcagcagacccctaagtctac

SEQ ID NO: 9354481 - DNA, 22 bp, Homo sapiens
ggcagaggtgacagtgtctttt

SEQ ID NO: 9354482 - DNA, 22 bp, Homo sapiens
ggcagaggtgaagttcacaagg

SEQ ID NO: 9354483 - DNA, 22 bp, Homo sapiens
ggcagaggtgaagttcacaagg

SEQ ID NO: 9354484 - DNA, 22 bp, Homo sapiens
ggcagatgttatatgatctgag

SEQ ID NO: 9354485 - DNA, 22 bp, Homo sapiens
ggcagatggaatgagctgtcta

SEQ ID NO: 9354486 - DNA, 22 bp, Homo sapiens
ggcagatggagaagcagcaggt

SEQ ID NO: 9354487 - DNA, 22 bp, Homo sapiens
ggcactgagaacaggctgactt

SEQ ID NO: 9354488 - DNA, 22 bp, Homo sapiens
ggcactgactgtgcagcgcacc

SEQ ID NO: 9354489 - DNA, 22 bp, Homo sapiens
ggcactgacactagcatggcac

SEQ ID NO: 9354490 - DNA, 22 bp, Homo sapiens
ggcactgagctgccttggggca

SEQ ID NO: 9354491 - DNA, 22 bp, Homo sapiens
ggcactgaagtgggtgttgggt

SEQ ID NO: 9354492 - DNA, 22 bp, Homo sapiens
ggcactgaatttcttggcatct

SEQ ID NO: 9354493 - DNA, 23 bp, Homo sapiens
ggcactgaagctacaatggtgag

SEQ ID NO: 9354494 - DNA, 22 bp, Homo sapiens
ggcactcaataaatgttgccaa

SEQ ID NO: 9354495 - DNA, 22 bp, Homo sapiens
ggcacgtgcctaaggagcaggc

SEQ ID NO: 9354496 - DNA, 19 bp, Homo sapiens
ggcacctttctgctgtgtc

SEQ ID NO: 9354497 - DNA, 22 bp, Homo sapiens
ggcagccatgtcccagggcttc

SEQ ID NO: 9354498 - DNA, 22 bp, Homo sapiens
ggcagccatgtcccagggcttc

SEQ ID NO: 9354499 - DNA, 22 bp, Homo sapiens
ggcagccccagaaacagttcag

SEQ ID NO: 9354500 - DNA, 22 bp, Homo sapiens
ggcagcccaccagcccacgtct

SEQ ID NO: 9354501 - DNA, 22 bp, Homo sapiens
ggcagccccatcagagacgctg

SEQ ID NO: 9354502 - DNA, 21 bp, Homo sapiens
ggcagcccgccctctcctggc

SEQ ID NO: 9354503 - DNA, 21 bp, Homo sapiens
ggcagcccgccctctcctggc

SEQ ID NO: 9354504 - DNA, 22 bp, Homo sapiens
ggcagccctgtggagaggccca

SEQ ID NO: 9354505 - DNA, 22 bp, Homo sapiens
ggcagccctgtggagaggccca

SEQ ID NO: 9354506 - DNA, 18 bp, Homo sapiens
ggcagcctacccacttgt

SEQ ID NO: 9354507 - DNA, 18 bp, Homo sapiens
ggcagcctacccacttgt

SEQ ID NO: 9354508 - DNA, 22 bp, Homo sapiens
ggcagccctttctggccagctc

SEQ ID NO: 9354509 - DNA, 22 bp, Homo sapiens
ggcagccctttctggccagctc

SEQ ID NO: 9354510 - DNA, 22 bp, Homo sapiens
ggcagcctcaggttttctttga

SEQ ID NO: 9354511 - DNA, 17 bp, Homo sapiens
ggcagcctcaggcgttt

SEQ ID NO: 9354512 - DNA, 17 bp, Homo sapiens
ggcagcctcaggcgttt

SEQ ID NO: 9354513 - DNA, 18 bp, Homo sapiens
ggcagcctggacatgctc

SEQ ID NO: 9354514 - DNA, 22 bp, Homo sapiens
ggcagcctggagactttgtgaa

SEQ ID NO: 9354515 - DNA, 22 bp, Homo sapiens
ggcagccttgagggaggcctgg

SEQ ID NO: 9354516 - DNA, 22 bp, Homo sapiens
ggcagccttgactagtgactta

SEQ ID NO: 9354517 - DNA, 23 bp, Homo sapiens
ggcagcctctgactctgctttgc

SEQ ID NO: 9354518 - DNA, 23 bp, Homo sapiens
ggcagcctctgactctgctttgc

SEQ ID NO: 9354519 - DNA, 21 bp, Homo sapiens
ggcagcctgacccccagagag

SEQ ID NO: 9354520 - DNA, 19 bp, Homo sapiens
ggcagcctgcacgggctgc

SEQ ID NO: 9354521 - DNA, 21 bp, Homo sapiens
ggcagcctctgtggaagggga

SEQ ID NO: 9354522 - DNA, 21 bp, Homo sapiens
ggcagcctgacccccagagag

SEQ ID NO: 9354523 - DNA, 20 bp, Homo sapiens
ggcaggctttatatggaggg

SEQ ID NO: 9354524 - DNA, 22 bp, Homo sapiens
ggcaggctttcagcatcaagtc

SEQ ID NO: 9354525 - DNA, 22 bp, Homo sapiens
ggcaggctttcagcatcaagtc

SEQ ID NO: 9354526 - DNA, 22 bp, Homo sapiens
ggcaggctttgagaaagagcat

SEQ ID NO: 9354527 - DNA, 18 bp, Homo sapiens
ggcagggaaaagataggg

SEQ ID NO: 9354528 - DNA, 22 bp, Homo sapiens
ggcaggcttggtggcaccggtt

SEQ ID NO: 9354529 - DNA, 22 bp, Homo sapiens
ggcaggcttgatatggggggac

SEQ ID NO: 9354530 - DNA, 22 bp, Homo sapiens
ggcaggctgttcacctgctttt

SEQ ID NO: 9354531 - DNA, 22 bp, Homo sapiens
ggcagccttgagggaggcctgg

SEQ ID NO: 9354532 - DNA, 22 bp, Homo sapiens
ggcagcgagtcgccaagtctcg

SEQ ID NO: 9354533 - DNA, 22 bp, Homo sapiens
ggcagcgcccgagtccgcagct

SEQ ID NO: 9354534 - DNA, 22 bp, Homo sapiens
ggcagctattccaagcagcact

SEQ ID NO: 9354535 - DNA, 21 bp, Homo sapiens
ggcagcgtgtggacaggaagg

SEQ ID NO: 9354536 - DNA, 22 bp, Homo sapiens
ggcagggaagctggcatcacgg

SEQ ID NO: 9354537 - DNA, 22 bp, Homo sapiens
ggcagggacaggatagggtttt

SEQ ID NO: 9354538 - DNA, 22 bp, Homo sapiens
ggcagggaagctggcatcacgg

SEQ ID NO: 9354539 - DNA, 22 bp, Homo sapiens
ggcagggaaacagctgatccca

SEQ ID NO: 9354540 - DNA, 18 bp, Homo sapiens
ggcagggaaaagataggg

SEQ ID NO: 9354541 - DNA, 22 bp, Homo sapiens
ggcagggaaacagctgatccca

SEQ ID NO: 9354542 - DNA, 22 bp, Homo sapiens
ggcaggggtcctggtgttgact

SEQ ID NO: 9354543 - DNA, 22 bp, Homo sapiens
ggcagggcttgtctctgtgatg

SEQ ID NO: 9354544 - DNA, 22 bp, Homo sapiens
ggcaggggtcctggtgttgact

SEQ ID NO: 9354545 - DNA, 20 bp, Homo sapiens
ggcagggcatcaacagctct

SEQ ID NO: 9354546 - DNA, 20 bp, Homo sapiens
ggcagggcatcaacagctct

SEQ ID NO: 9354547 - DNA, 20 bp, Homo sapiens
ggcagggcatcaacagctct

SEQ ID NO: 9354548 - DNA, 20 bp, Homo sapiens
ggcagggcatcaacagctct

SEQ ID NO: 9354549 - DNA, 22 bp, Homo sapiens
ggcagggccctgattcctgggg

SEQ ID NO: 9354550 - DNA, 22 bp, Homo sapiens
ggcagggccctgattcctgggg

SEQ ID NO: 9354551 - DNA, 22 bp, Homo sapiens
ggcagggcttgtctctgtgatg

SEQ ID NO: 9354552 - DNA, 22 bp, Homo sapiens
ggcagggccctgattcctgggg

SEQ ID NO: 9354553 - DNA, 22 bp, Homo sapiens
ggcagtggcagagcttggtcta

SEQ ID NO: 9354554 - DNA, 17 bp, Homo sapiens
ggcagtggaggaagaga

SEQ ID NO: 9354555 - DNA, 22 bp, Homo sapiens
ggcagtgccttagaatctgtgg

SEQ ID NO: 9354556 - DNA, 17 bp, Homo sapiens
ggcagtggaggaagaga

SEQ ID NO: 9354557 - DNA, 17 bp, Homo sapiens
ggcagtggaggaagaga

SEQ ID NO: 9354558 - DNA, 22 bp, Homo sapiens
ggcagtgcaaggctggcacagt

SEQ ID NO: 9354559 - DNA, 18 bp, Homo sapiens
ggcagtgcagtctcaggg

SEQ ID NO: 9354560 - DNA, 18 bp, Homo sapiens
ggcagtgcagtctcaggg

SEQ ID NO: 9354561 - DNA, 22 bp, Homo sapiens
ggcagtgccactaagctctgct

SEQ ID NO: 9354562 - DNA, 22 bp, Homo sapiens
ggcagtgcccggtgcctcctct

SEQ ID NO: 9354563 - DNA, 22 bp, Homo sapiens
ggcagtgcctgatgctgcagga

SEQ ID NO: 9354564 - DNA, 22 bp, Homo sapiens
ggcagtgagtcccggagaggcc

SEQ ID NO: 9354565 - DNA, 22 bp, Homo sapiens
ggcagtgagtcccggagaggcc

SEQ ID NO: 9354566 - DNA, 22 bp, Homo sapiens
ggcagtgatgtcaaacagtgaa

SEQ ID NO: 9354567 - DNA, 21 bp, Homo sapiens
ggcagtgatgtgaagtgcatc

SEQ ID NO: 9354568 - DNA, 22 bp, Homo sapiens
ggcagtgcaaggcagcctggat

SEQ ID NO: 9354569 - DNA, 22 bp, Homo sapiens
ggcagtgagaggtctcctggtc

SEQ ID NO: 9354570 - DNA, 22 bp, Homo sapiens
ggcagtgagctggagggaagga

SEQ ID NO: 9354571 - DNA, 22 bp, Homo sapiens
ggcagtgagctggagggaagga

SEQ ID NO: 9354572 - DNA, 22 bp, Homo sapiens
gcccctgggagcagagccacca

SEQ ID NO: 9354573 - DNA, 22 bp, Homo sapiens
gccccttccatcatgtgaggac

SEQ ID NO: 9354574 - DNA, 22 bp, Homo sapiens
gccccttcgtggaagtgcattc

SEQ ID NO: 9354575 - DNA, 22 bp, Homo sapiens
gcccgcagagatctttaacaaa

SEQ ID NO: 9354576 - DNA, 22 bp, Homo sapiens
gccccttgtctccaggccccaa

SEQ ID NO: 9354577 - DNA, 22 bp, Homo sapiens
gccccttgggaattcctccact

SEQ ID NO: 9354578 - DNA, 22 bp, Homo sapiens
gcccgcgccagcctctccatct

SEQ ID NO: 9354579 - DNA, 22 bp, Homo sapiens
gcccgcgccagcctctccatct

SEQ ID NO: 9354580 - DNA, 22 bp, Homo sapiens
gccctagcgccagctcagcacc

SEQ ID NO: 9354581 - DNA, 22 bp, Homo sapiens
gccctagcccgggccacctgtt

SEQ ID NO: 9354582 - DNA, 22 bp, Homo sapiens
gccctacctcagtccagatctg

SEQ ID NO: 9354583 - DNA, 22 bp, Homo sapiens
gccctgagttgagccttccaaa

SEQ ID NO: 9354584 - DNA, 19 bp, Homo sapiens
gccctgagtaagctaggag

SEQ ID NO: 9354585 - DNA, 22 bp, Homo sapiens
gccctcagaggacagctgactt

SEQ ID NO: 9354586 - DNA, 22 bp, Homo sapiens
gccctaggcctgtttgtccata

SEQ ID NO: 9354587 - DNA, 21 bp, Homo sapiens
gccctaggctacctggagcgc

SEQ ID NO: 9354588 - DNA, 22 bp, Homo sapiens
gccctaggcttttgtgactgcc

SEQ ID NO: 9354589 - DNA, 22 bp, Homo sapiens
gccctagggggaaccgaggact

SEQ ID NO: 9354590 - DNA, 22 bp, Homo sapiens
gccctcagaggacagctgactt

SEQ ID NO: 9354591 - DNA, 22 bp, Homo sapiens
gccctcagaatgggctctaatc

SEQ ID NO: 9354592 - DNA, 22 bp, Homo sapiens
gcccctctccttgtgcacctgc

SEQ ID NO: 9354593 - DNA, 22 bp, Homo sapiens
gcccctctccttgtgcacctgc

SEQ ID NO: 9354594 - DNA, 22 bp, Homo sapiens
gcccctctccttgtgcacctgc

SEQ ID NO: 9354595 - DNA, 22 bp, Homo sapiens
gcccctctccttgtgcacctgc

SEQ ID NO: 9354596 - DNA, 22 bp, Homo sapiens
gcccctggctggccagctcctc

SEQ ID NO: 9354597 - DNA, 22 bp, Homo sapiens
gcccctggctggccagctcctc

SEQ ID NO: 9354598 - DNA, 22 bp, Homo sapiens
gcccctccatccatcaccgggg

SEQ ID NO: 9354599 - DNA, 22 bp, Homo sapiens
gccccaggtggtaaacctaaga

SEQ ID NO: 9354600 - DNA, 22 bp, Homo sapiens
gccccaggttgcctgtcccagg

SEQ ID NO: 9354601 - DNA, 22 bp, Homo sapiens
gccccaggttgcctgtcccagg

SEQ ID NO: 9354602 - DNA, 20 bp, Homo sapiens
gcccaaggtccagaaggggg

SEQ ID NO: 9354603 - DNA, 22 bp, Homo sapiens
gcccaaggtcccatggcagcac

SEQ ID NO: 9354604 - DNA, 22 bp, Homo sapiens
gcccaatattgtgtgctacctt

SEQ ID NO: 9354605 - DNA, 22 bp, Homo sapiens
gcccaatagtggggatatacct

SEQ ID NO: 9354606 - DNA, 22 bp, Homo sapiens
gcccaatagagaaatagtgaaa

SEQ ID NO: 9354607 - DNA, 22 bp, Homo sapiens
gccccaggggaggtgccctgca

SEQ ID NO: 9354608 - DNA, 22 bp, Homo sapiens
gccccaggggaggtgccctgca

SEQ ID NO: 9354609 - DNA, 22 bp, Homo sapiens
gcccacaggggacctggtggct

SEQ ID NO: 9354610 - DNA, 22 bp, Homo sapiens
gcccacagctcgttcctctcct

SEQ ID NO: 9354611 - DNA, 22 bp, Homo sapiens
gcccacaggggacctggtggct

SEQ ID NO: 9354612 - DNA, 22 bp, Homo sapiens
gcccacagaggcaccaccaggc

SEQ ID NO: 9354613 - DNA, 22 bp, Homo sapiens
gcccacagctcgttcctctcct

SEQ ID NO: 9354614 - DNA, 22 bp, Homo sapiens
gccctgcttctggcatgcagaa

SEQ ID NO: 9354615 - DNA, 22 bp, Homo sapiens
gccctgcttctggcatgcagaa

SEQ ID NO: 9354616 - DNA, 22 bp, Homo sapiens
gccctgctgtttagagagctac

SEQ ID NO: 9354617 - DNA, 22 bp, Homo sapiens
gccctgctgtttagagagctac

SEQ ID NO: 9354618 - DNA, 22 bp, Homo sapiens
gccctgctgtttagagagctac

SEQ ID NO: 9354619 - DNA, 22 bp, Homo sapiens
gccctgctgtcttcagagtata

SEQ ID NO: 9354620 - DNA, 23 bp, Homo sapiens
gccctgctgggacctcctgctac

SEQ ID NO: 9354621 - DNA, 22 bp, Homo sapiens
gccctgctggggcacagcaaga

SEQ ID NO: 9354622 - DNA, 22 bp, Homo sapiens
gccctgctcttttgcccaccca

SEQ ID NO: 9354623 - DNA, 22 bp, Homo sapiens
gccctgctgagtccggctcaga

SEQ ID NO: 9354624 - DNA, 22 bp, Homo sapiens
gccctgctgcgcagcacgcatg

SEQ ID NO: 9354625 - DNA, 22 bp, Homo sapiens
gccctgctgagtccggctcaga

SEQ ID NO: 9354626 - DNA, 23 bp, Homo sapiens
gccctgctgggacctcctgctac

SEQ ID NO: 9354627 - DNA, 23 bp, Homo sapiens
gccctgctgggacctcctgctac

SEQ ID NO: 9354628 - DNA, 22 bp, Homo sapiens
gccctgctgctggcagaggcgc

SEQ ID NO: 9354629 - DNA, 23 bp, Homo sapiens
gccctgctcctggctgggaggga

SEQ ID NO: 9354630 - DNA, 23 bp, Homo sapiens
gccctgctcctggctgggaggga

SEQ ID NO: 9354631 - DNA, 22 bp, Homo sapiens
gccctgctcatttcacgtgttt

SEQ ID NO: 9354632 - DNA, 22 bp, Homo sapiens
gccctgctccaggagaataccc

SEQ ID NO: 9354633 - DNA, 22 bp, Homo sapiens
gccctgctcctccgtcccacga

SEQ ID NO: 9354634 - DNA, 22 bp, Homo sapiens
gccctgctctggtctctgcccg

SEQ ID NO: 9354635 - DNA, 22 bp, Homo sapiens
gccctgctctggtctctgcccg

SEQ ID NO: 9354636 - DNA, 22 bp, Homo sapiens
gccctgctctggtctctgcccg

SEQ ID NO: 9354637 - DNA, 22 bp, Homo sapiens
gccctgctctgttggtcacctg

SEQ ID NO: 9354638 - DNA, 22 bp, Homo sapiens
gccctgctaatttcgtactttt

SEQ ID NO: 9354639 - DNA, 22 bp, Homo sapiens
gccctgcgccgtcccgctggtg

SEQ ID NO: 9354640 - DNA, 22 bp, Homo sapiens
gccctgctcatttcacgtgttt

SEQ ID NO: 9354641 - DNA, 22 bp, Homo sapiens
gccctgctcatttcacgtgttt

SEQ ID NO: 9354642 - DNA, 23 bp, Homo sapiens
gccctgctactcacaagctgtgt

SEQ ID NO: 9354643 - DNA, 17 bp, Homo sapiens
gccctgcctgctgccct

SEQ ID NO: 9354644 - DNA, 20 bp, Homo sapiens
gccctggacgtggcctcggc

SEQ ID NO: 9354645 - DNA, 22 bp, Homo sapiens
gccctgcttctggcatgcagaa

SEQ ID NO: 9354646 - DNA, 22 bp, Homo sapiens
gccctgcttggtcatggccttc

SEQ ID NO: 9354647 - DNA, 22 bp, Homo sapiens
gccctgcttggtcatggccttc

SEQ ID NO: 9354648 - DNA, 22 bp, Homo sapiens
gccctggaatctctccatggga

SEQ ID NO: 9354649 - DNA, 22 bp, Homo sapiens
gccctggaaaggaacctgggct

SEQ ID NO: 9354650 - DNA, 22 bp, Homo sapiens
gcctcaggtaaaacttgagttt

SEQ ID NO: 9354651 - DNA, 22 bp, Homo sapiens
gcctcaggtgcatctctcattc

SEQ ID NO: 9354652 - DNA, 22 bp, Homo sapiens
gcctcaggtgcatctctcattc

SEQ ID NO: 9354653 - DNA, 22 bp, Homo sapiens
gcctcaggtaaaacttgagttt

SEQ ID NO: 9354654 - DNA, 22 bp, Homo sapiens
gcctcagggggagaggccagct

SEQ ID NO: 9354655 - DNA, 22 bp, Homo sapiens
gcctcagggggagaggccagct

SEQ ID NO: 9354656 - DNA, 20 bp, Homo sapiens
gccctggacgtggcctcggc

SEQ ID NO: 9354657 - DNA, 20 bp, Homo sapiens
gcctccacactcacccctta

SEQ ID NO: 9354658 - DNA, 20 bp, Homo sapiens
gcctccaccccaggcttcag

SEQ ID NO: 9354659 - DNA, 18 bp, Homo sapiens
gcctccaccatggagggt

SEQ ID NO: 9354660 - DNA, 20 bp, Homo sapiens
gcctccacactcacccctta

SEQ ID NO: 9354661 - DNA, 22 bp, Homo sapiens
gcctggagaaaggaaggtggga

SEQ ID NO: 9354662 - DNA, 22 bp, Homo sapiens
gcctggagaaaggaaggtggga

SEQ ID NO: 9354663 - DNA, 22 bp, Homo sapiens
gcctggagaaaggaaggtggga

SEQ ID NO: 9354664 - DNA, 22 bp, Homo sapiens
gcctggagaaaggaaggtggga

SEQ ID NO: 9354665 - DNA, 22 bp, Homo sapiens
gcctggagaaaggaaggtggga

SEQ ID NO: 9354666 - DNA, 22 bp, Homo sapiens
gcctggagaagatggaactagc

SEQ ID NO: 9354667 - DNA, 22 bp, Homo sapiens
gcctggagaattaaaaggaagg

SEQ ID NO: 9354668 - DNA, 22 bp, Homo sapiens
gcctggagaagatggaactagc

SEQ ID NO: 9354669 - DNA, 22 bp, Homo sapiens
gcctggagaattaaaaggaagg

SEQ ID NO: 9354670 - DNA, 22 bp, Homo sapiens
gcctggagaattaaaaggaagg

SEQ ID NO: 9354671 - DNA, 22 bp, Homo sapiens
gcctggagacaaggacaaaggg

SEQ ID NO: 9354672 - DNA, 22 bp, Homo sapiens
gcctggagacaaggacaaaggg

SEQ ID NO: 9354673 - DNA, 22 bp, Homo sapiens
gcctggagacaaggacaaaggg

SEQ ID NO: 9354674 - DNA, 22 bp, Homo sapiens
gcctggagacaaggacaaaggg

SEQ ID NO: 9354675 - DNA, 22 bp, Homo sapiens
gcctggagacagcagaggcggc

SEQ ID NO: 9354676 - DNA, 22 bp, Homo sapiens
gcctgcagggtgatgggctgcc

SEQ ID NO: 9354677 - DNA, 22 bp, Homo sapiens
gcctgcagggtgatgggctgcc

SEQ ID NO: 9354678 - DNA, 22 bp, Homo sapiens
gcctgcagtgagtgcagaaggt

SEQ ID NO: 9354679 - DNA, 22 bp, Homo sapiens
gcctgcagtgagtgcagaaggt

SEQ ID NO: 9354680 - DNA, 20 bp, Homo sapiens
gcctgcaggttggatgggat

SEQ ID NO: 9354681 - DNA, 22 bp, Homo sapiens
gcctgcagttctgtgctaggca

SEQ ID NO: 9354682 - DNA, 23 bp, Homo sapiens
gcctggagaaaagctgcagttca

SEQ ID NO: 9354683 - DNA, 23 bp, Homo sapiens
gcctggagaaaagctgcagttca

SEQ ID NO: 9354684 - DNA, 23 bp, Homo sapiens
gcctggagaaaagctgcagttca

SEQ ID NO: 9354685 - DNA, 23 bp, Homo sapiens
gcctggagaaaagctgcagttca

SEQ ID NO: 9354686 - DNA, 22 bp, Homo sapiens
gcctggagagcactgtgcgctt

SEQ ID NO: 9354687 - DNA, 22 bp, Homo sapiens
gcctggagagcactgtgcgctt

SEQ ID NO: 9354688 - DNA, 22 bp, Homo sapiens
gcctggagagcactgtgcgctt

SEQ ID NO: 9354689 - DNA, 22 bp, Homo sapiens
gcctggagacctgctcctctac

SEQ ID NO: 9354690 - DNA, 22 bp, Homo sapiens
gcctggagacctgctcctctac

SEQ ID NO: 9354691 - DNA, 22 bp, Homo sapiens
gcctggagagcactgtgcgctt

SEQ ID NO: 9354692 - DNA, 22 bp, Homo sapiens
gcctggagacctgctcctctac

SEQ ID NO: 9354693 - DNA, 22 bp, Homo sapiens
gcctggagacctgctcctctac

SEQ ID NO: 9354694 - DNA, 22 bp, Homo sapiens
gcctggagacctgctcctctac

SEQ ID NO: 9354695 - DNA, 22 bp, Homo sapiens
gcctggagacagcagaggcggc

SEQ ID NO: 9354696 - DNA, 22 bp, Homo sapiens
gcctggagacagcagaggcggc

SEQ ID NO: 9354697 - DNA, 22 bp, Homo sapiens
gcctggagacagcagaggcggc

SEQ ID NO: 9354698 - DNA, 22 bp, Homo sapiens
gcctggagcagacgtgtcccgg

SEQ ID NO: 9354699 - DNA, 22 bp, Homo sapiens
gcctggagcagacgtgtcccgg

SEQ ID NO: 9354700 - DNA, 22 bp, Homo sapiens
gcctggagcagacgtgtcccgg

SEQ ID NO: 9354701 - DNA, 22 bp, Homo sapiens
gcctggagaggaagccggtgga

SEQ ID NO: 9354702 - DNA, 22 bp, Homo sapiens
gcctggagaggaagccggtgga

SEQ ID NO: 9354703 - DNA, 22 bp, Homo sapiens
gcctggagaggaagccggtgga

SEQ ID NO: 9354704 - DNA, 22 bp, Homo sapiens
gcctggagaggaagccggtgga

SEQ ID NO: 9354705 - DNA, 22 bp, Homo sapiens
gcctggagaggaagccggtgga

SEQ ID NO: 9354706 - DNA, 22 bp, Homo sapiens
gcctggagaggaagccggtgga

SEQ ID NO: 9354707 - DNA, 22 bp, Homo sapiens
gcctggagtgcagtggcgtgat

SEQ ID NO: 9354708 - DNA, 22 bp, Homo sapiens
gcctggagtgcagtggcgtgat

SEQ ID NO: 9354709 - DNA, 22 bp, Homo sapiens
gcctggagtgcagtggcgtgat

SEQ ID NO: 9354710 - DNA, 22 bp, Homo sapiens
gcctggagtgcagtggcgtgat

SEQ ID NO: 9354711 - DNA, 16 bp, Homo sapiens
gcctggagtggcaggg

SEQ ID NO: 9354712 - DNA, 22 bp, Homo sapiens
gcctggagtggacttggcccct

SEQ ID NO: 9354713 - DNA, 22 bp, Homo sapiens
gcctggagtggacttggcccct

SEQ ID NO: 9354714 - DNA, 16 bp, Homo sapiens
gcctggagtggcaggg

SEQ ID NO: 9354715 - DNA, 16 bp, Homo sapiens
gcctggagtggcaggg

SEQ ID NO: 9354716 - DNA, 22 bp, Homo sapiens
gcctggagtgcagtggcgtgat

SEQ ID NO: 9354717 - DNA, 22 bp, Homo sapiens
gcctggagtagcatggcaagcc

SEQ ID NO: 9354718 - DNA, 22 bp, Homo sapiens
gcctggagtagcatggcaagcc

SEQ ID NO: 9354719 - DNA, 22 bp, Homo sapiens
gcctggagtagcatggcaagcc

SEQ ID NO: 9354720 - DNA, 22 bp, Homo sapiens
gcctggagtagcatggcaagcc

SEQ ID NO: 9354721 - DNA, 22 bp, Homo sapiens
gcctggagtagcatggcaagcc

SEQ ID NO: 9354722 - DNA, 22 bp, Homo sapiens
gcctggagcccagtgtggggct

SEQ ID NO: 9354723 - DNA, 22 bp, Homo sapiens
gcctggagcccagtgtggggct

SEQ ID NO: 9354724 - DNA, 22 bp, Homo sapiens
gcctggagcccagtgtggggct

SEQ ID NO: 9354725 - DNA, 22 bp, Homo sapiens
gcctggagcccagtgtggggct

SEQ ID NO: 9354726 - DNA, 22 bp, Homo sapiens
gcctccacccctggggagtgga

SEQ ID NO: 9354727 - DNA, 22 bp, Homo sapiens
gcctccaccgaacgctctcttg

SEQ ID NO: 9354728 - DNA, 22 bp, Homo sapiens
gcctccaccgaacgctctcttg

SEQ ID NO: 9354729 - DNA, 22 bp, Homo sapiens
gcctccacttctttagtatgac

SEQ ID NO: 9354730 - DNA, 22 bp, Homo sapiens
gcctccccaggggtgtcatgag

SEQ ID NO: 9354731 - DNA, 22 bp, Homo sapiens
gcctccactgatcagacttgac

SEQ ID NO: 9354732 - DNA, 22 bp, Homo sapiens
gcctccctggcccacagcagcg

SEQ ID NO: 9354733 - DNA, 22 bp, Homo sapiens
gcctccctccaccactgcaggt

SEQ ID NO: 9354734 - DNA, 18 bp, Homo sapiens
gcctccctggctacactt

SEQ ID NO: 9354735 - DNA, 18 bp, Homo sapiens
gcctccctggctacactt

SEQ ID NO: 9354736 - DNA, 22 bp, Homo sapiens
gcctccctgtttcctgctccaa

SEQ ID NO: 9354737 - DNA, 22 bp, Homo sapiens
gcctccctgttcttccacaata

SEQ ID NO: 9354738 - DNA, 22 bp, Homo sapiens
gcctgagtaaatatgcggcagg

SEQ ID NO: 9354739 - DNA, 22 bp, Homo sapiens
gcctgagtcaagatgtggcacc

SEQ ID NO: 9354740 - DNA, 22 bp, Homo sapiens
gcctgagggctcctagcaggct

SEQ ID NO: 9354741 - DNA, 22 bp, Homo sapiens
gcctgcaaacaaggacttctga

SEQ ID NO: 9354742 - DNA, 20 bp, Homo sapiens
gcctgatggacatttcagtt

SEQ ID NO: 9354743 - DNA, 22 bp, Homo sapiens
gcctgcacccacaggcatggcc

SEQ ID NO: 9354744 - DNA, 21 bp, Homo sapiens
gcctgcacacagtaggtgcac

SEQ ID NO: 9354745 - DNA, 22 bp, Homo sapiens
gcctgcagaactgtgaggcaat

SEQ ID NO: 9354746 - DNA, 19 bp, Homo sapiens
gcctgcagaaaaggcaggg

SEQ ID NO: 9354747 - DNA, 19 bp, Homo sapiens
gcctgcagaaaaggcaggg

SEQ ID NO: 9354748 - DNA, 22 bp, Homo sapiens
gcctgcactcaaacactctctt

SEQ ID NO: 9354749 - DNA, 20 bp, Homo sapiens
gcctgcagagaaggtcagag

SEQ ID NO: 9354750 - DNA, 22 bp, Homo sapiens
gcctgcagaggtgctgctagct

SEQ ID NO: 9354751 - DNA, 21 bp, Homo sapiens
gcctgcagaccccaccaggct

SEQ ID NO: 9354752 - DNA, 22 bp, Homo sapiens
gcctgcagaactgtgaggcaat

SEQ ID NO: 9354753 - DNA, 20 bp, Homo sapiens
gcctgcagagaaggtcagag

SEQ ID NO: 9354754 - DNA, 22 bp, Homo sapiens
gcctgcagatatataggatggt

SEQ ID NO: 9354755 - DNA, 22 bp, Homo sapiens
gcctgcagatatataggatggt

SEQ ID NO: 9354756 - DNA, 22 bp, Homo sapiens
gcctgcagcccctctgcagtag

SEQ ID NO: 9354757 - DNA, 22 bp, Homo sapiens
gcctgcagcctcaagggctgag

SEQ ID NO: 9354758 - DNA, 22 bp, Homo sapiens
gcctgcagcctcagagaatttt

SEQ ID NO: 9354759 - DNA, 18 bp, Homo sapiens
gcctgcaggcacgggggt

SEQ ID NO: 9354760 - DNA, 22 bp, Homo sapiens
gcctgcagggcccttgtgggtc

SEQ ID NO: 9354761 - DNA, 17 bp, Homo sapiens
gcctgcaggcccgcaga

SEQ ID NO: 9354762 - DNA, 22 bp, Homo sapiens
gcctgcagggcctgggcctacc

SEQ ID NO: 9354763 - DNA, 22 bp, Homo sapiens
gccaccctgcaaatgcccagga

SEQ ID NO: 9354764 - DNA, 22 bp, Homo sapiens
gccaccctggaccaccctgggc

SEQ ID NO: 9354765 - DNA, 22 bp, Homo sapiens
gcatttcatgccgtggaagtcc

SEQ ID NO: 9354766 - DNA, 18 bp, Homo sapiens
gccaccctcctcgtctcc

SEQ ID NO: 9354767 - DNA, 18 bp, Homo sapiens
gccaccctcctcgtctcc

SEQ ID NO: 9354768 - DNA, 22 bp, Homo sapiens
gcatttatttctttactgcatc

SEQ ID NO: 9354769 - DNA, 22 bp, Homo sapiens
gcatttcaaaattccaggcaag

SEQ ID NO: 9354770 - DNA, 22 bp, Homo sapiens
gcatttatttctttactgcatc

SEQ ID NO: 9354771 - DNA, 22 bp, Homo sapiens
gcatttatttctttactgcatc

SEQ ID NO: 9354772 - DNA, 22 bp, Homo sapiens
gcatttatttctttactgcatc

SEQ ID NO: 9354773 - DNA, 18 bp, Homo sapiens
gcatttatgcggggctac

SEQ ID NO: 9354774 - DNA, 22 bp, Homo sapiens
gcatttatattctgttcggata

SEQ ID NO: 9354775 - DNA, 18 bp, Homo sapiens
gcatttatgcggggctac

SEQ ID NO: 9354776 - DNA, 22 bp, Homo sapiens
gcatttatattctgttcggata

SEQ ID NO: 9354777 - DNA, 22 bp, Homo sapiens
gcatttatattctgttcggata

SEQ ID NO: 9354778 - DNA, 22 bp, Homo sapiens
gcatttattatctgccaggcac

SEQ ID NO: 9354779 - DNA, 22 bp, Homo sapiens
gcatttattatctgccaggcac

SEQ ID NO: 9354780 - DNA, 18 bp, Homo sapiens
gcatttatgcggggctac

SEQ ID NO: 9354781 - DNA, 22 bp, Homo sapiens
gcatttattatctgccaggcac

SEQ ID NO: 9354782 - DNA, 22 bp, Homo sapiens
gcattgtttcagtccactgtag

SEQ ID NO: 9354783 - DNA, 20 bp, Homo sapiens
gcattgttgtagtagattgt

SEQ ID NO: 9354784 - DNA, 22 bp, Homo sapiens
gcattgtttaagtgggtggggt

SEQ ID NO: 9354785 - DNA, 22 bp, Homo sapiens
gcattgttagtctatgcagata

SEQ ID NO: 9354786 - DNA, 23 bp, Homo sapiens
gcattgtctccccacttctgggc

SEQ ID NO: 9354787 - DNA, 21 bp, Homo sapiens
gcattgttggctgctgctagg

SEQ ID NO: 9354788 - DNA, 22 bp, Homo sapiens
gcattgttgaaaggaatgggct

SEQ ID NO: 9354789 - DNA, 22 bp, Homo sapiens
gcattgttagtctatgcagata

SEQ ID NO: 9354790 - DNA, 22 bp, Homo sapiens
gcattggttaagagctttgggg

SEQ ID NO: 9354791 - DNA, 22 bp, Homo sapiens
gcattgcaggtgtacccagtta

SEQ ID NO: 9354792 - DNA, 23 bp, Homo sapiens
gcattgtagaatgtttagcagca

SEQ ID NO: 9354793 - DNA, 22 bp, Homo sapiens
gcattggtttacacagggtgaa

SEQ ID NO: 9354794 - DNA, 22 bp, Homo sapiens
gcattggttcaaggttgtgcag

SEQ ID NO: 9354795 - DNA, 22 bp, Homo sapiens
gcattgattctgaagtgaaatg

SEQ ID NO: 9354796 - DNA, 22 bp, Homo sapiens
gcattgatctgtatgcattaag

SEQ ID NO: 9354797 - DNA, 22 bp, Homo sapiens
gcattgatctttattctgcttt

SEQ ID NO: 9354798 - DNA, 22 bp, Homo sapiens
gcattgcaaaaagcagcttgat

SEQ ID NO: 9354799 - DNA, 22 bp, Homo sapiens
gcattgcaactgacagatcatt

SEQ ID NO: 9354800 - DNA, 22 bp, Homo sapiens
gccaccctggacgcactgttcg

SEQ ID NO: 9354801 - DNA, 22 bp, Homo sapiens
gccacccttatcccatgcttct

SEQ ID NO: 9354802 - DNA, 21 bp, Homo sapiens
gccacctcaatcttctagcgc

SEQ ID NO: 9354803 - DNA, 22 bp, Homo sapiens
gccacctccttattccacctgt

SEQ ID NO: 9354804 - DNA, 22 bp, Homo sapiens
gccacctcccaggacgaggctg

SEQ ID NO: 9354805 - DNA, 22 bp, Homo sapiens
gccacctcccaggacgaggctg

SEQ ID NO: 9354806 - DNA, 22 bp, Homo sapiens
gccacctctctcttgactcgag

SEQ ID NO: 9354807 - DNA, 22 bp, Homo sapiens
gccacctctttgtctctgccgc

SEQ ID NO: 9354808 - DNA, 22 bp, Homo sapiens
gccacctcggctttctctgctc

SEQ ID NO: 9354809 - DNA, 22 bp, Homo sapiens
gccacctctagcaaagctcagc

SEQ ID NO: 9354810 - DNA, 22 bp, Homo sapiens
gccacctgtttcgcttgcccag

SEQ ID NO: 9354811 - DNA, 22 bp, Homo sapiens
gccacttactaacctcctatcc

SEQ ID NO: 9354812 - DNA, 22 bp, Homo sapiens
gccacctggacagctgtgccct

SEQ ID NO: 9354813 - DNA, 22 bp, Homo sapiens
gccacctgccaacttgctggaa

SEQ ID NO: 9354814 - DNA, 22 bp, Homo sapiens
gcagttatgtgaatcatgtgac

SEQ ID NO: 9354815 - DNA, 22 bp, Homo sapiens
gcagttggcagggagcccagat

SEQ ID NO: 9354816 - DNA, 22 bp, Homo sapiens
gcagttggcagggagcccagat

SEQ ID NO: 9354817 - DNA, 22 bp, Homo sapiens
gcaggtggaagcagcagactca

SEQ ID NO: 9354818 - DNA, 22 bp, Homo sapiens
gcaggtggaagcagcagactca

SEQ ID NO: 9354819 - DNA, 22 bp, Homo sapiens
gcaggtggaagcagcagactca

SEQ ID NO: 9354820 - DNA, 18 bp, Homo sapiens
gcaggtgccactgctgtt

SEQ ID NO: 9354821 - DNA, 18 bp, Homo sapiens
gcaggtgccactgctgtt

SEQ ID NO: 9354822 - DNA, 22 bp, Homo sapiens
gcaggtgattcaccctgggcct

SEQ ID NO: 9354823 - DNA, 22 bp, Homo sapiens
gcaggtgattcaccctgggcct

SEQ ID NO: 9354824 - DNA, 22 bp, Homo sapiens
gcaggtgattcaccctgggcct

SEQ ID NO: 9354825 - DNA, 22 bp, Homo sapiens
gcattctttgaatgcttctaat

SEQ ID NO: 9354826 - DNA, 22 bp, Homo sapiens
gcattcttcgaagtaagtagtg

SEQ ID NO: 9354827 - DNA, 22 bp, Homo sapiens
gcattacagcagttcaacttgg

SEQ ID NO: 9354828 - DNA, 22 bp, Homo sapiens
gcattagacccaaggtattttg

SEQ ID NO: 9354829 - DNA, 19 bp, Homo sapiens
gcataaaatgtcaatgtgt

SEQ ID NO: 9354830 - DNA, 22 bp, Homo sapiens
gcagtttctgaatttatccaag

SEQ ID NO: 9354831 - DNA, 22 bp, Homo sapiens
gcagtttgaaagtatgagtcca

SEQ ID NO: 9354832 - DNA, 19 bp, Homo sapiens
gcataaaatgtcaatgtgt

SEQ ID NO: 9354833 - DNA, 22 bp, Homo sapiens
gcagttttattatgatggaaat

SEQ ID NO: 9354834 - DNA, 22 bp, Homo sapiens
gcagtttgtttgtggacacctt

SEQ ID NO: 9354835 - DNA, 22 bp, Homo sapiens
gcagtttgctggactaatgaag

SEQ ID NO: 9354836 - DNA, 22 bp, Homo sapiens
gcagttttagagctttaagatg

SEQ ID NO: 9354837 - DNA, 22 bp, Homo sapiens
gccaggctccaggccctcctga

SEQ ID NO: 9354838 - DNA, 19 bp, Homo sapiens
gccaggctccatagccggc

SEQ ID NO: 9354839 - DNA, 19 bp, Homo sapiens
gccaggctccatagccggc

SEQ ID NO: 9354840 - DNA, 22 bp, Homo sapiens
gccaggctccaggccctcctga

SEQ ID NO: 9354841 - DNA, 22 bp, Homo sapiens
gccaggctccaggccctcctga

SEQ ID NO: 9354842 - DNA, 22 bp, Homo sapiens
gccaggctccaggccctcctga

SEQ ID NO: 9354843 - DNA, 22 bp, Homo sapiens
gccaggctccccggatccctgg

SEQ ID NO: 9354844 - DNA, 22 bp, Homo sapiens
gccaggctccccggatccctgg

SEQ ID NO: 9354845 - DNA, 22 bp, Homo sapiens
gccaggctccccggatccctgg

SEQ ID NO: 9354846 - DNA, 23 bp, Homo sapiens
gccaggctccggtctgtggccac

SEQ ID NO: 9354847 - DNA, 23 bp, Homo sapiens
gccaggctccggtctgtggccac

SEQ ID NO: 9354848 - DNA, 22 bp, Homo sapiens
gccaggctccccggatccctgg

SEQ ID NO: 9354849 - DNA, 22 bp, Homo sapiens
gccaggctaagaaaggtgtgat

SEQ ID NO: 9354850 - DNA, 22 bp, Homo sapiens
gccaggctcagtagcgattcct

SEQ ID NO: 9354851 - DNA, 22 bp, Homo sapiens
gccaggctcagcagtcaacctg

SEQ ID NO: 9354852 - DNA, 22 bp, Homo sapiens
gccaggctcagcagtcaacctg

SEQ ID NO: 9354853 - DNA, 22 bp, Homo sapiens
gccaggctaagaaaggtgtgat

SEQ ID NO: 9354854 - DNA, 22 bp, Homo sapiens
gccaggctaagaaaggtgtgat

SEQ ID NO: 9354855 - DNA, 22 bp, Homo sapiens
gccaggctaagaaaggtgtgat

SEQ ID NO: 9354856 - DNA, 22 bp, Homo sapiens
gccaggctaagaaaggtgtgat

SEQ ID NO: 9354857 - DNA, 22 bp, Homo sapiens
gccaggcgggtctcaaactcct

SEQ ID NO: 9354858 - DNA, 22 bp, Homo sapiens
gccaggcgggtctcaaactcct

SEQ ID NO: 9354859 - DNA, 22 bp, Homo sapiens
gccaggcattattccgatccct

SEQ ID NO: 9354860 - DNA, 22 bp, Homo sapiens
gccaggcattattccgatccct

SEQ ID NO: 9354861 - DNA, 22 bp, Homo sapiens
gccaggcattattccgatccct

SEQ ID NO: 9354862 - DNA, 22 bp, Homo sapiens
gccaggcgggtctcaaactcct

SEQ ID NO: 9354863 - DNA, 22 bp, Homo sapiens
gcccaaggtatatcagagacag

SEQ ID NO: 9354864 - DNA, 20 bp, Homo sapiens
gcccaagcgccggccgcaga

SEQ ID NO: 9354865 - DNA, 22 bp, Homo sapiens
gccaggctctcagtgactgccc

SEQ ID NO: 9354866 - DNA, 22 bp, Homo sapiens
gccaggctctcagtgactgccc

SEQ ID NO: 9354867 - DNA, 23 bp, Homo sapiens
gccaggctccggtctgtggccac

SEQ ID NO: 9354868 - DNA, 22 bp, Homo sapiens
gccattttctgtcttgtttatt

SEQ ID NO: 9354869 - DNA, 22 bp, Homo sapiens
gccattttgaaaaccgttgcta

SEQ ID NO: 9354870 - DNA, 22 bp, Homo sapiens
gcccaaagagctttgatctcag

SEQ ID NO: 9354871 - DNA, 21 bp, Homo sapiens
gccatttcacacagacatttg

SEQ ID NO: 9354872 - DNA, 22 bp, Homo sapiens
gcccaaagtcactcagctagga

SEQ ID NO: 9354873 - DNA, 22 bp, Homo sapiens
gcccaaagccagtgtgctctcc

SEQ ID NO: 9354874 - DNA, 22 bp, Homo sapiens
gcccaagaatatttcccaagtt

SEQ ID NO: 9354875 - DNA, 22 bp, Homo sapiens
gccaggcatgtcctctgcagaa

SEQ ID NO: 9354876 - DNA, 22 bp, Homo sapiens
gccaggaatcactgctgagtaa

SEQ ID NO: 9354877 - DNA, 22 bp, Homo sapiens
gccaggaagcagttagatgggt

SEQ ID NO: 9354878 - DNA, 22 bp, Homo sapiens
gccaggaacacaatgccaagct

SEQ ID NO: 9354879 - DNA, 22 bp, Homo sapiens
gccaggaaagggaattccctga

SEQ ID NO: 9354880 - DNA, 22 bp, Homo sapiens
gccaggaaaaacgtggtgggag

SEQ ID NO: 9354881 - DNA, 22 bp, Homo sapiens
gccaggaaaaagggtggccaat

SEQ ID NO: 9354882 - DNA, 22 bp, Homo sapiens
gccaggaaaagaagctggtgct

SEQ ID NO: 9354883 - DNA, 22 bp, Homo sapiens
gccaggaaagccactggcatac

SEQ ID NO: 9354884 - DNA, 22 bp, Homo sapiens
gccagctgtttcagagcccagt

SEQ ID NO: 9354885 - DNA, 22 bp, Homo sapiens
gccagctgtttcagagcccagt

SEQ ID NO: 9354886 - DNA, 22 bp, Homo sapiens
gccagctgttcagacattcttt

SEQ ID NO: 9354887 - DNA, 22 bp, Homo sapiens
gccagcttccatggccacgtca

SEQ ID NO: 9354888 - DNA, 17 bp, Homo sapiens
gccagcttgagggccat

SEQ ID NO: 9354889 - DNA, 22 bp, Homo sapiens
gccagcttggcatgtgaggagt

SEQ ID NO: 9354890 - DNA, 22 bp, Homo sapiens
gccagcttggccagtggccagt

SEQ ID NO: 9354891 - DNA, 22 bp, Homo sapiens
gccagctgggccttagggctgg

SEQ ID NO: 9354892 - DNA, 22 bp, Homo sapiens
gccagctgggccttagggctgg

SEQ ID NO: 9354893 - DNA, 21 bp, Homo sapiens
gccagctgggtcttgcaggag

SEQ ID NO: 9354894 - DNA, 22 bp, Homo sapiens
gccagctggtaggcacctagcc

SEQ ID NO: 9354895 - DNA, 22 bp, Homo sapiens
gccagctggtaggcacctagcc

SEQ ID NO: 9354896 - DNA, 22 bp, Homo sapiens
gccagctgtaagctggggtgat

SEQ ID NO: 9354897 - DNA, 22 bp, Homo sapiens
gccagctgtaagcagtgattct

SEQ ID NO: 9354898 - DNA, 22 bp, Homo sapiens
gccagctgtaagcagtgattct

SEQ ID NO: 9354899 - DNA, 22 bp, Homo sapiens
gccagctgtaagcagtgattct

SEQ ID NO: 9354900 - DNA, 22 bp, Homo sapiens
gccagctgtctaagagagtaaa

SEQ ID NO: 9354901 - DNA, 22 bp, Homo sapiens
gccagctgtatctttggccagc

SEQ ID NO: 9354902 - DNA, 22 bp, Homo sapiens
gccagctgtaggtggtgggttg

SEQ ID NO: 9354903 - DNA, 22 bp, Homo sapiens
gccagctgaggccgtgcaggct

SEQ ID NO: 9354904 - DNA, 22 bp, Homo sapiens
gccagctgaggccgtgcaggct

SEQ ID NO: 9354905 - DNA, 22 bp, Homo sapiens
gccagctgaggccgtgcaggct

SEQ ID NO: 9354906 - DNA, 22 bp, Homo sapiens
gccagaagactggagtcagctg

SEQ ID NO: 9354907 - DNA, 22 bp, Homo sapiens
gccagaaggggtggatccaggc

SEQ ID NO: 9354908 - DNA, 22 bp, Homo sapiens
gccagaaacatacacatcactt

SEQ ID NO: 9354909 - DNA, 22 bp, Homo sapiens
gccactttgatgatataaaaac

SEQ ID NO: 9354910 - DNA, 22 bp, Homo sapiens
gccacttatattcccactgtgc

SEQ ID NO: 9354911 - DNA, 16 bp, Homo sapiens
gccacttattgattga

SEQ ID NO: 9354912 - DNA, 22 bp, Homo sapiens
gccacttctgcctggcagggcc

SEQ ID NO: 9354913 - DNA, 22 bp, Homo sapiens
gcaggtgaatgatggactagga

SEQ ID NO: 9354914 - DNA, 22 bp, Homo sapiens
gcaggtgaatgatggactagga

SEQ ID NO: 9354915 - DNA, 22 bp, Homo sapiens
gcaggtgaatgatggactagga

SEQ ID NO: 9354916 - DNA, 22 bp, Homo sapiens
gcaggtgaatgatggactagga

SEQ ID NO: 9354917 - DNA, 22 bp, Homo sapiens
gcaggtgaatgatggactagga

SEQ ID NO: 9354918 - DNA, 22 bp, Homo sapiens
gcaggtgaatgatggactagga

SEQ ID NO: 9354919 - DNA, 22 bp, Homo sapiens
gcaggtgatgtgatgtgagcat

SEQ ID NO: 9354920 - DNA, 22 bp, Homo sapiens
gcaggtgatgtgatgtgagcat

SEQ ID NO: 9354921 - DNA, 22 bp, Homo sapiens
gcaggtgatgtgatgtgagcat

SEQ ID NO: 9354922 - DNA, 19 bp, Homo sapiens
gcaggtgagccgtggctcc

SEQ ID NO: 9354923 - DNA, 22 bp, Homo sapiens
gcaggtctggcatagagcctgc

SEQ ID NO: 9354924 - DNA, 22 bp, Homo sapiens
gcaggtgaaagtgagtagtgag

SEQ ID NO: 9354925 - DNA, 22 bp, Homo sapiens
gcaggtgaaagtgagtagtgag

SEQ ID NO: 9354926 - DNA, 22 bp, Homo sapiens
gcaggtctatcaggctgcaggt

SEQ ID NO: 9354927 - DNA, 22 bp, Homo sapiens
gcaggtctcaatctgagcaggc

SEQ ID NO: 9354928 - DNA, 22 bp, Homo sapiens
gcaggtctcaatctgagcaggc

SEQ ID NO: 9354929 - DNA, 19 bp, Homo sapiens
gcaggtcattaggctaggt

SEQ ID NO: 9354930 - DNA, 22 bp, Homo sapiens
gcaggtccagtcaccagagaga

SEQ ID NO: 9354931 - DNA, 19 bp, Homo sapiens
gcaggtcattaggctaggt

SEQ ID NO: 9354932 - DNA, 19 bp, Homo sapiens
gcaggtcattaggctaggt

SEQ ID NO: 9354933 - DNA, 20 bp, Homo sapiens
gcaggtccctggcatgcaga

SEQ ID NO: 9354934 - DNA, 22 bp, Homo sapiens
gcaggtcccagaaagttaattc

SEQ ID NO: 9354935 - DNA, 22 bp, Homo sapiens
gcaggtctagaagctgcctctg

SEQ ID NO: 9354936 - DNA, 21 bp, Homo sapiens
gcagggtttgtgctgtgagtt

SEQ ID NO: 9354937 - DNA, 22 bp, Homo sapiens
gcaggtagcattttttgacaaa

SEQ ID NO: 9354938 - DNA, 19 bp, Homo sapiens
gcaggtagagacagcagcc

SEQ ID NO: 9354939 - DNA, 22 bp, Homo sapiens
gcagggccagtgcagagaggaa

SEQ ID NO: 9354940 - DNA, 22 bp, Homo sapiens
gcagggccagtgcagagaggaa

SEQ ID NO: 9354941 - DNA, 19 bp, Homo sapiens
gcagggtgttgactgtccc

SEQ ID NO: 9354942 - DNA, 22 bp, Homo sapiens
gcagggtgtgtctcatacagtt

SEQ ID NO: 9354943 - DNA, 22 bp, Homo sapiens
gcagggtgtgtctcatacagtt

SEQ ID NO: 9354944 - DNA, 22 bp, Homo sapiens
gcagggtgtgtctcatacagtt

SEQ ID NO: 9354945 - DNA, 19 bp, Homo sapiens
gcagggtggcagagctctt

SEQ ID NO: 9354946 - DNA, 22 bp, Homo sapiens
gcagggcagggcaagaactggg

SEQ ID NO: 9354947 - DNA, 22 bp, Homo sapiens
gcagggcaggatttgaacccag

SEQ ID NO: 9354948 - DNA, 22 bp, Homo sapiens
gcagggcaggatttgaacccag

SEQ ID NO: 9354949 - DNA, 22 bp, Homo sapiens
gcagggcaggatttgaacccag

SEQ ID NO: 9354950 - DNA, 22 bp, Homo sapiens
gcagggcagtaagagctagagt

SEQ ID NO: 9354951 - DNA, 22 bp, Homo sapiens
gcagggcagtaagagctagagt

SEQ ID NO: 9354952 - DNA, 22 bp, Homo sapiens
gcagggcagtaagagctagagt

SEQ ID NO: 9354953 - DNA, 22 bp, Homo sapiens
gcagggcagggcaagaactggg

SEQ ID NO: 9354954 - DNA, 22 bp, Homo sapiens
gcagggcagggcaagaactggg

SEQ ID NO: 9354955 - DNA, 22 bp, Homo sapiens
gcagggccagggctcaggctgt

SEQ ID NO: 9354956 - DNA, 22 bp, Homo sapiens
gcagggcatgggccctgtctgc

SEQ ID NO: 9354957 - DNA, 22 bp, Homo sapiens
gcagggcatgggccctgtctgc

SEQ ID NO: 9354958 - DNA, 22 bp, Homo sapiens
gcagggcatgggccctgtctgc

SEQ ID NO: 9354959 - DNA, 22 bp, Homo sapiens
gcagggcatgggccctgtctgc

SEQ ID NO: 9354960 - DNA, 23 bp, Homo sapiens
gcagctggttagaagggaaggag

SEQ ID NO: 9354961 - DNA, 22 bp, Homo sapiens
gcagctgtaaagcagaaatagt

SEQ ID NO: 9354962 - DNA, 22 bp, Homo sapiens
gcagctgtactggcagcattgt

SEQ ID NO: 9354963 - DNA, 22 bp, Homo sapiens
gcaggcatggtcgctgccaggt

SEQ ID NO: 9354964 - DNA, 22 bp, Homo sapiens
gcaggcatctctgtagccaggg

SEQ ID NO: 9354965 - DNA, 22 bp, Homo sapiens
gcaggcatctctgtagccaggg

SEQ ID NO: 9354966 - DNA, 22 bp, Homo sapiens
gcaggcagtttgcttttccctc

SEQ ID NO: 9354967 - DNA, 22 bp, Homo sapiens
gcaggcagtttgcttttccctc

SEQ ID NO: 9354968 - DNA, 22 bp, Homo sapiens
gcaggccacagtggagtctctg

SEQ ID NO: 9354969 - DNA, 22 bp, Homo sapiens
gcaggccaagccctcgcagaga

SEQ ID NO: 9354970 - DNA, 22 bp, Homo sapiens
gcaggcatggtcgctgccaggt

SEQ ID NO: 9354971 - DNA, 22 bp, Homo sapiens
gcaggccaagccctcgcagaga

SEQ ID NO: 9354972 - DNA, 22 bp, Homo sapiens
gcaggcattagcccccatggct

SEQ ID NO: 9354973 - DNA, 22 bp, Homo sapiens
gcaggccagctgtgcagatggg

SEQ ID NO: 9354974 - DNA, 22 bp, Homo sapiens
gcaggccagctgtgcagatggg

SEQ ID NO: 9354975 - DNA, 22 bp, Homo sapiens
gcaggccagctgtgcagatggg

SEQ ID NO: 9354976 - DNA, 22 bp, Homo sapiens
gcaggccagctgtgcagatggg

SEQ ID NO: 9354977 - DNA, 22 bp, Homo sapiens
gcaggccacagtggagtctctg

SEQ ID NO: 9354978 - DNA, 22 bp, Homo sapiens
gcaggccactgtctcctctggg

SEQ ID NO: 9354979 - DNA, 22 bp, Homo sapiens
gcaggccactgtctcctctggg

SEQ ID NO: 9354980 - DNA, 22 bp, Homo sapiens
gcaggccacagtggagtctctg

SEQ ID NO: 9354981 - DNA, 22 bp, Homo sapiens
gcaggccattcaggagatgtgc

SEQ ID NO: 9354982 - DNA, 22 bp, Homo sapiens
gcaggccaggctaggggctgtc

SEQ ID NO: 9354983 - DNA, 22 bp, Homo sapiens
gcaggccaggctaggggctgtc

SEQ ID NO: 9354984 - DNA, 19 bp, Homo sapiens
gcaggccaggaggcggagg

SEQ ID NO: 9354985 - DNA, 19 bp, Homo sapiens
gcaggccaggaggcggagg

SEQ ID NO: 9354986 - DNA, 22 bp, Homo sapiens
gcaggccattcaggagatgtgc

SEQ ID NO: 9354987 - DNA, 22 bp, Homo sapiens
gcaggcccagagtcgctggcct

SEQ ID NO: 9354988 - DNA, 22 bp, Homo sapiens
gcaggcccagagtcgctggcct

SEQ ID NO: 9354989 - DNA, 22 bp, Homo sapiens
gcaggcccagagtcgctggcct

SEQ ID NO: 9354990 - DNA, 22 bp, Homo sapiens
gcaggcccagagtcgctggcct

SEQ ID NO: 9354991 - DNA, 22 bp, Homo sapiens
gcaggccctcctctagcaaggc

SEQ ID NO: 9354992 - DNA, 20 bp, Homo sapiens
gcaggccctctctctagtct

SEQ ID NO: 9354993 - DNA, 19 bp, Homo sapiens
gcaggcccagtcgggctgg

SEQ ID NO: 9354994 - DNA, 22 bp, Homo sapiens
gcaggcccttagccttggtggg

SEQ ID NO: 9354995 - DNA, 22 bp, Homo sapiens
gcaggcccttagccttggtggg

SEQ ID NO: 9354996 - DNA, 18 bp, Homo sapiens
gcaggccctgtttctggg

SEQ ID NO: 9354997 - DNA, 20 bp, Homo sapiens
gcaggccctctctctagtct

SEQ ID NO: 9354998 - DNA, 20 bp, Homo sapiens
gcaggccctctctctagtct

SEQ ID NO: 9354999 - DNA, 22 bp, Homo sapiens
gcaggcctaagagaaggcattg

SEQ ID NO: 9355000 - DNA, 22 bp, Homo sapiens
gcaggcccttagccttggtggg

SEQ ID NO: 9355001 - DNA, 22 bp, Homo sapiens
gcaggcctaagagaaggcattg

SEQ ID NO: 9355002 - DNA, 22 bp, Homo sapiens
gcaggcccttagccttggtggg

SEQ ID NO: 9355003 - DNA, 22 bp, Homo sapiens
gcaggcctcccctgctggagct

SEQ ID NO: 9355004 - DNA, 18 bp, Homo sapiens
gcaggcctagaacttggt

SEQ ID NO: 9355005 - DNA, 22 bp, Homo sapiens
gcaggcctcccctgctggagct

SEQ ID NO: 9355006 - DNA, 22 bp, Homo sapiens
gcaggcctctaattcaccgcag

SEQ ID NO: 9355007 - DNA, 22 bp, Homo sapiens
gcagggcagccacaggccccct

SEQ ID NO: 9355008 - DNA, 22 bp, Homo sapiens
gcagggcagctcactgtggttc

SEQ ID NO: 9355009 - DNA, 22 bp, Homo sapiens
gcagggcagctcactgtggttc

SEQ ID NO: 9355010 - DNA, 22 bp, Homo sapiens
gcagggcagctcactgtggttc

SEQ ID NO: 9355011 - DNA, 22 bp, Homo sapiens
gcagggcagctcactgtggttc

SEQ ID NO: 9355012 - DNA, 22 bp, Homo sapiens
gcagggcagctgaagctaggtg

SEQ ID NO: 9355013 - DNA, 22 bp, Homo sapiens
gcagggcagctcactgtggttc

SEQ ID NO: 9355014 - DNA, 22 bp, Homo sapiens
gcagggcagctgaagctaggtg

SEQ ID NO: 9355015 - DNA, 22 bp, Homo sapiens
gcagggcagcttagtccctgtc

SEQ ID NO: 9355016 - DNA, 22 bp, Homo sapiens
gcagggcagctgaagctaggtg

SEQ ID NO: 9355017 - DNA, 22 bp, Homo sapiens
gcagggcagcttagtccctgtc

SEQ ID NO: 9355018 - DNA, 22 bp, Homo sapiens
gcagggcagcttagtccctgtc

SEQ ID NO: 9355019 - DNA, 22 bp, Homo sapiens
gcagggcagcttagtccctgtc

SEQ ID NO: 9355020 - DNA, 22 bp, Homo sapiens
gcagggcagcttagtccctgtc

SEQ ID NO: 9355021 - DNA, 22 bp, Homo sapiens
gcagggcagcttagtccctgtc

SEQ ID NO: 9355022 - DNA, 17 bp, Homo sapiens
gcagccagtgcagcagg

SEQ ID NO: 9355023 - DNA, 17 bp, Homo sapiens
gcagccagtgcagcagg

SEQ ID NO: 9355024 - DNA, 22 bp, Homo sapiens
gcagccagtatcctctgagatt

SEQ ID NO: 9355025 - DNA, 22 bp, Homo sapiens
gcagccaggaagcccaggacac

SEQ ID NO: 9355026 - DNA, 22 bp, Homo sapiens
gcagccaggaagcccaggacac

SEQ ID NO: 9355027 - DNA, 22 bp, Homo sapiens
gcagccagtgggatgagaaaga

SEQ ID NO: 9355028 - DNA, 22 bp, Homo sapiens
gcagcccaaaaaagaggtagat

SEQ ID NO: 9355029 - DNA, 22 bp, Homo sapiens
gcagctgggacactgaggccag

SEQ ID NO: 9355030 - DNA, 22 bp, Homo sapiens
gcagctggctcagagaggtggg

SEQ ID NO: 9355031 - DNA, 22 bp, Homo sapiens
gcagctggctcagagaggtggg

SEQ ID NO: 9355032 - DNA, 22 bp, Homo sapiens
gcagctggctctgggaaaaact

SEQ ID NO: 9355033 - DNA, 22 bp, Homo sapiens
gcagcccaatggactgagacag

SEQ ID NO: 9355034 - DNA, 22 bp, Homo sapiens
gcagcccacagctggaggccta

SEQ ID NO: 9355035 - DNA, 22 bp, Homo sapiens
gcagcccacagctggaggccta

SEQ ID NO: 9355036 - DNA, 23 bp, Homo sapiens
gcagctggttagaagggaaggag

SEQ ID NO: 9355037 - DNA, 23 bp, Homo sapiens
gcagctggttagaagggaaggag

SEQ ID NO: 9355038 - DNA, 23 bp, Homo sapiens
gcagctggttagaagggaaggag

SEQ ID NO: 9355039 - DNA, 22 bp, Homo sapiens
gcagctggtgcaaatgtcactc

SEQ ID NO: 9355040 - DNA, 22 bp, Homo sapiens
gcagctggttaatgggagaatt

SEQ ID NO: 9355041 - DNA, 22 bp, Homo sapiens
gcagctggtgcaaatgtcactc

SEQ ID NO: 9355042 - DNA, 22 bp, Homo sapiens
gcagctggtctggcctagagta

SEQ ID NO: 9355043 - DNA, 22 bp, Homo sapiens
gcagctggtgcaaatgtcactc

SEQ ID NO: 9355044 - DNA, 21 bp, Homo sapiens
gcagctggtctcagagcttgc

SEQ ID NO: 9355045 - DNA, 22 bp, Homo sapiens
gcagctggtctggcctagagta

SEQ ID NO: 9355046 - DNA, 22 bp, Homo sapiens
gcagctgggtctgtgtgggctg

SEQ ID NO: 9355047 - DNA, 22 bp, Homo sapiens
gcagctgggtctgtgtgggctg

SEQ ID NO: 9355048 - DNA, 22 bp, Homo sapiens
gcagctgggtctgtgtgggctg

SEQ ID NO: 9355049 - DNA, 22 bp, Homo sapiens
gcagctggggccacacttaggc

SEQ ID NO: 9355050 - DNA, 22 bp, Homo sapiens
gcagctggggccacacttaggc

SEQ ID NO: 9355051 - DNA, 22 bp, Homo sapiens
gcagctggggccacacttaggc

SEQ ID NO: 9355052 - DNA, 22 bp, Homo sapiens
gcagctggggaggtcgtgggga

SEQ ID NO: 9355053 - DNA, 22 bp, Homo sapiens
gcagctgggccccagcctctcc

SEQ ID NO: 9355054 - DNA, 22 bp, Homo sapiens
gcagctggggaggtcgtgggga

SEQ ID NO: 9355055 - DNA, 22 bp, Homo sapiens
gcagctggggaggtcgtgggga

SEQ ID NO: 9355056 - DNA, 22 bp, Homo sapiens
gcagctgggacactgaggccag

SEQ ID NO: 9355057 - DNA, 22 bp, Homo sapiens
gcagctgggacactgaggccag

SEQ ID NO: 9355058 - DNA, 22 bp, Homo sapiens
gcagctgggacactgaggccag

SEQ ID NO: 9355059 - DNA, 22 bp, Homo sapiens
gcagctgggccccagcctctcc

SEQ ID NO: 9355060 - DNA, 22 bp, Homo sapiens
gcagctgggccccagcctctcc

SEQ ID NO: 9355061 - DNA, 22 bp, Homo sapiens
gcagcagatgtgggcccagagc

SEQ ID NO: 9355062 - DNA, 22 bp, Homo sapiens
gcagcagaaggccaaggggagc

SEQ ID NO: 9355063 - DNA, 22 bp, Homo sapiens
gcagcagcaagaaggttggact

SEQ ID NO: 9355064 - DNA, 22 bp, Homo sapiens
gcagcagatgtgggcccagagc

SEQ ID NO: 9355065 - DNA, 22 bp, Homo sapiens
gcagcagcagcaattttctgtc

SEQ ID NO: 9355066 - DNA, 22 bp, Homo sapiens
gcagcagcagcaattttctgtc

SEQ ID NO: 9355067 - DNA, 22 bp, Homo sapiens
gcagcagcaggcgctcggccgt

SEQ ID NO: 9355068 - DNA, 22 bp, Homo sapiens
gcagcagcagggagtctgactt

SEQ ID NO: 9355069 - DNA, 22 bp, Homo sapiens
gcagcagccactattctggcat

SEQ ID NO: 9355070 - DNA, 22 bp, Homo sapiens
gcagcagcagggagtctgactt

SEQ ID NO: 9355071 - DNA, 22 bp, Homo sapiens
gcagcagcaggcgctcggccgt

SEQ ID NO: 9355072 - DNA, 22 bp, Homo sapiens
gcagcactaatgggccccagaa

SEQ ID NO: 9355073 - DNA, 22 bp, Homo sapiens
gcagcaccaaccagggcctgtt

SEQ ID NO: 9355074 - DNA, 22 bp, Homo sapiens
gcagcacatataaacaaagaga

SEQ ID NO: 9355075 - DNA, 22 bp, Homo sapiens
gcagcacaaagtccccagggac

SEQ ID NO: 9355076 - DNA, 22 bp, Homo sapiens
gcagcaagtctagtttgtaggc

SEQ ID NO: 9355077 - DNA, 22 bp, Homo sapiens
gcagcaaggatgaagcacttgg

SEQ ID NO: 9355078 - DNA, 22 bp, Homo sapiens
gcagcaaggatgaagcacttgg

SEQ ID NO: 9355079 - DNA, 22 bp, Homo sapiens
gcagcaagaggtttctgttgac

SEQ ID NO: 9355080 - DNA, 22 bp, Homo sapiens
gcagccaggaaagctggaccct

SEQ ID NO: 9355081 - DNA, 21 bp, Homo sapiens
gcagccagccgagaccatgcc

SEQ ID NO: 9355082 - DNA, 21 bp, Homo sapiens
gcagccagccgagaccatgcc

SEQ ID NO: 9355083 - DNA, 22 bp, Homo sapiens
gcagccagccctagtcccactt

SEQ ID NO: 9355084 - DNA, 22 bp, Homo sapiens
gcagccagagggggtgtgatca

SEQ ID NO: 9355085 - DNA, 22 bp, Homo sapiens
gcagccagagggggtgtgatca

SEQ ID NO: 9355086 - DNA, 21 bp, Homo sapiens
gcagccagacgggattcagtt

SEQ ID NO: 9355087 - DNA, 22 bp, Homo sapiens
gcagccagcaggaagcgggaga

SEQ ID NO: 9355088 - DNA, 22 bp, Homo sapiens
gcagccagcccctctgacctct

SEQ ID NO: 9355089 - DNA, 22 bp, Homo sapiens
gcagccaccctcaaggctgaat

SEQ ID NO: 9355090 - DNA, 22 bp, Homo sapiens
gcagccagaagactcagaacaa

SEQ ID NO: 9355091 - DNA, 22 bp, Homo sapiens
gcagcagcccagggctctcaga

SEQ ID NO: 9355092 - DNA, 22 bp, Homo sapiens
gcagcagcccagggctctcaga

SEQ ID NO: 9355093 - DNA, 22 bp, Homo sapiens
gcagcagccactattctggcat

SEQ ID NO: 9355094 - DNA, 22 bp, Homo sapiens
gcagccaccctcaaggctgaat

SEQ ID NO: 9355095 - DNA, 22 bp, Homo sapiens
gcagccacagaggagggatgca

SEQ ID NO: 9355096 - DNA, 21 bp, Homo sapiens
gcaaggcaatgccatgatttc

SEQ ID NO: 9355097 - DNA, 22 bp, Homo sapiens
gagtcaacaagtcagatctcac

SEQ ID NO: 9355098 - DNA, 22 bp, Homo sapiens
gagtattttcaaattcagcaga

SEQ ID NO: 9355099 - DNA, 22 bp, Homo sapiens
gagtattttcaaattcagcaga

SEQ ID NO: 9355100 - DNA, 22 bp, Homo sapiens
gagtcacaaaagatgcccaggg

SEQ ID NO: 9355101 - DNA, 22 bp, Homo sapiens
gcaaggaagagcaggtggtgct

SEQ ID NO: 9355102 - DNA, 22 bp, Homo sapiens
gagtagcattctagagtatgct

SEQ ID NO: 9355103 - DNA, 22 bp, Homo sapiens
gagtagggatgctggtgactcc

SEQ ID NO: 9355104 - DNA, 22 bp, Homo sapiens
gagtagcattctagagtatgct

SEQ ID NO: 9355105 - DNA, 22 bp, Homo sapiens
gagtagaaggaagttatctacc

SEQ ID NO: 9355106 - DNA, 22 bp, Homo sapiens
gagtagaactggttatctaata

SEQ ID NO: 9355107 - DNA, 22 bp, Homo sapiens
gagtagaactggttatctaata

SEQ ID NO: 9355108 - DNA, 22 bp, Homo sapiens
gagtagaactagaattcttcaa

SEQ ID NO: 9355109 - DNA, 22 bp, Homo sapiens
gagtagaaagtaaagtacgaat

SEQ ID NO: 9355110 - DNA, 22 bp, Homo sapiens
gagtagggatgctggtgactcc

SEQ ID NO: 9355111 - DNA, 22 bp, Homo sapiens
gagtagggatgctggtgactcc

SEQ ID NO: 9355112 - DNA, 22 bp, Homo sapiens
gagtagggtttccaggttagag

SEQ ID NO: 9355113 - DNA, 22 bp, Homo sapiens
gagtataatgattttcattcac

SEQ ID NO: 9355114 - DNA, 22 bp, Homo sapiens
gagtataagtaatttcaagcaa

SEQ ID NO: 9355115 - DNA, 22 bp, Homo sapiens
gagtataagctttttcacttca

SEQ ID NO: 9355116 - DNA, 20 bp, Homo sapiens
gagtatgtaggatggtatca

SEQ ID NO: 9355117 - DNA, 22 bp, Homo sapiens
gagtatttatatgtaagtacct

SEQ ID NO: 9355118 - DNA, 22 bp, Homo sapiens
gcaataaaatgtaatgattggg

SEQ ID NO: 9355119 - DNA, 22 bp, Homo sapiens
gcaataaataacatggaagaca

SEQ ID NO: 9355120 - DNA, 22 bp, Homo sapiens
gcaataaataacatggaagaca

SEQ ID NO: 9355121 - DNA, 22 bp, Homo sapiens
gcaaggcagcgcggagtagcta

SEQ ID NO: 9355122 - DNA, 20 bp, Homo sapiens
gcaaggcacagtgaggaggg

SEQ ID NO: 9355123 - DNA, 21 bp, Homo sapiens
gcaaggcctatcatggcagct

SEQ ID NO: 9355124 - DNA, 19 bp, Homo sapiens
gcaaggccagcttgatgtg

SEQ ID NO: 9355125 - DNA, 21 bp, Homo sapiens
gcaaggcctatcatggcagct

SEQ ID NO: 9355126 - DNA, 22 bp, Homo sapiens
gcaaggcctgaggtgggtgctc

SEQ ID NO: 9355127 - DNA, 22 bp, Homo sapiens
gcaaggcctgaggtgggtgctc

SEQ ID NO: 9355128 - DNA, 18 bp, Homo sapiens
gcaaggctcaggccaggc

SEQ ID NO: 9355129 - DNA, 22 bp, Homo sapiens
gcaaggctcacattgaactgaa

SEQ ID NO: 9355130 - DNA, 17 bp, Homo sapiens
gcaaggcctgtttgttc

SEQ ID NO: 9355131 - DNA, 18 bp, Homo sapiens
gcaaggctcaggccaggc

SEQ ID NO: 9355132 - DNA, 18 bp, Homo sapiens
gcaaggctcaggccaggc

SEQ ID NO: 9355133 - DNA, 22 bp, Homo sapiens
gcacagaaccagacatgaggca

SEQ ID NO: 9355134 - DNA, 22 bp, Homo sapiens
gcaatagagcagctaatggaaa

SEQ ID NO: 9355135 - DNA, 22 bp, Homo sapiens
gcacagaataacactctgggct

SEQ ID NO: 9355136 - DNA, 22 bp, Homo sapiens
gcacagaagtaaaatacaagtc

SEQ ID NO: 9355137 - DNA, 22 bp, Homo sapiens
gcacagagacagtcctgagatc

SEQ ID NO: 9355138 - DNA, 22 bp, Homo sapiens
gcacagagacagtcctgagatc

SEQ ID NO: 9355139 - DNA, 20 bp, Homo sapiens
gcacagagatgagcaaagta

SEQ ID NO: 9355140 - DNA, 22 bp, Homo sapiens
gcacagagagtcccgggtgccc

SEQ ID NO: 9355141 - DNA, 22 bp, Homo sapiens
gcacagagagggaaggtaactt

SEQ ID NO: 9355142 - DNA, 22 bp, Homo sapiens
gcacagaggtggaggacaaata

SEQ ID NO: 9355143 - DNA, 22 bp, Homo sapiens
gcacagagggcagtgagcctct

SEQ ID NO: 9355144 - DNA, 22 bp, Homo sapiens
gcacagagtcactagctaagca

SEQ ID NO: 9355145 - DNA, 22 bp, Homo sapiens
gcacagagtgggtgagatgtgg

SEQ ID NO: 9355146 - DNA, 22 bp, Homo sapiens
gcacagagtcactagctaagca

SEQ ID NO: 9355147 - DNA, 22 bp, Homo sapiens
gcacagaggtggaggacaaata

SEQ ID NO: 9355148 - DNA, 22 bp, Homo sapiens
gcacagcagctgctcagttgct

SEQ ID NO: 9355149 - DNA, 22 bp, Homo sapiens
gcacagcacagcaacatgtttt

SEQ ID NO: 9355150 - DNA, 22 bp, Homo sapiens
gcacagcagacttggtggggct

SEQ ID NO: 9355151 - DNA, 22 bp, Homo sapiens
gcacatggacaatggaggtgca

SEQ ID NO: 9355152 - DNA, 22 bp, Homo sapiens
gcacatggtaggcatttgatgt

SEQ ID NO: 9355153 - DNA, 22 bp, Homo sapiens
gcacatggcggccagcaggtga

SEQ ID NO: 9355154 - DNA, 22 bp, Homo sapiens
gcacatggtaggcatttgatgt

SEQ ID NO: 9355155 - DNA, 22 bp, Homo sapiens
gcagagtcattatttatgcaat

SEQ ID NO: 9355156 - DNA, 22 bp, Homo sapiens
gcagagtcaggtccaaggactg

SEQ ID NO: 9355157 - DNA, 22 bp, Homo sapiens
gcagagtcaggtccaaggactg

SEQ ID NO: 9355158 - DNA, 22 bp, Homo sapiens
gcagagtcaggattccatccca

SEQ ID NO: 9355159 - DNA, 22 bp, Homo sapiens
gcagagtctgggcagcctccat

SEQ ID NO: 9355160 - DNA, 22 bp, Homo sapiens
gcagagtcccagcaggtggtgg

SEQ ID NO: 9355161 - DNA, 22 bp, Homo sapiens
gcagagtcccagcaggtggtgg

SEQ ID NO: 9355162 - DNA, 22 bp, Homo sapiens
gcagagtcccagcaggtggtgg

SEQ ID NO: 9355163 - DNA, 22 bp, Homo sapiens
gcagagtctgggctacctcttg

SEQ ID NO: 9355164 - DNA, 22 bp, Homo sapiens
gcagagtctggtaggtgctggt

SEQ ID NO: 9355165 - DNA, 22 bp, Homo sapiens
gcagagtctggtaggtgctggt

SEQ ID NO: 9355166 - DNA, 22 bp, Homo sapiens
gcagagtgaagcagtatggaaa

SEQ ID NO: 9355167 - DNA, 22 bp, Homo sapiens
gcagagtgaagcagtatggaaa

SEQ ID NO: 9355168 - DNA, 23 bp, Homo sapiens
gcagagtcaagtagtcatgagtg

SEQ ID NO: 9355169 - DNA, 22 bp, Homo sapiens
gcagagtcagcctccgagacag

SEQ ID NO: 9355170 - DNA, 19 bp, Homo sapiens
gcagagtcaagagctgctg

SEQ ID NO: 9355171 - DNA, 19 bp, Homo sapiens
gcagagtcaagagctgctg

SEQ ID NO: 9355172 - DNA, 22 bp, Homo sapiens
gcagaggttggattggtgactt

SEQ ID NO: 9355173 - DNA, 19 bp, Homo sapiens
gcagagtcaagagctgctg

SEQ ID NO: 9355174 - DNA, 22 bp, Homo sapiens
gcagaggtgtcaccttccagga

SEQ ID NO: 9355175 - DNA, 22 bp, Homo sapiens
gcagaggtgctcagtggcagaa

SEQ ID NO: 9355176 - DNA, 22 bp, Homo sapiens
gcagaggtgctcagtggcagaa

SEQ ID NO: 9355177 - DNA, 22 bp, Homo sapiens
gcagaggtgctcagtggcagaa

SEQ ID NO: 9355178 - DNA, 22 bp, Homo sapiens
gcagaggtggcatctgggctct

SEQ ID NO: 9355179 - DNA, 22 bp, Homo sapiens
gcagaggtgagtttctcagctg

SEQ ID NO: 9355180 - DNA, 22 bp, Homo sapiens
gcagacagggctacagaggtac

SEQ ID NO: 9355181 - DNA, 22 bp, Homo sapiens
gcagacagggctacagaggtac

SEQ ID NO: 9355182 - DNA, 22 bp, Homo sapiens
gcagacaggcccagtggaggga

SEQ ID NO: 9355183 - DNA, 22 bp, Homo sapiens
gcagacagggctacagaggtac

SEQ ID NO: 9355184 - DNA, 22 bp, Homo sapiens
gcagcaagaataatttgggtag

SEQ ID NO: 9355185 - DNA, 22 bp, Homo sapiens
gcagcaagaggtgccatcttga

SEQ ID NO: 9355186 - DNA, 22 bp, Homo sapiens
gcagcaagaggtgccatcttga

SEQ ID NO: 9355187 - DNA, 22 bp, Homo sapiens
gcagcaacgcggccctactgct

SEQ ID NO: 9355188 - DNA, 18 bp, Homo sapiens
gcagcaaagggcccgggg

SEQ ID NO: 9355189 - DNA, 22 bp, Homo sapiens
gcagatgttgatgcaagaagag

SEQ ID NO: 9355190 - DNA, 22 bp, Homo sapiens
gcagatgttgtgaggctggtaa

SEQ ID NO: 9355191 - DNA, 22 bp, Homo sapiens
gcagatgttgttgctgggagtt

SEQ ID NO: 9355192 - DNA, 19 bp, Homo sapiens
gcagagtggggtggagggt

SEQ ID NO: 9355193 - DNA, 19 bp, Homo sapiens
gcagagtggggtggagggt

SEQ ID NO: 9355194 - DNA, 19 bp, Homo sapiens
gcagagtggggtggagggt

SEQ ID NO: 9355195 - DNA, 22 bp, Homo sapiens
gcagagtgaggaagagcttcca

SEQ ID NO: 9355196 - DNA, 22 bp, Homo sapiens
gcagagtgaagggagaggtgtg

SEQ ID NO: 9355197 - DNA, 22 bp, Homo sapiens
gcagagtgaagggagaggtgtg

SEQ ID NO: 9355198 - DNA, 22 bp, Homo sapiens
gcagagtgagatatgaacccag

SEQ ID NO: 9355199 - DNA, 22 bp, Homo sapiens
gcagagtgagccgaggctgctc

SEQ ID NO: 9355200 - DNA, 22 bp, Homo sapiens
gcagagtgagatatgaacccag

SEQ ID NO: 9355201 - DNA, 22 bp, Homo sapiens
gcagagtgccgagatggaagcg

SEQ ID NO: 9355202 - DNA, 22 bp, Homo sapiens
gcagagtgccgagatggaagcg

SEQ ID NO: 9355203 - DNA, 22 bp, Homo sapiens
gcagagtgatggaatgtgggtg

SEQ ID NO: 9355204 - DNA, 22 bp, Homo sapiens
gcagagtgctgtcgtacgcccc

SEQ ID NO: 9355205 - DNA, 18 bp, Homo sapiens
gcagagtgcgtctctgtg

SEQ ID NO: 9355206 - DNA, 18 bp, Homo sapiens
gcagagtgcgtctctgtg

SEQ ID NO: 9355207 - DNA, 22 bp, Homo sapiens
gcaccagctgcagggtggctga

SEQ ID NO: 9355208 - DNA, 22 bp, Homo sapiens
gcaccagctgccttctgtgccc

SEQ ID NO: 9355209 - DNA, 22 bp, Homo sapiens
gcaccagcctgagcctcttgca

SEQ ID NO: 9355210 - DNA, 22 bp, Homo sapiens
gcaccagctgccttctgtgccc

SEQ ID NO: 9355211 - DNA, 22 bp, Homo sapiens
gcacccagaggtcagcagtgct

SEQ ID NO: 9355212 - DNA, 22 bp, Homo sapiens
gcagaaggatccgcaggtgcaa

SEQ ID NO: 9355213 - DNA, 22 bp, Homo sapiens
gcagaaggatccgcaggtgcaa

SEQ ID NO: 9355214 - DNA, 22 bp, Homo sapiens
gcagaaggatccgcaggtgcaa

SEQ ID NO: 9355215 - DNA, 21 bp, Homo sapiens
gcacccagccggttctcccag

SEQ ID NO: 9355216 - DNA, 22 bp, Homo sapiens
gcacccagaggtcagcagtgct

SEQ ID NO: 9355217 - DNA, 22 bp, Homo sapiens
gcacccagaggtcagcagtgct

SEQ ID NO: 9355218 - DNA, 22 bp, Homo sapiens
gcagacaggcccagtggaggga

SEQ ID NO: 9355219 - DNA, 22 bp, Homo sapiens
gcagacagccagactgcactgg

SEQ ID NO: 9355220 - DNA, 22 bp, Homo sapiens
gcagacagccagactgcactgg

SEQ ID NO: 9355221 - DNA, 22 bp, Homo sapiens
gcagacaggattgggttaatag

SEQ ID NO: 9355222 - DNA, 22 bp, Homo sapiens
gcagacagcatgttgggctatt

SEQ ID NO: 9355223 - DNA, 22 bp, Homo sapiens
gcagacagcatgttgggctatt

SEQ ID NO: 9355224 - DNA, 22 bp, Homo sapiens
gcagacagcatgttgggctatt

SEQ ID NO: 9355225 - DNA, 22 bp, Homo sapiens
gcagacagcatgttgggctatt

SEQ ID NO: 9355226 - DNA, 22 bp, Homo sapiens
gcagacagatgagggtgctggg

SEQ ID NO: 9355227 - DNA, 22 bp, Homo sapiens
gcagacagatgagggtgctggg

SEQ ID NO: 9355228 - DNA, 22 bp, Homo sapiens
gcagacagatgagggtgctggg

SEQ ID NO: 9355229 - DNA, 22 bp, Homo sapiens
gcagacagaagctaagtagaca

SEQ ID NO: 9355230 - DNA, 23 bp, Homo sapiens
gcagacagagcagactaagacaa

SEQ ID NO: 9355231 - DNA, 22 bp, Homo sapiens
gcagacagactgcagtgatttt

SEQ ID NO: 9355232 - DNA, 22 bp, Homo sapiens
gcagaagggaataaggagcttt

SEQ ID NO: 9355233 - DNA, 22 bp, Homo sapiens
gcagaagggaataaggagcttt

SEQ ID NO: 9355234 - DNA, 22 bp, Homo sapiens
gcagacacagggaaggcaagga

SEQ ID NO: 9355235 - DNA, 22 bp, Homo sapiens
gcagacaatttattagcagatt

SEQ ID NO: 9355236 - DNA, 22 bp, Homo sapiens
gcagacaccttgtaggtgtgta

SEQ ID NO: 9355237 - DNA, 18 bp, Homo sapiens
gcagacactcgtggaggg

SEQ ID NO: 9355238 - DNA, 22 bp, Homo sapiens
gctgtttccccttcacagtggc

SEQ ID NO: 9355239 - DNA, 22 bp, Homo sapiens
gctgtttccagacaatgtcttt

SEQ ID NO: 9355240 - DNA, 22 bp, Homo sapiens
gctgtttctttggcaaactgat

SEQ ID NO: 9355241 - DNA, 22 bp, Homo sapiens
gctgtttctgagtagctaggct

SEQ ID NO: 9355242 - DNA, 22 bp, Homo sapiens
gctgtgtggctgtgccgtcacg

SEQ ID NO: 9355243 - DNA, 22 bp, Homo sapiens
gctgtgtgctgggcatggcact

SEQ ID NO: 9355244 - DNA, 22 bp, Homo sapiens
gctgtgtgctgggcatggcact

SEQ ID NO: 9355245 - DNA, 22 bp, Homo sapiens
gctgtgtgctgggcatggcact

SEQ ID NO: 9355246 - DNA, 22 bp, Homo sapiens
gctgtgtgttcaataatgtgat

SEQ ID NO: 9355247 - DNA, 22 bp, Homo sapiens
gctgtgtgttcaataatgtgat

SEQ ID NO: 9355248 - DNA, 22 bp, Homo sapiens
gctgtgtttgacagtagcagac

SEQ ID NO: 9355249 - DNA, 22 bp, Homo sapiens
gctgtgttggtgaagctgtagc

SEQ ID NO: 9355250 - DNA, 22 bp, Homo sapiens
gcttgtttctatttatcaagta

SEQ ID NO: 9355251 - DNA, 22 bp, Homo sapiens
gcttgtcattactggtttctcg

SEQ ID NO: 9355252 - DNA, 22 bp, Homo sapiens
gcttgtctgctgagccacctgt

SEQ ID NO: 9355253 - DNA, 22 bp, Homo sapiens
gctttacacagatgaatatttc

SEQ ID NO: 9355254 - DNA, 22 bp, Homo sapiens
gctttacataaacatttattat

SEQ ID NO: 9355255 - DNA, 22 bp, Homo sapiens
gctttacatgtttccctttaag

SEQ ID NO: 9355256 - DNA, 22 bp, Homo sapiens
gctttacatgagatgaggacaa

SEQ ID NO: 9355257 - DNA, 22 bp, Homo sapiens
gctttacaacaaattgaatatg

SEQ ID NO: 9355258 - DNA, 22 bp, Homo sapiens
gcttggtttggcaaaggaagga

SEQ ID NO: 9355259 - DNA, 22 bp, Homo sapiens
gcttggcagggcctgctggagc

SEQ ID NO: 9355260 - DNA, 22 bp, Homo sapiens
gcttggcagcaacaggcatccc

SEQ ID NO: 9355261 - DNA, 20 bp, Homo sapiens
gcttggcaggttttgttgcc

SEQ ID NO: 9355262 - DNA, 22 bp, Homo sapiens
gcttggagatgggggatgagcc

SEQ ID NO: 9355263 - DNA, 22 bp, Homo sapiens
gcttggaagtaggattgggaga

SEQ ID NO: 9355264 - DNA, 22 bp, Homo sapiens
gcttggagtagaatgcattctt

SEQ ID NO: 9355265 - DNA, 22 bp, Homo sapiens
gcttaaattgtttgtggatagt

SEQ ID NO: 9355266 - DNA, 22 bp, Homo sapiens
gcttaaatcccaatgctagacc

SEQ ID NO: 9355267 - DNA, 22 bp, Homo sapiens
gctttatccgcttgacccttac

SEQ ID NO: 9355268 - DNA, 22 bp, Homo sapiens
gctttggatgtgtgcctgaggt

SEQ ID NO: 9355269 - DNA, 22 bp, Homo sapiens
gctttgtgaattattactcaca

SEQ ID NO: 9355270 - DNA, 22 bp, Homo sapiens
gctttggtgatacttgctggct

SEQ ID NO: 9355271 - DNA, 22 bp, Homo sapiens
gctttggtcaggtgtccagccc

SEQ ID NO: 9355272 - DNA, 22 bp, Homo sapiens
gctttggtacctcctgctgatc

SEQ ID NO: 9355273 - DNA, 22 bp, Homo sapiens
gctttagaaatgagtaaattag

SEQ ID NO: 9355274 - DNA, 22 bp, Homo sapiens
gctttagaaatatcactgtgga

SEQ ID NO: 9355275 - DNA, 22 bp, Homo sapiens
gctttagaagacactctgtttt

SEQ ID NO: 9355276 - DNA, 22 bp, Homo sapiens
gctttagaaatgtaggagatac

SEQ ID NO: 9355277 - DNA, 22 bp, Homo sapiens
gctttagagaagaaaggttgct

SEQ ID NO: 9355278 - DNA, 22 bp, Homo sapiens
gctttagacataaagttcttca

SEQ ID NO: 9355279 - DNA, 22 bp, Homo sapiens
gctttagatactcccaatgtcc

SEQ ID NO: 9355280 - DNA, 22 bp, Homo sapiens
gctttagagcccagcttggtgg

SEQ ID NO: 9355281 - DNA, 22 bp, Homo sapiens
gctttagatagatttagtcttt

SEQ ID NO: 9355282 - DNA, 22 bp, Homo sapiens
gctttagatctgactttctgtg

SEQ ID NO: 9355283 - DNA, 22 bp, Homo sapiens
gctttatccgcttgacccttac

SEQ ID NO: 9355284 - DNA, 21 bp, Homo sapiens
gctttagatttagtgagccag

SEQ ID NO: 9355285 - DNA, 22 bp, Homo sapiens
gcttttttgggatgcctgcctt

SEQ ID NO: 9355286 - DNA, 22 bp, Homo sapiens
gcttttttgctattgaagtggt

SEQ ID NO: 9355287 - DNA, 22 bp, Homo sapiens
gcttttttaggtaagacccagg

SEQ ID NO: 9355288 - DNA, 22 bp, Homo sapiens
gcttttcttcagcagcctgatg

SEQ ID NO: 9355289 - DNA, 18 bp, Homo sapiens
gctttttagtgcatcttc

SEQ ID NO: 9355290 - DNA, 22 bp, Homo sapiens
gcttttctataagaactttcaa

SEQ ID NO: 9355291 - DNA, 22 bp, Homo sapiens
gcttttctagctagaacatccg

SEQ ID NO: 9355292 - DNA, 22 bp, Homo sapiens
gcttttctccttagtgtccctg

SEQ ID NO: 9355293 - DNA, 22 bp, Homo sapiens
gcttttctccttagtgtccctg

SEQ ID NO: 9355294 - DNA, 19 bp, Homo sapiens
gcttttctccttcaagcca

SEQ ID NO: 9355295 - DNA, 22 bp, Homo sapiens
gcttttatttcttcacaaaagt

SEQ ID NO: 9355296 - DNA, 22 bp, Homo sapiens
gcttttatttcttcacaaaagt

SEQ ID NO: 9355297 - DNA, 22 bp, Homo sapiens
gcttttatttcttcacaaaagt

SEQ ID NO: 9355298 - DNA, 22 bp, Homo sapiens
gcttttatgcacataagggtca

SEQ ID NO: 9355299 - DNA, 19 bp, Homo sapiens
gcttttattgctcaggtgc

SEQ ID NO: 9355300 - DNA, 22 bp, Homo sapiens
gcttttattgtctttacgacga

SEQ ID NO: 9355301 - DNA, 22 bp, Homo sapiens
gctggtccattggcactgctca

SEQ ID NO: 9355302 - DNA, 22 bp, Homo sapiens
gctggccaggaagagtctcaga

SEQ ID NO: 9355303 - DNA, 22 bp, Homo sapiens
gctggtcagagagaaaggaggc

SEQ ID NO: 9355304 - DNA, 22 bp, Homo sapiens
gctggccaggaagagtctcaga

SEQ ID NO: 9355305 - DNA, 22 bp, Homo sapiens
gctggccacagatccccaggga

SEQ ID NO: 9355306 - DNA, 22 bp, Homo sapiens
gctggccacactgctgatggag

SEQ ID NO: 9355307 - DNA, 22 bp, Homo sapiens
gctggccacagatccccaggga

SEQ ID NO: 9355308 - DNA, 22 bp, Homo sapiens
gctggccacagatccccaggga

SEQ ID NO: 9355309 - DNA, 22 bp, Homo sapiens
gctggccacactgctgatggag

SEQ ID NO: 9355310 - DNA, 22 bp, Homo sapiens
gctggccacactgctgatggag

SEQ ID NO: 9355311 - DNA, 22 bp, Homo sapiens
gctggccaggaagagtctcaga

SEQ ID NO: 9355312 - DNA, 22 bp, Homo sapiens
gctggccagccctcttcctcca

SEQ ID NO: 9355313 - DNA, 22 bp, Homo sapiens
gctggccaggaagagtctcaga

SEQ ID NO: 9355314 - DNA, 19 bp, Homo sapiens
gctggccacgccccagttg

SEQ ID NO: 9355315 - DNA, 22 bp, Homo sapiens
gctggccacattgtgccgtcct

SEQ ID NO: 9355316 - DNA, 22 bp, Homo sapiens
gctggccacattgtgccgtcct

SEQ ID NO: 9355317 - DNA, 22 bp, Homo sapiens
gctgtatttaacaactggctca

SEQ ID NO: 9355318 - DNA, 22 bp, Homo sapiens
gctgtattggaacacatccatg

SEQ ID NO: 9355319 - DNA, 22 bp, Homo sapiens
gctgtattcctgcactgtatag

SEQ ID NO: 9355320 - DNA, 17 bp, Homo sapiens
gctgtagtttgataaga

SEQ ID NO: 9355321 - DNA, 22 bp, Homo sapiens
gctgtagtgaatggccgcgttc

SEQ ID NO: 9355322 - DNA, 22 bp, Homo sapiens
gctgtagggctgagctggaccg

SEQ ID NO: 9355323 - DNA, 22 bp, Homo sapiens
gctgtcagaaggtgaagggtaa

SEQ ID NO: 9355324 - DNA, 22 bp, Homo sapiens
gctgtccaggagtgcagagatt

SEQ ID NO: 9355325 - DNA, 22 bp, Homo sapiens
gctgtcatagagtgggtgggcc

SEQ ID NO: 9355326 - DNA, 22 bp, Homo sapiens
gctgtccacggggttggtagag

SEQ ID NO: 9355327 - DNA, 22 bp, Homo sapiens
gctgtccagagcatgggagcaa

SEQ ID NO: 9355328 - DNA, 22 bp, Homo sapiens
gctgtcccgaacccctggtaat

SEQ ID NO: 9355329 - DNA, 23 bp, Homo sapiens
gctgtccccatgctccatccctg

SEQ ID NO: 9355330 - DNA, 22 bp, Homo sapiens
gctgtccatgtctggcctcagt

SEQ ID NO: 9355331 - DNA, 20 bp, Homo sapiens
gctgtcccaggccaaagggc

SEQ ID NO: 9355332 - DNA, 20 bp, Homo sapiens
gctgtcccaggccaaagggc

SEQ ID NO: 9355333 - DNA, 22 bp, Homo sapiens
gctgtcccgctgacttccagct

SEQ ID NO: 9355334 - DNA, 22 bp, Homo sapiens
gctgtcccgctgacttccagct

SEQ ID NO: 9355335 - DNA, 22 bp, Homo sapiens
gctgtgtgacctgggcaagtct

SEQ ID NO: 9355336 - DNA, 19 bp, Homo sapiens
gctgtgtgaccttgggcaa

SEQ ID NO: 9355337 - DNA, 22 bp, Homo sapiens
gctgtgtgctcacgtagtggaa

SEQ ID NO: 9355338 - DNA, 22 bp, Homo sapiens
gctgtgtgccaggggaaggctg

SEQ ID NO: 9355339 - DNA, 22 bp, Homo sapiens
gctgtgtgccaggggaaggctg

SEQ ID NO: 9355340 - DNA, 22 bp, Homo sapiens
gctgtctgggaggcctccactt

SEQ ID NO: 9355341 - DNA, 22 bp, Homo sapiens
gctgtctgggatgtcactgctg

SEQ ID NO: 9355342 - DNA, 22 bp, Homo sapiens
gctgtctgctgtgcactgagca

SEQ ID NO: 9355343 - DNA, 22 bp, Homo sapiens
gctgtctgggttgagggccctg

SEQ ID NO: 9355344 - DNA, 22 bp, Homo sapiens
gctgtctgtggtgtcagctgac

SEQ ID NO: 9355345 - DNA, 22 bp, Homo sapiens
ggagccagggaagctgcttcct

SEQ ID NO: 9355346 - DNA, 22 bp, Homo sapiens
ggagccaggggaccttcacaga

SEQ ID NO: 9355347 - DNA, 22 bp, Homo sapiens
ggagccagtatttagtggtctt

SEQ ID NO: 9355348 - DNA, 22 bp, Homo sapiens
ggagaagcagcttcttgatgaa

SEQ ID NO: 9355349 - DNA, 22 bp, Homo sapiens
ggagaagcagcttcttgatgaa

SEQ ID NO: 9355350 - DNA, 22 bp, Homo sapiens
ggagaagattggaattaagcac

SEQ ID NO: 9355351 - DNA, 17 bp, Homo sapiens
ggagccaggagcccacc

SEQ ID NO: 9355352 - DNA, 22 bp, Homo sapiens
ggagccaggcaatctgtacttt

SEQ ID NO: 9355353 - DNA, 22 bp, Homo sapiens
ggagccaggcaatctgtacttt

SEQ ID NO: 9355354 - DNA, 22 bp, Homo sapiens
ggagaagaggagctggaagcct

SEQ ID NO: 9355355 - DNA, 22 bp, Homo sapiens
ggagaagaggagctggaagcct

SEQ ID NO: 9355356 - DNA, 22 bp, Homo sapiens
ggagaagaggagctggaagcct

SEQ ID NO: 9355357 - DNA, 22 bp, Homo sapiens
ggagaagaggagctggaagcct

SEQ ID NO: 9355358 - DNA, 22 bp, Homo sapiens
ggagaaagtacagcaggcaaca

SEQ ID NO: 9355359 - DNA, 22 bp, Homo sapiens
ggagaaagtacagcaggcaaca

SEQ ID NO: 9355360 - DNA, 22 bp, Homo sapiens
ggagaaagggactgatctgctc

SEQ ID NO: 9355361 - DNA, 22 bp, Homo sapiens
ggagaacatatctcccacattg

SEQ ID NO: 9355362 - DNA, 18 bp, Homo sapiens
ggagccagtctgtctctg

SEQ ID NO: 9355363 - DNA, 18 bp, Homo sapiens
ggagcccacggcgtccca

SEQ ID NO: 9355364 - DNA, 22 bp, Homo sapiens
ggagcctggagtttctgatggg

SEQ ID NO: 9355365 - DNA, 22 bp, Homo sapiens
ggagcctggcaatgctgcgtcc

SEQ ID NO: 9355366 - DNA, 22 bp, Homo sapiens
ggagccctcaccggcgagtgcc

SEQ ID NO: 9355367 - DNA, 22 bp, Homo sapiens
ggagccctcaccggcgagtgcc

SEQ ID NO: 9355368 - DNA, 22 bp, Homo sapiens
ggagcctggcccggcccttggc

SEQ ID NO: 9355369 - DNA, 23 bp, Homo sapiens
ggagcctggcatatgagacgcat

SEQ ID NO: 9355370 - DNA, 19 bp, Homo sapiens
ggagcctggcaggggcgtg

SEQ ID NO: 9355371 - DNA, 22 bp, Homo sapiens
ggagctgtgggacgctgtccca

SEQ ID NO: 9355372 - DNA, 22 bp, Homo sapiens
ggagctggggttggcatcttcc

SEQ ID NO: 9355373 - DNA, 22 bp, Homo sapiens
ggagctggtcagccttgagcat

SEQ ID NO: 9355374 - DNA, 22 bp, Homo sapiens
ggagctggggttggcatcttcc

SEQ ID NO: 9355375 - DNA, 22 bp, Homo sapiens
ggaggaggggtgactgaatgct

SEQ ID NO: 9355376 - DNA, 22 bp, Homo sapiens
ggaggaggggtgactgaatgct

SEQ ID NO: 9355377 - DNA, 22 bp, Homo sapiens
ggaggaggggtgactgaatgct

SEQ ID NO: 9355378 - DNA, 22 bp, Homo sapiens
ggaggaggggtgactgaatgct

SEQ ID NO: 9355379 - DNA, 22 bp, Homo sapiens
ggaggaggggcgctttgtctat

SEQ ID NO: 9355380 - DNA, 22 bp, Homo sapiens
ggaggaggggcgctttgtctat

SEQ ID NO: 9355381 - DNA, 21 bp, Homo sapiens
ggaggaaaaaggaatgacttg

SEQ ID NO: 9355382 - DNA, 21 bp, Homo sapiens
ggaggaaaaaggaatgacttg

SEQ ID NO: 9355383 - DNA, 22 bp, Homo sapiens
ggaggaggcggcagaagttcct

SEQ ID NO: 9355384 - DNA, 19 bp, Homo sapiens
ggagcttggtggctgtggc

SEQ ID NO: 9355385 - DNA, 19 bp, Homo sapiens
ggagcttggtggctgtggc

SEQ ID NO: 9355386 - DNA, 19 bp, Homo sapiens
ggagcttggtggctgtggc

SEQ ID NO: 9355387 - DNA, 19 bp, Homo sapiens
ggagcttggtggctgtggc

SEQ ID NO: 9355388 - DNA, 21 bp, Homo sapiens
ggagctggggagctggcccca

SEQ ID NO: 9355389 - DNA, 21 bp, Homo sapiens
ggagctggggagctggcccca

SEQ ID NO: 9355390 - DNA, 18 bp, Homo sapiens
ggagctgggcctggttcc

SEQ ID NO: 9355391 - DNA, 22 bp, Homo sapiens
ggagctgggaattggatcatct

SEQ ID NO: 9355392 - DNA, 22 bp, Homo sapiens
ggagctgggaattggatcatct

SEQ ID NO: 9355393 - DNA, 22 bp, Homo sapiens
ggagctgggaattggatcatct

SEQ ID NO: 9355394 - DNA, 22 bp, Homo sapiens
ggagcctggtatagtgttgcat

SEQ ID NO: 9355395 - DNA, 22 bp, Homo sapiens
ggagcctggtcaggttggctcc

SEQ ID NO: 9355396 - DNA, 22 bp, Homo sapiens
ggagcctggtatagtgttgcat

SEQ ID NO: 9355397 - DNA, 21 bp, Homo sapiens
ggagctgcaggagccgaaggc

SEQ ID NO: 9355398 - DNA, 21 bp, Homo sapiens
ggagctgcaggagccgaaggc

SEQ ID NO: 9355399 - DNA, 22 bp, Homo sapiens
ggagctgcatttagggagcctt

SEQ ID NO: 9355400 - DNA, 20 bp, Homo sapiens
ggagctgccctgggctggag

SEQ ID NO: 9355401 - DNA, 22 bp, Homo sapiens
ggagctggctacagagaactcc

SEQ ID NO: 9355402 - DNA, 22 bp, Homo sapiens
ggacttgctaaggtggctgaac

SEQ ID NO: 9355403 - DNA, 22 bp, Homo sapiens
ggacttgctaaggtggctgaac

SEQ ID NO: 9355404 - DNA, 22 bp, Homo sapiens
ggactgggaatcagggagatgc

SEQ ID NO: 9355405 - DNA, 22 bp, Homo sapiens
ggactgggtcactaagatagta

SEQ ID NO: 9355406 - DNA, 22 bp, Homo sapiens
ggactgggaatcagggagatgc

SEQ ID NO: 9355407 - DNA, 22 bp, Homo sapiens
ggactggccggcgctgaggccc

SEQ ID NO: 9355408 - DNA, 23 bp, Homo sapiens
ggactgcaatggcgccgtctcag

SEQ ID NO: 9355409 - DNA, 22 bp, Homo sapiens
ggagaaagctgtagtggaatgt

SEQ ID NO: 9355410 - DNA, 22 bp, Homo sapiens
ggacttgggctggtctgtttct

SEQ ID NO: 9355411 - DNA, 17 bp, Homo sapiens
ggactttaggttcttcc

SEQ ID NO: 9355412 - DNA, 22 bp, Homo sapiens
ggacagggctcttggcactcct

SEQ ID NO: 9355413 - DNA, 23 bp, Homo sapiens
ggacagggccctgccctatggcc

SEQ ID NO: 9355414 - DNA, 23 bp, Homo sapiens
ggacagggccctgccctatggcc

SEQ ID NO: 9355415 - DNA, 22 bp, Homo sapiens
ggacagggatcattatctgagc

SEQ ID NO: 9355416 - DNA, 23 bp, Homo sapiens
ggacagggccctgccctatggcc

SEQ ID NO: 9355417 - DNA, 22 bp, Homo sapiens
ggacaggggcgtggggattgtt

SEQ ID NO: 9355418 - DNA, 22 bp, Homo sapiens
ggacaggggcgtggggattgtt

SEQ ID NO: 9355419 - DNA, 19 bp, Homo sapiens
ggacagggggagcttttat

SEQ ID NO: 9355420 - DNA, 22 bp, Homo sapiens
ggacagggctcttggcactcct

SEQ ID NO: 9355421 - DNA, 22 bp, Homo sapiens
ggacagggctcttggcactcct

SEQ ID NO: 9355422 - DNA, 22 bp, Homo sapiens
ggacaggccgcctcggtggggg

SEQ ID NO: 9355423 - DNA, 22 bp, Homo sapiens
ggacaggcccggggagcctgga

SEQ ID NO: 9355424 - DNA, 22 bp, Homo sapiens
ggacaggctgcatctgagcatg

SEQ ID NO: 9355425 - DNA, 22 bp, Homo sapiens
ggacaggcgcagggccaaggaa

SEQ ID NO: 9355426 - DNA, 19 bp, Homo sapiens
ggaaggcagaggggctgtg

SEQ ID NO: 9355427 - DNA, 18 bp, Homo sapiens
ggaaggagtggaccccag

SEQ ID NO: 9355428 - DNA, 22 bp, Homo sapiens
ggaaggaggggcaaagcagttc

SEQ ID NO: 9355429 - DNA, 22 bp, Homo sapiens
ggaaggaggggcaaagcagttc

SEQ ID NO: 9355430 - DNA, 22 bp, Homo sapiens
ggaaggaggggcaaagcagttc

SEQ ID NO: 9355431 - DNA, 18 bp, Homo sapiens
ggaaggagtggaccccag

SEQ ID NO: 9355432 - DNA, 22 bp, Homo sapiens
ggaaggaggatgctctggcctt

SEQ ID NO: 9355433 - DNA, 22 bp, Homo sapiens
ggaaggaggatgctctggcctt

SEQ ID NO: 9355434 - DNA, 22 bp, Homo sapiens
ggaaggaggatgctctggcctt

SEQ ID NO: 9355435 - DNA, 22 bp, Homo sapiens
ggaaggaggggcaaagcagttc

SEQ ID NO: 9355436 - DNA, 22 bp, Homo sapiens
ggaaggaggggcaaagcagttc

SEQ ID NO: 9355437 - DNA, 22 bp, Homo sapiens
ggaaggaggggcaaagcagttc

SEQ ID NO: 9355438 - DNA, 19 bp, Homo sapiens
ggaaggagagaaatgcatg

SEQ ID NO: 9355439 - DNA, 22 bp, Homo sapiens
ggaaggagcatttgccagttta

SEQ ID NO: 9355440 - DNA, 22 bp, Homo sapiens
ggaaggagcatttgccagttta

SEQ ID NO: 9355441 - DNA, 22 bp, Homo sapiens
ggacaggataagagacactgcc

SEQ ID NO: 9355442 - DNA, 22 bp, Homo sapiens
ggacagagggttgacagagtat

SEQ ID NO: 9355443 - DNA, 18 bp, Homo sapiens
ggacaggagacatgggtg

SEQ ID NO: 9355444 - DNA, 18 bp, Homo sapiens
ggacaggagacatgggtg

SEQ ID NO: 9355445 - DNA, 22 bp, Homo sapiens
ggacaggagtgaggcgggttcc

SEQ ID NO: 9355446 - DNA, 22 bp, Homo sapiens
ggacagagggttgacagagtat

SEQ ID NO: 9355447 - DNA, 22 bp, Homo sapiens
ggacagagggttgacagagtat

SEQ ID NO: 9355448 - DNA, 22 bp, Homo sapiens
ggaagggaaaattcattcggct

SEQ ID NO: 9355449 - DNA, 22 bp, Homo sapiens
ggaaggcagtgaaggggctgat

SEQ ID NO: 9355450 - DNA, 19 bp, Homo sapiens
ggaaggccacggcaggctt

SEQ ID NO: 9355451 - DNA, 22 bp, Homo sapiens
ggaaggcagaggtgtcgtgggg

SEQ ID NO: 9355452 - DNA, 22 bp, Homo sapiens
ggaaggctttgtagaagtgcca

SEQ ID NO: 9355453 - DNA, 22 bp, Homo sapiens
ggaaggctttctgttctgtgac

SEQ ID NO: 9355454 - DNA, 22 bp, Homo sapiens
gctccccaggctggtcccctcg

SEQ ID NO: 9355455 - DNA, 22 bp, Homo sapiens
gctccccattgatctgcaggct

SEQ ID NO: 9355456 - DNA, 22 bp, Homo sapiens
gctccccattgatctgcaggct

SEQ ID NO: 9355457 - DNA, 22 bp, Homo sapiens
gctccccattgatctgcaggct

SEQ ID NO: 9355458 - DNA, 22 bp, Homo sapiens
gctccccattgatctgcaggct

SEQ ID NO: 9355459 - DNA, 22 bp, Homo sapiens
gctccccattgatctgcaggct

SEQ ID NO: 9355460 - DNA, 22 bp, Homo sapiens
gctccccttggtcctcctggga

SEQ ID NO: 9355461 - DNA, 22 bp, Homo sapiens
gctccctccatgaggcagaccg

SEQ ID NO: 9355462 - DNA, 22 bp, Homo sapiens
gctccctccatgaggcagaccg

SEQ ID NO: 9355463 - DNA, 22 bp, Homo sapiens
gctccctcccaccagcctgcag

SEQ ID NO: 9355464 - DNA, 22 bp, Homo sapiens
gctccctcatctgtgctgtttt

SEQ ID NO: 9355465 - DNA, 22 bp, Homo sapiens
gctccctcatctgtgctgtttt

SEQ ID NO: 9355466 - DNA, 22 bp, Homo sapiens
gctcccagctggagcctcaaca

SEQ ID NO: 9355467 - DNA, 20 bp, Homo sapiens
gctcccagcctgcagtcccc

SEQ ID NO: 9355468 - DNA, 20 bp, Homo sapiens
gctcccagcctgcagtcccc

SEQ ID NO: 9355469 - DNA, 22 bp, Homo sapiens
gctcccaggatgaggagccagg

SEQ ID NO: 9355470 - DNA, 22 bp, Homo sapiens
gctcccagcattgcttcccagg

SEQ ID NO: 9355471 - DNA, 20 bp, Homo sapiens
gctcccagcctgcagtcccc

SEQ ID NO: 9355472 - DNA, 22 bp, Homo sapiens
gctcccagcattgcttcccagg

SEQ ID NO: 9355473 - DNA, 22 bp, Homo sapiens
gctctccaggtctcatgcactg

SEQ ID NO: 9355474 - DNA, 22 bp, Homo sapiens
gctctcccgcagcctggtgggc

SEQ ID NO: 9355475 - DNA, 22 bp, Homo sapiens
gctctccaggggctcccaggat

SEQ ID NO: 9355476 - DNA, 22 bp, Homo sapiens
gctccctctgctcaggcacttg

SEQ ID NO: 9355477 - DNA, 22 bp, Homo sapiens
gctctctgaggtgctggcagag

SEQ ID NO: 9355478 - DNA, 22 bp, Homo sapiens
gctctctgcaagtcagcagcct

SEQ ID NO: 9355479 - DNA, 22 bp, Homo sapiens
gctctctgcaagtcagcagcct

SEQ ID NO: 9355480 - DNA, 21 bp, Homo sapiens
gctctctgcatggtggctcag

SEQ ID NO: 9355481 - DNA, 22 bp, Homo sapiens
gctctctgcagcctccttggag

SEQ ID NO: 9355482 - DNA, 22 bp, Homo sapiens
gctctctgcagcctccttggag

SEQ ID NO: 9355483 - DNA, 22 bp, Homo sapiens
gctctctcttggggattcagca

SEQ ID NO: 9355484 - DNA, 22 bp, Homo sapiens
gctctctcttggggattcagca

SEQ ID NO: 9355485 - DNA, 22 bp, Homo sapiens
gctctctcgtgaacaggtggtt

SEQ ID NO: 9355486 - DNA, 22 bp, Homo sapiens
gctctctcgtgaacaggtggtt

SEQ ID NO: 9355487 - DNA, 22 bp, Homo sapiens
gctctctccctaggcaagtgag

SEQ ID NO: 9355488 - DNA, 22 bp, Homo sapiens
gctctctcgtgaacaggtggtt

SEQ ID NO: 9355489 - DNA, 22 bp, Homo sapiens
gctctctcgtgaacaggtggtt

SEQ ID NO: 9355490 - DNA, 22 bp, Homo sapiens
gctctctccctaggcaagtgag

SEQ ID NO: 9355491 - DNA, 22 bp, Homo sapiens
gctctgtcaacagctagctgtg

SEQ ID NO: 9355492 - DNA, 22 bp, Homo sapiens
gctctgtatgtagttcttgctt

SEQ ID NO: 9355493 - DNA, 22 bp, Homo sapiens
gctctgtgagtattggccctgg

SEQ ID NO: 9355494 - DNA, 19 bp, Homo sapiens
gctctgtgatgctgagggg

SEQ ID NO: 9355495 - DNA, 22 bp, Homo sapiens
gctctgtgagccacttgatgta

SEQ ID NO: 9355496 - DNA, 22 bp, Homo sapiens
gctctgtcttcagcacacagta

SEQ ID NO: 9355497 - DNA, 21 bp, Homo sapiens
gctctgtgaaatttcaccagg

SEQ ID NO: 9355498 - DNA, 22 bp, Homo sapiens
gctctgtggcaggaggtcttgt

SEQ ID NO: 9355499 - DNA, 22 bp, Homo sapiens
gctctgtgcccctgccgtggac

SEQ ID NO: 9355500 - DNA, 22 bp, Homo sapiens
gctctgtgctagaactaagaat

SEQ ID NO: 9355501 - DNA, 19 bp, Homo sapiens
gctctgtgatgctgagggg

SEQ ID NO: 9355502 - DNA, 19 bp, Homo sapiens
gctctgtgatgctgagggg

SEQ ID NO: 9355503 - DNA, 22 bp, Homo sapiens
gctctgtgccacatgcagtgtt

SEQ ID NO: 9355504 - DNA, 22 bp, Homo sapiens
gctctgggtagccactgcctgg

SEQ ID NO: 9355505 - DNA, 22 bp, Homo sapiens
gctctggtttcctgttcactca

SEQ ID NO: 9355506 - DNA, 22 bp, Homo sapiens
gctctggttttagcctttcagg

SEQ ID NO: 9355507 - DNA, 22 bp, Homo sapiens
gctctggttctcttagagtagt

SEQ ID NO: 9355508 - DNA, 22 bp, Homo sapiens
gctctgtagtatttagtaaata

SEQ ID NO: 9355509 - DNA, 21 bp, Homo sapiens
gctctgtacgttggtgccttc

SEQ ID NO: 9355510 - DNA, 22 bp, Homo sapiens
gctctctgttattaagatcttt

SEQ ID NO: 9355511 - DNA, 22 bp, Homo sapiens
gctctcttgacagcttgctgtt

SEQ ID NO: 9355512 - DNA, 22 bp, Homo sapiens
gctctctgtcgttatgcttcat

SEQ ID NO: 9355513 - DNA, 22 bp, Homo sapiens
gctctctgtcgttatgcttcat

SEQ ID NO: 9355514 - DNA, 22 bp, Homo sapiens
gctctctgtcgttatgcttcat

SEQ ID NO: 9355515 - DNA, 22 bp, Homo sapiens
gctctcttgacagcttgctgtt

SEQ ID NO: 9355516 - DNA, 22 bp, Homo sapiens
gctctggggttggaaagtgatc

SEQ ID NO: 9355517 - DNA, 22 bp, Homo sapiens
gctctcttggtggctgtcctgg

SEQ ID NO: 9355518 - DNA, 22 bp, Homo sapiens
gctctctggttccagtcaggaa

SEQ ID NO: 9355519 - DNA, 22 bp, Homo sapiens
gctctctgggtgtgtctagata

SEQ ID NO: 9355520 - DNA, 22 bp, Homo sapiens
gctctctggctagtccatcggg

SEQ ID NO: 9355521 - DNA, 22 bp, Homo sapiens
gctctctgccatatgaggatac

SEQ ID NO: 9355522 - DNA, 22 bp, Homo sapiens
gctctctgccatatgaggatac

SEQ ID NO: 9355523 - DNA, 22 bp, Homo sapiens
gctctctgcctttctcaatgac

SEQ ID NO: 9355524 - DNA, 22 bp, Homo sapiens
gctctctgcctttctcaatgac

SEQ ID NO: 9355525 - DNA, 22 bp, Homo sapiens
gctctctggaaggtatcattat

SEQ ID NO: 9355526 - DNA, 22 bp, Homo sapiens
gctcagtgtggtcctcagatgt

SEQ ID NO: 9355527 - DNA, 22 bp, Homo sapiens
gctcagtgtgcacgagtactct

SEQ ID NO: 9355528 - DNA, 22 bp, Homo sapiens
gctcagttatccgtgtgtgact

SEQ ID NO: 9355529 - DNA, 22 bp, Homo sapiens
gctcagtttttagtttgtgaga

SEQ ID NO: 9355530 - DNA, 22 bp, Homo sapiens
gctcccagcaattgaggcagcc

SEQ ID NO: 9355531 - DNA, 22 bp, Homo sapiens
gctcccagcaattgaggcagcc

SEQ ID NO: 9355532 - DNA, 22 bp, Homo sapiens
gctcccagatttcagccttgtg

SEQ ID NO: 9355533 - DNA, 22 bp, Homo sapiens
gctcccagcaattgaggcagcc

SEQ ID NO: 9355534 - DNA, 22 bp, Homo sapiens
gctcatccagcaagccagggcc

SEQ ID NO: 9355535 - DNA, 18 bp, Homo sapiens
gctcatcccacaatcagg

SEQ ID NO: 9355536 - DNA, 22 bp, Homo sapiens
gctcccagactgaccagaggtg

SEQ ID NO: 9355537 - DNA, 22 bp, Homo sapiens
gctcccagactgaccagaggtg

SEQ ID NO: 9355538 - DNA, 22 bp, Homo sapiens
gctcccagatttcagccttgtg

SEQ ID NO: 9355539 - DNA, 22 bp, Homo sapiens
gctcagggagagagggcagccg

SEQ ID NO: 9355540 - DNA, 20 bp, Homo sapiens
gctcagggaattcaggaagc

SEQ ID NO: 9355541 - DNA, 21 bp, Homo sapiens
gctatacagaatggccagagg

SEQ ID NO: 9355542 - DNA, 22 bp, Homo sapiens
gctcagggaaggccacgtgaga

SEQ ID NO: 9355543 - DNA, 22 bp, Homo sapiens
gctaggtgcagcagacagctta

SEQ ID NO: 9355544 - DNA, 23 bp, Homo sapiens
gctaggtgcttccacacgtgctg

SEQ ID NO: 9355545 - DNA, 22 bp, Homo sapiens
gctaggtgcagcagacagctta

SEQ ID NO: 9355546 - DNA, 22 bp, Homo sapiens
gctaggttggggaagttctcct

SEQ ID NO: 9355547 - DNA, 22 bp, Homo sapiens
gctaggttggggaagttctcct

SEQ ID NO: 9355548 - DNA, 22 bp, Homo sapiens
gctaggttggggaagttctcct

SEQ ID NO: 9355549 - DNA, 22 bp, Homo sapiens
gctaggtgcagcagacagctta

SEQ ID NO: 9355550 - DNA, 22 bp, Homo sapiens
gctagtgcagggaaatctttgg

SEQ ID NO: 9355551 - DNA, 22 bp, Homo sapiens
gctagtttcttgaatactctaa

SEQ ID NO: 9355552 - DNA, 22 bp, Homo sapiens
gctatacacatttcttggtagt

SEQ ID NO: 9355553 - DNA, 22 bp, Homo sapiens
gctagtttcttgttggcagaga

SEQ ID NO: 9355554 - DNA, 22 bp, Homo sapiens
gctatacaagtgtagaatagag

SEQ ID NO: 9355555 - DNA, 22 bp, Homo sapiens
gctcagggcgcgagggacgtgg

SEQ ID NO: 9355556 - DNA, 22 bp, Homo sapiens
gctcagggccatggaccagcag

SEQ ID NO: 9355557 - DNA, 22 bp, Homo sapiens
gctcagggcctggctgcggact

SEQ ID NO: 9355558 - DNA, 22 bp, Homo sapiens
gctcagggagagagggcagccg

SEQ ID NO: 9355559 - DNA, 22 bp, Homo sapiens
gctcagggagagagggcagccg

SEQ ID NO: 9355560 - DNA, 22 bp, Homo sapiens
gctcagggagagagggcagccg

SEQ ID NO: 9355561 - DNA, 22 bp, Homo sapiens
gctcagggccatggaccagcag

SEQ ID NO: 9355562 - DNA, 22 bp, Homo sapiens
gctcagggccatggaccagcag

SEQ ID NO: 9355563 - DNA, 22 bp, Homo sapiens
gctagcctcccttttccatggt

SEQ ID NO: 9355564 - DNA, 22 bp, Homo sapiens
gctagcctgcagtggctatggt

SEQ ID NO: 9355565 - DNA, 22 bp, Homo sapiens
gctaggagattgagctctgaag

SEQ ID NO: 9355566 - DNA, 17 bp, Homo sapiens
gctaggagagggaggag

SEQ ID NO: 9355567 - DNA, 22 bp, Homo sapiens
gctagctgggtttcactgtgga

SEQ ID NO: 9355568 - DNA, 22 bp, Homo sapiens
gctaggaacatttatatacaaa

SEQ ID NO: 9355569 - DNA, 22 bp, Homo sapiens
gctaggaagaagggtgcttgaa

SEQ ID NO: 9355570 - DNA, 22 bp, Homo sapiens
gctaggctcggaagcagcaggg

SEQ ID NO: 9355571 - DNA, 22 bp, Homo sapiens
gctaggctcttccatcagggca

SEQ ID NO: 9355572 - DNA, 22 bp, Homo sapiens
gctaggctgtgtttcagaccct

SEQ ID NO: 9355573 - DNA, 20 bp, Homo sapiens
gctaggctggtgattgtcaa

SEQ ID NO: 9355574 - DNA, 20 bp, Homo sapiens
gctaggctgtgtcctgccca

SEQ ID NO: 9355575 - DNA, 22 bp, Homo sapiens
gctaggctcggaagcagcaggg

SEQ ID NO: 9355576 - DNA, 22 bp, Homo sapiens
gctaggctgaatatggtgctta

SEQ ID NO: 9355577 - DNA, 22 bp, Homo sapiens
gctagggtggctaataggagag

SEQ ID NO: 9355578 - DNA, 22 bp, Homo sapiens
gctagggctcttgtccttgctc

SEQ ID NO: 9355579 - DNA, 22 bp, Homo sapiens
gctagggcgggagtgctggaga

SEQ ID NO: 9355580 - DNA, 18 bp, Homo sapiens
gctagggcatgcatggtg

SEQ ID NO: 9355581 - DNA, 18 bp, Homo sapiens
gctagggcatgcatggtg

SEQ ID NO: 9355582 - DNA, 22 bp, Homo sapiens
gctagggactagggaaggagca

SEQ ID NO: 9355583 - DNA, 22 bp, Homo sapiens
gctagggagacttgtgtcatca

SEQ ID NO: 9355584 - DNA, 22 bp, Homo sapiens
gctagggaacctcttctgagga

SEQ ID NO: 9355585 - DNA, 22 bp, Homo sapiens
gcctggcactgggctcctggcc

SEQ ID NO: 9355586 - DNA, 22 bp, Homo sapiens
gcctggcactgggctcctggcc

SEQ ID NO: 9355587 - DNA, 22 bp, Homo sapiens
gcctggcactcactgaagaggc

SEQ ID NO: 9355588 - DNA, 22 bp, Homo sapiens
gcctggcagattgacatagcca

SEQ ID NO: 9355589 - DNA, 22 bp, Homo sapiens
gcctggcagattgacatagcca

SEQ ID NO: 9355590 - DNA, 22 bp, Homo sapiens
gcctggcagattgacatagcca

SEQ ID NO: 9355591 - DNA, 22 bp, Homo sapiens
gcctggcactcactgaagaggc

SEQ ID NO: 9355592 - DNA, 22 bp, Homo sapiens
gcctggcactcaatcatctgct

SEQ ID NO: 9355593 - DNA, 22 bp, Homo sapiens
gcctggcactcaatcatctgct

SEQ ID NO: 9355594 - DNA, 22 bp, Homo sapiens
gcctggcacgggctcggcccac

SEQ ID NO: 9355595 - DNA, 22 bp, Homo sapiens
gcctggcacgggctcggcccac

SEQ ID NO: 9355596 - DNA, 22 bp, Homo sapiens
gctactttgcagctagctagga

SEQ ID NO: 9355597 - DNA, 22 bp, Homo sapiens
gcctggcaggcctcatgagggg

SEQ ID NO: 9355598 - DNA, 22 bp, Homo sapiens
gcctggcaggcctcatgagggg

SEQ ID NO: 9355599 - DNA, 22 bp, Homo sapiens
gcctggcaggcctcatgagggg

SEQ ID NO: 9355600 - DNA, 22 bp, Homo sapiens
gcctggcaggaatctcagtgct

SEQ ID NO: 9355601 - DNA, 22 bp, Homo sapiens
gcctggcaggaatctcagtgct

SEQ ID NO: 9355602 - DNA, 22 bp, Homo sapiens
gcctggcagcctccaaccttca

SEQ ID NO: 9355603 - DNA, 22 bp, Homo sapiens
gcctggcagcccctagacattt

SEQ ID NO: 9355604 - DNA, 22 bp, Homo sapiens
gcctggcagcccctagacattt

SEQ ID NO: 9355605 - DNA, 22 bp, Homo sapiens
gcctggcagcctccaaccttca

SEQ ID NO: 9355606 - DNA, 22 bp, Homo sapiens
gcctggagtggtcctgctgccc

SEQ ID NO: 9355607 - DNA, 22 bp, Homo sapiens
gcctggagtggtcctgctgccc

SEQ ID NO: 9355608 - DNA, 22 bp, Homo sapiens
gcctggagtggtcctgctgccc

SEQ ID NO: 9355609 - DNA, 16 bp, Homo sapiens
gcctggagtggcaggg

SEQ ID NO: 9355610 - DNA, 22 bp, Homo sapiens
gcctggagtggtcctgctgccc

SEQ ID NO: 9355611 - DNA, 22 bp, Homo sapiens
gcctggagtggtcctgctgccc

SEQ ID NO: 9355612 - DNA, 22 bp, Homo sapiens
gcctggagtggtcctgctgccc

SEQ ID NO: 9355613 - DNA, 22 bp, Homo sapiens
gcctggagtgttggtatttctc

SEQ ID NO: 9355614 - DNA, 20 bp, Homo sapiens
gcctggagttagttttcctt

SEQ ID NO: 9355615 - DNA, 20 bp, Homo sapiens
gcctggagttagttttcctt

SEQ ID NO: 9355616 - DNA, 22 bp, Homo sapiens
gcctggagtgttggtatttctc

SEQ ID NO: 9355617 - DNA, 22 bp, Homo sapiens
gcctggagtggtcctgctgccc

SEQ ID NO: 9355618 - DNA, 20 bp, Homo sapiens
gcctggcacccggggctggc

SEQ ID NO: 9355619 - DNA, 16 bp, Homo sapiens
gcctggcaccgtcggc

SEQ ID NO: 9355620 - DNA, 16 bp, Homo sapiens
gcctggcaccgtcggc

SEQ ID NO: 9355621 - DNA, 20 bp, Homo sapiens
gcctggcacccggggctggc

SEQ ID NO: 9355622 - DNA, 20 bp, Homo sapiens
gcctggcacccggggctggc

SEQ ID NO: 9355623 - DNA, 20 bp, Homo sapiens
gcctggcacccggggctggc

SEQ ID NO: 9355624 - DNA, 22 bp, Homo sapiens
gcctggagttcagccaagtccc

SEQ ID NO: 9355625 - DNA, 22 bp, Homo sapiens
gcctggagttcagccaagtccc

SEQ ID NO: 9355626 - DNA, 22 bp, Homo sapiens
gcctggagttcagccaagtccc

SEQ ID NO: 9355627 - DNA, 22 bp, Homo sapiens
gcctggagttcagccaagtccc

SEQ ID NO: 9355628 - DNA, 22 bp, Homo sapiens
gcctggcaccacagcctttcag

SEQ ID NO: 9355629 - DNA, 22 bp, Homo sapiens
gctgctggaacaaatcacccca

SEQ ID NO: 9355630 - DNA, 22 bp, Homo sapiens
gctgctggaacaaatcacccca

SEQ ID NO: 9355631 - DNA, 22 bp, Homo sapiens
gctgctggaacaaatcacccca

SEQ ID NO: 9355632 - DNA, 19 bp, Homo sapiens
gctgctggctctggctgga

SEQ ID NO: 9355633 - DNA, 22 bp, Homo sapiens
gctgctggcgctgggcgtccgg

SEQ ID NO: 9355634 - DNA, 22 bp, Homo sapiens
gctgctggaagcatgcgatgaa

SEQ ID NO: 9355635 - DNA, 23 bp, Homo sapiens
gctgcctctgttggtcttcagtt

SEQ ID NO: 9355636 - DNA, 22 bp, Homo sapiens
gctgcctgaaatgttgcctagc

SEQ ID NO: 9355637 - DNA, 22 bp, Homo sapiens
gctgcctctgtagctttggacc

SEQ ID NO: 9355638 - DNA, 22 bp, Homo sapiens
gctgcctctgtagctttggacc

SEQ ID NO: 9355639 - DNA, 22 bp, Homo sapiens
gctgctggggtcacatggtaag

SEQ ID NO: 9355640 - DNA, 22 bp, Homo sapiens
gctgctggggtcacatggtaag

SEQ ID NO: 9355641 - DNA, 22 bp, Homo sapiens
gctgctggggtcacatggtaag

SEQ ID NO: 9355642 - DNA, 22 bp, Homo sapiens
gctgctgggcaccccctgagct

SEQ ID NO: 9355643 - DNA, 22 bp, Homo sapiens
gctgctgggaatgaacagtgtt

SEQ ID NO: 9355644 - DNA, 22 bp, Homo sapiens
gctgctgggaatgaacagtgtt

SEQ ID NO: 9355645 - DNA, 22 bp, Homo sapiens
gctgctgggagggatcgtaaat

SEQ ID NO: 9355646 - DNA, 22 bp, Homo sapiens
gctgctgggaatgaacagtgtt

SEQ ID NO: 9355647 - DNA, 19 bp, Homo sapiens
gctgctggctctggctgga

SEQ ID NO: 9355648 - DNA, 19 bp, Homo sapiens
gctgctggctctggctgga

SEQ ID NO: 9355649 - DNA, 22 bp, Homo sapiens
gctgctggcttcctgctgtttt

SEQ ID NO: 9355650 - DNA, 22 bp, Homo sapiens
gctggaggggtaataggatggg

SEQ ID NO: 9355651 - DNA, 22 bp, Homo sapiens
gctggaggggtaataggatggg

SEQ ID NO: 9355652 - DNA, 22 bp, Homo sapiens
gctggaggggtaataggatggg

SEQ ID NO: 9355653 - DNA, 22 bp, Homo sapiens
gctggaggggtaataggatggg

SEQ ID NO: 9355654 - DNA, 22 bp, Homo sapiens
gctggaggggtaataggatggg

SEQ ID NO: 9355655 - DNA, 22 bp, Homo sapiens
gctggagctgcagcctgggcct

SEQ ID NO: 9355656 - DNA, 22 bp, Homo sapiens
gctggagcttgagaggacaggg

SEQ ID NO: 9355657 - DNA, 22 bp, Homo sapiens
gctgctgtctcatgcgatgcgg

SEQ ID NO: 9355658 - DNA, 22 bp, Homo sapiens
gctgctgtccttcaagtctgcg

SEQ ID NO: 9355659 - DNA, 22 bp, Homo sapiens
gctgctgtcagtggtggcagtt

SEQ ID NO: 9355660 - DNA, 22 bp, Homo sapiens
gctgctgtcagtggtggcagtt

SEQ ID NO: 9355661 - DNA, 22 bp, Homo sapiens
gctgctgtcagtggtggcagtt

SEQ ID NO: 9355662 - DNA, 22 bp, Homo sapiens
gctgctgtcagtctgaatctga

SEQ ID NO: 9355663 - DNA, 22 bp, Homo sapiens
gctgctgtcagtggtggcagtt

SEQ ID NO: 9355664 - DNA, 22 bp, Homo sapiens
gctgctgtccttagggagttct

SEQ ID NO: 9355665 - DNA, 22 bp, Homo sapiens
gctgctgtccttagggagttct

SEQ ID NO: 9355666 - DNA, 18 bp, Homo sapiens
gctgctggtggagggagc

SEQ ID NO: 9355667 - DNA, 22 bp, Homo sapiens
gctgctgtaatgtgttaagtca

SEQ ID NO: 9355668 - DNA, 22 bp, Homo sapiens
gctgctgtacttggggggtgct

SEQ ID NO: 9355669 - DNA, 22 bp, Homo sapiens
gctgctgtaacactaagtgcag

SEQ ID NO: 9355670 - DNA, 22 bp, Homo sapiens
gctgctgtacttggggggtgct

SEQ ID NO: 9355671 - DNA, 22 bp, Homo sapiens
gctgctgtcacccacatctgtc

SEQ ID NO: 9355672 - DNA, 22 bp, Homo sapiens
gctgctgtcacggtgctaaggg

SEQ ID NO: 9355673 - DNA, 22 bp, Homo sapiens
gctgctgtcacggtgctaaggg

SEQ ID NO: 9355674 - DNA, 22 bp, Homo sapiens
gctgctgtcagcaggccttgtt

SEQ ID NO: 9355675 - DNA, 22 bp, Homo sapiens
gctgctggtcctcagagctcat

SEQ ID NO: 9355676 - DNA, 22 bp, Homo sapiens
gctgctggtcctcagagctcat

SEQ ID NO: 9355677 - DNA, 22 bp, Homo sapiens
gctgctggggtggagaaacgct

SEQ ID NO: 9355678 - DNA, 22 bp, Homo sapiens
gctgctggtcctcagagctcat

SEQ ID NO: 9355679 - DNA, 22 bp, Homo sapiens
gctggcagtttcctcaccgagg

SEQ ID NO: 9355680 - DNA, 22 bp, Homo sapiens
gctggcagtttcctcaccgagg

SEQ ID NO: 9355681 - DNA, 22 bp, Homo sapiens
gctggcagtgtgaatgacaagc

SEQ ID NO: 9355682 - DNA, 22 bp, Homo sapiens
gctggcagtgtgaatgacaagc

SEQ ID NO: 9355683 - DNA, 22 bp, Homo sapiens
gctggccaaagtgtacctggag

SEQ ID NO: 9355684 - DNA, 22 bp, Homo sapiens
gctggccaaagtgtacctggag

SEQ ID NO: 9355685 - DNA, 22 bp, Homo sapiens
gctggcagtcccatcagctggg

SEQ ID NO: 9355686 - DNA, 22 bp, Homo sapiens
gctggcagtaaagggtttggca

SEQ ID NO: 9355687 - DNA, 22 bp, Homo sapiens
gctggcagtaaagggtttggca

SEQ ID NO: 9355688 - DNA, 22 bp, Homo sapiens
gctggcagtaaagggtttggca

SEQ ID NO: 9355689 - DNA, 22 bp, Homo sapiens
gctggcagtaaagggtttggca

SEQ ID NO: 9355690 - DNA, 22 bp, Homo sapiens
gctggcagtgtattgttagctg

SEQ ID NO: 9355691 - DNA, 22 bp, Homo sapiens
gctggcagtgtattgttagctg

SEQ ID NO: 9355692 - DNA, 22 bp, Homo sapiens
gctggcagtcccatcagctggg

SEQ ID NO: 9355693 - DNA, 22 bp, Homo sapiens
gctggcagtcccatcagctggg

SEQ ID NO: 9355694 - DNA, 22 bp, Homo sapiens
gctggcagtcccatcagctggg

SEQ ID NO: 9355695 - DNA, 22 bp, Homo sapiens
gctggcagtcccatcagctggg

SEQ ID NO: 9355696 - DNA, 22 bp, Homo sapiens
gctggcaggtccaagatagagc

SEQ ID NO: 9355697 - DNA, 22 bp, Homo sapiens
gctggcaggtaaagccccgggg

SEQ ID NO: 9355698 - DNA, 22 bp, Homo sapiens
gctggcaggtccaagatagagc

SEQ ID NO: 9355699 - DNA, 22 bp, Homo sapiens
gctggcaggtccaagatagagc

SEQ ID NO: 9355700 - DNA, 22 bp, Homo sapiens
gctggcagggttctcactgaaa

SEQ ID NO: 9355701 - DNA, 22 bp, Homo sapiens
gctggcaggtaaagccccgggg

SEQ ID NO: 9355702 - DNA, 22 bp, Homo sapiens
gctggcaggtaaagccccgggg

SEQ ID NO: 9355703 - DNA, 22 bp, Homo sapiens
gctggcaggtaaagccccgggg

SEQ ID NO: 9355704 - DNA, 22 bp, Homo sapiens
gctggcaggtaaagccccgggg

SEQ ID NO: 9355705 - DNA, 22 bp, Homo sapiens
gctggcagggttctcactgaaa

SEQ ID NO: 9355706 - DNA, 22 bp, Homo sapiens
gctggcagggtggttgagagag

SEQ ID NO: 9355707 - DNA, 22 bp, Homo sapiens
gctggcagggtggttgagagag

SEQ ID NO: 9355708 - DNA, 22 bp, Homo sapiens
gctggcagggtggttgagagag

SEQ ID NO: 9355709 - DNA, 22 bp, Homo sapiens
gctggagttggcaaggcatgta

SEQ ID NO: 9355710 - DNA, 22 bp, Homo sapiens
gctggagttaggtgggcttgaa

SEQ ID NO: 9355711 - DNA, 22 bp, Homo sapiens
gctggagttggcaaggcatgta

SEQ ID NO: 9355712 - DNA, 22 bp, Homo sapiens
gctggagttgtgggtttactaa

SEQ ID NO: 9355713 - DNA, 22 bp, Homo sapiens
gctggagttggcaaggcatgta

SEQ ID NO: 9355714 - DNA, 22 bp, Homo sapiens
gctggaggtttcacctgagttt

SEQ ID NO: 9355715 - DNA, 22 bp, Homo sapiens
gctggaggtggtgagaaaaggt

SEQ ID NO: 9355716 - DNA, 22 bp, Homo sapiens
gctggaggtagggaggtcctgt

SEQ ID NO: 9355717 - DNA, 22 bp, Homo sapiens
gctggaggtagggaggtcctgt

SEQ ID NO: 9355718 - DNA, 22 bp, Homo sapiens
gctggaggtttcacctgagttt

SEQ ID NO: 9355719 - DNA, 22 bp, Homo sapiens
gctggagtaggaccatgcttga

SEQ ID NO: 9355720 - DNA, 22 bp, Homo sapiens
gctggagtacatctttggcggc

SEQ ID NO: 9355721 - DNA, 22 bp, Homo sapiens
gctggagtaggaccatgcttga

SEQ ID NO: 9355722 - DNA, 22 bp, Homo sapiens
gctggagtccagtggcatgatc

SEQ ID NO: 9355723 - DNA, 22 bp, Homo sapiens
gctggagtccagtggcatgatc

SEQ ID NO: 9355724 - DNA, 19 bp, Homo sapiens
gctggagtcacttttgaga

SEQ ID NO: 9355725 - DNA, 22 bp, Homo sapiens
gctggagtccagtggcatgatc

SEQ ID NO: 9355726 - DNA, 22 bp, Homo sapiens
gctggagtatctggggaaggag

SEQ ID NO: 9355727 - DNA, 19 bp, Homo sapiens
gctggagtcacttttgaga

SEQ ID NO: 9355728 - DNA, 22 bp, Homo sapiens
gctggagtatctggggaaggag

SEQ ID NO: 9355729 - DNA, 22 bp, Homo sapiens
gctggagtccagtggtatgatc

SEQ ID NO: 9355730 - DNA, 22 bp, Homo sapiens
gctggagtccagtggtatgatc

SEQ ID NO: 9355731 - DNA, 22 bp, Homo sapiens
gctggagtccctgcctttcctt

SEQ ID NO: 9355732 - DNA, 16 bp, Homo sapiens
gctggagtcctggagc

SEQ ID NO: 9355733 - DNA, 16 bp, Homo sapiens
gctggagtcctggagc

SEQ ID NO: 9355734 - DNA, 22 bp, Homo sapiens
gctggagtctggaggtgtgcca

SEQ ID NO: 9355735 - DNA, 22 bp, Homo sapiens
gctggagtctacattcaagaat

SEQ ID NO: 9355736 - DNA, 22 bp, Homo sapiens
gctggagtgatgcctgtgtctc

SEQ ID NO: 9355737 - DNA, 22 bp, Homo sapiens
gctggagtgatgcctgtgtctc

SEQ ID NO: 9355738 - DNA, 22 bp, Homo sapiens
gctggagtgatgcctgtgtctc

SEQ ID NO: 9355739 - DNA, 22 bp, Homo sapiens
gctggagtgagtatgtgtagtc

SEQ ID NO: 9355740 - DNA, 22 bp, Homo sapiens
gctggagtcttgaaagtggact

SEQ ID NO: 9355741 - DNA, 22 bp, Homo sapiens
gctggagtctggaggtgtgcca

SEQ ID NO: 9355742 - DNA, 22 bp, Homo sapiens
gctggagtgagggaccatattt

SEQ ID NO: 9355743 - DNA, 22 bp, Homo sapiens
gctggagtcttgaaagtggact

SEQ ID NO: 9355744 - DNA, 22 bp, Homo sapiens
gctggagtgctggagtgcagtg

SEQ ID NO: 9355745 - DNA, 22 bp, Homo sapiens
gctggagttagaactagcctgg

SEQ ID NO: 9355746 - DNA, 22 bp, Homo sapiens
gctggagttagaactagcctgg

SEQ ID NO: 9355747 - DNA, 22 bp, Homo sapiens
gctggagttaggtgggcttgaa

SEQ ID NO: 9355748 - DNA, 22 bp, Homo sapiens
gctggagtgctgaggtgcagtg

SEQ ID NO: 9355749 - DNA, 22 bp, Homo sapiens
gctggagtgcagttgcacagtc

SEQ ID NO: 9355750 - DNA, 22 bp, Homo sapiens
gctgcctccactggctcccagt

SEQ ID NO: 9355751 - DNA, 22 bp, Homo sapiens
gctgcctccactggctcccagt

SEQ ID NO: 9355752 - DNA, 22 bp, Homo sapiens
gctgcctccactggctcccagt

SEQ ID NO: 9355753 - DNA, 22 bp, Homo sapiens
gctgcctccactggctcccagt

SEQ ID NO: 9355754 - DNA, 22 bp, Homo sapiens
gctgcctcccagagccctgcag

SEQ ID NO: 9355755 - DNA, 22 bp, Homo sapiens
gctgcctcccagagccctgcag

SEQ ID NO: 9355756 - DNA, 22 bp, Homo sapiens
gctgcctccgccggctccacag

SEQ ID NO: 9355757 - DNA, 22 bp, Homo sapiens
gctgcctcccccatggctggaa

SEQ ID NO: 9355758 - DNA, 22 bp, Homo sapiens
gctgcctccgccggctccacag

SEQ ID NO: 9355759 - DNA, 22 bp, Homo sapiens
gctgcctccgccggctccacag

SEQ ID NO: 9355760 - DNA, 22 bp, Homo sapiens
gctgcctccgccggctccacag

SEQ ID NO: 9355761 - DNA, 22 bp, Homo sapiens
gctgcctcctgaaagcgctctg

SEQ ID NO: 9355762 - DNA, 22 bp, Homo sapiens
gctgcctcctgaaagcgctctg

SEQ ID NO: 9355763 - DNA, 22 bp, Homo sapiens
gctgcctctgcacagctcactc

SEQ ID NO: 9355764 - DNA, 22 bp, Homo sapiens
gctgcctctcctgagttgacag

SEQ ID NO: 9355765 - DNA, 22 bp, Homo sapiens
gctgcaggggggtctggacttg

SEQ ID NO: 9355766 - DNA, 22 bp, Homo sapiens
gctgcaggggggtctggacttg

SEQ ID NO: 9355767 - DNA, 22 bp, Homo sapiens
gctgcctccaatctgtgccccg

SEQ ID NO: 9355768 - DNA, 22 bp, Homo sapiens
gctgcaggggggtctggacttg

SEQ ID NO: 9355769 - DNA, 22 bp, Homo sapiens
gctgcaggggggtctggacttg

SEQ ID NO: 9355770 - DNA, 22 bp, Homo sapiens
gctgcagggctctcacaggggg

SEQ ID NO: 9355771 - DNA, 22 bp, Homo sapiens
gctgcagggctctcacaggggg

SEQ ID NO: 9355772 - DNA, 22 bp, Homo sapiens
gctgcagggctctcacaggggg

SEQ ID NO: 9355773 - DNA, 22 bp, Homo sapiens
gctgcagggagctggaaggctc

SEQ ID NO: 9355774 - DNA, 22 bp, Homo sapiens
gctgcagggagctggaaggctc

SEQ ID NO: 9355775 - DNA, 22 bp, Homo sapiens
gctgcagggagctggaaggctc

SEQ ID NO: 9355776 - DNA, 21 bp, Homo sapiens
gctgcagggcccagggcaccc

SEQ ID NO: 9355777 - DNA, 21 bp, Homo sapiens
gctgcagggcccagggcaccc

SEQ ID NO: 9355778 - DNA, 21 bp, Homo sapiens
gctgcagggcccagggcaccc

SEQ ID NO: 9355779 - DNA, 21 bp, Homo sapiens
gctgcagggcccagggcaccc

SEQ ID NO: 9355780 - DNA, 22 bp, Homo sapiens
gctgcaggcggccgtggtggcg

SEQ ID NO: 9355781 - DNA, 22 bp, Homo sapiens
gctgcaggcggccgtggtggcg

SEQ ID NO: 9355782 - DNA, 22 bp, Homo sapiens
gctgcaggctgtggcaggggag

SEQ ID NO: 9355783 - DNA, 22 bp, Homo sapiens
gctgcaggctgtggcaggggag

SEQ ID NO: 9355784 - DNA, 22 bp, Homo sapiens
gctgcaggctctgcaggaattg

SEQ ID NO: 9355785 - DNA, 22 bp, Homo sapiens
gctgcaggctctgcaggaattg

SEQ ID NO: 9355786 - DNA, 22 bp, Homo sapiens
gctgcaggctgtggcaggggag

SEQ ID NO: 9355787 - DNA, 22 bp, Homo sapiens
gctgcagggaatgtatggattt

SEQ ID NO: 9355788 - DNA, 22 bp, Homo sapiens
gctgcagggagctggaaggctc

SEQ ID NO: 9355789 - DNA, 22 bp, Homo sapiens
gctgcagggagctggaaggctc

SEQ ID NO: 9355790 - DNA, 22 bp, Homo sapiens
gctgcagggagctggaaggctc

SEQ ID NO: 9355791 - DNA, 17 bp, Homo sapiens
gctgagtgcagggagtc

SEQ ID NO: 9355792 - DNA, 22 bp, Homo sapiens
gctgagtggagcagtcagcgct

SEQ ID NO: 9355793 - DNA, 22 bp, Homo sapiens
gctgagtggagcagtcagcgct

SEQ ID NO: 9355794 - DNA, 22 bp, Homo sapiens
gctgagtgattgatattttagt

SEQ ID NO: 9355795 - DNA, 17 bp, Homo sapiens
gctgagtgcagggagtc

SEQ ID NO: 9355796 - DNA, 22 bp, Homo sapiens
gctgagtgtaatgatggcagag

SEQ ID NO: 9355797 - DNA, 22 bp, Homo sapiens
gctgagttgaaagcagaggata

SEQ ID NO: 9355798 - DNA, 22 bp, Homo sapiens
gctgagtgtaatgatggcagag

SEQ ID NO: 9355799 - DNA, 17 bp, Homo sapiens
gctgagtgcagggagtc

SEQ ID NO: 9355800 - DNA, 22 bp, Homo sapiens
gctgagtgattcatacgctgct

SEQ ID NO: 9355801 - DNA, 22 bp, Homo sapiens
gctgagtgaggtccagagcttg

SEQ ID NO: 9355802 - DNA, 22 bp, Homo sapiens
gctgagtgaggctgtcaaaatg

SEQ ID NO: 9355803 - DNA, 22 bp, Homo sapiens
gctgagtgaggaaaaggttata

SEQ ID NO: 9355804 - DNA, 22 bp, Homo sapiens
gctgagtgaaagtttgctgtgt

SEQ ID NO: 9355805 - DNA, 22 bp, Homo sapiens
gctgagtgaaagtttgctgtgt

SEQ ID NO: 9355806 - DNA, 22 bp, Homo sapiens
gctgagtgaaagtttgctgtgt

SEQ ID NO: 9355807 - DNA, 22 bp, Homo sapiens
gctgagtgaggaaaaggttata

SEQ ID NO: 9355808 - DNA, 22 bp, Homo sapiens
gctgagtcttgcctgtgctgtc

SEQ ID NO: 9355809 - DNA, 22 bp, Homo sapiens
gctgataaatagttgatgtacc

SEQ ID NO: 9355810 - DNA, 22 bp, Homo sapiens
gctgataagaagacccatcctg

SEQ ID NO: 9355811 - DNA, 22 bp, Homo sapiens
gctgataaattacccagcatct

SEQ ID NO: 9355812 - DNA, 22 bp, Homo sapiens
gctgatagactgaatgttggga

SEQ ID NO: 9355813 - DNA, 23 bp, Homo sapiens
gctgataatgcattctgtttaat

SEQ ID NO: 9355814 - DNA, 22 bp, Homo sapiens
gctgataagagggcaatgagtg

SEQ ID NO: 9355815 - DNA, 22 bp, Homo sapiens
gctgcaggcattttcctgggca

SEQ ID NO: 9355816 - DNA, 22 bp, Homo sapiens
gctgcaggcattttcctgggca

SEQ ID NO: 9355817 - DNA, 22 bp, Homo sapiens
gctgcaggcagaatctcccaat

SEQ ID NO: 9355818 - DNA, 18 bp, Homo sapiens
gctgcaggcgcctgcggt

SEQ ID NO: 9355819 - DNA, 18 bp, Homo sapiens
gctgcaggcgcctgcggt

SEQ ID NO: 9355820 - DNA, 22 bp, Homo sapiens
gctgcaggcgcctgcggtctct

SEQ ID NO: 9355821 - DNA, 22 bp, Homo sapiens
gctgcaggcgcctgcggtctct

SEQ ID NO: 9355822 - DNA, 18 bp, Homo sapiens
gctgcaggcgcctgcggt

SEQ ID NO: 9355823 - DNA, 18 bp, Homo sapiens
gctgcaggccctccgagg

SEQ ID NO: 9355824 - DNA, 22 bp, Homo sapiens
gctgcaggcattttcctgggca

SEQ ID NO: 9355825 - DNA, 22 bp, Homo sapiens
gctgcaggcattttcctgggca

SEQ ID NO: 9355826 - DNA, 20 bp, Homo sapiens
gctgaggtttcttcctatat

SEQ ID NO: 9355827 - DNA, 22 bp, Homo sapiens
gctgaggtttcaggagtggcag

SEQ ID NO: 9355828 - DNA, 22 bp, Homo sapiens
gctgaggttttctgcctgctca

SEQ ID NO: 9355829 - DNA, 22 bp, Homo sapiens
gctgagtcttgagcactgagca

SEQ ID NO: 9355830 - DNA, 22 bp, Homo sapiens
gctgagtcagattgcagtcttg

SEQ ID NO: 9355831 - DNA, 22 bp, Homo sapiens
gctgaggtggtgatggttcatc

SEQ ID NO: 9355832 - DNA, 22 bp, Homo sapiens
gctgaggtggctgccttagtaa

SEQ ID NO: 9355833 - DNA, 22 bp, Homo sapiens
gctgaggtttcaggagtggcag

SEQ ID NO: 9355834 - DNA, 22 bp, Homo sapiens
gctgaggtgtcaccttgctggg

SEQ ID NO: 9355835 - DNA, 22 bp, Homo sapiens
gctgaggtgtcaccttgctggg

SEQ ID NO: 9355836 - DNA, 22 bp, Homo sapiens
gctgagggggaaggaaagctga

SEQ ID NO: 9355837 - DNA, 20 bp, Homo sapiens
gctgaggggtctatggcata

SEQ ID NO: 9355838 - DNA, 20 bp, Homo sapiens
gctgaggggtctatggcata

SEQ ID NO: 9355839 - DNA, 20 bp, Homo sapiens
gctctgtggtttgagtctcc

SEQ ID NO: 9355840 - DNA, 22 bp, Homo sapiens
gctctgtgtaaatgtagggtcc

SEQ ID NO: 9355841 - DNA, 22 bp, Homo sapiens
gctctgtggtggggcagagttt

SEQ ID NO: 9355842 - DNA, 22 bp, Homo sapiens
gctctgtggcattcatgggcag

SEQ ID NO: 9355843 - DNA, 22 bp, Homo sapiens
tatcattttactgtgacatttt

SEQ ID NO: 9355844 - DNA, 22 bp, Homo sapiens
tatcattttactgtgacatttt

SEQ ID NO: 9355845 - DNA, 22 bp, Homo sapiens
tatcatttagagtatttcttca

SEQ ID NO: 9355846 - DNA, 23 bp, Homo sapiens
tatcatttcagctctctgcctgg

SEQ ID NO: 9355847 - DNA, 22 bp, Homo sapiens
tatcatttgttattattagtgg

SEQ ID NO: 9355848 - DNA, 22 bp, Homo sapiens
tatcatttgttattattagtgg

SEQ ID NO: 9355849 - DNA, 18 bp, Homo sapiens
tatcttttccagtggtat

SEQ ID NO: 9355850 - DNA, 23 bp, Homo sapiens
tatctttttcaatgttggaaata

SEQ ID NO: 9355851 - DNA, 22 bp, Homo sapiens
tatgaaattgccatttttatgg

SEQ ID NO: 9355852 - DNA, 22 bp, Homo sapiens
tatgaaattgccatttttatgg

SEQ ID NO: 9355853 - DNA, 22 bp, Homo sapiens
tatgacaagaaatacagaggta

SEQ ID NO: 9355854 - DNA, 22 bp, Homo sapiens
tatgaattctgttcattgatga

SEQ ID NO: 9355855 - DNA, 22 bp, Homo sapiens
tatgaattctgttcattgatga

SEQ ID NO: 9355856 - DNA, 22 bp, Homo sapiens
tatgaattctcttgtgtatagt

SEQ ID NO: 9355857 - DNA, 20 bp, Homo sapiens
tatgaagtgttcttctggta

SEQ ID NO: 9355858 - DNA, 22 bp, Homo sapiens
tatgaatataccacaatttagg

SEQ ID NO: 9355859 - DNA, 22 bp, Homo sapiens
tatgaagtgatgttgaattttg

SEQ ID NO: 9355860 - DNA, 22 bp, Homo sapiens
tatcacttgcgttttggcagag

SEQ ID NO: 9355861 - DNA, 22 bp, Homo sapiens
tatcactacacctggctaatta

SEQ ID NO: 9355862 - DNA, 22 bp, Homo sapiens
tatcactacacctggctaatta

SEQ ID NO: 9355863 - DNA, 22 bp, Homo sapiens
tatcacatttggagatttatga

SEQ ID NO: 9355864 - DNA, 22 bp, Homo sapiens
tatcacatacttctcatccagg

SEQ ID NO: 9355865 - DNA, 22 bp, Homo sapiens
tataaagagtctcaaagaagtt

SEQ ID NO: 9355866 - DNA, 22 bp, Homo sapiens
tataaagagtctatctggtggc

SEQ ID NO: 9355867 - DNA, 22 bp, Homo sapiens
tataaagagtctcaaagaagtt

SEQ ID NO: 9355868 - DNA, 22 bp, Homo sapiens
tataaagtgtgaactgtgagta

SEQ ID NO: 9355869 - DNA, 22 bp, Homo sapiens
tataaagttggggctgaagtaa

SEQ ID NO: 9355870 - DNA, 22 bp, Homo sapiens
tagttttttcaacaaatggtgc

SEQ ID NO: 9355871 - DNA, 22 bp, Homo sapiens
tataaaatggcatcagctccaa

SEQ ID NO: 9355872 - DNA, 22 bp, Homo sapiens
tataaaacagaaagcactacct

SEQ ID NO: 9355873 - DNA, 22 bp, Homo sapiens
tataaaattctcagtttggggt

SEQ ID NO: 9355874 - DNA, 22 bp, Homo sapiens
tataaaatggcatcagctccaa

SEQ ID NO: 9355875 - DNA, 22 bp, Homo sapiens
tataaaattctcagtttggggt

SEQ ID NO: 9355876 - DNA, 22 bp, Homo sapiens
tataaactcctcttgcattcct

SEQ ID NO: 9355877 - DNA, 22 bp, Homo sapiens
tataaactcctcttgcattcct

SEQ ID NO: 9355878 - DNA, 22 bp, Homo sapiens
tataaactttaaccaggatgtc

SEQ ID NO: 9355879 - DNA, 22 bp, Homo sapiens
tataaacttaatggttccgaat

SEQ ID NO: 9355880 - DNA, 22 bp, Homo sapiens
tatgtatagagtcttttaaatt

SEQ ID NO: 9355881 - DNA, 22 bp, Homo sapiens
tatgtatagagtcttttaaatt

SEQ ID NO: 9355882 - DNA, 22 bp, Homo sapiens
tatgtataatcacagagtgtca

SEQ ID NO: 9355883 - DNA, 22 bp, Homo sapiens
tatgtatagagtcttttaaatt

SEQ ID NO: 9355884 - DNA, 22 bp, Homo sapiens
tatgtatataggtgtgtgtctc

SEQ ID NO: 9355885 - DNA, 22 bp, Homo sapiens
tatgtatataggtgtgtgtctc

SEQ ID NO: 9355886 - DNA, 22 bp, Homo sapiens
tatgtatataggtgtgtgtctc

SEQ ID NO: 9355887 - DNA, 18 bp, Homo sapiens
tatgtataacatagttca

SEQ ID NO: 9355888 - DNA, 18 bp, Homo sapiens
tatgtataacatagttca

SEQ ID NO: 9355889 - DNA, 22 bp, Homo sapiens
tatgtataatcacagagtgtca

SEQ ID NO: 9355890 - DNA, 22 bp, Homo sapiens
tatgtataatcacagagtgtca

SEQ ID NO: 9355891 - DNA, 22 bp, Homo sapiens
tatgtataaatgcatgtgtgga

SEQ ID NO: 9355892 - DNA, 22 bp, Homo sapiens
tatgtataaatgcatgtgtgga

SEQ ID NO: 9355893 - DNA, 22 bp, Homo sapiens
tatgtataaatgcatgtgtgga

SEQ ID NO: 9355894 - DNA, 22 bp, Homo sapiens
tatgtagtacttagtgcataca

SEQ ID NO: 9355895 - DNA, 22 bp, Homo sapiens
tatgtagtcaagtggatatatg

SEQ ID NO: 9355896 - DNA, 18 bp, Homo sapiens
tatgtagtatatgtgtat

SEQ ID NO: 9355897 - DNA, 22 bp, Homo sapiens
tatgtagtcaagtggatatatg

SEQ ID NO: 9355898 - DNA, 22 bp, Homo sapiens
tatgtagatttctctgtttttc

SEQ ID NO: 9355899 - DNA, 22 bp, Homo sapiens
tatgtagatgtcatataaattg

SEQ ID NO: 9355900 - DNA, 22 bp, Homo sapiens
tatgtagagataaaatccaaat

SEQ ID NO: 9355901 - DNA, 22 bp, Homo sapiens
tatgtagacttcattgtttact

SEQ ID NO: 9355902 - DNA, 22 bp, Homo sapiens
tatgtatatatgttgggtagaa

SEQ ID NO: 9355903 - DNA, 22 bp, Homo sapiens
tatgtatatatgttgggtagaa

SEQ ID NO: 9355904 - DNA, 22 bp, Homo sapiens
tatgtatatatgttgggtagaa

SEQ ID NO: 9355905 - DNA, 22 bp, Homo sapiens
tatgtatatggctcttccccat

SEQ ID NO: 9355906 - DNA, 22 bp, Homo sapiens
tatgtatatgtatacacacaca

SEQ ID NO: 9355907 - DNA, 22 bp, Homo sapiens
tatgtatatggtagaagtatgt

SEQ ID NO: 9355908 - DNA, 22 bp, Homo sapiens
tatgtatatggtagaagtatgt

SEQ ID NO: 9355909 - DNA, 22 bp, Homo sapiens
tatgtatatgtatacacacaca

SEQ ID NO: 9355910 - DNA, 22 bp, Homo sapiens
tatgtatatgtgtgttgacaac

SEQ ID NO: 9355911 - DNA, 22 bp, Homo sapiens
tatgtatatgtgtgttgacaac

SEQ ID NO: 9355912 - DNA, 22 bp, Homo sapiens
tatgtatatggtagaagtatgt

SEQ ID NO: 9355913 - DNA, 22 bp, Homo sapiens
tatgtatccgtgtgtgtacaga

SEQ ID NO: 9355914 - DNA, 20 bp, Homo sapiens
tatgtatgcctacatgctat

SEQ ID NO: 9355915 - DNA, 22 bp, Homo sapiens
tatgtattattcatcagtggga

SEQ ID NO: 9355916 - DNA, 22 bp, Homo sapiens
tatgtattagagctccatgagg

SEQ ID NO: 9355917 - DNA, 22 bp, Homo sapiens
tatgtattagagctccatgagg

SEQ ID NO: 9355918 - DNA, 22 bp, Homo sapiens
tatgtattatctgtgactgctt

SEQ ID NO: 9355919 - DNA, 23 bp, Homo sapiens
tatgtatgtatgtttgtatggaa

SEQ ID NO: 9355920 - DNA, 22 bp, Homo sapiens
tatgtattctcagatttactaa

SEQ ID NO: 9355921 - DNA, 22 bp, Homo sapiens
tatgtattctcagatttactaa

SEQ ID NO: 9355922 - DNA, 22 bp, Homo sapiens
tatgtattctgagtacaagttc

SEQ ID NO: 9355923 - DNA, 22 bp, Homo sapiens
tattaataagtgactactagct

SEQ ID NO: 9355924 - DNA, 22 bp, Homo sapiens
tattaataagtgactactagct

SEQ ID NO: 9355925 - DNA, 21 bp, Homo sapiens
tattaatatgtctaagctgat

SEQ ID NO: 9355926 - DNA, 21 bp, Homo sapiens
tattaatatgtctaagctgat

SEQ ID NO: 9355927 - DNA, 22 bp, Homo sapiens
tattaagatacgtagttgtaaa

SEQ ID NO: 9355928 - DNA, 22 bp, Homo sapiens
tattaacatgaactgacttttc

SEQ ID NO: 9355929 - DNA, 22 bp, Homo sapiens
tattaacattttatgaaaataa

SEQ ID NO: 9355930 - DNA, 22 bp, Homo sapiens
tatgtcatgggtcaaaatgaag

SEQ ID NO: 9355931 - DNA, 22 bp, Homo sapiens
tatgtttcatcaggcatggagt

SEQ ID NO: 9355932 - DNA, 22 bp, Homo sapiens
tatgtttctgggcttgatattt

SEQ ID NO: 9355933 - DNA, 22 bp, Homo sapiens
tatgtttctgggcttgatattt

SEQ ID NO: 9355934 - DNA, 22 bp, Homo sapiens
tatgtttctgggcttgatattt

SEQ ID NO: 9355935 - DNA, 22 bp, Homo sapiens
tatgtttcattcttttctggta

SEQ ID NO: 9355936 - DNA, 22 bp, Homo sapiens
tattaacatgaactgacttttc

SEQ ID NO: 9355937 - DNA, 22 bp, Homo sapiens
tattaaattatggatttaggag

SEQ ID NO: 9355938 - DNA, 22 bp, Homo sapiens
tattaaattatggatttaggag

SEQ ID NO: 9355939 - DNA, 22 bp, Homo sapiens
tatgtttcttccttttcataca

SEQ ID NO: 9355940 - DNA, 22 bp, Homo sapiens
tatgctttaaccctcttatatt

SEQ ID NO: 9355941 - DNA, 22 bp, Homo sapiens
tatgctttaaccctcttatatt

SEQ ID NO: 9355942 - DNA, 17 bp, Homo sapiens
tatgcttttcttctcca

SEQ ID NO: 9355943 - DNA, 22 bp, Homo sapiens
tatggaaataattagacaagtg

SEQ ID NO: 9355944 - DNA, 22 bp, Homo sapiens
tatgtacatatacacgtgtgtg

SEQ ID NO: 9355945 - DNA, 22 bp, Homo sapiens
tatgtacatatacacgtgtgtg

SEQ ID NO: 9355946 - DNA, 22 bp, Homo sapiens
tatgtacatacatgtgcatacg

SEQ ID NO: 9355947 - DNA, 22 bp, Homo sapiens
tatgtacatacatgtgcatacg

SEQ ID NO: 9355948 - DNA, 22 bp, Homo sapiens
tatgtactctaatttgtctcat

SEQ ID NO: 9355949 - DNA, 22 bp, Homo sapiens
tatgtactaactttcattctag

SEQ ID NO: 9355950 - DNA, 22 bp, Homo sapiens
tatgtactttcctgggaatgtt

SEQ ID NO: 9355951 - DNA, 22 bp, Homo sapiens
tatgtagacaggctgcttttcc

SEQ ID NO: 9355952 - DNA, 22 bp, Homo sapiens
tatgtaaaaattcatcaggctg

SEQ ID NO: 9355953 - DNA, 22 bp, Homo sapiens
tatggtttcaatttctgggtag

SEQ ID NO: 9355954 - DNA, 22 bp, Homo sapiens
tatgtaaaggattgagatgaat

SEQ ID NO: 9355955 - DNA, 22 bp, Homo sapiens
tatgtacatacatgtgcatacg

SEQ ID NO: 9355956 - DNA, 22 bp, Homo sapiens
tatgtacatacatgtgcatacg

SEQ ID NO: 9355957 - DNA, 21 bp, Homo sapiens
tatggtaaccagacaagaatg

SEQ ID NO: 9355958 - DNA, 22 bp, Homo sapiens
tatttgcaggacatagatatgg

SEQ ID NO: 9355959 - DNA, 22 bp, Homo sapiens
tatttgcaaagaactacactag

SEQ ID NO: 9355960 - DNA, 22 bp, Homo sapiens
tatttcttgttattctcgttga

SEQ ID NO: 9355961 - DNA, 22 bp, Homo sapiens
tatttcttgttattctcgttga

SEQ ID NO: 9355962 - DNA, 22 bp, Homo sapiens
tatttaattagtgattgtagag

SEQ ID NO: 9355963 - DNA, 22 bp, Homo sapiens
tatttgaataaaggataaggaa

SEQ ID NO: 9355964 - DNA, 22 bp, Homo sapiens
tatttgaaggcatacattttga

SEQ ID NO: 9355965 - DNA, 22 bp, Homo sapiens
tatttgaatcctggttcttcag

SEQ ID NO: 9355966 - DNA, 22 bp, Homo sapiens
tatttgacatggtggatttgct

SEQ ID NO: 9355967 - DNA, 22 bp, Homo sapiens
tatttgcttttgtgccacagat

SEQ ID NO: 9355968 - DNA, 22 bp, Homo sapiens
tatttggaaaagggaagggaca

SEQ ID NO: 9355969 - DNA, 22 bp, Homo sapiens
tatttgctgacagtgctggagc

SEQ ID NO: 9355970 - DNA, 22 bp, Homo sapiens
tatttggaatagcttgctaatg

SEQ ID NO: 9355971 - DNA, 22 bp, Homo sapiens
tatttggacaccaagtagaagt

SEQ ID NO: 9355972 - DNA, 22 bp, Homo sapiens
tatttggaaacaattcacatgc

SEQ ID NO: 9355973 - DNA, 22 bp, Homo sapiens
tattttctggggagagtgaacc

SEQ ID NO: 9355974 - DNA, 22 bp, Homo sapiens
tattttgaaagtctgttttgaa

SEQ ID NO: 9355975 - DNA, 22 bp, Homo sapiens
tattttgacgattttatgcaaa

SEQ ID NO: 9355976 - DNA, 23 bp, Homo sapiens
tattttccaaatgatgactacat

SEQ ID NO: 9355977 - DNA, 22 bp, Homo sapiens
tattttctggacagtcttgctt

SEQ ID NO: 9355978 - DNA, 23 bp, Homo sapiens
tattacaattggtcttattaaga

SEQ ID NO: 9355979 - DNA, 23 bp, Homo sapiens
tattacaattggtcttattaaga

SEQ ID NO: 9355980 - DNA, 22 bp, Homo sapiens
tattacaatttacattgcactt

SEQ ID NO: 9355981 - DNA, 23 bp, Homo sapiens
tattacaattggtcttattaaga

SEQ ID NO: 9355982 - DNA, 23 bp, Homo sapiens
tattacaattggtcttattaaga

SEQ ID NO: 9355983 - DNA, 22 bp, Homo sapiens
tattacaagaaagggcatgaat

SEQ ID NO: 9355984 - DNA, 22 bp, Homo sapiens
tattacaagaaagggcatgaat

SEQ ID NO: 9355985 - DNA, 22 bp, Homo sapiens
tattacaaattataatgggaga

SEQ ID NO: 9355986 - DNA, 21 bp, Homo sapiens
tattaatttttcttcccacta

SEQ ID NO: 9355987 - DNA, 22 bp, Homo sapiens
tattaattcttgccaattctcc

SEQ ID NO: 9355988 - DNA, 22 bp, Homo sapiens
tattaatttaatctccatggta

SEQ ID NO: 9355989 - DNA, 22 bp, Homo sapiens
tattacaatttacattgcactt

SEQ ID NO: 9355990 - DNA, 22 bp, Homo sapiens
tattacaatttacattgcactt

SEQ ID NO: 9355991 - DNA, 22 bp, Homo sapiens
tattgtatcttaccacatgtat

SEQ ID NO: 9355992 - DNA, 22 bp, Homo sapiens
tattgtattaaggattcaagta

SEQ ID NO: 9355993 - DNA, 22 bp, Homo sapiens
tattgtatcttctgtttagaag

SEQ ID NO: 9355994 - DNA, 22 bp, Homo sapiens
tattgtattaaggattcaagta

SEQ ID NO: 9355995 - DNA, 22 bp, Homo sapiens
tattgtcacgtcttaattctag

SEQ ID NO: 9355996 - DNA, 22 bp, Homo sapiens
tattgtcaagaagtttatagtg

SEQ ID NO: 9355997 - DNA, 22 bp, Homo sapiens
tattgtctaggaattgtttaaa

SEQ ID NO: 9355998 - DNA, 22 bp, Homo sapiens
tattgtctctgcgttgttctat

SEQ ID NO: 9355999 - DNA, 22 bp, Homo sapiens
tattgtcagtgcctgcctcata

SEQ ID NO: 9356000 - DNA, 22 bp, Homo sapiens
tatttaaaatagtgctccagca

SEQ ID NO: 9356001 - DNA, 22 bp, Homo sapiens
tatttaaaatagtgctccagca

SEQ ID NO: 9356002 - DNA, 22 bp, Homo sapiens
tatttaaaatagtgctccagca

SEQ ID NO: 9356003 - DNA, 22 bp, Homo sapiens
tatttaaaatagtgctccagca

SEQ ID NO: 9356004 - DNA, 22 bp, Homo sapiens
tatttaaaataagccccagtgg

SEQ ID NO: 9356005 - DNA, 22 bp, Homo sapiens
tatttaaaataagccccagtgg

SEQ ID NO: 9356006 - DNA, 22 bp, Homo sapiens
tatttaaaataagccccagtgg

SEQ ID NO: 9356007 - DNA, 22 bp, Homo sapiens
tatttaaaataagccccagtgg

SEQ ID NO: 9356008 - DNA, 22 bp, Homo sapiens
tatttaactggaaacacaatga

SEQ ID NO: 9356009 - DNA, 22 bp, Homo sapiens
tatttaactggaaacacaatga

SEQ ID NO: 9356010 - DNA, 22 bp, Homo sapiens
tattgtgccaggtaatgtgttc

SEQ ID NO: 9356011 - DNA, 22 bp, Homo sapiens
tattgtgcttctgttgtgcaat

SEQ ID NO: 9356012 - DNA, 22 bp, Homo sapiens
tattgtgctcaccattacatcc

SEQ ID NO: 9356013 - DNA, 22 bp, Homo sapiens
tattgttgttgtgagggggatg

SEQ ID NO: 9356014 - DNA, 22 bp, Homo sapiens
tattgtgttttctctgtgcgga

SEQ ID NO: 9356015 - DNA, 22 bp, Homo sapiens
tatttaaaaagaggccagctgg

SEQ ID NO: 9356016 - DNA, 22 bp, Homo sapiens
tatttaaaaagaggccagctgg

SEQ ID NO: 9356017 - DNA, 22 bp, Homo sapiens
tatttaaaaagaggccagctgg

SEQ ID NO: 9356018 - DNA, 22 bp, Homo sapiens
tatttaaaaagaggccagctgg

SEQ ID NO: 9356019 - DNA, 22 bp, Homo sapiens
tattgtgcatgttgaataacta

SEQ ID NO: 9356020 - DNA, 22 bp, Homo sapiens
tattgtgagtataactgcattt

SEQ ID NO: 9356021 - DNA, 22 bp, Homo sapiens
tattgtgagttcagactaaaaa

SEQ ID NO: 9356022 - DNA, 20 bp, Homo sapiens
tattgtgataggtgttaatc

SEQ ID NO: 9356023 - DNA, 22 bp, Homo sapiens
tattgtgaagggaaaaatagtg

SEQ ID NO: 9356024 - DNA, 22 bp, Homo sapiens
tcaaatattggctatttcacat

SEQ ID NO: 9356025 - DNA, 22 bp, Homo sapiens
tcaaatcaccaaactcactggc

SEQ ID NO: 9356026 - DNA, 22 bp, Homo sapiens
tcaaatattggctatttcacat

SEQ ID NO: 9356027 - DNA, 21 bp, Homo sapiens
tcaaatcaggtatcactattg

SEQ ID NO: 9356028 - DNA, 22 bp, Homo sapiens
tcaaatcaccaaactcactggc

SEQ ID NO: 9356029 - DNA, 22 bp, Homo sapiens
tcaaatcaccaaactcactggc

SEQ ID NO: 9356030 - DNA, 22 bp, Homo sapiens
tcaaatcagcaagcagcttccc

SEQ ID NO: 9356031 - DNA, 22 bp, Homo sapiens
tcaaatctttgaccacttatgt

SEQ ID NO: 9356032 - DNA, 21 bp, Homo sapiens
tcaaatcctgctgttaccact

SEQ ID NO: 9356033 - DNA, 22 bp, Homo sapiens
tcaaatctcattgcctaaaact

SEQ ID NO: 9356034 - DNA, 22 bp, Homo sapiens
tcaaataccagcaatttcatgt

SEQ ID NO: 9356035 - DNA, 22 bp, Homo sapiens
tcaaataggcttgtagtgactg

SEQ ID NO: 9356036 - DNA, 18 bp, Homo sapiens
tcaaatactttgggcagt

SEQ ID NO: 9356037 - DNA, 22 bp, Homo sapiens
tcaaatatgtgatagaagctaa

SEQ ID NO: 9356038 - DNA, 22 bp, Homo sapiens
tcaaaggttaactctgttgttc

SEQ ID NO: 9356039 - DNA, 19 bp, Homo sapiens
tcaaaggcttttaggagac

SEQ ID NO: 9356040 - DNA, 22 bp, Homo sapiens
tcaaagttggaaaagctggccc

SEQ ID NO: 9356041 - DNA, 22 bp, Homo sapiens
tattttgtcttctgctcatcac

SEQ ID NO: 9356042 - DNA, 22 bp, Homo sapiens
tattttgtcttctgctcatcac

SEQ ID NO: 9356043 - DNA, 22 bp, Homo sapiens
tattttgtatttatgcaagaaa

SEQ ID NO: 9356044 - DNA, 22 bp, Homo sapiens
tattttgtatttatgcaagaaa

SEQ ID NO: 9356045 - DNA, 22 bp, Homo sapiens
tattttgtatttatgcaagaaa

SEQ ID NO: 9356046 - DNA, 22 bp, Homo sapiens
tattttgtatttatgcaagaaa

SEQ ID NO: 9356047 - DNA, 22 bp, Homo sapiens
tattttgttaataatccagtcc

SEQ ID NO: 9356048 - DNA, 22 bp, Homo sapiens
tattttgtgccatgcactgcct

SEQ ID NO: 9356049 - DNA, 22 bp, Homo sapiens
tattttgtgccatgcactgcct

SEQ ID NO: 9356050 - DNA, 22 bp, Homo sapiens
tattttgtgccatgcactgcct

SEQ ID NO: 9356051 - DNA, 22 bp, Homo sapiens
tattttgttttgtatccactgt

SEQ ID NO: 9356052 - DNA, 22 bp, Homo sapiens
tattttgttaataatccagtcc

SEQ ID NO: 9356053 - DNA, 22 bp, Homo sapiens
tattttgttttgtatccactgt

SEQ ID NO: 9356054 - DNA, 22 bp, Homo sapiens
tatttttgcctctcagataaaa

SEQ ID NO: 9356055 - DNA, 22 bp, Homo sapiens
tatttttgcctctcagataaaa

SEQ ID NO: 9356056 - DNA, 22 bp, Homo sapiens
tatttttgcctctcagataaaa

SEQ ID NO: 9356057 - DNA, 22 bp, Homo sapiens
tcaaaaataagatattctggac

SEQ ID NO: 9356058 - DNA, 22 bp, Homo sapiens
tcaaaaataagatattctggac

SEQ ID NO: 9356059 - DNA, 22 bp, Homo sapiens
tattttgcaaacctgagtttga

SEQ ID NO: 9356060 - DNA, 22 bp, Homo sapiens
tattttgaggtatttttgagct

SEQ ID NO: 9356061 - DNA, 22 bp, Homo sapiens
tattttgacgattttatgcaaa

SEQ ID NO: 9356062 - DNA, 22 bp, Homo sapiens
tattttgtaattggtcatagct

SEQ ID NO: 9356063 - DNA, 22 bp, Homo sapiens
tattttgtaattggtcatagct

SEQ ID NO: 9356064 - DNA, 22 bp, Homo sapiens
tattttgtaattggtcatagct

SEQ ID NO: 9356065 - DNA, 20 bp, Homo sapiens
tattttgcaattatggttca

SEQ ID NO: 9356066 - DNA, 22 bp, Homo sapiens
tattttgcgttgagtcagattt

SEQ ID NO: 9356067 - DNA, 22 bp, Homo sapiens
tattttgcgttgagtcagattt

SEQ ID NO: 9356068 - DNA, 20 bp, Homo sapiens
tcaaagaagattcagctcaa

SEQ ID NO: 9356069 - DNA, 20 bp, Homo sapiens
tcaaagaagattcagctcaa

SEQ ID NO: 9356070 - DNA, 22 bp, Homo sapiens
tcaaagaacatcatctgaaatg

SEQ ID NO: 9356071 - DNA, 22 bp, Homo sapiens
tcaaagaacatcatctgaaatg

SEQ ID NO: 9356072 - DNA, 17 bp, Homo sapiens
tcaaagaatgcatgcag

SEQ ID NO: 9356073 - DNA, 22 bp, Homo sapiens
tcaaagaagtgcaaacctcatc

SEQ ID NO: 9356074 - DNA, 22 bp, Homo sapiens
tcaaagaagtgcaaacctcatc

SEQ ID NO: 9356075 - DNA, 17 bp, Homo sapiens
tcaaagaatgcatgcag

SEQ ID NO: 9356076 - DNA, 22 bp, Homo sapiens
tcaaagatagatgttgagaaat

SEQ ID NO: 9356077 - DNA, 22 bp, Homo sapiens
tcaaagatgataggaaatcata

SEQ ID NO: 9356078 - DNA, 22 bp, Homo sapiens
tcaaagatgataggaaatcata

SEQ ID NO: 9356079 - DNA, 22 bp, Homo sapiens
tcaaagatagatgttgagaaat

SEQ ID NO: 9356080 - DNA, 22 bp, Homo sapiens
tcaaagacatctggtagctgag

SEQ ID NO: 9356081 - DNA, 22 bp, Homo sapiens
tagcaacataagaaacattttg

SEQ ID NO: 9356082 - DNA, 22 bp, Homo sapiens
tagcagctctttactaaccagt

SEQ ID NO: 9356083 - DNA, 22 bp, Homo sapiens
tagcagctctgattctgggccc

SEQ ID NO: 9356084 - DNA, 22 bp, Homo sapiens
tagcagctcctaaacagtggtg

SEQ ID NO: 9356085 - DNA, 22 bp, Homo sapiens
tagcaaccagaacagcactcta

SEQ ID NO: 9356086 - DNA, 22 bp, Homo sapiens
tagcaaaggccttggacacgct

SEQ ID NO: 9356087 - DNA, 22 bp, Homo sapiens
tagcaaagttttgtggtgatta

SEQ ID NO: 9356088 - DNA, 23 bp, Homo sapiens
tagcaaagttgtttgggaaattt

SEQ ID NO: 9356089 - DNA, 21 bp, Homo sapiens
tagatgaaatcagagtatttc

SEQ ID NO: 9356090 - DNA, 20 bp, Homo sapiens
tagatcctggggatttattg

SEQ ID NO: 9356091 - DNA, 22 bp, Homo sapiens
tagatcctgcataggttgtgct

SEQ ID NO: 9356092 - DNA, 22 bp, Homo sapiens
tagatgaagcaacatgtgtaat

SEQ ID NO: 9356093 - DNA, 22 bp, Homo sapiens
tagcaaaagctcaacaggaagg

SEQ ID NO: 9356094 - DNA, 22 bp, Homo sapiens
tagcaaagaagatattattgca

SEQ ID NO: 9356095 - DNA, 22 bp, Homo sapiens
tagcaaagaacctgatacccca

SEQ ID NO: 9356096 - DNA, 22 bp, Homo sapiens
tagcaaaatgtggatgtagttg

SEQ ID NO: 9356097 - DNA, 18 bp, Homo sapiens
tagcaaagatgtggattg

SEQ ID NO: 9356098 - DNA, 22 bp, Homo sapiens
tagcagctggggctattcatca

SEQ ID NO: 9356099 - DNA, 19 bp, Homo sapiens
tagcagctgccaaaggaga

SEQ ID NO: 9356100 - DNA, 22 bp, Homo sapiens
tagcagctgcatcattttacag

SEQ ID NO: 9356101 - DNA, 22 bp, Homo sapiens
tagcagctgtgagtaaaagcca

SEQ ID NO: 9356102 - DNA, 22 bp, Homo sapiens
tagcagctgtcagtttcacata

SEQ ID NO: 9356103 - DNA, 22 bp, Homo sapiens
tagcagctgtggaggggctgtg

SEQ ID NO: 9356104 - DNA, 22 bp, Homo sapiens
tagcagcttaagtaattagaat

SEQ ID NO: 9356105 - DNA, 22 bp, Homo sapiens
tagcagcttccagagagggcag

SEQ ID NO: 9356106 - DNA, 22 bp, Homo sapiens
tagcaggaaacctgtgttgagg

SEQ ID NO: 9356107 - DNA, 22 bp, Homo sapiens
tagcaggaagaaagctactcag

SEQ ID NO: 9356108 - DNA, 22 bp, Homo sapiens
tagcaggaatgaagttctgagg

SEQ ID NO: 9356109 - DNA, 22 bp, Homo sapiens
tagcaggaatatgaggttaata

SEQ ID NO: 9356110 - DNA, 22 bp, Homo sapiens
tagcaggaattggctgcagctg

SEQ ID NO: 9356111 - DNA, 22 bp, Homo sapiens
tagcagggatacaaggtcgcct

SEQ ID NO: 9356112 - DNA, 22 bp, Homo sapiens
tagcagggccaggctgggaacc

SEQ ID NO: 9356113 - DNA, 22 bp, Homo sapiens
tagcagggccaggctgggaacc

SEQ ID NO: 9356114 - DNA, 22 bp, Homo sapiens
tagcaggagtgtgttctatttt

SEQ ID NO: 9356115 - DNA, 21 bp, Homo sapiens
tagcaggagcgaattttgatg

SEQ ID NO: 9356116 - DNA, 22 bp, Homo sapiens
tagcaggaggcagttcctcgct

SEQ ID NO: 9356117 - DNA, 22 bp, Homo sapiens
tagcaggcatctcagagataat

SEQ ID NO: 9356118 - DNA, 22 bp, Homo sapiens
tagcaggcatggagatgactgt

SEQ ID NO: 9356119 - DNA, 22 bp, Homo sapiens
tagcaggcttgtgaatggagcc

SEQ ID NO: 9356120 - DNA, 22 bp, Homo sapiens
tagcaggcatggagatgactgt

SEQ ID NO: 9356121 - DNA, 22 bp, Homo sapiens
tagcaggcatggagatgactgt

SEQ ID NO: 9356122 - DNA, 22 bp, Homo sapiens
tagcagggtccaatgtgaggca

SEQ ID NO: 9356123 - DNA, 22 bp, Homo sapiens
tagcagggtctcaggagtcagg

SEQ ID NO: 9356124 - DNA, 22 bp, Homo sapiens
tagcaggggtagatagagtgtg

SEQ ID NO: 9356125 - DNA, 22 bp, Homo sapiens
tagcaggggtagatagagtgtg

SEQ ID NO: 9356126 - DNA, 22 bp, Homo sapiens
tagcaggggtagatagagtgtg

SEQ ID NO: 9356127 - DNA, 22 bp, Homo sapiens
tagcagggtaaatgtagatgga

SEQ ID NO: 9356128 - DNA, 22 bp, Homo sapiens
tagcagggtctcaggagtcagg

SEQ ID NO: 9356129 - DNA, 22 bp, Homo sapiens
tagctgggaattatctggttgc

SEQ ID NO: 9356130 - DNA, 22 bp, Homo sapiens
tagctggctaatagtatgaata

SEQ ID NO: 9356131 - DNA, 22 bp, Homo sapiens
tagctggcttatataaaagggc

SEQ ID NO: 9356132 - DNA, 22 bp, Homo sapiens
tagctgggaattatctggttgc

SEQ ID NO: 9356133 - DNA, 17 bp, Homo sapiens
tagctggcactggggtt

SEQ ID NO: 9356134 - DNA, 22 bp, Homo sapiens
tagctggccctgggactcccgg

SEQ ID NO: 9356135 - DNA, 22 bp, Homo sapiens
tagctggcatggccctgtggga

SEQ ID NO: 9356136 - DNA, 22 bp, Homo sapiens
tagctgcttctcacatgggcaa

SEQ ID NO: 9356137 - DNA, 22 bp, Homo sapiens
tagctggcaaaggggaattagg

SEQ ID NO: 9356138 - DNA, 22 bp, Homo sapiens
tagctggcaaaacattatttct

SEQ ID NO: 9356139 - DNA, 22 bp, Homo sapiens
tagctgcttcagtctaggtctc

SEQ ID NO: 9356140 - DNA, 22 bp, Homo sapiens
tagctgcctttgggctcctgct

SEQ ID NO: 9356141 - DNA, 22 bp, Homo sapiens
tacttacattagcaaacaaggt

SEQ ID NO: 9356142 - DNA, 22 bp, Homo sapiens
tagaacatgctcatgtataaat

SEQ ID NO: 9356143 - DNA, 22 bp, Homo sapiens
tagaacttagcactagacttgt

SEQ ID NO: 9356144 - DNA, 22 bp, Homo sapiens
tagaacttagcactagacttgt

SEQ ID NO: 9356145 - DNA, 22 bp, Homo sapiens
tagaactaaagaacaactttga

SEQ ID NO: 9356146 - DNA, 22 bp, Homo sapiens
tagactggtgaattagggggaa

SEQ ID NO: 9356147 - DNA, 22 bp, Homo sapiens
tagactggtgaattagggggaa

SEQ ID NO: 9356148 - DNA, 22 bp, Homo sapiens
tagactggtgaattagggggaa

SEQ ID NO: 9356149 - DNA, 22 bp, Homo sapiens
tagactggtgaattagggggaa

SEQ ID NO: 9356150 - DNA, 22 bp, Homo sapiens
tagactatagctcacagtgctt

SEQ ID NO: 9356151 - DNA, 21 bp, Homo sapiens
tagaccagctgtgctcctcgg

SEQ ID NO: 9356152 - DNA, 22 bp, Homo sapiens
tagaccattttacaatagtgtg

SEQ ID NO: 9356153 - DNA, 22 bp, Homo sapiens
tagaccaggttgaccaggtagg

SEQ ID NO: 9356154 - DNA, 22 bp, Homo sapiens
tagacaggaaacattaggatgg

SEQ ID NO: 9356155 - DNA, 22 bp, Homo sapiens
tagaccagaattgtcagcacct

SEQ ID NO: 9356156 - DNA, 22 bp, Homo sapiens
tagaagcacagcctgatggaca

SEQ ID NO: 9356157 - DNA, 21 bp, Homo sapiens
tagaagcacataggttcaaag

SEQ ID NO: 9356158 - DNA, 22 bp, Homo sapiens
tagaagattctgccaagagcgc

SEQ ID NO: 9356159 - DNA, 22 bp, Homo sapiens
tagaagattcatttcctctgaa

SEQ ID NO: 9356160 - DNA, 22 bp, Homo sapiens
tagaagaaagtgaagctgggga

SEQ ID NO: 9356161 - DNA, 22 bp, Homo sapiens
tagaagaaaagcacttagagat

SEQ ID NO: 9356162 - DNA, 22 bp, Homo sapiens
tagaagaaagtgaagctgggga

SEQ ID NO: 9356163 - DNA, 22 bp, Homo sapiens
tagaagaaaagcacttagagat

SEQ ID NO: 9356164 - DNA, 22 bp, Homo sapiens
tagaagaacatgtcaaactata

SEQ ID NO: 9356165 - DNA, 22 bp, Homo sapiens
tagatatgtagtttttacagta

SEQ ID NO: 9356166 - DNA, 22 bp, Homo sapiens
tagatataggacagtactgtat

SEQ ID NO: 9356167 - DNA, 22 bp, Homo sapiens
tagatataggacagtactgtat

SEQ ID NO: 9356168 - DNA, 22 bp, Homo sapiens
tagatataggacagtactgtat

SEQ ID NO: 9356169 - DNA, 22 bp, Homo sapiens
tagatatatctgtcatactggt

SEQ ID NO: 9356170 - DNA, 22 bp, Homo sapiens
tagatatatctgtcatactggt

SEQ ID NO: 9356171 - DNA, 22 bp, Homo sapiens
tagatataaggtccttagaaca

SEQ ID NO: 9356172 - DNA, 22 bp, Homo sapiens
tagatataaggtccttagaaca

SEQ ID NO: 9356173 - DNA, 22 bp, Homo sapiens
tagatataaggtccttagaaca

SEQ ID NO: 9356174 - DNA, 22 bp, Homo sapiens
tagatcctgagccctatctact

SEQ ID NO: 9356175 - DNA, 22 bp, Homo sapiens
tagatcatgggtactgcatatg

SEQ ID NO: 9356176 - DNA, 21 bp, Homo sapiens
tagatcatggtattctttggc

SEQ ID NO: 9356177 - DNA, 22 bp, Homo sapiens
tagatatgtgtttattatgctg

SEQ ID NO: 9356178 - DNA, 22 bp, Homo sapiens
tagatatgtatacttgtttgag

SEQ ID NO: 9356179 - DNA, 22 bp, Homo sapiens
tagatcatggagtaaaatggaa

SEQ ID NO: 9356180 - DNA, 22 bp, Homo sapiens
tagatcatatttgtggagaaaa

SEQ ID NO: 9356181 - DNA, 22 bp, Homo sapiens
tagatactgcccattgagcaat

SEQ ID NO: 9356182 - DNA, 19 bp, Homo sapiens
tagatactgatgaactcca

SEQ ID NO: 9356183 - DNA, 22 bp, Homo sapiens
tagatacctgctggacctcatt

SEQ ID NO: 9356184 - DNA, 23 bp, Homo sapiens
tagatagcacactgacatctgac

SEQ ID NO: 9356185 - DNA, 22 bp, Homo sapiens
tagatagattctcctatagagt

SEQ ID NO: 9356186 - DNA, 22 bp, Homo sapiens
tagagaaacagaaccaacaggg

SEQ ID NO: 9356187 - DNA, 22 bp, Homo sapiens
tagagaggtttgaattggctgc

SEQ ID NO: 9356188 - DNA, 22 bp, Homo sapiens
tagagaggtttgaattggctgc

SEQ ID NO: 9356189 - DNA, 22 bp, Homo sapiens
tagagtatagctaactgtatta

SEQ ID NO: 9356190 - DNA, 20 bp, Homo sapiens
tagagagatatgggggttcc

SEQ ID NO: 9356191 - DNA, 22 bp, Homo sapiens
tagagaggccgcgggtcccctc

SEQ ID NO: 9356192 - DNA, 22 bp, Homo sapiens
tagagaggccgcgggtcccctc

SEQ ID NO: 9356193 - DNA, 16 bp, Homo sapiens
tagagagggcagggag

SEQ ID NO: 9356194 - DNA, 16 bp, Homo sapiens
tagagagggcagggag

SEQ ID NO: 9356195 - DNA, 22 bp, Homo sapiens
tagagagagctgtggtggctct

SEQ ID NO: 9356196 - DNA, 22 bp, Homo sapiens
tagagaacaagtatggcacgga

SEQ ID NO: 9356197 - DNA, 22 bp, Homo sapiens
tagagaactcagtgtgcagcct

SEQ ID NO: 9356198 - DNA, 22 bp, Homo sapiens
tagtttcatctccaccctgccc

SEQ ID NO: 9356199 - DNA, 22 bp, Homo sapiens
tagtttatgctgctgcagtgag

SEQ ID NO: 9356200 - DNA, 22 bp, Homo sapiens
tagtttcagattgctttcatat

SEQ ID NO: 9356201 - DNA, 22 bp, Homo sapiens
tagtttatagttagcgagcacg

SEQ ID NO: 9356202 - DNA, 22 bp, Homo sapiens
tagtttatagttagcgagcacg

SEQ ID NO: 9356203 - DNA, 22 bp, Homo sapiens
tagtttatgattttttggaagg

SEQ ID NO: 9356204 - DNA, 22 bp, Homo sapiens
tagtttatgctgctgcagtgag

SEQ ID NO: 9356205 - DNA, 22 bp, Homo sapiens
tagtttaggatcttttttgtgc

SEQ ID NO: 9356206 - DNA, 22 bp, Homo sapiens
tagtttaggtcgtacaagcaaa

SEQ ID NO: 9356207 - DNA, 22 bp, Homo sapiens
tagtttttaagtgtacaatttc

SEQ ID NO: 9356208 - DNA, 22 bp, Homo sapiens
tagttttttcaacaaatggtgc

SEQ ID NO: 9356209 - DNA, 22 bp, Homo sapiens
tagtttctaaagcttcctaggt

SEQ ID NO: 9356210 - DNA, 21 bp, Homo sapiens
tagtttctacccagttaatgg

SEQ ID NO: 9356211 - DNA, 22 bp, Homo sapiens
tagttacagtgcatagcaagat

SEQ ID NO: 9356212 - DNA, 22 bp, Homo sapiens
tagttacagtgcatagcaagat

SEQ ID NO: 9356213 - DNA, 22 bp, Homo sapiens
tagttacataaagtggactgtt

SEQ ID NO: 9356214 - DNA, 22 bp, Homo sapiens
tagttacataaagtggactgtt

SEQ ID NO: 9356215 - DNA, 22 bp, Homo sapiens
tagttacagcaggcaggatata

SEQ ID NO: 9356216 - DNA, 22 bp, Homo sapiens
tagttatatccagtctttaaaa

SEQ ID NO: 9356217 - DNA, 22 bp, Homo sapiens
tagttatatccagtctttaaaa

SEQ ID NO: 9356218 - DNA, 22 bp, Homo sapiens
tagttagagatgaattttgtct

SEQ ID NO: 9356219 - DNA, 23 bp, Homo sapiens
tagttacattattgtcagagctg

SEQ ID NO: 9356220 - DNA, 23 bp, Homo sapiens
tagttattttctctgtaatttgc

SEQ ID NO: 9356221 - DNA, 21 bp, Homo sapiens
tagttcaagttctttcagttc

SEQ ID NO: 9356222 - DNA, 22 bp, Homo sapiens
tagttctacagatggtttgtaa

SEQ ID NO: 9356223 - DNA, 22 bp, Homo sapiens
tagttctgtaacatttcaaggg

SEQ ID NO: 9356224 - DNA, 22 bp, Homo sapiens
tagttgaaagggattattgtgg

SEQ ID NO: 9356225 - DNA, 22 bp, Homo sapiens
tagtttaaaagttagggatgat

SEQ ID NO: 9356226 - DNA, 22 bp, Homo sapiens
tagtttaatggtcaactaatga

SEQ ID NO: 9356227 - DNA, 22 bp, Homo sapiens
tagtttaatggtcaactaatga

SEQ ID NO: 9356228 - DNA, 22 bp, Homo sapiens
tagtttactcatctataaaatg

SEQ ID NO: 9356229 - DNA, 22 bp, Homo sapiens
tagtttaatggtcaactaatga

SEQ ID NO: 9356230 - DNA, 22 bp, Homo sapiens
tagtttaccaaattgatcttcc

SEQ ID NO: 9356231 - DNA, 22 bp, Homo sapiens
tagtttaccaaattgatcttcc

SEQ ID NO: 9356232 - DNA, 22 bp, Homo sapiens
tagtttaccaaattgatcttcc

SEQ ID NO: 9356233 - DNA, 22 bp, Homo sapiens
tagtttaccaaattgatcttcc

SEQ ID NO: 9356234 - DNA, 22 bp, Homo sapiens
tagtttactgttcactttgccc

SEQ ID NO: 9356235 - DNA, 22 bp, Homo sapiens
tagttacagagaaatgatttga

SEQ ID NO: 9356236 - DNA, 22 bp, Homo sapiens
tagttacaaaccaacaggcagc

SEQ ID NO: 9356237 - DNA, 22 bp, Homo sapiens
tagttacaaaccaacaggcagc

SEQ ID NO: 9356238 - DNA, 22 bp, Homo sapiens
tagttacaaaccaacaggcagc

SEQ ID NO: 9356239 - DNA, 22 bp, Homo sapiens
tagttacaattatgcatggaaa

SEQ ID NO: 9356240 - DNA, 22 bp, Homo sapiens
tagttacaatgggttctgtgac

SEQ ID NO: 9356241 - DNA, 22 bp, Homo sapiens
tagtggagaggatgtggagaaa

SEQ ID NO: 9356242 - DNA, 22 bp, Homo sapiens
tagtggaggggatgcaaagctt

SEQ ID NO: 9356243 - DNA, 22 bp, Homo sapiens
tagtggagagttgttttgtgca

SEQ ID NO: 9356244 - DNA, 22 bp, Homo sapiens
tagtggaggcctgttgtgtgca

SEQ ID NO: 9356245 - DNA, 22 bp, Homo sapiens
tagtggaggtggtctgtgaact

SEQ ID NO: 9356246 - DNA, 22 bp, Homo sapiens
tagtggagggtgtagctgctgg

SEQ ID NO: 9356247 - DNA, 22 bp, Homo sapiens
tagtggagtagaaaccaaagaa

SEQ ID NO: 9356248 - DNA, 22 bp, Homo sapiens
tagtggaggtggtctgtgaact

SEQ ID NO: 9356249 - DNA, 22 bp, Homo sapiens
tagtgctttggagctttctcct

SEQ ID NO: 9356250 - DNA, 22 bp, Homo sapiens
tagtggagaagtggagtctgtg

SEQ ID NO: 9356251 - DNA, 18 bp, Homo sapiens
tagtggaactgctctggg

SEQ ID NO: 9356252 - DNA, 22 bp, Homo sapiens
tagtgctttaagtttacagaga

SEQ ID NO: 9356253 - DNA, 22 bp, Homo sapiens
tagtgctttaggcctgagtgtc

SEQ ID NO: 9356254 - DNA, 22 bp, Homo sapiens
tagtgctttattgttcctgaaa

SEQ ID NO: 9356255 - DNA, 22 bp, Homo sapiens
tagtgcttgagtctctccgtac

SEQ ID NO: 9356256 - DNA, 22 bp, Homo sapiens
tagtgcttaataaatttcagaa

SEQ ID NO: 9356257 - DNA, 22 bp, Homo sapiens
tagtgcttggccctaccagata

SEQ ID NO: 9356258 - DNA, 22 bp, Homo sapiens
tagtgcttgagtctctccgtac

SEQ ID NO: 9356259 - DNA, 22 bp, Homo sapiens
tagtgctatagaagtgcttgcg

SEQ ID NO: 9356260 - DNA, 22 bp, Homo sapiens
tagtgcttaataaatttcagaa

SEQ ID NO: 9356261 - DNA, 22 bp, Homo sapiens
tagtgcttaacacaaagtgatt

SEQ ID NO: 9356262 - DNA, 22 bp, Homo sapiens
tagtgccattcaagaggtagtt

SEQ ID NO: 9356263 - DNA, 22 bp, Homo sapiens
tagtgccatgcgaggggtggga

SEQ ID NO: 9356264 - DNA, 22 bp, Homo sapiens
tagtgccatcttgagctgcttt

SEQ ID NO: 9356265 - DNA, 22 bp, Homo sapiens
taggggaggccaggaagtttta

SEQ ID NO: 9356266 - DNA, 22 bp, Homo sapiens
taggggaggggatcatgtgctg

SEQ ID NO: 9356267 - DNA, 22 bp, Homo sapiens
taggggaactggcacagggcag

SEQ ID NO: 9356268 - DNA, 22 bp, Homo sapiens
taggggaactggcacagggcag

SEQ ID NO: 9356269 - DNA, 21 bp, Homo sapiens
taggggctggggctccagctg

SEQ ID NO: 9356270 - DNA, 22 bp, Homo sapiens
tagtctctgtggtcctgaggaa

SEQ ID NO: 9356271 - DNA, 22 bp, Homo sapiens
tagtctctgtggtcctgaggaa

SEQ ID NO: 9356272 - DNA, 22 bp, Homo sapiens
tagtctctgttgctgctttcat

SEQ ID NO: 9356273 - DNA, 22 bp, Homo sapiens
tagtctctgttcccacaatgcc

SEQ ID NO: 9356274 - DNA, 22 bp, Homo sapiens
tagtgcaacagggaaagagtgt

SEQ ID NO: 9356275 - DNA, 22 bp, Homo sapiens
tagtgcaaaggccctgagatgg

SEQ ID NO: 9356276 - DNA, 22 bp, Homo sapiens
tagtctctgctttgcccttggc

SEQ ID NO: 9356277 - DNA, 22 bp, Homo sapiens
tagtctctggagactctagggg

SEQ ID NO: 9356278 - DNA, 22 bp, Homo sapiens
tagtctctgctttgcccttggc

SEQ ID NO: 9356279 - DNA, 22 bp, Homo sapiens
tagtgcagaggaggagcctctg

SEQ ID NO: 9356280 - DNA, 22 bp, Homo sapiens
tagtgccaaagcctggtgtcat

SEQ ID NO: 9356281 - DNA, 22 bp, Homo sapiens
tagtgccaccactgtctttggc

SEQ ID NO: 9356282 - DNA, 22 bp, Homo sapiens
tagtgccaccttccaagtatca

SEQ ID NO: 9356283 - DNA, 22 bp, Homo sapiens
tagggcagctgcatcaggcact

SEQ ID NO: 9356284 - DNA, 23 bp, Homo sapiens
tagggcagctgggagggacatgc

SEQ ID NO: 9356285 - DNA, 22 bp, Homo sapiens
tagggcagctgcatcaggcact

SEQ ID NO: 9356286 - DNA, 22 bp, Homo sapiens
tagggcagctgcatcaggcact

SEQ ID NO: 9356287 - DNA, 22 bp, Homo sapiens
tagggcagctgcatcaggcact

SEQ ID NO: 9356288 - DNA, 22 bp, Homo sapiens
tagggcagccttatagctccca

SEQ ID NO: 9356289 - DNA, 23 bp, Homo sapiens
tagggcagctgggagggacatgc

SEQ ID NO: 9356290 - DNA, 23 bp, Homo sapiens
tagggcagctgggagggacatgc

SEQ ID NO: 9356291 - DNA, 23 bp, Homo sapiens
tagggcagctgggagggacatgc

SEQ ID NO: 9356292 - DNA, 22 bp, Homo sapiens
tagggctgaggcaacaagggag

SEQ ID NO: 9356293 - DNA, 22 bp, Homo sapiens
tagggcagattcggtggagttt

SEQ ID NO: 9356294 - DNA, 22 bp, Homo sapiens
tagggcagccacccaggctgct

SEQ ID NO: 9356295 - DNA, 22 bp, Homo sapiens
tagggcagccacccaggctgct

SEQ ID NO: 9356296 - DNA, 22 bp, Homo sapiens
tagggcagccacccaggctgct

SEQ ID NO: 9356297 - DNA, 22 bp, Homo sapiens
tagggcagccacccaggctgct

SEQ ID NO: 9356298 - DNA, 22 bp, Homo sapiens
taggcccagttccgcctcccgg

SEQ ID NO: 9356299 - DNA, 22 bp, Homo sapiens
taggccattgatttttataagt

SEQ ID NO: 9356300 - DNA, 22 bp, Homo sapiens
tagggcagagtccaggatgggc

SEQ ID NO: 9356301 - DNA, 22 bp, Homo sapiens
tagggcagagtccaggatgggc

SEQ ID NO: 9356302 - DNA, 22 bp, Homo sapiens
tagggcagagtccaggatgggc

SEQ ID NO: 9356303 - DNA, 22 bp, Homo sapiens
tagggcagagtccaggatgggc

SEQ ID NO: 9356304 - DNA, 22 bp, Homo sapiens
tagggctgccatttgcttttct

SEQ ID NO: 9356305 - DNA, 22 bp, Homo sapiens
tagggctgccatttgcttttct

SEQ ID NO: 9356306 - DNA, 22 bp, Homo sapiens
tagggctgcctatggctagata

SEQ ID NO: 9356307 - DNA, 22 bp, Homo sapiens
tagggctgcctatggctagata

SEQ ID NO: 9356308 - DNA, 22 bp, Homo sapiens
tagggctgctgcagatgacagg

SEQ ID NO: 9356309 - DNA, 22 bp, Homo sapiens
tagggctgcctatggctagata

SEQ ID NO: 9356310 - DNA, 22 bp, Homo sapiens
tagggctgcagaacaatggcct

SEQ ID NO: 9356311 - DNA, 22 bp, Homo sapiens
tagggctgccatttgcttttct

SEQ ID NO: 9356312 - DNA, 22 bp, Homo sapiens
tagggctgcagaacaatggcct

SEQ ID NO: 9356313 - DNA, 19 bp, Homo sapiens
tagggctggccgggcggtg

SEQ ID NO: 9356314 - DNA, 22 bp, Homo sapiens
tagggctgctttgtattctgct

SEQ ID NO: 9356315 - DNA, 22 bp, Homo sapiens
tagggctgctgcagatgacagg

SEQ ID NO: 9356316 - DNA, 22 bp, Homo sapiens
tagggctggcgtgctcagggaa

SEQ ID NO: 9356317 - DNA, 19 bp, Homo sapiens
tagggctggccgggcggtg

SEQ ID NO: 9356318 - DNA, 22 bp, Homo sapiens
tagggctgtttaaaagtgaggt

SEQ ID NO: 9356319 - DNA, 22 bp, Homo sapiens
tagggctgtttaaaagtgaggt

SEQ ID NO: 9356320 - DNA, 22 bp, Homo sapiens
tagggctgttagtaattctcag

SEQ ID NO: 9356321 - DNA, 22 bp, Homo sapiens
tagggctgtgtctccaggacca

SEQ ID NO: 9356322 - DNA, 22 bp, Homo sapiens
tagggctgtgtctccaggacca

SEQ ID NO: 9356323 - DNA, 22 bp, Homo sapiens
tagggctgggtacactcttgcc

SEQ ID NO: 9356324 - DNA, 22 bp, Homo sapiens
tagggctgtggtcagtcctcta

SEQ ID NO: 9356325 - DNA, 22 bp, Homo sapiens
tagggctgtggtcagtcctcta

SEQ ID NO: 9356326 - DNA, 22 bp, Homo sapiens
tagggctgtgtctccaggacca

SEQ ID NO: 9356327 - DNA, 22 bp, Homo sapiens
tagggctgggtacactcttgcc

SEQ ID NO: 9356328 - DNA, 22 bp, Homo sapiens
tagggctggcgtgctcagggaa

SEQ ID NO: 9356329 - DNA, 16 bp, Homo sapiens
tagggctgggaaggag

SEQ ID NO: 9356330 - DNA, 16 bp, Homo sapiens
tagggctgggaaggag

SEQ ID NO: 9356331 - DNA, 17 bp, Homo sapiens
tagctgtgtttcagcta

SEQ ID NO: 9356332 - DNA, 22 bp, Homo sapiens
tagctgtgtaagcttggtaaga

SEQ ID NO: 9356333 - DNA, 22 bp, Homo sapiens
taggcagaattgtgggctctaa

SEQ ID NO: 9356334 - DNA, 22 bp, Homo sapiens
taggcagaaaggaaggcaagtt

SEQ ID NO: 9356335 - DNA, 20 bp, Homo sapiens
taggcagagctgtgcagcct

SEQ ID NO: 9356336 - DNA, 20 bp, Homo sapiens
taggcagagctgtgcagcct

SEQ ID NO: 9356337 - DNA, 22 bp, Homo sapiens
tagctgggactactggccctgc

SEQ ID NO: 9356338 - DNA, 22 bp, Homo sapiens
tagctggggctttcattcttgc

SEQ ID NO: 9356339 - DNA, 22 bp, Homo sapiens
tagctgggagtgtctgatgggt

SEQ ID NO: 9356340 - DNA, 22 bp, Homo sapiens
tagctgggagtgtctgatgggt

SEQ ID NO: 9356341 - DNA, 22 bp, Homo sapiens
tagctgggagtgtctgatgggt

SEQ ID NO: 9356342 - DNA, 22 bp, Homo sapiens
tagctgggtctctgttttctca

SEQ ID NO: 9356343 - DNA, 22 bp, Homo sapiens
tagctgggttgaggtcatctac

SEQ ID NO: 9356344 - DNA, 22 bp, Homo sapiens
tagctggtctttaagcatgtaa

SEQ ID NO: 9356345 - DNA, 22 bp, Homo sapiens
tagctgtgaaacagcagaagag

SEQ ID NO: 9356346 - DNA, 22 bp, Homo sapiens
tagctgtccagtgagtcccttt

SEQ ID NO: 9356347 - DNA, 22 bp, Homo sapiens
tagctggttctccaggagctag

SEQ ID NO: 9356348 - DNA, 23 bp, Homo sapiens
taggcaggactcagatatgacag

SEQ ID NO: 9356349 - DNA, 23 bp, Homo sapiens
taggcaggactcagatatgacag

SEQ ID NO: 9356350 - DNA, 22 bp, Homo sapiens
taggcagattccatattttggc

SEQ ID NO: 9356351 - DNA, 22 bp, Homo sapiens
taggcagaggtatggtaaggac

SEQ ID NO: 9356352 - DNA, 21 bp, Homo sapiens
taggcagaggagcaggtatct

SEQ ID NO: 9356353 - DNA, 22 bp, Homo sapiens
taggcagagtttaatggttaag

SEQ ID NO: 9356354 - DNA, 22 bp, Homo sapiens
taggcagatgttaacaggaaaa

SEQ ID NO: 9356355 - DNA, 22 bp, Homo sapiens
taggcagatgttaacaggaaaa

SEQ ID NO: 9356356 - DNA, 22 bp, Homo sapiens
taggcaggctgaatgtagattt

SEQ ID NO: 9356357 - DNA, 22 bp, Homo sapiens
taggcaggctgaatgtagattt

SEQ ID NO: 9356358 - DNA, 22 bp, Homo sapiens
taggcaggctgaatgtagattt

SEQ ID NO: 9356359 - DNA, 22 bp, Homo sapiens
taggcaggctgaatgtagattt

SEQ ID NO: 9356360 - DNA, 22 bp, Homo sapiens
taggcaggctgaatgtagattt

SEQ ID NO: 9356361 - DNA, 22 bp, Homo sapiens
taggcaggctgaatgtagattt

SEQ ID NO: 9356362 - DNA, 22 bp, Homo sapiens
taggccagattactagagtagg

SEQ ID NO: 9356363 - DNA, 22 bp, Homo sapiens
taggccagattactagagtagg

SEQ ID NO: 9356364 - DNA, 22 bp, Homo sapiens
taggcagggattagggttgatt

SEQ ID NO: 9356365 - DNA, 22 bp, Homo sapiens
taggccagaggagcagctttgg

SEQ ID NO: 9356366 - DNA, 22 bp, Homo sapiens
taggccagcccttagtcctgtc

SEQ ID NO: 9356367 - DNA, 22 bp, Homo sapiens
taggccaggaatcagcaagctt

SEQ ID NO: 9356368 - DNA, 22 bp, Homo sapiens
taggccaggaatcagcaagctt

SEQ ID NO: 9356369 - DNA, 22 bp, Homo sapiens
taggccagcccttagtcctgtc

SEQ ID NO: 9356370 - DNA, 22 bp, Homo sapiens
taggccagattgttatccatgg

SEQ ID NO: 9356371 - DNA, 22 bp, Homo sapiens
taggccaggacagagcttccag

SEQ ID NO: 9356372 - DNA, 22 bp, Homo sapiens
taggccaggagtcagacagatt

SEQ ID NO: 9356373 - DNA, 22 bp, Homo sapiens
taggccaggagtcagacagatt

SEQ ID NO: 9356374 - DNA, 23 bp, Homo sapiens
taggccagggtgacctggggaga

SEQ ID NO: 9356375 - DNA, 23 bp, Homo sapiens
taggccagggtgacctggggaga

SEQ ID NO: 9356376 - DNA, 22 bp, Homo sapiens
taggccagtaaaatgtttcagt

SEQ ID NO: 9356377 - DNA, 18 bp, Homo sapiens
taggccagtatacttttc

SEQ ID NO: 9356378 - DNA, 22 bp, Homo sapiens
taggccagtaaaatgtttcagt

SEQ ID NO: 9356379 - DNA, 22 bp, Homo sapiens
taggccagtggcaggttgtgtg

SEQ ID NO: 9356380 - DNA, 22 bp, Homo sapiens
taggccagttggtggccctgga

SEQ ID NO: 9356381 - DNA, 22 bp, Homo sapiens
taaagagcgatatgctttaaag

SEQ ID NO: 9356382 - DNA, 22 bp, Homo sapiens
taaagagccattgtatggtttt

SEQ ID NO: 9356383 - DNA, 22 bp, Homo sapiens
taaagagcacgcttttctctct

SEQ ID NO: 9356384 - DNA, 22 bp, Homo sapiens
taaagacatggtgtaggtgaac

SEQ ID NO: 9356385 - DNA, 22 bp, Homo sapiens
taaagcaaaaatgaactgccat

SEQ ID NO: 9356386 - DNA, 22 bp, Homo sapiens
taaagcaaggcaaattgttggt

SEQ ID NO: 9356387 - DNA, 22 bp, Homo sapiens
taaagcaaggcaaattgttggt

SEQ ID NO: 9356388 - DNA, 22 bp, Homo sapiens
taaagcaattactcagtggctt

SEQ ID NO: 9356389 - DNA, 22 bp, Homo sapiens
taaagcaatgaaagttttgcag

SEQ ID NO: 9356390 - DNA, 20 bp, Homo sapiens
taaagcagccgtggagggta

SEQ ID NO: 9356391 - DNA, 22 bp, Homo sapiens
taaagcacatatcttacaataa

SEQ ID NO: 9356392 - DNA, 22 bp, Homo sapiens
taaagcacatatcttacaataa

SEQ ID NO: 9356393 - DNA, 22 bp, Homo sapiens
taaatgataataatgctagtgt

SEQ ID NO: 9356394 - DNA, 22 bp, Homo sapiens
taaatgataataatgctagtgt

SEQ ID NO: 9356395 - DNA, 22 bp, Homo sapiens
taaatgatttatgtatgtgaaa

SEQ ID NO: 9356396 - DNA, 22 bp, Homo sapiens
taaatgatttatgtatgtgaaa

SEQ ID NO: 9356397 - DNA, 18 bp, Homo sapiens
taaatgcatgttaataac

SEQ ID NO: 9356398 - DNA, 22 bp, Homo sapiens
taaagacactggttttaatcat

SEQ ID NO: 9356399 - DNA, 22 bp, Homo sapiens
taaaagtggataagctgtagga

SEQ ID NO: 9356400 - DNA, 20 bp, Homo sapiens
taaagacataagctactatc

SEQ ID NO: 9356401 - DNA, 22 bp, Homo sapiens
taaagacatgcaaagtctaatt

SEQ ID NO: 9356402 - DNA, 22 bp, Homo sapiens
taaaaggcacttggatgctgag

SEQ ID NO: 9356403 - DNA, 22 bp, Homo sapiens
taaaagtaggaatgaaacgcat

SEQ ID NO: 9356404 - DNA, 22 bp, Homo sapiens
taaaagtaggaatgaaacgcat

SEQ ID NO: 9356405 - DNA, 22 bp, Homo sapiens
taaaaggcaatactagatgagt

SEQ ID NO: 9356406 - DNA, 22 bp, Homo sapiens
taaaaggaggttgaagctgtca

SEQ ID NO: 9356407 - DNA, 22 bp, Homo sapiens
taaaaggattagcaggatgggc

SEQ ID NO: 9356408 - DNA, 22 bp, Homo sapiens
taaaaggattagcaggatgggc

SEQ ID NO: 9356409 - DNA, 22 bp, Homo sapiens
taaaacttctcatttttatggt

SEQ ID NO: 9356410 - DNA, 21 bp, Homo sapiens
gttttaagggagaaaacctag

SEQ ID NO: 9356411 - DNA, 22 bp, Homo sapiens
gttttacaaatgacggcattca

SEQ ID NO: 9356412 - DNA, 22 bp, Homo sapiens
taaaactgaatacatactgagg

SEQ ID NO: 9356413 - DNA, 22 bp, Homo sapiens
taaaagagaatggataacagag

SEQ ID NO: 9356414 - DNA, 22 bp, Homo sapiens
taacatgatttgctatttagat

SEQ ID NO: 9356415 - DNA, 22 bp, Homo sapiens
taacatgcagagtttagctttt

SEQ ID NO: 9356416 - DNA, 22 bp, Homo sapiens
taagacaaatactatttcaaga

SEQ ID NO: 9356417 - DNA, 22 bp, Homo sapiens
taagacaagcctcgcatttgta

SEQ ID NO: 9356418 - DNA, 22 bp, Homo sapiens
taagacaattcttcagtcacaa

SEQ ID NO: 9356419 - DNA, 22 bp, Homo sapiens
taagacagggagggctctcagc

SEQ ID NO: 9356420 - DNA, 22 bp, Homo sapiens
taagacttaggtcgagtttggc

SEQ ID NO: 9356421 - DNA, 22 bp, Homo sapiens
taagactagttgaatggttttc

SEQ ID NO: 9356422 - DNA, 22 bp, Homo sapiens
taagacatcctggatgttcaaa

SEQ ID NO: 9356423 - DNA, 22 bp, Homo sapiens
taagacatgagactcagccagt

SEQ ID NO: 9356424 - DNA, 22 bp, Homo sapiens
taagacatcattaaacagcaat

SEQ ID NO: 9356425 - DNA, 22 bp, Homo sapiens
taagagctcccttctccttgca

SEQ ID NO: 9356426 - DNA, 20 bp, Homo sapiens
taagcatagttgtcagggtc

SEQ ID NO: 9356427 - DNA, 22 bp, Homo sapiens
taagcatagtaccgtagcagct

SEQ ID NO: 9356428 - DNA, 22 bp, Homo sapiens
taagcatattccagtcatgtcc

SEQ ID NO: 9356429 - DNA, 21 bp, Homo sapiens
taagcatatcagatagactct

SEQ ID NO: 9356430 - DNA, 22 bp, Homo sapiens
taagagcctgtgctttgagttc

SEQ ID NO: 9356431 - DNA, 22 bp, Homo sapiens
taaatgttatgcccatcatcca

SEQ ID NO: 9356432 - DNA, 18 bp, Homo sapiens
taaatgcatgttaataac

SEQ ID NO: 9356433 - DNA, 22 bp, Homo sapiens
taaatgccattcgtttcataca

SEQ ID NO: 9356434 - DNA, 22 bp, Homo sapiens
taaatgttgtaagtacatctaa

SEQ ID NO: 9356435 - DNA, 22 bp, Homo sapiens
taacagtacatccttttctctt

SEQ ID NO: 9356436 - DNA, 22 bp, Homo sapiens
taacagtatccccatttgcaag

SEQ ID NO: 9356437 - DNA, 22 bp, Homo sapiens
taacagtgtggacttgagatct

SEQ ID NO: 9356438 - DNA, 22 bp, Homo sapiens
gttaaattcgatgatggataaa

SEQ ID NO: 9356439 - DNA, 22 bp, Homo sapiens
gttaaatgcattttccaagcac

SEQ ID NO: 9356440 - DNA, 22 bp, Homo sapiens
gttaaatgcactattgaaagct

SEQ ID NO: 9356441 - DNA, 22 bp, Homo sapiens
gttaaatgcagattctgactca

SEQ ID NO: 9356442 - DNA, 22 bp, Homo sapiens
gttaacattcaattaaacagtc

SEQ ID NO: 9356443 - DNA, 22 bp, Homo sapiens
gttaacataggcttaggggttt

SEQ ID NO: 9356444 - DNA, 22 bp, Homo sapiens
gtgtttacagataaagtgagct

SEQ ID NO: 9356445 - DNA, 19 bp, Homo sapiens
gtgtttactgtgtgcagaa

SEQ ID NO: 9356446 - DNA, 22 bp, Homo sapiens
gtgtttaataggtagctgaatc

SEQ ID NO: 9356447 - DNA, 22 bp, Homo sapiens
gtgtttaatgcagatgtgggtg

SEQ ID NO: 9356448 - DNA, 22 bp, Homo sapiens
gtgtttaataggtagctgaatc

SEQ ID NO: 9356449 - DNA, 22 bp, Homo sapiens
gttaaataacctcatgtccgtt

SEQ ID NO: 9356450 - DNA, 22 bp, Homo sapiens
gtgtttcttgcactccccggac

SEQ ID NO: 9356451 - DNA, 22 bp, Homo sapiens
gtgttcatgccccagtgcagga

SEQ ID NO: 9356452 - DNA, 22 bp, Homo sapiens
gtgttcatcccaatgctgatag

SEQ ID NO: 9356453 - DNA, 23 bp, Homo sapiens
gtgttcatcccagtctgtgcaat

SEQ ID NO: 9356454 - DNA, 22 bp, Homo sapiens
gtgttcatggatgtcaatttga

SEQ ID NO: 9356455 - DNA, 22 bp, Homo sapiens
gtgttcattgtatggaatgggt

SEQ ID NO: 9356456 - DNA, 22 bp, Homo sapiens
gtgttctgcagaccagcatcat

SEQ ID NO: 9356457 - DNA, 22 bp, Homo sapiens
gtgtttaacatctggtttatac

SEQ ID NO: 9356458 - DNA, 23 bp, Homo sapiens
gtgttggcagcagtgctctgggg

SEQ ID NO: 9356459 - DNA, 22 bp, Homo sapiens
gtgttgatgacattttagaaac

SEQ ID NO: 9356460 - DNA, 22 bp, Homo sapiens
gtgttctttatttagtgatgct

SEQ ID NO: 9356461 - DNA, 22 bp, Homo sapiens
gtgctgggattacaggtgtgag

SEQ ID NO: 9356462 - DNA, 22 bp, Homo sapiens
gtgttattagagcattaatttt

SEQ ID NO: 9356463 - DNA, 22 bp, Homo sapiens
gtgctggctggggcatcaggca

SEQ ID NO: 9356464 - DNA, 22 bp, Homo sapiens
gtgctggctggggcatcaggca

SEQ ID NO: 9356465 - DNA, 21 bp, Homo sapiens
gtgctgggacacagccaggct

SEQ ID NO: 9356466 - DNA, 17 bp, Homo sapiens
gtgctggcctggggctc

SEQ ID NO: 9356467 - DNA, 22 bp, Homo sapiens
gtgctggcctcagagggtcatg

SEQ ID NO: 9356468 - DNA, 22 bp, Homo sapiens
gtgctggctggacatggagcac

SEQ ID NO: 9356469 - DNA, 22 bp, Homo sapiens
gtgctggctggacatggagcac

SEQ ID NO: 9356470 - DNA, 22 bp, Homo sapiens
gtgctggctgccaggaggctgc

SEQ ID NO: 9356471 - DNA, 22 bp, Homo sapiens
gttctggaaagcaagaaagagt

SEQ ID NO: 9356472 - DNA, 21 bp, Homo sapiens
gttctggaggctgcaagtcca

SEQ ID NO: 9356473 - DNA, 22 bp, Homo sapiens
gttctggagtggtgccaggcct

SEQ ID NO: 9356474 - DNA, 22 bp, Homo sapiens
gttctggagtggtgccaggcct

SEQ ID NO: 9356475 - DNA, 22 bp, Homo sapiens
gttctggaggagagcctggtgt

SEQ ID NO: 9356476 - DNA, 22 bp, Homo sapiens
gttctggaattgtctgaaatcc

SEQ ID NO: 9356477 - DNA, 21 bp, Homo sapiens
gttctggagcctggaagtcca

SEQ ID NO: 9356478 - DNA, 22 bp, Homo sapiens
gttctggaagcttttgagcaac

SEQ ID NO: 9356479 - DNA, 22 bp, Homo sapiens
gttctggaagcttttgagcaac

SEQ ID NO: 9356480 - DNA, 22 bp, Homo sapiens
gttcttcagtcacatcacagaa

SEQ ID NO: 9356481 - DNA, 22 bp, Homo sapiens
gttcttcagtaaaattaaatgt

SEQ ID NO: 9356482 - DNA, 22 bp, Homo sapiens
gttattggaaagcctggagggc

SEQ ID NO: 9356483 - DNA, 22 bp, Homo sapiens
gttattggcagcatttcagagt

SEQ ID NO: 9356484 - DNA, 20 bp, Homo sapiens
gttattggaaatattgtgtg

SEQ ID NO: 9356485 - DNA, 21 bp, Homo sapiens
gttattggttacactgcactt

SEQ ID NO: 9356486 - DNA, 20 bp, Homo sapiens
gttattggtcatttttgcca

SEQ ID NO: 9356487 - DNA, 22 bp, Homo sapiens
gttattgggtgcctcaggccct

SEQ ID NO: 9356488 - DNA, 22 bp, Homo sapiens
gttatttcagccacagagtgca

SEQ ID NO: 9356489 - DNA, 22 bp, Homo sapiens
gttatttcagccacagagtgca

SEQ ID NO: 9356490 - DNA, 22 bp, Homo sapiens
gttatttataaggtgtaactcc

SEQ ID NO: 9356491 - DNA, 22 bp, Homo sapiens
gttatttataaggtgtaactcc

SEQ ID NO: 9356492 - DNA, 22 bp, Homo sapiens
gttatttaactttgtagcatgg

SEQ ID NO: 9356493 - DNA, 22 bp, Homo sapiens
gttatttaactttgtagcatgg

SEQ ID NO: 9356494 - DNA, 22 bp, Homo sapiens
gttatttaactttgtagcatgg

SEQ ID NO: 9356495 - DNA, 22 bp, Homo sapiens
gttattgtccagcacagttggg

SEQ ID NO: 9356496 - DNA, 22 bp, Homo sapiens
gttattgtccatttatttagca

SEQ ID NO: 9356497 - DNA, 22 bp, Homo sapiens
gttatgaaataaatatagatca

SEQ ID NO: 9356498 - DNA, 22 bp, Homo sapiens
gttatgtatgagggaatgatta

SEQ ID NO: 9356499 - DNA, 22 bp, Homo sapiens
gttatcttctatttctcatact

SEQ ID NO: 9356500 - DNA, 22 bp, Homo sapiens
gttatcttccctttgatgattt

SEQ ID NO: 9356501 - DNA, 22 bp, Homo sapiens
gttatattgccaagtatattgt

SEQ ID NO: 9356502 - DNA, 22 bp, Homo sapiens
gttataaatgactgcaaaagtt

SEQ ID NO: 9356503 - DNA, 22 bp, Homo sapiens
gttataaatacctaataggatt

SEQ ID NO: 9356504 - DNA, 22 bp, Homo sapiens
gttatattcaaaatgaggctgt

SEQ ID NO: 9356505 - DNA, 22 bp, Homo sapiens
gttatataattcctgtggtagt

SEQ ID NO: 9356506 - DNA, 22 bp, Homo sapiens
gttctttaaactgctgctctgt

SEQ ID NO: 9356507 - DNA, 22 bp, Homo sapiens
gttcttggaccagcagcattga

SEQ ID NO: 9356508 - DNA, 22 bp, Homo sapiens
gttcttgccagcatcctcaggt

SEQ ID NO: 9356509 - DNA, 21 bp, Homo sapiens
gttcttgcaggatttccttcc

SEQ ID NO: 9356510 - DNA, 21 bp, Homo sapiens
gttcttgcaggatttccttcc

SEQ ID NO: 9356511 - DNA, 22 bp, Homo sapiens
gttcttttggtagagtgtgcat

SEQ ID NO: 9356512 - DNA, 22 bp, Homo sapiens
gttcttttggtagagtgtgcat

SEQ ID NO: 9356513 - DNA, 22 bp, Homo sapiens
gttgaaaatacagattcctagg

SEQ ID NO: 9356514 - DNA, 19 bp, Homo sapiens
gttcttttcacctctgtgc

SEQ ID NO: 9356515 - DNA, 19 bp, Homo sapiens
gttctttcatagtaagagc

SEQ ID NO: 9356516 - DNA, 23 bp, Homo sapiens
gttgaagtggtcggggaggcaga

SEQ ID NO: 9356517 - DNA, 22 bp, Homo sapiens
gttgaagtttatatgagtgctt

SEQ ID NO: 9356518 - DNA, 22 bp, Homo sapiens
gttgaaatcctaaccccctagt

SEQ ID NO: 9356519 - DNA, 22 bp, Homo sapiens
gttgaaagtagatgctatttgg

SEQ ID NO: 9356520 - DNA, 22 bp, Homo sapiens
gttgaaagatgtcttggttccc

SEQ ID NO: 9356521 - DNA, 22 bp, Homo sapiens
gttgaaatttgtgataatttag

SEQ ID NO: 9356522 - DNA, 22 bp, Homo sapiens
gttgaacatgtgagtctcagga

SEQ ID NO: 9356523 - DNA, 22 bp, Homo sapiens
gttgaaatgagggattaatcag

SEQ ID NO: 9356524 - DNA, 22 bp, Homo sapiens
gttgaaatcctaaccccctagt

SEQ ID NO: 9356525 - DNA, 22 bp, Homo sapiens
gtttattaactgtcaagtgatt

SEQ ID NO: 9356526 - DNA, 22 bp, Homo sapiens
gtttattagagttttctgtctg

SEQ ID NO: 9356527 - DNA, 22 bp, Homo sapiens
gtttattagagttttctgtctg

SEQ ID NO: 9356528 - DNA, 22 bp, Homo sapiens
gtttatctgcactctcttgtag

SEQ ID NO: 9356529 - DNA, 22 bp, Homo sapiens
gtttatcagagagcagaggtgg

SEQ ID NO: 9356530 - DNA, 22 bp, Homo sapiens
gtttcacagatggtgttcatat

SEQ ID NO: 9356531 - DNA, 22 bp, Homo sapiens
gtttcacagggccatggaggaa

SEQ ID NO: 9356532 - DNA, 22 bp, Homo sapiens
gtttcaagagtggctcaaaact

SEQ ID NO: 9356533 - DNA, 22 bp, Homo sapiens
gtttcaagggaactgttttggt

SEQ ID NO: 9356534 - DNA, 22 bp, Homo sapiens
gtttcaagtagctgctgattat

SEQ ID NO: 9356535 - DNA, 22 bp, Homo sapiens
gtttcttttaaaatatgtagac

SEQ ID NO: 9356536 - DNA, 22 bp, Homo sapiens
gtttcttttgtgatcaccaacc

SEQ ID NO: 9356537 - DNA, 22 bp, Homo sapiens
gtttctttctattgactgaaca

SEQ ID NO: 9356538 - DNA, 22 bp, Homo sapiens
gtttgaatgcagtatgcatttt

SEQ ID NO: 9356539 - DNA, 22 bp, Homo sapiens
gtttgaaatgtctgcaagggaa

SEQ ID NO: 9356540 - DNA, 22 bp, Homo sapiens
gtttgaaagaccaattagattt

SEQ ID NO: 9356541 - DNA, 22 bp, Homo sapiens
gtttgaaagaccaattagattt

SEQ ID NO: 9356542 - DNA, 22 bp, Homo sapiens
gtttgaaagtggcaagtccttg

SEQ ID NO: 9356543 - DNA, 22 bp, Homo sapiens
gtttgaaagtggcaagtccttg

SEQ ID NO: 9356544 - DNA, 22 bp, Homo sapiens
gtttgcatatttgcacaggaat

SEQ ID NO: 9356545 - DNA, 22 bp, Homo sapiens
gtttgtgtaacatgatgatgat

SEQ ID NO: 9356546 - DNA, 22 bp, Homo sapiens
gtttgtcccacttctggcagaa

SEQ ID NO: 9356547 - DNA, 22 bp, Homo sapiens
gtttgtcatttgtacttctagc

SEQ ID NO: 9356548 - DNA, 22 bp, Homo sapiens
gtttgtatgaatgttttatgct

SEQ ID NO: 9356549 - DNA, 22 bp, Homo sapiens
gtttgtcaatgacttaggcgtt

SEQ ID NO: 9356550 - DNA, 20 bp, Homo sapiens
gttttaaggcacaggccttt

SEQ ID NO: 9356551 - DNA, 22 bp, Homo sapiens
tacacagtatatgggatcacag

SEQ ID NO: 9356552 - DNA, 22 bp, Homo sapiens
tacacagaacctggtgtacagt

SEQ ID NO: 9356553 - DNA, 22 bp, Homo sapiens
tacacagaacctggtgtacagt

SEQ ID NO: 9356554 - DNA, 22 bp, Homo sapiens
tacacagaacctggtgtacagt

SEQ ID NO: 9356555 - DNA, 22 bp, Homo sapiens
tacacataaaatgctcatggta

SEQ ID NO: 9356556 - DNA, 22 bp, Homo sapiens
tacacagttttgctcccatgat

SEQ ID NO: 9356557 - DNA, 22 bp, Homo sapiens
tacacatacaccaatgtggtca

SEQ ID NO: 9356558 - DNA, 22 bp, Homo sapiens
tacacatacattgcttacaagg

SEQ ID NO: 9356559 - DNA, 22 bp, Homo sapiens
tacacatacattgcttacaagg

SEQ ID NO: 9356560 - DNA, 22 bp, Homo sapiens
tacacatacattgcttacaagg

SEQ ID NO: 9356561 - DNA, 22 bp, Homo sapiens
tacacacatgcatttgccttat

SEQ ID NO: 9356562 - DNA, 22 bp, Homo sapiens
tacacacatgcatttgccttat

SEQ ID NO: 9356563 - DNA, 22 bp, Homo sapiens
tacacacatgcatttgccttat

SEQ ID NO: 9356564 - DNA, 22 bp, Homo sapiens
tacacacagaggccatgggatt

SEQ ID NO: 9356565 - DNA, 22 bp, Homo sapiens
tacacacagaggccatgggatt

SEQ ID NO: 9356566 - DNA, 22 bp, Homo sapiens
tacacacagaggccatgggatt

SEQ ID NO: 9356567 - DNA, 22 bp, Homo sapiens
tacacaattagttgcaaagtga

SEQ ID NO: 9356568 - DNA, 20 bp, Homo sapiens
tacagaatgcaataaaatgg

SEQ ID NO: 9356569 - DNA, 22 bp, Homo sapiens
tacacataggagggtaataaaa

SEQ ID NO: 9356570 - DNA, 22 bp, Homo sapiens
tacacataggagggtaataaaa

SEQ ID NO: 9356571 - DNA, 22 bp, Homo sapiens
tacacatacattgcttacaagg

SEQ ID NO: 9356572 - DNA, 22 bp, Homo sapiens
tacacataggtctgaataaaaa

SEQ ID NO: 9356573 - DNA, 20 bp, Homo sapiens
tacagaatgcaataaaatgg

SEQ ID NO: 9356574 - DNA, 22 bp, Homo sapiens
tacagacaaagagcatgcggta

SEQ ID NO: 9356575 - DNA, 22 bp, Homo sapiens
tacagacagtttttcagatatt

SEQ ID NO: 9356576 - DNA, 22 bp, Homo sapiens
tacagacaaagtgctatagggt

SEQ ID NO: 9356577 - DNA, 22 bp, Homo sapiens
tacagacagacttcccaccctc

SEQ ID NO: 9356578 - DNA, 21 bp, Homo sapiens
tacaagatagaggtaatatat

SEQ ID NO: 9356579 - DNA, 22 bp, Homo sapiens
tacaagatgtactaaaaattat

SEQ ID NO: 9356580 - DNA, 22 bp, Homo sapiens
tacaagaggtatatagaaacag

SEQ ID NO: 9356581 - DNA, 22 bp, Homo sapiens
tacaagagtgagattatcatgt

SEQ ID NO: 9356582 - DNA, 22 bp, Homo sapiens
tacaagaggtatatagaaacag

SEQ ID NO: 9356583 - DNA, 22 bp, Homo sapiens
tacaagctcacaaatttttaag

SEQ ID NO: 9356584 - DNA, 22 bp, Homo sapiens
tacaagctcacaaatttttaag

SEQ ID NO: 9356585 - DNA, 22 bp, Homo sapiens
tacaagattaaaacttatacca

SEQ ID NO: 9356586 - DNA, 22 bp, Homo sapiens
tacacaatctgtttttccattt

SEQ ID NO: 9356587 - DNA, 22 bp, Homo sapiens
tacacaatctgtttttccattt

SEQ ID NO: 9356588 - DNA, 22 bp, Homo sapiens
tacacaatgacttaagatgtca

SEQ ID NO: 9356589 - DNA, 22 bp, Homo sapiens
tacaagaatgtcttaaaagctc

SEQ ID NO: 9356590 - DNA, 22 bp, Homo sapiens
tacaagagaactaatgtaagtc

SEQ ID NO: 9356591 - DNA, 22 bp, Homo sapiens
tacaaccatagacatatactag

SEQ ID NO: 9356592 - DNA, 22 bp, Homo sapiens
tacaaccatagacatatactag

SEQ ID NO: 9356593 - DNA, 22 bp, Homo sapiens
tacaactgcacatctgaatcac

SEQ ID NO: 9356594 - DNA, 22 bp, Homo sapiens
tacaacttccagctttcagccc

SEQ ID NO: 9356595 - DNA, 22 bp, Homo sapiens
tacaagaaactacatgaatgca

SEQ ID NO: 9356596 - DNA, 22 bp, Homo sapiens
tacaagaaatttctgcatatat

SEQ ID NO: 9356597 - DNA, 22 bp, Homo sapiens
tacaagaaatttctgcatatat

SEQ ID NO: 9356598 - DNA, 22 bp, Homo sapiens
tacaacatgtggtcctttatga

SEQ ID NO: 9356599 - DNA, 22 bp, Homo sapiens
taatttcaaatttcttagcgtg

SEQ ID NO: 9356600 - DNA, 22 bp, Homo sapiens
taatttcaagtttagggctcta

SEQ ID NO: 9356601 - DNA, 22 bp, Homo sapiens
taatttatggtatgtgtgtaat

SEQ ID NO: 9356602 - DNA, 21 bp, Homo sapiens
taatttattcagcacagtgtt

SEQ ID NO: 9356603 - DNA, 22 bp, Homo sapiens
taatttatagaatttcttggat

SEQ ID NO: 9356604 - DNA, 22 bp, Homo sapiens
taatttatatggaattgttgct

SEQ ID NO: 9356605 - DNA, 22 bp, Homo sapiens
taatttacttgcaaataacaat

SEQ ID NO: 9356606 - DNA, 22 bp, Homo sapiens
taatttagtccaatgtgaatat

SEQ ID NO: 9356607 - DNA, 22 bp, Homo sapiens
taatttatagaatttcttggat

SEQ ID NO: 9356608 - DNA, 22 bp, Homo sapiens
taatttatatggaattgttgct

SEQ ID NO: 9356609 - DNA, 22 bp, Homo sapiens
taatttatatggaattgttgct

SEQ ID NO: 9356610 - DNA, 22 bp, Homo sapiens
taattgcagggtgtcagaatac

SEQ ID NO: 9356611 - DNA, 22 bp, Homo sapiens
taattgcagaactttgggaggc

SEQ ID NO: 9356612 - DNA, 22 bp, Homo sapiens
taattgcagggagcctgggggc

SEQ ID NO: 9356613 - DNA, 22 bp, Homo sapiens
taattgctgtatagattgtcat

SEQ ID NO: 9356614 - DNA, 22 bp, Homo sapiens
taatttacttgcaaataacaat

SEQ ID NO: 9356615 - DNA, 22 bp, Homo sapiens
taattgctgaactactatccct

SEQ ID NO: 9356616 - DNA, 22 bp, Homo sapiens
taattgctatttaatgtggtga

SEQ ID NO: 9356617 - DNA, 22 bp, Homo sapiens
taattcctagaaattattctca

SEQ ID NO: 9356618 - DNA, 22 bp, Homo sapiens
taattcatgggcccagtgatat

SEQ ID NO: 9356619 - DNA, 22 bp, Homo sapiens
taattctgacaacagtggcgtt

SEQ ID NO: 9356620 - DNA, 22 bp, Homo sapiens
taattcttcaggccttttgtct

SEQ ID NO: 9356621 - DNA, 22 bp, Homo sapiens
taattcttgttcagaggtagta

SEQ ID NO: 9356622 - DNA, 22 bp, Homo sapiens
taattattgtctgaagagttat

SEQ ID NO: 9356623 - DNA, 22 bp, Homo sapiens
taattatttgaagacattagag

SEQ ID NO: 9356624 - DNA, 22 bp, Homo sapiens
taattattatgacaacaattgc

SEQ ID NO: 9356625 - DNA, 22 bp, Homo sapiens
taatcttagcaacctccagtgt

SEQ ID NO: 9356626 - DNA, 18 bp, Homo sapiens
taatcttacagacaggat

SEQ ID NO: 9356627 - DNA, 22 bp, Homo sapiens
taatcttagacatgtatttttc

SEQ ID NO: 9356628 - DNA, 22 bp, Homo sapiens
taatcttagacatgtatttttc

SEQ ID NO: 9356629 - DNA, 19 bp, Homo sapiens
taatcttattgggcagatt

SEQ ID NO: 9356630 - DNA, 22 bp, Homo sapiens
taatctgtgtaccttcatcgga

SEQ ID NO: 9356631 - DNA, 22 bp, Homo sapiens
taatcctgtcttgaccatcagg

SEQ ID NO: 9356632 - DNA, 22 bp, Homo sapiens
taatctctttatgagaagaagg

SEQ ID NO: 9356633 - DNA, 22 bp, Homo sapiens
taatatatttctgctaagctca

SEQ ID NO: 9356634 - DNA, 22 bp, Homo sapiens
taatatatttctgctaagctca

SEQ ID NO: 9356635 - DNA, 22 bp, Homo sapiens
taatatatttctgctaagctca

SEQ ID NO: 9356636 - DNA, 22 bp, Homo sapiens
taatatatttctgctaagctca

SEQ ID NO: 9356637 - DNA, 22 bp, Homo sapiens
taatatctacttcatagagttt

SEQ ID NO: 9356638 - DNA, 22 bp, Homo sapiens
taagcgtcctgtaaatgttagt

SEQ ID NO: 9356639 - DNA, 22 bp, Homo sapiens
taagcctgcatgaaccatgaga

SEQ ID NO: 9356640 - DNA, 22 bp, Homo sapiens
taagcctgcatgaaccatgaga

SEQ ID NO: 9356641 - DNA, 22 bp, Homo sapiens
taagcctgcatgaaccatgaga

SEQ ID NO: 9356642 - DNA, 22 bp, Homo sapiens
taagccactagtctgttatgaa

SEQ ID NO: 9356643 - DNA, 21 bp, Homo sapiens
taagccaccatgtgaaaccag

SEQ ID NO: 9356644 - DNA, 22 bp, Homo sapiens
taagccactgagatttggggtt

SEQ ID NO: 9356645 - DNA, 21 bp, Homo sapiens
taagccaccatgtgaaaccag

SEQ ID NO: 9356646 - DNA, 22 bp, Homo sapiens
taagcattaactctgctgcaag

SEQ ID NO: 9356647 - DNA, 22 bp, Homo sapiens
taaggaaacaacttgtattttt

SEQ ID NO: 9356648 - DNA, 22 bp, Homo sapiens
taaggagagaatttagaggttt

SEQ ID NO: 9356649 - DNA, 22 bp, Homo sapiens
taaggacaatcaggttagtagc

SEQ ID NO: 9356650 - DNA, 22 bp, Homo sapiens
taaggacagcagctacttttcc

SEQ ID NO: 9356651 - DNA, 22 bp, Homo sapiens
taatatacttcccatagtttga

SEQ ID NO: 9356652 - DNA, 22 bp, Homo sapiens
taatatacttcccatagtttga

SEQ ID NO: 9356653 - DNA, 22 bp, Homo sapiens
taatatatacctttgttaggaa

SEQ ID NO: 9356654 - DNA, 21 bp, Homo sapiens
taatataggttcacaactagt

SEQ ID NO: 9356655 - DNA, 22 bp, Homo sapiens
taatatatacctttgttaggaa

SEQ ID NO: 9356656 - DNA, 22 bp, Homo sapiens
taatatatacctttgttaggaa

SEQ ID NO: 9356657 - DNA, 22 bp, Homo sapiens
taatatatacctttgttaggaa

SEQ ID NO: 9356658 - DNA, 22 bp, Homo sapiens
taatatacttcccatagtttga

SEQ ID NO: 9356659 - DNA, 22 bp, Homo sapiens
taatatacttcccatagtttga

SEQ ID NO: 9356660 - DNA, 22 bp, Homo sapiens
taatataccaaactgtaatttt

SEQ ID NO: 9356661 - DNA, 22 bp, Homo sapiens
taatataccaaactgtaatttt

SEQ ID NO: 9356662 - DNA, 19 bp, Homo sapiens
taatatacagacccatctg

SEQ ID NO: 9356663 - DNA, 22 bp, Homo sapiens
tacagtgtttcccccaggatag

SEQ ID NO: 9356664 - DNA, 22 bp, Homo sapiens
tacagtgtttcccccaggatag

SEQ ID NO: 9356665 - DNA, 22 bp, Homo sapiens
tacagtgtgaataagcaggcat

SEQ ID NO: 9356666 - DNA, 22 bp, Homo sapiens
tacagtgtgacatttctacaaa

SEQ ID NO: 9356667 - DNA, 22 bp, Homo sapiens
tacatgaacctttatgtgtgat

SEQ ID NO: 9356668 - DNA, 22 bp, Homo sapiens
tacatgaagatgaatgtatggc

SEQ ID NO: 9356669 - DNA, 22 bp, Homo sapiens
tacatgcaatgaggattctagt

SEQ ID NO: 9356670 - DNA, 22 bp, Homo sapiens
tacatgcaattaagagggtgaa

SEQ ID NO: 9356671 - DNA, 22 bp, Homo sapiens
tacatgcacatgaacatgtgtg

SEQ ID NO: 9356672 - DNA, 22 bp, Homo sapiens
tacatgcatgtcacagaatgaa

SEQ ID NO: 9356673 - DNA, 22 bp, Homo sapiens
taccaagtcatctattcccatg

SEQ ID NO: 9356674 - DNA, 22 bp, Homo sapiens
taccaagtgataataggaaagc

SEQ ID NO: 9356675 - DNA, 22 bp, Homo sapiens
tacatgtatgtgttaatatctg

SEQ ID NO: 9356676 - DNA, 22 bp, Homo sapiens
tacatgtaattttcatagtaag

SEQ ID NO: 9356677 - DNA, 22 bp, Homo sapiens
tacatgtacatgcataggtaga

SEQ ID NO: 9356678 - DNA, 22 bp, Homo sapiens
tacatgtacatgcataggtaga

SEQ ID NO: 9356679 - DNA, 22 bp, Homo sapiens
tacatgtaggtgacattttaat

SEQ ID NO: 9356680 - DNA, 22 bp, Homo sapiens
tacatggatgttatccttactg

SEQ ID NO: 9356681 - DNA, 22 bp, Homo sapiens
tacatgtaagacatgagactct

SEQ ID NO: 9356682 - DNA, 23 bp, Homo sapiens
tacatgctataatttcaccctca

SEQ ID NO: 9356683 - DNA, 22 bp, Homo sapiens
tacagtgtccctttttcagaca

SEQ ID NO: 9356684 - DNA, 22 bp, Homo sapiens
tacagtgtctgcaactgcacac

SEQ ID NO: 9356685 - DNA, 20 bp, Homo sapiens
tacagtgtatgtatttaggc

SEQ ID NO: 9356686 - DNA, 22 bp, Homo sapiens
tacagtgtatgtatttgtaggt

SEQ ID NO: 9356687 - DNA, 22 bp, Homo sapiens
tacagtgcttggtatctagtaa

SEQ ID NO: 9356688 - DNA, 22 bp, Homo sapiens
tacagtggaaaactcagtgtgt

SEQ ID NO: 9356689 - DNA, 22 bp, Homo sapiens
tacagtggggagctcaggagag

SEQ ID NO: 9356690 - DNA, 22 bp, Homo sapiens
tacagtgcatagaggcatgata

SEQ ID NO: 9356691 - DNA, 22 bp, Homo sapiens
tacagtgcttggtatctagtaa

SEQ ID NO: 9356692 - DNA, 22 bp, Homo sapiens
tacagtgagtggcagagccaga

SEQ ID NO: 9356693 - DNA, 22 bp, Homo sapiens
tacagtgcaatgtgatgtagat

SEQ ID NO: 9356694 - DNA, 22 bp, Homo sapiens
tacagtctctttgagtgattgt

SEQ ID NO: 9356695 - DNA, 22 bp, Homo sapiens
tacagtctttggaaagagatag

SEQ ID NO: 9356696 - DNA, 20 bp, Homo sapiens
tacagtcagggcacaggcag

SEQ ID NO: 9356697 - DNA, 22 bp, Homo sapiens
tacagtcaatactaggaccata

SEQ ID NO: 9356698 - DNA, 22 bp, Homo sapiens
tacagtatttgaagaatatgag

SEQ ID NO: 9356699 - DNA, 19 bp, Homo sapiens
tacagtgaaccaggaggag

SEQ ID NO: 9356700 - DNA, 22 bp, Homo sapiens
tacagtgaatgaatggctgtgc

SEQ ID NO: 9356701 - DNA, 22 bp, Homo sapiens
tacagtgaccctatttccaaat

SEQ ID NO: 9356702 - DNA, 22 bp, Homo sapiens
tacagtgacctagaataaatac

SEQ ID NO: 9356703 - DNA, 22 bp, Homo sapiens
tacagtgagtggcagagccaga

SEQ ID NO: 9356704 - DNA, 22 bp, Homo sapiens
tacagtgagactggctcaggga

SEQ ID NO: 9356705 - DNA, 22 bp, Homo sapiens
tacagtgaggtggtttccttta

SEQ ID NO: 9356706 - DNA, 22 bp, Homo sapiens
tacagagtaatttgcatgggga

SEQ ID NO: 9356707 - DNA, 22 bp, Homo sapiens
tacagtagctgaggttctcagg

SEQ ID NO: 9356708 - DNA, 22 bp, Homo sapiens
tacagtagtatcttcatttgtt

SEQ ID NO: 9356709 - DNA, 22 bp, Homo sapiens
tacagtaggattttcagggtct

SEQ ID NO: 9356710 - DNA, 22 bp, Homo sapiens
tacagtatggaaaatgtatagt

SEQ ID NO: 9356711 - DNA, 22 bp, Homo sapiens
tacagtatcttctggcaagcat

SEQ ID NO: 9356712 - DNA, 22 bp, Homo sapiens
tacagagatgtgaaaagctcta

SEQ ID NO: 9356713 - DNA, 20 bp, Homo sapiens
tacagacatgacaataatgg

SEQ ID NO: 9356714 - DNA, 22 bp, Homo sapiens
tacagacagtttttcagatatt

SEQ ID NO: 9356715 - DNA, 22 bp, Homo sapiens
tactagtttctaccttacagaa

SEQ ID NO: 9356716 - DNA, 22 bp, Homo sapiens
tactagttctcatatgaaataa

SEQ ID NO: 9356717 - DNA, 22 bp, Homo sapiens
tactataaagtcttaatgagtc

SEQ ID NO: 9356718 - DNA, 22 bp, Homo sapiens
tactatactctccattttatag

SEQ ID NO: 9356719 - DNA, 23 bp, Homo sapiens
tactataacgctgtgtcagctcc

SEQ ID NO: 9356720 - DNA, 21 bp, Homo sapiens
tactatgtagtgattgcagga

SEQ ID NO: 9356721 - DNA, 22 bp, Homo sapiens
tactatactctccattttatag

SEQ ID NO: 9356722 - DNA, 22 bp, Homo sapiens
tactataccatgtaagatatga

SEQ ID NO: 9356723 - DNA, 22 bp, Homo sapiens
tactacatacagaatttagaga

SEQ ID NO: 9356724 - DNA, 22 bp, Homo sapiens
tactacattaataaaacattca

SEQ ID NO: 9356725 - DNA, 22 bp, Homo sapiens
tactacattaataaaacattca

SEQ ID NO: 9356726 - DNA, 22 bp, Homo sapiens
tactactttcattcatctgact

SEQ ID NO: 9356727 - DNA, 22 bp, Homo sapiens
tactacagtatgtgtgttatac

SEQ ID NO: 9356728 - DNA, 21 bp, Homo sapiens
tactacagtctctttatcagt

SEQ ID NO: 9356729 - DNA, 23 bp, Homo sapiens
tactacagggtcttgctatgaat

SEQ ID NO: 9356730 - DNA, 23 bp, Homo sapiens
tactacagggtcttgctatgaat

SEQ ID NO: 9356731 - DNA, 22 bp, Homo sapiens
tactacaaggccgaagctctca

SEQ ID NO: 9356732 - DNA, 22 bp, Homo sapiens
taccaggaatgttttcaccact

SEQ ID NO: 9356733 - DNA, 22 bp, Homo sapiens
taccaggaattattttacattt

SEQ ID NO: 9356734 - DNA, 22 bp, Homo sapiens
taccaggaattattttacattt

SEQ ID NO: 9356735 - DNA, 22 bp, Homo sapiens
taccaggaatggggtcaccgtc

SEQ ID NO: 9356736 - DNA, 22 bp, Homo sapiens
taccagcaatgctagtcaactc

SEQ ID NO: 9356737 - DNA, 22 bp, Homo sapiens
taccacagacagatttcagtaa

SEQ ID NO: 9356738 - DNA, 22 bp, Homo sapiens
taccatgatcaggctcatcctt

SEQ ID NO: 9356739 - DNA, 22 bp, Homo sapiens
taccagggaacagggatattaa

SEQ ID NO: 9356740 - DNA, 22 bp, Homo sapiens
taccagggaacagggatattaa

SEQ ID NO: 9356741 - DNA, 22 bp, Homo sapiens
taccagggaacagggatattaa

SEQ ID NO: 9356742 - DNA, 22 bp, Homo sapiens
taccatgatgtttgagttacta

SEQ ID NO: 9356743 - DNA, 22 bp, Homo sapiens
taccattgtaccaaggtaattt

SEQ ID NO: 9356744 - DNA, 22 bp, Homo sapiens
tacttacactgaagcaaagata

SEQ ID NO: 9356745 - DNA, 22 bp, Homo sapiens
tacttacataaaaactgaatgt

SEQ ID NO: 9356746 - DNA, 22 bp, Homo sapiens
tacttacagttgatcgatgtat

SEQ ID NO: 9356747 - DNA, 22 bp, Homo sapiens
tacttacatgaattcaagagca

SEQ ID NO: 9356748 - DNA, 22 bp, Homo sapiens
tacttacataaaaactgaatgt

SEQ ID NO: 9356749 - DNA, 22 bp, Homo sapiens
tacttacagagcttataagtta

SEQ ID NO: 9356750 - DNA, 22 bp, Homo sapiens
tacttacagttgatcgatgtat

SEQ ID NO: 9356751 - DNA, 22 bp, Homo sapiens
tacttaaaactgatagaatctc

SEQ ID NO: 9356752 - DNA, 22 bp, Homo sapiens
tacttacacagctgtagaaggt

SEQ ID NO: 9356753 - DNA, 22 bp, Homo sapiens
tactgttttctttatagtacag

SEQ ID NO: 9356754 - DNA, 22 bp, Homo sapiens
tactgtttttaaaattgcatcc

SEQ ID NO: 9356755 - DNA, 22 bp, Homo sapiens
tactctcagggttagtacagga

SEQ ID NO: 9356756 - DNA, 22 bp, Homo sapiens
tactctaacatttgttagatgt

SEQ ID NO: 9356757 - DNA, 22 bp, Homo sapiens
tactccaggactccatttgaaa

SEQ ID NO: 9356758 - DNA, 22 bp, Homo sapiens
tactcctgctgatcctgccagc

SEQ ID NO: 9356759 - DNA, 22 bp, Homo sapiens
tactgaaaaagaatccagacct

SEQ ID NO: 9356760 - DNA, 22 bp, Homo sapiens
tactgaaactcttgtaaatatc

SEQ ID NO: 9356761 - DNA, 22 bp, Homo sapiens
tactgtactgtcttttttgctg

SEQ ID NO: 9356762 - DNA, 22 bp, Homo sapiens
tactgtgtgattccatttacgt

SEQ ID NO: 9356763 - DNA, 22 bp, Homo sapiens
tactgaaacttttcttcaactg

SEQ ID NO: 9356764 - DNA, 22 bp, Homo sapiens
tactgaaagaatacataatttc

SEQ ID NO: 9356765 - DNA, 22 bp, Homo sapiens
tactgtaatgagattagcttcc

SEQ ID NO: 9356766 - DNA, 22 bp, Homo sapiens
tactgtacattccgtttgttgc

SEQ ID NO: 9356767 - DNA, 22 bp, Homo sapiens
tactgtactcaacatgtgagtt

SEQ ID NO: 9356768 - DNA, 22 bp, Homo sapiens
tactgtactgcagttctgcaaa

SEQ ID NO: 9356769 - DNA, 22 bp, Homo sapiens
tcactgcaacctccacctcccg

SEQ ID NO: 9356770 - DNA, 22 bp, Homo sapiens
tcactgcaacctccacctcccg

SEQ ID NO: 9356771 - DNA, 22 bp, Homo sapiens
tcactgcaacctccacctcccg

SEQ ID NO: 9356772 - DNA, 22 bp, Homo sapiens
tcactgcaacctccacctcctg

SEQ ID NO: 9356773 - DNA, 22 bp, Homo sapiens
tcactgcgcttcagcctgggtg

SEQ ID NO: 9356774 - DNA, 22 bp, Homo sapiens
tcactgcgcttcagcctgggtg

SEQ ID NO: 9356775 - DNA, 22 bp, Homo sapiens
tcactgcaacctccacctcctg

SEQ ID NO: 9356776 - DNA, 22 bp, Homo sapiens
tcactgcaacctccacctcctg

SEQ ID NO: 9356777 - DNA, 22 bp, Homo sapiens
tcactgctatattggatactga

SEQ ID NO: 9356778 - DNA, 23 bp, Homo sapiens
tcactgctactcagcctgagatt

SEQ ID NO: 9356779 - DNA, 22 bp, Homo sapiens
tcactgctcagtctgtactaca

SEQ ID NO: 9356780 - DNA, 22 bp, Homo sapiens
tcactgctcagtctgtactaca

SEQ ID NO: 9356781 - DNA, 22 bp, Homo sapiens
tcactgctgctgccatgatgga

SEQ ID NO: 9356782 - DNA, 22 bp, Homo sapiens
tcactgctctccaatgtggagt

SEQ ID NO: 9356783 - DNA, 22 bp, Homo sapiens
tcactgctctctaagcatcgcc

SEQ ID NO: 9356784 - DNA, 22 bp, Homo sapiens
tcactgctctgaaagtacaggg

SEQ ID NO: 9356785 - DNA, 22 bp, Homo sapiens
tcactgcttaactcaagatctc

SEQ ID NO: 9356786 - DNA, 22 bp, Homo sapiens
tcacatttgttcctctgcactt

SEQ ID NO: 9356787 - DNA, 22 bp, Homo sapiens
tcacattttatatctctggttt

SEQ ID NO: 9356788 - DNA, 22 bp, Homo sapiens
tcacatttgtgttttattagag

SEQ ID NO: 9356789 - DNA, 22 bp, Homo sapiens
tcacattttatctattttaagt

SEQ ID NO: 9356790 - DNA, 22 bp, Homo sapiens
tcactgcaacctccacctcccg

SEQ ID NO: 9356791 - DNA, 22 bp, Homo sapiens
tcactgatttgcccttatcctg

SEQ ID NO: 9356792 - DNA, 22 bp, Homo sapiens
tcactgcaacctccacctcccg

SEQ ID NO: 9356793 - DNA, 22 bp, Homo sapiens
tcactgcaacctccacctcccg

SEQ ID NO: 9356794 - DNA, 22 bp, Homo sapiens
tcagaacaattcctttataaca

SEQ ID NO: 9356795 - DNA, 22 bp, Homo sapiens
tcagaacagcacagggtgattt

SEQ ID NO: 9356796 - DNA, 22 bp, Homo sapiens
tcagaacagaagctggctataa

SEQ ID NO: 9356797 - DNA, 22 bp, Homo sapiens
tcagaacagaagctggctataa

SEQ ID NO: 9356798 - DNA, 22 bp, Homo sapiens
tcagaaaggttctatgttttac

SEQ ID NO: 9356799 - DNA, 22 bp, Homo sapiens
tcagaaaggagttagaggtctc

SEQ ID NO: 9356800 - DNA, 22 bp, Homo sapiens
tcagaaaggagttagaggtctc

SEQ ID NO: 9356801 - DNA, 22 bp, Homo sapiens
tcagaaaggccacatggtgcag

SEQ ID NO: 9356802 - DNA, 22 bp, Homo sapiens
tcagaaacagaaactaagaacc

SEQ ID NO: 9356803 - DNA, 22 bp, Homo sapiens
tcagaaaatgaaatggactctc

SEQ ID NO: 9356804 - DNA, 22 bp, Homo sapiens
tcagaaagaacacaggcagtag

SEQ ID NO: 9356805 - DNA, 22 bp, Homo sapiens
tcagaaagcttttacttaaaca

SEQ ID NO: 9356806 - DNA, 22 bp, Homo sapiens
tcagaaagcttagtgtcttgca

SEQ ID NO: 9356807 - DNA, 22 bp, Homo sapiens
tcagaaagctgattcttgatac

SEQ ID NO: 9356808 - DNA, 22 bp, Homo sapiens
tcagaaagacgaaacagatggg

SEQ ID NO: 9356809 - DNA, 22 bp, Homo sapiens
tcagaaagacgaaacagatggg

SEQ ID NO: 9356810 - DNA, 22 bp, Homo sapiens
tcagaaagctatatggtgtgtc

SEQ ID NO: 9356811 - DNA, 22 bp, Homo sapiens
tcagaagccaccttttgttggg

SEQ ID NO: 9356812 - DNA, 22 bp, Homo sapiens
tcagaagccgggcaggttttgg

SEQ ID NO: 9356813 - DNA, 22 bp, Homo sapiens
tcagaagccggaagtgctcctc

SEQ ID NO: 9356814 - DNA, 22 bp, Homo sapiens
tcagaagccggaagtgctcctc

SEQ ID NO: 9356815 - DNA, 22 bp, Homo sapiens
tcagaagccttgattatctaga

SEQ ID NO: 9356816 - DNA, 22 bp, Homo sapiens
tcagaacagcgagaatattcac

SEQ ID NO: 9356817 - DNA, 22 bp, Homo sapiens
tcagaacagcagggtgtggctg

SEQ ID NO: 9356818 - DNA, 22 bp, Homo sapiens
tcagaacagcgagaatattcac

SEQ ID NO: 9356819 - DNA, 22 bp, Homo sapiens
tcagaacaggttgtactatgtc

SEQ ID NO: 9356820 - DNA, 22 bp, Homo sapiens
tcagaacaggttgtactatgtc

SEQ ID NO: 9356821 - DNA, 22 bp, Homo sapiens
tcagaatatgctaatgacattt

SEQ ID NO: 9356822 - DNA, 22 bp, Homo sapiens
tcagaatatattcatgttgtca

SEQ ID NO: 9356823 - DNA, 22 bp, Homo sapiens
tcagaataagttatgaaatgaa

SEQ ID NO: 9356824 - DNA, 23 bp, Homo sapiens
tcagaataataacctagtaactg

SEQ ID NO: 9356825 - DNA, 20 bp, Homo sapiens
tcagaagtttcctggagcat

SEQ ID NO: 9356826 - DNA, 22 bp, Homo sapiens
tcaacaatgggtctgtaatgga

SEQ ID NO: 9356827 - DNA, 22 bp, Homo sapiens
tcaaatgagtgactcacacagg

SEQ ID NO: 9356828 - DNA, 22 bp, Homo sapiens
tcaacaataggatatagcaggt

SEQ ID NO: 9356829 - DNA, 22 bp, Homo sapiens
tcaacacttgctggtttcctct

SEQ ID NO: 9356830 - DNA, 22 bp, Homo sapiens
tcaagaaactgtgctacagagt

SEQ ID NO: 9356831 - DNA, 22 bp, Homo sapiens
tcaagaaactgtgctacagagt

SEQ ID NO: 9356832 - DNA, 22 bp, Homo sapiens
tcaactttagtgtagctattta

SEQ ID NO: 9356833 - DNA, 22 bp, Homo sapiens
tcaactgcaagtttgcttagtt

SEQ ID NO: 9356834 - DNA, 19 bp, Homo sapiens
tcaaccctctttgcctagc

SEQ ID NO: 9356835 - DNA, 22 bp, Homo sapiens
tcaacccttcctccatatttcc

SEQ ID NO: 9356836 - DNA, 22 bp, Homo sapiens
tcaaccctgttttctttgcaat

SEQ ID NO: 9356837 - DNA, 22 bp, Homo sapiens
tcaacccttgtgcaacagtgat

SEQ ID NO: 9356838 - DNA, 21 bp, Homo sapiens
tcaacccttgcgtcaccaagc

SEQ ID NO: 9356839 - DNA, 22 bp, Homo sapiens
tcacagtattcatgaacatgga

SEQ ID NO: 9356840 - DNA, 22 bp, Homo sapiens
tcacagtgagaaatttgttggc

SEQ ID NO: 9356841 - DNA, 22 bp, Homo sapiens
tcacagtgacagccaatgtttt

SEQ ID NO: 9356842 - DNA, 22 bp, Homo sapiens
tcacagtgacttacagagattg

SEQ ID NO: 9356843 - DNA, 22 bp, Homo sapiens
tcacatttatttcaaagttact

SEQ ID NO: 9356844 - DNA, 22 bp, Homo sapiens
tcacattgccattagttcagtt

SEQ ID NO: 9356845 - DNA, 21 bp, Homo sapiens
tcacatgcttattcctggaat

SEQ ID NO: 9356846 - DNA, 22 bp, Homo sapiens
tcacatttcgcatcagtccgat

SEQ ID NO: 9356847 - DNA, 22 bp, Homo sapiens
tcacatttctcagcactgatga

SEQ ID NO: 9356848 - DNA, 22 bp, Homo sapiens
tcacagtgatgacgtgggagca

SEQ ID NO: 9356849 - DNA, 22 bp, Homo sapiens
tcacagtgataactaagtcctg

SEQ ID NO: 9356850 - DNA, 22 bp, Homo sapiens
tcacagtgcacccctcacaggg

SEQ ID NO: 9356851 - DNA, 19 bp, Homo sapiens
tcacagtgcagaaccctcc

SEQ ID NO: 9356852 - DNA, 22 bp, Homo sapiens
tcagcattcctgaagacaagca

SEQ ID NO: 9356853 - DNA, 22 bp, Homo sapiens
tcagcatgttcttaggtcacag

SEQ ID NO: 9356854 - DNA, 22 bp, Homo sapiens
tcagcatgttcttaggtcacag

SEQ ID NO: 9356855 - DNA, 20 bp, Homo sapiens
tcagcatgctcctcagacat

SEQ ID NO: 9356856 - DNA, 22 bp, Homo sapiens
tcagcatgtacttctcctccat

SEQ ID NO: 9356857 - DNA, 22 bp, Homo sapiens
tcagcatctcaaccttctctac

SEQ ID NO: 9356858 - DNA, 22 bp, Homo sapiens
tcagcatttcagaagtggcata

SEQ ID NO: 9356859 - DNA, 22 bp, Homo sapiens
tcagcattgtggcagagaatgg

SEQ ID NO: 9356860 - DNA, 22 bp, Homo sapiens
tcagcattttttgggtgtaact

SEQ ID NO: 9356861 - DNA, 22 bp, Homo sapiens
tcagccagaaagtgattttcag

SEQ ID NO: 9356862 - DNA, 22 bp, Homo sapiens
tcagccagaggcttcttggttt

SEQ ID NO: 9356863 - DNA, 22 bp, Homo sapiens
tcagccagaggtggatgagtca

SEQ ID NO: 9356864 - DNA, 22 bp, Homo sapiens
tcagccagagggggcaaaggaa

SEQ ID NO: 9356865 - DNA, 22 bp, Homo sapiens
tcagccagccagctacaggctt

SEQ ID NO: 9356866 - DNA, 22 bp, Homo sapiens
tcagccagcattacccctgact

SEQ ID NO: 9356867 - DNA, 22 bp, Homo sapiens
tcagccagcatcagctaagtgc

SEQ ID NO: 9356868 - DNA, 22 bp, Homo sapiens
tcagctgccccgggcactgccc

SEQ ID NO: 9356869 - DNA, 22 bp, Homo sapiens
tcagctgccccatgtgttcact

SEQ ID NO: 9356870 - DNA, 22 bp, Homo sapiens
tcagctgccccatgtgttcact

SEQ ID NO: 9356871 - DNA, 22 bp, Homo sapiens
tcagctgccccgggcactgccc

SEQ ID NO: 9356872 - DNA, 22 bp, Homo sapiens
tcagctgctctgttgagctgaa

SEQ ID NO: 9356873 - DNA, 22 bp, Homo sapiens
tcagctgctctgttgagctgaa

SEQ ID NO: 9356874 - DNA, 22 bp, Homo sapiens
tcagctgcgacaggggcctgag

SEQ ID NO: 9356875 - DNA, 22 bp, Homo sapiens
tcagctgctcaaatttatgtca

SEQ ID NO: 9356876 - DNA, 22 bp, Homo sapiens
tcagctgctcaaatttatgtca

SEQ ID NO: 9356877 - DNA, 19 bp, Homo sapiens
tcagctctggggtcagtgg

SEQ ID NO: 9356878 - DNA, 22 bp, Homo sapiens
tcagctctgcactccactgtgg

SEQ ID NO: 9356879 - DNA, 22 bp, Homo sapiens
tcagctctgcctgtggaggcac

SEQ ID NO: 9356880 - DNA, 22 bp, Homo sapiens
tcagccaggccaccttcagctt

SEQ ID NO: 9356881 - DNA, 22 bp, Homo sapiens
tcagccaggcagccccctggtc

SEQ ID NO: 9356882 - DNA, 20 bp, Homo sapiens
tcagccagctaacatgggga

SEQ ID NO: 9356883 - DNA, 22 bp, Homo sapiens
tcagccagctcttggactctga

SEQ ID NO: 9356884 - DNA, 22 bp, Homo sapiens
tcagccaggcacaatggcagct

SEQ ID NO: 9356885 - DNA, 22 bp, Homo sapiens
tcagccagctgtgtgcttctgc

SEQ ID NO: 9356886 - DNA, 22 bp, Homo sapiens
tcagccagctcttggactctga

SEQ ID NO: 9356887 - DNA, 22 bp, Homo sapiens
tcaggagaaaatatcaggaagt

SEQ ID NO: 9356888 - DNA, 22 bp, Homo sapiens
tcaggagaaggcaatgtggaaa

SEQ ID NO: 9356889 - DNA, 22 bp, Homo sapiens
tcaggagaacttccttctaccc

SEQ ID NO: 9356890 - DNA, 22 bp, Homo sapiens
tcaggagacaaagggtgcggag

SEQ ID NO: 9356891 - DNA, 18 bp, Homo sapiens
tcaggagacacagacgca

SEQ ID NO: 9356892 - DNA, 22 bp, Homo sapiens
tcaggagacattcttaaagtag

SEQ ID NO: 9356893 - DNA, 22 bp, Homo sapiens
tcaggagactggcagtgcccac

SEQ ID NO: 9356894 - DNA, 22 bp, Homo sapiens
tcaggagactggcagtgcccac

SEQ ID NO: 9356895 - DNA, 22 bp, Homo sapiens
tcaggacagccagggtgcagac

SEQ ID NO: 9356896 - DNA, 18 bp, Homo sapiens
tcagctggggctgcagcc

SEQ ID NO: 9356897 - DNA, 22 bp, Homo sapiens
tcagctgggtgagtgttctgca

SEQ ID NO: 9356898 - DNA, 18 bp, Homo sapiens
tcagctgggtttctgggt

SEQ ID NO: 9356899 - DNA, 22 bp, Homo sapiens
tcagctggtgaatggactcatc

SEQ ID NO: 9356900 - DNA, 18 bp, Homo sapiens
tcagctgggtttctgggt

SEQ ID NO: 9356901 - DNA, 22 bp, Homo sapiens
tcagctggtgaatggactcatc

SEQ ID NO: 9356902 - DNA, 22 bp, Homo sapiens
tcagctggtgagtggatagaca

SEQ ID NO: 9356903 - DNA, 22 bp, Homo sapiens
tcagctggtgccactcagtcaa

SEQ ID NO: 9356904 - DNA, 22 bp, Homo sapiens
tcagctggtgtttcttctcctt

SEQ ID NO: 9356905 - DNA, 22 bp, Homo sapiens
tcagctggtgtttcttctcctt

SEQ ID NO: 9356906 - DNA, 22 bp, Homo sapiens
tcaggaattttgttctgtatcc

SEQ ID NO: 9356907 - DNA, 22 bp, Homo sapiens
tcaggacaacaagacttgttta

SEQ ID NO: 9356908 - DNA, 22 bp, Homo sapiens
tcaggaagggtggtccacaggg

SEQ ID NO: 9356909 - DNA, 22 bp, Homo sapiens
tcaggaatgaggataaacattg

SEQ ID NO: 9356910 - DNA, 22 bp, Homo sapiens
tcaggaagtataatcagattca

SEQ ID NO: 9356911 - DNA, 22 bp, Homo sapiens
tcaggaagggtggtccacaggg

SEQ ID NO: 9356912 - DNA, 22 bp, Homo sapiens
tcaggaagggctcagtctgtgc

SEQ ID NO: 9356913 - DNA, 22 bp, Homo sapiens
tcagctggggccccctctgtcc

SEQ ID NO: 9356914 - DNA, 22 bp, Homo sapiens
tcagctgggaagttctcgcttg

SEQ ID NO: 9356915 - DNA, 18 bp, Homo sapiens
tcagctggggctgcagcc

SEQ ID NO: 9356916 - DNA, 18 bp, Homo sapiens
tcagctggggctgcagcc

SEQ ID NO: 9356917 - DNA, 22 bp, Homo sapiens
tcagctggcatcggctcaccca

SEQ ID NO: 9356918 - DNA, 22 bp, Homo sapiens
tcagctggcatcggctcaccca

SEQ ID NO: 9356919 - DNA, 22 bp, Homo sapiens
tcagctggcatcggctcaccca

SEQ ID NO: 9356920 - DNA, 22 bp, Homo sapiens
tcagctggcagttcagaggctg

SEQ ID NO: 9356921 - DNA, 22 bp, Homo sapiens
tcagctggcagttcagaggctg

SEQ ID NO: 9356922 - DNA, 22 bp, Homo sapiens
tcagctggcaggttctgggaag

SEQ ID NO: 9356923 - DNA, 22 bp, Homo sapiens
tcagctggcaggttctgggaag

SEQ ID NO: 9356924 - DNA, 22 bp, Homo sapiens
tcagctggagactgctcaatga

SEQ ID NO: 9356925 - DNA, 22 bp, Homo sapiens
tcagctggaagatggtgcagaa

SEQ ID NO: 9356926 - DNA, 23 bp, Homo sapiens
tcagctgcttcctcctgcctgcc

SEQ ID NO: 9356927 - DNA, 23 bp, Homo sapiens
tcagctgcttcctcctgcctgcc

SEQ ID NO: 9356928 - DNA, 22 bp, Homo sapiens
tcagctggatgtggaagtgcta

SEQ ID NO: 9356929 - DNA, 22 bp, Homo sapiens
tcagctggatgtggaagtgcta

SEQ ID NO: 9356930 - DNA, 19 bp, Homo sapiens
tcagctggcaggcctcctc

SEQ ID NO: 9356931 - DNA, 22 bp, Homo sapiens
tcagctggagatccttgttgtg

SEQ ID NO: 9356932 - DNA, 22 bp, Homo sapiens
tcagctggagatgagaaccgaa

SEQ ID NO: 9356933 - DNA, 22 bp, Homo sapiens
tcagcagggcctccttgtgcag

SEQ ID NO: 9356934 - DNA, 22 bp, Homo sapiens
tcagcagggcctccttgtgcag

SEQ ID NO: 9356935 - DNA, 22 bp, Homo sapiens
tcagcagggccatgctctctct

SEQ ID NO: 9356936 - DNA, 22 bp, Homo sapiens
tcagcagggccatgctctctct

SEQ ID NO: 9356937 - DNA, 22 bp, Homo sapiens
tcagcagggccatgctctctct

SEQ ID NO: 9356938 - DNA, 22 bp, Homo sapiens
tcagcagggcatactgagccta

SEQ ID NO: 9356939 - DNA, 22 bp, Homo sapiens
tcagcagggcatactgagccta

SEQ ID NO: 9356940 - DNA, 22 bp, Homo sapiens
tcagcagggaggctctgtgccc

SEQ ID NO: 9356941 - DNA, 22 bp, Homo sapiens
tcagcagggaggctctgtgccc

SEQ ID NO: 9356942 - DNA, 22 bp, Homo sapiens
tcagcagggcatactgagccta

SEQ ID NO: 9356943 - DNA, 22 bp, Homo sapiens
tcagcagggaggctctgtgccc

SEQ ID NO: 9356944 - DNA, 22 bp, Homo sapiens
tcagcaggctgtcagcaggggc

SEQ ID NO: 9356945 - DNA, 22 bp, Homo sapiens
tcagcagggagaggagaatgca

SEQ ID NO: 9356946 - DNA, 22 bp, Homo sapiens
tcagcagggagaggagaatgca

SEQ ID NO: 9356947 - DNA, 22 bp, Homo sapiens
tcagcagggagaggagaatgca

SEQ ID NO: 9356948 - DNA, 22 bp, Homo sapiens
tcagcaggggccgttgggtgga

SEQ ID NO: 9356949 - DNA, 22 bp, Homo sapiens
tcagcagtgtcagttcccagag

SEQ ID NO: 9356950 - DNA, 17 bp, Homo sapiens
tcagcaggggccaagct

SEQ ID NO: 9356951 - DNA, 17 bp, Homo sapiens
tcagcaggggccaagct

SEQ ID NO: 9356952 - DNA, 17 bp, Homo sapiens
tcagcaggggccaagct

SEQ ID NO: 9356953 - DNA, 22 bp, Homo sapiens
tcagcagggctgggagctgtga

SEQ ID NO: 9356954 - DNA, 22 bp, Homo sapiens
tcagcagggctgggagctgtga

SEQ ID NO: 9356955 - DNA, 22 bp, Homo sapiens
tcagcagggcctccttgtgcag

SEQ ID NO: 9356956 - DNA, 22 bp, Homo sapiens
tcagcagggctgtggtgtggct

SEQ ID NO: 9356957 - DNA, 22 bp, Homo sapiens
tcagcagggctgggagctgtga

SEQ ID NO: 9356958 - DNA, 22 bp, Homo sapiens
tcagcagggctgtggtgtggct

SEQ ID NO: 9356959 - DNA, 22 bp, Homo sapiens
tcagatttttgagatgtctgtt

SEQ ID NO: 9356960 - DNA, 22 bp, Homo sapiens
tcagatttttgagatgtctgtt

SEQ ID NO: 9356961 - DNA, 20 bp, Homo sapiens
tcagatttttctaactttga

SEQ ID NO: 9356962 - DNA, 17 bp, Homo sapiens
tcagcaaagacaaagga

SEQ ID NO: 9356963 - DNA, 22 bp, Homo sapiens
tcagcaggcaggaggcatgcca

SEQ ID NO: 9356964 - DNA, 22 bp, Homo sapiens
tcagcaggcaggaggcatgcca

SEQ ID NO: 9356965 - DNA, 22 bp, Homo sapiens
tcagcaggcagaaatctgcaga

SEQ ID NO: 9356966 - DNA, 22 bp, Homo sapiens
tcagcaagaagctgtgggcttc

SEQ ID NO: 9356967 - DNA, 22 bp, Homo sapiens
tcagcaggcccatcctccaggc

SEQ ID NO: 9356968 - DNA, 22 bp, Homo sapiens
tcagcaggcccatcctccaggc

SEQ ID NO: 9356969 - DNA, 22 bp, Homo sapiens
tcagcaggcccatcctccaggc

SEQ ID NO: 9356970 - DNA, 22 bp, Homo sapiens
tcagcaggcagtgggtcacaat

SEQ ID NO: 9356971 - DNA, 22 bp, Homo sapiens
tcagcaggcagtgggtcacaat

SEQ ID NO: 9356972 - DNA, 22 bp, Homo sapiens
tcagcaggcaggaggcatgcca

SEQ ID NO: 9356973 - DNA, 22 bp, Homo sapiens
tcagcaggctctggttgaccat

SEQ ID NO: 9356974 - DNA, 22 bp, Homo sapiens
tcagcaggctctggttgaccat

SEQ ID NO: 9356975 - DNA, 22 bp, Homo sapiens
tcagcaggcggttccttgtggg

SEQ ID NO: 9356976 - DNA, 22 bp, Homo sapiens
tcagcaggcggttccttgtggg

SEQ ID NO: 9356977 - DNA, 22 bp, Homo sapiens
tcagcaggctgtcagcaggggc

SEQ ID NO: 9356978 - DNA, 22 bp, Homo sapiens
tcagcaggctgtcagcaggggc

SEQ ID NO: 9356979 - DNA, 22 bp, Homo sapiens
tcagcaggctgtcagcaggggc

SEQ ID NO: 9356980 - DNA, 22 bp, Homo sapiens
tcagatttgtcctactaggcac

SEQ ID NO: 9356981 - DNA, 22 bp, Homo sapiens
tcagattttattttcctgttac

SEQ ID NO: 9356982 - DNA, 22 bp, Homo sapiens
tcagattttattttcctgttac

SEQ ID NO: 9356983 - DNA, 22 bp, Homo sapiens
tcagatttggacacaggaactt

SEQ ID NO: 9356984 - DNA, 22 bp, Homo sapiens
tcagatttgaatattcctttcg

SEQ ID NO: 9356985 - DNA, 22 bp, Homo sapiens
tcagatttgatgtggttttcta

SEQ ID NO: 9356986 - DNA, 22 bp, Homo sapiens
tcagattttccacagactggaa

SEQ ID NO: 9356987 - DNA, 22 bp, Homo sapiens
tcagattttgcacgaggttttg

SEQ ID NO: 9356988 - DNA, 22 bp, Homo sapiens
tcagattttgcacgaggttttg

SEQ ID NO: 9356989 - DNA, 20 bp, Homo sapiens
tcagattttgggtcactgat

SEQ ID NO: 9356990 - DNA, 20 bp, Homo sapiens
tcagatttttctaactttga

SEQ ID NO: 9356991 - DNA, 22 bp, Homo sapiens
tcagatttatgtggctaggctc

SEQ ID NO: 9356992 - DNA, 22 bp, Homo sapiens
tcagatttcctgttgaagaagt

SEQ ID NO: 9356993 - DNA, 22 bp, Homo sapiens
tcagatttcagctaaagggatg

SEQ ID NO: 9356994 - DNA, 22 bp, Homo sapiens
tcagatttagggtgattacctt

SEQ ID NO: 9356995 - DNA, 22 bp, Homo sapiens
tcagatttatgaatatactatg

SEQ ID NO: 9356996 - DNA, 22 bp, Homo sapiens
tcagatttatgaatatactatg

SEQ ID NO: 9356997 - DNA, 22 bp, Homo sapiens
tcagatttatgaatatactatg

SEQ ID NO: 9356998 - DNA, 22 bp, Homo sapiens
tcagatttctagcgtttggcca

SEQ ID NO: 9356999 - DNA, 22 bp, Homo sapiens
tcagatttcctgttgaagaagt

SEQ ID NO: 9357000 - DNA, 22 bp, Homo sapiens
tcagatttcctgttgaagaagt

SEQ ID NO: 9357001 - DNA, 22 bp, Homo sapiens
tcagatttcttcttgcaacggc

SEQ ID NO: 9357002 - DNA, 22 bp, Homo sapiens
tcagatttccttgcagtttgga

SEQ ID NO: 9357003 - DNA, 22 bp, Homo sapiens
tcagatttctagcgtttggcca

SEQ ID NO: 9357004 - DNA, 18 bp, Homo sapiens
tcagatttaactgtatcc

SEQ ID NO: 9357005 - DNA, 22 bp, Homo sapiens
tcagattctggatagatcttca

SEQ ID NO: 9357006 - DNA, 20 bp, Homo sapiens
tcagattaaatgttctgtct

SEQ ID NO: 9357007 - DNA, 22 bp, Homo sapiens
tcagatttactgcagagcagat

SEQ ID NO: 9357008 - DNA, 22 bp, Homo sapiens
tcagatttactgcagagcagat

SEQ ID NO: 9357009 - DNA, 18 bp, Homo sapiens
tcagatttaactgtatcc

SEQ ID NO: 9357010 - DNA, 22 bp, Homo sapiens
tcagatgctaaagatggaatta

SEQ ID NO: 9357011 - DNA, 22 bp, Homo sapiens
tcagatgctagggctgagctat

SEQ ID NO: 9357012 - DNA, 22 bp, Homo sapiens
tcagacagaggagctcgtgcag

SEQ ID NO: 9357013 - DNA, 22 bp, Homo sapiens
tcagacagagaagtacaatgag

SEQ ID NO: 9357014 - DNA, 22 bp, Homo sapiens
tcagagtgtgacttggtcatga

SEQ ID NO: 9357015 - DNA, 22 bp, Homo sapiens
tcagacagaaggactatttgaa

SEQ ID NO: 9357016 - DNA, 22 bp, Homo sapiens
tcagacagaaagatgagtatgg

SEQ ID NO: 9357017 - DNA, 22 bp, Homo sapiens
tcagacagagaagtacaatgag

SEQ ID NO: 9357018 - DNA, 22 bp, Homo sapiens
tcagacagagaagtacaatgag

SEQ ID NO: 9357019 - DNA, 22 bp, Homo sapiens
tcagaattgtggagaaagggga

SEQ ID NO: 9357020 - DNA, 22 bp, Homo sapiens
tcagaatttaaaatgtgtagat

SEQ ID NO: 9357021 - DNA, 22 bp, Homo sapiens
tcagaattggacaatagaagca

SEQ ID NO: 9357022 - DNA, 22 bp, Homo sapiens
tcagaattggaacgtgaagatt

SEQ ID NO: 9357023 - DNA, 23 bp, Homo sapiens
tcagaattccagtttctttgaag

SEQ ID NO: 9357024 - DNA, 22 bp, Homo sapiens
tcagttaatggattctgtcaga

SEQ ID NO: 9357025 - DNA, 22 bp, Homo sapiens
tcataaagttacccaaatttta

SEQ ID NO: 9357026 - DNA, 22 bp, Homo sapiens
tcataaagttatcaccaaatcc

SEQ ID NO: 9357027 - DNA, 22 bp, Homo sapiens
tcataaatcatactccatttgc

SEQ ID NO: 9357028 - DNA, 22 bp, Homo sapiens
tcataaatatttgtgggggctt

SEQ ID NO: 9357029 - DNA, 22 bp, Homo sapiens
tcagtctcatcaactctattcc

SEQ ID NO: 9357030 - DNA, 22 bp, Homo sapiens
tcagtcctacacgctcagggac

SEQ ID NO: 9357031 - DNA, 22 bp, Homo sapiens
tcagtcccttctccaggtcagc

SEQ ID NO: 9357032 - DNA, 22 bp, Homo sapiens
tcagtatctactatcttgatga

SEQ ID NO: 9357033 - DNA, 22 bp, Homo sapiens
tcagtcctccacacaggcaccc

SEQ ID NO: 9357034 - DNA, 22 bp, Homo sapiens
tcagtcctccacacaggcaccc

SEQ ID NO: 9357035 - DNA, 22 bp, Homo sapiens
tcagtcctccacacaggcaccc

SEQ ID NO: 9357036 - DNA, 22 bp, Homo sapiens
tcagtcctcctctcatagagag

SEQ ID NO: 9357037 - DNA, 22 bp, Homo sapiens
tcagtcctcctctcatagagag

SEQ ID NO: 9357038 - DNA, 18 bp, Homo sapiens
tcagtcctccatagagct

SEQ ID NO: 9357039 - DNA, 18 bp, Homo sapiens
tcagtcctccatagagct

SEQ ID NO: 9357040 - DNA, 22 bp, Homo sapiens
tcagtcctgggccggcatcctc

SEQ ID NO: 9357041 - DNA, 22 bp, Homo sapiens
tcagtcctgatgacaggcccaa

SEQ ID NO: 9357042 - DNA, 22 bp, Homo sapiens
tcatgaaaaattttccatgtca

SEQ ID NO: 9357043 - DNA, 22 bp, Homo sapiens
tcatctttcctcaaaagatcca

SEQ ID NO: 9357044 - DNA, 22 bp, Homo sapiens
tcatctttaccccttgcttcaa

SEQ ID NO: 9357045 - DNA, 22 bp, Homo sapiens
tcatctgtcatccacaaagctg

SEQ ID NO: 9357046 - DNA, 22 bp, Homo sapiens
tcatctgaccccatctattctc

SEQ ID NO: 9357047 - DNA, 22 bp, Homo sapiens
tcatctgaggtttgaggcagtt

SEQ ID NO: 9357048 - DNA, 22 bp, Homo sapiens
tcatctgaggcaccagagcata

SEQ ID NO: 9357049 - DNA, 21 bp, Homo sapiens
tcatctggtctggggcctgct

SEQ ID NO: 9357050 - DNA, 22 bp, Homo sapiens
tcatctgggagcttgttagaaa

SEQ ID NO: 9357051 - DNA, 22 bp, Homo sapiens
tcatcttgctgccattgcttta

SEQ ID NO: 9357052 - DNA, 22 bp, Homo sapiens
tcatcttcctcatttctccagg

SEQ ID NO: 9357053 - DNA, 23 bp, Homo sapiens
tcatcttcctcatttctccaggg

SEQ ID NO: 9357054 - DNA, 23 bp, Homo sapiens
tcatcttcctcatttctccaggg

SEQ ID NO: 9357055 - DNA, 22 bp, Homo sapiens
tcatcttcctcatttctccagg

SEQ ID NO: 9357056 - DNA, 23 bp, Homo sapiens
tcatcttcctcatttctccaggg

SEQ ID NO: 9357057 - DNA, 22 bp, Homo sapiens
tcatacatcttgtatatctatc

SEQ ID NO: 9357058 - DNA, 22 bp, Homo sapiens
tcataaattgggttggctgggt

SEQ ID NO: 9357059 - DNA, 22 bp, Homo sapiens
tcataaattgattatgtgcttt

SEQ ID NO: 9357060 - DNA, 22 bp, Homo sapiens
tcataaattgattatgtgcttt

SEQ ID NO: 9357061 - DNA, 22 bp, Homo sapiens
tcataaattgattatgtgcttt

SEQ ID NO: 9357062 - DNA, 22 bp, Homo sapiens
tcataaattctggtgctgtgag

SEQ ID NO: 9357063 - DNA, 22 bp, Homo sapiens
tcataaattatctatttggcta

SEQ ID NO: 9357064 - DNA, 22 bp, Homo sapiens
tcataaattagctgtctttgaa

SEQ ID NO: 9357065 - DNA, 22 bp, Homo sapiens
tcatctgaccactttatctctc

SEQ ID NO: 9357066 - DNA, 22 bp, Homo sapiens
tcatctgaaattgtatatgtag

SEQ ID NO: 9357067 - DNA, 22 bp, Homo sapiens
tcatagaatgagttaatgaact

SEQ ID NO: 9357068 - DNA, 22 bp, Homo sapiens
tcaggctgttcctgtccaaaat

SEQ ID NO: 9357069 - DNA, 22 bp, Homo sapiens
tcaggctgttagccacctcctc

SEQ ID NO: 9357070 - DNA, 22 bp, Homo sapiens
tcaggctgtatatcttgcactc

SEQ ID NO: 9357071 - DNA, 22 bp, Homo sapiens
tcaggctgtatatcttgcactc

SEQ ID NO: 9357072 - DNA, 22 bp, Homo sapiens
tcaggctgtatatcttgcactc

SEQ ID NO: 9357073 - DNA, 22 bp, Homo sapiens
tcaggcttgggaggcccagggc

SEQ ID NO: 9357074 - DNA, 22 bp, Homo sapiens
tcaggcttgggaggcccagggc

SEQ ID NO: 9357075 - DNA, 22 bp, Homo sapiens
tcaggcttggtgctccagtgcc

SEQ ID NO: 9357076 - DNA, 18 bp, Homo sapiens
tcaggctttgagagaatc

SEQ ID NO: 9357077 - DNA, 22 bp, Homo sapiens
tcaggctttgaagtctagctgg

SEQ ID NO: 9357078 - DNA, 22 bp, Homo sapiens
tcaggcttgtctctagagcaat

SEQ ID NO: 9357079 - DNA, 22 bp, Homo sapiens
tcaggctttccgaagcgcgcgg

SEQ ID NO: 9357080 - DNA, 22 bp, Homo sapiens
tcaggcttgaggtctgtatgtg

SEQ ID NO: 9357081 - DNA, 22 bp, Homo sapiens
tcaggcttgcgatggaagtcac

SEQ ID NO: 9357082 - DNA, 22 bp, Homo sapiens
tcaggcttgcgatggaagtcac

SEQ ID NO: 9357083 - DNA, 22 bp, Homo sapiens
tcaggcttgaggtctgtatgtg

SEQ ID NO: 9357084 - DNA, 22 bp, Homo sapiens
tcaggcttccaggctctgctga

SEQ ID NO: 9357085 - DNA, 22 bp, Homo sapiens
tcaggcttccaggctctgctga

SEQ ID NO: 9357086 - DNA, 22 bp, Homo sapiens
tcaggcttcttctgagcaggga

SEQ ID NO: 9357087 - DNA, 22 bp, Homo sapiens
tcaggctttgggtcaggctctg

SEQ ID NO: 9357088 - DNA, 22 bp, Homo sapiens
tcaggctttgggtcaggctctg

SEQ ID NO: 9357089 - DNA, 22 bp, Homo sapiens
tcaggctttgggaatgccactt

SEQ ID NO: 9357090 - DNA, 18 bp, Homo sapiens
tcaggctttgagagaatc

SEQ ID NO: 9357091 - DNA, 22 bp, Homo sapiens
tcaggcttttcctgcctcctac

SEQ ID NO: 9357092 - DNA, 22 bp, Homo sapiens
tcaggcttttcttccctcagtg

SEQ ID NO: 9357093 - DNA, 22 bp, Homo sapiens
tcaggcttttcctgcctcctac

SEQ ID NO: 9357094 - DNA, 22 bp, Homo sapiens
tcagggcaggacagtgtaggcc

SEQ ID NO: 9357095 - DNA, 22 bp, Homo sapiens
tcagggcaggcgagcagctgct

SEQ ID NO: 9357096 - DNA, 22 bp, Homo sapiens
tcagggcaggacagtgtaggcc

SEQ ID NO: 9357097 - DNA, 21 bp, Homo sapiens
tcagggcagctgctcttcaga

SEQ ID NO: 9357098 - DNA, 22 bp, Homo sapiens
tcagggcaggcgagcagctgct

SEQ ID NO: 9357099 - DNA, 22 bp, Homo sapiens
tcagggcaggcgagcagctgct

SEQ ID NO: 9357100 - DNA, 22 bp, Homo sapiens
tcagggcaggttaacttgggtg

SEQ ID NO: 9357101 - DNA, 21 bp, Homo sapiens
tcagggcagtgggaggttcct

SEQ ID NO: 9357102 - DNA, 19 bp, Homo sapiens
tcagggcagtccggtcccc

SEQ ID NO: 9357103 - DNA, 19 bp, Homo sapiens
tcagggcagtccggtcccc

SEQ ID NO: 9357104 - DNA, 22 bp, Homo sapiens
tcagggcaggttaacttgggtg

SEQ ID NO: 9357105 - DNA, 20 bp, Homo sapiens
tcaggctggtgggctttccc

SEQ ID NO: 9357106 - DNA, 22 bp, Homo sapiens
tcaggctggtccccacagtgga

SEQ ID NO: 9357107 - DNA, 22 bp, Homo sapiens
tcaggctggtccccacagtgga

SEQ ID NO: 9357108 - DNA, 22 bp, Homo sapiens
tcaggctggtccccacagtgga

SEQ ID NO: 9357109 - DNA, 22 bp, Homo sapiens
tcaggctggtccccacagtgga

SEQ ID NO: 9357110 - DNA, 22 bp, Homo sapiens
tcaggctggtggtcagatggct

SEQ ID NO: 9357111 - DNA, 22 bp, Homo sapiens
tcaggctggtggtcagatggct

SEQ ID NO: 9357112 - DNA, 22 bp, Homo sapiens
tcaggctgtagggcccctggag

SEQ ID NO: 9357113 - DNA, 22 bp, Homo sapiens
tcaggctgtagggcccctggag

SEQ ID NO: 9357114 - DNA, 22 bp, Homo sapiens
tcaggctgtaaatggtgtgggt

SEQ ID NO: 9357115 - DNA, 17 bp, Homo sapiens
tcaggctgggtgcagtg

SEQ ID NO: 9357116 - DNA, 21 bp, Homo sapiens
tcaggagagcccatctacaaa

SEQ ID NO: 9357117 - DNA, 21 bp, Homo sapiens
tcaggagagcccatctacaaa

SEQ ID NO: 9357118 - DNA, 21 bp, Homo sapiens
tcaggagagcccatctacaaa

SEQ ID NO: 9357119 - DNA, 17 bp, Homo sapiens
tcaggctgggtgcagtg

SEQ ID NO: 9357120 - DNA, 17 bp, Homo sapiens
tcaggctgggtgcagtg

SEQ ID NO: 9357121 - DNA, 22 bp, Homo sapiens
tcaggagagagaaattggggct

SEQ ID NO: 9357122 - DNA, 22 bp, Homo sapiens
tcaggagagagttgggtaggct

SEQ ID NO: 9357123 - DNA, 22 bp, Homo sapiens
tcaggagacttatgtcacagtg

SEQ ID NO: 9357124 - DNA, 22 bp, Homo sapiens
tcaggagagaaagaatacaatt

SEQ ID NO: 9357125 - DNA, 22 bp, Homo sapiens
tcaggagagaaagaatacaatt

SEQ ID NO: 9357126 - DNA, 22 bp, Homo sapiens
tcagtaaatgaatgaatatatg

SEQ ID NO: 9357127 - DNA, 22 bp, Homo sapiens
tcagtaaatggttgctgttatt

SEQ ID NO: 9357128 - DNA, 22 bp, Homo sapiens
tcagtaaatgagcaaaaatttc

SEQ ID NO: 9357129 - DNA, 22 bp, Homo sapiens
tcagtaaatgagcaaaaatttc

SEQ ID NO: 9357130 - DNA, 22 bp, Homo sapiens
tcagtaaatgcctttctgtgaa

SEQ ID NO: 9357131 - DNA, 22 bp, Homo sapiens
tcagtacaaaggtgctctcaag

SEQ ID NO: 9357132 - DNA, 23 bp, Homo sapiens
tcagtaccacagctgcatgacct

SEQ ID NO: 9357133 - DNA, 22 bp, Homo sapiens
tcagtagcagaaagcaatgagt

SEQ ID NO: 9357134 - DNA, 22 bp, Homo sapiens
tcagtagcagaaagcaatgagt

SEQ ID NO: 9357135 - DNA, 22 bp, Homo sapiens
tcagtatccacaaatgctcaaa

SEQ ID NO: 9357136 - DNA, 22 bp, Homo sapiens
tcagggctgcatacaggagata

SEQ ID NO: 9357137 - DNA, 22 bp, Homo sapiens
tcagggctgcatacaggagata
